United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 97

SEQ ID NO: 189765 - DNA, 9810 bp, Artificial Sequence
  Description of Artificial Sequence: Synthetic coding sequence
atgctgagccggctgagcggcctggccaacgtggtgctgcacgagctgtctggcgacgatgatactgatcagaacatgagggcccccctcgatccagaactgcatcaggagagtgacatggaattcaataacaccacccaggaagatgttcaggaaagactggcctacgctgaacagctagtggttgagttgaaagatataatccggcaaaaggacgtccagttacaacagaaagacgaagcattgcaggaagagaggaaagcagccgacaacaaaattaagaaactaaagctgcacgctaaggcaaaactaacatcactgaataagtacatagaggagatgaaggcgcagggtggtaccgtgctgcccaccgagccacagtcagaagagcagctgagcaaacacgacaagtcctcgaccgaagaagagatggaaattgaaaaaattaaacacaaactgcaagagaaggaggagctgatcagcaccctgcaagcccagcttacacaggctcaagccgagcagcctgctcaatcttcaacagagatggaggagttcgttatgatgaagcagcagttgcaggagaaggaggagttcatatcaacattgcaggcgcagctgtcacaaactcaggctgagcaggccgcacagttgagctctatgcagcaggtagtccgagaaaaggatgctaggttcgaaacacaggtgcggctccacgaagacgaactgctccaactggtgacacaggccgatgtggagacagaaatgcaacagaaactgagagtgctccaacgaaagcttgaagagcacgaggagtcgctggttggcagagcgcaggtcgtggacttgctccagcaggagttgacggcagccgagcagcgcaatcagattctaagtcagcagcttcagcaaatggaggccgagcataacacactcagaaatacagtcgagactgaaagggaagaatccaagatcttattagaaaagatggagcttgaagtagccgaaagaaagctgagtttccataacctgcaggaagagatgcaccatctccttgagcagtttgaacaggccggtcaggcgcaggccgaactcgagtccagatatagtgcgttggagcaaaaacataaagccgaaatggaagagaagactagccacatcttgagtctccagaaaaccggtcaggagttgcagagtgcctgtgatgccttgaaggatcagaattcaaaactgctgcaggataagaacgagcaagccgtgcagagcgcgcagaccatccagcagctggaggatcagcttcaacagaagtccaaggagataagccagtttcttaatagactgcccctgcagcagcacgaaaccgccagtcaaaccagctttccggatgtgtataatgagggcacacaagccgtgactgaggagaacattgcctccctgcaaaagagagtggtggaacttgaaaacgagaaaggagcactcttgctttcttccatcgaattagaggaattaaaggccgagaacgaaaagctcagctcacagatcacactgcttgaggcccaaaaccgaaccggggaggcagacagggaggtttcagagatctccattgtggatatcgccaataagcggtcgtcgagtgccgaagaaagcggtcaggatgtgttggaaaacacatttagccaaaaacacaaggaattatctgtcctgctcctggagatgaaggaagcgcaggaagagattgccttccttaaacttcagctccaaggcaagagggccgaagaggcagaccatgaagtgttggatcagaaagaaatgaagcagatggaaggagagggcattgcccctataaagatgaaggtcttccttgaagataccggccaggactttcctctcatgcctaacgaggagagctctctgcctgccgtcgaaaaggaacaggccagcactgagcaccagtcaaggacatctgaggagatctcattaaatgatgccggcgtcgaattgaagagcaccaagcaagacggcgataagtctctcagcgcagttcctgacataggacagtgccaccaagacgagctggagcgactgaaatcccagatcctggagcttgaactgaactttcataaagctcaggagatttacgagaaaaatcttgatgagaaagccaaagaaattagcaatttgaaccagcttatcgaagagttcaagaaaaacgctgacaacaactcgtccgctttcacagcccttagcgaggaacgggaccagctgttgagtcaagtcaaagagttgagtatggttactgaactgcgtgcacaggtcaaacaactggagatgaacttagctgaagccgaacgccaaagacggctggactacgagagtcaaactgcgcacgataatctccttaccgaacagatccactccctgagcatcgaggctaagtctaaagacgttaaaattgaggtgctgcagaacgaactggacgatgtgcagctccagttcagcgagcaatcgactctcataagatccctccaaagtcaattgcaaaacaaggaatccgaggtgctggaaggagccgagcgagtgcggcacatcagcagtaaagtggaagagctgagccaagcattgagtcagaaagagcttgagatcactaaaatggatcagttgctcctagagaaaaagcgtgatgtggaaacgctgcagcagacgatcgaggaaaaggatcagcaagtgacagaaatttcttttagcatgactgagaagatggtgcaattgaatgaggaaaaatttagtctgggcgtggagatcaagacactcaaggagcagctcaaccttctaagtcgggccgaggaagcaaaaaaagagcaggttgaagaggacaacgaggtttcttctggtcttaaacagaattacgatgagatgtctccggcaggacagatctccaaagaagagctgcagcatgagttcgatctgctaaaaaaggaaaatgaacagaggaaaaggaagttacaagctgcccttatcaaccggaaggaactgctgcaacgggtctccagactggaggaagagctagctaacttaaaggacgaaagcaaaaaggagattcctttgagtgaaactgagaggggcgaggtggaagaggacaaagagaacaaagagtactccgagaaatgtgtgactagcaagtgccaagagatagagatatatctgaaacagaccatttctgaaaaggaagtggagctgcagcatatacggaaggatctggaggagaaactggcggcagaggaacagttccaggcacttgtgaaacaaatgaaccagactctgcaggataaaaccaatcagattgacctcttgcaagccgaaatcagtgaaaatcaagctataattcaaaagttgatcacttctaatacagatgcatctgatggtgactccgtagccctcgtgaaagaaaccgtggtgataagtcctccctgcactggtagttcagagcactggaaacccgagctcgaggagaaaattctcgcgctggaaaaggagaaggaacagctccagaaaaaactgcaagaggctctaaccagccgcaaggctatcttaaaaaaagcacaagaaaaggagaggcatctccgagaagaattgaagcagcaaaaagacgattataaccgtttgcaggagcagtttgacgaacagtcaaaagaaaatgaaaatatcggcgaccagctgagacagctgcaaatccaagtgagggagagcatcgacggcaaactcccaagtaccgatcaacaggagagttgcagttccactcccgggctagaagagcctttgttcaaggccactgaacaacatcatacgcaacccgtgctggagtcaaacctttgccctgattggccttcacactctgaagacgcaagcgccctgcaaggaggaacgtccgtcgcgcaaataaaggcccagctcaaggaaatcgaggccgaaaaagtggaacttgagctgaaggtatcaagcacaacaagcgaactcacaaaaaaatcagaggaggtcttccaactccaggagcagatcaacaaacagggtctggagatcgagagcctgaaaaccgtctcacacgaggccgaggtacacgctgaatcgctacagcagaaactggagtcaagccagctgcagattgcggggctggagcacctcagagaacttcagccaaagctggatgaactgcagaaactaattagcaaaaaggaggaggatgtgtcatacctctccgggcagctctcagaaaaagaagcggccttgaccaaaatccagacggaaatcatagaacaagaggaccttattaaggcccttcatacccagctggaaatgcaggcaaaggaacatgacgagcgcattaaacagctgcaggtggagctttgcgaaatgaaacagaagcctgaggagataggagaggaatcgcgcgctaagcaacagatccagaggaagctgcaggccgcgctgatcagccgaaaggaggccctgaaagagaataagtcattgcaggaggaactctccttggcccgcggtacaatcgagaggctgacaaaaagcctggccgatgtggaatctcaggtgagcgctcaaaataaagagaaagataccgtgctgggccggctggcgttgctgcaggaagagcgcgataaactgatcaccgaaatggatcgatcgttgctggaaaaccagtcactttccagctcttgtgaatcccttaaactcgccctggaaggcctgactgaagacaaagagaagttggtgaaggaaattgaaagtcttaagtcatctaaaatcgcagaatccacagaatggcaggaaaagcataaggaactgcagaaggagtacgaaatactcctgcagagctacgaaaacgtctctaacgaggcggaaaggattcagcacgtcgtggaggccgtgcgccaggagaagcaggaactctacggcaaacttaggagtacggaggcgaataagaaggaaactgagaaacagctccaggaggcagagcaagaaatggaagagatgaaagagaagatgaggaaattcgccaagagcaagcagcagaaaatactcgaacttgaagaggagaacgatcgccttagggccgaagtgcaccctgctggcgacaccgcaaaagaatgcatggaaactctgctctcatccaatgcgtctatgaaagaggagctggaacgcgtaaaaatggagtatgaaactctgtccaagaaatttcagagcctgatgagtgagaaagattccctgagcgaggaagtccaggacttaaagcatcagattgaaggaaatgtgtcaaaacaggccaatctggaagcaaccgaaaagcatgataatcaaactaacgtcacggaggaagggactcagtccatccctggagagaccgaggaacaggactccctcagcatgagtactcggcctacgtgcagtgaatcagtcccatctgctaagtctgctaatcctgctgtttctaaggactttagttcccatgacgaaatcaacaattatctgcagcagatcgatcagttaaaggagagaatagccggcttagaggaagaaaaacagaagaataaagagttttctcagaccttagagaacgagaaaaatactttgctctcgcaaataagtactaaggatggtgagctgaaaatgctgcaggaagaggtcactaaaatgaacctgctgaatcagcagattcaggaagagctttctcgtgtcaccaaactaaaggagactgcagaagaggaaaaggacgatttagaggagcggctgatgaaccagctagctgagctgaatgggagtattggaaattattgccaggatgtaactgatgcacagatcaaaaacgagcttttggaatctgaaatgaaaaacctcaaaaaatgcgtgagtgagctagaggaagaaaaacagcagctagtcaaggagaagactaaggtggagtccgaaatccgtaaggagtatttagagaagattcagggcgcccaaaaggagccgggcaataaatcacatgccaaggaactccaggagctcctgaaggagaagcagcaggaagtgaaacaactccagaaggactgcattcggtatcaggaaaaaataagcgctctggaacgaactgtgaaggcgctggagtttgtccagacggagagccagaaagatctggaaatcaccaaagaaaatctggctcaggccgtagagcaccggaaaaaagcacaggccgaactggcatcatttaaggtgctgttagatgacactcagtccgaagctgccagagttctggcagacaatctcaagctgaaaaaagagctgcagtctaataaggaatcagtcaaatctcaaatgaaacaaaaggacgaagaccttgaaaggcgacttgaacaggcggaagagaaacacttgaaggaaaagaagaatatgcaagaaaagctcgatgccctgagacgggagaaggtgcatcttgaagaaaccataggtgaaattcaagttactctgaataagaaggataaggaagtgcagcagctccaagaaaacctggattcaactgtcactcaactggctgctttcaccaaaagcatgagctccttgcaggacgatcgggatagggtgatcgacgaagccaaaaagtgggagagaaaattttctgatgcgatccagtcaaaagaagaggagatccgacttaaggaggataattgctccgtccttaaggaccagctaagacagatgtccatacacatggaggagctgaaaatcaacatctccaggctggagcatgataaacagatctgggagagcaaagctcaaacagaagtgcagttacagcaaaaggtatgtgacacactccaaggcgagaacaaggaattactgtcgcagttagaggaaacgcgccatttataccatagctctcaaaatgagctggctaagttagagtctgagttaaagtctctcaaggaccagctcaccgacttgtctaatagcctggagaaatgcaaggagcagaaagggaatctcgagggcatcattagacaacaggaggccgacatccagaactccaagttctcctatgagcagctagagaccgatttacaggccagtcgggagctgacttcacggttgcatgaagaaatcaatatgaaggaacagaaaattattagccttctctctggaaaggaggaagccattcaggttgccatagccgagctgcggcagcagcacgataaggagataaaggagctcgagaatctcctgtctcaggaggaggaggaaaatattgttttggaagaagagaacaaaaaggccgtggataaaacaaatcagcttatggaaacccttaagactatcaagaaagagaatatccagcaaaaagcgcagctagactccttcgtcaagagtatgagcagcctgcagaatgaccgggataggatcgtaggggactaccagcagcttgaagagaggcacttgtcgattattctagaaaaagaccagctgatacaggaggcggcagccgagaataataagttaaaggaggaaatcaggggcttgagaagtcacatggacgatctaaatagcgaaaatgctaagctcgacgctgaactgatccagtatagagaagatctgaaccaggtgatcaccatcaaagattctcagcagaagcagctgctcgaggttcagcttcagcaaaacaaggagcttgagaataagtatgcaaagctggaagagaaactcaaggagagtgaagaggcaaacgaagacctccgacggtccttcaacgccctgcaggaagaaaaacaggacttgagtaaagaaatagaaagtctgaaggtatccatatcccagctcacccgacaggtgacagcattgcaggaggaggggacactcggtctctaccatgcccagctgaaggtgaaggaggaggaagtccataggctgtctgctctcttctcttccagccaaaaaaggatcgccgagcttgaagaggaactggtgtgtgtgcagaaggaagctgctaagaaggttggggagatagaagataagctgaaaaaggagctcaagcaccttcaccacgatgcagggattatgcgcaatgagaccgaaaccgcagaagaacgagtcgcagagctggctagggacttggtagagatggagcagaagcttttgatggtgaccaaggaaaacaagggcctgacggcgcagatacaatcttttggtcggagcatgtcgagtttgcagaacagtagggatcacgctaatgaagaactagacgagctgaagcggaaatacgatgccagtctgaaagagttagctcaactcaaagagcaggggctactgaatagggagagagatgcgctgttgtccgagaccgctttcagtatgaattcaacagaagagaactccctctcgcacctggagaagctgaaccagcagctgttgtccaaagacgagcagctcttgcacctttcgtcccagctggaggattcctataaccaggtgcaatcatttagcaaggccatggctagtttgcaaaatgaacgggaccacctgtggaacgagttggagaagttccgaaagtctgaggaaggtaaacagcgatctgcagctcaaccttccacctctcccgcagaggtccagagccttaaaaaggccatgtctagcctgcagaacgatcgagatcgcctgctgaaggagttaaagaatcttcagcaacaatacctacagattaatcaggaaattacagaactccacccactgaaagctcaactacaagagtaccaggacaaaactaaggcatttcagattatgcaggaagagctccgtcaggagaacttgtcctggcagcacgaactgcatcagctacgcatggagaagagctcctgggagatacacgaaagacgcatgaaggagcagtacctgatggctatcagcgacaaagaccagcagctaagccatctgcagaatctgatccgcgagttaaggtcttcctcaagtcagacgcagccccttaaagtgcagtaccagagacaggcctccccagaaacgtccgcttcgccagacggctcacagaacttggtctacgagacagagctgctccgcacccagcttaacgattccctcaaggaaatccatcaaaaagaacttcgaatacagcagctgaacagtaacttttcccagctacttgaggagaagaatactctgtcgatccagctgtgcgatacctcccaaagcttgcgtgaaaaccagcagcattatggtgatctgctcaatcactgtgcagtgcttgagaagcaggtccaggagctccaggccgtgagcaaggagaagggacctcttaatattgacgtggcccctggcgctcctcaggagaaaaacggtgtccacaggaagtcagatcccgaagagctgcgtgaaccccagcagagcttttctgaggcgcagcagcagctatgtaacacccgccaggaggtgaatgaactgagaaagctgctcgaggaggaaagggatcagagggtggctgccgaaaatgccctgtcagtggcggaagagcagatccgccgcctggagcactcagaatgggatagcagcaggaccccaattattgggtcctgcggcactcaggagcaggccttgctgatagaccttaccagtaactcctgccggcggaccagaagcggggtggggtggaaaagagtgctgagaagcctctgccacagccgcactagggtacctctgttggccgccatttacttcttgatgatccacgttctgctgatcctctgctttactgggcatctctag

SEQ ID NO: 189766 - DNA, 741 bp, Artificial Sequence
  Description of Artificial Sequence: Synthetic coding sequence
atgagctgggccgccgtgctggccgtggccgccgcccggttcggccatttttggggatgccgctggcctggccccatggcccagggctgggccggcttttccgaggaagagctccgtagactgaagcaaacaaaggaccctttcgaaccccagaggagacttccggctaagaaatctcgccagcagttacagcgggaaaaggccctggtggaacagtctcagaaattaggccttcaggacggaagcacaagtctcttacccgaacagctgctgtctgccccaaagcaacgtgttaacgtacagaaacccccattctcctcaccaacactccctagtcactttacactgacttcccccgtcggcgacggccagccacagggcatcgagtcacagcctaaggagctggggctggagaattcgcatgatggccataataatgttgaaatcctccctccaaaacccgactgtaaactggagaagaagaaggtggaactgcaggagaagagtaggtgggaagtgcttcagcaggaacagcggttgatggaggagaaaaacaagcgcaaaaaagctctgctggctaaagcaatcgccgagaggtccaagagaactcaggcagagactatgaaactgaagcgcattcagaaggagctgcaagccctggacgatatggtttctgccgacattggaattctgcggaacaggatagaccaggcctcactggattactcatatgctagatag

SEQ ID NO: 189767 - DNA, 1185 bp, Artificial Sequence
  Description of Artificial Sequence: Synthetic coding sequence
atgagctgggccgccgtgctggccgtggccgccgcccggttcggccacttctggggatgtcggtggccaggccctatggctcaggggtgggctggatttagcgaagaagagctgcggcggttgaaacaaactaaggaccctttcgagccacagagacggctcccggctaagaaatctcggcaacaattgcagcgggaaaaggccttggtagagcaatcccaaaagcttggtctgcaggacggcagcacttccctgctgccagaacaactactgtctgcccctaagcagagggtcaacgttcaaaagccccctttttcctctcctacactcccatcgcatttcactctgacaagtccagttggcgacggtcagccacagggcatcgagagccagccaaaggagctgggactggagaactcacatgacggccacaataatgtagagatccttccacccaaaccggattgcaagctggaaaaaaaaaaggtagaactgcaggagaaatcccgctgggaggtgttgcagcaggaacagaggctaatggaggagaagaacaagcgcaagaaggccctcctagctaaagcaatcgccgagaggtcaaaacgaacgcaagccgagaccatgaaactgaagcggatacagaaagaacttcaggctctggacgatatggtcagcgcggatatcggtattctgcgcaatcggattgatcaggcttcactggactactcatatgccaggaagagattcgacagagccgaggcagagtatattgccgccaagctggatattcagagaaagaccgaaattaaggagcagcttactgagcatctgtgtacaattatccagcaaaatgagctgcgcaaggctaagaaactagaagaactgatgcagcaattagatgtggaggccgacgaggagactctcgagcttgaggttgaggtagaacgtctgctgcatgagcaggaggtggaatcaagacggcccgtggtgagactcgagcggccctttcagcccgccgaggagtccgtcaccctggagtttgctaaggaaaatagaaagtgccaagaacaggctgtgagccccaaggttgatgaccagtgcggaaatagtagttccataccgttcttaagtccaaactgtcccaatcaggaaggcaatgatatctctgccgcactggcaacctag

SEQ ID NO: 189768 - DNA, 861 bp, Artificial Sequence
  Description of Artificial Sequence: Synthetic coding sequence
  Description of Combined DNA/RNA Molecule: Synthetic coding sequence
atgcccctggacgccacctggaacatcaccgtgcagtggctggccgttgacatcgcttgtcgtactctcatgtttctcaaactgatggcaacttactctgcagcctttctccctgtggtcatcggtttggaccggcaggcagccgttttgaaccccctggggtccagatccggcgtgaggaaactattgggcgctgcttggggtctctcatttctcttggcgtttccacagctctttttattccatactgtgcacugagctggccctgtgccatttactcaatgcgtcactaaaggctctttcaaggcccagtggcaggagacaacctacaatttgtttaccttctgttgcctgtttctgctccctttaaccgcgatggctatctgctattctagaattgtgttgtcagtctcaagaccccagacccggaagggtagccatgccccagccggggagtttgcactacctcgatcatttgacaattgcccccgggtcaggttacgggcattgaggcttgcattgttaatattgctgacgtttatattgtgctggaccccatactacctactcggaatgtggtattggttctcgccaacgatgctcaccgaagttcctccgagcctcagccatatcctgttcctacttggtctgttgaatgcaccccttgatcctctactgtatggcgcttttaccttagggtgcagacggggtcatcaggaactttccatcgactctagtaaggagggctctggacgaatgctgcaggaggaaattcacgcatttcggcagttggaggtgcaaaagaccgtgactagcagacgggcgggtgagaccaagggcatcagtattacatcgatctag

SEQ ID NO: 189769 - DNA, 879 bp, Artificial Sequence
  Description of Artificial Sequence: Synthetic coding sequence
  Description of Combined DNA/RNA Molecule: Synthetic coding sequence
atgagcgccggcaacggcaccccctgggacgccacctggaacatcacagtgcaatggctggccgtggatattgcatgtagaaccctgatgtttcttaaactgatggcgacatactccgccgccttcctccccgtggtcatcggccttgacaggcaggcagcagtgctgaatccactgggttccaggtccggtgtgagaaagcttctgggagctgcgtgggggctctcgttcctactggcctttccacaactgttcctcttccacaccgttcatugagctggacccgtgcccttcacgcagtgtgttacaaagggttctttcaaggctcagtggcaggagactacttacaatctcttcacattttgctgtttatttctgctgccccttacagctatggcgatatgctactccaggatagtcctatctgtcagccgaccacagacgaggaaaggctcgcacgccccagccggtgaattcgcactgccccgctcattcgacaactgcccaagggtgcgtttacgcgcattgagactcgcactgttgattttgctgacattcatattatgctggactccgtactatctgttgggaatgtggtattggttcagccctaccatgctgacggaagtgccgccgtccctgagccatatcctctttctgcttggcctgcttaatgcccccctggaccctttattgtatggtgcattcacacttggatgtcggcgcggccatcaggagcttagcatcgatagttctaaagaggggagtggccgcatgctccaagaggagatccatgcctttcgccagcttgaagtccagaagaccgtcacaagccgacgggctggcgaaaccaaggggattagcatcacatcgatttag

SEQ ID NO: 189770 - DNA, 363 bp, Artificial Sequence
  Description of Artificial Sequence: Synthetic coding sequence
atggccagcagccggcggggcctgctgctgctgctgctgctgaccgctcatctcggccccagcgaggcccagcattggtctcacgggtggtatccgggtggaaagcgcgcgctgtcaagtgcccaagatcctcagaatgctctcaggccacccggccgggccctggacaccgctgccgggtcccctgtccagacggcccacggcctgccatcagacgccctcgctccactggatgattccatgccgtgggagggtcgcactaccgcccagtggtccctccacagaaaaaggcatctggcccgaaccttgctgacagccgctagggaaccgcgcccagctcctcccagtagtaataaggtctag

SEQ ID NO: 189771 - DNA, 342 bp, Artificial Sequence
  Description of Artificial Sequence: Synthetic coding sequence
atggccagcagccggcggggcctgctgctgctgctgctgctgaccgctcacctaggcccaagcgaagctcagcactggagccatggatggtatcctggaggtaaacgcgccctgagctctgcccaggatccccagaatgcccttagacccccggctggctcacccgtgcagactgctcatgggctgcccagtgacgccttagcccctctagatgactccatgccatgggaggggagaaccacagctcaatggtctctgcataggaaacgccacttggccaggacgctactcactgcagcacgcgagcctcgccccgctcctccctccagtaacaaggtttag

SEQ ID NO: 189772 - DNA, 339 bp, Artificial Sequence
  Description of Artificial Sequence: Synthetic coding sequence
atggccagcagccggcggggcctgctgctgctgctgctgctgaccgcacatctgggccccagtgaagcccaacactggtctcacgggtggtaccccggagggaaacgcgctttgtcctccgctcaggacccacagaatgctctcagacctcctggtagtccggtccaaaccgctcacggtctcccgagcgatgccctcgcaccgctggatgacagtatgccctgggaggggcggaccaccgcacagtggtccctgcaccggaaaagacatctggcccggactctgctgactgctgcccgagagccaaggcccgcccctccatcttctaataaagtgtag

SEQ ID NO: 189773 - DNA, 339 bp, Artificial Sequence
  Description of Artificial Sequence: Synthetic coding sequence
atggccagcagccggcggggcctgctgctgctgctgctgctgaccgcacacctcggtccatctgaggcacagcattggagtcatggctggtatcccggtggcaaacgggcattatctagcgcacaagatccacaaaatgcactacgccctccggggtctccggtgcaaaccgcacacggcctgccgtcagacgcgctggccccgctggacgattccatgccatgggagggtagaaccaccgctcaatggagtctgcatagaaagcgccatttagcgaggactcttctgactgcagcccgcgagccgcggccagcgccaccttcctccaataaagtgtag

SEQ ID NO: 189774 - DNA, 342 bp, Artificial Sequence
  Description of Artificial Sequence: Synthetic coding sequence
atggccagcagccggcggggcctgctgctgctgctgctgctgaccgcacatctggggccctcagaggctcaacattggtctcacggatggtatcctggcggaaaacgcgcactttcctcggcacaagaccctcaaaatgcgctccgcccacccgcgggatctccggtccagactgctcatggcttgcctagcgatgccttggctccattggacgattcaatgccctgggaaggacggacaacagctcaatggagtcttcataggaaaagacacctcgctagaactctactgaccgctgctcgggagccaaggcctgcccctcccagctcaaacaaggtgtag

SEQ ID NO: 189775 - DNA, 945 bp, Artificial Sequence
  Description of Artificial Sequence: Synthetic coding sequence
atgtacaagatggagtacagctacctgaacagcagcgcctacgagtcgtgcatggccggcatggacacatctagtttagcaagcgcgtatgcagacttttccagttgttctcaagcgtctggatttcagtacaatcccatcagaaccacgtttggtgcaacctcaggctgcccctcattgactcccggatcctgctccttgggcaccctgcgggaccatcagtcctctccctatgcagctgtgccctacaaactgtttaccgaccatgggggtctgaatgaaaagcgcaagcaacgtcgaatcaggacaacctttacttctgctcagcttaaggagctggaacgggtgttcgccgagacacattatccagacatctatacaagggaggagctcgccctgaagatagatctgaccgaggccagggttcaggtatggtttcagaatcgccgagccaaatttcgtaaacaagagagggcggccgccgccgcggccgcagccgccaagaatggcagctccgggaaaaagtcggactcatctagagatgatgagtcaaaggaagcaaaatctaccgacccggactcaaccggagggccagggcccaaccctaatccaactcccagttgcggagcaaatggcggaggaggtggtgggccatctcccgcaggagcgcctggagcagcaggccctggaggtcccggaggagagccaggtaaagggggagccgcggctgcggcggctgcagctgctgcggccgccgctgcagccgctgccgccgctgcgggtggcctggcagctgccggtgggcccggacaaggctgggcacctggccccggccccattactagcatcccggattctctcggtggaccctttgccagcgttctttcaagcttacagcgacctaacggggccaaggcagccctggtcaagagcagcatgttttag

SEQ ID NO: 189776 - DNA, 750 bp, Artificial Sequence
  Description of Artificial Sequence: Synthetic coding sequence
atggccaacagcgccagccccgagcagaaccagaaccactgcagcgccatcaacaacagcatccccctgatgcagggtaatcttccaacattgaccctcagtggaaagatcagagtgaccgtcacattctttttgttcctcctgtcagctactttcaatgctagctttctgctcaagctccaaaaatggacacagaaaaaagaaaagggcaagaaactgtcacgaatgaagcttttgctgaaacatttgaccctagccaatttgctggagacactgattgtgatgcctctcgacggcatgtggaatattacggtgcagtggtacgccggcgaattactctgtaaggtactgagttatctaaagcttttctcaatgtatgcccccgcatttatgatggtagtgattagcctcgacagatctcttgccatcacaaggccgctggcgctgaagagtaactcaaaggtggggcagtctatggtcggcttagcatggatcctaagcagtgtgtttgctggcccccaactgccgctgcaccacccttctttccaccacgctgacctgcagtgtaaaaatcaccttcatcctgacaccgggccaagcagtggccccccaaggacgacaactgagtccgtgcaagaacagtataccaagtccacagccgaggactccaagaatgacggatgtatctgccattttatctattgcctgctggactctcttctttgcccgcgtaatttagtgttagtgtag

SEQ ID NO: 189777 - DNA, 2055 bp, Artificial Sequence
  Description of Artificial Sequence: Synthetic coding sequence
atggaggagaacctgatcagcatgcgggaggaccacagcttccacgtgcggtaccgtatggaagctagctgcttagaactggcactcgaaggagagcgcctgtgtaagagtggagattgccgggccggcgtgagcttctttgaggctgccgtacaggtgggcacagaggacctgaaaaccctcagcgctatctatagtcagctgggcaatgcctacttctaccttcatgactacgcaaaagcactggagtatcaccaccatgatttgacattggcgcggaccattggtgatcagctcggcgaagccaaagctagcggaaacctcgggaacactttgaaggtgctggggaactttgacgaggcaatcgtctgctgccaacgtcatctagatatctcacgcgagcttaacgataaagtgggcgaggccagggctttgtacaatcttggtaatgtttatcatgcaaagggtaagagtttcggttgtcctggacctcaagacgtaggcgagtttcccgaagaagttcgggatgccctgcaggctgcagtggatttctacgaggagaacctctctctggtgaccgccttgggagatcgcgcggcccagggacgggcttttggaaatcttgggaatacacattaccttttagggaatttccgagacgccgtgattgctcatgaacagcgcctcctgattgccaaagagttcggggataaagcagcggagagacgagcatactcaaatctgggaaacgcatacatattcctcggcgagtttgagaccgcatctgaatactataagaagacattattactggctcgccagcttaaggatagggcggtcgaagctcagagctgctattctctaggtaatacttacacacttcttcaggattatgagaaggccattgattatcacctcaaacacctggccatcgcgcaggagctcaatgatcggataggcgagggcagggcttgttggtctttgggcaatgcatataccgctttgggcaaccacgatcaagcaatgcattttgctgagaagcatctggagattagcagggaggtgggggacaagagcggcgagcttactgcccgactcaatctgagcgacctccagatggtgctgggactaagctacagcacaaacaacagtatcatgtcagagaacaccgagatagactcgtccctgaacggagtccggcctaagcttggtcgacgtcattcaatggagaatatggagctgatgaagctaacaccagagaaggttcagaattggaattcagaaatactggctaagcagaagccgctaattgccaagccatcagcgaagctgctgtttgtgaacaggctgaaaggaaagaagtacaaaacaaactcttctactaaagtgctacaggacgcctctaattctatagatcaccgcattccaaactcccagaggaagataagcgccgatacaatcggcgatgagggctttttcgatcttctgagccggtttcagtcaaataggatggatgaccagcggtgctgcctgcaggaaaaaaattgccacacagcttcaacaactacctcgtctacaccacccaaaatgatgctcaagacttcttcagttccagtggtgagccctaatacggatgagttcctagatctgttggcctcatcacagagcagacggctcgacgaccagagggcttcattttctaacctgcccggccttaggcttactcagaattcccagtccgtgctgtcccacctgatgaccaacgacaataaggaagcggacgaagatttcttcgacatactcgtgaaatgccagggtagtaggctcgatgatcagcgctgcgcccctcctcccgccacaacgaaaggacccactgtcccagacgaagattttttcagcctgatactgcgctcacagggtaagaggatggatgagcagagagtcttactccagagggaccaaaatcgggacactgacttcggtcttaaggattttctccagaataacgccctgctggagtttaaaaactccggcaagaagtccgctgaccattag

SEQ ID NO: 189778 - DNA, 2055 bp, Artificial Sequence
  Description of Artificial Sequence: Synthetic coding sequence
atggaggagaacctgatcagcatgcgggaggaccacagcttccacgtccgctacagaatggaggcaagctgtcttgagctcgcgctggaaggagagagactttgtaagtccggtgactgtagggccggggtctccttcttcgaggccgctgtccaggttggtaccgaggaccttaaaaccttaagcgctatttattcccaactggggaatgcctatttctacttacacgactacgccaaagctttggagtaccaccatcacgacctgaccctagccagaaccatcggggaccaacttggggaggccaaggcatctggtaacctcggtaatacccttaaggtgctcgggaactttgacgaagctatcgtgtgctgtcaaagacatctggacattagccgggagctcaatgataaggtgggggaagccagagctctctataatttgggaaacgtgtaccatgccaagggcaaatcttttggctgccctggccctcaggacgtcggcgagtttcctgaagaagtgcgcgatgctctccaagccgccgtggacttctacgaggagaatctttctctggttaccgcacttggcgatagagcagcccagggccgcgcattcggcaatcttggaaacactcattatttactgggaaattttagagacgccgtaatagctcacgaacagcgtctactcattgccaaagagtttggtgataaggccgcggaacgaagggcttactctaatctgggtaacgcatacatattcttgggcgaattcgaaaccgccagtgagtattataagaaaactctcctcctggccaggcaactaaaagatagggcggttgaggctcagtcctgctactcccttggcaatacgtacaccctcctacaggattacgagaaagccattgattaccacctgaagcacctggctattgcgcaggagctaaacgacagaataggcgagggccgcgcttgctggagcctgggaaacgcctacacagcattggggaatcatgaccaagcgatgcacttcgctgaaaaacatctcgagatttctcgagaggtgggtgataaaagtggcgagctgaccgctagactcaatctgagcgacctgcagatggtgcttggacttagctactcaacaaacaatagcattatgtctgaaaacacagagatcgacagcagcctcaatggagttcgacctaaactgggaaggcggcactcgatggagaacatggagctcatgaaactgacccctgagaaagtgcaaaactggaactctgagatcctggcgaaacaaaaacctttgattgctaaaccaagcgctaagctgctgttcgtgaaccgcctgaaaggtaaaaagtacaagacaaacagtagtaccaaggtgttgcaggatgcaagcaattccattgaccaccgaatacctaactctcagagaaaaattagcgccgacacaattggggatgagggtttctttgacttgttgtcaaggttccagtctaacaggatggatgaccagcgatgctgcctccaggagaaaaactgccataccgccagtaccacaactagcagtactccgcccaaaatgatgctgaagacaagctccgtgccagtagtttcacccaacacggacgagtttttggatttattagcgtcgtcccagtctcgcagattggatgaccagcgcgcctcattcagcaatttaccagggctccgactgacacaaaacagtcagtccgtgctaagtcacctcatgacgaacgataacaaggaagcagacgaagatttcttcgatatactggtgaagtgccaaggatcccggctcgatgatcagcgatgtgcccctcctcccgctaccacgaaaggacctaccgtgccggacgaggacttcttcagcctcatcctgcggtcacagggaaagaggatggatgaacagcgggtcctgctccaaagagatcagaaccgggacacagacttcgggctgaaagactttttgcagaataacgccctgctggagttcaagaattcggggaagaagagcgctgatcattag

SEQ ID NO: 189779 - DNA, 228 bp, Artificial Sequence
  Description of Artificial Sequence: Synthetic coding sequence
atggaggagaacctgatcagcatgcgggaggaccacagcttccacgtcaggtatcgcatggaagcctcatgccttgagctggcactcgaaggggaacgcctctgcaagagcggcgattgcagagccggcgtatcattctttgaggccgcggtgcaggtgggaaccgaggatctgaagaccctgtcagctatctactcacaactgggaaatgcgtacttctacctctag

SEQ ID NO: 189780 - DNA, 642 bp, Artificial Sequence
  Description of Artificial Sequence: Synthetic coding sequence
atggaggagaacctgatcagcatgcgggaggaccacagcttccacgtaagatatcggatggaggcttcctgtttggagctggcgttggagggggagaggttgtgtaaaagtggcgactgccgggcaggcgtgtcttttttcgaggccgccgtgcaagttggcaccgaggaccttaaaaccctttcagccatatactctcagctgggtaatgcttacttttatctgcatgactacgctaaagccctggagtaccatcatcacgatttgacccttgccagaacaattggagaccagttaggggaagcgaaggcaagtggcaacctcgggaataccctcaaagtgttggggaattttgatgaagccattgtctgttgtcagaggcacctggatatctcgagagaacttaacgataaggttggggaagcgcgagctctatacaaccttggcaacgtgtatcacgccaaagggaaatcctttggctgccccgggccgcaagacgtcggggaatttcccgaggaagtgagagatgcgctacaggctgcagtggacttttatgaggagaacttgtcattagtcacagcgcttggagatagagctgcccaggggagagctttcgggaacctgggaaacacacactattag

SEQ ID NO: 189781 - DNA, 159 bp, Artificial Sequence
  Description of Artificial Sequence: Synthetic coding sequence
atggaggagaacctgatcagcatgcgggaggaccacagcttccacgtccggtacaggatggaagcctcatgtctggagttagctcttgagggcgagcgattgtgcaaatccggagactgccgggccggcgtctccttttttgaggcggccgtccaatag

SEQ ID NO: 189782 - DNA, 1290 bp, Artificial Sequence
  Description of Artificial Sequence: Synthetic coding sequence
atggccagcctgtgggagagcccccagcagtgcatcatcctgagcccactgtccggatggtggttcagtataggaatctccatcctcacgtcttccgccctagtcctcaagcctcagatgctgaaaggcgagttgcagactaggccttcgcaacgtccgtcccgcaaggcgtttagacgtaacaattttgagtacactctggaggcgtccaagtctcttcgtcaaaagcctggggattctactatgacgtacctgaataaaggacaattttatccaatcactctcaaggaagtgtccagcagcgaaggaattcaccacccaatcagcaaagtaaggagtgtgatcatggtggtgtttgcggaggacaaaagccgtgaagaccagcttagacattggaaatactggcactcccggcaacataccgcaaaacagagatgtattgacattgccgactacaaagagagtttcaacaccatctcaaacattgaggaaatagcctacaacgctatctccttcacttgggacatcaacgacgaagcgaaggtattcatatccgtcaattgcttatccactgatttcagttcccagaagggtgttaaggggctccccttgaatatccaagtcgatacctatagctacaataaccggtccaataaacccgtacatcgagcctactgtcagattaaggtcttttgcgataaaggcgcagaacggaaaatcagggacgaagagcgcaaacagtccaagagaaaagtgagtgacgtcaaggttcctctcctccctagccacaaacggatggatattaccgtcttcaaaccttttatcgacctcgacacccagccagtgctctttatccccgatgtgcattttgccaatcttcagcgcggtactcacgtcctccccatcgctagcgaggagttggagggcgaaggtagcgtactgaaaagaggaccttatggcacagaggatgattttgccgtgccaccttccaccaaactggcacgcatcgaagagccgaagagggtgttgctctatgttagaaaggagagtgaggaggtgttcgacgctttgatgttaaaaaccccatcactgaagggccttatggaagctattagtgataaatacgatgtgccacatgataagatcggaaagatcttcaagaaatgtaagaaaggaattctggtaaacatggatgataacatcgtgaaacactacagcaacgaagacacgttccagcttcagattgaggaggcgggcggcagctacaagttgacactcaccgaaatatag

SEQ ID NO: 189783 - DNA, 1857 bp, Artificial Sequence
  Description of Artificial Sequence: Synthetic coding sequence
atgacccaggagtacgacaacaagcggcccgtgctggtgctgcagaatgaagctctgtacccccagcgacgtagctacacaagtgaagatgaagcatggaaaagtttcctggagaatccgctcaccgctgcaaccaaagccatgatgagcatcaatggcgatgaagatagcgccgctgccttgggccttctgtacgactactataaagtgccgagggagcgtcgctcttctacggccaagccagaggtagagcaccctgaaccggaccacagcaaaagaaactccatcccaatagttaccgagcagcccctaatttcggctggagagaatcgggtacaagtcctgaaaaacgttccctttaacatcgtacttccccatgggaaccagctcgggatagacaaacgcggtcacctgacagctccagatacgaccgtaaccgtgtccatagccacaatgcccacacactcaatcaagaccgagactcagcctcacgggttcgctgtcggtatcccaccagccgtctatcacccagaacccaccgagagggtggtcgtgttcgataggaatctcaatactgatcagttttccagcggcgcccaagcaccaaacgcacagcgacggaccccagatagcacattctcagaaacattcaaggagggagttcaggaagtgttctttcctagcgacttgtcgttgagaatgccaggtatgaatagtgaggactatgtgttcgatagcgtttcaggtaacaatttcgaatatacccttgaggcctccaaatcgctccgtcagaaacccggggattccacgatgacctacttgaataaagggcagttctaccccatcaccctgaaagaggtgtcctcttcagagggaattcaccatccaatcagcaaagtccgcagcgttatcatggtcgtgttcgccgaggataaaagcagagaagatcaactgcgtcactggaaatactggcacagtaggcagcataccgccaagcagagatgcatagatatagccgactacaaggagtcttttaacaccattagtaacattgaagagatcgcttataatgcaatcagcttcacatgggatattaacgacgaggccaaggtcttcatctctgtgaactgtctgagtacggatttttcctctcagaaaggggtgaaagggctaccactaaacatccaggtagatacgtatagctacaataatcgctccaacaagcccgtgcaccgtgcttattgccagatcaaggtcttttgtgacaagggagctgaacgtaagatcagggacgaagagcggaagcagtccaagagaaaagtgtcagatgttaaagtgccacttctcccatctcacaagagaatggacatcacagtgtttaaaccttttattgatttggacacgcagcccgtgctatttatacctgatgttcacttcgccaacctgcagaggggaacccacgtccttccgattgcaagtgaagagctggagggtgaaggatccgtccttaagcgcggaccctatggaaccgaggacgatttcgctgtgcctccttcaacaaaattggcccggattgaagaacccaagcgcgtgcttctgtatgttagaaaggagagtgaagaggtttttgacgcccttatgctgaaaacccccagtctaaaaggactaatggaggctatctcagacaagtatgatgtgcctcacgacaagattggtaagatatttaaaaagtgcaagaagggtatcctagtgaacatggatgataacattgtgaagcactactccaatgaagacaccttccagctgcagattgaggaagccggaggttcatacaagttgacccttacggagatctag

SEQ ID NO: 189784 - DNA, 1857 bp, Artificial Sequence
  Description of Artificial Sequence: Synthetic coding sequence
ctgcccaaggaggtggagaacaagcggcccgtgctggtgctgcagaacgaagcactgtacccccagcggcgaagctacacatccgaggacgaagcctggaaatcctttcttgagaatccactcaccgcagctacaaaagcgatgatgagcatcaacggtgacgaggattccgccgctgcgttgggtctgctgtatgattattacaaagttccccgcgagaggcgttcttcgaccgccaaaccggaagtcgagcatcccgagccagaccactctaagcgcaactccatcccgatcgtaacagagcaacctctgatttccgctggggagaatcgcgtgcaggtgctcaaaaacgtgcccttcaatatagtgttgccacacgggaaccagctgggcatcgacaagagagggcaccttactgcgcctgacacgaccgttaccgtgagcattgcaacaatgcccacacacagcatcaaaacagagacccagcctcacggattcgctgtggggatcccccctgccgtctaccaccccgagccaaccgaacgagtggttgtctttgaccgcaatctgaacacggatcagttttctagcggagctcaagccccgaatgcacagcgccgaaccccagatagcacattctcagaaacgttcaaggaaggcgtgcaagaggttttctttccttcagatctatccttaaggatgccgggtatgaattccgaggactatgtcttcgacagcgtgagtggcaacaactttgaatacacattggaagcttcgaaaagcctgcgccagaaaccaggggactctacaatgacttacctgaacaaaggtcagttttatcctatcacccttaaggaagtctctagcagtgaaggcattcaccatcctatctccaaagttcgctccgtgattatggtggttttcgccgaggataagtcacgggaggatcagctgaggcactggaaatactggcatagtaggcagcataccgccaaacagaggtgcatcgatattgccgattataaggagagcttcaacacaatttccaacatagaagagatcgcttacaatgcgatcagctttacttgggatattaatgatgaagcgaaggtgtttatctccgtcaactgtctgagtacggacttcagtagtcagaagggagtcaaaggattacctctgaacatccaagtagatacctattcctataacaacagatctaataaaccagtgcaccgcgcatattgtcaaataaaggtgttctgcgataagggagccgaaaggaagatcagggatgaggaacggaaacagtctaagaggaaggtgtctgacgtcaaagttcccctgttgccatctcacaagcggatggatataaccgtctttaaaccatttatcgacctggacacccagcccgtcctgtttattcctgacgtgcactttgctaaccttcagaggggaacccacgtgctcccaatcgcaagtgaggagctggaaggcgaagggtccgtacttaagcgcgggccttatggaacagaagatgatttcgctgtgccgccaagcaccaaattggcaaggatcgaggaaccaaagagggtgctactgtacgtgcgaaaagagtctgaagaggtgtttgacgcgttgatgctgaagacaccgtcactgaaaggcctgatggaagccatctctgacaagtatgacgtcccgcacgataagattggtaaaattttcaagaagtgtaagaaagggatcctggttaatatggacgacaatatagtgaagcactactcgaacgaagatactttccagcttcagatcgaagaggccggcggctcctacaaactgactctgacagaaatatag

SEQ ID NO: 189785 - DNA, 1878 bp, Artificial Sequence
  Description of Artificial Sequence: Synthetic coding sequence
atgagccaggagagcgacaacaacaagcggctggtggccctggtgccaatgcctagcgacccgccgttcaatactcgcagagcctatacctcagaggatgaggcgtggaagtcatatttagagaaccccctcacagcagcaactaaagctatgatgagtattaacggggacgaggactcggctgcagcgttggggctgctgtacgattattataaggtccccagggacaaacggctcctctctgtgagcaaggcttccgattctcaggaagatcaggagaaaagaaattgccttggaacctccgaagcgcagtccaatctttccggtggagagaatagggtgcaagtgctgaaaactgtccctgtcaatctttcactcaatcaggaccatctagaaaatagcaaacgcgaacagtacagtatctcattccctgaaagctccgcaattatccccgtgtccgggataaccgttgtgaaggcggaggactttacccctgttttcatggctccgccagttcactacccgagaggggacggcgaggagcaacgcgttgttatctttgagcagacccagtatgacgtgccatccctggccacgcacagcgcatatctgaaagatgatcagcggagtacccccgattctacctacagcgagagctttaaagatgccgcaacagaaaaattccggagcgcatctgtgggcgctgaggagtacatgtacgatcagacatccagcggaaccttccaatatacactggaggctacaaaatcactgagacagaagcaaggagagggccccatgacctatctcaacaaaggacagttctacgccatcacattatcggagacaggcgacaacaagtgcttccgacatcccataagcaaggtgcggtcagtcgtgatggtggtgttcagcgaggacaagaaccgggacgaacagctgaaatactggaaatactggcactctagacaacacaccgccaagcagcgagtgctcgatatcgccgactacaaagagtccttcaataccatagggaacatcgaagagattgcctacaatgctgtctctttcacctgggatgtgaatgaagaagctaagatctttatcacagtgaactgcttaagcacagacttctcatctcagaaaggagtcaaagggctgcccctcatgattcagattgacacatacagttacaataaccgtagtaataagccgattcaccgcgcatactgtcagattaaagttttctgtgacaaaggcgcagaaagaaagatcagggacgaagagagaaaacagaatagaaaaaaggggaagggccaggcctcccaaacacaatgcaacagctcaagtgatgggaaactcgctgcaattcctctccagaagaagtccgatatcacatactttaagaccatgccagatctccatagtcagccagttctgtttattcctgatgtccactttgccaatttacagcgcaccggccaggtgtactacaatactgacgacgagcgagagggcggcagcgtcctggtaaagcgcatgtttagaccaatggaagaggagttcggtccggtcccatctaagcagatgaaggaagagggaacgaagcgcgtcctattgtacgttcgaaaggagactgatgatgtttttgatgctttgatgcttaagtctcccacagtcaagggtctgatggaagctattagtgaaaagtacggcctccctgtggagaagatcgcaaaactgtacaaaaagtccaagaaagggatcttggtgaacatggatgataatattatagagcattactctaatgaggacacattcatccttaacatggagtccatggtggaggggttcaaggtaacactcatggaaatctag

SEQ ID NO: 189786 - DNA, 1830 bp, Artificial Sequence
  Description of Artificial Sequence: Synthetic coding sequence
atgcccagcgacccccccttcaacacccggcgggcctacaccagcgaagacgaagcgtggaagtcatatttggagaaccccctaaccgctgctaccaaagcaatgatgagcattaatggggacgaagactctgccgctgcactgggcttactctatgattattacaaagtgccacgggataagcgcctgctttcggtctccaaggccagtgactctcaggaagatcaggaaaagcggaactgcctcggcacaagtgaggcacagagcaatctgtcaggcggagagaaccgagttcaggtcctgaagaccgtgcctgtcaacctcagtctgaatcaggaccacttagagaattccaaaagagagcagtactctatctcttttcccgagagctctgcaatcattcctgtgtctggtataactgtcgtcaaggctgaggactttacgcccgtatttatggccccgcctgtccactacccaagaggggatggtgaagaacagcgcgtggtgatattcgaacaaacacagtacgatgtgccctccttggcaactcatagcgcttacttgaaggatgaccaacgaagcacccccgatagcacttactctgagagtttcaaggatgctgccactgaaaaattccggtccgcgtctgtgggcgccgaagaatatatgtatgaccagacctctagcggtaccttccagtataccttagaggccacgaagtctctgagacagaagcagggcgagggccccatgacatatttgaacaaaggacagttctacgcgataaccctgtccgaaacgggcgacaacaaatgtttccgccaccccattagcaaggttcgatcagtcgtaatggtcgttttcagcgaggataaaaacagagatgagcagttgaaatactggaaatactggcacagtcgccagcacaccgccaaacagcgcgtgctcgatattgctgattacaaggagtctttcaacacaatcggaaatattgaggagatcgcctataatgcggtctccttcacgtgggatgtgaacgaagaagcgaaaatcttcattaccgtcaactgcctgtctacagacttttccagccagaaaggtgtgaaaggcttgcctttaatgattcagattgatacctactcatacaataatagatctaacaaacctatccaccgagcatactgccagatcaaagtgttctgcgataagggcgcagagcgcaagatcagggacgaagagcgaaagcagaatcgcaaaaagggaaagggtcaggccagccaaacacaatgcaactcctcctccgacggcaaattggcagccatacctcttcagaagaaatccgacattacttatttcaaaacaatgcctgacctacactcgcaaccagtgcttttcatccctgatgtccacttcgcgaatctgcaacgtacagggcaggtgtactacaacaccgacgacgaaagggaaggaggcagcgtgcttgttaagagaatgtttcgaccaatggaagaggaatttggtcctgtgccatccaaacagatgaaagaggagggaacaaaacgcgtgctcctttacgtcaggaaggaaacagacgacgtgttcgatgctctgatgcttaagtcccccactgtcaaaggacttatggaggccattagcgagaaatacggactgccagtggagaagattgccaagctgtacaagaagtcaaagaagggtatccttgtgaatatggatgacaatattattgaacactattcgaatgaagacaccttcattcttaatatggagagcatggtggaggggtttaaggtgactctcatggagatctag

SEQ ID NO: 189787 - DNA, 1878 bp, Artificial Sequence
  Description of Artificial Sequence: Synthetic coding sequence
atgggcaaggacggccggagcaacaagcggctggtggccctggtgcccatgccctcggacccaccgttcaacacccgacgggcatatacgtctgaggatgaggcttggaagagctacctggagaatccactgacagcagcaacaaaagccatgatgtccataaatggtgacgaagactcggctgctgcacttggcctgctgtatgattactataaggtacccagagataaaaggctgcttagcgtgagcaaggcctcagactcacaagaggaccaagaaaagaggaactgcctcggaacgagtgaagcccagtctaatctgtctgggggggagaacagagttcaggttctgaagacagtgccagttaacctttcccttaaccaagatcatctggaaaatagcaagcgggagcagtactcaattagcttccctgaatcctctgcaataattcccgtgagcggtataactgtggtaaaggccgaggactttacacctgtgtttatggcaccaccagtccattaccctcggggggacggcgaagagcaacgtgtcgtaatcttcgagcagacccagtacgacgtgccttctctcgctacgcacagcgcatacctgaaggatgatcaacggtcgacccctgacagcacttacagcgagagtttcaaggatgcagccactgaaaagtttcggtcagcgagcgtgggcgcagaagagtacatgtacgaccagactagctccggcactttccagtacacactcgaagcaacaaaatcacttagacaaaaacagggagaagggccaatgacatatctgaataagggccagttctatgcaataacactgtctgagaccggcgacaataagtgttttcgacatcccatctccaaagtacgcagtgtggtgatggtggtattctccgaggataaaaatagagatgagcagttgaaatattggaaatattggcactcacgccagcacactgccaaacagagagtccttgatatcgcggactacaaggaatcattcaatactatcggcaacatcgaagagatcgcctacaatgccgtgtcattcacctgggatgtgaacgaggaggccaaaatcttcatcactgtcaattgcctctctaccgacttttcttcccagaagggggtgaaaggactgccccttatgattcaaatagacacctactcatataataaccgaagcaacaagcccatccatagagcatactgtcagatcaaagtgttctgcgacaagggcgccgagaggaaaatccgagatgaggagcggaagcagaaccgcaaaaagggcaagggtcaggcatcccagacccagtgtaactcttcttcagacggaaaattggcggcaatcccactgcagaagaaatcagacatcacatactttaagaccatgcctgacctgcatagccagcccgtgctcttcatccccgacgtgcacttcgccaacctccaaaggactggccaggtgtactataatactgatgatgagcgagaaggtgggtctgtcctggtgaaaaggatgttcagaccgatggaggaagaattcggtcccgtaccctcaaagcaaatgaaagaagaagggaccaagagggtgctgttatacgtacgcaaggagactgatgacgtgttcgatgctcttatgttgaaatcccccacagtgaagggcctgatggaagccatttccgaaaagtacggcctcccagtggagaagatagcaaagctgtacaaaaaatccaaaaaagggattctggtaaatatggacgacaacataattgagcactactccaatgaggacacctttattctcaatatggagagtatggtggagggctttaaagtcacactgatggaaatctag

SEQ ID NO: 189788 - DNA, 21 bp, Artificial Sequence
  Description of Artificial Sequence: Synthetic coding sequence
atgagccaggagagcgactag

SEQ ID NO: 189789 - DNA, 1737 bp, Artificial Sequence
  Description of Artificial Sequence: Synthetic coding sequence
atgctgcggcggctggacaagatccggttccggggccacaagcgggacgactttctggaccttgcagagagccctaatgcctccgatacagagtgctcagacgagatccctcttaaggtgccaagaacctctccgcgggacagtgaggagctgcgcgatccagcgggcccaggcacattgattatggcaacaggcgtgcaggattttaaccgaaccgagttcgatagactgaatgagattaaaggtcacctggaaatagccctcctggaaaagcatttcctccaggaggagcttaggaagctgcgcgaggaaacaaacgccgagatgctgcgccaggaattagacagggagcgccagaggaggatggagctggagcagaaagtacaggaagtgttaaaagctaggaccgaggaacagatggcccagcagccacctaaaggacaggcccaagcgtccaatggagcggagcggagatctcaggggctctccagccgccttcagaagtggttttatgagaggttcggagaatatgttgaagattttaggtttcagccagaggagaataccgttgagacggaagaacccctttctgcacgccggttgacagagaatatgagacggctgaagaggggcgctaaacccgtgaccaacttcgtgaaaaacctgtctgctctctccgactggtatagcgtgtatacaagtgcgattgccttcactgtttatatgaacgcagtctggcacggttgggctattccattattcctatttttagcaatcctccggctatctttaaattacctcatagccaggggctggcgaatccagtggagcatagtgccagaagtgtcagaacctgtggaacccccaaaagaagatctcacagtatctgaaaagttccagctagtgttagatgtcgcgcagaaagcccagaatctctttggaaagatggccgatatcctcgaaaagattaagaacctgttcatgtgggtccagcccgaaatcacccagaaattatacgtggctctatgggccgccttcctggcgtcctgcttcttcccctacagactagtcggcctcgcagttggcctctacgctgggataaaatttttcctgatagatttcatcttcaagaggtgccccagacttcgagccaagtacgacaccccatatattatctggcggagcctccccactgatccgcagctcaaggagaggtccagcgcagccgtctctcggcggctccagactacttcttcaaggtcctacgtgccttctgctcccgctggactgggtaaagaagaggacgcgggtcgctttcatagcaccaagaaagggaattttcatgagatttttaatctgaccgagaatgaacggcctctggctgtgtgtgaaaatggctggcggtgttgcctgatcaatcgagaccgcaagatgccaactgactatatacgcaatggagtcctatacgtgactgaaaattatctttgttttgagagtagcaaaagtggctctagcaagcgcaacaaagtcatcaagttggttgacattaccgatattcaaaagtataaagttttgagcgtactgcccggcagcggcatggggatcgccgtatctactccgtcaacccagaaacccctggtattcggagcgatggtacaccgggatgaagcattcgagaccatcctgagccagtacatcaaaattacctcggcggccgcctctggaggtgacagctag

SEQ ID NO: 189790 - DNA, 1737 bp, Artificial Sequence
  Description of Artificial Sequence: Synthetic coding sequence
atgctgcggcggctggacaagatccggttccggggccacaagcgggacgatttcttagacttagcagaaagcccgaatgcctcggataccgaatgctccgacgagattccactgaaagttcctcgaaccagccctcgcgattctgaggagctgcgcgacccagcaggccccgggaccctcatcatggcaacgggcgtgcaggactttaaccgtacggaattcgataggctaaacgaaataaaggggcacttggaaatcgccctcctggagaagcattttctccaggaagaactgcgcaagctacgggaggagactaatgccgagatgttgagacaggagctggacagggaacgtcagcggcgaatggagctggaacagaaggtgcaggaagtcctgaaggcacggaccgaagaacagatggcacagcaacctcctaaggggcaggctcaagcctctaacggggcagagcgcaggtctcaaggtctttcgagcagactacaaaagtggttttacgagcggtttggtgagtacgtggaggacttccgcttccagcctgaggaaaacacagtggaaactgaggaacctcttagcgctaggcggctaactgagaatatgaggagacttaagagaggcgccaaacccgtgaccaatttcgtcaaaaacctgtccgccctaagtgattggtatagcgtttacacatcagcaatcgctttcacagtgtacatgaacgccgtgtggcacggctgggcgattccactgttcctcttcctagcaatccttcgactttcactaaactatcttattgctagagggtggaggattcagtggagcatcgtgcctgaggtgtcagagcctgtggagccccctaaggaagaccttaccgtcagtgagaaatttcagctggtgctggacgtcgcccagaaggctcagaacttattcggcaagatggcagacattttagagaaaataaagaacttattcatgtgggtccagccagagatcacacagaagctctatgtggcactgtgggcagctttcctcgccagttgtttttttccataccggcttgtgggcctggctgtcggcctctacgccggcatcaagtttttcttaattgattttatctttaagaggtgccccaggctgcgggcaaaatacgatactccttacattatctggcgaagcctgcctacagatccccaattgaaggaacgctcctctgctgcagtatctaggcgactccagacaacttcttcccgctcctatgtgcccagtgcccccgcaggcttgggtaaagaggaagatgcgggcagattccatagtacgaaaaagggcaattttcatgagatctttaaccttaccgaaaatgaacgccccttggccgtgtgcgagaacggctggcgctgctgcctgataaaccgcgatagaaaaatgcccacggattatatacggaacggggttctctacgtgacagagaactatctgtgctttgaatcctctaaaagcggatcttccaaaagaaacaaggtaatcaaactcgtggatatcacagatatacagaagtacaaggtgctctccgtgttgccagggtctgggatgggaatcgcagtgtctacccctagcacacagaaaccgctggtttttggcgccatggttcaccgcgacgaggccttcgagacaatactcagccagtatattaagattaccagcgctgccgcctctgggggggacagctag

SEQ ID NO: 189791 - DNA, 102 bp, Artificial Sequence
  Description of Artificial Sequence: Synthetic coding sequence
atgctgcggcggctggacaagatccggttccggggccacaagcgggacgactttctcgacctggccgaatcaccaaatgcctccgatacagaatgctcttag

SEQ ID NO: 189792 - DNA, 1782 bp, Artificial Sequence
  Description of Artificial Sequence: Synthetic coding sequence
atgtggaccctggtgagctgggtggccctgaccgccggcctggtggctggaacccggtgtcctgacggacagttctgccccgtggcgtgctgtctggatcccggcggggcctcctacagttgctgtcgcccacttttagataagtggccaaccacactgtcacggcacctaggtggcccctgccaggttgatgcgcactgcagcgcaggccacagttgcatcttcaccgtctccggcacatcgtcgtgctgcccattccctgaggcagtggcctgtggcgacgggcatcattgttgcccccgtggctttcattgttccgccgatggtagatcttgtttccaaagatctggtaataactctgttggggccatacagtgcccagattcacaattcgagtgccccgacttttcaacttgttgcgtaatggtggatggcagctggggatgttgtcccatgcctcaggcctcgtgctgcgaggatcgcgtgcattgctgtcctcacggcgccttctgcgacctggtccatactaggtgtatcacccccaccgggactcatccgctagccaaaaagcttcccgcacagaggactaatcgcgcggtcgccctctcctcgagtgtgatgtgtcccgacgctcggtcaaggtgcccagatgggagcacttgctgcgaactcccctccggaaagtacggatgctgcccgatgcctaatgccacttgttgctccgaccacttgcattgttgcccacaggatactgtgtgtgatcttatccagtcgaagtgtctgtccaaagagaacgccactaccgacctgttgaccaagttgcccgctcacaccgtcggagatgttaagtgcgacatggaagtgtcttgtcctgacggctacacgtgttgccggttgcagtccggcgcttggggctgttgccctttcactcaggccgtatgttgcgaggaccatatacactgctgccccgcaggctttacatgtgatacacagaagggaacgtgtgagcaggggccccaccaggtgccctggatggaaaaggctccggctcacctatctttgcctgatcctcaggctctgaagcgggacgttccctgtgataatgttagtagctgtcccagcagtgacacctgctgccagctgaccagtggtgagtgggggtgttgtcccatccctgaggcagtctgctgttcagatcaccagcactgctgcccccagggctatacctgcgtggccgaaggacaatgccagcgcggttctgagattgtggcgggactggagaagatgccggcaaggcgcgcctcgctctctcacccacgagatataggatgtgaccagcacacaagctgcccagtgggccaaacatgctgtcccagcctgggcggctcatgggcctgctgccaactgcctcacgcagtctgttgtgaagacagacaacattgctgtcccgcagggtatacttgtaatgtcaaggccagatcatgcgaaaaagaggtcgtgagcgctcagcccgctactttcctagcccgaagtccacacgtcggggtgaaggatgtcgagtgtggggagggccacttttgtcacgacaatcagacctgctgcagagacaatcgccagggatgggcctgctgcccttatcgccagggtgtgtgctgcgccgaccggcgccactgttgccccgcaggattccgctgcgccgctagaggtactaagtgtctgcgaagggaagcacctcgttgggatgctcccctccgggacccagccttgaggcagctgctctag

SEQ ID NO: 189793 - DNA, 1317 bp, Artificial Sequence
  Description of Artificial Sequence: Synthetic coding sequence
atgtggaccctggtgagctgggtggccctgaccgccggcctggtggctggcaccaggtgcccggatgggcagttctgtccagtggcatgctgtctcgatccaggaggcgctagttactcttgctgtcggcccctgctggacaagtggccaacaacgttgagcagacatctgggcggaccctgtcaagtggacgcccactgttccgctggacactcatgcatcttcactgtatccggaacatcctcgtgttgcccgtttcccgaagcagtggcctgcggggatgggcatcattgctgccctagagggttccattgctcagcggatggacggtcctgctttcagcggtcagggaataattcggtgggagctattcagtgccctgactcacaatttgagtgtcctgattttagtacgtgctgtgtgatggtggacgggtcctggggctgctgccccatgccccaggcctcatgttgtgaagatcgcgtccactgttgcccccatggagccttctgcgatttggtgcacacccggtgcatcacgcccaccggaacccatcccctcgcaaagaagctcccggctcaaaggactaacagagctgtggcattatccagcagtgttatgtgtcctgacgcgcggagccgctgtcccgacggaagcacatgctgcgagctgcctagcggtaaatatggttgctgcccaatgcccaatgctacatgctgcagtgaccacctgcactgctgcccccaagacaccgtgtgtgacctcatccagtctaagtgcctctccaaggaaaacgccacaaccgatcttttaacaaaactacctgctcacaccgttggtgacgtcaagtgcgatatggaggtgagctgtcctgacggttatacctgttgtagactacagagcggcgcatggggctgttgccccttcactcaggcggtgtgctgcgaggaccacattcattgttgtcctgcaggcttcacgtgtgatacacagaagggtacttgtgaacagggcccccaccaggtcccgtggatggaaaaggcacccgcgcacttgagcctcccggaccctcaggcgctcaaaagggatgtgccttgcgataatgtctccagttgtccaagtagcgacacatgctgccgcgataaccggcagggctgggcatgctgcccgtacaggcaaggggtgtgttgcgcagaccgaaggcactgttgccccgccggattccgctgtgccgccagaggcactaaatgtcttcgacgcgaagctccacgatgggacgctccattgcgggatccggctctccgtcagctcctttag

SEQ ID NO: 189794 - DNA, 1242 bp, Artificial Sequence
  Description of Artificial Sequence: Synthetic coding sequence
atggccatcaccgccgcccacggcgccagcaccgccgtgcagaccggcgaccctgcgtctaaagaccaagtcaccaccccctgggtgcccagctctgccctaatcgtctcaagcaacgctaggaccagcccgcgggctgttctgtggtccatggcccccggtggagctgcaccctgccctcgcctccccgccgtcaagaccggctgcaccgcagtctgtgacttaatacagtcaaagtgtctttccaaagagaacgctacaaccgacttgctaaccaaactgcccgcacacaccgtaggagatgtcaagtgtgatatggaggtttcctgtcccgacgggtacacatgttgtcggctgcaaagcggagcctggggctgctgtccctttacacaggccgtttgttgcgaagaccatatacactgctgccccgcgggttttacatgtgacacccagaaaggaacctgcgaacaaggaccccaccaagtaccctggatggagaaggctccagcccatctctcgctgccagaccctcaggctttgaaaagagacgttccctgtgacaacgtctccagttgcccttcaagtgacacatgctgtcagctgactagcggggagtggggatgttgccccatacccgaggccgtttgttgttccgaccaccagcactgctgcccgcagggttatacttgcgttgccgagggccagtgtcaacgcggatcagagattgtggcggggctggagaagatgccagctcggcgggctagcctgagtcatccgagagacattggttgtgaccaacacacttcatgcccagtggggcagacctgttgccctagcctaggaggaagctgggcgtgctgccagctgccccacgctgtgtgttgcgaagaccggcagcactgctgtcccgcaggttacacctgcaatgttaaggctaggtcgtgtgagaaagaagtagtcagtgcccagcctgccacatttttagctaggtctccccacgtaggagtgaaggatgtggagtgtggggagggccatttttgccatgataaccagacatgctgtcgggataaccggcaaggctgggcgtgctgcccatatcgccagggggtctgctgtgctgaccggaggcattgttgtccggctgggtttcgatgcgctgcccgtggtactaagtgtttgcgacgagaagccccgcgctgggacgctccactgcgcgacccagctctgcggcagttgctttag

SEQ ID NO: 189795 - DNA, 789 bp, Artificial Sequence
  Description of Artificial Sequence: Synthetic coding sequence
atgcggaacagctaccggttcctggccagcagcctgagcgtggtggtcagcctgctcctgattcccgaggatgtttgcgagaaaatcattggtgggaacgaggtcacccctcactctaggccgtacatggtgctgctctccctcgatcgcaaaaccatctgtgccggcgcactgatcgctaaagactgggttctgacggccgcacattgtaacctaaacaagcgttcccaagttatcttgggcgctcactcaattacacgcgaagaaccaaccaaacaaattatgttagtaaaaaaagaattcccctatccttgttacgatccggcgacccgagaaggagacctaaagcttttacagctgatggagaaagccaagatcaataaatatgtgaccattctgcatctgccaaaaaagggagacgacgtgaaacctggaaccatgtgtcaggtggctggctggggccgcacacacaattcagcctcgtggtccgacaccctcagggaggttaacattaccataatcgacaggaaggtctgtaacgacagaaaccattataacttcaatccggtgattgggatgaacatggtctgtgcaggtagtctgcgggggggccgcgactcttgcaacggggactcgggtagtccactgctgtgtgagggcgtgttcaggggtgtgaccagcttcggcctggagaacaagtgtggcgacccaaggggacccggggtttacattctcttgagcaagaagcatctgaactggatcattatgaccatcaagggcgccgtttag

SEQ ID NO: 189796 - DNA, 741 bp, Artificial Sequence
  Description of Artificial Sequence: Synthetic coding sequence
atgcagcccttcctgctgctgctggccttcctgctgacccccggcgcagggacagaagaaatcatcgggggccacgaggccaaaccccactccaggccgtatatggcattcgtccaattcctgcaggagaaaagcagaaagcggtgtggtggaatcttggtgcgaaaagacttcgtgctcaccgccgcccactgtcagggaagcagcatcaacgtgacactcggcgcacacaatatcaaggaacaagagcgaacccagcaattcattccagtgaagcggcctatccctcatcccgcctataatcccaagaacttctcgaacgatataatgctcctgcagctcgagagaaaagcgaagtggaccactgctgtacgtccactcagactcccgtcatcgaaggctcaggtgaagcccggccagctatgtagcgttgccggatggggatacgtctcaatgtctacattggctaccacccttcaggaagtcttgctgactgttcagaaggattgtcaatgtgaacggctgttccacggcaactactcacgggctacagaaatctgcgttggggaccccaagaagacccagaccggttttaagggagattccggcgggccactggtctgcaaggatgtggcgcaggggattctgtcttacggtaacaagaaaggaactccacccggggtgtacattaaggtttcccactttttgccttggataaagcgcactatgaagaggctgtag

SEQ ID NO: 189797 - DNA, 459 bp, Artificial Sequence
  Description of Artificial Sequence: Synthetic coding sequence
atgcagcccatcctgctgctgctggccttcctgctgctgccccgggccgaccagttagaacggaaagctaagcggacacgcgctgttcagccccttaggcttccctcaaataaagcccaggtgaaaccggggcagacatgttccgttgctggctggggacaaaccgcaccgttagggaagcattcccacaccttgcaggaggtcaaaatgactgttcaggaggatcggaaatgtgagtctgacctaaggcactattatgacagcacaattgagttatgcgtgggagatcccgaaattaagaaaacgtcttttaagggagatagtggcggccctctcgtctgtaataaagtagcacaaggcatcgtttcttacggccgcaataatgggatgccgccacgagcctgcacaaaagtgagcagctttgtacattggattaaaaagacgatgaagagatactag

SEQ ID NO: 189798 - DNA, 609 bp, Artificial Sequence
  Description of Artificial Sequence: Synthetic coding sequence
atgcagcccatcctgctgctgctggccttcctgctgctgccccgggccgacgcaggcgagatcatcggtgggcacgaggccaagcctcacagccggccatatatggcgtacctgatgatttgggatcagaaaagcttgaagcgatgcggagggttcctcatcagggatgactttgtcctgactgctgctcactgttggggtcgtcttgaaaggaaagcgaagaggactagagctgtacagccactgagattgccaagtaacaaggcccaagtcaaacctggacagacgtgctcagtcgctggctggggacaaacagcccctctaggaaaacattcccacactctgcaagaggtgaaaatgaccgtccaggaggaccgtaagtgtgagtcagacttgagacactactatgactcaactatagagctttgtgtgggagatccggagataaaaaaaacctcctttaagggcgacagcggtggccctctcgtgtgtaataaggtagcccaaggaatagtgagctacggccgtaacaacgggatgcctccccgagcctgtaccaaggtttctagttttgtgcattggatcaagaagaccatgaagcggtactag

SEQ ID NO: 189799 - DNA, 846 bp, Artificial Sequence
  Description of Artificial Sequence: Synthetic coding sequence
atgaagagcctgagcctgctgcacctgttccccctgccccgggccaaaagagagcaaggaggcaataattcttccagtaatcaagggtccctgcctgagaagatgcaaccaattcttcttcttttggcgttcctgctactccctagagctgatgctggcgaaattattggcggtcacgaggccaaaccgcattccagaccctacatggcctacctgatgatctgggaccaaaaatctctcaagcgatgcggcgggttcctgatccgggatgactttgtgctgaccgcagcccactgttggggctcctccataaatgtgaccctgggtgcacacaatatcaaggagcaggagcctactcaacagtttattcccgtgaaacggccaattccccaccccgcctataatcctaaaaatttctctaacgacattatgctgttgcagctcgagagaaaggcgaagagaaccagggccgtgcagccactccggctgcctagcaataaagctcaggtgaagcctggacaaacctgctcagtggccggatggggccagacggcacccttaggcaagcattctcacacacttcaagaagtgaaaatgacagtccaggaagatagaaagtgcgaatccgacctgagacactactatgattccacgatcgagttgtgcgtgggcgacccggagataaagaaaacttcattcaagggtgactcaggtggaccccttgtgtgtaacaaagtggctcagggaatcgtgtcctatggtcggaataacggcatgcctccgagagcttgtaccaaggtctccagcttcgtgcattggatcaaaaagaccatgaagcgctactag

SEQ ID NO: 189800 - DNA, 708 bp, Artificial Sequence
  Description of Artificial Sequence: Synthetic coding sequence
atgcagaccttccccagcggcgagatcatcggcggccacgaggccaaacctcattcacgtccttatatggcctacctcatgatttgggatcagaaatccctgaagagatgcggaggattcctgatccgtgacgatttcgtcttgactgctgcccattgttggggttcctctatcaatgtaacactgggagcacataacattaaagagcaagagcccactcaacaattcatccctgtgaagaggcccattcctcatcccgcctacaaccccaagaacttctctaacgatatcatgctccttcagcttgagaggaaggctaagcgcacccgggctgttcagccgttgagactgccatccaataaggcccaggttaaacccggacagacttgcagtgtagccgggtggggtcagacagctcccctcggaaaacacagtcacactctacaggaagttaaaatgactgtccaggaagatcgtaaatgcgagtccgacctgcgccactattatgatagtacaattgaattatgcgtgggcgatcctgagatcaagaagacatccttcaaaggtgacagtggaggaccgctagtctgcaataaggtagcccaaggaattgtgagctacgggcgcaacaatgggatgccgccccgtgcatgtactaaagtcagttcttttgtgcattggattaagaaaacaatgaagagatattag

SEQ ID NO: 189801 - DNA, 483 bp, Artificial Sequence
  Description of Artificial Sequence: Synthetic coding sequence
atgcagcccttcctgctgctgctggccttcctgctgacccccggcgccgggaccgaagagattatcggcggtcacgaggccaaaccacactcgcgcccatacatggctttcgttcagtttcttcaggaaaaatctcgcaaaaggtgtggcgggatcctggtgcgaaaggatttcgtcttgactgcagcgcactgtcaagggagttccatcaacgtaaccctcggcgcccacaacataaaagagcaggagcgcacacagcagtttattcctgtaaaaagaccaatccctcatccggcttacaatcccaagaacttttctaacgatattatgctgctgcagggtgacagcggcggacctctggtttgcaaagatgtggcccaggggattctgagctatgggaataaaaagggaacaccaccaggggtttacattaaggtgtctcacttcctgccatggataaaacgcacgatgaagcgcctttag

SEQ ID NO: 189802 - DNA, 768 bp, Artificial Sequence
  Description of Artificial Sequence: Synthetic coding sequence
atgcagcccctgctgctgctgctggccttcctgctgcccaccggcgctgaagccggtgagataatcggagggcgagagtcccgcccccattcacggccttatatggcctacctgcagatccagagcccagccgggcagtccaggtgcgggggttttctcgtacgggaggatttcgtcctcaccgctgcccattgctgggggtcaaacattaatgttaccctgggcgctcataatattcagcgcagagagaacacacagcagcacattacggctcgacgggcaattcggcatccacagtataatcagaggactatccaaaatgacatcatgcttctgcaactctcaaggagggtgagacggaatcggaacgtcaatccagtcgccctgcctcgggctcaagaaggactcaggccagggaccctctgcaccgtcgccggctggggacgtgtgtcaatgcggcgggggacagatactctgagagaggtccagctgagagtccagagggatagacagtgccttagaatttttggaagttacgacccacggcggcagatttgcgtgggagacaggagggaacgcaaagcggcatttaaaggcgacagtggtggtccgctgctgtgtaataatgtcgcccatgggattgtgagctatggcaaatcctcaggggtaccccccgaggtatttaccagggtttcatcatttcttccttggatccgtaccacaatgcgatcttttaaactgctggatcagatggaaacccctctgtag

SEQ ID NO: 189803 - DNA, 348 bp, Artificial Sequence
  Description of Artificial Sequence: Synthetic coding sequence
atgcagcccttcctgctgctgctggccttcctgctgacccccggcgccggcactgaggagattatcggtggccacgaggccaagccacatagcagaccatatatggccttcgttcagtttcttcaagaaaaatctcggaagcgctgcggggggatcttggttcgaaaagattttgtcttgacggccgctcactgtcagggccggggcgacagcggcggcccactggtttgtaaagatgtcgcccagggtatactgtcctacggcaacaaaaaggggaccccacctggggtgtatattaaggtgtcccacttccttccctggatcaaacggactatgaaaagactgtag

SEQ ID NO: 189804 - DNA, 774 bp, Artificial Sequence
  Description of Artificial Sequence: Synthetic coding sequence
atggaggcctgcgtgagcagcctgctggtgctggccctgggcgccctttccgtcggctcctccttcgggacacagattatcggcgggagggaggtgatccctcacagcagaccttacatggctagtcttcagcgaaatggcagccacctgtgcggcggagttctcgtgcatcctaaatgggtgcttaccgccgcccactgtctggcccagcgtatggcacagctgaggctggtcctcggcctccatacgctggactctcctgggctcacttttcatatcaaggccgcaatccaacacccccgatacaaaccagtgccagcacttgagaacgatttggcactccttcagctggatgggaaggtgaagccatctcgaacaatccgccccctggccctgcctagtaaaagacaggtcgtggctgctggaacacggtgcagtatggcgggctggggtctgacgcaccagggcggccgcctgtcccgcgtcctccgggaattggacttgcaggtgttagataccagaatgtgcaataattcaagattctggaacggctcattgagtcctagcatggtttgcttggcggctgatagcaaagatcaggccccctgtaagggggatagcgggggtcccctggtgtgcggtaagggacgcgttctggccagagtgctctcgttttctagcagagtatgcactgatattttcaagccccctgtcgcaaccgctgttgccccatatgtaagctggattcgaaaggtgacagggcgaagcgcttag

SEQ ID NO: 189805 - DNA, 3108 bp, Artificial Sequence
  Description of Artificial Sequence: Synthetic coding sequence
atggccgccgagaccctgaacttcggccccgagtggctgcgggccttgtctggagggggcagcgtggcttcaccgcctccaagccccgccatgcctaaatacaagctcgcggactatcgctacgggagagaggagatgctagccttgtacgtgaaggagaacaaggtgccagaggaactccaggacaaagaattcgcggcggtcctgcaggatgaacctctacaacctctagccctagaacccctgaccgaggaagaacaaaggaacttcagcctgtctgtaaacagcgtggccgtgttgcgcttaatgggaaaaggtgccggcccaccactcgcgggcacatcaaggggacgagggagcacgcggtctcggggacgcggcagaggagatagctgcttttatcagcgaagcatcgaagaaggggacggggcatttgggcgcagcccacgggagattcagcgcagtcaatcatgggacgacaggggtgaacgccggttcgaaaaaagcgcgcggcgcgacggcgcgcggtgcggatttgaggaggggggagctggtccaagaaaggaacacgctagatccgatagcgagaactggagaagcttgagagaagaacaagaggaggaagaagaaggctcatggaggttgggcgcaggcccacggcgagacggagatcgctggagaagtgcctctcctgacggcgggcccagatctgcaggctggagggaacatggggagcgccgacgaaaattcgagttcgatctgaggggggaccggggtggatgcggagaagaggaggggagagggggaggagggagttcccacctcaggcgatgtcgggccccagagggttttgaggaagacaaggacggtctcccagaatggtgcctcgacgatgaagacgaggagatgggcaccttcgacgctagcggagccttcctgccccttaaaaagggccctaaggagccaatccctgaggagcaggagctggacttccagggcctcgaagaggaagaagagcctagcgaaggcctcgaggaggaaggaccagaagcggggggcaaggaactcactccactacctccacaagaggaaaagagtagctctccttctccactgcccacactaggccccttgtgggggactaatggtgatggcgatgagactgcagaaaaagagccgcctgccgctgaggacgacatcagaggcattcagctgtcccccggcgtgggctcctccgctggtcctcctggagacctggaggatgacgaagggctcaagcacctccaacaggaagccgaaaaactggtagcctccctccaggattcaagcctcgaggaggagcaattcactgcagccatgcagacccagggtctaagacactccgccgctgctaccgccctcccactgtctcacggggcggcaaggaagtggttctacaaggacccgcaaggagagatccaaggcccctttaccacccaggagatggcagaatggtttcaggctggctatttcagtatgtccctgctcgttaaacgcggctgcgatgagggcttccagcccctgggagaagtcatcaaaatgtggggtcgggttccgtttgccccggggcccagcccacctcccctgcttggcaacatggatcaagaaagattaaaaaagcagcaggagctcgcggcagccgcgttgtatcagcagctccagcatcagcagtttttgcaacttgtttcctcccgtcagttaccacagtgcgctctgcgtgagaaagctgcgcttggtgatctcaccccgccccctccaccgcctccacagcagcagcagcagcagttgacggcctttcttcagcaactccaggccctgaaaccacctagaggtggcgaccagaatctgctgcctaccatgtcaaggagcttgagtgtgcctgactctggcagactgtgggatgtgcacacgagtgcttcttcccagagtggaggagaggcttccttgtgggacatccctatcaatagcagtactcagggaccaatacttgaacagcttcaacttcagcataagtttcaagagaggcgggaggtggaactgcgagcaaaacgcgaagaggaggaaagaaagcgccgtgaggagaaaaggagacagcaacagcaagaagagcagaagaggcggcaggaggaagaggagctgtttcgtaggaaacacgtgcggcaacaggaattgttgctcaagctcctccagcagcagcaggctgtgcccgtacctcccgcaccttcttcccccccccctctctgggctgggctcgccaagcagggactttcaatgaagaccttgctagagcttcagctggaaggagagaggcaactccataagcagccgcctccgagagagccagcaagggcccaagctcccaatcatagagtccagctaggaggattagggacagcccctctcaaccaatgggtaagcgaggcggggcccctctgggggggccctgacaagtctggcggggggagtagcggcctcggtctgtgggaggatacccctaaatcagggggctctttggtgcgaggattaggactgaaaaatagcagaagtagtccctctctgagcgatagctattcacacctgtccggccgccccatccgaaaaaaaactgaggaggaagagaagctgttgaagctgttacagggcatccccagaccacaggacggcttcacccagtggtgtgagcaaatgttacacaccttgtctgccacaggttcattggacgtccccatggccgtggctattttgaaagaggtagagtccccctatgacgtccacgactacatccgctcatgtctgggagatactctggaggccaaggagtttgcaaagcagtttctcgaaaggagagctaagcaaaaggctagccagcagaggcagcagcaacaagaggcctggctctcaagcgcttccctacagacagccttccaggccaaccacagtacaaaactaggacctggcgagggaagtaaagcgaagagacgagcactcatgttgcattctgatccaagcatcctgggctacagtctacacggaagctctggagaaatcgaaagcgttgacgattattag

SEQ ID NO: 189806 - DNA, 2265 bp, Artificial Sequence
  Description of Artificial Sequence: Synthetic coding sequence
agcagcttccccagcccccggctgccccaggtgttccaccggctggacgatgaggacgaagaaatgggcactttcgatgcaagcggggccttcctacccctgaaaaaaggcccgaaagagcctatccctgaggagcaggaattggattttcaagggttggaagaagaggaagaaccctctgaagggctagaagaagaaggtcccgaggctgggggcaaggagcttacccccctgccaccacaggaggaaaaaagctccagtccctccccattaccaactttaggcccactttggggcaccaatggagatggagacgaaactgccgagaaggagcctccagccgcggaagatgatatccggggaatacaactgagtcctggagtggggagctccgccggcccacccggagacctagaagacgatgaaggcctgaaacaccttcagcaggaggccgaaaaattggtggcgagtctgcaggattctagtctggaggaggaacaattcaccgccgcaatgcagacacagggactgaggcattccgcggcagcaacggcattgcccctctcccacggagccgctaggaaatggttttataaggatcctcagggagagatacagggacctttcacaacccaagagatggcagagtggttccaggcgggctacttttctatgtctctgctggtcaagagagggtgcgacgagggatttcaaccacttggcgaagtgatcaagatgtggggcagagtacccttcgcacctggcccaagcccaccccctttgctcggtaacatggaccaggaacggctgaagaaacagcaggagctcgctgcagcagcactttatcagcagctacagcaccagcaatttctgcagctggtcagctctcgtcaacttccccagtgcgcgttgcgagagaaggccgccctgggcgacctgacccctcccccccccccccctccccagcagcagcagcagcaactgaccgccttcctgcagcagctccaggcactgaagccacctcggggaggcgaccaaaaccttctgcctaccatgtcacgatctttgagcgtacctgactccgggcggttatgggacgttcacacatcagcaagctctcagagcggaggagaagcctctctctgggacattcctatcaacagcagcacccagggacccattctggagcaattgcagctgcagcataagtttcaggagaggagggaggtcgagcttcgagccaaaagggaggaggaagagagaaaacgtcgtgaggaaaagcgaagacagcaacagcaggaagaacagaaacggaggcaggaagaggaggagttattcagacgcaaacacgtgcggcagcaggagttgctattgaagttactccagcagcagcaggccgtgcctgttccacccgccccttcgtctccaccgccgctatgggcgggcttggccaaacaggggctctctatgaagaccctgctggagttgcagctggaaggcgaaagacagctccacaaacagcctccaccacgggaaccagcgcgcgcccaagctcctaaccaccgggtgcaactgggtggcctgggaacagcacctttgaatcagtgggtcagcgaagccgggcccttatggggcggacctgataaaagcggcggcggaagcagcgggctgggtctgtgggaggataccccaaagtcgggcgggtccctggtccgcgggttgggcttgaagaactcaaggtcaagcccttccctttcggattcctactctcacttatcaggtagacccattagaaagaaaacagaagaagaagaaaagctacttaaactgctgcaggggatcccacgtccccaggatggctttactcagtggtgtgaacaaatgctccacacactgtctgccacgggcagtctcgatgtcccaatggctgttgccatcttaaaggaagtggagtccccttatgacgtccatgactacatcagatcgtgtttaggagacacactggaggccaaggaattcgcgaaacagttcctcgaaaggcgggccaaacagaaggcttcccagcagcgacagcagcagcaggaggcctggttgagcagtgcttcactccagactgcattccaggccaaccactctacaaagcttggccctggtgagggttccaaggccaagagaagggcactgatgctccacagcgacccatccatcctggggtactccctccacggttcttctggggagattgaaagtgtagacgactactag

SEQ ID NO: 189807 - DNA, 3900 bp, Artificial Sequence
  Description of Artificial Sequence: Synthetic coding sequence
atggccgccgagacccagaccctgaacttcggccccgagtggctgagagcactctcatctggaggtagcattacatctcctcctttaagtcccgcgctcccaaaatacaagctggctgattaccgatatgggcgggaggaaatgctggctctcttcttaaaagataacaaaattcctagtgacttactggataaggagttcttacccatcctgcaggaggaaccgctacctccccttgcactggtgccattcaccgaggaagaacagaggaatttctcaatgagcgtgaatagtgccgccgttttacgtctgacaggacgcggcggcggaggcacagtggtgggggccccaaggggtcggagttcttcgagaggacgggggcggggccgcggcgaatgcgggttttatcagaggtctttcgatgaagttgaaggagtctttgggcgcggtgggggccgcgagatgcaccggagtcagtcatgggaggagcggggagaccggagattcgagaagcctgggcgcaaagacgtggggagacccaatttcgaggaaggaggccccacctccgtaggtcggaagcatgagttcatcagaagtgaatccgagaactggagaatttttcgcgaggagcagaatggtgaggacgaggatggtggatggaggctcgcaggttctcggagagatggagagagatggcgccctcacagccccgatggcccgagaagtgctggatggcgggaacatatggaaagaaggcgtaggttcgaatttgactttcgcgatcgggacgatgaacgcggttaccggcgcgtccgttcgggttctgggtctattgatgatgacagagattccctccctgaatggtgcctcgaggacgccgaagaggaaatggggacatttgatagctccggtgctttcctttccctgaaaaaggtgcagaaagaacctatccccgaggagcaggagatggacttcaggcccgtagacgaaggcgaagagtgctcagattccgaagggagccacaatgaggaggcgaaggagcctgacaaaactaacaagaaggagggagagaaaacggacagggtaggagtcgaggccagcgaagagaccccccaaacatcctcttcctctgcccgtccaggcactccgagcgaccaccagagccaggaggcatctcagtttgagcggaaggatgagccaaagacggaacagacagagaaggcagaagaggagacaagaatggagaatagcctgccagcaaaagtgccctcaaggggtgacgaaatggtggccgacgtacagcaaccattaagccagattccctctgataccgcctcccctttactgatcctgccccctcctgtcccaaatccttcccccacactgaggcccgtagaaacgcccgtggtaggcgcacccggtatgggatctgtaagcacagagcccgacgacgaggaagggctgaagcaccttgagcagcaggcagaaaaaatggtagcatacctacaggatagcgcactggatgatgagcgtctggcgtcaaagctgcaggagcacagggcaaagggcgtatccattccacttatgcatgaagccatgcagaaatggtactacaaggacccgcagggggagattcagggccctttcaacaatcaggagatggctgaatggttccaggctggctattttaccatgagcttgctggtgaagcgcgcttgcgacgagtcatttcagcccctaggggatatcatgaaaatgtgggggagagttccttttagccccggtccagcaccccctccacacatgggcgagttggatcaggagcgcctgaccagacagcaggaactcacagcactgtaccagatgcagcatttacagtaccagcagttcctcatccagcagcagtatgcccaggttcttgcacagcagcaaaaagctgccctgagctcacagcagcagcagcagcttgccctcttgctacagcagttccagaccctgaagatgaggatctcagaccagaatataattccttcagtgaccagaagtgtctcagtccctgacactggcagcatctgggaactgcagccaacggccagccagcccaccgtgtgggaaggcggaagtgtatgggatcttcccctggatacaacaaccccgggcccagccctcgaacagctccaacagctggaaaaggccaaggcagcaaagctagagcaggagcggagggaagccgaaatgcgtgccaagcgagaggaggaggaacgaaagcgacaagaagaactgcgacgacagcaggaagagatcctgagaaggcagcaggaggaagaacggaaaaggagggaagaagaagagcttgcaaggcgcaaacaagaggaggctctgagaagacagcgtgaacaggagatcgccctccggagacagcgggaagaagaggagagacagcagcaagaggaggcgttgaggcgactcgaagagaggagacgtgaggaggaagagagacggaaacaggaggagcttctgcgaaaacaggaagaggaggccgccaaatgggcacgggaagaagaggaggcccagaggcggttagaagagaacagactccggatggaagaggaagcagctagactgagacacgaggaagaggaacgcaagaggaaggagctagaagttcagcgtcagaaggagttgatgaggcagcggcagcagcaacaggaagctcttagacgcctccagcagcagcagcagcaacagcagttagcccagatgaagctgccctcctcatccacctggggccagcaaagcaatactacagcctgccagagccaagccactctctctctggccgaaattcagaaactcgaggaagaacgggagcggcagttgagagaggaacaacgacggcagcagcgggaattgatgaaggccctccagcagcaacaacagcagcaacagcagaaactcagcggctgggggaatgtctcaaagcctagcggtactaccaagtctttactggagatccagcaggaagaggctcgccaaatgcagaagcagcagcagcaacaacagcagcatcagcagcccaatcgagcccggaataacacccattctaatctgcatacatcaatcggcaatagcgtgtggggttcaattaacaccgggccccctaatcagtgggccagcgacttggtttcttctatttggtccaacgccgatacaaaaaacagcaatatggggttctgggatgatgccgttaaggaggtgggtccccggaattcgactaacaagaataaaaataatgctagcctcagcaagagcgtgggtgttagtaaccgccagaataaaaaggtggaggaagaagaaaagttactgaaactattccagggtgtgaacaaggcccaggatggctttacacaatggtgcgagcaaatgttgcacgcccttaataccgcaaataatctggatgtccccactttcgttagttttcttaaggaggtagagtccccgtacgaagtacatgactatatccgcgcatacctgggagacacatctgaggccaaagaatttgccaagcagttcctggagaggagggccaaacagaaagctaaccagcagagacagcagcaacagctgccccagcagcaacagcaacagcctccacagcagccccctcaacagccacagcagcaagatagtgtgtggggaatgaaccactcaaccctgcattctgtgttccagaccaatcagtccaacaatcaacagagtaactttgaagccgtgcagtccggtaagaaaaaaaaaaaacagaaaatggtgcgcgctgatcccagtttactcggctttagtgtcaatgcgtctagcgaacgactgaacatgggcgagatcgaaacactggatgattattag

SEQ ID NO: 189808 - DNA, 3966 bp, Artificial Sequence
  Description of Artificial Sequence: Synthetic coding sequence
atggccgccgagacccagaccctgaacttcggccccgagtggctgcgagctctcagttccggcgggtcaatcacgagccctcccctgtccccagcactccctaagtataagcttgctgattaccgatacggccgagaggaaatgctcgcccttttcctgaaagataataagatcccctcagaccttctggacaaggaatttctcccaatacttcaagaggaaccactgcccccattagctctggtgccgttcacggaagaggagcagcggaacttcagcatgagtgttaactcagcggcagttctcagattaacgggccggggaggcggggggaccgtggtgggggctccacgcggtagaagcagcagccggggaaggggaagagggagaggcgaatgtgggttctaccagcggagctttgacgaggttgaaggggtcttcggcagaggtggcggacgggagatgcacaggtcacaaagctgggaagagcggggcgacagacgcttcgaaaaacctggccggaaggacgtgggcaagaagaatggctattactgcatgtactctccagtcttactgctgggtcagcccttatgccagggtcgacccaattttgaggaaggcgggcctacctccgtgggacggaagcatgagtttatccgcagtgaaagcgaaaattggcgtatttttcgggaggagcagaatggggaagatgaggatgggggatggaggctggccggctcaaggcgggatggagagcggtggagacctcattctcccgacggtccgcgtagcgccggatggcgtgagcatatggaaaggcgtcgccggttcgagttcgacttccgcgacagggatgatgagcggggctatagacgtgttagatccggttccggctctatcgatgacgacagggactcactgccagagtggtgccttgaggacgcagaagaagagatgggcacatttgactcctcaggagcttttctctctttgaagaaagtgcagaaagagcctatccccgaggagcaggaaatggattttcgtccagttgacgagggtgaggaatgctccgactcagagggctctcataacgaggaggctaaagaaccagacaagacaaacaagaaagagggggaaaagactgaccgagtgggggtggaagcttctgaagaaacgccgcagacttcgtcctcctcagcccgacctggaacccccagcgatcatcaatctcaggaggcatcacagtttgagcggaaagatgagcccaagacggagcaaaccgagaaggccgaggaggagacgcgcatggaaaattctctccccgcaaaagtgccgtcaagaggcgatgagatggtggccgatgttcaacagccactgagtcagataccttccgacacagctagtcctctcctcattctccctccacctgtgcccaacccatcccccacccttaggccagtcgagacacccgttgtgggggccccagggatgggttcagtgagcaccgaacccgatgacgaggaagggctgaagcatctggaacaacaggcggagaagatggtcgcttatttacaggacagtgccctggacgacgaaagactggcttcaaagctccaggaacacagggcgaagggggtgtcaatccctcttatgcacgaggccatgcagaaatggtactacaaagacccacaaggcgagatccaaggcccgtttaacaatcaagagatggcggaatggttccaggccggatactttactatgagtctactagttaaaagagcctgtgatgagtcttttcagccactgggcgatattatgaagatgtgggggagggtgccatttagcccaggtcctgccccgcctccgcacatgggtgaactggatcaagagaggttgaccaggcagcaagaactcaccgccctgtatcaaatgcagcatctgcagtatcaacagttcctcatacagcagcagtacgcccaggtccttgcgcagcaacagaaagctgccttgagctcacagcaacaacagcagttagcattgttactccagcaatttcagaccctaaagatgcgtatatctgaccagaatatcattccttcggtcacgcggtctgtctcagtgccagataccggtagtatttgggagctccagccaactgcatctcaaccgacagtatgggaggggggatctgtgtgggatcttcctttggacactaccacgcctgggcctgctctcgaacagttgcagcaactcgagaaagctaaagccgcaaagctcgagcaggagcgcagggaagcagaaatgagggcaaagagggaagaagaagagagaaaacggcaagaagagctgagacgccagcaggaagagatccttagaaggcagcaggaagaggagcgaaagagacgcgaggaggaggagctggcacggcggaagcaggaagaggcgcttcgccgccagagagagcaggaaattgccctccggaggcagcgagaggaggaggaacggcaacagcaggaggaggctttgcgcagacttgaggagagacgccgcgaggaggaagagcggaggaagcaggaggaactcttgaggaagcaagaggaggaggccgccaagtgggctcgcgaagaggaagaggcacaaaggcgtctcgaagagaaccgtctgaggatggaggaggaagctgcccggctgcggcacgaagaggaggagaggaaaagaaaggagctggaggtgcaaagacagaaagaacttatgcgccaaagacagcagcagcaggaggcactgaggcgtctgcagcagcagcagcaacagcagcaactggctcaaatgaagcttccctcatcaagtacttggggccagcaatctaataccaccgcctgtcagagtcaggccacgctcagcctggctgagatccaaaaactggaggaggaaagagagaggcagcttagagaagagcaacgacggcagcagcgggagttgatgaaggcgctgcagcaacagcagcagcagcaacagcagaaattgtcaggatggggcaatgtgagtaagccaagcgggactaccaagagtcttctcgaaattcaacaggaagaagctcgtcagatgcaaaagcagcaacagcaacagcagcaacatcagcagcccaacagggcaagaaataatacccactcaaatttgcatacgtcaataggcaatagcgtttggggatcaattaacaccgggcctcccaaccaatgggctagtgatctcgtgagtagtatttggagcaatgccgataccaaaaactccaatatgggtttttgggacgatgcggtgaaggaggtgggccctaggaatagtacgaataagaataagaataatgcgtccctttctaaatctgtaggagtgtccaaccgacaaaacaagaaggtggaagaggaggaaaagttacttaagctgttccagggcgtaaacaaggcacaggatggcttcacgcagtggtgcgagcagatgctgcacgccctgaataccgccaacaaccttgatgtgccaacgtttgtgtccttcctcaaggaggtcgagtccccatacgaagtacacgactacatcagagcctacctaggtgatactagcgaggccaaagagtttgctaagcagttcttagagcggcgggcaaagcagaaagccaatcaacagaggcagcagcagcagctgccccaacagcagcaacagcagcctccacagcagccaccccagcagccacagcagcaggacagtgtctgggggatgaatcatagtaccctccactctgtgtttcagaccaaccagtctaacaaccagcagagtaacttcgaggcagtccaatctggtaaaaaaaagaagaagcagaaaatggtgagggccgacccttcgctccttggtttcagtgttaacgcatcctcggagagactaaacatgggggagatagagactctggatgactattag

SEQ ID NO: 189809 - DNA, 3966 bp, Artificial Sequence
  Description of Artificial Sequence: Synthetic coding sequence
atggccgccgagacccagaccctgaacttcggccccgagtggctgcgagcccttagctccgggggttctattacgtctcctcccctcagtcctgccctgcctaaatacaaacttgcagactatcgctacgggcgagaggagatgttagcgctattcctgaaagacaacaaaattccgagcgatttattagacaaggaattccttcccatactgcaagaggagccactgcctccgctcgccttggtcccgtttaccgaagaagaacagcggaatttcagtatgtcagttaattccgccgcagttctccgacttaccggaagaggcggaggcggaaccgtcgtgggggcacctcgggggcggagctcctcaaggggccgcggtcgaggacggggggaatgcggattctaccagcgctccttcgacgaggtcgagggagtcttcgggaggggcgggggacgagaaatgcaccgttcccagagctgggaggagcgtggtgatcgccggtttgaaaagccgggcagaaaagatgtcggcaagaagaatggctattattgtatgtactcccccgtgcttctgctgggccagcctttgtgccagggtaggccaaattttgaggagggtggcccaaccagtgtgggccggaagcacgaatttattcgttccgaatccgagaactggcgcatctttcgggaggaacagaatggagaagatgaggacggaggatggagactggccggatcgcgcagggatggtgagcgatggaggccccactcaccggacgggccaagatccgcaggttggagagaacacatggagaggagacgcaggttcgagttcgactttcgcgatagagacgacgagcggggataccgaagagtaagatctgggagcggtagcattgacgacgaccgtgactccctgcccgaatggtgcctggaggatgccgaagaagagatggggactttcgactcatctggagcttttttatctctgaaaaaagtccaaaaggaacctatccctgaagaacaggagatggacttccgaccagtggatgaaggcgaagaatgttcagactctgaagggtcccataacgaggaagccaaggaaccagataagacaaacaagaaagaaggcgaaaaaacagacagagtcggtgtggaggcgtcggaagaaacaccacagacctcttcatcttcagctagaccaggtacaccttcagatcaccagagtcaagaagcatcacagtttgagcgaaaggacgaaccaaagacggaacaaaccgagaaagcagaagaggagacgaggatggagaactccttgccagctaaggtgccatccaggggcgatgagatggttgcagatgtgcaacagccgctgtcccagatcccaagcgataccgcatcgcccctcctgatacttccccctcccgtgccgaacccatctcccacgctccggccagtagaaacaccagtggtgggcgcccccggaatgggatcggtcagcacggagcctgatgacgaggaggggctgaagcacctggaacagcaggccgaaaagatggtagcttacctgcaggattctgccctcgatgacgagcggctggcttcaaagcttcaagaacaccgagctaagggggtatcaatccccctcatgcatgaggccatgcagaagtggtattacaaggacccacaaggcgagattcaaggacccttcaacaatcaagaaatggccgagtggtttcaggcgggttactttactatgagtttgcttgtcaagcgtgcatgcgatgaatcatttcagcccctgggggatataatgaaaatgtggggaagggtgccattctcacccggcccagctcctccgccacacatgggagagcttgatcaagagcggttgaccaggcagcaggaactgactgcgctgtaccagatgcagcacctgcaataccagcagttcctgatccagcagcagtatgcccaagtgctggcacagcagcagaaggccgccctgagcagccaacagcaacagcaactagccctgctgttgcagcagttccagacactcaaaatgcgaatatctgatcagaatattatccccagtgtgactagaagcgtctctgtgccggacacaggatcaatatgggagctgcagcccaccgcctctcagcccaccgtttgggagggaggctccgtttgggacctccccttagacacgaccacccccgggcctgcattggaacagctacagcaactggagaaagctaaagctgccaaattggaacaggaacgcagagaggctgagatgcgcgcaaagcgggaagaggaagagaggaaaaggcaggaagagctgcggaggcagcaggaggagatcttgcgtagacagcaggaggaagagaggaagcgaagagaggaggaggagctggcccgcaggaagcaggaggaagcactaaggcgccaacgtgagcaggagatagcactgaggagacagcgggaggaggaagagaggcagcagcaagaagaagcacttcggaggcttgaggagagacgccgcgaagaggaggaacggagaaaacaagaggagctgcttcggaagcaggaggaagaggcagcaaagtgggcccgcgaagaggaggaagcgcagcgtcggctcgaggagaacaggcttaggatggaggaagaagcggcccggctccggcatgaagaggaagagcggaaacggaaggagctggaggtgcagcgtcagaaagagctcatgagacagcgccaacagcagcaggaagctctccgtcgacttcagcagcagcagcagcaacagcagcttgcccagatgaaactgcctagctcatctacctggggacaacaaagcaacacaacagcatgccagtcgcaggctacgctgtcgctcgctgaaattcagaagctggaggaggaacgagaaagacagctgagggaggaacagagaaggcaacagcgcgaacttatgaaagcattgcagcagcagcagcaacaacagcaacaaaagttatctgggtggggcaatgtttccaaacctagtggcaccactaagtcactgctggagatccagcaggaagaggcccgacagatgcagaaacagcagcagcagcagcagcagcaccagcagccgaaccgcgctagaaataacacccatagtaatctgcacacatccattgggaactccgtctggggcagcatcaacacaggcccacctaatcagtgggcatccgatttggtgagcagtatctggtccaatgcggatactaaaaattcgaacatgggtttttgggatgacgccgtgaaagaggtcggccctaggaactcaacgaataagaacaagaacaatgcaagtctgagcaagtctgttggcgttagcaataggcaaaataagaaagtagaggaagaggaaaagctgcttaaactgttccagggcgtcaataaggcacaggacggatttacacagtggtgcgaacagatgctccacgccctcaacaccgcaaataacctcgacgttcctactttcgtgtccttcctcaaggaagtggagtcgccctatgaagttcacgactatattagagcttacctgggggacacttcagaagccaaagagttcgccaagcaatttttggagagacgagccaagcagaaggccaaccagcagaggcagcaacagcaactaccacagcagcagcagcaacagcctccacagcagccccctcagcaaccacagcagcaggatagcgtctggggaatgaaccatagtacattgcactctgttttccaaaccaaccagtctaacaaccagcaaagtaacttcgaggccgttcaaagcgggaaaaaaaagaagaagcagaagatggtcagggcagatccatccttgctaggattctccgttaacgcaagttcagagcgtctgaacatgggagaaatcgaaactctcgacgactattag

SEQ ID NO: 189810 - DNA, 3900 bp, Artificial Sequence
  Description of Artificial Sequence: Synthetic coding sequence
atggccgccgagacccagaccctgaacttcggccccgagtggctgcgcgccctctcatcaggaggctccatcacatcacccccgctttcacctgcactgcccaaatataagctggctgactatcgatatgggagggaggagatgctagcactgttcctcaaagacaataagataccctcagacttgctcgataaagaattcctgccaatattacaagaggaaccacttcctccactcgctctcgttccatttactgaagaggagcagaggaatttcagcatgagcgtgaacagtgctgcagttctgagactgaccgggagaggcgggggtggaactgtggtgggggctccacgtggcagaagttcatctagggggaggggaaggggccgaggcgaatgtggcttttaccagcggtctttcgacgaagtggagggagtttttggacggggcggtggccgagagatgcacaggtctcagagttgggaagagaggggagaccgccgcttcgaaaaaccagggaggaaagacgtcggccggcctaattttgaagaaggcggccctacttctgtggggaggaaacacgagttcatcagatccgaatctgaaaactggaggattttccgcgaggaacaaaatggggaggatgaggacggcggctggagactcgccgggagtaggcgggacggggaacggtggcgccctcattctcccgatggccctcgcagtgcggggtggcgggagcacatggaaagacgccgccggttcgagttcgacttccgtgatcgcgacgacgagcgcggctatagaagggtcaggtcaggctcaggttctatcgacgacgatagggactcattaccagagtggtgtctggaggacgccgaggaagagatgggcacctttgatagtagcggcgcattcctaagcttaaaaaaggtgcagaaggagcccatacccgaagaacaagaaatggactttcgcccagttgacgaaggggaagaatgtagcgacagcgaaggatcccataatgaggaggcaaaagagcccgataaaactaacaaaaaagaaggagagaagaccgatagggtaggggttgaggcctcagaagagacaccccagacatcctcaagctccgccagacctgggaccccgagcgatcaccagtcccaggaggcctctcagtttgagcggaaggacgaacccaagacagaacagactgagaaggccgaagaggaaactagaatggagaactcgctacctgcaaaggtgcctagccggggcgacgagatggttgccgacgtgcagcaacccctctctcagataccgagcgataccgcgtctccccttttaatcctgccccctcccgtcccaaaccccagcccaaccctcagacccgtggaaacaccagtggtgggcgcacctggaatgggatctgtatcaaccgaacctgacgatgaggagggattaaagcatcttgagcagcaggctgagaagatggttgcttatcttcaggactccgctctcgacgacgagagactcgcttcaaagctacaagaacaccgggctaagggtgtaagtataccccttatgcatgaggccatgcaaaagtggtactataaagatcctcagggggagattcaaggacctttcaataaccaggaaatggcagaatggtttcaggcaggctacttcactatgtcactgctcgtaaaacgagcttgcgatgagagctttcagcccctgggcgatatcatgaagatgtggggcagggtgccattttcacctggcccggcacctccaccacacatgggggaactggatcaggagcggcttacccgccaacaggagctgactgccctgtatcagatgcagcatttgcagtatcaacagttcctgatccagcagcagtatgcccaagtgcttgcccagcaacaaaaagccgcactctcttcccagcagcagcagcaattagcgctcctgctccagcagtttcaaactctgaaaatgcgcatttccgaccagaacatcattccatccgtcacgcggtcggtcagtgtgccagacacaggatccatttgggagctgcagccgacggcctcgcagccaacagtgtgggaaggtggatccgtgtgggaccttccactagacaccaccacgcccggtccagctttggagcagctccagcaattggaaaaagctaaggctgcgaaactggagcaggaacgaagagaggccgaaatgagagccaagcgggaagaggaggagcggaaaaggcaggaagagcttcgacgtcagcaagaagagatacttcggaggcagcaggaggaagaacgcaagcgcagagaggaagaggagcttgctcggcggaagcaagaggaggcgttaaggagacaaagagagcaggagattgcattgcgacgtcagcgagaggaagaagaaaggcagcagcaggaggaagcactccgacgcctggaagaacgtcggagagaagaggaggagaggcgcaaacaagaggagctcctgcggaaacaggaggaggaagcagccaagtgggctcgggaggaagaagaggcccagcggcgcctggaagaaaatcggttgcgtatggaggaggaggccgcccgcctcaggcacgaagaagaggaacgcaaacggaaggagctagaagtccagcgacagaaggagctgatgcggcaacggcaacagcagcaagaagctcttcgtaggctgcagcagcagcagcagcaacagcagctcgcacagatgaagctcccatcctctagcacatggggccagcagagtaacaccactgcctgtcagagccaggctacactctccctcgccgaaattcagaaacttgaggaagagcgtgagagacagctgagggaagagcagagacgtcaacagcgagagctaatgaaggcactccagcaacagcaacagcaacaacaacagaagctatctggctgggggaacgtgtcaaagcctagtggaaccaccaaatcccttctggagatccagcaggaggaggcaaggcagatgcaaaaacagcaacagcagcagcagcaacaccaacaacccaatagagctcgaaataacacccattctaacctccatactagtatcggcaactccgtttggggatcaattaataccggtcctcctaatcaatgggcctctgatctggtgtccagcatttggagcaacgcagacaccaaaaattcaaacatgggattttgggacgatgcagttaaggaggtggggcctagaaactcaacaaacaagaataaaaataatgcttccctttctaagtccgtgggtgtgagcaatcgccagaataaaaaagttgaagaggaagagaagctgctcaagctgttccaaggcgttaataaagcacaggatgggttcactcagtggtgtgagcagatgctgcatgcattgaataccgcgaataatctcgatgtgccgacgttcgtgtctttccttaaagaggtcgaatccccatatgaggttcacgactatattagagcatatctgggagatacctcggaggctaaggaatttgctaaacagttcttggagcgccgcgccaagcagaaagccaatcagcagaggcagcagcagcagctcccccagcagcaacagcaacaaccgcctcagcagcctccacaacagcctcaacaacaggactctgtctggggcatgaatcattccacacttcactccgtttttcagacaaaccagtcgaataatcaacaaagtaacttcgaggctgtccagtccggcaagaaaaaaaagaaacaaaagatggtcagagcggacccatccctgttgggtttctccgtgaatgccagttccgaaaggctgaacatgggagagattgaaacattagacgattattag

SEQ ID NO: 189811 - DNA, 2163 bp, Artificial Sequence
  Description of Artificial Sequence: Synthetic coding sequence
atggccgccgagacccagaccctgaacttcggccccgagtggctgagggctctgtcaagcggggggtctattacttcacctccactgagtccagcactgcccaagtataaattagcagattatcgttacggacgcgaagaaatgttagccttgttcctgaaagacaataaaatcccatccgaccttctcgacaaggaatttttacctatattacaggaggagccactgcccccacttgcgctggtgccatttaccgaggaagagcaacgcaatttttcaatgagcgttaactctgcagccgtgttgagactgactggccgaggagggggcggaacagtcgttggagctcccagaggtcgctcctcaagccgaggccgaggcaggcccaatttcgaagaaggagggcccacctccgtgggtcgtaagcatgagttcataagatcagaaagcgaaaattggagaattttcagagaagagcaaaatggcgaggacgaagatggtggatggaggctggcggggtccaggagggatggcgaacggtggcggcctcattccccaggctggcgggagcatatggagcgtcggaggagattcgaattcgacttcagggacagggatgatgagagaggctataggcgggtacggagcggcagcgggtcaatcgatgacgatcgggattccctgcctgagtggtgtctcgaggatgccgaggaagagatgggcacgtttgacagtagtggcgcgttcctcagtctgaaaaaagttcagaaagagcctattcccgaagaacaagaaatggatttccgcccagtagatgagggggaagagtgttctgattctgagggctcccacaatgaggaggctaaagaaccagacaagacaaacaaaaaagagggggagaagaccgatcgggtgggcgtggaagcgtctgaggaaaccccacaaacttcttcctctagcgcacgacctggtacacccagtgatcatcagtcacaagaagcgagccagtttgaaaggaaggatgaacccaaaactgaacagactgaaaaagctgaggaggagactaggatggagaactcattgccagctaaagtgccttctaggggcgacgagatggtggcagacgtgcagcagcccctcagccagattccctcagacacggcatcgccgctgctgatcctgccaccgccagtgccaaatccctcccccactctgaggcccgtggagactcctgtcgtcggagcgcctgggatgggatccgtttccacggagcccgacgatgaggaaggtcttaagcaccttgagcagcaagcggaaaagatggtggcctacttgcaggactctgcccttgatgacgaacgcctagcctcgaaactgcaagagcaccgcgcaaagggagtctcgattcctctaatgcacgaggctatgcaaaagtggtactacaaggacccccaaggcgagatacaaggcccctttaacaaccaggagatggccgagtggttccaggccgggtactttacaatgtccctgctggttaaacgggcttgtgatgagtccttccaacctctgggtgatattatgaaaatgtggggcagagtgcccttttctccaggacccgccccaccacctcacatgggggagctggatcaggagagactgactcgccagcaggagctgacagctctctatcaaatgcaacacctccagtaccagcagttcctgattcaacaacagtatgcccaagtgcttgcccaacaacaaaaggccgcattgtctagccagcagcagcagcagttagccctgctgcttcagcagttccagaccctgaagatgagaataagtgatcagaatataattccatctgtgacaaggtctgtgtccgtgccagacaccgggtcgatttgggagttacagccaacggccagccaaccaaccgtttgggaggggggaagcgtgtgggatttaccactggataccaccacacccggaccagccctggaacagctccagcagttggagaaggccaaagcagccaaactcgaacaggagcgtagggaggccgagatgagagctaagcgcgaagaagaagagcgcaagcggcaggaggagctcaggagacaacaggaagaaatcctgcgcagacagcaggaagaggaaagatag

SEQ ID NO: 189812 - DNA, 282 bp, Artificial Sequence
  Description of Artificial Sequence: Synthetic coding sequence
atggccgccgagacccagaccctgaacttcggccccgagtggctgcgcgccctgtcctccggcggctcgataacctccccgcccctgagccctgctttgccaaagtataagctagctgattacagatatggccgggaggaaatgctcgccctcttcctgaaagacaataagatacctagcgatctgttagataaggaattcctgcctattcttcaggaagaacctctcccaccactggccctggtgcccttcacagaggaagagcagaggaatttttcatag

SEQ ID NO: 189813 - DNA, 303 bp, Artificial Sequence
  Description of Artificial Sequence: Synthetic coding sequence
atggccgccgagacccagaccctgaacttcggccccgagtggctgcgagccttaagctccggtggctcaattacatccccacccttatcccccgccctgcctaagtataagctagctgactatcgttatggccgggaggagatgctagccctgttcctgaaggacaataaaatccccagtgatctgctggataaggagtttctcccaatcctgcaggaggaaccgcttccacccctggctcttgttccatttactgaggaagaacagcggaacttctctatgtcagttaacagcgccgcatag

SEQ ID NO: 189814 - DNA, 42 bp, Artificial Sequence; identical to SEQ ID NO: 83620
  Description of Artificial Sequence: Synthetic coding sequence

SEQ ID NO: 189815 - DNA, 348 bp, Artificial Sequence
  Description of Artificial Sequence: Synthetic coding sequence
atggccgccgagacccagaccctgaacttcggccccgagtggctgagagctctctcctccggtggatcaatcacaagcccaccgctgtctcctgcgctgcccaagtacaagctggctgattaccggtatggaagagaggagatgctcgccctgtttcttaaggataacaagatcccaagcgaccttctcgataaagaatttttgcccatcctacaggaggaaccgttaccgccgcttgctttagtaccttttacagaagaggaacagagaaactttagtatgagcgtgaattccgcagcagtccttaggctgactggccggggtggagggggaaccgtggtcgggtag

SEQ ID NO: 189816 - DNA, 321 bp, Artificial Sequence
  Description of Artificial Sequence: Synthetic coding sequence
atggccgccgagacccagaccctgaacttcggccccgagtggctgcgagctttgtccagcggaggatccattacctcccccccgctctcccctgctttgcctaagtataaattggcggattatcggtacggacgggaggaaatgctggcgctcttcttgaaggataataaaatccctagcgatctgttggacaaggagttcctgcctatcttgcaagaagagcctttaccacccctggccctggtgcccttcaccgaagaagagcagcggaattttagtatgtcggtgaattccgccgccgtactcagactaaccggctag

SEQ ID NO: 189817 - DNA, 342 bp, Artificial Sequence
  Description of Artificial Sequence: Synthetic coding sequence
atggccgccgagacccagaccctgaacttcggccccgagtggctgagagccctgtcatccggggggtccataacaagcccccctctgtctcccgccttacctaagtataagttggcagattacaggtacggacgggaggaaatgttggccctgtttttaaaagacaataaaattccgagtgacttgttggataaggaattcttgcctatcctacaggaagaaccacttccgccattggccctggtgccttttactgaggaggagcagcggaatttcagtatgtctgttaatagcgctgccgtgttgcgcctgaccggtcgcggcggcggcgggaccgtttag

SEQ ID NO: 189818 - DNA, 2619 bp, Artificial Sequence
  Description of Artificial Sequence: Synthetic coding sequence
atgaccaagctgcccgacgaccccggccggcccaacttcgaggagggcggacccactagtgtggggagaaagcatgagttcatccgatccgaaagtgaaaattggcgtatttttcgagaagaacaaaatggagaggatgaggacggaggttggaggcttgcaggcagtcgcagagacggcgagcggtggcgtccccactccccagatggcccacgctcggctggttggagggagcacatggagcgtaggcgccgcttcgagtttgactttagagatcgggacgacgagagaggataccgacgagtgagatcagggagcggatccatcgatgatgatagggacagccttcctgaatggtgcctggaggatgcggaggaagagatggggacctttgatagttctggggctttcctgagcctaaaaaaagtacaaaaagaacctatacccgaggagcaggagatggacttcaggccagtggatgagggggaggaatgttccgactccgaagggagccataatgaagaggctaaggaacctgacaaaaccaataaaaaggagggcgagaaaaccgatcgagtgggggtcgaggcttcagaagagactccacaaacaagctccagctctgcaaggcccggaacacctagtgaccaccagagtcaggaagcctcccaattcgagcgcaaggatgaaccgaaaaccgaacagacagagaaagccgaggaagagacacgtatggaaaactctctgccagccaaggtgccttcgcgcggggatgaaatggtcgctgatgtacaacaacctctttctcagatccccagtgatacagcatcacctctgctgattctgccgccacctgtcccaaatcccagtcctacgttgcgcccagtagagaccccagtggtcggtgctcccgggatgggctcagtgagcacagagccagacgatgaggaaggcctcaaacatctggaacagcaggcagaaaaaatggtcgcctatctgcaggattccgctctggacgacgagcgcctggcctctaagttacaggagcacagagccaagggggtttcgatcccactgatgcacgaggcgatgcagaaatggtactataaagacccccaaggtgagatccaaggaccctttaacaatcaggaaatggcagagtggtttcaggcaggttatttcaccatgtcgctgctggttaagagagcttgtgacgaatcattccaacccctaggcgatatcatgaaaatgtggggtagggtgcctttctcacctggccccgccccacctccgcacatgggggaacttgatcaggagaggctgacacgacagcaggagctgactgcactctatcagatgcagcacttgcagtaccagcaattcctcattcagcagcaatatgctcaggtgctcgctcagcagcagaaagcagcattgagctctcagcagcagcagcagctagccctcttgctgcagcaattccagactttaaaaatgcgcatcagcgatcagaatatcattcccagcgtgacacggagcgtatccgtgcccgacacgggcagcatatgggaactccagcctaccgctagccagcccactgtttgggaggggggctcagtgtgggacctgccacttgataccactacgccaggtccggctctggaacagctccaacaattggagaaagccaaggcagctaagcttgagcaggagaggcgtgaggccgagatgagagccaagagagaggaggaagaacgcaaacgacaagaggagctgcgccgtcagcaggaggagattctccggaggcagcaggaagaggaacggaaaagaagagaggaggaggaactcgcaaggcgcaaacaggaagaagcgctgaggcggcaaagggagcaagagatcgcattacgcaggcaacgcgaagaggaggagaggcagcagcaagaggaggctttgaggcggctggaggagcgacgtcgggaggaggaagaacgacgcaaacaggaggagctgctaagaaagcaggaagaagaagccgctaaatgggctagggaggaggaggaggcccagaggcggcttgaggagaacaggctgcggatggaagaagaagccgccaggctcagacatgaggaggaggagagaaagcgcaaggaactggaagtccagagacagaaagagctgatgcggcagcgccagcagcagcaggaagcgctgcgcagattacagcaacagcagcaacaacagcaactggcccagatgaaacttccaagctccagcacatggggccaacagtctaatacaacagcatgtcagtcgcaggccaccctgagtctggcagagattcaaaagcttgaagaagagcgcgaaagacagctgagagaagaggaatcctcggccagtttctgcttttatgccaccgctaaggcccccgctgagggagtggacgagagttcttcagcagctgctgcaacagccaccgctgagaccttgcgtctcggggaatgccagcagacctttcgctaccacgaaatatcctcaggggatcctgctgggcgggggcaggctaatgcaaaggctgctgcagcagctgccgcaacacctgccactaagcaatcttcttag

SEQ ID NO: 189819 - DNA, 2364 bp, Artificial Sequence
  Description of Artificial Sequence: Synthetic coding sequence
atggccgccgagacccagaccctgaacttcggccccgagtggctgcgcgccctctcttcaggcggcagtatcaccagccctccgctgagtcccgctctgccaaagtacaagctcgctgattatcggtacggccgggaggaaatgctggcgctattcctgaaagataataagatacctagcgatctgctggacaaggagttcctgccaatactccaggaagagcccctaccgccgctggccctggtcccattcaccgaagaagagcaaagaaacttcagcatgtctgttaattccgccgccgtgctaagactcactggaagaggcggagggggcaccgtggtaggcgcccccaggggccggagctcgtctcggggtaggggccgggggagaggagagtgcggcttttatcagcggagctttgacgaagtggaaggggtttttggcagaggtggtggccgggagatgcatcgctctcagagctgggaggagaggggagaccgccgtttcgaaaaaccaggccgcaaggacgtgggaaggccgaacttcgaagagggagggcccaccagtgtgggcagaaagcatgaattcattagatcggaatccgagaactggcggatcttccgtgaagaacaaaatggggaagatgaagacggcggttggcgtctggccggttcacgcagagacggagagcggtggcggccccactcacccgacgggcccagatctgccggttggagagagcacatggagcggaggcgaagatttgaatttgacttcagagatcgagatgacgaacggggctacaggagggtgcgttctggtagtggatctattgatgatgatcgggactctttgcccgaatggtgcttggaggacgccgaagaagaaatgggcacttttgattctagcggagcgttcctgtccctcaagaaagtccagaaggaacccatcccagaagagcaggagatggactttcggcctgtggatgaaggagaagagtgtagcgattctgaggggtcgcataatgaggaggcaaaggaacctgataaaactaataaaaaagagggcgagaagaccgatagggtgggcgtggaagccagcgaggaaaccccccagaccagctcttcatccgcgagacctggcacacccagcgatcatcagtctcaagaagcaagccagttcgaacgcaaggacgaaccaaagaccgaacagaccgaaaaggctgaggaggaaactcggatggagaactccctcccagcaaaagtccctagtcgcggagatgagatggtcgctgacgtgcagcagcctctcagccaaataccttccgataccgcatccccactactcattcttccccccccggtgcccaatccaagtcctactctccggcccgtagagacacctgtggtcggcgctcccggaatgggttccgtttctacggagcccgacgacgaggagggccttaagcatttggaacagcaggccgagaagatggtcgcttacttgcaagattcagcactggatgatgagcggctagcttcaaaattacaggagcaccgcgcaaaaggagttagcattcccctcatgcacgaggcaatgcagaagtggtactacaaggatccacagggtgaaatacagggacctttcaacaaccaagagatggcagagtggtttcaggccggctacttcaccatgagccttctggtgaagcgggcatgtgacgagtcttttcagccactaggcgacatcatgaaaatgtggggccgggtacccttctccccaggacccgctccgccaccacatatgggagagcttgaccaagagaggctaacgcggcaacaggaacttacagcactgtatcagatgcagcacctacaatatcaacagttcttgattcagcagcagtacgcccaagtgctggctcagcaacagaaggccgctctgtcaagccagcagcagcagcagttggcattgctccttcagcagttccagacactgaagatgcgcatctctgaccaaaatattattccatccgtcacacgctccgtgtctgttcccgataccgggtcaatctgggagcttcagcccaccgcaagccaaccaactgtctgggaaggaggttcggtgtgggatctccctttagacaccacaactccaggcccagccctggagcagctgcagcaattagaaaaagctaaggcagcgaagctagagcaggagagaagggaagccgagatgcgggcaaagcgggaggaagaagagagaaagaggcaggaggagctgagacgccagcaggaggagattctgagacgccaacaagaggaggagagaaaacgaagagaagtggggaaaagggattcatag

SEQ ID NO: 189820 - DNA, 3882 bp, Artificial Sequence
  Description of Artificial Sequence: Synthetic coding sequence
atggccgccgagacccagaccctgaacttcggccccgagtggctgcgtgcattgtcctctggtggatctataacctcgcccccgctcagccctgccctccctaagtataagttggctgattatcgctacggtcgggaagagatgctggctctgttcctaaaagataataagattccttctgatctcttagataaggaattcctcccaatcctacaagaagaacctctgccgcctctcgcgctggtcccctttaccgaagaagagcagcgcaactttagcatgtctgtcaactctgccgccgtcctgcgactgactggccggggagggggcggaaccgtagtcggggctcctagaggacgaagttcttcccgcggtcggggccgaggacggggagaatgcggtttctaccagaggtcctttgatgaagttgagggagtgttcggacggggagggggtcgggaaatgcacagatcgcagagctgggaggagagaggggacagacgctttgaaaaacctggtaggaaagatgtcgggaggccaaactttgaggaaggcggcccaacgtcagttggaagaaaacacgagttcattaggtccgaatccgaaaattggcgtatcttccgagaggaacaaaacggagaagacgaggacgggggatggagactggcaggatcaaggcgggatggcgagcgttggagaccccactctcccgggtggcgcgagcacatggagcggaggagaagattcgagttcgactttcgtgaccgggatgatgagcgcggttacagaagggttcgctccggatctggcagcattgatgacgaccgggatagcctcccagaatggtgcctcgaggacgccgaagaggaaatgggtacgtttgactcatcgggcgcctttctttccctcaagaaggtccagaaagagcccattcccgaagaacaggagatggatttcagacccgtagacgagggagaagaatgtagtgactccgaaggttcccacaatgaggaggcgaaggagcccgataagactaataagaaggagggagagaagaccgacagggtgggggtggaagccagtgaagagacgccccagacttcctcctctagcgctcggccagggacgccttctgatcaccagtcccaagaagctagccagtttgagagaaaagacgaaccaaaaacagaacagacagagaaggctgaagaagagactcgcatggagaatagccttccagccaaggttccttctagaggagatgagatggtggccgatgtccagcagccgctttctcagattcccagcgataccgcatctccactgctgattctgccaccgccagtccctaaccccagcccaaccctgagaccagttgagactcccgttgtaggggcacctggcatgggctctgtttcaaccgagcccgacgacgaggagggcctgaaacacttggaacaacaggctgagaaaatggtggcatatctgcaagatagtgccttagacgatgagcgcctggcctcaaagttgcaggaacacagagccaagggggttagcattcccctgatgcatgaagccatgcaaaaatggtactataaggacccccaaggagagattcagggcccattcaacaaccaggagatggctgagtggttccaggcagggtattttacaatgtcactcctggtcaagagggcctgcgatgagtcctttcagcctctgggagatattatgaagatgtggggccgtgttccattctccccaggccccgcaccccctcctcacatgggcgagctggatcaagagagacttacccggcagcaggagctgacggccctttaccagatgcagcacctccagtaccagcagttccttattcagcaacagtacgctcaggtgctggcgcagcaacagaaagcagccttgtccagccagcaacaacagcagctggctttgttgctgcagcagtttcagacactgaagatgcggatatcagaccagaacattatcccgtcagtgacccggagcgtctccgtgcccgacacggggtctatctgggaacttcagcctactgcctcccagccaacggtgtgggaagggggttccgtgtgggaccttcccctcgataccacgactccaggacccgccctggagcaactgcagcagctggaaaaagccaaggccgccaagcttgagcaggaaaggagggaagcagagatgcgcgctaaaagggaggaggaggaacggaagcgccaagaggagttaagaaggcagcaggaagagattctgagaagacagcaggaggaagaaaggaaacggcgcgaagaggaggagttagctcgtagaaagcaggaagaagcattgaggcggcagcgcgagcaggagattgctctgaggcgacaacgcgaggaggaggaaaggcagcagcaggaagaggcactgcgacgactagaggagcggagacgcgaggaagaggagcggagaaagcaggaggagctcttgagaaagcaagaagaggaggccgcaaagtgggcgcgagaagaagaggaagctcagagaagacttgaagaaaatcgccttagaatggaagaagaggcagcacggctgcggcacgaagaggaggagcgtaaacgcaaagaattggaagtccagaggcagaaggagctcatgcgacagcggcagcagcagcaggaggcgctacgaaggctccagcagcagcagcaacagcagcagctggcccagatgaaactgccctcctcatccacttggggccagcagtccaatactacagcgtgtcagagccaggctaccctgagtctggcggaaatacagaagctcgaggaggaacgtgagcgccaactgcgagaggaacagaggcgccagcagagagagctaatgaaagccttgcagcaacagcaacagcagcagcagcagaaactcagtggctggggcaacgtgtcaaaaccatctggtactacaaagtccctgctggagatacagcaggaagaagcccgtcagatgcagaagcaacagcagcagcagcagcaacaccagcagccaaatcgcgcccgcaacaatactcacagcaatttacacacatccatagggaactctgtttgggggagtatcaacaccgggccccctaatcagtgggcctctgatctggtgtcaagcatttggtcgaatgccgacaccaagaactccaacatgggattctgggacgatgcagttaaagaggtgggccccagaaactccaccaataagaacaaaaataatgcctccttgtccaagtcggtcggcgtgtccaatcgtcagaataagaaagtggaggaagaggagaagctgcttaaacttttccagggcgtgaacaaggcgcaggatggattcacacagtggtgtgagcagatgttgcacgcccttaatactgcaaacaatctggacgtgcctacttttgttagctttctcaaggaggttgaatctccatatgaggtgcacgactacataagggcatatctgggggatacttcagaggctaaagaatttgccaagcagtttttggagaggagggctaagcagaaggccaatcagcagcggcagcagcagcagcttccacagcagcaacagcagcagcccccgcagcagcctcctcaacagcctcagcaacaggattcagtttgggggatgaatcacagtactctgcattccgtgttccaaacaaatcaatccaacaaccagcagtccaacttcgaagcagtgcagtcgggaaagaaaaagaaaaaacagaaaatggtgagggcagatcccagccttttagggttctcagtgaatgcctccagcgaacgccttaatatgggggaaatcgagacgctggacgactattag

SEQ ID NO: 189821 - DNA, 3963 bp, Artificial Sequence
  Description of Artificial Sequence: Synthetic coding sequence
atggccgccgagacccagaccctgaacttcggccccgagtggctgagggccttgtcttcaggaggttcaatcacctctcctccactcagccccgctttacctaaatacaagctcgccgattacaggtatggaagggaggaaatgctcgctctgtttttgaaggacaataagatacctagtgatctgcttgacaaggagttcctccctatcctccaggaagaacctcttcccccattggctcttgtgcccttcacagaagaggaacagcggaacttctctatgagcgttaatagtgcagctgtgttgagactgacgggccgcgggggtggcggcacggtggtgggcgccccgcgagggaggagttcctcacgagggcgggggagaggacgcggtgagtgcggtttttatcaaaggagttttgacgaagtggagggcgtgtttggacgcgggggagggagggaaatgcatcggagtcaaagctgggaagagcgaggggaccggagatttgagaagccaggccggaaagacgtagggaagaagaatggatactactgcatgtattctccagttctgctgctggggcaacctctgtgtcagggcaggccaaacttcgaggaaggggggcccaccagtgtgggccgcaagcacgaatttatacggagtgagtcagagaactggcgcatctttcgcgaggaacaaaacggagaggacgaagacgggggatggcgtttggctgggtctcggcgcgatggtgaacgctggcgacctcatagtcccgatgggccaagaagcgcaggttggcgggaacatatggaacgccgccggaggtttgagttcgatttccgggatagagatgatgaacggggctaccggagggtgcgctctggttctggctccatcgatgacgatcgggattctctgcccgaatggtgccttgaggacgcagaagaggaaatggggacatttgactcttccggagccttcctttccctcaagaaagtacaaaaagaacccattcctgaggaacaagagatggactttcgacctgtagatgagggggaggagtgcagcgacagcgaaggctcacacaatgaagaagccaaggaacctgacaaaacaaacaagaaggaaggcgaaaaaacggatagagtgggagtggcttcagaagagacaccacagaccagttcttcctctgcccggcccggaaccccatctgaccaccagtcacaagaagcttcccagttcgagcgcaaagacgagccaaaaaccgagcaaaccgagaaggccgaggaggagacccgaatggaaaactctctgccagccaaagtcccttcccggggcgacgagatggtcgctgatgtgcagcaaccgcttagtcagatcccaagcgacaccgctagcccgctcttgattttgcctccacctgtgcccaacccttcccctacactgcgccccgtggagacaccggtggtgggcgcgcccggcatgggttctgtctcaaccgagcccgacgacgaggagggcctgaagcacttagaacagcaggccgaaaagatggttgcctatctgcaggatagcgccctggacgatgaacgcctggcatccaaattgcaagagcacagggctaagggtgtatcaattcctcttatgcacgaagctatgcagaagtggtactacaaagaccctcaaggcgaaatccagggtcccttcaacaaccaggaaatggctgaatggttccaggcggggtactttaccatgtcactcctggtgaagcgagcctgtgatgaaagttttcagccactgggagacatcatgaagatgtggggcagagtgccttttagccccggacctgcccccccacctcacatgggcgagctcgaccaggagagactgacccgccagcaggaattaacagccttgtaccagatgcagcacctgcagtaccagcagtttctgatccagcagcagtacgcccaggttttggcccaacaacaaaaggccgcgctgagttcccagcagcagcagcagttggcactgttgctccaacagtttcaaacactgaagatgcggatttctgaccagaatatcataccttccgtgactcggagcgtttcagtgcctgacacaggctcaatttgggagcttcaaccaacggcctcgcagcctactgtctgggagggcggatctgtgtgggatctgccccttgatactacgacacccggtcccgctttggagcagctgcagcagctcgaaaaggctaaggcagctaagctagaacaggagagacgggaggccgaaatgcgggccaagcgggaggaggaggaaagaaagcgtcaggaggagctccggcggcaacaagaggaaatactccggaggcagcaggaggaagaaagaaagaggagagaagaagaggagctggctaggaggaagcaggaggaggccctccgccggcagagggaacaggaaattgcactgagacgtcaacgcgaagaggaggagcgacaacagcaagaagaggccctacggcggctggaagagcgccgccgagaggaagaggaaaggcgtaaacaggaagagctcctgagaaaacaggaagaggaggccgccaagtgggcaagggaggaggaagaggctcagaggcgacttgaagaaaacagattgcgcatggaagaggaagcggcccggttgagacacgaggaggaagaacgtaagcgcaaagaactggaggttcagcggcaaaaggagttaatgagacagcggcagcagcagcaggaggcccttagaaggttgcaacagcaacagcaacaacaacagctggcgcagatgaaactgccaagcagctccacgtggggacagcagtcaaacaccaccgcctgccagtctcaagcgaccttgtccctggccgaaattcagaagttagaagaggagagagagagacagctgcgtgaggagcagaggcgccaacagagggaactgatgaaggcactccagcagcagcagcagcagcagcagcagaagctgtccggctggggcaacgtgtctaaaccctcgggcactacaaaaagcctcctggagatccaacaggaggaagcgaggcagatgcaaaaacagcaacagcagcaacagcagcaccagcagccaaacagggctagaaataatactcacagcaatctgcacacaagtatcggtaactctgtatggggctcaattaatacgggccccccaaaccagtgggccagtgaccttgtatcttctatttggtccaatgctgataccaagaactcaaacatggggttctgggacgatgctgtgaaggaggtaggacctagaaattccaccaataagaacaagaataatgccagcctgtccaaaagcgtcggcgttagtaatcgacagaataaaaaggttgaggaggaggagaaactgctcaaactgtttcagggagtgaataaagcgcaggacggattcacccagtggtgtgagcaaatgcttcatgcgcttaatacagccaataatctcgacgtacctacttttgtatctttcctcaaggaagtggagtcaccatatgaggttcacgattacatacgggcctaccttggagatacaagcgaggctaaggagtttgctaagcaattcctggagaggcgagctaaacaaaaagccaaccaacagaggcaacagcaacaactgccacagcagcagcaacaacagcctccccagcaacccccccagcagccccaacaacaggattcagtttgggggatgaatcacagcactctgcattctgtgtttcaaacgaatcagtcgaacaaccaacagtcaaatttcgaggcagtgcaatctggtaagaaaaaaaagaaacagaagatggtccgggctgaccctagcctgctgggtttctcagttaatgcctcctccgaacggctaaacatgggggagatcgaaaccctggatgactactag

SEQ ID NO: 189822 - DNA, 2085 bp, Artificial Sequence
  Description of Artificial Sequence: Synthetic coding sequence
atgagcggcggcgaggtggtgtgcagcggctggctgcggaagagcccccccgagaagaagctgaaaagatatgcgtggaagcggcgatggttcgtgttgaggtccgggcgattgacaggcgatcctgatgtactcgagtactataagaacgatcatgccaaaaagccaattaggattatcgacttgaacctgtgtcaacaggtggacgcgggcctgacctttaataaaaaggagtttgaaaacagctacatctttgacattaacactatcgatagaatcttctacttggtcgccgactctgaagaggagatgaataagtgggtgcgatgcatttgcgatatttgcgggttcaatccgaccgaggaagaccctgtcaaaccacccggaagttctctgcaggccccggccgacctccctctggctattaatacggcaccaccctctactcaggcagattcgagcagtgcgactctgcctcccccctaccagctgatcaatgttccaccacatttggagaccctgggaattcaggaggacccccaggattacctgctcttaatcaactgccaaagtaagaaacctgagcctacccgcacgcacgccgatagtgccaaatccaccagcagcgagacagactgtaatgacaatgtgcctagtcataaaaaccctgcctcaagccaaagcaagcatggcatgaatggtttctttcagcagcaaatgatctacgacagtccgcctagccgcgcgccatccgctagtgtggatagctctctgtacaatctgcctaggagttattcgcacgacgtactgccgaaggtatctccatccagtactgaggctgacggcgagctctacgtgttcaatacaccctcaggtacgagcagcgtggagacacagatgagacatgtgtccatttcttatgacataccccctaccccaggtaatacataccagatcccgcgcacgttccctgaagggactctgggacagacatccaaacttgatactataccggacatcccgccgccacgcccgccaaagccgcaccccgcacacgaccggtcgcccgtggagacctgctcgatccctcggacagcttccgacactgactctagctactgtattccaacggcaggcatgtctccatcaaggagtaacacaattagcaccgtggaccttaacaaactgaggaaggacgccagtagtcaggattgctacgacatccctcgggcttttcctagtgacaggtcctctagcctcgaagggtttcataaccactttaaggtgaaaaatgtactgaccgtggggtcagtgagcagtgaagagctcgacgaaaattatgtaccaatgaaccccaactcccctccacgacagcattccagttcctttaccgaacccattcaggaggctaactatgttcccatgactccgggcaccttcgatttttctagtttcggcatgcaagtgcctccccccgctcatatggggttcaggagcagtcccaaaactcctcctcggcgaccagtgcctgtcgctgattgtgagcctccccctgtcgatcggaatttaaaaccagacaggaaagttaagccagcaccgctagaaataaagcctctccctgagtgggaggaactgcaagcccctgtgagatccccgatcacccgctcatttgcgagagatagcagcaggtttccaatgagcccgcgcccagactcggtgcactccacgaccagcagtagtgacagccacgacagcgaggaaaactacgtcccaatgaatccaaacctgtcgtcagaggatccaaatctgttcggatctaattccttggatggcggaagcagtcccatgataaagccaaaaggggacaaacaagtggagtacctcgaccttgatctggattctggcaagagtactcctccccgcaagcagaagagcagcggatcagggtccagcgttgccgacgagcgcgtggactacgtcgttgtggaccaacagaaaacgctcgctcttaaatccacacgggaagcctggaccgatggtcgccagtctactgaaagcgagacgcctgctaaatcagtcaaatag

SEQ ID NO: 189823 - DNA, 2175 bp, Artificial Sequence
  Description of Artificial Sequence: Synthetic coding sequence
atgagcggcggcgaggtggtgtgcagcggctggctgcggaagagccctcctgagaaaaaactgaaacgatacgcctggaagagacggtggtttgtgttgcgatccggcagattgaccggcgatcctgacgtgctggagtactataaaaacgaccatgcaaagaagcctatacgaataatcgacctgaacctctgtcaacaggtcgacgcgggactgactttcaataagaaggagtttgaaaatagttacatcttcgacattaacacaatcgaccggatcttttatctcgtggccgacagtgaggaggagatgaacaagtgggttaggtgtatctgcgatatatgcgggtttaaccccacagaggaagaccccgtgaagccgccggggagtagcctgcaggcccccgccgacctgcctctcgcaattaatacggcgccgccgagtacacaggctgactcctcatccgctactctccccccgccgtatcaactgatcaacgtgcctcctcatctggaaactctgggaattcaggaggacccacaggattatctgctcttgatcaattgtcagtccaaaaaaccagagccaacacggacgcacgctgattcagccaaaagcacaagttccgaaacggactgcaacgacaacgtccccagtcataagaacccagcctcctctcagtctaaacatggaatgaacggatttttccagcagcaaatgatctacgatagcccaccaagcagggccccctcggcctctgtcgatagttctttgtacaacctcccacgctcctactcacatgacgtgttaccgaaagtttctccctccagcacagaggctgatggcgagctgtacgtgttcaacaccccctcaggtacaagctcggtggagacgcagatgcgccatgtgagtatctcttacgatatcccccctaccccgggtaatacttaccaaattccccgcacgttccccgaaggtacactgggtcagacgtcaaagctagacacaatccctgacattcctcctcctaggcctcccaagccacaccctgcacacgaccggtctcctgtagagacatgtagcatcccaaggacagctagcgacaccgacagcagctactgtattcccaccgccggaatgtcgcctagtagatcaaacactatttccacagtcgacctcaataagcttcgaaaagacgctagtagccaggactgctatgatatcccacgagctttccccagtgaccgcagctcgtcactggagggcttccataaccacttcaaagttaaaaatgtgcttacagtaggaagtgtgtctagtgaggaactggatgaaaactacgttcctatgaacccaaacagtcctccccggcaacactcgtcatctttcacggagcccatccaggaggcaaactatgtccctatgactcccgggacattcgacttcagctcattcggcatgcaagtgcctccccctgcccacatgggcttcaggagcagtccaaagactcctcctaggcgccctgtgcccgtggcggactgcgaaccccctcccgtggaccgaaacctgaagcctgacaggaaaggccagtcccccaaaattctgcggttgaagcctcacgggctcgagaggactgactctcagaccataggagatttcgctaccaggagaaaagttaagcccgccccactggagattaagcccttgcctgaatgggaggagctgcaggctcctgtaaggtcaccaattacacgcagcttcgcacgagactcctcaagatttcccatgtcccctagaccagatagtgtgcacagcactacttcaagtagcgactctcacgattcggaagaaaattacgtgcctatgaatcctaatctctcttcggaagaccccaacctgttcggaagtaattctcttgatgggggaagcagccctatgatcaaacctaagggcgacaagcaggttgagtatctcgatctggatcttgactccgggaagtccactccgcctcgtaagcagaaatcaagcggatccggatcctccgtggccgacgagcgtgtggattatgtggtggtagatcagcaaaagacactggcactaaagagtactcgcgaagcatggacggacgggaggcagtccacagaatccgagacccccgccaaatccgtgaagtag

SEQ ID NO: 189824 - DNA, 1776 bp, Artificial Sequence
  Description of Artificial Sequence: Synthetic coding sequence
atgaacaagtgggtgcggtgcatctgcgacatctgcggcttcaaccctaccgaagaagatcccgtgaagccgcccggcagcagcctccaggcgccagccgacctgcccctggctataaatactgcaccccccagtactcaggccgactcctcgagcgccacactccctcctccctatcagctcatcaatgtacctccacacttggaaacgcttgggatccaggaagatcctcaggactacctgctgcttatcaactgtcaatccaagaaacctgagcctacgcgcacccacgcagacagtgcaaaatctacatccagcgagactgattgcaacgacaatgtgccaagccataagaaccctgcaagtagtcaaagcaagcacggtatgaacggattcttccaacagcagatgatatatgactcaccaccaagccgtgccccgtctgccagcgtcgactctagcttatacaatctgcctcgaagttacagccatgacgtgctccctaaggtgtcacctagctccaccgaagctgacggagaactctacgtcttcaacactccgtccggtacatcttctgtggaaacccagatgcggcacgtcagcatatcctacgatatcccgcccaccccgggcaatacctaccaaatccctcggacattccccgagggaactttggggcagaccagcaagcttgataccatcccagacattccccctcctagacctccaaagccacatcctgcccatgatcgatctcctgtcgaaacgtgcagtatccccaggactgcatcggacacagactcgtcatactgtatacccactgctgggatgagccctagtaggagcaacacaatcagcactgtggatctgaacaaactgcggaaagacgcttcttctcaggattgttatgatattccccgggcattcccttccgacaggtcctcttccctcgaagggttccataaccactttaaggtgaagaatgttcttacagtcggatccgtgagctctgaggagctggacgagaactacgtgcctatgaaccccaatagccctccacgccagcattcatcaagcttcactgaaccaatacaggaggctaattatgtccctatgactcctgggacctttgacttcagtagcttcgggatgcaggtaccaccgcctgcccacatgggtttcagaagtagccctaaaacgccacccagaaggcctgtgcctgtggccgattgcgagcctccaccggttgaccgaaatctgaagcctgatagaaaagtgaaacccgcccccctcgaaattaaaccacttccggagtgggaggaactccaggcccccgtgcgaagtccaatcacacggtctttcgcccgtgattccagcaggttcccaatgtctccacgacccgatagtgtacattcgaccaccagttccagtgacagtcacgattctgaagagaattatgttcctatgaaccccaatttgagctccgaggatccaaacctgttcggcagcaacagcttggatggggggtccagccctatgatcaaaccgaagggcgataagcaagtggagtatctggacctagacctggacagcggtaagtccactcccccacggaaacagaagtcgtcagggtctggatcatccgtcgccgacgagcgtgtagattacgtagttgtggatcagcagaagaccttggcgttaaaatctaccagggaagcatggaccgacggccgtcaatcaacggagagtgaaacaccggcgaaaagtgtcaagtag

SEQ ID NO: 189825 - DNA, 1917 bp, Artificial Sequence
  Description of Artificial Sequence: Synthetic coding sequence
atgagcggcgaccccgacgtgctggagtactacaagaacgaccacagcaaaaaacctctgcgcatcattaacttgaacttctgtgagcaggtagacgctggtctcacctttaacaaaaaggagctccaggactcatttgtttttgacatcaaaaccagcgaacggacgttttatcttgtggctgagaccgaggaggacatgaacaagtgggtgcagagcatctgccagatatgtggcttcaaccaagcagaagagagcactgactctctgcggaatgtaagctcagccggtcacggaccacggtctagccccgctgaactgagctcatcctctcagcacctgctccgagaacgcaaaagcagtgcgccaagccactcaagccagcctacattgtttacctttgagcccccggtgtctaatcatatgcagccaaccctgtcgacttcagcgcctcaggagtatctgtatctgcatcagtgtatttctcgccgtgctgaaaacgctcgctccgccagcttttcgcagggcacgcgagcatcctttctgatgaggagtgacaccgctgtgcagaaactggcacagggcaacggacactgcgtgaacggtatctcaggtcaggtccacgggttctacagcctccctaagccgagcaggcataacaccgaattcagggactccacctatgacctgccccgcagcctggccagccacggtcatacaaaagggagcctcacaggaagcgaaactgacaatgaggatgtctatactttcaagactccatcaaacactctttgtcgagagttcggggacctgttagtggacaatatggacgtacctgccactccgctatctgcctatcagattcctaggacttttaccctggataagaaccacaatgccatgacagttgcaacccccggagactcagctatcgcaccccctcctaggcccccaaagccttcacaggccgagactcctcgatgggggagcccacagcagaggccccccataagcgagaactcacgctcggtggcagccactattccccgcaggaatacacttccggccatggataacagcagattgcatcgagcctcctcctgcgagacgtatgaatatccacagaggggaggagagagcgcaggtagatctgcggaatcgatgtcagacggagtaggcagcttcctacctggaaaaatgattgtgggccgctccgacagcactaatagcgaggataattatgtgcccatgaaccctggaagttccacgttactggcgatggaacgggcaggggacaacagccagtccgtgtacattcctatgagtcccggcgcacatcattttgactcacttggatacccctcaactactcttccagttcacaggggccctagtaggggttcggagatccagccaccacccgtaaatagaaatctaaaacctgatagaaaggctaaacctacccctctggatctaagaaacaatacagtgattgacgagttaccgtttaagtcgccaattacaaagtcatggagccgtgctaatcacacttttaactcttcctccagccaatattgcaggccgatctccacacagtctatcacatccacagactctggcgacagtgaggagaactacgtccctatgcagaatcctgtatcggccagtcccgtccctagcggtaccaactcacctgcccctaagaaatccaccggctcggtggactaccttgcactcgacttccagccctcaagcccttcgccccatagaaaaccatctacctcctctgtgaccagcgatgagaaggtggattacgtccaggttgacaaggagaaaacacaagcactgcagaacactatgcaagagtggaccgacgtacggcagtcctcagaaccgagcaaaggggccaagctgtag

SEQ ID NO: 189826 - DNA, 2031 bp, Artificial Sequence
  Description of Artificial Sequence: Synthetic coding sequence
atgagcggcggcggcgacgtggtgtgcaccggctggctgcggaagagtccccctgagaaaaaattgagacgctatgcctggaaaaaaagatggtttattctgcgaagtgggcgcatgtcaggcgaccccgacgtgctcgagtattacaaaaatgaccattcaaagaaacccttacggatcatcaatctgaatttttgtgagcaagtggacgctggcctgacgttcaacaagaaggagctgcaggattctttcgtgtttgatatcaagacatccgagcggacattttacttggtggccgagactgaagaagatatgaataagtgggtgcagagcatctgtcaaatctgtgggttcaatcaggctgaagaatccaccgacagcctgcgaaacgtgagcagcgctggacacggaccgcggtcttctcccgccgaactgagttcatcgtcacaacacctgttgcgcgagcgtaaatccagtgccccttcccacagtagccaaccgactttattcacctttgagcctccggtgtctaaccacatgcagcccacactttcaactagtgccccacaggagtatttatatctccaccaatgcatttcccggcgcgcggagaacgctagatcagctagcttttctcagggtacacgggcttcatttctgatgagaagtgatactgccgtgcaaaagctggcccaaggtaatggccattgcgtaaacgggatcagcggccaagtccacgggttttattcactgcccaagcccagccgccataacactgaatttagagatagcacctacgacttgccgaggagtttggcgtcacacgggcacactaaaggctcactgacaggctcagagacggacaacgaggatgtgtacacctttaagactccaagcaataccttgtgtagagagttcggcgaccttctcgtggacaatatggacgtgcccgcaactcccctgagcgcctatcagattccaaggacgttcactctcgacaaaaatcataatgctatgaccgtggcgactcctggggacagcgccatagcccccccacctaggcccccaaaacccagtcaggctgagacgcctcgctggggcagccctcagcagaggcctccgatcagcgagaattctagatctgtagcagccacgatccccaggcggaacaccttacccgccatggacaatagccgactgcaccgcgcctcctcttgtgaaacttacgagtacccgcagaggggaggcgagagcgccggcaggtccgccgagagcatgtcagacggcgttggtagcttccttcccggaaagatgatcgttgggagatctgattcaacaaacagtgaggacaattatgtgccgatgaaccctgggagctcaactttgttagcgatggagcgcgccggtgataactctcagagcgtgtacatccccatgagtcccggggctcatcacttcgacagcttagggtatcccagcaccaccctgccagtccaccgggggccctcacggggctctgaaatccagccccctccagtgaacaggaatcttaagcccgaccgcaaagctaagccaacaccactggatttgaggaataacactgtgatcgatgagctgccatttaagagccctattacgaaaagttggtctagggcgaatcacacttttaactctagctcctcgcaatactgccgcccgatttcaactcagtccattacttctactgactccggcgacagcgaggagaactacgtgccaatgcagaatcctgtcagcgccagcccggttccttcgggcactaacagcccagcccctaagaagtccaccggctccgtcgattacctggctttggattttcagccatccagtccttctccacacaggaaaccgtccacaagctcggtcaccagcgatgaaaaagtggattatgtccaggtggacaaggagaagacccaggcgctgcagaataccatgcaagagtggaccgatgttcgccagtcatcagagccgagcaagggagccaaattgtag

SEQ ID NO: 189827 - DNA, 396 bp, Artificial Sequence
  Description of Artificial Sequence: Synthetic coding sequence
atgagcggcgaccccgacgtgctggagtactacaagaacgaccactcaaagaagcccttgagaattatcaacctcaatttctgtgagcaggtggatgctggcctgacctttaataagaaggagcttcaggattcattcgtctttgacatcaagacatccgagaggacattctacctggtcgcagagaccgaggaagacatgaacaagtgggttcaatctatctgccagatatgtggatttaatcaggccgaagaatccacagacagcctaagaaatgttagcagtgctggtcatggaccgcgatcgtcccctgccgagctctcttccagctcccagcacctactcagagagagaaagtcctccgctcccagccattccagtcagccgaccctgtag

SEQ ID NO: 189828 - DNA, 309 bp, Artificial Sequence
  Description of Artificial Sequence: Synthetic coding sequence
atgagcggcgaccccgacgtgctggagtactacaagaacgaccactcaaaaaaacccctgcgtattatcaatctgaacttctgcgagcaagtggacgctggcttgactttcaataagaaagagctgcaggatagcttcgtctttgacatcaagacatctgagaggacattctacctagtagccgaaacagaggaagacatgaataagtgggttcagagtatctgtcagatttgcggctttaaccaagcagaggaatccaccgatagccttcgcaacgtgtcctcagcaggacatggcccgagatcatag

SEQ ID NO: 189829 - DNA, 993 bp, Artificial Sequence
  Description of Artificial Sequence: Synthetic coding sequence
atggaggccgtggccaagttcgacttcaccgccagcggcgaggacgagctctcatttcatactggtgacgtgctgaagattctgtcaaaccaagaggaatggtttaaggctgaactcggatcacaggagggctacgttccaaagaatttcattgacattcagtttccaaagtggtttcatgaagggctgagcaggcaccaagcggaaaacctgctaatgggaaaggaagtaggatttttcattatccgggcttcccagtcctccccgggagatttctcaatcagtgtgcgccatgaggacgacgtccagcatttcaaagtgatgcgagacaacaaaggcaattattttctctggaccgaaaaatttcccagcttgaacaaactagtggattactatagaacgaattctatatcccgccagaagcagattttcctccgagaccgaactcgggaggatcaaggacatcgcggtaattctctcgataggaggtctcagggtggacctcatctgtccggcgctgtgggcgaagagatccgacccagtatgaacagaaaactgagcgatcatccccccacattgccgctgcaacagcatcagcaccaaccccagccccctcagtatgccccagcgccacagcaacttcagcagcccccccagcagcggtatttacagcaccatcatttccaccaggaaagaaggggcggtagcctggatatcaatgatggccattgcgggactggcctgggctctgaaatgaacgcggccctcatgcacagacggcatacggaccccgttcagcttcaggcggctggccgagtgagatgggccagggctttgtacgattttgaggcgttagaagatgacgaattagggtttcactcaggcgaggtagtagaggtcctcgactccagcaatcctagctggtggacaggtcggctgcacaataagctaggactcttccccgctaactatgtggctccaatgactaggtag

SEQ ID NO: 189830 - DNA, 654 bp, Artificial Sequence
  Description of Artificial Sequence: Synthetic coding sequence
atggtgagccggcggcccctgagcacccccggccgggagctgacccacggacagggtggctggctgctgcaccatcccggccagccagaactaccgcgcgggctgctgcatctgtgccaaggacatcgtggtaacagtctcgacagacgctcccagggcggtccacacttgagtggcgctgttggcgaggagatccgaccgtctatgaaccggaagctgagcgaccatcccccaacgttgccacttcagcagcatcagcaccagccccagcccccacagtatgcacctgctccacagcagcttcagcagccaccacagcagcgatatctacaacatcaccattttcaccaagaaaggcgaggcggtagtctggacatcaacgatggccattgtgggaccgggctcgggagcgaaatgaacgctgctctgatgcatcgtcggcacactgaccccgtccaactgcaagccgccggcagagtgcggtgggcacgggcattatacgactttgaggccctggaggatgatgagctgggcttccattccggagaggtcgtggaagtcttggatagcagcaaccccagctggtggacaggtaggttgcataacaagcttggattatttcctgccaactatgtggcccctatgacccggtag

SEQ ID NO: 189831 - DNA, 993 bp, Artificial Sequence
  Description of Artificial Sequence: Synthetic coding sequence
atggaggccgtggccaagttcgacttcaccgccagcggcgaggacgagctgtcctttcataccggcgatgtactgaagatcctctcgaaccaggaggaatggttcaaggcagagctgggttctcaggagggctacgttcctaaaaacttcattgacattcagttccccaagtggttccacgagggattgagtcggcaccaggctgaaaaccttctgatgggcaaggaggtcggcttttttatcatccgcgcctctcagtcaagcccaggtgacttcagtatatccgttagacatgaggatgacgtccaacacttcaaagtgatgagagacaataaagggaattacttcctgtggaccgagaagttcccttctttgaataaacttgtcgactactaccggactaactcaatctcccggcaaaaacagattttcctgagggatcgcacccgggaggatcagggccacagagggaactccttggatcgcaggtcacagggcggtccccacctctctggagccgttggcgaggagattcggccaagcatgaaccgtaaactgtcagatcaccccccaaccctgcccctgcaacagcaccagcaccaaccccaacccccccagtatgcccccgccccccagcaactccagcagcccccacagcagcggtacctgcagcatcaccacttccaccaggagagacgcggcgggagcctggacataaacgatggtcattgcggcaccggcctcgggtcagaaatgaacgctgccctaatgcatcggcgtcataccgaccccgtccagttgcaagcagcaggccgggtaaggtgggctcgggctttatacgatttcgaggcgctcgaggatgatgagctgggattccactctggcgaagtggtcgaggtacttgactcttccaacccctcctggtggacaggccgattacacaacaaactcggtctgttcccagcaaactacgtggctcccatgactcggtag

SEQ ID NO: 189832 - DNA, 294 bp, Artificial Sequence
  Description of Artificial Sequence: Synthetic coding sequence
atggaggccgtggccaagttcgacttcaccgccagcggcgaggacgagctcagtttccacacgggggatgttcttaagatattgtccaatcaagaggagtggttcaaggcggagttgggaagccaggaaggatacgtgccaaaaaacttcatcgatatccaattcccaaaatggtttcacgaaggtctgtccaggcatcaagctgagaatcttttaatgggcaaggaagtgggattctttattatcagggcttctcagagttcaccaggcgatttcagtatttcagtccgctag

SEQ ID NO: 189833 - DNA, 795 bp, Artificial Sequence
  Description of Artificial Sequence: Synthetic coding sequence
atgctggagttcgtgagcctgctggcccggaaggacagcaacaacagtgtttccaagccaaggcacaaacttaaccccttttcgtcaaagcgacatgaggatgatgtgcagcactttaaagtcatgagagacaacaaaggtaattacttcttatggaccgaaaaatttccctctctgaacaagctagtggattactaccgaaccaactctatttcacgtcagaaacagatatttctgagagaccgtactcgtgaggaccagggccacaggggcaatagtctcgaccggcgcagccaaggagggccacacctcagcggcgccgtcggcgaggagatccgacccagtatgaacaggaagctgtcagaccatccgcccactttacctctgcagcaacatcagcaccagcctcagcccccccaatatgcccctgcccctcagcagttgcagcagccaccccagcagcgctacctgcagcaccaccactttcaccaagagcgaagaggtggatctctggacattaatgatggccattgtgggactggccttgggtcagaaatgaacgccgcactcatgcatcgccgtcacacagatcccgtgcagcttcaggccgctggtagggtccgatgggctcgcgcactgtatgattttgaggccctcgaggacgatgaattgggcttccactctggggaggtcgtcgaggtcctggattcaagtaaccctagctggtggaccggccgtctacacaacaagctggggctcttcccagccaactacgtagctccaatgaccagatag

SEQ ID NO: 189834 - DNA, 837 bp, Artificial Sequence
  Description of Artificial Sequence: Synthetic coding sequence
atggaggccgtggccaagttcgacttcaccgccagcggcgaggacgaactatcattccataccggagacgttctgaagatcctaagcaaccaggaagaatggttcaaagcagaacttggtagtcaagagggttacgtaccaaaaaatttcattgacatccagtttccaaaacatgaggatgatgtccagcacttcaaagtgatgagagataacaaaggcaactatttcctgtggacggagaaattcccaagcttgaacaagctagttgattactaccggaccaattcaatttctcggcagaaacagatctttctgcgggacaggactcgcgaagaccagggccatagggggaattcactggatcgccgaagccagggtggacctcacctgtctggcgctgtcggagaagagatacgtccttccatgaatcggaagcttagcgaccaccccccgactctccctctgcaacaacaccagcatcagccccagcctccgcaatacgcccctgccccacaacagctgcagcaaccgccgcaacagcgctacctgcagcatcaccacttccaccaggaacggcgcggagggtctctggatatcaatgacggccattgtggcactgggctcgggtcggagatgaacgcagcactgatgcacagacgccacacagatccggtacagctccaggccgctggacgggttcggtgggcgcgagcgctgtacgacttcgaagcactggaagaggtcctcgattccagtaatccctcgtggtggacgggccggctgcacaataagttaggcctgtttccggctaactatgtggccccaatgacacgatag

SEQ ID NO: 189835 - DNA, 915 bp, Artificial Sequence
  Description of Artificial Sequence: Synthetic coding sequence
atgctggagttcgtgagcctgctggcccggaaggacagcaacaactcagtgtcgaaaccaaggcataagttgaacccattctcttccaaacgatggtttcacgagggactgtccagacaccaggcagagaatctcttgatgggaaaggaagttggattttttattatacgtgcatcccagtcctcaccgggtgactttagcattagcgtcagacacgaggacgacgtgcagcatttcaaggtcatgcgggacaacaaaggcaattactttctctggactgagaagttcccgtctttgaacaagctcgtggattattatcgtaccaattcaatcagtagacagaagcagatcttcctgcgtgaccgaacccgcgaggaccaaggacacagaggtaactcactcgaccggcggtcccaagggggtcctcatctcagcggcgccgtcggggaggaaattagaccctccatgaatcggaaactcagcgatcatccccccactctacccctgcaacagcatcagcatcagccccagccccctcagtacgcccctgctccgcaacaactgcaacaacctccccaacagcggtatttacagcatcatcacttccatcaagaacggaggggtggtagcctggacatcaacgatggccattgcggtaccgggttgggctcagagatgaacgccgccttgatgcaccgaagacacactgaccctgtgcagctccaagccgccggtagggtccgctgggccagagcactgtatgatttcgaggcgctagaagacgatgagctgggattccatagtggcgaggtcgtggaggtcctcgacagcagcaatccctcttggtggacaggaagactgcataacaaactaggactctttcctgctaactacgtggctcccatgactcgatag

SEQ ID NO: 189836 - DNA, 777 bp, Artificial Sequence
  Description of Artificial Sequence: Synthetic coding sequence
atgggcaaggaggtgggcttcttcatcatccgggccagccagagctccccaggcgatttcagcatatctgttcgccatgaggacgacgtccagcatttcaaagttatgagagataataaagggaattactttttgtggactgagaaatttccgagcctgaacaagctggtggattactatcggactaattccatttctagacaaaaacagatttttctgcgggacagaacacgcgaggaccaaggtcatagaggtaacagcttggatcggaggtcacagggcggaccacatttgagtggtgctgtaggcgaagaaattcgacccagcatgaatagaaagctgtccgaccacccccctactttacccttacaacagcatcagcatcaaccacaaccacctcaatacgcacccgctcctcagcagctgcaacagccacctcagcaacgataccttcagcaccatcacttccatcaagagcgcagaggtggcagtcttgatataaacgacggtcattgtggcaccgggctgggcagcgagatgaacgctgcccttatgcaccgcagacacaccgaccccgtgcagttgcaggccgctggtcgcgtgaggtgggcaagggccctctatgactttgaggcactcgaggatgacgagctcggcttccacagcggagaggtggtggaagttctggacagctccaatccctcctggtggaccggtcgcctgcacaataagctgggtctgttccccgccaattatgttgctcctatgacacggtag

SEQ ID NO: 189837 - DNA, 507 bp, Artificial Sequence
  Description of Artificial Sequence: Synthetic coding sequence
atgttctggaagctgagcctgagcctgttcctggtggccgtgctggttaaggtcgcagaagcgagaaagaataggcccgctggagccatcccgtccccttataaagacggctcttcaaacaattccgaaagatggcagcaccagatcaaagaggtcctggcctccagccaggaggccttggtcgtcacagagcgtaagtacctgaagtccgattggtgtaagacccagcctttgcggcagacggttagcgaagagggttgcagatccagaaccattctcaatagattttgctatgggcagtgtaattccttttacatcccccgtcatgttaagaaggaggaggaatcatttcagagctgcgccttttgtaagccccagcgggttaccagtgttctggtcgaattggagtgtccagggttggatccccccttccggcttaaaaaaatccaaaaagttaaacagtgccggtgtatgtcggttaacctgagtgattcagataagcagtag

SEQ ID NO: 189838 - DNA, 1443 bp, Artificial Sequence
  Description of Artificial Sequence: Synthetic coding sequence
atggccggcacccggtgggtgctgggcgccctgctgcggggctgcggatgcaactgttcatcttgtcgccgcaccggcgcagcttgcctccctttttactccgcagccggatctattccctctggtgtgtccggacggagaagactcttgttgcttctgggggctgcagcagcagcggccagtcagacaagagggctgcagacagggcctgtgccacccggccggctcgctggtccccctgccgtggctacaagtgcggccgccgctgcagccgctagctactctgccctgcgcgcctccctcctcccccagtctcttgccgcggccgctgccgtccccacccgatcctattcgcaggaatctaaaaccacttacctggaagatctcccacctccacctgagtacgaactggctccatctaaactggaggaagaagtggatgatgtgtttctcatacgcgctcaaggtctcccatggagttgcacgatggaagatgttctgaacttcttcagcgactgccgcattcggaatggagaaaatgggatacatttcttactaaatcgtgatgggaaaaggaggggcgacgctttgattgaaatggaatccgagcaggatgtccagaaggctttggagaagcacagaatgtatatgggacagaggtacgtagaggtgtacgagatcaacaatgaagacgttgacgccctcatgaaaagcctgcaggtcaagtcaagccctgtagtcaacgatggcgtggtgaggctgcgagggctgccctatagttgcaacgaaaaggacatcgtagattttttcgcagggttgaatatcgtggacatcaccttcgtcatggattatagggggcgccggaagacaggggaagcctatgtccagtttgaggagccggagatggctaaccaggcgctcctgaagcatcgtgaagagattggcaaccgctacattgaaattttcccgtctcggagaaatgaagttaggactcatgtcggctcttacaagggaaagaagattgcctcctttcctaccgcgaaatacatcaccgaacctgagatggtcttcgaagagcacgaagttaatgaggacatccagccaatgaccgctttcgaatctgagaaggaaatcgagctccccaaagaggttcccgaaaagctaccagaagccgccgatttcggcaccacaagtagcttacactttgtgcacatgaggggcttgcctttccaggccaacgcacaagatattatcaactttttcgccccactcaagcccgtacgcattacgatggaatactcttccagtggaaaggctactggagaggccgatgtgcatttcgagacccatgaggacgccgtggctgctatgctgaaagatcggtcccacgtgcatcacaggtatattgagttgttcctcaattcctgtcccaagggtaaatag

SEQ ID NO: 189839 - DNA, 957 bp, Artificial Sequence
  Description of Artificial Sequence: Synthetic coding sequence
atggaggacgtgctgaacttcttcagcgactgccggatccggaacggcgagaatggtatacactttctactgaacagggatggcaagaggaggggcgatgcactcattgagatggaatccgaacaggacgtccagaaagccctggaaaagcatcgcatgtatatgggccaacgctatgttgaggtttatgagattaataacgaggacgttgacgcccttatgaagagcctccaggtgaaatcatcccccgtggttaacgatggagtggtgagactgcgcgggctcccttactcttgtaatgaaaaagacattgtcgactttttcgctggacttaatatcgtggacatcacatttgttatggattaccggggcagaagaaagacgggcgaagcctacgtccaatttgaagagcctgagatggccaaccaggctctcctgaagcatcgagaggaaattggaaatcggtatattgagatcttcccatcccggcgcaacgaagttagaacgcacgtgggatcatataagggtaagaaaatcgccagcttccctacggccaagtacataactgagccagagatggtttttgaggagcatgaagtgaatgaagatatacagcctatgactgctttcgagtcggaaaaagagatcgagctgccaaaggaagtgccagaaaagttacccgaagcggctgacttcgggaccacctctagtttacatttcgtgcacatgagggggcttccatttcaagctaacgcccaagatatcattaactttttcgctccacttaaaccagtgcggatcaccatggagtacagcagcagtggcaaggcaaccggagaggctgacgttcactttgagacacacgaagacgccgttgctgccatgctgaaggaccggagtcatgtgcatcaccggtacatagagctgttcctgaactcctgtccgaaaggaaagtag

SEQ ID NO: 189840 - DNA, 1362 bp, Artificial Sequence
  Description of Artificial Sequence: Synthetic coding sequence
gccgccgccgtgcccacccggagctacagccaggtgcggggccggagggaaggacccggtgcaaggtccctgcccggaagggtgcacgcccctcctcgaccctctgttcctccttgcgccccacgcggccatgcccggggatcagcaaccctggctgcccatccaccaccatccacactgtgctcatactgggccctggagcagggtaaactgagccaagcttcagggctgcttcttgtcctgttctcacccagagtgtccggcaggctgggatcagagagtaagaccacgtatctcgaggacttgccaccgcctcctgagtacgagcttgctcctagcaagctggaggaggaagtagacgacgtgtttctgattagggcccagggcctcccatggtcctgcacaatggaggacgtcctaaacttcttcagtgattgccgtatccgcaacggcgagaacggcatccattttctgctgaaccgggacggaaagagaaggggagacgccctgattgagatggaatccgaacaggacgtgcagaaagcactcgagaagcaccgtatgtatatgggacagagatatgtggaggtctacgaaattaacaacgaggacgttgacgcattaatgaaatctctgcaggtgaagtcaagcccagtggtgaacgatggggtagtaagacttcggggactgccatactcttgtaacgagaaagatatcgtcgatttctttgcggggctgaatatcgtcgacatcacatttgtgatggactataggggaaggcggaaaacaggtgaagcttacgtgcaattcgaagagcccgaaatggccaaccaagctcttcttaaacatagggaagaaatcggaaatagatatatcgaaatcttcccttcgcgccggaacgaggtccgtacacacgtgggatcatataagggcaaaaagatcgccagctttcccacagccaagtatattaccgaaccagaaatggtgttcgaagagcacgaagtcaatgaggatatacaaccaatgaccgcatttgaatctgaaaaagaaatcgagctacccaaggaggtccctgaaaagctcccagaggcggccgatttcggcaccacctcctcactgcacttcgtacatatgagggggctgccttttcaggccaacgctcaggacatcatcaatttttttgctccgttgaagccagtgcgcattacaatggagtactctagctctgggaaagctacaggggaggctgacgtgcattttgagacccacgaggacgccgtcgccgccatgctaaaagatcggtcccatgtccatcacaggtacatcgaactcttcttgaatagttgtcccaaaggaaaatag

SEQ ID NO: 189841 - DNA, 957 bp, Artificial Sequence
  Description of Artificial Sequence: Synthetic coding sequence
atggaggacgtgctgaacttcttcagcgactgccggatccggaacggggaaaacggcatacatttcttgttgaaccgggacggaaaacgacggggagacgcgctcatcgagatggaaagtgaacaagatgttcagaaggccctggagaaacacagaatgtatatgggtcaaaggtatgttgaagtttatgagatcaacaacgaagatgttgatgcgctcatgaagtctctgcaggtgaaatcttctcccgttgttaatgacggcgtcgtgaggctacgaggattgccctattcgtgtaacgagaaggatattgtggactttttcgcaggactcaacattgttgacataactttcgtgatggattataggggccgaaggaaaaccggcgaggcatacgtccagtttgaggagccggagatggccaaccaggcactgctaaaacatagggaggagatcggtaatcgctacatcgagatctttccatcacgccggaacgaggtgaggacccatgtcggttcctataaggggaagaaaattgcatccttcccaacagcgaagtacataacagagcccgaaatggttttcgaggaacatgaagtgaatgaggacatccagcccatgactgcattcgagagcgagaaggaaatagagttgccgaaagaagtgccggagaagctgcccgaggccgcagacttcggaactacaagttccctccactttgtgcatatgcggggccttccctttcaggccaacgcacaggatatcatcaacttttttgctcctttgaagccagtgcgaattaccatggaatactcctcatctggcaaggcaacgggggaagcagacgttcattttgagacgcacgaggacgccgtggccgctatgctcaaagacaggtctcacgtgcaccatagatatattgagctgttcctaaattcctgccccaaggggaagtag

SEQ ID NO: 189842 - DNA, 1254 bp, Artificial Sequence
  Description of Artificial Sequence: Synthetic coding sequence
tgacccccccccagcaccctgtgcagctactgggccctggagcagggtaaactgagtcaggccagtgggctcctgctggtgctcttctctcctagagtcagtggccgacttggaagtgtgtccgttgccggtgtgaatgtcgaagccctgtttcccgcctggcccatggaaagcaagactacctacttagaagacctgcccccgccccccgagtacgaactggcaccttctaaactcgaggaggaggtcgacgatgtcttcctcattagagcccagggtctgccctggtcctgtactatggaggacgttcttaattttttttccgactgccggatccggaatggcgagaatgggatccactttttgctgaaccgggatggcaaaaggagaggcgacgccctcatcgagatggaatctgagcaagacgtccaaaaggcattggaaaagcaccgtatgtacatgggacagcgatacgttgaggtatacgagattaacaacgaggatgtggacgctctgatgaaatcactccaagtaaaaagttctccagtcgtgaatgatggcgtcgtccgcctaaggggtctaccctatagctgtaatgaaaaagatatagtggattttttcgctgggctgaacattgtcgatatcacctttgtcatggactaccggggaaggcggaaaaccggcgaggcatacgtacagttcgaagagcctgagatggccaatcaggcattgctcaaacaccgtgaggagattggcaatcgatacatcgaaatcttcccctctcgccgcaatgaagtccggacccatgttgggagttacaagggcaagaaaatcgctagctttccaaccgccaagtacattaccgagcccgaaatggtctttgaagaacatgaagttaatgaagacattcaacctatgacagcgtttgagtcggaaaaagaaatagaactgcccaaggaagtgccagagaagctgccagaagctgcagatttcggcaccacctccagtctccatttcgttcacatgcgcggcctcccttttcaagccaatgcccaggatatcatcaatttttttgcccccctgaaaccggtgcgaattaccatggaatattcctcgagtggtaaagcaacaggcgaggccgatgttcactttgaaacacacgaagacgccgtggctgcaatgctgaaggatcggtcccatgtgcaccatcggtatattgagctctttctaaatagttgccctaaaggcaagtag

SEQ ID NO: 189843 - DNA, 1239 bp, Artificial Sequence
  Description of Artificial Sequence: Synthetic coding sequence
atggccggcacccggtgggtgctgggcgccctgctgcggggctgcgggtgcaattgttctagttgccggcgcacaggtgcagcctgcttgccgttctatagcgcggccggcagtattccagccgcggcagttcctaccagaagctactctcaggagagcaagaccacatacctggaggatctgcctccccctcctgaatatgagcttgctcctagtaagttagaggaggaggtagacgatgtgttcctgattagggctcagggcctgccctggagctgcacaatggaagacgtcttgaatttttttagtgactgccgaatcaggaatggagaaaacggtattcacttcttacttaatcgggacggcaagaggcgcggggatgcccttattgaaatggaatccgaacaggatgtccagaaagcgcttgagaaacatcgcatgtatatgggacagagatatgtcgaggtgtacgagatcaacaatgaggatgtggacgcacttatgaaaagcctgcaggttaaatcatcccctgtagtgaacgatggtgtggtgcgcttgagaggcttgccatattcctgtaacgaaaaggacatcgtggatttcttcgcaggcctgaacatagtcgatatcactttcgtgatggactacagagggaggcgcaaaacgggagaagcctacgtacaattcgaggagcctgagatggccaatcaggctttgctaaaacacagagaagaaatcgggaatcggtatatcgaaatattcccatctcgccggaatgaagtgcgcacacatgttggcagctataaaggaaagaagattgcctcctttcccacggccaaatatatcaccgaacctgaaatggtgttcgaggagcacgaggtgaatgaggatatacagccaatgaccgcttttgaaagcgaaaaggaaatcgaacttccaaaagaagtccccgaaaaactgcctgaagcagcggattttgggacaactagttccttacactttgtgcatatgagaggactaccttttcaggcgaacgctcaagatatcatcaacttttttgctccactcaagccagttcgaattacaatggagtatagctcctcaggaaaggcaacaggggaggcggacgtgcatttcgagacacatgaagatgccgttgccgccatgcttaaggacaggtcacatgtccaccaccgctacatcgagctgtttctaaatagttgtcccaagggaaagtag

SEQ ID NO: 189844 - DNA, 1089 bp, Artificial Sequence
  Description of Artificial Sequence: Synthetic coding sequence
atggagagcaagaccacctacctggaggacctgccccccccccccgaatacgaactcgcaccaagtaagctagaggaagaggtggatgacgtttttctgatcagagcccagggccttccttggagctgcaccatggaggatgtgcttaattttttctctgactgcagaattcgcaacggggaaaacggtattcatttcttgctgaacagagacgggaagaggaggggggacgctttgatcgaaatggaaagcgaacaggacgttcagaaggctcttgagaagcaccggatgtacatgggacagaggtatgtggaagtgtacgagatcaacaacgaagatgtcgatgctcttatgaaatcactccaggtaaagagcagccccgttgtcaatgatggtgtcgtccgcctccgcggattgccgtactcatgtaatgaaaaagacattgtagacttctttgcaggcctcaatatcgttgacattaccttcgtgatggactaccggggacggcgtaagacaggggaagcctatgtccaattcgaggaacccgagatggccaatcaggcgcttctgaaacaccgggaagaaatcggaaatagatatatcgagatctttccttccagaagaaatgaagttcgcacacacgtgggcagctataagggtaagaagatagcatcattcccaaccgccaagtatattaccgagcccgaaatggtatttgaggaacacgaggtgaatgaggacattcagcccatgacagctttcgaatctgagaaggaaatcgagttaccgaaagaagtgcctgaaaagctgcctgaagccgctgatttcggaaccactagctctttacatttcgtacacatgagaggtctgccttttcaggctaatgcccaagacataattaacttctttgctccacttaaacccgtccggattacaatggaatactcatcttccggaaaggcaacaggagaggccgacgtgcactttgaaacccacgaggatgctgtggccgctatgctgaaggatcgatctcacgtccaccatcgctacatcgagctgtttttgaatagttgtcccaaggggaagtag

SEQ ID NO: 189845 - DNA, 1401 bp, Artificial Sequence
  Description of Artificial Sequence: Synthetic coding sequence
atgctgcggagcaccagcaccgtgaccctgctgagcggcggcgccgcgcgtactccaggggcacctagccggcgcgctaacgtgtgcagactgcgcctgaccgtacctcctgagtcaccagtccctgagcaatgtgaaaaaaaaattgaaaggaaggagcagctcctggatctttccaatggggagcccaccagaaaactcccccagggagtggtttatggggtggtgaggagaagtgatcagaaccagcaaaaagaaatggtggtatacggctggtcaacctcccagctgaaggaagagatgaattatatcaaagacgtgcgggctaccctagaaaaggtgcggaaaagaatgtacggggattacgacgaaatgcgacagaagatcaggcaattgacccaagaactgagcgtgtctcatgcccagcaggaatacttggagaatcacattcagacacagagctccgcactggacaggtttaatgcgatgaactctgctctagcttctgacagcatcggcttgcaaaagacactggtggatgtgacactcgaaaacagcaacatcaaagaccaaatccgtaacttgcagcaaacctacgaggcctccatggataagctgagagagaagcagaggcaactcgaagtggctcaggtggagaaccaactgcttaaaatgaaggtagagtcttcccaggaagctaatgccgaagtgatgcgcgagatgacaaaaaagctctactcccagtacgaagagaaactgcaggaggagcagcgaaagcattccgctgagaaggaggcgttattggaagagaccaactcttttctgaaagccattgaggaagctaataaaaagatgcaggcggctgagatcagtctcgaggaaaaggaccagcgtatcggagaactggaccggctaatcgagagaatggagaaggagcgtcaccagctccagctccagttgctcgaacacgagactgagatgtctggcgagctcactgactcagataaggagcgctaccaacaattagaggaagcctccgcctctctgcgcgaacgcattagacatctggacgatatggtgcattgccaacagaagaaagtcaagcaaatggtggaagagatcgaatcacttaagaaaaaactgcagcagaaacagctgcttatcctccagctcttagagaaaatctcatttcttgagggggagaacaatgaacttcagtcgaggctagactatttgactgagactcaggccaagaccgaagtggagactcgcgagattggggtaggttgcgacttgctacctagccaaacagggcgtacccgagagattgtcatgccatcccgtaattacactccatatacccgggtcctggagctgacgatgaaaaaaaccctcacctag

SEQ ID NO: 189846 - DNA, 1194 bp, Artificial Sequence
  Description of Artificial Sequence: Synthetic coding sequence
atgctgcggagcaccagcaccgtgaccctgctgagcggcggcgccgcccgtactccgggcgccccgagtcgccgcgccaatgtttgccggctgcgcttgacagtcccaccagaatcccctgtaccggaacaatgcgaaaagaaaatcgagcggaaagagcagttactggacttgagcaacggagaacccacacggaagctccctcaaggggtggtctatggggtggtgcgcagatccgaccagaatcagcaaaaggagatggtggtttacggctggtccacttcacagttgaaggaggaaatgaactacatcaaggataaaactctggtggatgttacactggagaattctaacatcaaagatcagatcaggaatctacagcaaacctatgaggcaagtatggacaaactgagagagaaacagcggcagttagaggttgcccaagtcgagaatcagctgttgaagatgaaggtggagtcttctcaggaagccaatgccgaagttatgagagagatgaccaagaagctgtactcacagtacgaagagaaactgcaggaggaacaacgcaagcactcggcagagaaagaggcgttgctggaagagacgaatagcttcctcaaagccattgaggaagctaacaagaaaatgcaggcagccgaaatcagcctcgaggaaaaggaccaacggatcggagagctggaccgcctcatcgagcgtatggaaaaagaacgtcaccagctgcagctgcagctgttggagcatgagacagaaatgagcggcgagctgactgattccgacaaggagcggtaccagcagctcgaagaggcttcggcttccctgcgcgaacgcatccgtcacctggacgatatggtccactgtcaacaaaaaaaggtcaagcaaatggtggaagaaatagagagcctcaaaaaaaagctgcagcaaaagcagctgctgattctccaattactggagaagattagctttttagaaggtgaaaataacgaactccaatcaagactagattacctgactgagactcaggccaagactgaagtggagactcgcgagatcggggttggatgtgatctgctgccttctcagaccggccgcaccagagagatcgtcatgcctagccggaactataccccttacacccgcgtgttggaactcacaatgaagaaaactctgacgtag

SEQ ID NO: 189847 - DNA, 1248 bp, Artificial Sequence
  Description of Artificial Sequence: Synthetic coding sequence
atgctgcggagcaccagcaccgtgaccctgctgagcggcggcgccgcgagaacgcccggagcaccctcgcgtcgcgctaacgtgtgtcgcctacgcctgactgtgccccccgaatctcccgtcccagaacagtgcgaaaagaaaatcgaacgcaaagaacagcttttggatctttccaatggcgagccgacacggaaactgccccagggcgttgtttacggagtggtccgacggtctgatcaaaatcaacagaaagagatggtggtctacggatggagcacttcccagctgaaagaggagatgaactatatcaaagacgtgagccatgcccagcaagagtatctggaaaatcatatacagacgcagagttcagccttggatcgcttcaacgcaatgaactctgccctcgccagcgatagtatcggcctgcaaaagacgctcgttgatgtgactcttgaaaacagcaacatcaaggatcagattagaaatttacagcagacttacgaggcaagcatggacaaattacgcgaaaagcagagacaattagaggtcgctcaggttgaaaaccagcttctcaagatgaaggtcgaaagctctcaggaagcaaacgcagaggtcatgcgcgagatgactaaaaagctgtatagtcagtatgaagagaagctgcaggaggaacaacggaaacattcagctgagaaggaggccctgctagaagagacaaactcctttctcaaggctatagaagaggcgaacaagaagatgcaggctgcagagatttcgctcgaagagaaggaccagagaatcggagagctggatcgcctcatcgaaaggatggagaaagaacgccaccagctgcaattacagcttctggaacacgagacggaaatgtccggtgaactcaccgactccgacaaagaaagataccagcagttagaagaggcttctgcaagtctccgggagaggatccggcatctggacgatatggtgcactgccagcagaaaaaggtcaagcagatggttgaagagaataatgaactccagtcccgactggactatttgaccgaaacccaggcaaagacagaggtggagactcgtgagattggagtgggctgtgacctgttgccgcggcaaagtcgcaaattcgaaaaggtgctgaacgagtttgtgcagctcttgcccctcccacatcatttgctatgggcttttggtaacgtctgctggagacggcacttcgggcttttgcagtag

SEQ ID NO: 189848 - DNA, 1317 bp, Artificial Sequence
  Description of Artificial Sequence: Synthetic coding sequence
atgctgcggagcaccagcaccgtgaccctgctgagcggcggcgccgctaggacacctggagccccctctagacgcgccaacgtgtgccgactcaggctcacggttcctccggaaagtcctgtccctgagcagtgtgaaaagaagatcgaaagaaaggaacagctgttggacttatctaacggtgaacccactcgcaagcttcctcagggcgtggtctatggagtcgtgaggagatccgaccagaatcaacagaaggagatggtcgtgtatgggtggtccacttctcagctgaaggaggaaatgaattatataaaggatgtccgcgcgactctggagaaggtgagaaagaggatgtatggggactatgacgaaatgcggcaaaaaatcaggcagctcacccaggagctcagcgtctcccatgctcagcaagaatacctggagaaccacatccagacccaaagttctgccctggatagattcaacgcgatgaacagcgcgctcgcgtctgactccattgggttgcaaaagactctggtagacgtaacccttgaaaactctaatattaaggaccagatccgcaacctgcaacagacatacgaggcgtccatggacaaactccgcgagaagcagagacagcttgaggtagcacaagtggaaaatcagctgttaaagatgaaggtcgagtctagccaagaggccaatgctgaggtaatgagagagatgaccaaaaagctttacagccaatacgaggaaaagctacaggaggaacagcggaaacacagcgcggaaaaagaagcccttctggaagaaactaacagctttctgaaggccattgaagaggctaacaaaaagatgcaggccgccgagattagtctggaagaaaaagatcagagaattggcgagctggatcgcctgatcgagcggatggaaaaggagagacaccaactgcagcttcaactgttggaacacgaaacagagatgtctggtgaactcaccgatagtgacaaggagagataccaacagctggaggaagcaagtgcttctctgcgggaacggatacgtcatcttgacgacatggtgcactgccagcagaaaaaggtgaagcaaatggtcgaagagaataacgagctacagtctcggctcgactacctcactgagactcaggccaagacagaggtagagacacgggagatcggggtgggctgtgacctgctgccaagccagactggcagaacgagggagatagtgatgcctagcaggaactacacaccctatacccgcgtgttggagctgaccatgaaaaagacattgacttag

SEQ ID NO: 189849 - DNA, 1338 bp, Artificial Sequence
  Description of Artificial Sequence: Synthetic coding sequence
atgctgcggagcaccagcaccgtgaccctgctgagcggcggcgccgcacggacccctggtgcgccgtcccgtagagccaatgtttgccgcctgcggctgacggtgccacctgaatctcccgttcctgagcagtgcgagaagaaaattgaaagaaaggagcagctgcttgatcttagtaacggggaaccaactagaaagctgccacagggcgtggtttatggagttgtgcgtagatcagaccagaaccaacagaaagaaatggtggtatacggatggagcacctctcagcttaaagaagaaatgaactacataaaggacgtacgtgcaaccctggaaaaggtacgtaagcggatgtacggcgactatgatgaaatgaggcagaaaattcgacaacttactcaggagctgtcggtgagccatgcccagcaggagtatctggagaatcatatacaaacccaatcctcggcgttagatcggtttaacgctatgaattccgccttggcttctgatagtatcgggctgcagaagacactggtggacgttactctcgaaaattcaaatattaaagatcagatccggaaccttcagcagacctacgaggcaagcatggataaactgcgcgaaaaacaacggcaattagaagtcgctcaggtggaaaaccagctgctaaagatgaaggtagaaagctcacaggaagcaaatgctgaggttatgcgggaaatgaccaagaagctgtactcacaatacgaggagaagttgcaggaggagcagcggaagcactccgcagagaaagaggcattactggaggagaccaactccttccttaaagccattgaggaggctaacaagaagatgcaggccgccgagatttccctggaggaaaaggaccaacgcatcggtgaactggaccggctcattgaaaggatggaaaaggagagacaccaactgcagctgcaactgctagagcatgagactgagatgagtggagagctgacagattccgataaagagcgctaccagcaactggaagaggcatcagcatccttacgtgagcggattcggcacctagatgatatggtgcactgccagcagaagaaggtcaagcaaatggtggaagaaattgaatcactcaaaaaaaagttgcagcagaagcagctgcttatcctgcagctgctggaaaagataagtttcctcgaaggtgagaataacgagctccagtctcggctggactaccttacagagacacaggcaaaaactgaagtggagacacgtgagatcggggtgggctgtgacctgctcccccgacgttgtaaacagtcctctcagcggaaaaactag

SEQ ID NO: 189850 - DNA, 1653 bp, Artificial Sequence
  Description of Artificial Sequence: Synthetic coding sequence
atgctgcggagcaccagcaccgtgaccctgctgagcggcggcgccgcccggacaccaggagcaccaagccggcgcgccaatgtctgccggctgaggctgacagtcccacccgagagtcctgtgccagaacaatgtgaaaaaaaaatcgagcggaaggagcaattgttagatctatctaatggcgagccaacacgaaagctaccacagggcgtggtctatggcgtagtgcgacggtcggaccagaatcaacagaaggagatggtcgtttacgggtggagtacaagccagctgaaggaggagatgaattacatcaaggacgtcagggcgaccctagaaaaagttcgaaaaagaatgtacggcgattatgacgagatgagacagaaaataagacagctcacccaggagttaagtgtcagccatgcacagcaggagtacttagagaatcacatccaaacacaaagctcagcactggatcgatttaacgcaatgaactcggccctcgcctcagattcaattgggctccagaagacactggtggatgtaaccctcgaaaactccaacattaaggatcagataaggaatctccagcagacgtatgaagcatcgatggacaaactgcgcgaaaagcagcgccaactcgaggtggcacaagtggaaaatcagctcctgaaaatgaaagtggagagctcccaagaagctaatgcagaggtgatgcgcgaaatgaccaagaagttgtactcccagtacgaggagaagcttcaggaagagcagcgcaagcatagtgccgagaaggaggcccttcttgaggagactaattcattcctgaaagccattgaagaagccaacaagaagatgcaggccgctgagatatccttggaggagaaagaccaaaggattggagaattagaccgcctgatagagagaatggagaaagaaagacaccagctccagctgcagttgttagagcacgagactgaaatgtctggtgagctcacagacagtgacaaggaacgttatcaacagttggaggaggcgtcggccagtctgcgggaaaggattcgacacctggacgatatggttcattgccaacagaaaaaggtgaagcagatggtcgaagagattgaatccctgaagaagaagctccagcagaaacagctgctgattctgcagctcctggagaaaatttcgtttctggagggcgagaataatgaactgcagtctcgcctcgattacttgacggaaacgcaggcgaaaacggaggtggaaacccgggagattggcgtggggtgcgacctgttgcctagactcccattccgccagaacgattcgtcctcccattgtcaaaagtctgggtcccccatctcgtctgaagaacgccggagaagggacaaacagcatctggatgatatcactgccgctaggctcttgcctctgcaccatatgccaacccagttgctgtccattgaggagagtctcgcgctccagaagcagcagaaacagaattacgaggaaatgcaggcaaaacttgctgcacaaaaattggccgagcggctgaatattaagatgcgtagttacaaccctgagggggaatcatcaggtagatatagagaggtgagggacgaagatgacgattggagctccgatgagttttag

SEQ ID NO: 189851 - DNA, 1308 bp, Artificial Sequence
  Description of Artificial Sequence: Synthetic coding sequence
atgctgcggagcaccagcaccgtgaccctgctgagcggcggcgccgcccgcacgccaggcgctcctagtcggagggcaaacgtatgtcgactgcgactgacggtgcctccagagtcacctgttcctgagcaatgtgagaaaaagatcgaaaggaaggaacagttgctggacctgagcaacggcgagcccaccaggaaactgccgcagggtgtggtttatggcgtggtcaggcggtccgaccaaaaccagcagaaggaaatggtggtgtacggctggagcacaagtcaactgaaggaggaaatgaactatattaaagacgtaagtcatgcacagcaggagtacctagaaaaccacatacaaacacagtcttctgcgctcgatcgctttaatgccatgaattcagcgctcgccagtgactctattggtttacaaaaaacactggtggacgtgacattagaaaactctaacattaaggatcaaattaggaatctccagcaaacctatgaagccagtatggacaaacttcgcgagaagcagcgccagctagaggtcgcgcaggtcgaaaatcagcttcttaaaatgaaggtggaaagctcccaagaagcaaatgcggaggtgatgagagaaatgacaaagaagctgtatagtcaatatgaggaaaaacttcaagaagaacaacgtaaacatagcgcagaaaaagaagcccttctcgaggagactaatagttttctgaaggccatcgaagaagcaaataaaaagatgcaagctgcagaaatctcactcgaggaaaaggaccagagaatcggagaactagacaggcttattgaacgaatggagaaagagagacaccagctgcagctccagctgctcgagcatgagaccgaaatgtcaggcgagcttactgattcagacaaagagcgctaccagcaattggaagaagcctctgcttcactgcgcgaacggatccgtcacctggatgacatggtgcattgccagcagaaaaaggtcaagcagatggtcgaagagatagaaagcctgaagaagaaactccaacaaaaacaactgttgattctgcagcttctcgaaaaaatctcattcctggagggcgagaataacgagctgcagtctcggttagactatctgaccgaaacgcaggctaaaactgaggtggagactcgcgaaatcggggttggatgcgaccttcttccgagtcagactggtcgaaccagggagattgtcatgccttctagaaattacaccccatacacccgagtgctggagctcaccatgaagaagactctgacctag

SEQ ID NO: 189852 - DNA, 1401 bp, Artificial Sequence
  Description of Artificial Sequence: Synthetic coding sequence
atgctgcggagcaccagcaccgtgaccctgctgagcggcggcgccgcgaggactcccggagcgccttctcgcagggccaacgtatgtaggctcagacttacagtgcccccagagagtcctgtgcctgagcagtgtgagaagaagatcgagaggaaggaacagctgctggacctcagcaacggcgagccgacgcggaagctgcctcagggcgtggtctatggtgttgttcgtcgaagtgatcagaaccagcagaaggaaatggttgtttacggatggtctactagccagttaaaagaagagatgaactacatcaaagacgtgcgtgccactctggaaaaagtccggaagcgcatgtacggagattatgatgagatgagacaaaaaattcggcaactgacacaggagctttctgtgtcccatgcgcaacaggagtaccttgagaaccacattcagacacagagttccgccttggataggtttaatgctatgaattccgctttagccagtgattctatcggactccaaaaaacactggtggatgtcaccctggagaatagtaatatcaaagaccaaatccgtaatctccagcagacctatgaggcgtcaatggataagctgcgggagaaacagcgacagttagaagtggcgcaagtcgagaatcaactgcttaagatgaaggttgaatcttcacaggaagccaacgcagaggtgatgcgagaaatgacgaagaaactatactcacagtacgaggagaagctccaagaggagcagcgcaaacactctgcagagaaggaggctctgctggaagagacaaactcatttttgaaggctattgaagaagccaataaaaaaatgcaagccgccgagatctctctagaggagaaggaccaacggatcggagaacttgacaggctcatagagagaatggagaaagaacgccaccagctgcagctccagctcctggagcatgaaacagaaatgtccggagaactgacagattctgacaaggagcgctatcagcaactcgaggaagcaagcgcatcactccgagagcgcatccggcaccttgacgatatggtgcactgtcaacagaaaaaagtgaaacagatggtggaagaaatcgaatctctgaagaagaagcttcaacagaagcagcttctcattcttcagctgctcgagaagatttcttttctggaaggtgaaaataatgagttgcagtccaggctggactatttgaccgaaacacaagctaagaccgaagttgagacacgcgaaattggggtcggctgcgacctgctgccctcccagacggggcgcactagagaaatcgtcatgccaagcagaaactataccccttataccagagttctggagttaacaatgaagaaaacattaacttag

SEQ ID NO: 189853 - DNA, 1317 bp, Artificial Sequence
  Description of Artificial Sequence: Synthetic coding sequence
atgctgcggagcaccagcaccgtgaccctgctgagcggcggcgccgccagaaccccgggggcccctagccggagagcaaacgtgtgccggctccgactgacggtgccgccagaatcgcccgtcccagaacagtgtgagaaaaaaatcgagcgaaaagagcaactgctggatttaagcaacggagagccaacccgtaagttgccgcagggtgtagtctacggggtggtgcggaggtccgaccagaaccaacagaaagaaatggtcgtgtatgggtggtcaacatcccagttgaaggaagaaatgaattacatcaaggatgtaagagccacactggagaaggtccggaaaagaatgtacggcgactacgatgagatgaggcagaaaataagacagctgactcaggagttatcggtttctcacgcccagcaagaatacttggagaatcatatccagacacagagtagtgccctagacaggtttaacgctatgaatagcgcgctggccagcgatagcatcggcctccagaaaactcttgtggatgtaacactagagaatagcaatatcaaggaccagatcagaaacctgcagcagacctacgaagcaagcatggacaaactgcgggagaaacagcgacagctcgaggtggcgcaagtcgagaaccagctgctcaagatgaaggtggaatccagccaggaggccaatgcagaagttatgagagagatgacaaagaagctttactcgcaatacgaagagaagctgcaggaagaacagagaaagcattccgccgaaaaagaagctctgctcgaggaaacaaatagcttcctgaaagcaatcgaagaagccaataagaagatgcaggccgctgagatttctctcgaggagaaagaccagaggataggggaattggatcgactcattgagcggatggagaaggagcgccatcagctccaactccagctcttagaacacgaaaccgagatgtcaggcgagttgacagacagcgacaaagaacggtatcagcagctcgaagaagcctcagcttccctccgggaaagaattcgccatctggacgacatggtccactgtcagcagaagaaggtcaagcagatggtcgaggaaaataacgaattacaaagcaggctcgattacttgaccgagactcaggccaaaaccgaagttgagacgcgagaaattggggtcggctgcgacttgcttccctcccagaccggccgcacccgtgagatcgtcatgcccagccgaaactataccccgtacacccgggtactcgagctgaccatgaagaagacattgacatag

SEQ ID NO: 189854 - DNA, 1401 bp, Artificial Sequence
  Description of Artificial Sequence: Synthetic coding sequence
atgctgcggagcaccagcaccgtgaccctgctgagcggcggcgccgctaggactcccggcgctccatcgcggagggctaatgtgtgccggctgagactcaccgtgcctccagagagcccggtaccggagcaatgcgaaaagaaaatcgagaggaaggagcagttgctcgatttgtccaatggcgaacctacccggaagctccctcagggcgttgtatacggagtggtgcgaagatccgaccagaaccagcagaaagagatggtggtgtatgggtggagcacttcacaactgaaagaagagatgaactatattaaagatgttcgcgccactctcgagaaagtcaggaagagaatgtacggtgattacgacgaaatgcgccagaaaattcgccagcttacacaggagctatctgtaagtcatgctcaacaggagtatctcgaaaatcacattcaaacccagtcctccgccctcgatcgatttaacgccatgaattctgcactggcgtcagattctattggcttgcagaagacgttagttgacgtgaccctggagaattccaacattaaggaccaaattagaaacctgcagcagacatatgaggccagtatggacaaattgcgcgagaagcagaggcagctcgaggtggcccaggtggagaaccagttgttgaaaatgaaggttgagagcagtcaagaggcgaacgcagaagtcatgcgcgagatgaccaagaagttatatagccagtacgaggaaaaattgcaggaggagcagaggaaacacagcgcagagaaggaggcgctgctcgaggaaactaattcatttttaaaagctattgaggaggcaaacaagaaaatgcaggccgcagagatcagcttggaagagaaggaccagcggatcggtgagctcgatagactgatagaaaggatggagaaagagaggcaccaactacagctccagctactcgaacacgagacggaaatgtccggagaactgacggatagcgacaaagaacgctaccagcagctcgaggaagcctcagcatcattgagagagcggataagacacctagatgacatggtacactgtcagcaaaagaaggttaagcagatggtcgaggagattgagtccttgaaaaagaagctccagcagaagcagctgctgattcttcagctactggaaaaaattagcttcctggaaggagagaataatgagcttcagtcacggctagattacttaaccgaaacccaagctaagaccgaggtggaaacacgggagattggcgtgggatgcgatctgctgccgagccagactggccgtacccgggagattgtaatgcccagcaggaactatacgccttacacccgggttctagagctcactatgaaaaaaaccctaacgtag

SEQ ID NO: 189855 - DNA, 2328 bp, Artificial Sequence
  Description of Artificial Sequence: Synthetic coding sequence
atggagaagttcggcatgaacttcggcggcggccccagcaagaaggacctgcttgagacaatagaaacccagaaaaagcagttattacaatatcaggctaggttgaaggacgttgtgagggcctacaaaagcctactgaaagagaaagaggcactggaagccagtattaaagtgctgtccgtgagccacgaagctgatgtgggactcgctggagtgcagctcccggggctgacattccctgactcggtggacgaccggtgcagtacgcactctgaggactcgactgggactgcaacaagcttagacaccgctgcatcattgacaagcacaaagggcgagttcggcgtggaagatgataggcccgcacgcgggcccccgccgcctaaatctgaggaagcctcatggtctgaaagtggtgtgtcaagtagcagcggcgacggaccttttgccggaggcgaggtggataagcggctgcatcagcttaagacacagctggccacactgacgtcctcccttgcgacggtgacgcaggagaaatctcggatggaggcctcatacctcgccgacaaaaagaagatgaaacaggacctcgaggatgcctcgaacaaggccgaagaagagagggcacggcttgagggtgagctcaaaggcctgcaagagcagatcgctgaaactaaggcccgcctaattactcagcaacatgatcgtgcccaggagcagtcagatcacgccctgatgttgcgcgagttgcagaaacttttacaggaagaaagaacccagagacaagaccttgagctaagactggaggagactcgtgaagcattggcgggtcgcgcatacgcagccgagcagatggagggctttgagctgcagaccaaacagctgaccagggaagtggaggaactgaagagcgaacttcaggccatccgagatgaaaagaaccagccggatccccggctccaagagctacaggaggaagctgccaggctcaaaagtcatttccaggcccaactgcaacaagaaatgcggaagactgccttggccgaggatcaactccggcaacagtcccaagtcgaggaacagagggtcgccgcattagagaatcaaatctcagaagtcagcgaattgctagggacctacgaaaaagcaaaacaaaaggaccaactggccatacagaagctcaaagaaagaatcctgcagttagaccttgagaacaaaactctggcgctggctgcgagctcgcggtcccccctggactctcacggagaggagagcagtctggatgtcaacgtcctgaaggacaagatggagaagctgaagaggctgctgcaggtggctgcacgaaaatctcaggtgaccctggatgtggagaaactgtgtgacttagaaataatgccctcttccgaggccgctgatggggagaaagctaccgccctctactatcagcaggaactaaagcagcttaaagaagaattcgaaaggtataagatgcgcgcgcaggtagtcttgaagtcgaagaacaccaaagacggcaatctaggaaaggaactggaggctgctcaggaacaactggctgagcttaaggagaaatatatctccctccgtctgagctgcgaggagctggagcatcagcatcaacaggaggcagatgactggaaacaggagcttgcgagactccagcagttgcacagacaggagctcgagcggtgtcagctggattttcgggaccgcaccttaaagctggaagaagagctccataagcagcgggacagggctttggctgttctaacagaaaaagacctggagctggagcagttgcggagcgtggctctcgcgagtggcctgcctggccggaggagtccggtcggtgggggaggacctggcgaccctgctgatactagtagtagtgattccctcactcaggccctgcagctggccgctgctaacgaacccacattctttctgtacgcggaacagttggcacgaaaggaagttgaaattacgagcctgagaaagcagaagcaccgcctggaagtggaagtgcaccagctacaggatcgcctactcgaagaaggggagcgccaccgagaagaagtcgctgcactgcaaagccacatcgaaaagaatattcgggatcagagtagagagggggccaatctggagtatctcaaaaacattatttaccggtttctgacactcccagactccctcggtcgccagcagaccttgaccgccattttaaccatactgcatttctctcctgaagagaagcaggtgatcatgcggctgccaacctccgcttcttggtggcctagtgggaagcgctag

SEQ ID NO: 189856 - DNA, 5055 bp, Artificial Sequence
  Description of Artificial Sequence: Synthetic coding sequence
atggaggacctggtgcaggacggcgtggccagccccgccacccccggcactggaaagtctaagctggagacattgccaaaagaggatctcatcaagtttgcaaaaaaacagatgatgttgatccagaaggccaaaagccgctgtactgagctggaaaaagagattgaagagttacggtcaaaaccggttacggaaggtacgggcgatattatcaaggccctgacggagaggttggacgcactcctcctggaaaaggccgaaactgaacagcagtgtctgagcctgaaaaaagagaacatcaagatgaagcaggaagtggaggactctgttacaaagatgggtgatgctcataaggagctagaacagtcccatataaactacgtaaaggagatcgaaaatcttaaaaacgaactgatggccgtcaggtctaagtactctgaagacaaagcaaacctccagaagcagctagaggaggctatgaacactcagttggagctttccgaacagttaaaatttcagaacaactccgaagacaatgtcaagaagctgcaggaagagatagaaaaaattcggcccgggttcgaagagcagatcctgtacctccagaagcagctcgacgctactacagacgaaaaaaaggagaccgtgacccagttgcaaaatatcatcgaagcaaactcacaacattaccagaagaacattaattcccttcaggaggagcttctgcagctcaaggccatacatcaggaggaagtcaaggaactgatgtgtcaaattgaggcgtctgccaaagaacacgaggctgaaatcaacaaactgaacgagctcaaggagaatctggtaaaacaatgcgaggcaagtgaaaagaatatacagaaaaaatatgagtgtgagctcgagaacctccggaaagcgacgagcaatgcaaaccaggacaaccaaatttgttctatcttactccaggagaacacttttgtggagcaggtcgtgaatgaaaaggttaagcatctcgaggacactctcaaggagttggagtctcaacattccatcctcaaagacgaggtgacatatatgaataacctaaagctgaaactggagatggacgcccagcatatcaaagatgaattttttcacgagcgcgaagaccttgagttcaagatcaatgagttgctcttggctaaggaagagcagggctgcgtgatagagaagctaaagtctgagctcgctggacttaacaagcagttctgttatacagtggagcagcataatcgtgaggtgcagagcctgaaagagcagcatcagaaggaaattagtgagctcaatgagacgttcctgagtgactctgagaaggaaaagcttacactcatgttcgaaattcaagggctgaaggaacagtgtgagaacctgcagcaggagaagcaagaagccatactgaattacgaatcgctgagggagatcatggagattctgcagacagaactaggagagagcgcgggaaaaatttcacaggaatttgagagcatgaagcaacagcaggcctcggatgttcatgagctgcagcagaagttgcggaccgctttcaccgagaaggatgcgctactggagacagtgaaccgcttacaaggcgaaaatgaaaagctgttgagccaacaggaactggtccccgagctagagaatactatcaaaaacctgcaggagaaaaacggggtttatttattgtctctgagtcagcgagacaccatgcttaaggagctcgaaggaaaaatcaattcactaactgaagagaaagatgactttatcaacaagcttaagaattcccacgaagagatggacaactttcacaagaagtgcgagagggaagagcggctgattctagagttgggcaaaaaagtggagcagacaatccaatataactcagaactggaacagaaagtcaacgaattgactggtggactcgaagagacgctcaaagaaaaggaccagaacgaccaaaaactcgagaagctgatggttcaaatgaaggtcctgtccgaggacaaagaggtgctaagtgctgaagtgaaaagcctttatgaagagaataacaagctgagcagtgaaaaaaaacagttgagtcgcgacctagaagtctttctgtcacagaaggaagatgtcattctaaaagaacacatcacgcagcttgagaagaagctgcagttgatggtggaggagcaggacaacttgaataaactcttggaaaatgagcaagttcagaaattgtttgtgaaaacacagctgtacggcttcctgaaggagatgggctccgaagtgtccgaggattccgaagagaaggacgtcgtcaacgtgcttcaagctgtcggagaatcactggccaagatcaatgaagagaaatgcaacctagctttccaaagggacgagaaagtgttagagctcgaaaaggaaatcaaatgtcttcaggaggaatctgtcgtccagtgtgaagagttaaagtccttgttgcgcgattacgaacaggagaaggtcctactgcgcaaggagttagaggaaatccaatccgaaaaagaagctttgcaaagcgatttactcgagatgaagaacgccaatgagaagacacgcctggagaatcaaaacctgctgatacaggtggaggaggttagtcagacatgcagcaagagtgagatccataacgagaaagagaagtgtttcatcaaggaacatgagaatctgaaacctctgctggagcagaaggagctgcgagaccggcgtgcagagctaattctgcttaaagactcactggcgaaaagtccctctgtcaagaacgacccactatcatcagttaaggaactcgaagaaaagatcgaaaatctggaaaaagaatgtaaagagaaagaagagaagataaataagatcaagctggtggccgtgaaggcaaaaaaggagcttgattcctcccgcaaggagactcagacagttaaagaggagcttgagagtctgcgtagcgagaaggaccagcttagcgctagtatgagggatcttatacaaggggccgagagttacaaaaaccttctgcttgaatacgagaaacaaagcgaacagctggacgttgagaaagagcgcgccaacaactttgaacacagaattgaagatttgaccagacagttgaggaacagtaccctccaatgtgagacaatcaactccgacaatgaggacttactggcaagaattgaaacgctacagtcgaacgctaaactcctcgaggtgcagattctagaagttcagagagccaaagccatggtggataaggagctcgaagctgagaagctccagaaggagcagaaaattaaggaacatgccacaactgtgaacgagctggaggaactgcaggtccagttacagaagcagaaaaaacagcttcagaagactatgcaggaactggagcttgtgaagaaagacgctcaacagactacactaatgaacatggagatagccgactatgaacggcttatgaaggagctgaatcagaagctgaccaataaaaacaataaaattgaagacctggaacaagaaataaaaattcaaaagcagaagcaagagactctccaagaggaaataacctctttgcaatcttcagttcaacagtacgaagaaaagaatacaaagatcaagcagcttctagtcaagactaagaaagagctcgctgatagcaagcaggccgaaacagatcacctgatcctgcaggctagtctaaagggggaactcgaagcctcacaacagcaggtggaggtatataaaatccaactggccgagatcactagtgagaagcacaagatacatgaacatctgaagacatctgccgaacagcaccaacgaacattgagcgcctaccaacagcgcgtcaccgcccttcaagaggagtgtcgggccgcaaaagctgagcaggccaccgttacctcagagtttgaaagttacaaagtgcgggtgcataacgtcttgaagcagcagaaaaacaaatccatgagtcaggcagaaacagaaggcgccaagcaggagcgcgagcacctggagatgctgatcgatcagctgaagatcaaactgcaggactcccagaataacttgcagataaatgtgagcgagttgcagacactccagtctgagcacgacaccctccttgagcgccacaataagatgcttcaggagacagtatcgaaagaagcagaactgagggaaaagttgtgctctattcagtccgaaaacatgatgatgaaatcagaacacacacaaaccgtaagccagctgacctcgcaaaacgaagtcctgcgcaactcttttcgggatcaggtacgccacctgcaggaggagcatcgcaaaaccgtcgaaactctccagcaacagctaagcaagatggaggctcagcttttccaactgaaaaacgagcccacaacccggtcccctgtttctagccagcagtccttaaaaaatctccgggagcgcaggaacactgacctgcccctcctggatatgcacacagttacacgcgaggagggggaaggaatggagacaaccgacactgagagcgtatcctctgcctccacttatactcagtccctggaacagcttctgaactcgcctgagacgaaactcgaaccgcccctctggcatgctgaattcacaaaagaggaactggtacagaagttatcaagtactacgaagagtgcagaccacctcaacgggctgctccgggaaactgaggcgactaacgccatcctgatggagcagattaaattactaaaatcggagattaggaggctcgaacggaaccaggaacgggaaaagtctgcagccaatctggagtacttgaagaacgtcctgctgcagttcattttccttaaacccggatcagaaagagagcggctcttaccagtgatcaataccatgctacagctgagccctgaggagaaaggtaagctggccgcggtcgcccagggcgaggaagaaaatgcaagcagatcctccggctgggccagctatctacattcttggtccgggcttcgatag

SEQ ID NO: 189857 - DNA, 2052 bp, Artificial Sequence
  Description of Artificial Sequence: Synthetic coding sequence
atgtgccagatcgaggccagcgccaaggagcacgaggccgagatcaacaagctgaatgagctcaaggagaatcttgtgaagcaatgcgaggcatcggagaaaaatatccagaagaaatatgaatgcgagctcgagaatctgcgaaaagcgacctctaacgccaaccaggataaccaaatctgtagcatcctcttacaggagaacacctttgtggaacaggtggtgaatgaaaaagtgaaacatcttgaagacaccttgaaagaactagagtctcaacattccattctgaaagacgaggtgacatacatgaacaatttgaagctgaaacttgagatggatgcacagcacattaaagacgaattcttccacgagcgtgaggacctggaatttaagattaacgaactgctcctggccaaggaggaacagggctgtgtcatcgagaaactgaagtctgaactcgcaggtttgaacaaacagttctgctacaccgtcgagcagcacaatcgcgaggttcagagtctgaaggagcagcatcagaaggagatttcggagctgaatgagacattcttaagtgattctgagaaggaaaaactcactctgatgtttgaaattcaggggctgaaagagcaatgtgaaaaccttcagcaggagaaacaggaagcgatcctcaactacgaaagcctgcgggaaatcatggagatccttcagaccgaactcggagagagtgccggcaaaatcagccaagagtttgagtctatgaaacagcagcaggcatccgacgtacatgaactgcagcagaagctgcgaaccgcattcactgaaaaggatgcgctcctcgaaactgtcaaccgactgcagggggagaacgagaaactgttgtcgcaacaagagttagttcctgagcttgaaaacacaattaagaatttacaggagaagaacggcgtctatctgctgtcacttagccaaagggataccatgcttaaagagctggaaggaaagatcaatagcctgacagaggaaaaggacgactttatcaataaattgaagaactcccacgaggaaatggacaattttcacaaaaagtgcgagcgggaagagcgattgattcttgaactcggcaagaaagtggagcagaccattcagtataacagtgaactggaacaaaaagttaacgagctaaccggaggcttagaagaaacactgaaagagaaggatcagaacgaccagaagcttgaaaaactgatggtacaaatgaaggtgttgtctgaggataaggaggtcctgtccgccgaagtcaaatccctgtacgaggaaaccattaattctgtgcaaaaaaagcagttgagcagggatctcgaggtatttctctctcagaaggaggacgtaattctcaaggagcacattacccagctcgaaaagaagctgcagctaatggtggaggagcaggataatttgaataagctgctcgaaaacgaacaggtgcaaaaattgttcgtcaagacacagctgtatgggtttcttaaggagatggggtccgaggtgagtgaggactctgaggaaaaagatgtagtgaacgtgctgcaggcagtgggagaatccctcgccaaaatcaacgaggaaaaatgtaaccttgcatttcagcgtgacgagaaggttttggaattggagaaagaaataaaatgtcttcaagaagagagcgtggtgcagtgtgaagagctgaaaagcctgcttagagactatgagcaggaaaaggtcctgctgcggaaagaactggaggagattcaatccgagaaggaggccctccagtcggatctgctcgaaatgaaaaatgccaatgagaagactagacttgaaaaccaaaaccttctcatacaggtggaagaagtatcccagacatgttccaaaagcgaaattcacaacgagaaggaaaaatgcttcatcaaggagcacgaaaatctgaagccgctccttgagcagaaggagctgcgcgaccgcagggctgagttgatcttactaaaggactctcttgcgaagagcccatcgaaaaaatag

SEQ ID NO: 189858 - DNA, 1347 bp, Artificial Sequence
  Description of Artificial Sequence: Synthetic coding sequence
atggaggacctggtgcaggacggcgtggccagccccgccacccccggcacaggtaagtctaagctagagaccctcccgaaggaggatctcatcaagttcgccaagaaacagatgatgctgatccagaaggccaagtcccggtgtaccgagctggagaaggagatagaggaactccggagcaagcctgttactgagggtaccggcgacattattaaagcgctcaccgagcggctggacgcacttctgctcgagaaagctgaaaccgaacagcagtgtctatccctgaaaaaagaaaatatcaaaatgaaacaggaggtggaggactccgtcacaaaaatgggggacgcccataaagaattggagcagtctcatatcaactatgtgaaggagatagagaatctgaaaaatgagctgatggccgtgcgctccaagtactcagaagacaaggcaaacctgcagaagcagttggaggaggccatgaatactcaactggagctgagcgagcaattgaaattccagaataactccgaggataatgtgaaaaagcttcaggaggagatagagaagatacgccccggatttgaagagcagattttgtatcttcagaaacagctggacgccacaaccgatgaaaagaaggaaaccgtcacacagctacagaacatcatcgaagccaactcccagcactatcaaaaaaatataaattctttacaggaggaacttctacagctgaaggctatacatcaagaagaggtaaaggagcttatgtgtcagattgaggcctcagccaaggagcacgaggcagaaattaacaagctgaacgagctgaaagagaacctagttaaacagtgcgaggcctccgagaagaatatccagaaaaaatatgagtgtgaactggagaacctgcgtaaggcaacaagcaatgctaaccaggataatcaaatctgctctattctgttgcaggagaatacgtttgtggagcaagtcgtcaacgaaaaggtcaagcacctggaagacactcttaaggaactagaaagccagcactccatattaaaggacgaagtgacctatatgaacaatctgaagctcaaactagaaatggacgcacagcatattaaggacgaatttttccacgagcgcgaggacctcgaattcaagataaatgagctgctgctcgccaaagaagagcaggggtgtgtaattgaaaagctgaagtcggagctggccggactgaacaaacagttctgttacaccgttgagcagcacaatcgagaagtgcagagtctcaaagaacagcaccagaaagaaattagtgaactcaatgagaccttcctttctgatagctag

SEQ ID NO: 189859 - DNA, 1878 bp, Artificial Sequence
  Description of Artificial Sequence: Synthetic coding sequence
atggcccaggccctgagcgaggaggagttccagcggatgcaggcccaacttctcgaattgaggaccaataactaccagttgtctgatgaactgcggaaaaacggggtcgaactgacttccctgagacagaaagtggcatatctcgacaaagagttctcaaaagcccaaaaggccctttcaaaaagcaaaaaggcccaagaagtggaggttttgttaagcgaaaatgaaatgttgcaggccaagctccactctcaggaggaggacttccgtttacagaattctacactgatggccgagttttccaaggaaaggtacggaaaagaagcgggaaaattctcagccgtgtccgaagggcaaggcgaccctccaggtggtcctgcgcctaccgtgctggccccaatgcctctcgctgaagtcgagctaaaatgggagatggagaaggaggagaaaagattactttgggagcaattgcagggcctcgaatcctcaaaacaagcggagacctcccgcctccaggaggagctggcgaaactctcagaaaaacttaaaaagaagcaggaaagcttttgtcggctgcagaccgaaaaggagaccctgtttaacgactcaagaaataagatagaggaacttcagcagagaaaggaggctgatcacaaggcacagcttgcccggactcaaaagttgcaacaggaactcgaggctgcaaatcagtctttggccgaactgcgcgatcaacgacaaggcgaacgactagaacatgccgccgcacttagagcacttcaggaccaagtctccatccaaagcgccgacgcccaagaacaagtggaaggactactggcagagaataatgcactgcgcacttctttggccgctctcgagcagattcagaccgcaaaaacacaggagctgaacatgctgcgcgagcaaacaacaggcttagcagctgaactgcagcaacagcaagcagagtatgaagacctgatgggacaaaaggatgacctaaatagtcagttacaggagagcttgcgagcaaactctaggctgttggagcagctccaggagattggccaggaaaaggagcagcttacacaggaactccaggaggcaagaaagagcgcagagaaacggaaagcaatgttagacgagctggccatggagacacttcaggaaaagtcccaacataaagaagaactcggggctgtacggctacgccacgaaaaggaagtcctcggggtccgcgcaagatatgagcgggaactgcgtgaactgcacgaagataagaaacgacaggaggaagagctgaggggccagattcgcgaagaaaaggcaaggacacgggagttggagactctccagcagacagtggaagagctacaggcccaagttcattctatggacggcgccaaggggtggtttgagaggaggttgaaggaagccgagggcaaggaggaggaactgcaggacgttcgcgaccagttagagcaggcacaggaggagcgggattgtcacttaaagacaatctcaagtttgaagcaggaggtcaaggacacagtggacggacagaggatacttgagaagaaggggtccgcagctttaaaggacctgaaacgccagcttcatctcgaacggaagagggctgacaagctgcaggaacggctgcaggatattcttaccaactccaagtctagatctgggctggaagaactcgtgctctccgaaatgaatagcccctcccgcactcagaccggggatagctctagcattagcagcttcagttacagggaaatccttagggagaaagagtcgtcagctgttcctgctagggtcagaggcaaagaagaaccaaccgcccccgctagcctgaatccgaagatttag

SEQ ID NO: 189860 - DNA, 2433 bp, Artificial Sequence
  Description of Artificial Sequence: Synthetic coding sequence
atggcccaggccctgagcgaggaggagttccagcggatgcaggcccagctcctcgaactgcgcaccaacaactaccaactgtccgacgagttgcgcaagaatggggtggaactaacatccctcagacagaaagtcgcttacctggataaagagtttagcaaagcccaaaaggccttaagtaaatcaaaaaaagcacaggaagtggaagtcctgctgtcggagaatgagatgctccaggcaaaattgcatagccaggaggaggattttcgacttcagaactctacgttgatggcagagttctctaagctctgtagtcagatggagcagcttgaacaagaaaaccagcagctcaaggaaggagcagctggtgccggtgtcgcccaggccggcccactagtggacggggaactgctgcgactccaggctgaaaacacagccctgcagaagaatgtcgcggcgttacaggaaagatatggtaaggaggcgggaaagttctcagcagtatcagaagggcagggggacccaccgggtggtcccgccccaacagtgctggcgcccatgccactcgcagaagtcgagctgaagtgggaaatggaaaaagaagagaagcggctgctgtgggaacaactacagggactcgagtcctccaagcaggcagaaacatcaagactccaggaagaattggccaaactgtccgaaaagctcaagaagaaacaggagtctttttgtcgcctgcaaaccgagaaagagaccctgtttaatgatagccgaaacaagatagaggaactgcagcagaggaaggaggcagaccacaaggcccagctcgcccggacccagaagttgcaacaggagctcgaggccgccaaccagagtctagctgaactccgagatcagcggcagggggaaagactggagcacgcagctgcactgagggccttacaagatcaaatccagacagctaaaacccaagagctgaacatgctgagggagcaaaccacaggactagccgccgagctacagcagcagcaggcagaatacgaggatctgatggggcagaaagatgatctgaacagccagttgcaagagtctcttagggctaatagcaggcttctggaacagcttcaagagattggacaggagaaggaacagctgacacaagagctgcaagaagccagaaagagcgctgagaaacgtaaggctatgttggacgagttggctatggaaaccctccaggagaaaagccagcacaaggaagaacttggcgcggtgagactaagacatgaaaaggaagttcttggagtgcgtgccaggtacgagcgagagctgagggaacttcacgaagacaaaaagagacaagaagaagagctgagaggacagattcgggaagagaaagcgagaacacgagagctggagaccctgcagcagaccgtggaggagctacaggcccaggtccacagtatggacggagcaaaaggatggtttgagaggcggctgaaggaggccgaagagagcctacagcagcagcaacaggaacaggaagaagcactgaagcagtgtagagaacagcacgcagccgagctgaaagggaaggaggaggagttgcaggacgtgcgggaccagttggaacaggctcaggaggaacgggactgccacttgaagactatctcgagtctcaagcaggaggtgaaggacacagtcgatgggcagcggattctggagaagaagggcagtgccgcccttaaagacctgaaacggcagctgcacctcgaacgaaagagggccgataagttacaagagcggttgcaagacatcttaaccaacagtaagagtcgctctggactggaggaattggtcctgtctgaaatgaacagcccaagtaggacgcaaacaggtgatagttcctccatatcatcctttagttatcgggagattcttcgggaaaaggaatcttctgccgtgcctgcccgcagtctgtctagctcccctcaggcccaaccacctcggcctgcagaactatctgacgaagaggtagccgaactgtttcagaggttggctgagactcaacaggaaaagtggatgctggaagagaaagtgaagcatcttgaggtctcttctgcatcaatggccgaagacctgtgtcggaagagcgctatcatcgagacctatgtcatggactctcgcattgacgtgtcagtggccgccggacatacagaccggtcgggcttgggtagtgtcctgcgggacctggtaaagcctggcgatgaaaacctcagagagatgaacaagaagcttcaaaacatgctggaagaacaactaactaagaacatgcatctgcataaggacatggaggtcttatcccaagagatcgtgcgactgtcaaaagagtgcgtgggcccaccagaccctgatctggaaccaggcgagacatcttag

SEQ ID NO: 189861 - DNA, 2526 bp, Artificial Sequence
  Description of Artificial Sequence: Synthetic coding sequence
atggcccaggccctgagcgaggaggagttccagcggatgcaggcccagctgctggagctaaggacaaataattaccagttgtctgatgaattacgtaaaaatggggtagagttgacatccctccggcagaaggtggcatatctggataaagaattttccaaggcccaaaaggccctatcaaaaagtaagaaggcccaggaagttgaggttctgctttccgaaaacgaaatgctccaggccaagctgcactcccaagaggaggacttccggttgcagaattctactctgatggccgagttcagtaagttgtgctcccagatggagcagctggaacaggagaatcagcagttaaaggagggggctgccggtgccggagtagcacaggccggacctctggtcgacggcgagctcctgcgcctgcaggccgaaaacactgctttacagaaaaatgttgctgccctacaggagagatacggaaaagaagcagggaaattctcggcagtgagcgaggggcagggcgatcccccaggcggtcctgcacccacagtactcgctcccatgcctcttgccgaggttgagttaaagtgggagatggagaaggaggaaaagaggttactgtgggagcagctgcagggactagagtcatcgaagcaagctgagacttcgaggcttcaagaggagctggccaagcttagcgagaaactaaagaagaaacaggagtcattctgccggttgcaaactgaaaaagagacgctattcaatgattcccggaacaagatagaagagctacagcaacggaaggaagcagaccacaaagctcagctggctaggactcagaagctacaacaggagttggaggcagccaatcagtctctcgccgagctgcgggatcaaaggcagggcgaacggctggagcacgcggccgctttaagggcattgcaggatcaagtttccatccagagtgcggacgcccaggagcaggttgaggggctcctcgcagaaaacaacgcgcttcgcacaagcctcgcagctctggaacagatccagacagcaaagacccaggagctgaacatgcttagggagcagaccaccggtttagcagctgaactgcagcaacagcaggctgaatatgaggacctgatgggacaaaaagacgatctgaacagtcaattacaggagagtttgcgggctaatagtcgcctgctggagcagctgcaggagatcgggcaggaaaaagagcagctgactcaggagttgcaagaagcacgcaaaagcgctgaaaagcgcaaggcgatgctggatgaacttgccatggagaccttacaggaaaaatcccagcataaggaagagttaggggcggtgaggcttcgccacgagaaagaggtgctgggagtgcgtgcccgatacgaacgcgaacttcgagagctccatgaagacaaaaagcggcaggaggaggagctcagaggtcaaattcgagaagaaaaagcaagaacacgagagctggaaaccctgcagcaaaccgtcgaagaattgcaagctcaggtgcatagcatggacggcgccaaaggctggttcgaaagacgtttgaaagaggccgaggaaagcttgcagcaacagcaacaggagcaggaggaggccttgaaacagtgccgggagcaacacgccgccgagctcaagggaaaagaagaggagctacaagatgtgcgggaccaactggaacaggcccaggaggaacgggactgtcatttaaaaaccatctcttcactcaagcaggaggttaaggacacagttgacggtcaaaggattctggaaaagaaggggtcagccgccctgaaggacctaaaacgccagctgcaccttgaaagaaaacgtgcagacaaattacaggagagactacaggacatattgactaactcaaaaagcagatctgggctggaggaactggttctgtctgagatgaatagcccctctcgcacacagacaggtgattcttcgtcaatctcgtccttcagttatcgggagattcttcgagaaaaggagtcaagcgctgtgcctgcccgcagcctaagctcatccccacaagctcagccgcccagacctgccgagctgagcgacgaagaggtggccgaactgtttcagcgtctggctgagacccagcaagaaaaatggatgctcgaagagaaggtaaaacacctcgaggtaagctctgcatccatggccgaggatttgtgccggaagagcgccataatagagacctacgtcatggactctcgtattgacgtgtctgtggctgctggacacacagaccgctctggcttgggatcggtgctcagagacctcgtgaaacctggcgacgagaacctcagagaaatgaacaagaaactgcaaaatatgttagaggagcaattaaccaaaaacatgcatctccataaggatatggaggtcctcagtcaggagattgtgcggctcagcaaggagtgcgtgggtccaccagatcccgatttggagcctggcgaaaccagctag

SEQ ID NO: 189862 - DNA, 2391 bp, Artificial Sequence
  Description of Artificial Sequence: Synthetic coding sequence
atggcccaggccctgagcgaggaggagttccagcggatgcaggcccagctcttggagctgcgcacaaacaattaccagctttctgatgagctgagaaagaatggagtggagctgacctcactacggcagaaagttgcctacctcgataaggagtttagcaaggcccagaagctttgttcccagatggagcaactggagcaagagaaccagcagctcaaagagggtgctgccggcgcgggggttgcacaggcgggtccccttgtagatggagagctgctgaggcttcaggctgaaaacactgctctccagaaaaacgtggcagctctccaggagagatatgggaaggaagctggcaaattcagtgctgtatcggagggccagggagaccctcctggaggccctgcccctacagtgctggctcctatgcccctggctgaggtggaactgaagtgggagatggaaaaagaagagaagcgactgctgtgggaacagttgcaaggtctggaatcatcaaaacaggctgaaacgagtaggctgcaggaagagctcgctaagcttagcgaaaaactaaaaaagaagcaggagtcattctgccggcttcagaccgaaaaggaaacactcttcaatgacagcagaaataaaatagaagaattgcagcagagaaaagaagctgatcacaaagcacagctcgcccggacccagaagctccagcaggaacttgaagccgccaatcagagcctggccgaactgagggaccagcgccagggggaacgactcgagcacgccgctgccctccgggcattacaggatcaggtaagtattcagtccgccgacgctcaggaacaggtggaaggcctactggccgagaataatgcgcttcgtacatccttggcagccctcgaacagattcagaccgcaaagactcaggaattgaacatgttgcgagagcagacaaccgggttagcggctgagctgcagcagcagcaggccgaatatgaagatctgatgggacaaaaagacgaccttaatagtcagttgcaggagagtcttcgtgcaaacagccgccttctcgagcaactgcaagagatcggccaggaaaaagaacagctcacacaggagctgcaggaagccagaaaatctgccgagaagaggaaagccatgctagatgagctcgcgatggaaaccctacaggagaagtctcagcacaaagaggaactaggcgcggtaaggctgagacatgaaaaggaggtgttgggggtgcgggcccggtatgagagggaactgagggaacttcatgaggacaaaaagagacaagaagaagaactgagggggcagattagggaggagaaagcccgaacccgggagcttgagaccctgcaacagacagtggaggagctgcaagctcaggtccactctatggacggcgccaagggctggtttgaaagaaggctgaaggaagctgaggaaagtctgcagcagcagcagcaggaacaggaagaagctctgaagcaatgcagagaacaacatgccgccgaacttaaggggaaggaggaggaactgcaggatgtccgggaccaactcgagcaagcccaggaggagcgggactgccacctcaaaaccatctcttctctcaagcaagaggtgaaggacaccgtcgacggacagcgcatcctggaaaagaagggaagcgctgccctgaaggatctgaaaaggcaactccacctagagaggaagagagcagacaagctgcaggagagactgcaggatatccttaccaatagtaagtccagaagcggtctggaagagctcgtcctctcagagatgaactctccctcgaggacccagaccggcgactcttcttcgataagctccttctcctatcgtgagattctgcgagaaaaggaaagtagcgcagtgccagcaagaagcctatcttcctctccccaggctcagcccccacgaccagccgagctgtcagatgaagaagtggctgaactcttccaacggttggcggagacccaacaagagaagtggatgcttgaggagaaggtaaaacacctagaagtcagttcagcctccatggctgaggatctatgtagaaagtctgccataatcgagacatatgtgatggactcccggatcgacgtcagcgtagccgcgggtcacaccgacaggagcggactcggttccgttcttagagatctggttaagcccggagacgagaacttacgggagatgaacaaaaagcttcaaaacatgctagaggagcagctcaccaagaacatgcatctgcacaaagacatggaggtgttatctcaggagattgttagactgagcaaagagtgtgtaggcccccccgacccggatctggaacctggggaaacatcctag

SEQ ID NO: 189863 - DNA, 2433 bp, Artificial Sequence
  Description of Artificial Sequence: Synthetic coding sequence
atggcccaggccctgagcgaggaggagttccagcggatgcaggcccaacttctcgagctccgaacaaacaattaccagctcagcgatgagctgcgtaaaaatggcgtagaactgacatctcttagacagaaggtggcatatctggataaagaattttccaaagcccaaaagtctccaggtccgtgccttccactgcaggaagtggaagtcctgctcagcgagaacgagatgctgcaggccaaattgcactcccaggaggaagatttcagattacagaatagcactttgatggccgagttctccaagttgtgtagtcagatggagcaactggagcaggaaaatcagcagctgaaagaaggtgcggccggggcaggggtggcgcaggccggaccactggtagacggggagcttctcagactgcaggccgagaacactgccttacagaagaacgtggctgcacttcaggaacgctacggtaaggaagccggcaaattttccgctgtttctgaaggccagggcgatccacccggcggaccagcacccactgtgctcgccccgatgcctctggccgaagtagagcttaagtgggaaatggagaaggaggagaagcgtctcttgtgggaacagctgcaaggactcgaatcctcaaaacaggccgaaacatctcgactgcaagaggagctggccaagctctccgaaaaactcaaaaagaaacaggagtcattctgtagactccaaaccgagaaagaaacgctttttaacgattccagaaataagatagaggagctgcagcagcgaaaggaggctgatcataaggcccaattagctcggacacagaaactgcagcaggagctagaagctgccaatcagtcactggccgaactgcgggaccagaggcagggggagagacttgagcacgcagccgctttgcgggctctgcaggatcagatccagaccgcgaagacgcaagaactgaatatgctccgggagcagaccaccggactggcagccgagctgcagcagcagcaggctgagtacgaggatcttatgggtcaaaaagacgatctgaacagccagctacaagagtccctgagggcgaactctaggctactcgagcaacttcaggagatcgggcaggagaaggagcaactaactcaggagctgcaggaggcccgcaagtcagctgagaagaggaaggccatgcttgacgaactggcaatggagacactgcaggagaagagtcagcataaggaagaacttggagccgtcaggctccgtcatgagaaggaagtgcttggagttagagcacgatatgaacgggagctacgagagcttcatgaggacaagaaacgacaagaggaagagctgagaggacagatcagggaggaaaaggctcggactcgagagttagagacactacaacaaaccgttgaggaattacaggcacaggtgcactctatggacggggctaagggatggttcgaaaggaggctcaaggaagctgaagagagcctgcaacagcaacagcaagagcaggaggaggccttgaaacaatgccgcgagcagcatgcagcagaactcaaaggtaaggaagaggaacttcaggatgtgagggatcagttggagcaagctcaggaggagagagactgccatctgaagacgatttcttccttgaagcaagaagttaaggatacagtggatggtcagcgaatccttgagaagaagggaagcgctgcattgaaagacttgaaaagacaactccacttagaaaggaaacgagcagataagctgcaagaacgacttcaggatatactcaccaactccaagtccaggagcgggcttgaggagctggttttatccgagatgaatagtccttctagaacccagaccggcgacagctctagtatctctagctttagctacagggaaattctgcgggagaaagagagctccgctgtgcctgctagaagcctatcgagtagcccacaggcacagccaccaagacccgcagagctgagcgatgaagaggtggcggagctgtttcaacgtcttgcagagacacaacaggaaaagtggatgcttgaagaaaaggttaaacatctcgaagtgtcttctgcctccatggctgaggacctgtgtcgtaaaagcgcgatcatcgagacgtacgtaatggacagccgcattgacgtcagtgtggccgccggacatactgacaggtccggcctggggtccgttctgagagacctagtgaaacccggtgacgaaaaccttcgtgagatgaacaagaaattgcagaacatgttagaagaacagctgaccaagaatatgcatttacacaaggatatggaagtcctttcgcaagagatcgtgaggctgagtaaagagtgcgtgggaccacctgatcctgatctcgagcccggtgagacctcatag

SEQ ID NO: 189864 - DNA, 1425 bp, Artificial Sequence
  Description of Artificial Sequence: Synthetic coding sequence
atgaagcgggtgctggtgctgctgctggccgtggccttcggccacgctcttgagcgaggcagggactatgaaaagaataaggtttgtaaagaattctcccatctgggaaaggaggatttcacttctctgtccttagtcctttatagtaggaaatttccaagcgggaccttcgagcaggtgagccagctcgtgaaagaggtggtgagcctcactgaagcttgttgtgccgagggggccgatcccgattgctatgacactcggaccagtgcccttagtgctaagtcgtgcgagagcaattctccctttcctgtgcatcccggtacggccgagtgttgcacgaaagaaggccttgagcgtaaactttgcatggcggccctgaagcaccaacctcaagagtttcctacatacgtggagcctacaaatgatgagatttgtgaggcctttcgcaaagatccgaaggaatacgccaatcagttcatgtgggagtacagcactaactatggtcaggcccccctctccttgctggtatcatacacaaaaagttacctcagcatggtcggtagttgttgtaccagtgcttcacctaccgtttgcttcctgaaagaacggcttcagctaaagcacctctccctgcttactacattgtctaaccgtgtttgtagccaatacgcagcatacggcgagaagaagtcgcggctctctaacttgattaagcttgcacaaaaagttcctaccgcagacttggaagacgtgctgccccttgcagaagacattacaaatatcctgagtaaatgctgcgaatctgcctcagaagattgcatggccaaggagctgcccgaacacacagtgaagttgtgcgataatctatcaacgaagaatagcaagtttgaggattgttgtcaagaaaagaccgccatggatgtgtttgtgtgcacctacttcatgccggccgctcaactgccagagctcccagatgtggaattacccacgaacaaggacgtgtgtgacccaggcaacacgaaagttatggataaatatacattcgagttgtcaaggaggacccatcttccagaggttttccttagtaaagtcctggaacctactcttaagtcactgggggagtgctgcgacgtggaagattccaccacatgttttaatgccaagggaccactgcttaaaaaggagttgtcgagtttcattgacaaggggcaggagctatgcgccgactattccgagaatactttcacagaatacaaaaagaagttggccgaacggctgaaggccaaattaccggacgccacccctacagagttggccaagctggttaataaacactccgacttcgcttctaactgctgctccattaactcaccgcctttatactgtgacagtgaaattgacgcagagctgaaaaatatcctctag

SEQ ID NO: 189865 - DNA, 438 bp, Artificial Sequence
  Description of Artificial Sequence: Synthetic coding sequence
atgaagcgggtgctggtgctgctgctggccgtggccttcggccacgcactcgaaagaggacgtgactatgagaagaacaaggtgtgcaaggagttttctcacctgggcaaagaggacttcactagtctctctctcgtgttatactccaggaagttccctagtggaacttttgaacaggtgagccaactggttaaagaggtagtgtctctgaccgaagcgtgctgcgccgagggggctgacccagactgttacgatacccggacttccgcattatccgcaaagtcctgtgagagtaatagcccttttcctgtacacccaggtaccgcggagtgttgcactaaggaagggctggaaagaaaactctgcatggctgccttaaaacatcaaccacaggagttccctacctacgttgagccaaccaacgatgagatttgttag

SEQ ID NO: 189866 - DNA, 1482 bp, Artificial Sequence
  Description of Artificial Sequence: Synthetic coding sequence
atgctgtggagctggagcgaggagcggggcggcgccgcccggctgtctggccggaagatgaaacgagtgctcgtcctactacttgcagttgcatttggacatgctctagagaggggccgagattacgaaaaaaataaagtgtgtaaagaattttcgcaccttgggaaggaagacttcaccagcctatctttagttctgtattctaggaagttccccagcggtacttttgagcaagtgtctcagttagtcaaggaggtagtctcccttaccgaggcatgttgcgccgagggtgcagatccagattgctatgatactcgcacatcagccctgagtgcaaaatcttgtgagagcaatagcccctttcctgtgcacccaggtaccgcagaatgctgcaccaaagaaggactggagaggaaactgtgcatggcggccctgaaacaccagccccaagagtttccaacctatgttgaacctacaaacgacgaaatctgcgaggctttcagaaaggacccgaaggagtatgctaatcagtttatgtgggagtattccacaaattacggccaggccccgctgagtctgttggtctcttacacgaagagctatctttccatggttggatcttgttgcacttcagcaagtcccacggtctgttttctgaaggaacggctgcagctgaaacatttaagtctcctcaccacgctgagtaacagagtttgttcacagtacgccgcttatggcgaaaaaaagagcaggctcagtaatctaattaaactggcacaaaaggtcccaacggctgatctggaagacgtgctgcctctggctgaagatatcaccaatattttgtcaaaatgctgcgagtcggcttcagaggattgtatggccaaagaactgcctgaacacactgtgaagctgtgcgataatctctccactaagaatagcaaattcgaggactgctgccaggagaaaaccgctatggacgtgtttgtatgcacctactttatgcctgccgcacaattgcccgagctgcccgacgtggagttacccacaaacaaggacgtgtgcgatcccggaaacacaaaggtcatggacaaatacactttcgagttatctcgcagaacacacctgcccgaggtatttctatcgaaggttttggaaccgactcttaaaagcttaggcgagtgctgcgacgtcgaggacagcacaacctgctttaacgcaaaaggtccacttctcaaaaaagagctgtcttcctttatagacaaagggcaagaactatgtgccgactactccgagaacacattcaccgagtataaaaaaaagcttgcggagcggctgaaggccaaactaccggatgccactccgactgagctggccaagttggtgaataaacatagcgatttcgcgtccaactgttgctcgatcaacagcccgccactgtattgcgacagcgaaatagatgctgagctgaagaatatcctgtag

SEQ ID NO: 189867 - DNA, 669 bp, Artificial Sequence
  Description of Artificial Sequence: Synthetic coding sequence
atggccgccagcgtgcggcaggcccggagcctgctgggcgtggccgccactcttgcccccgggtctagaggatatagggccaggccaccaccaaggaggcgcccaggaccccgatggcctgatcctgaagaccttctgaccccacggtggcagctcggcccaagatacgctgccaagcagtttgcccgctacggcgctgcctctggggtggtccccgggtctctatggccttcccccgaacagttgcgggaacttgaagccgaggagcgcgagtggtatccgtcccttgctacgatgcaggaatcactgagggtgaaacagctggccgaggagcagaaacgtcgtgagcgcgaacagcatatcgctgagtgtatggccaagatgccacagatgatcgtgaactggcaacagcagcaaagagagaactgggagaaggctcaagcggataaggaacgacgggcaagactgcaggcagaagcccaggagctgctggggtaccaggtagatcccagaagcgcacgctttcaggaactgttacaggacctggaaaagaaggagaggaagcgcctgaaagaggaaaagcaaaagcggaaaaaggaggctagagccgcggcactcgctgccgcagtggctcaggacccagctgcctcaggagcacccagttcctag

SEQ ID NO: 189868 - DNA, 1038 bp, Artificial Sequence
  Description of Artificial Sequence: Synthetic coding sequence
atggtggccgccctgctgggcggcggcggcgaggcccggggcggcaccgttccaggggcctggctgtgccttatggcactactgcagctgctgggatctgccccacgggggtctggactggcccacggcagacggctgatctgctggcaagcgctcctgcagtgccagggcgagccggaatgttcatacgcatacaatcagtacgccgaggcttgcgcacctgtgttagcacagcatggcgggggggacgccccgggcgccgcagctgcagcgttccctgcatccgctgcatccttttcctcccggtggcgctgcccatctcactgtatctcagccctcattcagctaaatcacacaaggcgtggccctgcactggaggattgtgactgtgcccaagacgaaaactgtaagagcacaaagagagccatagaaccttgtcttcctcgaacaagcggcggcggtgccggggggccaggtgccggcggtgtcatggggtgcacggaggcccggagacggtgtgatagggacagtagatgcaatctggccctgtcacgctatctgacatactgcggcaaagttttcaatggtctgcgctgtacagacgaatgccgcactgttatcgaagatatgttggccatgccgaaagccgctctgttgaacgactgtgtgtgcgacgggctggaacggccgatctgtgagtccgtgaaggagaatatggcacggttatgtttcggcgcagaactgggtaatggccccggctcgtctggctccgatggcggtctcgatgactactacgatgaggattacgacgatgaacagcggacgggaggtgccggcggggaacagcccttagacgatgacgatggggttccacatcccccacgaccagggtccggggctgccgcttccggcggccgtggcgaccttccatacggaccaggacggcggagcagcggaggaggcggtagattggccccccgcggcgcatggacacccctcgcttctatcttactgcttctgctggggcctttattctag

SEQ ID NO: 189869 - DNA, 942 bp, Artificial Sequence
  Description of Artificial Sequence: Synthetic coding sequence
atgtgcaccgccctgagccccaaggtgcggagcggccccggcctgtcagacatgcaccagtactcccaatggcttgctagtagacatgaggccaacctgctgcccatgaaggaggacttggcactgtggcttaccaacctgttaggtaaggaaatcacagcagaaacattcatggaaaaattggacaacggagccctgttgtgtcaattagcagagacaatgcaagagaagttcaaggagtccatggatgccaacaagcctaccaaaaaccttccattgaaaaaaattccctgcaagacatcggcgccttctgggagtttctttgccagagataacaccgcaaatttcctgagttggtgcagggatctcggtgttgacgaaacgtgcctgtttgaaagcgaagggctggtactgcacaagcagccccgtgaggtttgcttatgcttgttggaattgggaaggatagctgccaggtacggcgttgagcctccaggcttaatcaagctggaaaaggagattgaacaggaagaaactctgagtgctccttctccaagtccctcaccctcgtctaagtcttctggcaagaagtctacaggtaatttgttggatgatgctgttaaacggataagtgaagaccctccatgcaagtgtccaaataagttctgcgtcgagcgattgtcgcagggacggtaccgtgtgggagaaaaaatacttttcatacggatgctgcataataaacacgttatggtgcgcgttggagggggatgggaaacttttgccggttacctcctgaagcacgatccttgtcgaatgctccagattagccgcgtagacggaaagacctctcccatccagtctaagtccccaacactcaaggatatgaatcctgataattacctggttgtgtctgccagctacaaagccaagaaagaaatcaagtag

SEQ ID NO: 189870 - DNA, 942 bp, Artificial Sequence
  Description of Artificial Sequence: Synthetic coding sequence
atgtgcaccgccctgagccccaaggtgcggagcggccccggcctgtccgatatgcaccagtactctcaatggctagcctctagacatgaggcaaaccttctgcctatgaaggaggatctggccctgtggcttaccaacttattaggcaaggaaatcacagcagagacctttatggaaaagctggataacggcgccttgctctgccagctggccgaaactatgcaggagaagtttaaggaatctatggacgctaacaagccaacaaaaaatctgcccctaaaaaagattccctgcaagacctcggcccccagcgggtcctttttcgcccgggataacactgccaatttcctgagttggtgtagagatcttggtgttgacgagacctgtttattcgagtccgagggcctcgtgcttcacaagcagcctcgagaagtgtgtctgtgcttgctggagctaggccggattgccgcccgttacggtgttgaaccaccagggttgatcaaactcgaaaaggagatcgagcaggaggagactctgtcagcaccatcaccttccccctcaccctcttctaaaagtagcggcaaaaagtccacagggaatctcctggatgacgcggtaaaaagaatttccgaggatcccccatgtaagtgtcccaataagttctgtgtggagcgactctcgcagggacggtaccgcgttggagaaaaaatcttgttcattaggatgctgcacaacaaacacgtgatggtaagggttggaggcggatgggagacgtttgctggatacttgctcaagcatgatccctgccgcatgctacagatctctagagttgacggtaaaacatccccaatccagtccaaaagccctactctaaaggacatgaatccagataactatcttgtggtttctgccagctataaagcgaaaaaggaaattaaatag

SEQ ID NO: 189871 - DNA, 942 bp, Artificial Sequence
  Description of Artificial Sequence: Synthetic coding sequence
atgtgcaccgccctgagccccaaggtgcggagcggccccggcctgtctgacatgcaccagtactcccagtggctggcctctcgccacgaagctaacttgcttcctatgaaggaagatctggcattatggctgaccaacctgctgggcaaggaaataaccgctgagacctttatggagaaactcgataatggcgccctgctatgccagctggctgaaaccatgcaggaaaagtttaaggagtctatggatgccaacaaaccaaccaaaaatcttccgctgaaaaagattccttgtaagacctccgccccgagcgggtctttctttgcccgagataatacggccaactttctgtcctggtgtagagatcttggagtagacgaaacttgcctgtttgaaagcgaggggcttgtgctgcataagcagccacgcgaggtctgtctgtgcctgctggagcttggaaggatcgccgccagatacggagtagaacccccaggactgatcaagctcgagaaagaaatagagcaggaggaaactttatcagctccaagcccatcaccatcacctagctcaaagtcctctggcaaaaagtccaccggcaacctgcttgacgatgcagtgaaaaggatctctgaggatccaccatgcaaatgcccaaacaagttttgcgtcgaacggctttcacaaggacgctatagagttggtgaaaagatcctcttcattaggatgctgcataataaacacgtaatggtgagggtgggaggcggatgggagacctttgccggttatctcctgaagcacgacccttgccggatgctccagatcagtagggttgatggtaaaaccagcccaatccaatccaagtctcccaccctcaaagacatgaacccagacaactatttggtggtcagcgcttcttacaaggccaagaaggaaattaaatag

SEQ ID NO: 189872 - DNA, 546 bp, Artificial Sequence
  Description of Artificial Sequence: Synthetic coding sequence
atgtgcaccgccctgagccccaaggtgcggagcggccccggcctgagtgacatgcaccagtatagtcagtggctcgctagtagacacgaggcaaatcttttgcctatgaaagaggatctcgcattgtggttaaccaacctgctgggtaaggaaataaccgctgaaacctttatggagaagctggacaatggtgcgctcctctgtcagctggccgaaacaatgcaggaaaaatttaaggagtcaatggacgccaacaaacctacaaaaaacctgccactgaagaagataccctgtaaaacctctgccccatcaggatcctttttcgcaagagacaacacagcaaactttctgtcttggtgtagagatctcggagtggacgagacttgcctattcgagagtgagggcctcgtcctacacaaacagcctcgcgaagtatgcctgtgcctgttggaattgggcagaattgccgcgcgatacggcgtggagccgcccggcctgataaagcttgaaaaggaaattgagcaggaagagacactttccgcgtag

SEQ ID NO: 189873 - DNA, 618 bp, Artificial Sequence
  Description of Artificial Sequence: Synthetic coding sequence
atgtgcaccgccctgagccccaaggtgcggagcggccccggcctgagtgacatgcatcaatacagccaatggctagcttctagacatgaagccaacctcctcccaatgaaagaagatctggcactctggctcactaatctcctggggaaagagatcactgccgagacatttatggagaagctggacaatggcgctttactatgccagttggcagagactatgcaggagaaatttaaagagagtatggacgcgaataaacccaccaaaaaccttcccctcaagaaaattccctgcaagacctctgcgcctagcgggagtttcttcgccagggacaacacagctaatttcctaagctggtgtagagaccttggggtcgatgagacatgcttattcgagtctgaggggctggtgctgcataaacagccgcgggaggtttgcctttgtttgttggaactcggtcggatcgccgcacggtatggagtcgaaccccctgggctcataaagctggaaaaagagattgagcaggaagagactctgtctgcaccaagtccctcgccttccccttcttctaagtcctcaggcaagaagagtacagggaacttgctagacgatgcctag

SEQ ID NO: 189874 - DNA, 411 bp, Artificial Sequence
  Description of Artificial Sequence: Synthetic coding sequence
atgtgcaccgccctgagccccaaggtgcggagcggccccggcctgtccgatatgcaccagtactcccagtggctggctagtcgtcacgaggcaaacctgcttccgatgaaggaggatctggccctgtggctcactaatctgttgggaaaggaaataaccgctgagaccttcatggagaagctggacaacggagccttgctttgtcagctagcagagactatgcaggagaaattcaaagagagcatggatgctaacaagcccactaagaatctccccctcaaaaagattccctgtaagactagcgcgccatctggatcttttttcgctagagacaacactgcgaacttcctgtcttggtgtagggatctcggggtcgacgaaacctgtctgtttgagtctgaaggcctgtag

SEQ ID NO: 189875 - DNA, 468 bp, Artificial Sequence
  Description of Artificial Sequence: Synthetic coding sequence
atgtgcaccgccctgagccccaaggtgcggagcggccccggcctgtcagacatgcatcagtattctcagtggctggcaagccgccatgaagctaatctgttaccaatgaaggaggatctggccctgtggctgacgaatcttctcggcaaggagattacagcggaaactttcatggaaaaactagataacggcgcccttctgtgccagctcgcggagacaatgcaggagaaatttaaagagagcatggatgcgaataaacctactaaaaacctccccctcaagaaaattccttgtaaaacaagtgcaccgagcggcagcttttttgctagagataataccgctaactttttatcgtggtgccgagatctcggcgttgacgaaacttgtctgttcgagagcgaagggcttgtccttcataagcaaccccgtgaagtttgcctgtgcctgctggagctgggccgcatctag

SEQ ID NO: 189876 - DNA, 2043 bp, Artificial Sequence
  Description of Artificial Sequence: Synthetic coding sequence
atggccgaccccgtggccggcatcgccggcagcgccgccaagagcgtccggccctttcgctctagtgaggcctacgtcgaagctatgaaggaggatctcgctgaatggctgaatgccctctacggattgggtctgcccgggggcggcgacggcttcttgaccggcctggccacagggacaaccctttgtcagcatgcaaacgcagtcaccgaggctgcgagagcgctggctgccgcgcgtccagctagaggcgttgcttttcaagctcattctgtggtgcccggcagctttatggcaagggacaacgtagccacatttatcggatggtgtcgcgtagaacttggagtccccgaagttttgatgtttgagactgaagatctggtgttgcgtaaaaatgaaaaatccgtggtgctctgcctactggaagttgctagacgcggcgctcgcttggggcttcttgcacccagacttgttcaattcgaacaggagatcgagcgcgaactgagagccgcgccgccagctcctaacgcacccgccgctggagaagacacaactgagacagcaccagcacctggcacacctgcccgcggtcctagaatgaccccttccgatcttaggaaccttgatgagttagtgcgcgaaattttgggccgatgtacatgtcccgatcagtttcctatgataaaggtgtcagaagggaaataccgggtgggagacagcagcttacttatctttgttcgcgtcctgagaagccacgtcatggtccgtgtcggcggtgggtgggacacactagagcactacttggacaaacacgatccctgtcgatgttcttccacagcacataggcccccccagccgcgtgtgtgtacttttagcccacaacgggtgtcccccacaacaagtccacgccccgcatcgccagtccctggcagtgaaaggcgcggcagccggcctgagatgacccccgtgtccctgcggtccactaaggagggccccgagacccctccacgtccgcgggaccaactacctcctcacccacggtctcgaagatattcgggcgacagcgactcgagtgcctcaagcgcacagtctgggcctctggggactcggagtgatgacacagggactggcccgagaagagaacgaccctctcggcgactgaccacagggaccccggctagcccacgcagaccccctctccgaagccagtcccgagaccgtctcgaccgaggaagaccccgtggcgcacctggcgggcgtggggcccagctctccgtgccttcaccagcccgacgggccaggtctcagagccgcgaggagcaagccgtgctgctggtgagaagggaccgggatggccaacactcatgggtacccagagggaggggctcagggggaagcggacggtccacaccacagacaccccgcgcccgatctccggctgcgcctaggctgtcacgggtgtcatcaccatctccagagctggggaccacgcctgccagtatctttcggactcccctgcagttggatccccagcaggagcagcagctgtttcgtcgcctggaagaggagttcctcgcaaatgccagagctctggaggccgtggcttctgtgacgcccacagggcccgctcccgatccagcccgggcccctgatccaccggcacctgacagtgcctattgctcatcctcatcctcatctagttccctcagcgtcctgggcgggaagtgcggtcagccaggggatagcggccgcaccgccaacggattgccggggcctcggtctcaggctcttagctcatctagcgacgagggttcaccctgccccggaatggggggaccgctcgacgctcccgggagtccccttgcctgcaccgagccatctcgtacatgggcccgtggacgtatggacacgcagccagatcgcaagcctagtagaatccctacgccccgggggccccggcggccctctggccctgctgagctgggcacctggcacgctttgcactctgtgacgccgcgggccgagcctgactcgtggatgtag

SEQ ID NO: 189877 - DNA, 1014 bp, Artificial Sequence
  Description of Artificial Sequence: Synthetic coding sequence
atggccgaccccgtggccggcatcgccggcagcgccgccaagagcgtacggcccttccgttcctcagaggcttacgtggaggcgatgaaggaagatctggccgagtggcttaacgcgctctacggcctcggtctgccaggagggggagacggcttcctaaccgggcttgccaccggcactacgctgtgccagcacgcaaatgcagtaaccgaagcagctagggcactggccgctgctaggcctgcaaggggtgttgcattccaggctcactccgtggtgccagggtcttttatggccagggacaatgtggcaacttttatcggatggtgcagagtagaattgggagttcccgaggttctgatgtttgaaactgaggaccttgtactgcgcaaaaatgaaaaaagcgttgtgctctgtctcctggaggtcgcacgacggggagcgcgccttggcttgctggccccgcgtttggtccaatttgagcaggaaatcgaacgggagctcagggccgcgccgcccgctccaaatgccccggcggccggggaagacaccacggaaaccgctcccgcacccggaactccagccaggggtccgaggatgacccctagtgatctccggaacctagatgaactcgtgagagagattttggggcgctgcacctgcccggaccaatttcctatgataaaagtcagcgagggcaagtaccgggtcggcgattctagcttgttaatatttgtgcgcgtcctgaggtcccacgtgatggtccgcgtgggaggtggctgggatactctggaacactacctggacaaacatgatccttgcagatgctcaagcactgcccaccgccccccgcaaccaagagtttgtaccttcagtccccagcgtgtttctcccacgaccagccctagacccgcctctcctgttcctggtagtgagcgccggggctcacgtccggaaatgaccccagtgagtctgcgcagcaccaaagaggggcccgaaaccccacctcgatag

SEQ ID NO: 189878 - DNA, 990 bp, Artificial Sequence
  Description of Artificial Sequence: Synthetic coding sequence
atggccgaccccgtggccggcatcgccggcagcgccgccaagagcgttagaccttttcggtcatccgaggcttacgttgaagccatgaaggaagacctcgccgagtggctgaacgctctctatggcctcggcctcccaggcgggggggatggcttccttaccggtctcgccaccggcactaccctgtgccagcatgctaatgctgtcacagaagctgctagggcactagctgccgcccggcccgcaaggggggtcgctttccaggctcattcagtggtgcctggctcgttcatggctcgcgataatgtagccaccttcatcggctggtgtcgcgtggaattgggcgtccccgaagtgctgatgtttgaaactgaagatctggtccttaggaaaaacgagaaatccgtggtgctgtgtctcctagaggtggcccggcgaggagctcggctggggctgctggcaccgagactggtccaattcgaacaggagattgaaagggaattacgggcggccccacccgccccgaacgcgccggcggccggcgaggacaccacagaaacggctcccgccccgggaacgcctgcccggggcccgcggatgactcccagtgacctgcgaaacctggatgagctggtacgggagatcttgggacggtgtacttgtccggatcagttccccatgattaaggtatctgaggggaagtacagagtaggtgattcctcattactgattttcgttcgggtactccgcagccatgtgatggtcagagtcgggggcggctgggacactttagagcactacctggacaagcacgatccatgcaggtgctccagcaccggccctggaatctcatgtcctcctatcccagccccagctgctacacctggaacagtcacaccacagccaccaccaccgcgcgccgcgccgctggtgcccgccgtgatgactcaggctctggccccaggcggctccgacccggcaggcggctag

SEQ ID NO: 189879 - DNA, 1614 bp, Artificial Sequence
  Description of Artificial Sequence: Synthetic coding sequence
atggccgaccccgtggccggcatcgccggcagcgccgccaagagcgtacgtccgttccggagttccgaggcatacgtggaggccatgaaagaagatttagctgagtggctgaatgccttgtacggcctgggcttgcctggcggaggcgacgggtttcttacgggcctggctactggcaccacactctgtcagcatgccaatgccgtcaccgaggccgcccgcgcgcttgcagcagcaaggcctgcccgcggtgtcgcgttccaggctcacagtgtagtacctgggagctttatggcacgggataacgtggccacattcatcggctggtgcagagtggaactgggggttccagaggtgctgatgtttgaaactgaggatctggtactgaggaaaaacgaaaagtccgtcgtgctgtgtctgcttgaggtcgctcgacgaggagccagactgggacttctggcccccagattggtacagtttgaacaggaaattgagagagaactgcgcgcggcaccaccggccccaaacgctcccgccgcaggagaggacacaactgagaccgctcccgcacccggtacacctgcacgggggcctagaatgaccccatctgatcttcggaatctggacgaactggtgagagaaattctcggccgatgcacctgccctgaccagtttcctatgattaaggtgtctgagggcaagtatcgcgtcggcgatagtagcttactgattttcgtccgggtgttgagaagccatgtgatggtgagagtaggcggggggtgggacacactggaacactacctggataagcacgacccttgccgctgctcgtctactgcccatcggccgccccagcctcgggtatgcacgttttccccccaaagggtgagcccaaccaccagcccacgcccagcctctcctgttcccggtagcgaaagacggggaagccgaccagagatgactcccgtttcgctccgttccacgaaagagggacctgaaacaccacctcgccccagggaccagcttcccccacatcctaggtcccggcgctattccggcgactctgattctagtgcgtcatcagcacagagcggtccactggggactagatcagacgatacagggactggtccccggcgggagagaccttctcggagactgacgaccggaacaccagcatcccctagacgaccccccgcctgtgcagccagtcctgagacaggctggatcgctgctgggcccggcgggccccaggaggccggcgagccgagttgcaggtccccggccctgcctggaggcccgggagctagggcagctcggtcgagactgtgttgcctgtgcgctggtatcgagacgggcagtactcacgggtgtcaaggggccggtgccgtcggggccagagccggcgcgcccccaaggctacccgtgccagcggctcttcagcatcccggattccccggttcacccgcacccgtgcagtcttgggccccacacaggcccgcgtctagcgctcatccttgcagctccaccagatcaagaagttcttcatgctccggggcttggaaaagatcatcatggccaatgcctggtccactacgactactgctggcttag

SEQ ID NO: 189880 - DNA, 1614 bp, Artificial Sequence
  Description of Artificial Sequence: Synthetic coding sequence
atggccgaccccgtggccggcatcgccggcagcgccgccaagagcgtgcgtccttttcggagcagtgaagcttacgttgaagccatgaaagaggatctagctgagtggctcaatgctctctacggcctggggctgcctggcggaggcgacggtttcctgaccgggttagctactggcacaactctgtgccagcatgcaaatgccgtgacagaggctgcccgtgcgcttgcagcggcacgaccagcgaggggtgtggcgttccaggcccacagtgtcgtgcccggctcattcatggccagggataatgtggcaaccttcataggctggtgcagagtggaacttggtgttcctgaagttctgatgtttgagacggaagacttggtgttgcgcaaaaacgaaaaatctgttgtactgtgcctgttggaggtggcaagaaggggagccagactggggttgcttgcaccacgccttgtgcagtttgaacaggaaattgaaagagagctgagggcggcgccaccggcaccgaatgctcccgccgctggcgaagacacaaccgaaaccgctccagctccgggcaccccggcaagaggcccacggatgacaccgtccgatctacgaaacctggacgagctagtgcgtgagatcctgggaaggtgcacttgccctgatcaattccccatgatcaaggtcagtgagggcaagtacagagtcggcgactcctctctgctgattttcgtgcgggtgcttcgttctcatgtcatggtgagagtgggaggcggctgggatactctcgagcattatctcgataagcatgatccctgtaggtgttctagtaccgcacaccgacctccacagccccgtgtctgcacattttcccctcagagagtcagtcctacaacctcaccccggccagcaagccccgtgccagggtccgaacggagaggctctcgtcccgagatgacccctgtgagcttgaggtccactaaggagggccctgagacccccccccgcccacgggatcaactgccaccccacccccgtagcaggcgctattccggcgactctgactctagcgcaagtagcgctcagagcggtccattagggacgcgcagtgatgacaccggaacaggacccagaagagaacgtcctagcaggagactaaccactggaaccccagcttctccacggcgtccccccgcttgtgctgcctctcctgagacgggctggatagccgctggtcccggcgggccgcaggaggcaggtgaaccttcctgccgaagcccggccctgcccggcggtccaggagcaagggccgctcgctcacgtctctgctgtctatgcgccggaatagaaacgggatcgacacatgggtgtcaaggggcaggggcagtgggcgcaagagcgggggcacccccacggctcccggtgcccgccgcattgcaacatcctggatttcccgggtctcccgctccagtccaatcatgggccccccaccggcctgcctccagcgcccatccgtgcagctctaccaggagtagatcatcatcctgttccggcgcctggaaacgctcgtcttggccgatgcccggccccctgcggttattgcttgcgtag

SEQ ID NO: 189881 - DNA, 1614 bp, Artificial Sequence
  Description of Artificial Sequence: Synthetic coding sequence
atggccgaccccgtggccggcatcgccggcagcgccgccaagagcgttcgcccattcagatcttctgaggcctacgtcgaggccatgaaggaagatctggctgagtggctgaacgctctgtacggccttgggctgcccggcggaggagatggttttttaaccgggctggctacggggacgacactctgccagcatgcgaacgctgtgaccgaggctgcccgggccttagccgccgcaaggcctgctaggggcgtcgcttttcaggcccatagcgtcgttccagggagttttatggccagagacaatgtggcaactttcatcggatggtgtcgcgtggagctcggggtacctgaggtactcatgtttgagactgaggacctggttcttagaaaaaatgagaagtcggtggttctatgcctgctggaggtcgcccggcgaggtgccagactgggtctgcttgccccccggctggttcaatttgagcaggagatcgagcgggaactgcgggctgcaccccccgctcccaacgcccccgctgccggtgaggacacgaccgagaccgcacccgcaccagggactccagcccgaggccccaggatgacaccatctgacctccggaacctcgacgagctcgttcgggaaatactgggacgatgcacatgccctgatcaattccctatgatcaaggtgtcagaggggaagtaccgtgtcggggacagcagcctcctaattttcgtgagggtgctgaggtcccatgtgatggtgagggtcggtggaggctgggacactctcgaacactacctcgacaagcatgatccctgtaggtgcagctcaactgctcacaggcctcctcaaccccgtgtgtgcacattctccccacaaagagtatccccaacaactagccctcgtccagcttccccagtgccaggcagtgaaagacgcgggtctcgcccagaaatgactccagtctccctgaggagcaccaaggagggaccagaaactccacccaggcccagagatcagctccccccccaccctaggtcacggcgttatagcggagactctgactctagcgcaagtagcgcacagagcggccccctaggcactcgaagcgacgataccggcaccgggcccagaagagaaagacctagccgcagacttactaccggcacgccagcatcaccccgtaggcctcccgcatgcgccgcgtctcctgaaaccggatggatcgccgccgggccaggaggcccacaggaggccggggaaccatcatgcagaagtcccgctctccccggaggacctggagctcgcgcagcaagaagcagattgtgctgtctatgcgctggtattgagaccgggagcacacatggctgccaaggcgcgggggcagtgggagccagggcgggcgctccacctcgactgcccgtgccagctgcactgcagcacccaggattcccagggtcacctgcacccgtgcaaagctgggctcctcatagaccagcctcatcagcacacccatgttcttccacaagaagcagaagtagctcttgctctggtgcttggaagcggtccagttggcccatgccgggcccactccggttactgctcgcatag

SEQ ID NO: 189882 - DNA, 417 bp, Artificial Sequence
  Description of Artificial Sequence: Synthetic coding sequence
atggccgaccccgtggccggcatcgccggcagcgccgccaagagcgtaaggccattccgctcatccgaagcctatgtggaagcgatgaaagaggatctggccgagtggctcaatgccctttacgggcttgggctcccgggcggcggtgatggtttccttacagggctggctaccgggacaactctctgtcagcatgccaacgcagttaccgaagcagcacgcgcccttgcggctgcacggcctgcgaggggcgtcgccttccaggcccatagtgtcgtcccggggagtttcatggcccgcgataacgtcgctacattcatcggctggtgtagggtggagctgggggtccccgaggttttgatgtttgaaacagaggatctggtgctccggaagaacgaaaagtctgtggttctctag

SEQ ID NO: 189883 - DNA, 432 bp, Artificial Sequence
  Description of Artificial Sequence: Synthetic coding sequence
atggccgaccccgtggccggcatcgccggcagcgccgccaagagcgtgcgcccgtttcgatccagcgaagcctatgttgaggctatgaaagaagacctcgcagagtggctgaatgctctgtacggactgggactcccaggcggcggggacgggttcttgacaggattagctaccggcacaaccttgtgtcagcacgctaatgccgtcaccgaggcggctagggccctagctgcagctagacctgcaagaggcgtcgcttttcaggcgcacagtgtggtcccgggctctttcatggcccgcgacaatgtcgcaacatttatcggctggtgccgtgttgaactgggggtacccgaggttctaatgttcgagaccgaagacctcgtgctgcgtaagaacgagaaaagtgttgtgctctgcttactagaagtgtag

SEQ ID NO: 189884 - DNA, 1614 bp, Artificial Sequence
  Description of Artificial Sequence: Synthetic coding sequence
atggccgaccccgtggccggcatcgccggcagcgccgccaagagcgtgcgaccttttagaagctccgaagcttacgttgaggcgatgaaagaggatctggccgaatggttgaacgcgctctatgggctcggtctgccaggcgggggggatggattcctaaccggcctggccaccgggacaaccctgtgtcaacacgccaacgcagtgaccgaagctgcgcgcgcattggcagcagcccgccctgccaggggcgtggccttccaggcccattccgttgtaccaggcagctttatggcacgcgacaacgtggccaccttcataggatggtgccgcgtggaactgggtgtccctgaggtcttgatgttcgagaccgaagatctggtgctgcgcaagaatgagaagagcgttgttctatgccttcttgaagtagcccgccggggtgcacggctgggtctgttggctcctagactggtgcagttcgagcaggagatcgaacgagagctccgcgctgctccgccagcccctaatgccccagcagcgggggaagacacgacagagactgctccagcccccgggacaccagcccggggacctagaatgactccttctgatttacgcaatttagatgagctagtgcgggagatcttaggcagatgcacctgtccggaccagtttcctatgattaaggtgtccgagggaaaatatagagtgggagatagctccctgctaatctttgtgcgcgtattgaggtcccacgtcatggtgcgcgtgggtggaggatgggatactttggagcattacctagacaaacatgacccctgccggtgcagctcgaccgcccatcgtcctccacaacccagagtctgtactttctccccccagagagtgtctccgacgacttctccccgaccggcaagcccagtgcctgggtcagagcggagaggatcccgccccgagatgacacccgtcagcttgaggagcacaaaggagggtccagaaacgcccccaaggccgagggaccagttgcctccccatcctcgtagccgtaggtacagcggtgattccgacagttctgcctcttcggcgcaaagcggccctcttggaacacggagcgatgacacaggaaccggccccagaagggagcgtccgtctaggcgtctgacaaccgggacgcccgcctcccccaggcgtcccccggcttgcgccgcaagcccagagacagggtggatcgcagctggtcccggagggccgcaagaagccggagaaccatcttgccggagccccgcgctgcccggagggcccggtgctcgggctgccaggagccggctttgttgtttgtgtgctggaatcgaaactggcagcactcacggatgtcagggcgctggtgcggtcggtgcccgtgccggtgcaccacctcgtctgccggtgcctgctgccctacagcatcccgggtttcctggctcgcccgcccccgtgcagtcctgggcgccccaccgtccagcgtcctcggcccatccatgtagtagcacacggtctagatcctcatcctgttcgggcgcatggaaacggtcatcatggcctatgcccggccccctgcggctgctcctggcttag

SEQ ID NO: 189885 - DNA, 2037 bp, Artificial Sequence
  Description of Artificial Sequence: Synthetic coding sequence
atggcccccagcctgagccccggccccgccgccctgcggcgggccccacaactcttgctgctgctgctcgccgctgaatgtgctctggcagcgttactgccagcacgcgaggctacccagtttctacggccccggcagagacgagcctttcaggtgttcgaagaggcaaaacagggtcatctggagcgggagtgtgtggaggagctttgttccagagaggaggcacgcgaagtgttcgaaaacgaccctgagactgactacttctaccctcggtatctggattgcattaataagtatgggagcccctatacaaaaaatagcggattcgctacatgtgtgcagaacctccctgatcaatgtacaccaaatccctgtgataggaaaggcacacaagcatgccaggacctcatggggaattttttttgcctgtgtaaggctgggtggggaggacgcctgtgtgacaaggacgtaaacgagtgtagtcaagagaatggtggatgtctccagatttgtcataataagccaggttctttccactgctcttgtcacagcgggttcgaactgtcaagtgacggtagaacatgccaggacatcgacgagtgtgccgattccgaggcctgtggcgaagctaggtgtaaaaatctgcccggctcgtatagttgtctatgcgatgaaggctttgcctactccagtcaggagaaagcatgccgggacgttgatgaatgcttgcagggcaggtgcgagcaagtttgtgtcaatagtcccggcagttatacttgtcactgcgacggccgtgggggacttaagctgtctcaggatatggacacctgcgaagatatccttccatgcgtaccgttttctgttgcaaagtcagttaagtccctgtacctcggcagaatgttcagcggcaccccggtaatacgcctgcggttcaagcgactacaacctactagactcgtggcggaattcgacttccggacatttgaccccgaagggattcttctgtttgcaggaggacaccaggattccacctggattgtcctggcactgcgggcaggccggctggaacttcaattgcggtataatggagtgggtagggtcacatcatcgggtccagtgatcaaccatggcatgtggcagaccatttctgtggaggaactggcacggaacctggtgatcaaggtaaacagggatgccgttatgaagatcgctgtggctggggaccttttccagcctgaaagggggctctatcatctgaatctaaccgttggagggattcctttccacgagaaggacttggtgcaacctattaaccccagactggacggctgtatgagaagctggaattggcttaatggagaggataccactatccaggagaccgtgaaagtgaacacaagaatgcagtgttttagcgtgacagagcgcggctctttctatccaggatccgggttcgcattttacagtctggattatatgagaaccccactggacgtcgggaccgagagcacttgggaagtcgaagtcgttgcccacatcaggccggccgctgatactggagtgctgttcgcactgtgggccccagatctgcgcgcggtccctctgtccgtcgctttggtggactaccatagtaccaagaaattgaaaaaacaactcgtggtgttggctgtggagcataccgccctggcgttgatggagatcaaggtgtgcgatgggcaggagcatgtggttaccgtgtcactgcgcgatggagaggcaactctcgaagtcgacggcaccaggggtcagtctgaggtttctgctgcccagctccaggagcgcctggctgtgctagaaaggcatctgcggtctcccgtgctgacctttgcggggggtctgccagatgtcccagtgaccagcgcaccagtaacagccttctataggggctgtatgacactggaagtgaatcggaggctgctggacctggatgaagctgcttacaaacactccgacatcactgcacactcttgtccacctgttgagcctgccgcagcttag

SEQ ID NO: 189886 - DNA, 1875 bp, Artificial Sequence
  Description of Artificial Sequence: Synthetic coding sequence
atgtgcatgtgccaggccagccccccccccgccgccctggccggctgtctcctgtcctcctgcgtccagcctgcacgcgaacatggcggcgcgttcagcaaggctgaatggctctccaactgcataaacaagtacggtagcccctatactaaaaacagcgggttcgcaacctgtgtgcaaaacctgcctgaccagtgtacaccaaacccgtgtgaccggaaaggcacacaggcctgccaagacctcatgggaaacttcttctgtttatgtaaggcgggctggggaggccggctgtgcgacaaggacgtcaatgagtgtagtcaagaaaacggcggatgtctgcaaatctgtcataacaagccaggctctttccattgtagctgtcacagtgggtttgaactttcctccgatggcaggacatgccaggatattgacgagtgtgctgactccgaggcctgcggagaggcccgttgcaaaaacttacctggttcttactcctgcctctgcgatgagggttttgcatactcatcgcaggaaaaggcttgccgagacgttgacgagtgcttacaggggcggtgtgagcaggtatgcgtcaactctcccgggagctacacgtgccactgtgacggcaggggaggcctgaaactgtctcaggatatggacacatgtgaagacattctgccttgtgtacccttcagcgtggctaagtcggtcaaatccctttatcttgggagaatgttcagcggtacaccagtaatacgcctccggtttaagcggttacagcccacgcggctggttgcagagttcgattttcgaacattcgacccggaaggaattctgctgtttgctggaggtcaccaggactccacatggatcgtgctcgcgctccgcgcgggccgactagagctacagcttcgatataacggggtcggacgggtgaccagctccggcccggtcataaaccacggaatgtggcagactatcagtgtggaagaactagcccgaaaccttgttattaaggtgaacagagacgccgttatgaagatagcggttgctggagacctgtttcaacctgaaagaggcttgtaccatttgaacttgactgtggggggcataccgttccacgagaaagacctggtacagcccattaatccccgcctggatggctgtatgaggagctggaactggctgaacggcgaagacactacaatccaggaaaccgtcaaagtgaacacacgcatgcagtgcttcagcgtaacggaacgaggatcgttctatcctggatctggattcgccttttactcccttgattacatgcggacacctctggacgtgggtactgagtccacatgggaagtggaggtggtggcccatattcggccagctgccgacactggcgtgctgttcgcactgtgggcacccgacttgagagccgtccccctgtctgtcgccctggtggactatcatagcaccaagaagttgaagaagcagctagtggtgttggctgtggaacacaccgcactggccttgatggaaattaaagtctgcgacggccaagagcacgtcgtcacagtgtccttgcgagatggcgaagccaccttggaagttgacgggacccgtggccagtccgaggtgtctgccgcacagctgcaagaacggctcgctgtgcttgagcgacatctgcgtagtcccgtcctaacatttgccgggggacttccggatgttcctgtaacatcagcacccgttactgctttctacaggggatgtatgactctggaagtgaaccgacgtcttcttgacctggacgaggcagcatacaaacactccgacatcacagcgcactcttgcccgcctgtagaaccggccgcggcctag

SEQ ID NO: 189887 - DNA, 2166 bp, Artificial Sequence
  Description of Artificial Sequence: Synthetic coding sequence
atggcccccagcctgagccccggccccgccgccctgcggcgggcccctcagctgcttctactgctactggctgcagagtgcgcactcgccgctttgctacccgcacgggaagccacccaattcctaagaccgcggcagcggcgtgcttttcaggttttcgaggaggctaaacagggacacctggagagagaatgtgtggaggagttgtgttctcgtgaggaggctcgcgaagtattcgaaaacgatccggagacagactacttttacccccgctacctggactgcatcaataaatatgggtcaccttacactaagaacagcggcttcgcgacctgtgtgcagaacctcccagatcagtgtacaccaaatccatgtgacagaaaaggcacgcaggcgtgtcaagatctcatgggtaactttttttgtctgtgtaaggctggttggggcggacgtttatgcgataaggatgtgaatgagtgttcccaggaaaatggtggatgcctccagatctgtcacaataaacccggctctttccattgttcttgtcactcaggtttcgagttatcctccgacggaaggacttgccaggatatcgatgaatgtgccgacagcgaggcgtgcggggaggctagatgtaaaaatctccccggctcgtactcttgtctgtgcgatgagggcttcgcatattcctcccaagaaaaggcatgcagagacgtggacgagtgtttgcaaggcagatgtgaacaggtatgcgtgaactcacctggctcttatacatgccattgtgacggacgcggcggtctcaagctgagccaggatatggatacatgcgagttggaagctggctggccactgcctaggcacaggagggatagcggcccggccgcgcgcccaggacgcggagcccagggctcacgaagcgaaggccatattccagacagacgagggccccggccctggcaggatattctgccctgcgtgccattcagcgtggctaaatctgtgaagagtctatacctgggccggatgttttccggtacccccgtgattaggttgagatttaaacgcttacagcccaccaggcttgtggctgagtttgactttaggactttcgatcctgagggtatcctcctcttcgcaggggggcatcaggactccacgtggatagtacttgcactgcgcgccggtcgcctagaattgcaactcaggtacaatggtgtcggacgcgtgacatcctcaggtcccgtcatcaatcacgggatgtggcagaccattagcgtggaagaattggcccggaacctagttatcaaagtgaatagggatgcagtgatgaagatagcagtggctggagacctgttccagcctgaacgcggactttaccacctgaatctgaccgtgggagggatccctttccacgaaaaggatttggtccagccgatcaacccacgactggatggctgcatgaggagttggaattggctcaacggggaagacaccaccattcaggaaaccgtcaaagtgaacacacgtatgcagtgtttttccgtcaccgagagagggtcgttctatcccggtagtggattcgcattctatagcctggactacatgcgcacccccctcgatgtgggaaccgagagcacatgggaggtggaggtggtggcccacatccggccagcagccgacactggtgtgctgtttgccctctgggccccagatctgcgcgctgtacctctttccgtggcgctcgtagattaccactccacaaagaagctgaagaaacagctcgttgttctggccgtagagcataccgctctggcgttaatggaaattaaggtttgtgatggccaggagcatgtggtaacagtgagccttcgtgatggagaggcaacactggaagtagatggcactagaggccagtccgaggtgagtgcggcacagttgcaagagaggctcgcggttcttgagcggcacttgcgatcccctgtgctgacgttcgctggaggcttgcccgacgtacccgtcacatcggcacccgttacagccttctacaggggctgcatgaccctggaagtgaaccgcaggcttctcgatctggatgaagccgcgtataagcatagcgacatcaccgctcactcttgcccccctgtggaaccggcagctgcctag

SEQ ID NO: 189888 - DNA, 1140 bp, Artificial Sequence
  Description of Artificial Sequence: Synthetic coding sequence
atgttcagcggcacccccgtgatccggctgcggttcaagcggctgcagcccacaagactggtggccgagtttgattttaggacatttgatccggaagggatcctgctgtttgccgggggccatcaggactctacatggatcgtgctggccctgcgcgccggccgattagaactccagttgagatacaacggcgtgggacgggtcacctccagtgggccagtgattaatcatggcatgtggcagactatatctgtcgaggagctggctcggaatctggtgatcaaggttaacagagatgcagtgatgaagatcgccgttgccggcgaccttttccagccggagagagggctgtaccatctgaacctcacagttggtggaattccatttcacgaaaaggacctggtacagcccatcaatcctcgactcgacgggtgcatgagatcttggaactggttgaacggggaggatactacgattcaggaaaccgtcaaggtaaatacaaggatgcagtgtttcagcgttacagagcgcggtagtttctaccctggatctggatttgctttttattccctagattacatgcgcacaccccttgatgtgggaacggaaagtacctgggaggttgaagtggtcgcacacatcaggcccgcagccgataccggtgtcttgtttgccctgtgggcacccgacttacgcgcagtgcccctgtccgtcgcactggtagactatcactccacaaagaaattgaagaaacagctcgtggtgctggcagtggaacacacagctcttgcactgatggaaataaaagtttgtgacggtcaagaacacgtggtcactgtctcactccgcgatggggaggcaaccctggaggtggatgggacgagaggccagagcgaggtctctgcggcccagctccaggagaggctagcagttttggaacggcaccttcgctcacccgtgttaacatttgccggtggactccctgacgtccctgtgacgagtgctcctgtaacagccttttaccgcggatgtatgaccctggaagtcaacaggagactgctggacttggatgaagctgcttataaacactcagacattacagcacacagctgccctccggtcgaacccgctgcagcatag

SEQ ID NO: 189889 - DNA, 1218 bp, Artificial Sequence
  Description of Artificial Sequence: Synthetic coding sequence
atggacacctgcgaggacatcctgccctgcgtgcccttcagcgtggcaaagtcagtgaagagtctctatctgggacggatgttttctgggactcccgttatcaggctgcggtttaaaagactgcaaccgactaggctggtagcagaatttgacttcagaacattcgatcccgaaggaattctgttgtttgctggaggccaccaggacagcacttggatcgtactcgccctgagagccgggaggctagagctccagcttagatataacggggtagggagggtgacctcctcaggacccgtgatcaatcacggaatgtggcagacaatcagcgtggaggagcttgctagaaacctcgtgatcaaagtcaacagggacgctgtgatgaagatcgccgtagccggcgaccttttccagcctgaacgaggtctatatcacctgaatctgaccgtcggtggtattcccttccatgaaaaagatctggtccagccaatcaatccccgcctggatggctgtatgagatcctggaactggctaaatggcgaggacaccaccattcaggaaaccgtcaaggtgaatactaggatgcaatgttttagcgtcactgaacgcgggtccttttacccaggctctggattcgctttctattcactcgactacatgagaacccctctggatgtggggaccgagagtacatgggaagtcgaggttgtcgcacacattcgtcctgccgccgatacaggtgttctgttcgctctatgggcacccgacttgcgggctgtcccactgagcgtggctctggttgattaccactcaaccaagaaactcaagaagcagttagtggtgctggctgtggaacacaccgcattagcactgatggagatcaaagtctgcgacggtcaggagcacgtggtaaccgtgtccctgagagatggggaggctactctggaggtggacgggacacgagggcagtctgaggtgtctgccgcccagttacaagaaagactggccgtcctggaacggcatctgaggtcccccgtgctcactttcgccggggggctgccagacgtgcctgtgacctctgcccccgtgaccgcattttatcgaggatgtatgactcttgaggtgaatagacgcttgctggacttggacgaggcagcctataagcacagcgacataacagcccatagctgcccacccgtggagcctgctgccgcatag

SEQ ID NO: 189890 - DNA, 1431 bp, Artificial Sequence
  Description of Artificial Sequence: Synthetic coding sequence
atgagcggcgcccggtgccggaccctgtaccccttcagcggcgagagacacggacaaggactgcgcttcgctgccggggagctcattaccttgctgcaagtgcccgacggcgggtggtgggaaggggagaaggaggatgggctccgaggatggttcccagctagttatgtgcagctgctagaaaagcctgggatggtaccgccaccaccaggggaagaatcccagaccgttatcctccccccagggtggcagtcttacctaagcccccagggtagaaggtactatgtcaataccacaacaaacgagactacttgggaacggcccagctcttccccaggaattcccgcatcgcctggctctcaccgctcttccctgccccccaccgtcaatggctatcacgcgtcgggaaccccagcgcaccctcccgaaactgcgcatatgtccgtccggaagtccaccggtgatagccaaaatctcgggtcgtcatctcccagcaaaaaacagagcaaggagaacaccattactatcaactgcgtcacgtttccacaccctgacacaatgcccgagcagcagttacttaagccaacagaatggagctattgtgattatttctgggctgataaaaaagacccccagggcaacggaacagttgctggcttcgagttactgcttcagaaacagctaaaaggaaagcagatgcagaaggaaatgtccgagttcattagagagaggatcaagatcgaggaagactatgctaagaaccttgcgaagctatcccagaactcactagctagccaggaggagggctccctgggcgaagcttgggctcaggtgaagaaatcactggccgacgaggccgaggtccatctcaagtttagcgccaagctccattccgaggtggaaaagccacttatgaatttccgtgagaatttcaagaaggatatgaagaagtgtgaccaccacatagccgacctgcggaaacagctggcatccaggtacgcctctgtggaaaaggctcggaaagccttaactgaaagacaaagggacttggaaatgaaaacccagcagctggaaataaagttgagcaataaaaccgaggaggacattaaaaaagcaagaaggaagagtacccaggccggcgatgacctgatgcgctgcgtggatctttacaaccaggcccagagcaagtggtttgaggagatggtaacgaccacacttgagctcgagcgcctggaggtcgagagagttgaaatgatacggcagcacctgtgccagtatacgcagctgcgtcacgaaacagacatgttcaaccagagcacagtggagcctgtggaccagttactgcgaaaggtagacccagctaaggaccgggaactctgggtaagggagcataaaaccgggaatattagacccgtcgacatggagatctag

SEQ ID NO: 189891 - DNA, 1251 bp, Artificial Sequence
  Description of Artificial Sequence: Synthetic coding sequence
atgaagcccggcatggtgccccccccccccggcgaggagagccagacagtaatacttccgccggggtggcagagctatctaagtccccaaggccgacgatattatgtgaataccaccaccaacgaaactacctgggagcgcccaagttcaagccccggaatccccgccagcccaggaagtcaccggtccagcctgccaccaaccgtcaacggatatcacgcatccggaacccccgcacacccacctgagacagctcacatgtctgtacgcaagagcactggagactcccagaatttgggcagctctagcccatccaagaaacagtccaaggagaataccatcaccatcaactgtgtgacgtttcctcacccagatacgatgccagagcagcagctccttaaacccacagagtggtcttattgcgactacttctgggccgacaagaaagatccccagggcaatggcacagtagccggctttgagctgctgctccagaagcagctgaagggtaaacaaatgcagaaggaaatgtccgagttcattagagaacggatcaagattgaggaggattatgctaaaaatttagcaaaattgagccagaactctcttgcgtcccaggaggaaggctccctgggagaggcctgggcccaggtgaaaaaatccctggctgatgaggctgaggttcatctgaaattctcggctaaactgcatagtgaggtggagaaacctctcatgaactttagggagaacttcaaaaaagatatgaaaaaatgtgaccaccatatcgccgatctaaggaaacaattagcctccaggtacgcttctgtagaaaaagctcgcaaagcccttacagaaaggcaacgggatctagaaatgaaaacacaacagctggagataaaactgtctaacaagacggaggaggacataaaaaaggctcggaggaaatctacccaggccggcgatgacctgatgagatgcgtggacctttataaccaggcccagtccaaatggttcgaggaaatggttaccacaacactggagcttgagaggctcgaagtggagcgggtggagatgattaggcagcatctgtgccaatacacccagttacgacatgagaccgatatgttcaaccaaagcaccgttgaaccagttgaccagcttctgcgcaaagtagatccagccaaggacagagagctatgggtgcgtgaacataagacaggcaatatcaggccggtagatatggagatctag

SEQ ID NO: 189892 - DNA, 1011 bp, Artificial Sequence
  Description of Artificial Sequence: Synthetic coding sequence
atgagcaacatggagaacagcttcgacgacgtgagctgcctgagccctcaaaacctgggatcctcatcacccagcaaaaaacaatctaaggagaacacgataaccatcaattgtgtaacattcccccacccagacaccatgcccgagcagcagctgttaaagccgacagaatggagttattgtgattacttttgggcagataaaaaggacccccaagggaacggcacggtggccggatttgaactgctgcttcagaagcaactcaaagggaagcagatgcaaaaggagatgtctgagttcattcgggaaagaattaagatcgaagaggactacgctaagaatctcgcaaagctttcacagaactccttagcttcccaggaggaagggtctctcggagaagcctgggcacaggtaaagaaatccctggcagatgaggcagaggtccacctcaagttttctgctaagctgcattccgaagtggaaaagccgctgatgaactttagggaaaacttcaaaaaagatatgaagaaatgcgaccatcacatagccgacctcaggaagcaactcgcatcgaggtacgccagcgtcgaaaaggcaaggaaagccttgacggagaggcagcgagatctggaaatgaaaacccagcagctggaaattaagctctctaataaaacggaagaggatatcaaaaaggctaggcggaaatctacacaggccggggacgacctgatgaggtgtgtggatttatataaccaagctcagagcaaatggtttgaagagatggtgacaacaacccttgagctggagagacttgaagtggaaagagtcgagatgatacgccagcacttatgtcaatacactcagttacgccacgagacagacatgttcaatcagtctaccgtagaacccgtcgatcaattattgaggaaggtggatcccgctaaggacagagagctctgggtccgagagcataagacgggaaacattcggccggttgacatggagatatag

SEQ ID NO: 189893 - DNA, 1248 bp, Artificial Sequence
  Description of Artificial Sequence: Synthetic coding sequence
aagcccggcatggtgccccccccccccggcgaggagagccagaccgtgatcctgccacctggctggcagagctatctgtcaccacagggccgcagatattacgtaaacaccaccactaatgagacgacctgggaaagaccttcttcgagcccggggattcctgcatctcccggctctcatcggtcctctctacctccaaccgtgaatggctaccacgcctcaggtacacctgcccaccctcctgagacagcccatatgtccgtcagaaagagtacaggtgacagccaaaacctcggatcttcaagtccctcaaaaaagcagtcaaaggagaacacaatcacaatcaactgtgtgactttcccccaccctgataccatgcccgaacagcagctgctgaaacccaccgaatggtcctactgcgactacttctgggctgacaaaaaggatcctcagggcaacgggactgttgctggttttgagttgctcttgcaaaagcagctgaaggggaaacagatgcagaaagagatgagcgagttcattcgggaacgaattaaaatcgaggaggattacgctaaaaacctcgccaagctttcccagaattcacttgcgtctcaggaagaaggaagtctgggggaggcctgggcacaggtcaagaaatccttagccgacgaggctgaggtgcatctaaagttctctgccaaactgcactcggaagtggaaaaaccgctgatgaatttcagagagaactttaagaaggacatgaaaaaatgcgaccaccacatcgctgatctgagaaagcagctggcaagccggtacgcttccgtggagaaagcaagaaaggcgctaaccgaaaggcaaagagatctagagatgaagacacagcagttggaaatcaagctttccaacaagacagaagaagacatcaaaaaagcacgccgtaagagtactcaagcaggtgacgatctaatgaggtgtgtggacctgtacaatcaggcacagtctaagtggtttgaagaaatggtgacaacaacccttgaactcgagcggttagaagtcgagcgcgtggaaatgatcagacagcatctctgccagtacacccaactgcgacatgaaaccgatatgtttaaccagtcaactgtagaaccggttgatcaactgctgagaaaagttgaccccgccaaggatcgggagctgtgggtgagagagcataagacagggaatatacgcccagtagacatggaaatttag

SEQ ID NO: 189894 - DNA, 1251 bp, Artificial Sequence
  Description of Artificial Sequence: Synthetic coding sequence
atgaagcccggcatggtgccccccccccccggcgaggagagccagactgttatactaccccccggatggcagtcctacctttcgccgcaaggacggaggtactacgtcaatactactaccaatgagacgacttgggagagacccagtagctctcctggcatccctgcatcgcctggttcccaccgcagctcgctcccaccaaccgtcaacgggtaccatgcttctggtactccggcccaccccccagaaactgctcacatgtctgtgaggaagtctaccggcgactcacagaaccttggcagcagctctccaagtaagaaacagtcaaaggaaaataccattactatcaattgtgtcaccttccctcatcctgacacaatgcctgaacaacagcttctcaagcccacggaatggtcctactgcgactacttctgggcagacaagaaagaccctcagggtaacggcactgttgcgggcttcgagctgctcctgcagaagcagctgaagggtaagcagatgcagaaggaaatgagtgagttcataagggaacggatcaagatcgaagaggactacgccaagaatctcgcgaagttgtctcagaactccttggctagccaagaggaaggtagcctaggcgaggcatgggctcaggtgaagaagtcactggcggacgaagccgaggtgcaccttaaattttctgcaaagctgcacagcgaagtagagaaaccacttatgaattttcgtgagaacttcaagaaggacatgaagaaatgcgatcatcacatcgctgacctgaggaagcagttagcgtcacgatacgcttctgtcgaaaaggcacggaaggccctcaccgagaggcagagggatctggagatgaagacccagcagctcgagattaagctctcaaataagactgaggaggatatcaaaaaggcaaggagaaagagcacacaagccggggatgatctgatgagatgcgtggatctatataaccaggcccagagtaaatggtttgaggagatggtgaccacaacactggaattagaacggttggaggtggagagagtggaaatgattcgccagcacttatgccagtacacccagctaagacatgagacagacatgtttaatcagagtactgtggaacccgtggatcagctcctaaggaaagtggatccagcaaaggatagggagctttgggtccgggagcacaaaaccggaaatatccggcccgtagatatggaaatctag

SEQ ID NO: 189895 - DNA, 546 bp, Artificial Sequence
  Description of Artificial Sequence: Synthetic coding sequence
atggtgccccccccccccggcgaggagagccagaccgtgatcctgccccctgggtggcaaagttacctgtccccacaaggacgccgatattacgtgaacactacgacaaacgaaactacctgggagaggccaagtagcagcccgggtattcccgcctctcccgggagccatcgctcatcgctgcctccaactgtcaacgggtatcacgcgagtgggacgcccgcgcaccctcccgaaactgcacatatgagcgtccgtaaatctacaggtgattctcagaacctgggcagcagtagtcctagtaaaaagcagtctaaggagaacaccattacggaactggaacgcttagaagtcgaaagagtggagatgattcgacaacacttgtgccagtacactcagctgcgacacgagactgatatgttcaatcagtccaccgtagaacctgttgatcagttgctgaggaaggtcgaccccgcaaaagatcgcgagctgtgggtccgcgagcataaaacaggcaacatacgtcctgtggatatggagatatag

SEQ ID NO: 189896 - DNA, 873 bp, Artificial Sequence
  Description of Artificial Sequence: Synthetic coding sequence
atgcccgagcagcagctgctgaagcccaccgagtggagctactgcgattatttctgggccgataaaaaggacccacagggaaatggcacagtcgccggcttcgagctgctcttgcagaagcagcttaaaggcaagcagatgcagaaagagatgtctgagttcattagggagcgtattaagatagaggaagactatgccaaaaacttggcaaaattgagccagaatagcttggcttctcaggaggaaggctctctcggcgaggcatgggcccaggttaagaaaagtctagctgacgaggccgaggtccacttaaaatttagcgcaaaactccattcagaggtcgagaagccactgatgaattttcgggagaatttcaagaaagacatgaagaaatgcgatcaccacattgctgatctaagaaaacagcttgcctcacggtatgcgagtgtggaaaaagcgcggaaggcattgaccgagaggcagcgagatctcgagatgaaaactcagcaactggagattaagctgagcaacaagacagaagaagatattaagaaagcgaggcggaaaagcacccaggccggcgacgatctgatgagatgtgtcgacttgtataatcaggctcaaagcaaatggtttgaagagatggtaactaccacccttgaattagaacgcctcgaggtcgagcgggtggaaatgatccgccagcacctctgtcaatatacccagttgcgacatgaaacagacatgtttaatcaaagcacagtcgaacctgtggaccagttgttgaggaaagtggatccagccaaggatcgggaactgtgggtccgggaacacaagacaggaaatatcagaccagttgatatggagatctag

SEQ ID NO: 189897 - DNA, 378 bp, Artificial Sequence
  Description of Artificial Sequence: Synthetic coding sequence
atgaagacccagcagctggagatcaagctgagcaacaagaccgaggaagatatcaaaaaggcccggcgaaagagcactcaggcaggtgacgatctgatgcgctgcgtcgacctctacaatcaggcacagtcaaaatggtttgaggagatggttactacaacacttgagttggaacgtctggaagtggaacgtgtagaaatgattaggcagcatctgtgtcagtatacacagctacgccacgagaccgacatgttcaaccagtcaactgtcgaaccagtcgatcagcttctacgaaaggtcgaccccgcgaaggaccgcgaactgtgggttcgtgaacacaagactggtaatattcggccagtagacatggagatctag

SEQ ID NO: 189898 - DNA, 1011 bp, Artificial Sequence
  Description of Artificial Sequence: Synthetic coding sequence
atgagcaacatggagaacagcttcgacgacgtgagctgcctgagccctcagaacttgggttcaagttctccttccaagaaacagtccaaagagaacactatcaccataaattgcgtcacctttccccaccccgataccatgcctgagcagcagctactgaagcccactgagtggagctactgcgactatttctgggctgataaaaaagatccgcaggggaacggaacagttgctggattcgaactactgcttcagaagcagctcaaaggcaaacagatgcaaaaagaaatgagtgagttcataagagaacgcattaagatcgaagaggactatgcaaagaaccttgcaaagttgagccagaacagtttggcctcacaggaggagggctccctcggcgaggcctgggcacaagttaagaagtcattggcagacgaggcggaagtgcaccttaaattttctgcgaaactgcacagcgaagtggagaagcctctaatgaatttcagagagaatttcaagaaagatatgaagaaatgtgatcaccatatagccgatcttaggaagcagctcgcttcccgctatgcatccgtggagaaagccaggaaggcccttaccgaacggcaacgggatttagagatgaagactcagcaactcgagatcaaactatcaaataagacagaagaggacattaagaaagctagacgtaagtccacacaggcaggcgatgaccttatgcgctgtgtggacctctacaaccaagcccagtcaaagtggttcgaggaaatggtcaccactaccttggagttagagcggctggaagtggaaagagtagaaatgatccgccagcacctctgccagtacacgcagctgcgacatgaaaccgatatgttcaatcagtcgacagtcgaacctgtggaccagctgctgcgcaaagtggatcccgccaaagaccgggagctttgggttcgggagcacaaaactggcaacattcgccccgtagacatggaaatctag

SEQ ID NO: 189899 - DNA, 1437 bp, Artificial Sequence
  Description of Artificial Sequence: Synthetic coding sequence
atggcccccaagaagaagggcaagaagggcaaggccaagggcaccccgatcgtggatggtctggcccctgaggatatgtcaaaggaacaggttgaggaacacgtgtcccgtattcgggaagagctggatagagagagggaggagcggaattacttccagctggagagagacaaaatccataccttctgggaaattacgcgtcggcaattggaagagaaaaaagccgagctgcggaacaaggatagagagatggaggaagccgaagagcgacaccaggtggaaataaaagtgtacaagcagaaggtgaaacacctgctgtatgagcaccagaacaacctcacagagatgaaggcggaaggaaccgtcgttatgaagttagcacaaaaggaacatcggatccaagagtccgtgctcaggaaggatatgcgcgccctgaaagtagaactgaaagagcaagaactggcatccgaagtggtcgtcaagaacctgcgtctaaagcataccgaggaaattacccgcatgaggaacgacttcgagcggcaggtccgtgaaattgaagcaaagtatgataaaaagatgaaaatgctgcgtgatgaactggatctccgccggaaaacagaactgcacgaggttgaagagcgcaaaaacggtcaaattcacactctgatgcagcggcacgaggaggcatttaccgacataaaaaactattataacgacataacattgaataacctggccctgatcaatagtctcaaagaacagatggaagacatgcgcaagaaggaggaccatctggaaagggaaatggccgaggtgtcaggccaaaataagcggcttgccgatccacttcaaaaagcaagggaggaaatgagcgagatgcagaaacagctcgctaactacgagagggacaaacaaatcctcctatgtacgaaggctcggttgaaggtccgcgagaaagagctgaaggacttacagtgggaacacgaggtgctggagcagcgtttcacaaaagtgcaacaggagcgagacgagttgtatcgcaagtttaccgcagcaatccaggaagtccagcagaaaactggattcaagaatctggtcctcgaacgtaaactgcaggcattgagtgcagccgtggagaaaaaggaagtgcaattcaacgaagtgctcgccgcaagtaatctggaccccgctgccctgactctcgtcagtagaaagctcgaggacgtgttggagtctaaaaatagtaccattaaggacctccagtacgagttagcacaagtgtgcaaagcccataacgacctgcttaggacatacgaggcaaagctactcgcctttggtattcccctggacaatgtcggcttcaagccgcttgagactgcggtcatcgggcagacactcggtcagggcccagccggtctggtgggaactcctacatag

SEQ ID NO: 189900 - DNA, 1362 bp, Artificial Sequence
  Description of Artificial Sequence: Synthetic coding sequence
atgagcaaggagcaggtggaggagcacgtgagccggatccgggaggagctggatagagagagagaagagagaaactatttccagttggaacgcgataaaattcacaccttctgggaaatcacccgccgccagcttgaagaaaagaaggctgagctgcggaacaaagatcgtgaaatggaagaggcagaagagagacaccaggttgagatcaaagtctataaacaaaaggtgaaacatctgctctacgaacaccaaaataacctaacagaaatgaaggccgaaggcaccgtggtgatgaagctggcacaaaaagaacatcgaattcaggagtctgtgcttcgaaaggacatgcgcgcactgaaagtggagctgaaagaacaggagctggcgagtgaggtcgtcgtgaaaaatctcaggttgaaacatacagaagaaattactcgtatgagaaacgactttgagcgtcaggttagagaaattgaggcgaaatacgacaagaaaatgaaaatgctgcgtgatgagttggaccttaggagaaaaactgagttgcatgaggtggaggagcggaaaaacggccaaatacacaccttgatgcagcgacacgaggaggcttttacggacattaagaactattacaatgacatcacactcaataacctggctctgatcaattcactcaaggagcagatggaggatatgcggaagaaggaagaccacctggaacgagaaatggctgaggtgagtggacagaacaaaaggctggcagatccactccaaaaggctcgggaagaaatgagcgaaatgcagaagcaactggctaattatgaacgagataaacaaattctcctctgtaccaaggctcgactgaaggtgcgtgagaaggaactgaaagatctgcagtgggagcacgaagtcctggagcaaagattcaccaaggtacaacaggagcgagatgaactgtaccggaaatttactgcagcaatccaagaagttcagcaaaaaacaggatttaagaacctggtcctagagcgtaagctccaggcactgagcgccgctgtggagaagaaagaagtgcagttcaatgaggttctcgccgctagcaatctggaccctgccgctctgactctggtctcccgaaagcttgaagacgtgctcgaatctaaaaactcgactatcaaggatctgcagtacgagctggcccaggtatgcaaggcccataacgacctgctgcgcacctatgaagcgaagctcctggcctttggaatccccctggataatgtaggattcaaacccctggagactgccgtgatcggtcagaccctagggcaggggcccgccggactggtgggaacccctacttag

SEQ ID NO: 189901 - DNA, 525 bp, Artificial Sequence
  Description of Artificial Sequence: Synthetic coding sequence
atggcccccaagaagaagggcaagaagggcaaggccaagggcacccccatcgtggatggacttgccccagaagatatgtccaaggaacaggtggaggagcacgtttctcgaattcgcgaggaactcgaccgcgaacgagaagagcgcaactattttcagttggagcgcgacaaaatccatacattctgggaaatcacacgcagacagcttgaagaaaaaaaggccgagctcagaaataaagaccgcgaaatggaagaagcggaagagagacatcaagtggaaatcaaggtttacaagcaaaaggttaagcacttactgtacgagcaccaaaataatttaaccgaaatgaaagctgaggggactgtcgtgatgaagttagcccagaaggagcatagaatccaggagagcgtgctcagaaaggatatgcgtgctctcaaggtcgagctcaaggaacaagagctggcgtcggaggtggtggttaaaaatctgagactgaaattgcggcccagcatgatccggagatag

SEQ ID NO: 189902 - DNA, 1149 bp, Artificial Sequence
  Description of Artificial Sequence: Synthetic coding sequence
atggtggaggagcacgtgagccggatccgggaggagctggaccgggagcgtgaagaacgcaattactttcagctcgagagagacaaaatccatacattctgggaaatcaccaggagacagctcgaggagaagaaggctgagctgagaaataaggaccgcgagatggaggaggcagaggaacgccaccaggtggaaattaaagtatacaagcagaaagtgaagcatctgctgtacgaacaccaaaacaacctgaccgagatgaaggccgaaggaactgtggtcatgaagctggcacagaaggaacaccgcatccaggaatcagtgttgagaaaagacatgagagctctgaaggtcgagctcaaggagcaggagcttgcatccgaagtggtcgtgaaaaatctgcggttgaagcatactgaggagatcactcgcatgcggaacgacttcgagcggcaggtacgtgagattgaagccaagtacgacaaaaagatgaagatgctcagagacgaactcgacttgcggaggaaaaccgagctccacgaggtggaggaaagaaagaatggccagatccacactctgatgcagcgacatgaggaggccttcactgatattaagaactactacaatgatatcaccctgaacaatctagctctgatcaattctctgaaagagcagatggaggacatgagaaaaaaagaggatcacctggaacgggaaatggccgaggtgagcggccaaaacaagagactcgctgacccactacaaaaagcccgcgaagaaatgagcgagatgcagaagcagctggcaaactatgaaagagacaaacaaatattgctttgtactaaagcaagactcaaggttagagaaaaagagcttaaggacctccagtgggaacacgaagtcctcgaacaaaggtttacaaaggtacaacaggagcgcgatgagctctatagaaagtttacggcagccatccaagaagtccagcaaaaaaccggcttcaaaaatctggtcttggagcgaaaactgcaggccctctccgcagctgtggagaaaaaggaagttcaattcaacgaagtgcttgccgcgtctaatctcgaccccgccgcactgactcttgtgtcccgaaagctggaaacattcttctgctag

SEQ ID NO: 189903 - DNA, 717 bp, Artificial Sequence
  Description of Artificial Sequence: Synthetic coding sequence
atgctgtgctgcatgcggcggaccaagcaggtggagaagaacgacgacgatcagaagatagagcaagacgggatcaagcctgaggacaaagcacataaagccgcaaccaagatacaggcatcatttcgaggccacattaccaggaagaaactgaaaggcgaaaagaaagacgacgtgcaggccgcggaggccgaggctaataagaaggatgaggcccctgtggcagacggtgtggagaagaagggcgagggaaccactactgccgaagcagcgcctgctactggctctaagcctgacgagcccggcaaggcaggcgagaccccttccgaagagaagaaaggggagggagatgcggccaccgaacaggcagctccccaagctccggcctcaagtgaagagaaagcaggctctgccgagactgagtccgcaacgaaagcatccacagacaatagcccgagttccaaggctgaagatgcccctgcaaaggaggaacctaaacaggctgacgtgcctgccgccgtgacggccgctgctgctaccactccggctgccgaggatgcagcggctaaagccacagcccagcctccaaccgaaactggtgaaagtagccaagccgaggaaaacatcgaagcggtggacgagaccaagcccaaagaaagcgcaagacaggatgagggcaaggaggaggagcctgaggcagatcaagagcatgcatag

SEQ ID NO: 189904 - DNA, 825 bp, Artificial Sequence
  Description of Artificial Sequence: Synthetic coding sequence
atgaccaagagctgcagcgagctgtgccaccccgccctgcacttcttaccctgcctaggaggtctccgaaagaatctacagagagcggttagacccagtccctactccctcggcttcctgacattttggatatcacgggtcgagaagaacgatgatgaccagaagatcgagcaggacggcattaagccagaggacaaagctcataaggctgcaactaaaatacaagcttccttcagaggacacattactcgtaaaaaactcaagggtgaaaagaaagacgatgtgcaagcagctgaagctgaggccaataagaaggacgaggcgcccgtggccgacggcgtggaaaaaaagggcgaggggacaacgacggccgaggccgcgccagccactggcagcaagcctgacgaacccggtaaagccggcgagactccaagcgaagagaaaaaaggggagggagatgccgcgacagagcaggcagccccccaagcgcccgcctccagtgaggaaaaggctggatccgccgaaactgagtctgccacgaaggcgagcaccgacaactctccctcttcaaaggctgaggatgctccggctaaagaggagccaaagcaagcagatgtcccagccgcggtgaccgctgccgcagccacaacacccgccgcggaggacgccgcagccaaggctaccgctcagccccccacagaaaccggtgaaagctcccaggccgaggagaacatcgaagcagtggacgagaccaaacccaaggaatctgctcgacaggacgaggggaaggaggaggaacccgaagccgatcaggaacacgcctag

SEQ ID NO: 189905 - DNA, 1119 bp, Artificial Sequence
  Description of Artificial Sequence: Synthetic coding sequence
atgccccccccccagcagggcccctgcggccaccacctgctgctgctcctggccctgctgcttccctctctccccctgactcgggcacccgtccctcccgggccggccgctgcattgcttcaggctctcgggctgcgggacgaaccccagggcgcaccccggttgaggccagtgccccccgttatgtggcgcctcttcaggagaagggacccacaggagacacggtctggcagcagaagaactagcccgggggtgaccttgcagccatgccatgtggaagaactgggcgtcgccggcaacatcgtcaggcatattcccgatcgtggggccccaacccgagcgtctgagccagcctctgccgcgggtcactgtcctgaatggacagttgtgttcgaccttagtgctgtggagcccgcggagcggccatcgagagcaagactggagttgcgattcgccgcagcagctgccgctgcacctgagggtggctgggagctctcagtggcccaggccgggcagggcgctggcgccgacccagggccggtgctcttgcgacagctagtaccagccttaggacctccagtgcgtgcggagctgctcggagcagcctgggcaaggaatgcctcttggccacggtcactgcgcctggcccttgcgctccgaccccgcgcacccgctgcgtgtgcaaggctggccgaagcctctctgctattggtcacccttgaccctaggctctgccacccactggccagaccgcgacgcgacgccgaacccgttctcgggggaggaccaggcggggcttgccgtgcccgtagactgtatgtttccttccgggaagtcggctggcaccggtgggtaatcgccccccgtggctttctggctaactactgtcaggggcagtgtgctctgcctgtcgccctgtcaggtagtggcggcccaccggctctgaatcatgctgttctgcgggccctgatgcatgccgcagcaccaggtgccgctgatctgccgtgctgcgtgcccgcgcggctgagtcctatctcagttctgttcttcgataatagtgataacgtcgtacttagacagtacgaggatatggtcgtcgatgaatgcgggtgtcggtag

SEQ ID NO: 189906 - DNA, 1224 bp, Artificial Sequence
  Description of Artificial Sequence: Synthetic coding sequence
atggtgctggccgcccccctgctgctgggcttcctgctgctggccctagagctccgacctcggggggaggctgccgagggcccagctgctgccgctgcagctgccgccgctgctgcggcggccggcgtgggcggggagcgttcatcaaggcccgcgccaagtgttgcaccggagcctgatggctgccccgtctgtgtgtggaggcagcactcacgggaactacgcctggaatctattaaatcacagattttgtcaaagcttaggttaaaagaggctcccaacattagccgcgaggtcgtgaagcaactcctgccaaaggctcccccactccagcagatactggaccttcacgattttcagggggacgctttgcagccagaggatttcctcgaggaagatgaataccacgccaccaccgagactgtcattagcatggcacaggaaacagacccagcagttcaaacagacggcagtccgctatgctgtcatttccatttctcccccaaagtaatgttcacaaaagtacttaaggcccagttgtgggtgtacctgaggcccgtcccccgtcctgcaacagtgtatcttcagatcctcagactgaagccgcttacaggcgaggggacagctggcggagggggcggtggacgccgtcatattcgtattcggagcctcaaaattgaactacatagtcgctcgggacactggcagtcaatcgatttcaagcaggtcctccattcttggttcagacaaccccagtcgaactggggcattgagatcaacgctttcgatccaagtggaacggacctggcagtgacatccctgggtcctggggccgagggtctccatcccttcatggaactccgggtactggagaatacaaagagaagtaggagaaaccttgggctggactgcgacgaacactcctcagagtcccggtgctgccggtacccactgacggtcgactttgaagcctttgggtgggactggattatcgctccgaagcgatacaaggccaactattgctcggggcaatgtgaatacatgtttatgcagaagtacccccatacccacctagtgcagcaagccaatccaagaggctcagctggaccttgctgcacgcctacgaagatgtctccaatcaatatgctgtatttcaacgacaagcaacagattatttacggcaagattccagggatggtggtggaccgctgtggttgcagctag

SEQ ID NO: 189907 - DNA, 1143 bp, Artificial Sequence
  Description of Artificial Sequence: Synthetic coding sequence
tgagccgccgccgccgccgccgccgccgccgccgccgccgccggcgtcggcggcgaaagatcaagccgaccggcacccagcgtcgcccccgaacccgatggttgccctgtatgtgtttggcgacagcacagccgagaattgaggcttgaatccattaaatcccagatactctctaagctcaggctgaaggaagccccgaatatctcaagagaggtagtaaaacagctactccccaaggccccacctctgcagcagatcctggacctgcacgatttccagggcgacgcgctgcaaccggaggactttctagaagaagatgagtatcatgcaaccacggaaaccgtgatttccatggcacaggagaccgatcccgccgtgcagacagatggcagccccctatgctgccacttccatttttcccctaaagtaatgtttacaaaggtgcttaaggcccagttgtgggtctacctgcgtcccgtaccccgcccagcaaccgtgtaccttcaaattttgagactaaagcccctaaccggcgaggggaccgctgggggcgggggaggggggcgtcgtcatatccgtatccgtagcttaaaaatcgaattacactcacggtcaggacactggcaaagtatcgacttcaagcaggtgctacactcctggttcaggcaacctcagagcaactggggcatcgaaatcaatgccttcgatccttctgggacagacctcgcagtgacttccctgggacctggggccgagggtctccatccgttcatggaactccgagtcctggagaacaccaagcggtcgcggcgtaacctgggcctagactgcgacgagcactcctccgaatcgcggtgttgtaggtatccactgaccgtggattttgaagcctttgggtgggactggatcatcgccccaaagcgatacaaggctaattactgctcagggcagtgcgaatacatgttcatgcagaagtatcctcacacacatctggtgcagcaggcaaaccctagaggctctgctggtccctgttgcaccccaactaagatgtcacctatcaacatgctgtacttcaacgacaaacagcagattatatatggcaagatcccaggaatggtcgtggataggtgtgggtgtagctag

SEQ ID NO: 189908 - DNA, 927 bp, Artificial Sequence
  Description of Artificial Sequence: Synthetic coding sequence
atgcccggccaggagctgcggaccgtgaacggcagccagatgctgctggtcctactcgtgctgtcctggctgcctcacggaggagctctgtctcttgccgaagctagtcgcgcatcttttccagggccaagtgaactacactccgaagactctaggtttcgcgaattgaggaaacggtatgaggaccttctcactaggctgagagccaaccagtcctgggaggattccaataccgacctggtgcctgcccccgctgtcaggatcctgacccctgaggtcagactgggcagcggggggcacctgcacctgaggatttcgcgggccgcactgccggaaggtctgccagaggccagcaggctccaccgagcactgttcagactgtctcccaccgcttcaaggagctgggatgttacaaggccacttcgccggcagctgagcctggcgcgtcctcaagctccagctctccatttgagactatccccgcctcctagccaaagtgaccaactgcttgccgagagttccagcgccaggcctcagttggagcttcatttgcggccccaagctgcaaggggcaggcggagggccagagccaggaatggagatcattgtcctctgggccctggacgctgctgccggttacacaccgtgcgtgctagcctcgaggatctcggatgggcagattgggtgttaagcccaagagaggtgcaggtgaccatgtgtattggcgcttgtccgtcccaattcagagcagcaaatatgcatgcccaaataaaaacttctttgcaccgcctgaagcctgatactgttcccgcaccctgctgtgtgccggcgtcgtataaccccatggtgttaatccagaaaaccgacaccggcgtatcgcttcagacatatgacgatctcctagcaaaggattgccactgtatctag

SEQ ID NO: 189909 - DNA, 927 bp, Artificial Sequence
  Description of Artificial Sequence: Synthetic coding sequence
atgcccggccaggagctgcggaccgtgaacggcagccagatgctgctagtgctacttgtgttaagttggctgcctcacggcggagccctttctctggctgaggcatcacgggcaagcttccccgggccaagtgagctacactctgaagactctaggtttagggagctgcgcaagcgatatgaggacctattgaccaggctgcgggcgaatcaatcatgggaggactcaaacacagaccttgtaccagctcctgccgttcgcatactcactcccgaggtgcgtctcgggagcggggggcacctgcatcttcggatctcacgcgccgcacttccagagggcctccctgaggccagcagacttcatcgggctctgttccgtctgagccctaccgctagtcgcagttgggacgtcactcgccccctgcgaagacagctctcgttggccagaccacaggccccagcgctacacctgcgcttaagccccccccccagccagtccgatcaacttctcgctgaaagctccagcgctaggcctcagctagagttgcacctgcgtccccaggccgcacgcggccgccgtcgcgctcgtgctagaaacggtgaccattgtcctctggggccaggtcgctgctgcagactgcatacagtgagggcctcgctggaggatttaggctgggcggattgggtgctgtcccctcgcgaggtacaagtgaccatgtgtattggcgcatgtccgagtcaattccgcgcggccaatatgcatgctcaaatcaaaacctcgctacacagacttaagccagacacggtccccgctccatgttgcgtgccagcgtcttacaaccctatggtgttgatccaaaagaccgataccggagtgagtctgcagacgtacgacgatcttcttgctaaggattgccattgcatctag

SEQ ID NO: 189910 - DNA, 1290 bp, Artificial Sequence
  Description of Artificial Sequence: Synthetic coding sequence
atgtgccccggcgccctgtgggtggccctgcccctgctgagcctgctggcagggtctctgcagggaaagcccttgcagagctggggccggggatcagccgggggcaatgctcattcccctttgggtgtgccagggggcggcttgcccgagcacacgttcaaccttaagatgttcctggagaacgtgaaggtcgatttcctgagaagcctaaatctgagtggcgtgccttcacaggataagaccagggtggagccgccgcaatacatgattgatttgtacaacaggtacacttcagataagtccactaccccagcatctaatatcgtccggtcatttagcatggaagatgctatatctattaccgcaaccgaagatttccccttccaaaagcacatactcctcttcaatattagcattcctaggcacgagcaaatcacccgtgctgagcttcgcttgtatgtgtcctgtcagaaccatgttgacccttcccatgacttaaaagggagtgtggtgatctacgatgtactcgatggaactgacgcttgggacagcgccaccgagactaagacctttctcgtatctcaggatattcaggatgaaggctgggaaacactggaagtgtcatccgcagtgaagaggtgggtccgatcagattccacaaagtctaaaaataaactggaggttacagtggagagtcacagaaaaggctgcgatacattggatatttcagtgccccccggcagcaggaacctgccattctttgtcgtcttttccaatgaccattctagcggaactaaagaaactcgcctggagcttcgcgagatgatctcccacgaacaggaaagtgtattgaagaagttgagtaaagacggcagtactgaggccggggagtccagccacgaggaggatacagatggccatgtggcagcaggaagcacattggcacgtaggaagaggagcgcaggcgctggttcacactgtcagaagacatccttgagggtaaatttcgaggacatcggttgggatagttggattatcgcacccaaagaatacgaagcatacgaatgtaaagggggctgcttctttccactcgcagatgatgtcactcccaccaaacacgccatcgtccagactttggttcacctcaagtttccaaccaaagtcggtaaggcttgctgcgtgcccacaaagttgagtccaatctccgtgctctacaaagacgacatgggggtaccaacactcaaataccactatgaaggaatgagcgtggccgagtgcggatgccggtag

SEQ ID NO: 189911 - DNA, 1095 bp, Artificial Sequence
  Description of Artificial Sequence: Synthetic coding sequence
atgctgcggttcctgcccgacctggccttcagcttcctgctgatcctagctctcggccaggcagttcagttccaagagtatgtatttctgcagtttctaggactggacaaagcaccttcgccgcaaaaatttcagcccgtcccatacattcttaaaaaaatcttccaggatagagaggcagcagctacaaccggcgtgagcagggatctgtgttacgttaaagaactaggggtgaggggcaacgtactaagattcttacctgaccagggcttcttcttgtacccgaagaagattagccaagcctcgtcttgtcttcagaaattgctctacttcaatctttctgccatcaaggagcgcgagcagctgacacttgcccagttgggcttggatttagggcctaacagctactataaccttggacctgagctggaactggctctgttcctcgtacaagagccccatgtgtgggggcagaccaccccaaaaccgggcaaaatgttcgtgctgaggtcagtgccgtggccccagggagccgtccatttcaatctgcttgacgtcgctaaggactggaatgacaatccacgcaagaactttggcctattcctggagatcctcgtcaaggaggatcgcgattccggagtaaacttccagcctgaagatacctgcgctcggttacgctgctctctgcatgcgagtctgttggtcgtgactctgaaccctgaccaatgtcatccttcgaggaaaagaagggccgctatccccgtacccaaacttagctgcaagaatttgtgtcaccgccaccagctcttcatcaatttcagagacctagggtggcacaaatggattatagctcctaagggctttatggccaattattgccacggagagtgccctttcagcctgactatcagccttaattcgagtaactacgccttcatgcaagcccttatgcacgcagtggatcccgaaatcccccaggccgtctgcatccctacgaagctttctccgattagtatgctatatcaagataataacgataacgtgattctgaggcattacgaggatatggtcgttgatgagtgtggatgcggttag

SEQ ID NO: 189912 - DNA, 1506 bp, Artificial Sequence
  Description of Artificial Sequence: Synthetic coding sequence
atgcggctgcccaagctgctgaccttcctgctgtggtacctggcctggttagatcttgagttcatttgcacggtgctcggcgctccggatctcggacaacgaccgcagggtacccgtccaggtctagcgaaagctgaagccaaggagaggccaccactggcacggaacgtatttcgacccggtgggcattcttatggagggggcgcaacaaatgcaaacgcacgcgcgaaagggggcaccggccagactgggggacttacacagcctaagaaggacgagcctaagaaactgcctcctagaccgggtgggccagaacccaagcctgggcacccgccccagacccgacaggctaccgccagaacagtcacacccaaggggcagctgccaggcggtaaagctccgccaaaggcagggtcagtgcctagtagcttcctgctgaagaaggctcgcgagccaggtccacccagagaaccaaaggaaccattccggcctccccctatcacaccacacgagtacatgttgtctttatatcgcacactgagtgatgcagatcggaagggaggtaacagtagcgtgaagcttgaagccggactggctaatactatcacatctttcattgataagggtcaggacgaccggggcccagtggtcagaaaacagaggtatgtgttcgacattagtgctctggagaaagacggactacttggcgctgagttacgaatcttgcgcaagaaaccaagtgacaccgcaaagcctgctgcgccaggcggtggcagagctgcgcagttaaagctgtcctcttgcccttccggtcgtcagcccgcctctctcctggatgtccggtcagtccccggactggatgggagtggatgggaagtattcgatatatggaaactgttccgcaacttcaagaatagcgcgcagttatgcttagaactcgaggcatgggagagaggacgcgccgtggatctgagagggctagggttcgatcgcgccgcacgtcaggtgcacgaaaaagcgttgtttctggtgttcgggcgcacaaagaaacgggacctcttttttaacgagattaaagcccgctcagggcaggatgataagaccgtgtacgaatatttattctcccagcgccgaaaaagacgagctcctctggctaccagacagggaaaaaggcccagcaaaaatcttaaagccagatgttccaggaaggctctgcacgttaattttaaagacatggggtgggacgactggatcattgcacctctggagtacgaggcctttcattgtgaagggctctgcgagtttcccttgagatctcatctggaacccacaaatcatgctgtcatacagacccttatgaattctatggaccccgagtccaccccgcccacttgttgcgtgcccacgcgcctgtctcccatctcaattcttttcattgacagtgccaataatgtcgtgtataagcagtatgaagatatggtagtagaaagttgtgggtgtcggtag

SEQ ID NO: 189913 - DNA, 1506 bp, Artificial Sequence
  Description of Artificial Sequence: Synthetic coding sequence
atgcggctgcccaagctgctgaccttcctgctgtggtacctggcctggctggacttggaattcatctgtacagtgctgggggcccccgatttgggccagcggcctcagggaactcggcccggcctagctaaggccgaggctaaagaaaggccccccctggcgaggaatgtgttccgacctggcggccatagttatggcggaggcgcaacaaatgccaacgctcgggcaaagggtggaactggtcagaccgggggattgactcagcccaagaaggacgaacccaaaaaactcccacccagaccaggtggccctgagcctaagccgggccaccctcctcagaccagacaagctactgcccgcacggtcaccccaaagggtcagctccctggcggcaaggcccctccgaaggccgggtctgtgccttcaagttttttgctgaagaaggcccgagaacctgggccgcctcgggaacctaaagaaccttttcgaccacctccaatcacaccacacgagtacatgctttccctgtatagaactctatccgacgctgatagaaagggaggaaatagcagcgtgaagttggaggcaggactcgcgaacaccatcaccagtttcatagataagggccaggacgatcggggccccgtggttcggaagcaacggtacgtgttcgacatcagcgccctggagaaagacggattactgggggccgagctgcggattttaagaaaaaaacctagtgatacagcaaagcccgctgcccccgggggcggccgtgccgcacagctgaagctctcttcatgtccttccggaaggcagccggcttctctgctagatgtgagaagtgttcccggattggatggcagtggctgggaagtctttgatatctggaaactgtttcgcaatttcaagaactccgcgcagctgtgcctggagcttgaggcatgggagagggggcgggctgtggatctccgcggccttggctttgacagagccgcccgccaagttcatgagaaggcactgttcttagtgttcggacggaccaaaaaacgtgacctgtttttcaatgagataaaagctcgctccggtcaagatgacaaaaccgtgtacgaatacctattttctcagcgccgaaagcgccgtgctccattggccaccaggcagggcaaacggcccagtaagaatctcaaggccaggtgttctaggaaggcgcttcatgtgaactttaaggacatggggtgggacgactggatcatcgcgccattggagtacgaagcctttcattgtgagggcttatgcgagtttccgcttaggagccacctggagccgacaaaccatgccgtcatccagacgcttatgaactctatggaccccgagagtacacccccgacatgctgcgtcccgacgagactctcccccatctcaatccttttcatcgattccgccaacaatgtcgtctataagcagtacgaggacatggtagttgaaagctgtggttgcaggtag

SEQ ID NO: 189914 - DNA, 1368 bp, Artificial Sequence
  Description of Artificial Sequence: Synthetic coding sequence
atggacaccccccgggtgctgctgagcgccgtgttcctgatcagcttcctgtgggacctgccgggcttccagcaagcgagtatttcatcgagcagttcctcagccgaactcggttccaccaagggcatgaggagtagaaaagaaggcaagatgcaaagagctccacgggactctgacgcaggccgtgaagggcaagagccccaaccccggccccaggatgaaccacgggcccaacagccaagggctcaggaaccccctggacgcgggcccagggtggttcctcacgagtacatgctgagcatttatagaacctatagcatcgcagagaagctgggaatcaatgcctcatttttccaaagtagcaaatctgctaacactattacttccttcgttgacagggggttggacgatttatcccacactcctttgcgtcgtcagaagtacctcttcgatgtgagcatgctgagtgacaaggaagaactcgttggtgccgaactcaggcttttcagacaagccccttccgccccatggggcccgcccgccggtcctctgcacgtgcaactgtttccttgcctgtctccccttctgttagacgcacgtaccctggacccccaaggggcaccacctgctggttgggaagtttttgatgtgtggcagggtcttaggcaccagccatggaagcaactgtgtctcgaacttagggccgcatggggagaactggacgctggggaagccgaagcccgtgcccgtggtcctcaacagcctccaccccccgatctcaggtcgctcggattcggccgccgcgtgcgccccccccaggagagggctctgctggtcgtgttcactcgtagccagcgcaaaaacttattcgcagagatgagagagcagctcgggagcgccgaggcagctggtcctggtgccggggctgaaggctcctggcctcccccgagtggcgcccccgatgctcgaccatggctacctagcccaggtcgacgccggaggcgcaccgcgtttgcctcgcgccacgggaagaggcacggaaaaaaatcgcgcctgcgctgttccaagaagccgctgcatgttaactttaaggaactgggctgggatgactggattatcgcccctctggaatacgaggcctatcattgcgaaggtgtatgtgattttcccctgagatcacatcttgaacccacaaatcatgccatcatccagaccctcatgaacagcatggatcctgggagcacacccccatcctgctgtgtgcctaccaaactgacgcctataagtatattgtatattgacgccgggaacaacgtcgtgtacaagcagtatgaagacatggtcgtcgagtcctgcggatgcaggtag

SEQ ID NO: 189915 - DNA, 1062 bp, Artificial Sequence
  Description of Artificial Sequence: Synthetic coding sequence
atggacaccccccgggtgctgctgagcgccgtgttcctgatcagcttcctgtgggatcttccgggttttcagcaggctagtatcagctcgtctagcagttcagcggagctaggtagtacaaaggggatgagaagtagaaaggaaggaaaaatgcagcgagccccgcgggattccgatgccgggcgcgagggacaggaaccgcagcctcgccctcaggacgagcctcgggcacagcaaccacgggctcaagagccccccggacgtggtccaagggtggtcccacacgagtacatgctgtcgatctaccgtacatattctatcgcagagaagctcggcatcaatgcttccttctttcaatcctctaagtccgccaacactattacaagcttcgtggaccgaggcttggacgatctgagccacactcctttgcgcagacaaaaatatctgtttgacgtttcaatgctgtctgacaaggaggaattagtgggcgctgagctgcgactcttcagacaggcaccctcagccccgtggggtccgccagccgggcctctccatgtgcagttgttcccttgcctgtcaccactgcttctcgacgcccggacacttgatcctcaaggcgcgcccccagccggatgggaagtttttgacgtttggcaagggttgcggcaccagccatggaaacagctgtgcctcgagctgagagctgcatggggggagctcgatgcgggcgaggcagaggcccgggcgagaggcccacagcaaccccccccccccgacctcagatctctcgggttcggaaggagagttcggcctcctcaggagagggcacttttagtggtgttcactcggtcccagcgcaaaaatctgttcgctccaggcgtgcgcggcctcagtttgagaggctgcatgaggcttccggcggcacttgcgccaggggcccaccaaccccgtcatcaccccgatgccgacgagctgcacggaccccgcttgcatcccgcgcagctgcttcgggcgcaccagatcgactcccatcagcactctatccatagaagaggccagtag

SEQ ID NO: 189916 - DNA, 816 bp, Artificial Sequence
  Description of Artificial Sequence: Synthetic coding sequence
atggacaccccccgggtgctgctgagcgccgtgttcctgatcagctttctgtgggacttgcccggctttcagcaagccagcattagctccagtagtagctccgcagagctgggttccaccaaagggatgcgatcccgtaaggagggcaagatgcagagggccccgagggacagcgacgccggaagagagggacaggagccacaacccaggccgcaggacgagcccagggctcaacagccccgcgcgcaggagccacctggacgggggcctcgggtcgttccccacgaatatatgctcagtatttatcgaacctacagcattgctgaaaagttgggcataaacgcctccttcttccaaagctccaaatctgcaaatacgattacaagcttcgtggacagagggctcgatgacctcagccatacacccctgcggaggcaaaagtatttattcgacgtatcgatgctctctgacaaggaggagctagtgggcgcagaattgagactgttccgccaagctccgtccgccccatggggccctcctgctggcccactgcacgtccagctctttccttgtctgtcccccttgctgctcgacgctaggaccttggacccgcagggtgccccaccagctggatgggaagtgttcgacgtctggcaaggtttacggcaccaaccatggaagcagctatgtcttgagctgcgggccgcacctggaccagcggagtcaggtctgcgcccggaaggagctgcttcacccggcgccggccccgctggtggcatccaccaaatccccgcagccgcctgcccccctaattag

SEQ ID NO: 189917 - DNA, 1353 bp, Artificial Sequence
  Description of Artificial Sequence: Synthetic coding sequence
atggacctgagcgccgccgccgccctgtgcctgtggctgctgagcgcttgccgcccccgcgatggactggaagctgcagcagtgctgagggcggcaggcgccggtcccgtgagatccccaggagggggtggtggcggtggcggtgggggacgaactctggcccaagcagccggtgctgccgccgtcccggctgctgccgtgccacgagccagggccgcaagaagagcagccggctcaggctttcggaatgggtcggtggtgccgcatcactttatgatgtccttgtaccgaagtctcgcaggtcgtgcaccggcaggggccgcggcagtatctgcctccgggcacggccgggccgataccatcaccggtttcacagaccaggctactcaggatgagagtgcggccgagaccggtcagtcattcctctttgatgtgagctctctcaatgatgccgacgaagtcgtgggcgcggaattacgggtcctgcgtagaggttcacctgagagcgggcctggctcatggactagccctcctcttctcctgctatctacttgccccggcgccgcgagggctccccgtctcctgtactcacgcgcagccgaacctcttgtgggccagagatgggaagccttcgacgtggctgatgctatgcggcgccatcgacgcgagccaagaccacccagagcgttttgtctcttactgcgtgccgttgcagggcctgtgccctcccctcttgccctgagacgcttaggctttgggtggcctggtgggggagggagcgctgctgaggagcgggccgtgctagtggtgagctctcggacccagagaaaagaatccctgttcagagagatcagggcccaggccagggctctgggggccgctcttgcttctgagccacttccagacccgggtactgggacagcatcacccagggcagtgatcggaggcaggagacgcagaagaacggctctagcaggcactcgaacggctcaggggtctggcgggggggccgggcgcgggcacgggagaagggggagatctaggtgttcaagaaaacccttgcatgtcgattttaaggaacttggttgggatgactggataatcgctccactcgactatgaggcgtatcattgcgagggcctatgtgattttcctttacggtcccacctcgagccgaccaatcacgcgatcattcagactctgctgaactccatggcgcctgacgccgccccagctagctgctgtgtgcccgctagactttctcctattagcattctgtatatcgatgcagcaaataacgtggtttataaacagtacgaagacatggtagtcgaagcatgtggatgtcggtag

SEQ ID NO: 189918 - DNA, 1269 bp, Artificial Sequence
  Description of Artificial Sequence: Synthetic coding sequence
atgccccggagcttcctggtgaagagcaagaaggcccacagctaccaccagcctcggtcacctggcccagactacagcttgaggctggagaatgtgcctgccccgagcagagcggactcaaccagcaatgcagggggagccaaagccgagccacgcgacaggttatctccggagtcacaattgacagaggcgcccgatcgtgccagcgctagtcctgatagctgcgaaggaagcgtgtgcgagcggtccagcgaattcgaagatttctggcggccaccaagtccgtctgcgagtcccgcctctgagaagtccatgtgcccttctctggatgaggcacagcctttcccccttcctttcaagccatattcctggtctggactcgccgggtcagatctccgacaccttgtacaaagttacaggccctgtggtgcccttgagcgaggcgcaggtctcggactgttttgtgagccggcacccgagccaggacacccggcggccttatatggtcccaaacgcgcggctggcggagccggcgccggagccccgggcagttgctccgcaggagcaggagctaccgctggccctggactcggcctctatggcgacttcggtagcgccgccgccggcctttacgaaaggcctacggccgctgccggcctgctgtatccagaaagagggcatggtctccacgccgataagggagctggtgtgaaggtggagtctgaactcctttgtacccgcctgctgctggggggagggtcttacaaatgtatcaagtgttccaaagtattcagtacaccccacggactggaagtacacgtgagaagatcccattcaggcaccagaccgtttgcttgcgagatgtgtggaaagactttcggccacgccgtgtcactcgagcagcacaaggccgtgcactctcaagagaggagcttcgactgcaagatctgcggcaaatcttttaaacgcagtagcaccctaagcacccacctgttgatccattctgacacgaggccctacccgtgtcagtattgcgggaagcgctttcaccagaaatccgacatgaagaagcacaccttcattcacacaggcgagaaaccacacaaatgtcaggtgtgtggaaaggccttctcccagtccagcaacctgattacgcatagcagaaagcacaccgggttcaaaccattcggctgtgatttatgcggaaagggctttcagcgcaaagtggatcttcggcgtcacagggaaactcagcacggactgaagtag

SEQ ID NO: 189919 - DNA, 1269 bp, Artificial Sequence
  Description of Artificial Sequence: Synthetic coding sequence
atgccccggagcttcctggtgaagagcaagaaggcccacagctaccaccagccccggtcccccggtcccgactactctctgcgcttggagaatgtgcctgcacctagtagagcggactcaacttccaacgccggaggggccaaggctgaaccgagagacagactgtcacccgaaagccagctcactgaggcacctgatagagcaagcgctagcccagacagttgtgagggatccgtttgcgaaaggagtagtgaatttgaagacttctggcggcctccaagtccatcagcatccccagcctctgagaagtccatgtgcccctcactggatgaagcccaacctttccccctgccctttaaaccttattcttggagtggcctggctggttcagatctgcgtcatctggtgcagagttaccgtccgtgcggcgccttggaacgtggggcaggccttggcctgttttgcgagcccgcaccagagcctggacaccccgcggctctgtacggcccgaagagggctgcaggcggagctggagcaggagctcccggcagttgttccgctggggctggcgctaccgctgggccagggttgggcctgtacggcgactttggcagcgcagctgccggactgtatgaacgccctactgcagccgcaggcctgctgtatcctgaaaggggtcacgggctgcacgctgataagggggccggtgtcaaagtcgaatcagaactgttgtgcacacgtctcctgctggggggtgggtcctacaaatgcatcaaatgttctaaggttttcagcacccctcacggactggaagtccacgtacgacgcagtcacagcggtaccagacctttcgcctgtgagatgtgtggcaagacattcggccatgccgttagcttggaacagcataaggcagtccactcccaggagagatcttttgactgtaagatttgcggaaagtctttcaaacgtagctctactcttagcacccacctgttgatccatagcgacaccaggccctacccatgtcagtactgcgggaaacgctttcatcagaagtccgacatgaagaagcacacctttatacacactggagagaagcctcacaaatgtcaagtgtgtggaaaggccttctcacagtcaagcaatctgataactcactcccgtaagcatacaggatttaagccttttggttgcgacctctgtggaaaaggatttcagcggaaagtggacctgagacgccacagagaaactcagcatggtctgaagtag

SEQ ID NO: 189920 - DNA, 1269 bp, Artificial Sequence
  Description of Artificial Sequence: Synthetic coding sequence
atgccccggagcttcctggtgaagagcaagaaggcccacagctaccatcaaccacggagtccggggccggattactctctgcgtctcgagaacgtgcccgcccccagcagagccgattctacctctaacgcgggaggggccaaggccgaaccacgagatagactatcccctgagtcccagctgaccgaggcacctgacagagcttccgcctctccggattcttgtgaagggtcagtctgtgagcggagcagcgagtttgaagatttttggagacccccttctcccagcgcttcacctgccagcgaaaagagtatgtgcccgtcactcgacgaagcacagcctttccccctgcccttcaagccctacagttggtctggacttgccggaagcgatttaagacatctggttcagtcatacaggccctgcggcgctctggaacgaggggcagggctgggcctgttttgcgagccagcacccgagccaggtcaccctgctgcactctacggcccaaagcgtgccgccgggggcgcaggcgcaggcgcccctggctcttgcagtgcaggcgccggcgccacggcaggcccgggcctgggattatacggagatttcggatcggccgccgccggcctgtacgagagacccaccgcggccgctggcctgctgtacccagaacgtggccatggcctgcatgcagataaaggagctggtgtgaaagtcgagtctgagctactatgcacccggctgctcctagggggcggatcatacaaatgcatcaagtgttcaaaggttttcagtactccccatgggctcgaagtacacgtgcgtcggtctcactctgggacaagacctttcgcctgcgagatgtgtggcaagacattcggccatgccgtgtctttggaacagcacaaagccgtgcactctcaggagaggagtttcgactgtaaaatttgtggcaagtcttttaagcgctctagtaccttatcaacccacctgttgattcacagcgacacccgcccctatccttgtcagtactgcggtaagagattccatcagaagtcagatatgaagaagcataccttcatccacacaggagagaagccgcacaagtgtcaggtgtgtgggaaagcctttagccagtcttccaatctgatcacacattccagaaaacacaccggcttcaagccttttgggtgtgacctatgtgggaaaggcttccagagaaaagtcgaccttaggcgccacagggagacccagcatggcttgaagtag

SEQ ID NO: 189921 - DNA, 993 bp, Artificial Sequence
  Description of Artificial Sequence: Synthetic coding sequence
atgccccggagcttcctggtgaagagcaagaaggcccacacctaccaccagccacgcgtgcaagaagatgagcccctctggcctcctgcccttacacccgtcccgcgcgaccaggctcctagtaattctccagtcctgtccacactgttcccaaatcagtgccttgattggacgaacttgaagcgggagcctgaacttgagcaggatcaaaacttggctcggatggccccagcacccgaggggcccattgtactaagtcgccctcaggacggggactcccctctgtctgattctccccccttttataagccctcattcagctgggacacactggccactacctacgggcattcttatcggcaggccccatccacaatgcagtcggccttcctcgaacactcagtatctttatatggtagtccacttgttcctagcacagagccagcactggattttagcctgcgatatagtcccggcatggatgcctatcattgtgtgaagtgcaataaggttttctcaacaccccacggcttggaggttcacgttcgaagaagccactccggcactcggccctttgcctgtgatatctgcggcaaaacgttcggacatgctgtgagtctggagcagcacacacatgttcacagtcaagaacgaagctttgagtgccggatgtgcggcaaggcattcaaacgctcctctacactgagtacacacttgcttattcatagcgacacaaggccgtatccatgccagttctgtggtaaacggttccatcagaaaagcgatatgaagaagcatacctatatacacactggggagaagccccacaaatgtcaagtgtgcgggaaagcttttagtcagtcctctaacttgatcactcattctcggaaacacaccggattcaaaccctttagctgtgagctctgcacaaagggtttccagcggaaggtggatctccggcgccatagagagtcacaacataatttaaaatag

SEQ ID NO: 189922 - DNA, 993 bp, Artificial Sequence
  Description of Artificial Sequence: Synthetic coding sequence
atgccccggagcttcctggtgaagagcaagaaggcccacacctaccatcaaccacgggtccaggaggacgaaccgctatggccccctgccctcactcccgtgccgagggaccaggccccttcaaattctccagtcctcagcacacttttcccaaaccaatgtctggactggacaaatctcaagagagaacccgaactggaacaggatcagaacctggcacgaatggctcccgcaccagaggggccaattgtgctctcccggccccaagatggggatagccccctatctgacagtcctccgttctacaaaccttcattcagctgggatactctggccacaacatacggacattcctacaggcaggcgccctccactatgcaatcagcgttccttgagcacagcgtaagtctctacggcagcccgcttgtaccttccactgagcccgccttggatttctccctcaggtatagcccaggcatggatgcttatcactgtgtcaaatgtaacaaggtcttctccaccccgcacggtctcgaggtgcacgttcgaagatcccacagcgggaccagaccttttgcttgcgatatttgcggtaagaccttcgggcatgcagtgagcctggaacagcacactcacgttcattctcaagaacgctcattcgaatgtaggatgtgcggcaaagcgttcaaaagaagctcaactctgagtacacatctgctcattcatagcgacactcgcccttatccctgccagttctgcggtaagcggtttcaccagaagtctgacatgaaaaagcatacctacatccatacaggagagaagccccacaagtgccaggtgtgcggcaaggcttttagccagagttcaaacctcatcactcattccagaaagcatacaggcttcaagccgttttcatgtgaactttgtacgaagggatttcagaggaaggtggacctgcgacgccaccgcgagagtcagcataacctgaaatag

SEQ ID NO: 189923 - DNA, 855 bp, Artificial Sequence
  Description of Artificial Sequence: Synthetic coding sequence
atgccccggagcttcctggtgaagagcaagaaggcccacacctaccatcaaccaagagtgcaggaggacgagccactgtggccaccagcattgacgcccgttccgcgcgaccaagctccttcaaactcacctgtgttgtcaacactttttccaaaccagtgcctggattggacaaatttaaaacgcgagcccgagcttgaacaggaccaaaacttggcccggatggcacccgccccggaaggccctatagtgttatccaggccccaggacggcgatagcccactgtcggatagcccaccattttataagccgtcattctcatgggatactctagctacgacttacggacattcatatcggcaggctccctctactatgcaatctgccttcctggaacactcggtttccctttatggcagtccccttgtcccgagtactgagccggctctcgattttagcctcaggtatagccccggcatggacgcttaccattgtgtcaagtgcaacaaggagcggagttttgagtgtcgcatgtgtggcaaggcctttaagaggagttctactttatcaacccatctcctgattcatagcgatacccggccctatccttgccaattctgcggaaagcggttccaccaaaaatcagacatgaaaaaacacacttacatccacaccggcgaaaagccccacaagtgccaggtctgcggcaaggcctttagtcagtcaagtaatttgattacgcatagtcggaagcataccggcttcaagcccttcagctgcgaactctgcacaaaggggtttcagcggaaggtggatctcagacgccacagggagtctcaacacaacttaaaatag

SEQ ID NO: 189924 - DNA, 855 bp, Artificial Sequence
  Description of Artificial Sequence: Synthetic coding sequence
atgccccggagcttcctggtgaagagcaagaaggcccacacctaccaccaacctagagtgcaggaagatgaaccgctttggccgcccgctctgacccctgtgccccgcgatcaggccccaagtaacagtcctgttttgtcgacattgttccctaatcagtgtctggactggactaacctcaaaagggaacctgaactggagcaggaccagaacctggcccgcatggctcctgccccggaaggacctatcgtcttgtccaggcctcaggacggcgattctcctctgtcggactctccccccttttataaaccgtccttctcctgggacacactggcaaccacctacgggcactcatatcggcaagccccaagtactatgcagagtgcatttctggaacacagcgtctctctctatgggtcccctcttgttccgtctaccgagcccgcattggacttttctcttcgctactcacccgggatggacgcgtatcattgtgtcaagtgcaataaggaacgcagtttcgagtgtcgcatgtgcggaaaagctttcaagcgcagctcgacattgagtacacacttgctcattcactcagataccagaccatatccctgccagttttgcggaaagcgcttccatcaaaagtccgatatgaagaagcatacatacatccacaccggcgaaaagccgcataagtgccaggtgtgtggcaaagcatttagccagagctctaacttaatcacccactcaaggaagcacacgggcttcaagccctttagctgtgaactgtgtaccaaaggttttcagagaaaggtagacttgcgcagacacagagagagccagcacaaccttaagtag

SEQ ID NO: 189925 - DNA, 993 bp, Artificial Sequence
  Description of Artificial Sequence: Synthetic coding sequence
atgccccggagcttcctggtgaagagcaagaaggcccacacctaccatcagccacgggtccaggaggatgagccgctgtggcctcctgcgttaacccccgtgccacgggaccaggcgcccagcaactcacctgtgctctccaccttgttcccgaaccagtgtcttgattggaccaatctgaagagagagcctgaactggagcaggaccagaatttagccagaatggccccagctcctgagggccctatcgtgttatcgcgcccccaggatggggattcccctctgtctgactccccccccttctacaagccttcattttcctgggacacccttgcaaccacgtatggccactcctatcggcaggctcctagtacaatgcagtccgctttccttgagcactcagtgtcactttacggttctccccttgtaccaagcaccgagcccgctcttgacttcagtctgcgctattctccagggatggacgcgtaccattgcgtgaagtgtaacaaagtgttctcgacgccacatggactggaagttcacgtacgcagatcccatagcggcacgaggccatttgcatgtgacatttgtggaaagacttttgggcatgctgtgtctttagagcagcatactcatgtccacagtcaggaacgctccttcgagtgtaggatgtgtggtaaggcatttaagaggagtagtacacttagtacccacctgctgattcatagtgatacgcggccctacccctgccagttctgcgggaaacgcttccatcagaagagtgatatgaaaaagcatacttacattcacaccggggaaaaaccccacaagtgccaggtgtgcgggaaggccttcagccagagctctaatcttatcacgcatagccgcaagcataccgggttcaagccttttagttgcgaactctgtactaaaggattccaaagaaaggtggatctgagaaggcatagggaaagccagcacaacctcaagtag

SEQ ID NO: 189926 - DNA, 855 bp, Artificial Sequence
  Description of Artificial Sequence: Synthetic coding sequence
atgccccggagcttcctggtgaagagcaagaaggcccacacctaccatcagcctagagtgcaggaagacgagcccctgtggccccccgctctaacccccgtccccagagaccaggcccccagcaacagtcctgttctgagcaccctgtttcctaatcagtgtctggattggaccaacttaaagcgagaacccgaactagaacaggaccagaatcttgcccgcatggctcctgcgccagaggggccaattgtgctatcccggccccaggatggggactctcctctcagtgactcgcccccattctacaagccgtctttctcttgggatacgctcgccacgacttatgggcactcctaccgccaagcaccatcaactatgcagtcagcatttttggagcacagcgtgtccttgtatggcagtccgctggttcctagcaccgagcccgctctggatttctccctcagatactccccggggatggatgcataccactgcgttaaatgcaataaggaacggtcctttgagtgccggatgtgcggtaaggccttcaaacgctcgagcacccttagcacacatctcctcatccattccgacacccgcccatacccatgccagttctgcggaaaacgtttccatcagaagtccgatatgaaaaagcatacctatattcacacaggggaaaaacctcataagtgccaagtttgcggcaaggcattctcacaaagcagtaacctcattacccacagccgcaaacacaccgggttcaaaccattcagttgtgagctgtgcacgaagggatttcagcgcaaggtggatttgagaaggcatagggaaagtcagcacaacttgaagtag

SEQ ID NO: 189927 - DNA, 1623 bp, Artificial Sequence
  Description of Artificial Sequence: Synthetic coding sequence
atgaccaccagcctgcaggacggccagagcgccgccagccgggccgccgcacgcgatagcccacttgcagctcaagtatgtggtgctgcccagggccggggggatgcccatgatctggctccagccccatggctgcacgcccgggcattattaccgctgcccgatgggacaagaggctgcgctgcagaccgcagaaaaaaaaaggacctcgacgtacctgaaatgccaagtatccccaacccatttcctgagctgtgctgctcccccttcactagcgtcctgagcgccgacctgttccctaaagctaactcgcgaaaaaaacaggttattaaagtgtatagcgaagatgaaactagccgagcactggatgttccatccgacataactgctcgagacgtctgccagctgctgatcctcaaaaaccactacatcgatgaccactcatggacattatttgagcatctgcctcacattggtgtggaacgaacaatagaggatcatgagttggtcatagaggttctcagtaattgggggattgaagaggaaaacaaactgtacttcaggaaaaattacgcaaagtacgaatttttcaagaatccaatgtatttttttcctgagcatatggtgtcgttcgctactgagacgaatggcgagatctcccctactcaaatcctgcaaatgttcctttccagcagcacctatcctgaaatccacgggttcttgcatgccaaggaacagggtaagaaaagctggaaaaagatctacttttttctgaggaggtcaggcctgtattttagcactaagggcactagcaaagagccgcgacatctgcagttcttctccgaattcgggaatagcgacatctatgtaagcctggccggcaagaagaaacacggcgcacctacaaactacggattctgtttcaaacccaacaaggccggtggaccacgcgacttgaagatgttatgcgccgaagaagaacaatccagaacttgttgggtcaccgcgatccgtctgctgaaatatggaatgcagctgtaccagaactacatgcacccctaccaaggacgatccgggtgcagttctcagagcatttcccctatgcggtctatttcagaaaacagcctggtggccatggacttttccggacagaagtcgagggttatagaaaatcccaccgaagctctcagcgtcgctgttgaagaggggcttgcgtggcgtaaaaagggctgtcttcgcttaggcacccacggctcccccacggccagttcccagtcttctgcgaccaacatggccattcacaggagccagccctggtttcaccacaagatcagcagagatgaggctcagcgtctgattatccaacagggactggtggacggtgttttcctggtaagagattcacaatcaaaccccaagacgttcgtcctgtccatgagtcacgggcagaaaatcaaacactttcaaattatacctgtggaggacgacggagagatgtttcacacattggacgacggccacacacggttcaccgatctaatccaactggtggagttctaccagctgaacaaaggggtacttccctgcaagcttaagcattattgtgctcgcatcgcactgtag

SEQ ID NO: 189928 - DNA, 1362 bp, Artificial Sequence
  Description of Artificial Sequence: Synthetic coding sequence
atgagcctgagcgcccggcgggtgaccctgcccgccatcacccccataattctccagaagcgggtgattaaggtgtactctgaggatgaaacaagtagagctcttgacgtgccttcagacattacagcaagagatgtgtgtcagctactgatactgaaaaatcactatatcgacgaccacagctggacgctgttcgagcacttgccccatatcggcgttgagaggacaattgaggaccacgagcttgtgattgaggtgctgagtaactgggggatcgaggaagaaaataaactgtactttcgcaaaaattatgccaaatacgagttttttaagaatcctatgtatttctttcccgagcacatggtgtcatttgccaccgagactaatggagaaatatctcctacccagatacttcagatgttcctctcgtcaagtacatatccggagattcacggcttccttcacgccaaggaacaaggaaaaaagagttggaagaagatctacttctttttgcgtagaagcggtctctacttctcaaccaagggtacttctaaagaacctagacacctgcaattcttctccgaattcggcaatagtgacatctatgtcagtctagcggggaagaagaaacatggggccccaaccaactatggcttctgttttaagcccaacaaggccggcggccccagggacttaaagatgctgtgtgctgaggaagagcaaagtcgaacatgttgggtcaccgccatccgactgctgaagtacggcatgcagctgtatcagaattatatgcacccttatcaagggcggagtgggtgctcctctcagagcatttctccgatgagatccatcagcgaaaacagccttgtagccatggactttagcggtcagaaatccagagtgattgagaaccctacagaggctttgtccgtcgctgttgaggaaggcctcgcatggcgaaaaaagggctgcctgcgtctagggacgcacggcagccccacagcctcttcacaatctagcgccaccaatatggcaattcaccgcagccagccatggtttcatcacaaaatatccagggacgaagcacagagactcataattcagcaagggctcgtcgatggggttttcctggtgcgggattctcagtcaaaccctaaaacattcgtgctgtcaatgagccacggccagaagatcaagcactttcaaattattccagtagaagacgatggggaaatgttccatactctcgacgatggccacacacggttcactgacctgattcagctggtggagttttatcagctaaataagggcgtgctcccgtgcaagctaaagcactactgtgcccgaatcgcactgtag

SEQ ID NO: 189929 - DNA, 1599 bp, Artificial Sequence
  Description of Artificial Sequence: Synthetic coding sequence
atggagctggacctgagccccccccacctgagcagcagccccgaggacttgtgtcccgcacctggcaccccacctggaactccgagaccgccagacacaccactgcccgaagaagtcaagcgaagccagccgcttttgattccaacaaccgggcggaagctgagagaggaggaaaggcgcgcgacttcgctgccatctatccctaacccctttcccgagctgtgctcccctccgagtcagtcgcccatcttgggcggacctagcagcgccaggggcctgcttcctcgcgacgcatctaggccacacgtagtgaaagtctacagcgaagacggagcatgtaggtctgtcgaagtggcagctggagcgacagccaggcatgtgtgcgaaatgctcgtgcagagagcacatgccttatccgatgaaacttgggggctcgtggaatgtcatccacatttggcccttgaacgagggctggaggatcacgagtccgttgttgaggtgcaggcagcctggcccgtgggtggtgacagccgcttcgtcttccgaaagaacttcgccaagtacgaactgtttaaaagttccccccactcattgtttccagaaaaaatggtgtcctcctgtttggatgcccatacggggatctcccacgaggatctgatccagaacttcctgaatgccggctctttccccgaaatccagggatttctacagcttcggggtagtggaaggaaactctggaaacggttcttttgcttccttcggcggagcggcctctattattcgacaaagggtactagtaaagacccccgccacctgcagtatgtggcagatgtgaatgagtccaatgtgtatgtggttacccagggcagaaaactgtatgggatgccaaccgacttcggtttttgcgtaaaacctaacaaactgcgcaatggtcacaaaggcctgagaattttctgctccgaagacgagcaatctcgcacatgttggctcgcagcctttcggttgtttaagtatggcgtgcaactgtacaagaattaccaacaggcacagtcaaggcatctgcatccgtcctgcctggggtcaccacctctgcgtagcgcttccgataatacactcgtggcaatggattttagcggccacgccgggagagtgatcgagaatcctcgcgaagccttatcagtggccttagaggaggctcaggcgtggcgcaaaaagaccaatcaccgactgtctttgcccatgcccgcctctgggacctccctgagtgccgccatccaccgaacccaactttggttccacggccgtatcagccgggaagagtcccaaaggctgatcggtcagcagggactggtggatggtctgtttctggtccgtgagtctcagcgaaatccgcaaggcttcgtgttgagcctctgtcacttgcagaaagtgaaacactacttgattttaccttcagaagaagagggccggttgtatttctctatggacgacggccaaaccaggtttaccgatctgttgcaattagtggagtttcatcagctcaacagagggattcttccttgtctgctgcggcactgctgtacaagggtcgctttgtag

SEQ ID NO: 189930 - DNA, 1344 bp, Artificial Sequence
  Description of Artificial Sequence: Synthetic coding sequence
atggagctggacctgagccccccccacctgagcagcagccccgaggacctctgtccagctcctggcacacctccaggtacaccacgcccccccgacacccccctaccagaggaagtcaagagatcccaacctttgctgatcccaactaccggtcggaagctgagggaggaggagcggagagccacgagcctcccgtccatcccaaaccccttccctgaattgtgttctcctccaagccagtctccgatactgggtggaccttcgagcgcgcgaggactccttcctagagatgcatcccgcccccacgtggtcaaggtttactccgaggacggggcctgcaggtcagtggaggttgcagccggtgcaacagcgaggcatgtgtgcgagatgctggtacagcgagcccatgccctgagcgacgagacttggggcctggtcgagtgtcacccccacctggccctggagcgcggcctggaggaccatgagtccgtcgtagaagtgcaagctgcctggcctgtgggaggggactccagatttgtgtttcgtaaaaattttgctaaatatgagttgttcaaatcgagccctcatagtcttttccctgaaaaaatggtaagttcgtgccttgacgcccatacggggattagtcacgaggatctcattcagaattttctgaacgccggcagttttccagagatccagggctttctgcagctgaggggcagcggccgaaagctgtggaaacggttcttctgcttcctgagacggagtggcctctactacagcactaaaggaaccagtaaagatccacgtcacttgcaatacgtggcagacgtcaatgagtccaacgtttacgtggtgactcagggtaggaagctgtacggcatgcctacagattttggattttgtgttaagccaaataaacttaggaatggacacaagggccttcggatattttgcagtgaagacgagcaatcccgaacctgctggttagccgcgtttagattattcaagtatggagtgcaactatataaaaattatcagcaggcccagtctcggcatttgcaccctagttgccttggatctcccccgctgaggtctgcttcagataatactctagtcgccatggacttctccggtcacgctggaagggtcattgagaaccctcgtgaggcactgtctgtagcactggaagaagcccaggcctggcgaaagaagacaaatcatcggctatccctccccatgccagcatctgggacttccctgtctgctgcgtgctcctggtctgggagagtgagtggaacccctagagccttgagttctctgtgtgccacatgtcgcaagtag

SEQ ID NO: 189931 - DNA, 1344 bp, Artificial Sequence
  Description of Artificial Sequence: Synthetic coding sequence
atggagctggacctgagccccccccacctgagcagcagccccgaggatttatgccctgctcccggcacacctcctgggacaccaagaccccctgatacacctttgcccgaggaggtgaaaagaagccagcctctgctgatcccaaccaccggtcggaagctgcgcgaggaggagcgccgcgcgacaagtctcccctctattcctaatcccttccctgaactttgctcccccccttctcagtctcctattctgggcggtccgtcttctgcccgcggactgctgcctagagacgccagccgccctcacgtcgtcaaagtttatagcgaagacggcgcctgcaggtcagtcgaggtggccgctggtgctaccgcaaggcacgtctgcgaaatgctggtccagagagctcatgcactgagtgatgagacctggggtctggtcgaatgtcaccctcacctggccctggaacgtgggctggaggatcacgagagtgtggttgaggtgcaggccgcatggcctgtcggtggcgactcgagattcgttttcaggaagaattttgcaaagtacgaactcttcaagagctccccccattcccttttccctgaaaaaatggtgtctagttgcctcgacgcacacacaggaattagtcacgaggatttgatacaaaacttcctcaatgctggctctttccctgagattcagggattcctacagctgcgggggtctgggcgcaaactgtggaagcggtttttctgctttctgagacggtccggattgtactattctaccaaggggacgagcaaagatcccaggcatttgcaatacgtggccgacgtgaatgagagcaacgtgtacgtggtaacacagggcagaaagctgtatggtatgccaacagactttgggttctgtgtaaagccaaacaaactcaggaatggacataaaggtctccgaatcttttgtagcgaagacgaacagagccgaacatgctggctggccgctttccgccttttcaagtacggcgtacaactctacaaaaactatcagcaagcgcaatccaggcatttacatccaagttgcttaggctccccaccattaagatcggctagcgataatacgctcgtggcaatggatttttcaggtcacgccggccgggtgatcgagaacccaagagaggccttaagtgtcgcactcgaagaagctcaggcctggaggaaaaagacaaatcatcgcctgagcctgcccatgcccgcatccgggacttccctcagcgcagcatgctcctggagcggccgcgtgtctggcaccccccgcgctctcagttcactgtgtgccacctgtaggaaatag

SEQ ID NO: 189932 - DNA, 1599 bp, Artificial Sequence
  Description of Artificial Sequence: Synthetic coding sequence
atggagctggacctgagccccccccacctgagcagcagccccgaggacctgtgtccagccccaggtacccccccagggacaccccggccccctgatacaccactgcccgaggaggtgaaaagaagtcagccattactgattcccactaccgggcgaaagttgcgtgaggaagaacgcagggctacctccctgcctagtatccccaatcccttccccgaattgtgctcacctccttctcagtcacctattcttggcggccctagctctgcaagaggcttactgccccgcgatgcatctcgcccccacgtggtgaaggtatactccgaggacggggcatgtagatccgtggaagttgctgcaggagcaaccgcccggcatgtatgcgagatgttagtccagcgggcacatgccctgagcgatgaaacttggggtctggtcgagtgccacccccacctggccctcgagcgcggcctggaagaccacgaatcggtcgtggaggtgcaggccgcgtggccagtggggggtgattcaagatttgtgttccgcaagaatttcgccaaatacgagctgttcaagagctcaccccatagcttatttcccgagaaaatggtcagctcctgcctggatgcccacacaggcatcagccatgaagacttgattcagaatttcctgaatgctgggtcttttcccgagattcagggattcctgcagttgaggggatctggaaggaaactttggaaacgcttcttttgttttctcaggcggagtggactttactacagcacaaaaggcactagcaaggacccgcgccaccttcagtatgtggccgatgtcaatgaaagcaacgtctatgtggtcacacaagggcggaagctgtatgggatgccaaccgactttgggttttgtgtgaaacctaacaagttacggaatggacacaaggggcttagaattttttgcagcgaagacgagcagtccaggacatgctggctggctgccttcaggctatttaaatacggcgtacaactgtacaagaattaccagcaggcccaatcaagacacctgcatccgtcttgtctggggtctccacccctgaggtcggcctcagataacactttggtggccatggacttcagtggacacgcgggcagggtgatcgaaaatccgagggaggccctgagtgtggcccttgaggaggcacaagcatggagaaagaaaacaaatcatcgtctgagtctaccgatgcccgcctctggcacctcgctgtccgctgcaatccatcgcacccagctctggttccacgggcgcatcagcagggaagaatcccaacggctgatcggccagcagggtttagtcgacggcctctttctggtcagagagtcccagcgcaatccgcagggtttcgtgctctcactctgccatttgcagaaggtgaaacattatctcatattgccgtccgaagaggaaggacggctctatttttccatggacgacggccaaactcgattcaccgaccttctccaacttgttgaatttcatcaacttaatagaggaattctgccctgtttattgagacactgttgtaccagagtagctctgtag

SEQ ID NO: 189933 - DNA, 1599 bp, Artificial Sequence
  Description of Artificial Sequence: Synthetic coding sequence
atggagctggacctgagccccccccacctgagcagcagccccgaggacctctgtccagctccaggcacccctcccggtactccaaggcccccggacactcccctgcccgaggaagtgaagagatctcagcccctgcttattcccaccacgggacggaaactcagagaggaagagcgaagggccacaagcctcccatctatcccaaatccatttccagaactgtgctcacctccctcacaatcccccattctgggtggaccgtcctcagcccgcgggctccttccccgagatgcatcacgaccccacgtggtgaaggtgtactctgaagacggcgcctgccggtctgtggaggttgccgcgggcgctacagccagacatgtatgcgagatgctagtgcaacgggcccacgcgcttagcgacgaaacttggggcctcgtagaatgtcatccccacctggctttagagcggggattggaggaccacgaatctgtggtggaggtgcaggccgcttggccagtcggtggggactcacgtttcgtcttcagaaaaaacttcgcaaaatatgagctcttcaagtcctcaccacattccctctttccagaaaagatggtatcctcttgccttgacgcccacacgggcatctcccacgaagatctgattcagaatttcttaaatgctgggtctttcccggagatccaaggcttccttcagttgagaggtagcggccggaagctgtggaagcgcttcttctgttttcttcgccggtcaggtctctactacagtaccaagggtacgtctaaggaccccagacacttacagtacgtggctgacgtaaatgaaagcaacgtgtacgtcgtcactcaaggcaggaagctttacggcatgcccacagatttcggattctgcgtgaagcctaacaaactgagaaacggccataaaggattaagaatattttgctctgaagacgaacaaagtcggacctgctggctggcagccttccggctgtttaaatacggcgtccaactgtataagaattatcagcaagcacagagcagacatctgcacccgagctgcctcggatctcctccattgcgcagtgcctcagacaatactttggtagcgatggattttagcggacacgcgggccgggtgattgagaacccccgagaagccctgtctgtggccttagaagaggcccaggcatggcgaaaaaagaccaaccataggttgagcctgcccatgcccgcctcaggaacatcacttagcgccgccatccataggactcagctctggttccacggccgaatctcaagggaggagagccagaggttgatcgggcagcaaggcttggtggacgggctgtttcttgtccgcgagagtcagaggaacccacagggatttgtgttatccctgtgccatcttcagaaagttaagcactatcttattcttccaagtgaggaagaaggaagactgtacttcagcatggatgatgggcagaccaggttcaccgacctcttgcagctggtggagtttcatcaactgaatcgcggcatactcccctgcctcctgaggcattgttgcacaagagttgctctttag

SEQ ID NO: 189934 - DNA, 1668 bp, Artificial Sequence
  Description of Artificial Sequence: Synthetic coding sequence
atgggcaagtggcggcccggccagggccacaccaccggcagcgtgaagcctcttagctgctccgacgcaatggagctcgatctttcgccgcctcacctctcaagcagcccagaggatctttgtccagctccaggaacacccccgggaactccccgaccgcctgacaccccgctcccggaagaggttaaaagatcccaaccgctactgatacccactacgggaagaaaacttcgagaggaagagaggcgggccacttccctgccatctataccgaaccctttccctgaactttgctctccccctagccagtcccctattttggggggaccgtctagcgcacggggccttcttccacgagatgccagccgtccacacgtggtgaaggtctacagtgaagacggtgcctgtcgctccgtggaggtggcagctggggcaacggctcgacatgtgtgcgagatgcttgtgcagagagctcatgccctgagcgacgagacgtggggcctcgtcgagtgtcatccacaccttgcactggagcgaggcctggaggatcacgagagcgtcgtggaagtgcaggccgcttggcccgttggaggagattcgagattcgtgttccggaaaaactttgcaaagtatgagctgtttaaaagttcccctcatagcttgtttccagaaaagatggtgtcatcctgcctcgacgcgcacactggcattagccatgaagatcttattcaaaactttctgaacgccgggtcctttcctgaaattcagggctttttgcagcttagaggatccggccggaagctctggaagaggtttttctgctttttgcgacgatcaggactgtattactctacaaaggggacatccaaggacccaagacatctgcaatatgtcgccgacgtcaatgagagcaacgtctacgtggtgactcaggggcgcaagttgtatggaatgccaaccgacttcggattctgtgtgaagcccaacaagttgcggaatggacacaaagggctacgcattttttgcagcgaagatgaacagagccggacttgctggctggcggccttcaggctcttcaagtacggggtgcaattgtataaaaactatcagcaggcccagtctaggcacctgcacccatcatgcctcgggagcccgcccctgcgcagcgcttcagataatacccttgtggctatggatttcagtggccacgcgggaagagtcatcgagaacccgcgggaagctctgagcgtcgccctggaagaggcccaagcttggcgcaagaaaaccaatcatcgcttgagccttcctatgccagcctcgggtacaagcctcagtgctgctatccaccgcacacagttatggttccacggacgaattagtcgggaggagtctcagcgcctcatcggccaacagggcttggtggacgggttgtttctcgtgcgtgaaagccagcgcaacccacagggctttgtcctgagcctgtgccatttacaaaaagtaaaacactacctcatcttacccagcgaagaagaagggcgcctgtattttagcatggacgacggtcagacacgttttaccgacttacttcagttggtcgagtttcatcaacttaaccggggaatcctcccttgcctcctgaggcactgttgcactagggtagccttatag

SEQ ID NO: 189935 - DNA, 618 bp, Artificial Sequence
  Description of Artificial Sequence: Synthetic coding sequence
atggccgcccccggcgagcggggccggttccacggcggcaacctgttttttctcccaggcggtgctcggagcgagatgatggatgacctcgcaaccgacgcccgtggacgaggcgcaggaagacgcgacgctgcggctagtgcttccacacccgctcaagcaccaacaagcgattccccggtcgctgaggacgccagtagacgcaggccttgtagagcttgtgtggatttcaaaacatggatgagaacacagcagaagcgtgatacaaagtttagggaagattgcccccccgacagggaagagctggggagacattcttgggctgtactgcatacgctggccgcctactacccagacctgccaacaccggaacagcagcaggacatggcacaattcatccacctattctccaagttctatccgtgcgaagagtgcgccgaagacttgcggaaaagactgtgtcgcaatcatcccgacacgcggacgcgagcctgcttcactcaatggctgtgccatctgcacaacgaagttaatcggaagctcggcaagcccgatttcgactgtagtaaggtggacgagcgatggcgagacggttggaaagacggcagctgcgactag

SEQ ID NO: 189936 - DNA, 285 bp, Artificial Sequence
  Description of Artificial Sequence: Synthetic coding sequence
atgcggacccagcagaagcgggacaccaagttccgggaggactgccctcctgaccgtgaggagctggggcgacactcctgggctgtcctgcacactctggcagcctattatcccgacctgccaactcctgaacagcagcaggatatggcacaatttatccatctgttcagcaaattttatccatgcgaagagtgcgccgaggacctcaggaaacgtttgtgtagaaatcacccagatacgcgcactagggcctgctttactgtggccgtgccacccgcacagtag

SEQ ID NO: 189937 - DNA, 1629 bp, Artificial Sequence
  Description of Artificial Sequence: Synthetic coding sequence
atgagcccctgccccgaggaggccgccatgcggcgggaggtggtgaaacggatagagaccgtcgtgaaggacctgtggcctacagctgacgtgcagatctttggttctttttccacaggactctatttaccaacaagcgatattgatctcgtcgtctttggcaagtgggaacggccacccctgcaactcctcgagcaagctctgaggaaacacaacgtggcagaaccatgctccatcaaggtactcgacaaagctacagtgcctattataaaactgactgatcaggagacagaggtgaaagtggatatcagttttaacatggagactggagttcgagccgctgagtttatcaagaactatatgaagaaatactcgctgctgccatacctgatcctagtgctcaagcagtttttactccagcgtgatcttaacgaagttttcacagggggcatttcgtcgtatagcctaatccttatggcgatcagttttctccaactgcatccgaggatcgatgccagacgagctgatgaaaatctgggaatgctgttggtggaattctttgagttgtacggcaggaatttcaattacctgaagaccggcattcggatcaaggagggtggggcctacatcgcaaaagaagagatcatgaaagccatgacgtcagggtataggccatctatgctctgtatagaggaccctctcctgccaggtaatgatgtaggaagaagttcttatggtgccatgcaggtaaaacaggtttttgactatgcctacatagtcttgagccacgccgtgagcccactggccagatcctatcctaaccgcgatgctgagagtactcttggccgcatcataaaagtcacgcaggaggtgatcgactaccgacggtggataaaagagaagtgggggtctaaggcacatccttcaccaggcatggactcgaggattaagatcaaggaacgaatcgcaacttgtaacggcgagcagacacagaatcgggagcccgagtccccgtacggccagcggttaactctgagcctttcctccccgcagcttctatccagcggctcatctgcttcatcagttagcagtctgagcggatccgacgttgattccgataccccgccctgcaccacgccaagcgtgtaccagttttccctacaggcccctgccccgttaatggccggcctccctaccgcactgcccatgcccagcggcaagcctcagcccaccaccagcagaactctcattatgactacaaataatcagacccgattcaccatccccccccccaccttaggggtcgcgcctgtgccatgccgccaggccggcgttgaagggaccgccagtctgaaggccgtacatcatatgagctcgcccgctattccaagtgccagtccgaacccactgagcagtccgcatctttaccacaagcagcataatgggatgaaattgagtatgaagggcagccatgggcacacacaaggtgggggctattcctcagtgggtagcgggggagtccgaccgcccgtagggaaccggggtcaccaccagtataatcgcacaggctggcggcggaagaaacacacccacacacgagacagcttgccagtgagtctaagccgatag

SEQ ID NO: 189938 - DNA, 885 bp, Artificial Sequence
  Description of Artificial Sequence: Synthetic coding sequence
atggacctgtggcagctgctgctgaccctggccctggccggcagctctgatgctttttccggttcggaagccacagccgcaatcctttcaagagccccatggtctctccagtctgtgaatcctgggctgaagactaatagtagcaaggagccaaagttcaccaaatgtaggagcccagaaagggagaccttctcctgccattggacggacgaggtgcaccacggcactaagaatctgggtccaattcagcttttctatacacggaggaatacccaggaatggactcaagagtggaaggagtgcccagactacgtgagtgccggagaaaacagctgctatttcaattcatctttcacctctatatggattccttattgcatcaaactgacctctaacgggggaacggttgatgagaagtgcttctctgtggacgaaatcgtgcagccagaccccccaatagccctgaattggaccctcttaaacgtctcactgacgggcatccatgccgacattcaggtccgatgggaggctcctcggaacgccgacatccagaagggctggatggttctggaatatgagctccaatataaagaggttaacgagaccaaatggaaaatgatggacccgattcttaccaccagcgtcccagtatatagccttaaagtagacaaggagtatgaggtgcgcgtccgatctaaacaaagaaactctgggaattatggcgagtttagcgaggtgctgtatgtgacactcccacagatgtctcaattcacttgcgaggaagatttttacttcccatggcttctgataataattttcggtatcttcgggttgacagtgatgttatttgtatttctcttcagtaaacagcagagccaaaactag

SEQ ID NO: 189939 - DNA, 1851 bp, Artificial Sequence
  Description of Artificial Sequence: Synthetic coding sequence
atggacctgtggcagctgctgctgaccctggccctggccggcagcagtgatgctttcagtgggagtgaagattcctctaaagaaccaaagttcacgaagtgcagaagtcctgaaagagaaaccttcagctgccactggacagatgaggtacatcacggcactaaaaatttgggcccaatccaactgttctatacacgccgtaacactcaggagtggacgcaggagtggaaggagtgccccgattacgtgagcgccggcgagaattcatgctacttcaattcttcctttacttcgatttggatcccttactgcatcaaacttacatctaatgggggaactgtcgatgaaaagtgtttcagcgtcgacgagatcgtccagcccgacccccccatcgcgttaaactggactctgctgaatgtgtcattgacaggcatacatgcagatatccaggtccgatgggaggctccccggaacgctgatatccagaaggggtggatggtcctggagtacgagctgcagtataaagaggtgaatgaaacaaaatggaagatgatggacccgattctgacaacctctgttcccgtctattcattaaaggttgataaagaatacgaagtgagggttcgctccaagcagagaaactctggaaattacggagaattcagcgaagtgctgtacgttacactaccgcagatgtcccagttcacatgcgaggaggacttttattttccgtggcttctcatcatcatttttggaatcttcggcctgacagtcatgctgtttgtgtttctcttcagcaaacagcagagaatcaagatgctaattctccccccagtgccagtcccaaaaatcaagggcatcgaccctgacctgcttaaagagggaaaacttgaggaagtgaataccatactagccatacatgattcgtacaaacccgaatttcactctgacgatagctgggttgagttcatagaactggatatcgacgagcctgacgagaaaaccgaggagagtgacacagaccgccttttgtcatctgatcacgagaaaagtcattccaatctcggagttaaggacggcgactccggaagaacatcatgttgtgagccggatatactggagacagattttaacgctaatgacattcacgagggcacatcagaggtagcacagccccaacgccttaaaggtgaagcagatctgctctgcttagatcagaaaaatcagaacaattcgccataccacgacgcctgtccagccacccagcagccgagcgtcatccaagccgaaaaaaataaacctcagcccttgccgaccgaaggtgcggagtctactcaccaagccgcgcacatccagctgtctaacccgtccagcttatccaatatcgacttttacgcacaggtgtccgacatcacccctgccgggagcgtggtgctgagcccaggacagaagaataaggctggcatgtcacaatgtgacatgcacccagaaatggtctccctgtgccaggaaaacttcctgatggacaatgcttacttttgtgaggccgacgccaagaaatgcatccccgtagccccccacattaaggtggaatctcatattcagccctcattgaaccaagaggacatctatataaccacggaatctctcactacggccgctggtcggccaggcacaggtgaacatgtgcctggatccgaaatgccagtgccggactacacctccatccacatagttcagtcacctcaagggttaatcttgaacgcgaccgccctgcccctgcctgataaagagtttctgtcttcttgcggctacgtgagcacagatcaactcaataaaatcatgccttag

SEQ ID NO: 189940 - DNA, 1356 bp, Artificial Sequence
  Description of Artificial Sequence: Synthetic coding sequence
atggtgctggagtacgagctgcagtacaaggaggtgaacgagaccaagtggaagatgatggatcctatcctgaccaccagtgttccggtttacagtttaaaagtcgacaaggagtatgaagtgcgggtgaggtccaagcagcggaactccgggaattacggagaattcagcgaggtgctctatgtcacgctaccccagatgtcacaatttacctgtgaggaggacttttacttcccctggttactcatcattatttttgggatcttcgggctgactgtgatgctattcgtgttcttgttctcaaaacagcagcgcatcaagatgctgatcctgcctcccgttcccgtgccaaaaatcaaaggaatcgatccagacctgctgaaggagggaaagctcgaggaagttaataccatcctagccatccatgattcctataagccagaattccactccgatgactcctgggtagagtttattgaattggatattgatgagcccgatgagaagactgaagagtccgataccgatcgcctgttgtcgtcagatcacgagaagagccattctaacttgggagtgaaggatggggattcagggcggacttcttgctgcgagccagatattctggagaccgacttcaatgccaacgatatacatgaaggaaccagcgaagttgcccaaccacaacggcttaaaggggaggcagacctcctctgtttagaccagaaaaaccagaataacagcccgtaccacgatgcatgtcccgccacacagcagccttctgttatccaggctgagaagaataagccccagcccctgcccaccgagggggctgagagcactcaccaggcagcacacattcaactgagcaatccatctagtttgtccaacatcgacttctacgctcaagtgagtgacatcacacctgctgggtccgttgttctgtctcccggccagaagaataaggctgggatgagccaatgtgacatgcatccagagatggtctccctgtgtcaggaaaatttcctcatggacaacgcttatttctgcgaagccgatgccaagaaatgtattcccgtcgcgcctcatattaaggtggaatcccacatccagccttcattgaaccaggaagacatctacatcaccactgaatctctcaccacggctgccggcagacccggtacaggtgaacacgtgcccggctccgagatgcctgtgcccgattacacatcaatccatattgtgcaaagcccgcagggcctaatcttgaacgcaactgccttgcccttgccagacaaggagttcctgtctagttgcggctacgtttctaccgaccagctgaacaagattatgccatag

SEQ ID NO: 189941 - DNA, 327 bp, Artificial Sequence
  Description of Artificial Sequence: Synthetic coding sequence
atgcccctgtgggtgttcttcttcgtgatcctgaccctgagcaactcgtcgcactgctcacccccacctccactgacacttcgaatgcgtcgatatgccgatgccatcttcactaattcgtacagaaaggtcctcggacagttgtcagccagaaaactcctacaggacataatgtcccggcagcaaggtgaatcaaaccaagagcggggcgctagagccaggctggggcggcaggtggacagtatgtgggctgaacagaagcaaatggaactcgagtccatcctggttgcccttcttcaaaagcacagccggaactctcaaggatag

SEQ ID NO: 189942 - DNA, 324 bp, Artificial Sequence
  Description of Artificial Sequence: Synthetic coding sequence
atgcccctgtgggtgttcttcttcgtgatcctgaccctgagcaacagtagccactgttcaccgcccccacctctcaccctgagaatgagacgctatgccgatgcaatttttacaaactcctacagaaaagtactgggccagttatctgcccgcaaactgctgcaggacattatgtcacgccagcagggggagtctaatcaggaaagaggggctcgtgcacgcctggggagacaggtagatagtatgtgggccgagcaaaagcagatggagcttgaatctattctggtggcattgctgcagaaacaccgcaattctcagggatag

SEQ ID NO: 189943 - DNA, 327 bp, Artificial Sequence
  Description of Artificial Sequence: Synthetic coding sequence
atgcccctgtgggtgttcttcttcgtgatcctgaccctgagcaactctagccactgctcccctccgcctcccctgacgctgaggatgcgacggtacgccgatgctatttttactaacagctatcgtaaggtcctcgggcagctgagcgcgcggaaattgctacaggatatcatgagcaggcagcagggcgagtccaatcaggagcgaggtgcgagagcaagattaggaagacaggtcgactccatgtgggccgagcaaaaacagatggaattagagagtatcctcgtggcattgttgcagaagcatagcagaaattcgcagggttag

SEQ ID NO: 189944 - DNA, 1272 bp, Artificial Sequence
  Description of Artificial Sequence: Synthetic coding sequence
atggaccggcggatgtggggcgcccacgtgttctgcgtgctgagccccttacctactgtgctcggtcacatgcatcctgagtgtgacttcattacacagctgcgcgaagacgaaagcgcatgtttacaagccgctgaggagatgcccaacacaacactcgggtgtcccgcgacatgggatgggctgctgtgctggcctacggccgggagcggcgagtgggtgactttgccgtgtcccgatttcttcagccacttctcatcagaaagcggtgcagtaaaacgcgactgtaccatcacgggctggagcgaaccatttccaccatatccagtggcctgtcccgtacccctggagctcttagccgaagaggagtcatacttttctacagtcaaaattatctacactgtgggccacagcattagcatcgtcgctctatttgtcgccatcaccattctggtcgccttaaggaggctccattgtcctagaaactacgtgcacacacagctctttactacctttattctaaaagccggagcagtgttcctaaaagacgccgccttgttccatagcgatgacacagaccattgcagcttcagtacggtactctgcaaagttagcgtcgctgccagccactttgcaaccatgactaacttctcttggctcctggccgaggccgtgtacctaaattgcttgctggccagcacttccccctcaagccgacgcgctttttggtggctggtgttggctggttggggcctgccagtgctgtttacagggacctgggtgagctgtaagctggcatttgaggatattgcctgttgggacctggatgacacgtcaccttattggtggataataaaggggcccatcgtgctgtcagtaggagtgaattttggactgtttttaaacataatccggatcctggtgcggaaactggagccagctcaaggtagcctccacactcagtcccagtactggcgcctgagcaagtcaactttgttcctcatcccgctatttggcatccattatataatttttaactttctgcctgataatgcaggtctaggtatcaggctgcccttagagctggggcttggttcatttcaggggttcattgttgccatactctactgtttcctgaaccaggaggtgagaactgaaatttccaggaaatggcatggacacgatcccgagctcctgcctgcttggcgcaccagggcgaagtggactactccaagtagaagcgccgcaaaggtgctgacatccatgtgctag

SEQ ID NO: 189945 - DNA, 207 bp, Artificial Sequence
  Description of Artificial Sequence: Synthetic coding sequence
atggtgcccggcacccccagccccctgctgggccggggcaaggagctctggctggagtccctggcgtgtctacctggcgcagtgaaacgggattgtaccattaccgggtggtccgagcccttcccgccttatcccgtcgcttgccctgtgccgctggagctcctcgccgaggaggggtgtccgtgttcctctttggcaagaggatag

SEQ ID NO: 189946 - DNA, 438 bp, Artificial Sequence
  Description of Artificial Sequence: Synthetic coding sequence
atggtgcccggcacccccagccccctgctgggccggggcaaggagctgtggctggagtcccttgcctgtttgccaggtgcggttaaaagggactgcaccatcacaggctggtccgagccctttcccccctatcctgtagcctgcccagtccctttggaactgctggccgaggaggaatcatacttttccaccgtgaaaatcatttacacagttggccacagcatttccattgtcgcgctgtttgtagctatcaccattctagtcgccctgaggcgtctccactgcccaagaaattacgtgcacacacagctgtttacaactttcatcctgaaagcgggggcagttttcctaaaggatgcagccctttttcacagcgacgatacagaccactgttccttctcaacaggatgcccttgcagttccctggcaaggggctag

SEQ ID NO: 189947 - DNA, 456 bp, Artificial Sequence
  Description of Artificial Sequence: Synthetic coding sequence
atgctgcccttcagcaccgccaccaccctgaccaccgccgccagcccacttgcagcacgggctttgcactggcacgtgggcgaactccagaccgggttacggggacatagagtgttgggacccgggcgacatttgcctctgctagtagaccaccaacgagcccattgtcctttagggcgcggagaattatgggccttcagtcagtattacccccaccctggcgaggagacaggagcttcttccgggcagcctccgtaccctgtcagtgttctggccagtttgcaggtcgatacattccctgatccaacattgtggaattctcttcaccatctccagttgcccgcgagacaatgctggcctggccatcccccccctccgggcgccgggacaggatttcttcctggcctccattgttgccatcccttgttgctacctcagcctaggggcgaggattag

SEQ ID NO: 189948 - DNA, 1080 bp, Artificial Sequence
  Description of Artificial Sequence: Synthetic coding sequence
atggtgcccggcacccccagccccctgctgggccggggcaaggagctgtggctggaatcgctggcctgcttacccggtgcagtgaaaagagattgcactattactggttggtctgagcctttcccgccctaccctgtggcatgccccgtgcccctcgagctccttgctgaggaggaatcctacttctccacagtgaaaatcatttatactgtcggccactctatcagcatcgtcgctctgttcgtcgccattacaatcctcgttgccctaagacgcctgcactgtcccaggaattatgttcacacccagctatttactacgttcatcctcaaagctggcgccgtgtttctaaaggacgctgccctcttccatagcgacgacactgatcattgcagcttttcgacggtgctgtgcaaggtgtccgttgcagcttctcattttgctacgatgaccaacttctcctggttgctggcagaggcagtatatcttaactgtctgcttgcctcaacttctcccagctcccgaagggccttctggtggcttgtactcgctgggtgggggttaccagttctatttacaggtacttgggtgtcatgtaagctggccttcgaggatattgcttgctgggacctggatgacacttcaccatattggtggattatcaagggacctatcgtattgtctgtcggcgtgaactttggtttatttttgaatatcattcgaattctggttcgaaagcttgagcccgctcagggctctctgcacacccagtctcagtactggcgactgagcaaatccaccctgttcctgatcccccttttcggaattcattacataatctttaacttcctccctgacaatgctggcttgggtatcaggctgccgcttgaattgggacttgggtcctttcagggcttcatcgtggcaatcctttattgtttcctcaatcaggaggtgaggacagagatctctcgcaagtggcacggccacgatccagagctcctgcccgcctggaggacacgcgccaagtggaccactccaagccggtcagctgccaaggttctcacgagtatgtgttag

SEQ ID NO: 189949 - DNA, 1101 bp, Artificial Sequence
  Description of Artificial Sequence: Synthetic coding sequence
atgtggaacgccacccccagcgaggagcccggcttcaacctgaccctcgctgacctagactgggacgccagccccggtaacgacagcctgggcgatgagctcctgcagctgttcccagcccccctattagcaggggtgaccgctacatgcgttgcacttttcgtcgtcggcatagcaggtaatctcctgacgatgttggtggtatcgagattcagagagctccgtacgacgacaaatctctatctctcgtctatggcattttccgacctgctgatatttctatgtatgcctttggatctcgttaggctctggcagtaccggccatggaatttcggggatctactttgcaagttatttcagttcgtgtcagagtcttgtacttacgctaccgtgctgactattactgcgctgtctgtagagcggtactttgcgatctgctttcccctaagggcgaaggtggtggtcaccaaaggcagggtaaagctggtgatttttgttatctgggccgttgccttctgcagtgccggaccaatttttgttctcgtaggcgttgagcacgagaatggaaccgacccatgggataccaacgagtgtagacccaccgaatttgccgtgcgcagcggcctgttgactgtgatggtgtgggttagctctatcttttttttccttccagtattttgtctgacagttctgtattcccttatagggagaaagttgtggagacgtcgccgcggagatgccgtggtgggcgcctccttgagggatcagaatcacaagcagaccgtcaaaatgttagcagtggtggtattcgcattcatcctgtgttggctccctttccacgtgggtcggtacttattttctaagagcttcgagccaggttccctagagattgctcagattagccaatattgtaacctcgtgagctttgtgttgttctatctttccgccgctattaaccccattttgtacaacattatgtccaagaagtaccgggtcgccgtgttcaggttgctgggattcgaaccattcagccaacgcaagctatctaccctcaaggacgagtccagccgagcctggaccgaatcatcaatcaatacatag

SEQ ID NO: 189950 - DNA, 870 bp, Artificial Sequence
  Description of Artificial Sequence: Synthetic coding sequence
atgtggaacgccacccccagcgaggagcccggcttcaacctgaccctggcggacctggattgggacgcgtcaccggggaatgattcattgggagatgagctattacagcttttccccgcgcctctgttggcgggcgttacggctacctgtgtcgccttatttgtggtaggtatcgcagggaatttgctgactatgcttgtggtgagtcggttccgggagctccgaactaccactaacctgtacctgtctagcatggcattctccgacctgctgatcttcttgtgtatgccgctcgaccttgtgcggctctggcagtaccggccgtggaacttcggagacctgttatgtaagttgtttcagttcgtatcagagtcatgtacatatgccactgttttaaccattacagctctttctgtggagcgctattttgcgatttgcttccctctccgggccaaggtggtggttaccaaaggccgcgtcaagctcgtaatcttcgtgatttgggctgtcgccttctgtagtgcagggccgatattcgttctcgtgggtgtggagcacgagaacggaacagatccctgggatactaatgagtgccggcctacagagttcgccgtccggagtggtctcctaactgtgatggtttgggtctcttcaatcttcttctttcttcccgtcttctgccttaccgtgctatactcgttgataggacggaagctatggcgccggcgccgtggtgacgccgtggtcggtgccagcctgcgggatcagaatcataagcagaccgtgaaaatgttgggcggctctcagcgcgctcttaggctgagcctggctggtccaatcctgagcctgtgccttctaccgtcgttatag

SEQ ID NO: 189951 - DNA, 666 bp, Artificial Sequence
  Description of Artificial Sequence: Synthetic coding sequence
atggccttcgtgaagagcggctggctgctgcggcagagcaccatcctgaaaagatggaaaaagaattggttcgacctctggtccgacggccatttaatatattacgatgaccagactcgccagaacatcgaggacaaagtgcatatgcccatggactgcatcaatattagaactggccaagagtgcagagatactcagcctcctgatggaaaaagtaaagactgcatgctgcagatagtttgccgggacgggaagacgatatcactgtgtgctgagtcaacagacgactgcttggcgtggaaatttacactccaggactccaggactaatacggcctatgtcggctctgccgtgatgacagatgagacctcagtagtgtcaagtcccccaccctatacggcctatgccgcaccagcacccgaggcatatggatacggcccttacgggggcgcctaccctcccgggacacaggttgtgtatgctgccaatggtcaggcttatgcagtgccttaccagtacccctacgcggggctgtacggccagcaacctgcaaatcaggtcattatacgggaacgttacagagacaatgactcagatctcgccctgggaatgctggccggcgcggctacaggcatggctctgggatctttattctgggttttctag

SEQ ID NO: 189952 - DNA, 1230 bp, Artificial Sequence
  Description of Artificial Sequence: Synthetic coding sequence
atgggcaacagctacgccggccagctgaagaccacccggttcgaggaggtcctccacaattcaatagaggctagcctgaggagcaacaatctggtgcctcggccaattttttcgcagctatatctggaggctgagcaacaattagctgcgctggaaggaggatctagagtcgacaacgaagaggaagaggaggaaggagaagggggcttggagacgaacggcccgccaaacccattccagctccaccctctcccagaaggctgctgcacaactgatggattctgccaggcaggaaaagacctcagactggtatccatctcaaacgagccaatggatgttcccgccggctttctcctcgtgggcgtgaaaagcccctctctccctgaccaccttctggtgtgtgctgtagacaaacggttccttccagacgacaacggccacaacgccctgctgggcttcagtgggaactgtgtcggatgcggcaagaaggggttctgttactttacggagttcagcaatcacatcaacctgaagttaacaacccagcctaaaaagcaaaagcacctgaaatactatctggtgaggaatgctcagggtacactgaccaagggccccctcatctgttggaagggctccgaatttaggtccaggcagattccagcatcgacctgctccagtagtctgttcccagcactcgagagcacggctgcattcccatctgaacccgtgccgggtaccaatccctctattcttatgggcgcacagcaagcaggaccggctagcgaccatccatccctgaatgctgcgatgggtcccgccgtattcaacggcaaggattctcctaagtgccagcaactggccaagaataatctgttggccctgcctcggccttccgcactcggcatccttagcaacagtggtccccccaagaagcgccacaaaggctggtcaccggaaagcccttctgctcctgacggcgggtgcccccaaggagggggcaatagagcaaagtacgagtccgccggaatgagctgcgtgccccaagtagggctcgttgggcctgcttctgtcacgttcccagtggtggcttcaggcgagcccgtgtctgtacccgacaacctactgaaaatatgtaaggcaaagcccgttatcttcaaagtgttcgtcaacggtgccacgcaaatggtggccttgggccccgcggagccagcctctccccggtctctgtag

SEQ ID NO: 189953 - DNA, 1374 bp, Artificial Sequence
  Description of Artificial Sequence: Synthetic coding sequence
atgggcaacagctacgccggccagctgaagaccacccggttcgaggaggtgctccataactctatcgaagccagcctgcgttccaataatctcgtgccacgacctatatttagtcagctgtacttagaagcagaacaacagctggccgccctcgagggtggttccagggtcgacaacgaggaagaggaggaggaaggagaagggggcctagaaacaaacgggcccccaaatccattccagttacatcctctccccgagggctgctgtaccacagacggattctgccaggccgggaaagacctcaggttggtgtccatctctaacgaaccaatggatgttccggccggcttcttattggtgggtgtcaaatcaccatctctgcctgaccatctgctggtgtgtgcagtggataagcgtttcctgccagacgacaatggacataatgccctgttggggttcagcgggaattgtgtgggctgcgggaagaaggggttctgttacttcacagaatttagcaatcacatcaacctgaaactgaccacacagcccaaaaagcagaagcatttgaagtattatctagtcagaaacgcacagggcactctgacaaaaggccctcttatttgctggaaaggttccgagtttcgctctaggcaaattcccgcctccacatgcagctcctctcttttccctgccctggagtccacagctgccttccccagcgaacctgtgcctgggaccaacccctctattttgatgggagcacagcaggctggacctgcctcagaccatccttccctgaatgcggcgatgggtcctgcagtcttcaacgggaaagacagccctaagtgccagcagcttgccaagaacaatttgcttgccctgccccgtccaagtgccctcggtattctaagcaacagcggtcctcccaagaagcgccataagggatggagtcccgaatctccaagtgcccccgacggcgggtgtccccaggggggaggaaaccgtgccaagtatgaatcagccgggatgtcatgtgtgccacaggtgggccttgtcgggccagcctctgtgactttcccagtggtggccagcggcgagccagtctctgtcccggacaatttgctgaagatctgcaaggctaagccagtgatttttaagggacacggaaactttccctatctttgcgggaatctcaatgacgtcgtggtatcacccctcctgtatacttgctaccaaaacagccagagtgtgtctcgtgcctacgaacagtatggcgcttccgctatccagcctatatctgaggaaatgcagttgctgttaaccgtgtactacctggttcagctagcacatcagattagaaatcctgacgtatag

SEQ ID NO: 189954 - DNA, 5850 bp, Artificial Sequence
  Description of Artificial Sequence: Synthetic coding sequence
atgggcaacagctacgccggccagctgaagaccacccggttcgaggaggtgctgcacaactcaattgaagccagcctacggagcaacaatctcgtaccccgacccattttctcccaactttaccttgaagcagagcagcagctcgccgccctagagggcggcagtcgagttgataacgaagaagaggaggaggagggcgagggcgggctggagacgaacggacctccaaatccttttcaactccaccctctgccagaagggtgttgtacgaccgatggcttctgtcaggccggaaaagacctcagactggtcagtattagcaacgagccaatggatgtgccagccggtttcctgcttgtgggtgtgaaatcccctagtctgcccgatcatctcctcgtgtgcgccgtggacaaaagatttctccctgacgacaatggtcacaacgccttgcttggtttctctgggaactgtgtcggctgtggaaaaaaagggttctgttacttcacagagttttcaaatcatatcaacttaaaactaacgacacagcctaagaagcaaaagcacctcaagtactatttggtgagaaacgctcagggcaccttgacaaaaggacctctgatctgttggaagggtagtgagtttcgttccaggcagatccctgcatcaacttgctcttcttccctgttccctgcgctcgaatcaaccgccgcatttccatccgagccggtccccggaacaaaccccagcattctgatgggcgcacagcaggccggccctgccagtgaccatccaagtctgaacgccgcaatggggcctgcagtgttcaacggtaaggattcaccaaaatgccagcaactggctaaaaacaatctgctggccctgccaagaccctctgccctgggcattctatccaacagtggaccccctaagaagagacacaagggttggtcgccggagagccccagcgcccccgatggtgggtgtccgcaaggcggcggcaatcgggcaaagtacgagtctgcaggaatgagttgtgtcccacaggtggggctcgtcggccctgcaagcgtaacctttcccgtggtggcttcaggtgagccagttagcgtcccggacaacctgctgaagatttgcaaagccaagcctgtaatttttaagggacacgggaactttccctatttgtgtgggaatcttaatgacgtcgttgtgtctcctttactgtacacttgctatcaaaatagccagagtgtctccagggcttatgagcaatacggggcaagcgcgatccagcccatttctgaggaaatgcagctcttgctcaccgtttactacctggtccagctggctgcagatcaggttcctctcatggaggacctggaacagatcttcctcagatcctggagagaaagccatctgactgaaataaggcagtaccagcaggcaccacctcaaccatttccacctgccccttccgccgcagctcccgtcacatcggctcagctcccctggctggccagcctcgccgcttcttcatgcaacgactctgttcacgtaatcgaatgcgcttattctctcgccgagggcctatctgagatgtttcgcctgctggttgagggaaagctggcaaagacgaattacgtagtcatcatttgtgcctgccggtccgctgcaattgatagttgcattgccgtgaccggaaaataccaggccaggatcctcagcgagagccttttaacacctgcagagtatcaaaaagaggtgaactatgagctcgtcaccggtaaggtggattctctcggcgctttcttcagcaccctgtgcccagaaggcgatattgacatcctgctcgataaatttcaccaggagaaccaggggcacatcagtagcagcctagccgcaagcagtgtgacgaaagccgcctctctggatgtgtccggtacccctgtgtgcacttcttacaacctggagccacatagtatccgccctttccaactggctgtggcgcagaagctgctctcccatgtctgttcgatagctgactcaagcacccaaaacctagaccttggttccttcgagaaagttgattttctcatatgcatccctccgagtgaggtgacataccagcagactctcctgcacgtgtggcatagcggcgtgctgctggagctcgggctgaagaaggaacacatgactaagcagcgcgttgagcagtatgtcttgaagctcgataccgaggcacagaccaagttcaaggcatttttgcagaatagctttcagaaccctcacaccttattcgtcttgattcacgatcatgctcattgggatctcgtctctagcactgtgcacaacctgtactcacagagcgatccctcagtcgggctggtagaccggctcctgaactgtcgcgaagttaaagaggcccctaatattgtgaccttgcacgttacgagttttccgtacgccttgcaaacacagcacacactgatttccccttataatgaaattcactggcctgcctcctgtagtaatggtgtggatttgtatcacgagaataaaaagtatttcggcttaagcgagttcattgaatccactctctccggacattcactgcccctgctcaggtacgactcatccttcgaagcaatggtcaccgccttggggaagcgcttcccgcgtctgcactctgccgtgattcgtacctttgtgttggtgcaacattatgccgctgccctcatggcagtctcaggcctcccccagatgaagaattacacgtcagttgagaccctggagatcacccagaatctgctcaactcccctaagcagtgcccctgtggccacggacttatggtattgcttagagtcccctgctcccctttggcagttgtggcatacgagcggctggcccacgttcgcgcgaggttggccctggaggagcatttcgagatcatattgggaagtccctcatctggcgtcaccgtgggtaaacacttcgtgaaacaactcaggatgtggcagaagatagaggatgtggagtggagaccccagacttatcttgaactcgaaggactgccttgcatcctgattttctccggaatggatccacacggcgagtccctgcctcgttcactcaggtattgtgatcttcggctgatcaattcatcttgtttagtgaggaccgctctggagcaagagctcggcctcgcggcgtactttgtgtccaatgaagtgccgctagagaagggggcccgaaatgaagcgctggaaagcgacgccgagaagctgagcagcacggataatgaagatgaagagctgggcaccgaaggcagcactagcgagaaacgttctcccatgaaacgggaacgaagccgcagccatgactctgccagttccagcttgtcatcaaaagcttccggaagtgccttgggcggagagtcctccgcacagcccactgccctgccacagggcgaacacgcccggtctcctcagccacgcgggcctgccgaggaaggcagggccccgggcgagaagcaaagaccacgagcctcccagggccccccttcagcaatcagcagacacagtcctgggcccacgccccaacccgattgctcactgagaaccggccaaagatctgtgcaagtctcagtcaccagctcctgttcacagctcagcagcagctcaggctcttcatctagttctgttgcacccgctgcgggaacctgggtcctgcaggccagtcaatgttcccttacgaaggcctgtcggcaaccaccaattgtgttcctcccaaaattggtgtacgatatggtagtctcaactgacagtagcggcctccccaaggctgcatcactgctccctagtccctccgttatgtgggcctcctccttcaggcccctcctatccaaaaccatgacgtccactgaacagagcctgtattatcggcagtggactgtgccccgccccagccacatggattatggtaaccgtgccgagggccgcgtcgatgggttccacccacggcggctgctactcagtggtcctccacagatcggaaaaacaggggcctacctgcagttcctgagcgtactcagtcggatgctggtgagactaacagaagtcgatgtgtacgatgaagaagagattaacatcaatcttagggaggaatcagattggcactacctccaactctctgacccgtggccagacttggaactttttaaaaaattaccttttgactatatcatccatgaccctaaatatgaggacgcctcgctcatctgttcccattatcagggcattaagtcagaggaccgcggaatgtcgaggaagcctgaagacttgtatgtgcggcgccagaccgctcgaatgagattatccaagtacgctgcgtataacacctaccaccactgtgaacaatgtcaccagtacatgggctttcatccgaggtaccagctgtatgagtccacactgcacgctttcgccttctcttatagcatgctcggggaggagattcagctccatttcattattcccaaatccaaggagcaccatttcgtgttctcacagcctggaggtcagctggagagcatgcggctgccactggtaaccgacaaaagccatgaatatattaaaagccccacattcacgccaaccacaggacgccacgaacatggcttgtttaacttgtatcacgcaatggacggggcctctcacttgcatgtgctagtcgttaaagaatacgaaatggccatctataagaagtactggccaaatcacattatgcttgtcctgccttccatcttcaattcagccggagtgggggctgctcactttctcatcaaagaactatcataccacaacctggagctggagagaaacagacaggaggagctcggaattaaaccacaagatatctggcctttcatcgtaatctctgacgattcctgtgtgatgtggaatgtggtcgatgttaacagtgccggtgagcgctcccgtgagttttcttggagcgaacggaatgtttccctcaaacacattatgcagcacattgaggcagcccccgatattatgcactacgccctcctgggtttacgcaagtggagcagcaagactagggctagtgaagtgcaggagccattcagtaggtgccacgtgcataacttcattattctgaacgtcgaccttacccagaacgtccagtacaaccagaatagattcttgtgtgacgacgtggattttaatctcagagttcactctgccggacttttgctgtgtcggttcaatagattctccgttatgaagaagcagattgtggtgggcggacaccgctcattccacatcaccagtaaggtctctgacaatagcgctgccgtggttcccgcccagtacatctgtgctcctgatagcaaacatacattcctggccgctcctgcccagctgctgctcgaaaaattcttacaacatcattctcacctgtttttccccctgtctttgaaaaaccatgatcaccccgtgctcagcgtggactgctacctgaatctcgggtcacagatctcagtttgctatgtgtcgtctcggccacacagtctgaatatctcttgttccgatttgttgttttcaggtctgctcctgtacttatgcgactcattcgttggcgctagctttctgaagaagttccatttcttaaaaggggccacactgtgtgtaatctgtcaggaccgctccagcctgagacagaccgtggtgaggctggagctcgaggatgaatggcagttccgcttgcgggacgaatttcagaccgcaaacgccagggaggatcggcctctattcttcctgaccggccgccatatctag

SEQ ID NO: 189955 - DNA, 1188 bp, Artificial Sequence
  Description of Artificial Sequence: Synthetic coding sequence
atgaccctgcggcggctgcggaagctgcagcagaaggaggaggccgcggcaactcccgaccctgcagcccggactcctgattccgaagttgctcctgccgcacctgtgccaacacccggcccccccgcggcagctgcaacccccggtcccccagccgatgaactgtatgccgctctagaagattatcatcccgcggagctgtaccgagctctggccgtgtccggtggaaccctccctaggagaaaagggagcggatttcgatggaaaaacctctctcagtccccagaacagcagcggaaggtgcttacattagaaaaagaagacaaccagacatttgggttcgaaattcagacttacgggcttcatcacagagaagaacagagggtagagatggtgaccttcgtatgccgcgtgcacgaatccagccctgctcagttggccggcctcacccctggtgacacgatcgccagcgttaatgggctcaatgtggagggtattcggcatagggagattgtcgacatcataaaggctagcggcaatgtcctgcgcctagagacattatacggaacaagcattcgtaaagccgaactggaagcaagattgcagtatctgaaacagactttgtatgaaaaatggggcgagtataggtcgttaatggtgcaggagcagcggttggtacacggtctggtagtcaaggaccctagcatctacgacactttggaaagcgtgcggagttgcctttacggtgcaggcctgctgccaggatcccttccattcggccctctgctagccgtgcccggccggcccagagggggcgcacgccgcgccaggggggacgcagatgacgccgtgtatcatacatgcttcttcggcgacagcgaaccacctgcccttcccccccctccgccgcctgctcgcgcattcggtcccggtccagccgagacaccagccgtgggccctggacctggaccgagggccgccctgtccagaagcgcaagcgtgagatgcgccgggccaggcgggggtgggggtggtggtgccccaggggccttatggaccgaagcgcgtgaacaggctttgtgtggccccggcttgcggaagacaaagtatcgttcttttagaagaagattactcaagtttattcctggtctgaataggtctttggaagaggaagagagtcagctctag

SEQ ID NO: 189956 - DNA, 759 bp, Artificial Sequence
  Description of Artificial Sequence: Synthetic coding sequence
atgaccctgctgcccagcaagggcggcgacaccatcgccagcgtgaacggcctgaacgtggagggcataagacacagggagatagtagatatcattaaagctagcggaaatgttctgaggcttgaaaccctgtatgggacatccatccggaaggccgagctggaggccaggctacagtatcttaaacagaccctgtacgagaaatggggggaatacagatctctgatggtacaggagcagcgcctggtccacggcctcgtcgttaaagatccgtccatttatgatactcttgaatctgtccgctcctgcctgtacggagcagggcttctacccggttcactaccttttggtcctctgttagcagtgcccggccgcccccggggcggggctcgccgcgcccgaggtgatgcggatgacgctgtctatcatacttgcttctttggcgattcagaacctcccgctctcccaccccccccacctccagctagggcttttggaccaggtcctgccgaaacccctgccgtgggtccaggccctggcccacgcgcagccctatctcggtcggccagtgtaagatgcgctggccccggtgggggtgggggagggggcgctccaggagcactttggactgaagctcgcgaacaagctctgtgcggccctggtctacgcaagacgaagtatcggagttttcgccgcaggctgctgaaatttattcccggcctgaacagatcactagaagaagaggagtctcaactctag

SEQ ID NO: 189957 - DNA, 759 bp, Artificial Sequence
  Description of Artificial Sequence: Synthetic coding sequence
atgaccctgctgcccagcaagggcggcgacaccatcgccagcgtgaatggtctgaatgtggaagggattcgtcaccgcgaaatcgttgacatcatcaaggccagcggcaacgtgttgaggttggaaactctgtacggaacttccattaggaaggctgagttggaggctagactgcaatatttgaaacaaactttgtatgagaaatggggagaatatcgctctctcatggtacaggagcagaggctcgtccacgggctggtcgttaaggacccaagtatctatgataccctcgagtcagtccgcagctgcttatatggagccgggcttctccctgggtcactccccttcggccccctgctggctgtgcccggtcgacctagaggcggcgccagacgagccagaggcgacgccgacgatgcggtttatcacacatgcttttttggagattctgaaccccccgcactgcctccacctcctccaccggcgagagcatttggtcctggtcctgccgaaacccccgccgtcggcccggggcccgggcccagggctgccctatctcgctccgccagcgtgaggtgcgccggccccggtgggggtggagggggaggggcaccgggggccctgtggacagaggcccgcgaacaggctctgtgtggacctggtttacgcaagacaaagtatcgttccttccgacggcgcctgctgaagttcataccaggtctcaatcgtagtctggaagaggaggaatcacagctctag

SEQ ID NO: 189958 - DNA, 654 bp, Artificial Sequence
  Description of Artificial Sequence: Synthetic coding sequence
atggccgcccagtgcgtgcggctggcccggcggagcctgcccgccctggctctgtccctccgcccaagcccaagattgctgtgtacggccaccaagcaaaaaaactccggccagaacctggaggaagacatgggccagagcgagcagaaagcggatccccccgccactgaaaagacattactggaggagaaggtgaaactggaggaacaattgaaggagaccgttgagaaatataagcgcgccctggcagatacagagaacctgagacagagaagccagaagctggtagaagaggccaagctatacggtattcaggccttctgtaaggacctgctagaggtcgcggacgttctggaaaaagccacccagtgcgtcccaaaggaagagatcaaagacgacaatccgcacttgaagaacctctatgagggacttgtgatgacggaggttcaaatccagaaagtgtttaccaaacatggactattaaagttgaaccccgtcggggccaagtttgacccttacgagcatgaggccctttttcacacccctgtggaaggcaaagagcccgggaccgttgcacttgtgagcaaagtggggtacaagttgcacggccggactctgcggcccgccttggtgggagtggttaaagaagcttag

SEQ ID NO: 189959 - DNA, 591 bp, Artificial Sequence
  Description of Artificial Sequence: Synthetic coding sequence
atggccgcccagtgcgtgcggctggcccggcggagcctgcccgccctggctctgagtcttcgaccctcgcctcgcctcttatgcaccgccactaaacagaaaaactccgggcagaatctggaagaagatatggggcaaagcgagcagttgaaagagaccgttgagaaatacaaacgggcccttgccgataccgaaaatctcaggcagcgatcacaaaagctggttgaggaagctaaactctacggaattcaggcattctgtaaggacttgctcgaggttgccgatgtactcgaaaaagccacacagtgcgtgcccaaggaagaaattaaagatgacaatccccacctgaaaaacctctatgaggggctggtgatgactgaggtccagattcagaaagtgttcactaagcacggtctactcaagctgaaccctgttggagccaagtttgacccgtacgaacacgaggctctgtttcacacccccgtagaaggcaaggagccaggaacagtcgccctggttagtaaggtgggctataagcttcatgggcgcactctacgcccagccttggtaggggttgtcaaggaggcgtag

SEQ ID NO: 189960 - DNA, 2880 bp, Artificial Sequence
  Description of Artificial Sequence: Synthetic coding sequence
atggccctgctgggcaagcggtgcgacgtgcccaccaacggctgcggacctgacaggtggaactccgcattcactcgcaaagacgagataatcacatctctggtgtccgctctggactctatgtgctctgctctgtccaaacttaatgctgaggtggcctgcgttgccgtgcatgacgaatctgcttttgttgtagggaccgagaaaggacggatgtttctaaacgctaggaaggagctccagtcagattttctgcggttctgtcgcggcccaccctggaaagaccccgaagccgagcacccaaagaaggtgcagaggggtgagggaggcgggcgctcactgccaaggtcctcgctggagcatgggtctgatgtttacctgttaagaaagatggttgaggaagtattcgacgtactgtattcggaggccctggggcgggcatccgtggtgcctctcccatatgaaagattgttaagagagcccgggttgttggctgtgcagggcctccccgaagggttagcattcagaaggccagccgagtatgatcccaaagcgctcatggcaatcctggaacactcccacagaatccggttcaaactgaaacgaccacttgaggacggaggcagagactcaaaggcactggtcgagctgaatggcgtgagcctgattccaaagggatcacgtgactgtggactccacggccaggcacctaaggtgcccccccaggatctgcctccaacagcaacaagttctagtatggcaagtttcctctactctactgcgttgccaaatcacgctattcgggagctaaaacaggaagccccatcttgcccacttgcgccgtccgaccttggcctgagcagaccaatgcccgaaccaaaggcgacaggagctcaggattttagcgactgctgcggacaaaaacccacagggcctgggggccccctaatccaaaatgttcatgcctccaagcggattctgttctcaatcgtgcacgacaagagcgagaagtgggatgcctttatcaaggagactgaagatatcaacactctgcgcgaatgcgttcagatactcttcaacagcaggtacgctgaggcactgggcctcgatcacatggtgcctgttccctacagaaaaatcgcttgcgaccctgaagctgtcgagatagtaggaattccggacaaaatcccctttaaacggccctgtacctatggtgtccccaaactgaagaggatactggaagagcgacactccattcatttcattattaaacgaatgtttgatgagagaattttcacaggtaacaagttcacgaaggatacaaccaaactggagcctgcctcgcctcctgaggacaccagcgcagaggtaagtcgcgcaacagttctggacctggccgggaatgcaagatccgataagggttccatgtccgaagactgcggtcccgggactagcggagaactcggcggtctgcggccgatcaagatagaaccggaggatttagatattatccaagtgactgtgcctgatccttctcctacttccgaagagatgaccgactccatgccaggccaccttccgtcagaagactcaggttacggtatggagatgctgactgacaagggactctcggaagatgcaaggcctgaggaacgacctgtcgaagattcacatggggacgtaatacgacccttgcgaaaacaagtagagctcctgttcaataccagatatgctaaggccattgggatctctgaaccagtgaaagtgccttactccaagttcttgatgcatcccgaggaactattcgtggtcgggcttcctgaaggaatttcgctgcggcgaccaaactgttttggtatcgcgaagttgaggaagatccttgaggctagtaattcaatccagttcgtcattaagcggccggagttgcttaccgagggggtgaaagagcccattatggattcccagggcaccgcgtctagcctcggttttagccccccagctctgccgcctgagagggactctggggaccctctggtcgacgaatccttaaaacgccaaggttttcaggagaattacgatgcccggctgtctcggattgacatcgccaacaccctgagagaacaggtacaagatttgttcaacaagaagtacggagaggcgttaggcatcaaataccccgtgcaggtgccctacaagagaataaaatcaaatccaggaagcgtgataattgagggtctccctccaggaatcccattccggaaaccgtgtacatttggctcacaaaatttggagcgcatccttgcagtcgcggacaaaattaagtttactgtcacccggccatttcagggtctgattccgaaacctgatgaagatgacgcaaacagacttggggagaaagtcattctgagggagcaggtcaaagagttattcaatgagaaatacggggaagcgttgggactgaacaggccagtgttggtgccatacaagctgatcagggatagccccgacgcagtcgaggtgacaggacttccagatgacatcccattcagaaacccaaatacatatgatatccaccgccttgaaaaaatcttgaaagcgagggagcacgtccgaatggttatcataaaccaactgcaaccctttgctgaaatctgcaacgacgccaaagttcccgccaaggattcatctataccgaagagaaaaagaaaacgcgtgagtgaagggaactccgtgtcttcgtcctcaagtagctcctccagttcttctagcaaccctgattccgtcgccagcgctaatcagatttctcttgtccagtggccgatgtatatggtagactacgcaggcctgaatgtgcagttgcccggcccactaaactactag

SEQ ID NO: 189961 - DNA, 2835 bp, Artificial Sequence
  Description of Artificial Sequence: Synthetic coding sequence
atggccctgctgggcaagcggtgcgacgtgcccaccaacggctgcggaccagacagatggaattccgcctttactcgtaaggacgaaatcatcacctctctagtcagcgctctggattctatgtgctccgccctgtcaaagctgaatgctgaggtcgcctgcgtggccgtgcatgatgaatctgctttcgtggtcggcacagagaaaggtcgaatgttcctgaacgccaggaaggaattgcagtccgattttctaaggttttgtcgtggcccgccctggaaggaccccgaggccgaacaccccaagaaggttcagcgcggagaaggagggggcaggagcctgcctcggagcagcctggaacatggaagtgatgtctaccttttacggaagatggtggaggaggtatttgatgtgctgtacagtgaggccctaggaagggcttctgtggtaccactcccctacgaaaggctgctccgcgaacccggcttgctcgccgtgcagggcctccccgaagggctcgcattccggagaccggctgagtacgatcccaaagccctgatggccatccttgaacattcgcaccgcatccgctttaagctgaagaggcctctggaggatggcggaagggactcaaaagctctggtcgagctgaacggtgtcagcctcatccctaaagggagcagggattgcggactgcacggccaagctcctaaagttccgccgcaggatttgccaccaactgcaactagtagttctatggccagcttcctctattctacagccctacctaatcacgccatccgagagcttaagcaggaagccccctcatgcccactggccccatctgatcttggtctttctcgaccgatgcctgaaccaaaagccactggtgctcaggatttctcagattgctgtggccagaagcctaccggccctgggggaccgctgatacaaaacgtacatgccagcaagaggatcctttttagcatcgtgcacgataagtccgaaaaatgggacgcatttattaaggagacggaggatattaacacgttacgcgaatgtgtgcagatcctgttcaattcgcgatatgccgaagctctggggctcgatcacatggtgccagtcccttaccgaaaaatcgcatgtgaccctgaagcagtggagatcgtcgggatccccgataaaattcccttcaagagaccctgcacctatggtgtgcccaaactgaaacggatattagaggagaggcattccatacatttcatcattaagcgtatgttcgacgagcggattttcactggaaacaaattcaccaaagataccaccaagctggagccagctagcccgcccgaggacacaagtgctgaggtatcaagggcgacagtgctcgacttagccggaaacgcgcggtcggataagggctctatgtctgaagattgcggacccggtactagcggggagctcgggggtctacggccgatcaagatagaacccgaagacctggatatcattcaggtcaccgtgccagatccatcccccacctctgaggagatgacagattcaatgcccgggcatctgccgtcagaggattccggatacgggatggagatgctgacagataaaggcctcagcgaggacgctcggcccgaggagaggcccgtggaagattcccacggcgacgtcattcgtcctctccggaaacaggtcgagctgttatttaatacccggtacgccaaagcaatcgggatctcagagccagtaaaagtgccatatagcaaattcttgatgcaccccgaagagctctttgtcgtaggtctgccagagggaatcagtctgagaaggcctaactgcttcgggatcgcaaaactgcgcaaaattctggaggccagcaacagcatccagtttgtaattaagagacctgagcttctaacagagggtgtcaaggaacccattatggattctcaggagcgagacagtggcgaccccctggtggatgaatcactgaaacgccagggatttcaagagaactatgacgcccgccttagccggatagacatcgccaataccctgagggagcaggtccaggacctctttaataaaaagtatggagaagcattgggcataaagtacccagtgcaggttccctataaaaggatcaagagcaatccggggtccgtcatcattgagggcctgcctccaggcatccccttccggaagccgtgcacctttggatcccagaacctagagcggatcttagcagtagccgacaagatcaaatttacagtgaccaggccgtttcaggggttgatcccaaaacccgacgaagacgatgcaaaccggttaggtgaaaaggtgatccttcgcgagcaggtcaaagagttgtttaacgagaagtacggtgaggcactggggcttaatcgcccagtcctcgtgccttacaagctgatccgcgattctcccgacgccgttgaggtaaccggtctccctgatgacatcccattcagaaacccaaatacatacgatattcatcggctggagaagattctgaaggcccgggagcacgtgaggatggttattatcaaccaactgcagccattcgcagaaatctgtaacgacgccaaagtccctgccaaggattcctccataccaaagcggaaaaggaagcgcgtttcagaaggcaattccgtgagtagttcctcttccagctctagtagcagctcgagcaaccctgattccgttgcgtcagctaatcagatcagtctagtccagtggcccatgtatatggtagattacgcaggactgaacgttcaactccccggaccacttaattactag

SEQ ID NO: 189962 - DNA, 2931 bp, Artificial Sequence
  Description of Artificial Sequence: Synthetic coding sequence
atggccctgctgggcaagcggtgcgacgtgcccaccaacggctgcggacctgatagatggaactcagcttttactaggaaggacgaaatcatcacaagcctggtctcggccttggactcgatgtgctcagcactcagtaagctgaacgcagaggtggcctgcgtggccgtccatgacgagtcagccttcgtggtgggcacagaaaaggggcgcatgtttcttaacgcccggaaagagttgcaatctgacttcctgaggttttgcctttcggcggcccagcacagggccgccacctctcagctggaaggaagagtcgtccggagagttctgacagtggcatccagagccctctgccctaccggcgggcccccttggaaggacccggaggctgaacaccccaaaaaggtgcagagaggcgaagggggtggcaggtcgcttccacgctctagcttggaacatggaagcgatgtgtaccttctgagaaaaatggtagaggaagttttcgacgtactgtatagcgaggccctcggaagggcgagtgttgtgcctttgccctatgaacggcttctccgcgaacccgggttactggcggtccagggcctgccggagggtttagccttccgccgccccgctgaatacgatccaaaggcactcatggccatcctggagcatagtcaccgtattcggttcaagcttaagaggcccctcgaagatggcggccgcgatagcaaagccctcgtggaattgaacggcgtttctctgattcctaaaggcagcagggactgtggacttcatggtcaggcgccaaaagtgccaccgcaggacctccctccaactgccactagtagctcaatggcgtcatttctatattccaccgcattgcctaaccacgctattcgcgagctgaagcaggaagctccatcatgcccactggccccttccgatctgggtctgtcccggccaatgccagagcctaaagccacaggcgcacaagatttttctgattgctgcggtcagaagccaacgggtcctggcggccccctcattcagaacgtgcatgcatccaagagaatcttgttctctatagtccatgacaaatccgagaagtgggatgcctttatcaaggagactgaagatatcaacacactccgggagtgtgttcagattctgttcaacagtaggtatgccgaagccctgggcttggatcatatggtgcctgtcccctatcggaaaattgcttgtgacccggaagccgtggaaatcgtagggattccagacaaaattccatttaaacgtccctgtacatacggtgtgccaaaactaaaaagaatcctggaggagcgccattctattcattttattatcaagcgcatgttcgatgaaaggatatttactggcaataagttcacaaaagatacaaccaaactggagcctgcatcaccccctgaggatacctctgccgaagtctctcgggctacagtcttggacctcgccggcaatgctaggtcagataaggggtctatgtccgaagattgtgggccgggaacaagcggagaactcggcggcctgaggccaataaagatcgaacctgaggacttagacattatccaggttaccgttcccgaccccagcccgacttccgaggaaatgacagactccatgcctgggcacctgcctagtgaggatagtggctacggaatggagatgctgacagataaaggactttctgaggacgcaagacctgaggagcgccccgtcgaagactcccatggcgacgtcataaggcctctcagaaagcaggttgaactcctgttcaacactcggtacgctaaagcgatcggaataagcgaacctgtcaaagtgccctatagcaaatttttgatgcatcccgaagaattgttcgttgtgggtctgcctgaaggcattagtctcaggcgtccaaattgttttggcatagctaagttgagaaagatactggaagcgagtaatagtatccagtttgtcatcaagaggcccgagctcctgactgagggtgttaaggagccgattatggattcccaagaaagggactccggagatcccctagtggacgagtcactgaaacgtcagggcttccaggagaactatgacgcacggttgagcaggatagatattgccaacactctccgagaacaggttcaggacctattcaacaaaaaatatggggaggccttggggatcaagtatccagtgcaggtcccttacaagcggatcaaatctaaccccggatcagtgattatagaaggattgcccccaggcatcccgtttcggaagccttgcacattcggttctcaaaacttagaacgcattctcgctgtcgcagacaaaatcaaatttaccgttacgcgtccattccagggtcttattccaaaacccgatgaagacgatgccaaccgtttgggagagaaagtcattttgagggagcaggtgaaggaactgtttaatgaaaagtacggtgaggccctgggcctgaataggcctgtcctagtcccatacaaacttatcagggacagccccgacgccgtggaggttacagggctgccagatgatatccctttccggaatcctaatacctacgatatacacaggcttgagaagatactgaaggcccgcgaacacgtgagaatggtgatcattaaccagcttcaaccattcgcagagatctgcaatgatgccaaagtaccagcgaaagattcctccatccccaaacgtaagcggaaaagggttagcgaaggcaattcagtgtcttcctcttctagttccagcagctcatcaagctcaaacccggattcagttgccagcgccaatcagatttcgctggtgcaatggcctatgtacatggtcgactacgctggcttgaatgtgcagctacctggacctctcaactactag

SEQ ID NO: 189963 - DNA, 609 bp, Artificial Sequence
  Description of Artificial Sequence: Synthetic coding sequence
atgagctgcgtgccctggaagggcgacaaggccaagagcgagagcctggagctcccacaggccgcccctcctcagatctaccacgaaaaacagagacgcgagctgtgtgcactccacgccttgaataacgtgttccaggactccaatgccttcacccgcgataccctgcaggaaatctttcagagattgtcgcctaacaccatggttactccacacaaaaagagcatgttgggaaatggtaattatgacgtgaatgtgatcatggccgctctgcaaaccaaaggatacgaagccgtctggtgggataagaggagggacgtaggcgtgattgctttaacgaatgttatgggcttcatcatgaacctgcctagctcattgtgctggggtccacttaagctaccactgaagagacaacattggatatgcgtgcgggaggtggggggtgcatattacaatttggactcaaaactaaaaatgcccgagtggatcggaggcgagagtgagcttcggaagttccttaagcatcatcttcggggtaaaaactgcgaattgctgttggtcgtgcccgaagaggtggaggcccatcagagctggcgaactgacgtttag

SEQ ID NO: 189964 - DNA, 1545 bp, Artificial Sequence
  Description of Artificial Sequence: Synthetic coding sequence
atgaagtggcggctgcaggagggccggggcgaggccgtgtaccagatcggagtcgaggacaacggacttttggtgggtctggccgaggaggagatgcgcgctagtctgaagaccctgcaccggatggccgagaaagttggcgccgacatcaccgtcctgcgcgaacgtgaggtagactacgacagcgacatgccccggaaaatcacagaggtccttgtgaggaaagttccagacaaccagcagtttctggatctccgcgtcgccgtcttaggtaacgtagactctgggaaatcaacattgctgggcgtactaacacaaggggagctggacaatgggcgcggacgggccagactcaacctattcaggcacctgcatgagattcagtccggccggacatcatccatctctttcgaaatcctcggctttaattccaaaggagaggtggtcaattactctgattcacggacagctgaggaaatttgcgaatcttccagcaagatgatcacctttatcgacctcgccggccaccacaaatacctgcacaccactatttttggtctgactagttattgccccgactgtgctttgctactagtgtcggctaatacaggcatcgccggaaccactagggagcacctgggcttggccctcgctttaaaagtgcccttctttattgtggtttcaaaaattgacctctgcgcaaaaaccacggtcgagaggacggtgaggcagcttgaaagagttctgaaacagcccgggtgtcacaaggttccaatgttggtcacttcggaagatgacgctgtaactgctgcacagcagtttgcccagtcaccgaacgtgactcccattttcacactctcctcagttagcggcgagtcactcgacctactgaaagtgttcttaaacattttgccacctttgaccaacagcaaggagcaggaagagctcatgcagcagttaaccgaattccaggtcgatgaaatttacacagtgcccgaagtgggcaccgtagtcggcggaacactgagctccggcatctgtcgggagggcgaccagcttgtggtgggtcccacggacgatggatgctttctcgagctccgcgtctgctccattcagaggaatcgttcggcatgccgtgtactgagagcagggcaggccgcgacccttgcccttggagatttcgatcgggccctgttgagaaaaggtatggtgatggtaagtcccgagatgaatccgacaatttgttctgtcttcgaagcagaaatcgtcctgctctttcatgccaccacattccggcgcggcttccaggtgacggttcatgtcggcaatgttaggcagactgccgttgttgagaagatccatgctaaagataagttaaggacaggagagaaagccgtggtgaggttccggttcctgaagcacccagaatatctcaaggtgggcgctaagctcctattccgggaaggggtcacgaagggtataggtcacgtaacagatgtgcaagccataactgccggcgaggcgcaggctaacatgggattctag

SEQ ID NO: 189965 - DNA, 1809 bp, Artificial Sequence
  Description of Artificial Sequence: Synthetic coding sequence
atggacagccgggtgagcgagctgttcggcggctgctgccggcccgggggtgggcctgccgtgggcggaacactgaaggcgagaggagctggaagttcttcggggtgtgggggacccaagggcaagaagaaaaacggccggaatcgtggcggcaaagccaataatccaccctacttgcctcccgaggcggaggacggcaatatcgagtacaagcttaagctagttaatccttcacagtatcgattcgaacacctcgtgacccagatgaaatggaggctgcaggaaggcaggggagaggctgtctatcagattggggttgaggataacggccttcttgtgggcttagctgaggaggagatgcgcgcctctctgaaaacccttcaccgaatggctgaaaaggtgggggcagatatcaccgttctccgagaacgcgaggtagattacgatagcgatatgcccagaaaaatcacagaagtgctagtgcgtaaggtgccagataatcagcaatttctggatctgcgcgtagcggtgctaggcaacgtcgattccgggaaatccactctgttaggcgtgcttacgcagggcgaacttgacaacggacggggcagagctagactgaacctattcagacatctacacgaaattcagagtggtagaaccagctctatctccttcgaaatattgggcttcaacagtaaaggcgaagtcgtgaattatagtgatagcagaacagcagaagagatttgcgaatcatcgagcaaaatgatcacgttcatcgatctggctggccaccataagtacctgcacacaaccatttttggcctaacgtcctattgtccggactgcgcactcctcctggtttctgcgaatacaggaatcgccggaaccactagggagcacctgggcctggctctggcactgaaggttcccttcttcattgtcgtctccaagatcgatctctgcgctaaaactacagttgagaggactgtgagacagctcgagcgcgtcctcaaacaaccagggtgccataaggtgccgatgttagttacatccgaggatgacgccgtcactgccgcacagcagttcgcacagagccccaacgtgacccccatctttaccttgagtagcgtttccggagaaagcttggacctgttgaaggtttttttgaatatcctcccccctctgactaacagcaaagagcaggaagagctcatgcagcagcttacagagtttcaggttgacgagatctacaccgtccccgaagtcggaacggtggtgggtggaaccctgagttcaggtatctgtcgagagggtgaccagctggtcgtgggacccaccgacgacggctgcttcctcgagctcagggtttgctccatccagcgaaaccggtctgcctgccgagttttacgggccgggcaggccgcaaccctcgcacttggggatttcgacagggccctcttgagaaaggggatggtcatggtgtcacccgaaatgaatccgacaatctgcagcgttttcgaagcggaaatagtcttactatttcatgcaaccactttccgccggggttttcaggtgacagtgcacgtgggaaatgttcgtcagaccgccgttgttgagaaaattcacgccaaggataagctgcgcacaggggaaaaagccgtggtccggtttcggttcctgaagcatcccgaatacttgaaggtcggtgccaaattgctctttagagagggcgtcacaaagggtatcggacatgtgacggatgttcaggcaattacagctggggaggcccaggcgaatatgggcttttag

SEQ ID NO: 189966 - DNA, 735 bp, Artificial Sequence
  Description of Artificial Sequence: Synthetic coding sequence
atgaagtggcggctgcaggagggccggggcgaggccatcttcaccctgagctctgtgtccggagaatcattagacctactgaaagtgtttctgaacatactgcctcctctgacgaattctaaggagcaagaggagcttatgcagcagcttaccgagtttcaggtcgatgagatatataccgtgcctgaagttggaacggtggtgggagggaccctcagttccggcatatgtcgagagggagaccagttggtagtgggccctaccgacgacggctgcttcctggagctccgtgtttgctcaattcaaagaaacagatccgcttgtcgggtcttgcgcgccggccaagcggccaccctggcactgggcgatttcgacagggccttgctgcggaaaggcatggtaatggtttcccctgagatgaaccctaccatctgcagcgtgttcgaagctgagatagtattgctgttccacgcaaccaccttccgccgcggctttcaagtgaccgtgcacgttggtaacgtccgccagacagccgttgtggagaaaattcacgccaaagataagcttcgtacaggtgagaaagctgtggttcggtttcgatttcttaagcaccccgagtatttaaaggtgggtgccaaacttctcttcagagagggagtgaccaaaggaatcggacacgtcacagacgtgcaggcaattactgccggggaagctcaggccaacatggggttttag

SEQ ID NO: 189967 - DNA, 462 bp, Artificial Sequence
  Description of Artificial Sequence: Synthetic coding sequence
tgaggcatctgccgggagggcgaccagctggtggtgggccccaccgacgatgggtgctttctggaactgcgggtgtgcagcatacagcgcaaccggtccgcctgccgcgtactgcgggcagggcaggcagccacccttgccctgggagatttcgaccgcgccctgctgcggaaaggcatggtgatggtgagcccggagatgaaccccacaatctgttctgtgtttgaggcagagattgtcctgcttttccacgccacaaccttccggagggggttccaggtaacagttcacgtgggaaatgtccgccaaaccgccgtggtggaaaagatccacgctaaggacaaacttaggaccggggagaaggccgtggcaagagaacgcggagtcctttcggcaacctgcagtcttcctacgttctggagaggagcaaagctgggggtggccagaaaaggtcagtcttag

SEQ ID NO: 189968 - DNA, 465 bp, Artificial Sequence
  Description of Artificial Sequence: Synthetic coding sequence
tgaggcatctgccgggagggcgaccagctggtggtgggccccaccgacgacggttgctttctcgagctgagagtgtgttccatacagaggaatagatccgcctgtcgagtgcttcgggccggacaggccgccacgctcgccctcggtgattttgatagggcccttctgagaaaaggaatggtcatggtaagccctgaaatgaatcctaccatctgttcagtctttgaagccgaaatcgttctgctatttcacgccaccacattcaggcgaggctttcaggtgacagtgcacgtcggcaacgtgcgacagacggccgtggtggaaaagatacacgccaaagttaggggcacctggccaagcatttctcctgaggtccgcaaggagggaggcctgccgcagaccggtagggaactgctggacccaacaatgggcattaagccccacctgggttgggtcgccgcatag

SEQ ID NO: 189969 - DNA, 543 bp, Artificial Sequence
  Description of Artificial Sequence: Synthetic coding sequence
atgcagcagctgaccgagttccaggtggacgagatctacaccgtgcccgaggtcggcacagttgtgggcggcaccttgagctccggaatctgtagagagggagatcagcttgtggtgggccccactgacgacggatgcttcctagaactcagagtctgttccattcagaggaatcgctctgcttgtcgggtgctaagggctgggcaggcagccactctggcccttggtgatttcgaccgcgcactcttaaggaagggcatggtaatggtgtctcccgaaatgaatcctaccatctgttctgtgtttgaggctgaaatcgttctcctgttccacgcaacaactttccggcggggattccaggtaacagtccacgtaggcaacgtccgccagaccgcggtggttgagaagatccatgccaaggataagctgcgtaccggcgagaaggccgtggcccgcgaaagaggcgtccttagcgccacatgcagcctgccgaccttctggagaggagcgaagctgggcgtggccaggaaaggacaatcttag

SEQ ID NO: 189970 - DNA, 951 bp, Artificial Sequence
  Description of Artificial Sequence: Synthetic coding sequence
tgacagggcggcggcgcccgggaggagaacaccagcttccggagccgggacccaagggaggaaggacagcgcctagacagccaagctgaagacgggaacattgaatataaattgaaactcgtaaatccgtctcagtaccggtttgaacacctggtgacccagatgaaatggcgccttcaggaaggccgaggagaggcagtgtatcagataggtgtagaagataatgggttgctggtggggctggccgaagaagaaatgcgcgcatctctgaaaactctgcacagaatggccgagaaagtcggggcggacataaccgttctgcgcgagagagaggtggactatgatagcgacatgccaagaaagattaccgaggtgctcgtgaggaaggtccctgataaccagcagttcctggatttacgtgtcgcagtgttgggaaacgtcgattccggtaagagtaccctgcttggggtgctgactcagggagaactggataacggtcgcggaagagcgcggcttaacctctttagacacctccacgagatccaaagcggtcgtaccagcagcatttccttcgagatcctcggattcaactccaagggggaggttgtgaactactccgatagccgtaccgccgaggagatttgtgaatcgtctagtaagatgatcacttttattgacctcgcaggtcaccacaagtacctgcacacaactatcttcggactgacaagctactgtccagattgtgcattgctgctggtcagtgcgaataccggcatcgctggaacaacacgagagcacctgggcctggccctcgcactcaaagtgcccttttttatagttgtcagcaaaatcgacctgtgtgcgaaaacgacagtggagcggaccgtccgacaactggagagagttctgaaacagccgggctgccacaaagtgccaatgctggtcacttag

SEQ ID NO: 189971 - DNA, 684 bp, Artificial Sequence
  Description of Artificial Sequence: Synthetic coding sequence
atggacagccgggtgagcgagctgttcggcggctgctgccggcccggcggagggcctgcagtaggtggcactctgaaagcacgtggtgcaggatcctcttccggttgtggaggtcccaaaggcaaaaaaaagaatgggcggaaccgcggaggtaaagctaacaatccaccttacctgcctccggaggccgaggacggcaatattgagtacaaatacaggttcgagcacctggtgacacaaatgaaatggagattgcaagaaggtcgcggtgaagcggtgtaccagattggcgtggaggacaatggcctgctggttggactggccgaagaagagatgcgcgcaagcctgaagaccctccacaggatggcagaaaaggtcggggccgatattaccgtccttcgggagcgtgaggttgactacgatagcgatatgccacggaaaattacagaagttttggtacggaaggtgcccgacaaccagcagttcctcgaccttagggtggccgtattgggtaacgtcgatagcgggaagtcaactctcctgggagttctcacccagggagagctggacaatggaagaggaagagctagattaaacctttttcgccatctccacgaaatacagtccgggcggacctcttccatctccttcgagatcctcggttttaactccaagggcgaatag

SEQ ID NO: 189972 - DNA, 1221 bp, Artificial Sequence
  Description of Artificial Sequence: Synthetic coding sequence
atggcccccgcccggtgcttcagcgcccggctgcggaccgtgttccagggggtcgggcattgggcactgagcacctgggcagggcttaagccttctcgtcttctcccccaaagggccagccctaggctgttatccgtcggccgggccgaccttgccaagcatcaggaactgcccgggaagaagctgctatccgagaaaaaattaaagagatactttgtggattatcgccgggttctggtctgcggtggcaatgggggggctggcgcctcttgtttccattcagagccgcgtaaagagtttggaggccccgacggaggcgatggcggtaatgggggccacgtgatcttacgtgtggatcagcaggtcaagtccttgagttcggtgttgtcccggtaccagggattttcgggtgaagacggcggcagtaaaaactgtttcgggcggtctggagctgtattgtatattcgagtccccgtggggaccttggtgaaggaagggggcagagtggtggctgacctaagttgcgttggcgatgaatacatcgccgcgctggggggcgccggcggcaaggggaataggttctttctggccaataacaatcgcgcccctgtgacttgcacccccgggcagcccggacagcagcgagtgctgcatctggagcttaaaactgtggctcacgcgggtatggtcgggtttcctaacgccggcaaaagctccctgttaagagctattagcaacgcccgccctgcggttgcctcatacccatttaccacacttaagccacatgtcggaattgttcattatgagggccacctgcagatcgctgtggcagatattcccggtataatacgaggcgcccatcagaaccgggggctcgggtctgctttcctgcgtcatattgaacgctgcaggtttttgctgttcgtggtagacctctcccagccagagccttggacccaggtggacgacctgaagtacgagctggagatgtacgagaagggcctcagcgcccggccccatgctatcgtggctaataaaatcgatctcccagaggcccaggcaaacctgagtcaactgcgcgatcatctgggacaagaagtgattgtcctgtcggctctaacaggagaaaatctggagcagcttttactgcacctgaaggttctctacgatgcttacgcagaagcagagctcgggcagggcaggcagccactgcgctggtag

SEQ ID NO: 189973 - DNA, 747 bp, Artificial Sequence
  Description of Artificial Sequence: Synthetic coding sequence
atggcccccgcccggtgcttcagcgcccggctgcggaccgtgttccagggcgtggggcactgggccctgtccacctgggcaggactaaagcctagccggctactgccgcagcgggcttcgcctagattgctgagcgtgggcagagccgacctggcaaaacatcaggagctgcctgggaagaaattactgtccgaaaaaaaactaaagcgctatttcgtggattaccggagagtactggtgtgtggcgggaatggcggggcaggcgcttcctgctttcatagcgagccaagaaaggaattcggtggccctgatggcggggatggaggaaatgggggacatgtgatcttgcgggttgcagacatccccggtataatcagaggtgctcatcaaaatagagggttaggcagtgcctttctgcgacacattgaaagatgtcgcttcctgctttttgtggtagacctttctcagcccgagccctggactcaggtcgatgatttgaaatacgagctggagatgtatgaaaaagggctcagcgcaaggccccacgccatcgttgccaacaaaatagatctgcccgaggcgcaggcaaacttgtcccaactgcgcgatcacctcggtcaggaggtcatcgtcctctcggccctgactggagagaatttggagcagctgctgcttcacttgaaggtactctacgacgcgtacgccgaagcggagctgggacaaggcagacagcctctgaggtggtag

SEQ ID NO: 189974 - DNA, 702 bp, Artificial Sequence
  Description of Artificial Sequence: Synthetic coding sequence
atggcccccgcccggtgcttcagcgcccggctgcggaccgtgttccagggagttgggcactgggcgctgagcacatgggccggcctgaaacccagtcgactgttgcctcagcgggcaagcccaaggctgctcagtgtagggcgggccgatctggctaagcaccaggagctgcctgggaaaaaactgctgagcgaaaaaaaacttaaacgctatttcgtggactatcgccgcgtgctggtgtgcggaggcaatgggggtgcgggcgcgtcttgcttccacagcgagcccagaaaggagttcggcggcccggatggtggagacgggggaaacggcggccacgtgatcctgagagtcgaccagcaagtgaaatccctatcttccgtcctgtccagatatcaaggtttttctggagaggacggcggcagcaagaactgctttggccggagcggagccgtgctgtacataagagtgcctgtcggcactcttgtgaaggaaggcggccgagtagtcgccgatctttcgtgcgtcggtgacgagtacattgccgctctcgggggagctggcgggaaaggaaataggttcttcctggctaacaacaatcgagccccagtgacatgtacccctgggcaacctggtcagcaacgcgttctccacctcgagcttaaaactgtggctcatgccgggatggttgggtttccatag

SEQ ID NO: 189975 - DNA, 537 bp, Artificial Sequence
  Description of Artificial Sequence: Synthetic coding sequence
atggtgggcttccccaacgccggcaagagcagcctgctgcgggccatatctaacgcccgccccgccgtcgcctcttatcccttcaccacactcaagccccatgtcggcattgtccattacgagggccatttgcagatagcggttgctgacattcctggtataatccgtggagctcatcagaaccgtgggctgggctcagcatttctgcgccacatagagagatgtcggtttctgctgttcgttgttgatttgtcgcaacccgaaccctggacccaggtggacgacctaaagtacgaacttgagatgtatgaaaaaggtctgtcagctcggcctcacgccatcgtagcaaataagatcgatttacccgaggcccaggccaacttgtcacaattgcgcgatcacctcggacaagaggtgattgttctatccgcattgactggagagaacctcgaacagcttcttctgcatctgaaggttctttacgacgcttacgccgaggctgagctggggcaggggaggcaacctctgcgatggtag

SEQ ID NO: 189976 - DNA, 864 bp, Artificial Sequence
  Description of Artificial Sequence: Synthetic coding sequence
cggagcaacctgaagcgggacgtggcccacctgtaccggggcgtgggtagtagatacatcatgggaagcggagaaagttttatgcagctacagcagcgtcttctaagggagaaggaggccaagatccggaaggcactggatcgtctgcgaaaaaaacggcacttactgagaagacagaggacccgtcgagaattccctgtgatatctgtggttggatacacaaactgcggaaagacaaccctgattaaagccttgactggggatgccgcgattcagcctcgcgaccagttgtttgcgacattagatgtgacagcacatgcaggaacactgccttctcgtatgaccgtcctgtatgttgataccataggctttctgtctcagctgcctcatggacttattgaaagcttttctgccaccctggaggacgttgcccatagcgacctcatcctgcacgtcagagacgtgtctcacccagaagccgaactgcagaagtgttcggtgctgagcaccctcagaggcctgcagctcccggctcccctcctggatagtatggttgaggtccacaacaaagttgacctcgttcctggttatagtcctacagaaccaaatgtggttcccgtgtcggccctcaggggtcatggcctccaggagctgaaggccgagctggacgccgcagtcctcaaagccaccgggcgtcagatccttaccctgcgagtgagattggcgggagcgcagctttcctggctgtacaaagaagcgacggtgcaagaggtggatgtcatcccggaggatggagccgctgatgttagagtcattatctccaacagcgcctacggaaaattccgcaagctgttcccagggtag

SEQ ID NO: 189977 - DNA, 864 bp, Artificial Sequence
  Description of Artificial Sequence: Synthetic coding sequence
tgaagcaacctgaagcgggacgtggcccacctgtaccggggcgtgggatcaagatacattatgggcagcggagagtcttttatgcagttacagcagagacttctgagggagaaggaagctaaaatccgaaaagccctggaccgcctgagaaagaagagacacctgttgagaaggcagcggactcggagagagttccctgtcatctccgttgtgggctacacaaactgtggcaagactactttgatcaaagctctgaccggtgacgccgctatacagccccgcgaccagctattcgcaaccctggacgtgactgcccatgcaggtactctgccctcgaggatgaccgtattgtacgtggacacaatcggtttcctttcccaactccctcacggcctgattgaaagtttttccgcaaccctggaggatgttgcacactccgaccttattctccatgtgagggatgtgagtcaccctgaagctgagctgcagaaatgctccgttctcagcactctaagaggccttcagctgccagccccactcctggactctatggtggaagtgcacaacaaggtagatctagtgcctgggtacagtcctacggagcccaatgtggtgcccgtctcagctctacggggccacggcctgcaggagttaaaggctgagctggacgctgccgttctgaaggccacagggcggcagatcctgactctccgtgttcgtctggccggcgctcagctgagctggctttataaggaggccactgtacaggaggtggatgtcataccggaagatggggccgccgacgttagagtgataatttcaaacagcgcttatggtaaattccggaaactgtttccaggctag

SEQ ID NO: 189978 - DNA, 891 bp, Artificial Sequence
  Description of Artificial Sequence: Synthetic coding sequence
atgaccctgaacaacgtgaccatgcggcagggcaccgtgggcatgcagccccagcagcagaggtggagcattcccgctgatggtcgccacttaatggtgcaaaaagagcctcaccagtattctcatcgcaatagacactccgctactccggaggaccactgtcgacgaagctggtcatccgacagcacagattcagtgataagctccgaatccggaaacacttattaccgagtcgtgctgatcggcgaacagggcgtggggaaatccactctcgctaatatattcgccggcgtgcatgattccatggactctgactgtgaggtcctgggcgaagacacatacgaacggactctgatggtcgatggcgaatcggccacaataatcttactggacatgtgggagaataagggcgagaatgaatggcttcacgatcattgcatgcaagtgggtgatgcatatcttattgtttatagtatcaccgaccgtgcatctttcgagaaagcttccgaactaaggatccagctcaggagggcacgccagacagaggacattccgatcattctggtgggtaacaagtctgatctggtccgatgtcgggaggtctccgtgtccgagggtcgagcatgtgccgttgtgtttgactgcaagtttatcgagaccagcgctgcagtgcagcacaacgttaaggaactatttgaggggatcgttcgccaggtcaggctacgcagggacagcaaagagaaaaacgaacgcaggctggcctatcagaaaagaaaagagagtatgccgcgcaaggccaggcgtttttggggcaagatagtagccaaaaataacaaaaacatggccttcaaactcaagagcaaatcctgtcatgatctttcagtgctctag

SEQ ID NO: 189979 - DNA, 891 bp, Artificial Sequence
  Description of Artificial Sequence: Synthetic coding sequence
atgaccctgaacaacgtgaccatgcggcagggcaccgtgggcatgcagccacagcaacagcggtggtccattcctgcagacggccggcatctcatggtccagaaagaaccacatcaatactctcaccgaaatcgacattccgccactcccgaagatcactgtagacgcagctggtcatctgactcaaccgactcagtcatttcatcggaaagcgggaacacatattacagggtggtccttatcggcgagcagggcgtgggcaaatctactctggccaatatcttcgccggtgtccacgatagcatggatagtgattgcgaggtgttgggggaggatacttacgagcgcactttgatggtggacggggagtctgccaccatcattctcctcgacatgtgggagaacaaaggcgaaaacgagtggctgcatgatcactgtatgcaggtgggcgatgcctacctaatagtgtactcaattaccgatcgggccagctttgaaaaggcttccgaactgcgtatccagctgagacgcgcgcgacagacagaagatatccccattatcctagtgggtaacaagtctgacctggtgcgctgtagagaagtctctgtttctgaggggcgggcttgcgctgtcgtcttcgactgcaagtttatcgaaacatctgccgccgttcagcacaacgtcaaggaattgttcgagggtattgtcagacaggtgaggttaaggcgggacagtaaagagaaaaatgagagacgtcttgcctaccaaaagcgcaaagaaagtatgccccgtaaagccaggagattttgggggaaaatcgtggctaaaaataataaaaacatggcatttaagctcaagtctaaatcttgccatgacctctcagtgctttag

SEQ ID NO: 189980 - DNA, 282 bp, Artificial Sequence
  Description of Artificial Sequence: Synthetic coding sequence
atgaccctgaacaacgtgaccatgcggcagggcaccgtgggcatgcagccccaacagcagaggtggtccatccctgccgatgggcgacaccttatggttcagaaggaacctcaccagtactcccatcgaaatcgtcatagcgcaactcccgaagaccactgccgacgatcctggagctctgattccacagactctgtgattagctcggagtctgggaatacatactacagagtcgtgctgattggcgagcaaggcgtgggcaagagcacattagcgaattag

SEQ ID NO: 189981 - DNA, 927 bp, Artificial Sequence
  Description of Artificial Sequence: Synthetic coding sequence
atggtgatggagaagcccagccccctgctggtgggccgggagttcgtccgacaatactacacactgctcaaccaagcccccgacatgctgcaccgattctatggaaagaattcatcttacgttcatgggggactggacagtaatggcaagcctgcggacgcggtatatggtcagaaagaggtggaggaacctgaggaaaggcagcagacacctgaggtcgtgccggacgattccggcaccttttacgatcaagccgttgtttctaacgacatggaggagcaccttgaggaaccagtcgcagagccagaaccagaccctgaaccggagccggagcaggaaccagtcagcgagattcaagaggaaaagccccccagacccgaatccaaacccgagtcccagatacctccacagcgaccccagcgggaccaaagggtgcgcgaacagagaatcaatatccccccacaacggggccccagacctataagggaggcaggggaacaaggagatattgagccccggcgaatggtcaggcacccagactctcatcagttgtttattgggaacctgccgcatgaggtggataaatccgaactgaaggacttctttcaatcttacggcaacgtggtggaactccgcattaattccggtggcaaactgccgaactttggcttcgttgtttttgacgactccgaaccagtgcagaaagtactcagcaatcgaccaattatgttccggggtgaggttcgcttgaacgttgaggagaagaaaaccagagccgcacgcgagggcgacaggcgtgataaccgactgaggggacccggaggaccacggggtggactcggagggggcatgagggggccaccacgagggggcatggtacagaagccagggtttggcgttggaagaggactcgcccctcgtcagtag

SEQ ID NO: 189982 - DNA, 1401 bp, Artificial Sequence
  Description of Artificial Sequence: Synthetic coding sequence
atggtgatggagaagcccagccccctgctggtgggccgggagttcgtgcgtcaatactatactctgctgaatcaggctccagacatgctgcatagattttatggcaagaactcctcttacgtgcacggaggactggattctaatggcaagccggcagatgcagtgtacggccagaaagaaatacacaggaaggtaatgtcccagaattttactaactgccataccaagattcgacatgtagatgctcatgctacactgaacgatggggtggtagtacaagtcatgggcctgctatcaaacaacaatcaggccctgagaagattcatgcagacatttgtacttgcacctgaaggttccgtggcgaataaattttatgttcacaatgacatctttaggtatcaggatgaagtgttcgggggcttcgtgacagagccccaagaggaaagtgaggaagaagtcgaagagcccgaagagagacaacagaccccagaggtggtacctgatgattcaggaacattctacgatcaagccgtggtgtctaacgatatggaggagcacctggaagagccagtggccgagccggaaccagaccccgagcctgagccggagcaggaacctgtatctgaaatacaagaagaaaaacccgagccagtgctggaagaaaccgcaccagaagacgctcagaagtcaagcagtcccgcgccagccgatattgctcagacagtgcaggaggatctgcgcactttttcttgggcgtctgtgacctcaaagaacctgcctccatccggcgcagtgcctgtaaccggcattcctcctcatgtggtcaaagtgcctgcttcacagccacggcccgaatcgaaaccggagtcccagattccaccacagcgtccgcagagagaccagcgggtgagagaacagagaatcaatattccaccccaacgtgggccgcgacccattcgggaggccggggagcagggcgacatagagccacggcgcatggtgcgccaccccgactcccaccagctgttcatcggtaatctgcctcacgaggtggataagtcggaattgaaggatttcttccagtcctatggaaatgtggtggagctccgcatcaacagtggaggaaaacttcctaatttcggtttcgttgtgttcgatgactcagaaccagtgcagaaggtgctatcaaatagacctatcatgttccgcggagaagtgcgcctgaatgtggaggaaaaaaagacaagggcagcccgggagggtgaccgtcgtgacaataggctccgtggcccaggcggtccccgcgggggtttgggagggggaatgcggggccccccgagaggaggtatggtgcagaaacctggtttcggggtgggacggggcttggctccaaggcaatag

SEQ ID NO: 189983 - DNA, 1401 bp, Artificial Sequence
  Description of Artificial Sequence: Synthetic coding sequence
atggtgatggagaagcccagccccctgctggtgggccgggagttcgtgcgccagtactacacactgctgaaccaggctccggacatgctgcatcgtttctatggtaagaatagtagctatgttcacggggggctggactccaacggcaagccagcagatgcagtttacggccagaaagaaattcaccgaaaggtcatgagtcaaaattttacgaattgtcatactaaaatcagacatgtggacgcccacgcgactcttaacgacggcgtggtcgttcaggtcatgggactgctctcgaacaacaaccaggctctgcgtagatttatgcagacctttgtgctcgcgcctgaaggttccgtggctaacaagttctacgtccataatgatatctttcgatatcaagatgaagtgttcggcgggtttgtcaccgagcctcaggaagagagtgaggaggaagtcgaagagccagaggaacggcagcaaacccccgaggtagtacccgacgacagcgggacattctatgatcaggcggtggtcagcaacgacatggaggagcacctcgaagaacccgtggctgaacccgagccagacccggagccggaaccggagcaggaacccgttagcgagatccaggaagagaaacccgagcctgtactggaggaaactgcacctgaagacgcccagaaaagctcgagcccagccccggcggacattgctcaaaccgtacaagaagacctaaggactttttcttgggctagcgtgaccagcaagaacctgcctcccagcggggcggtccccgtgaccggcattcccccccacgttgtgaaggtcccagcatcgcagcctcggcccgagagcaagcccgagtcacagattccccctcaacgtccccaaagggatcagcgcgtgagggaacagcggattaacatccctcctcagcgtggccctcgtcctattagagaggcgggagagcagggcgacatcgagccaagaaggatggttaggcatcctgacagccaccagctgtttatcggcaatctgccgcacgaggtagataagagcgaacttaaggatttcttccagtcttatggtaatgtcgtggagctacgcatcaactcgggcggcaaattgcctaattttgggtttgtggtcttcgatgattctgagcctgtgcagaaggtgctgtctaacaggccgatcatgtttcgaggagaggtccgactgaacgtggaggaaaagaaaacccgcgcagctcgcgagggagacagaagagataataggctacgtgggcctggggggccacggggcggactcggcggtgggatgcgagggccaccccggggcggaatggtccagaaacccggcttcggggttgggaggggactagctccacggcagtag

SEQ ID NO: 189984 - DNA, 318 bp, Artificial Sequence
  Description of Artificial Sequence: Synthetic coding sequence
atggtgatggagaagcccagccccctgctggtgggccgggagttcgttagacagtattatacattgctcaaccaggcacctgacatgctgcacagattttacgggaaaaattcatcctatgtacatgggggtctggacagtaatgggaaaccagctgatgcagtgtatggccagaaagagattcataggaaggtgatgtcccagaattttacaaattgccacacaaagattcgacacgttgatgcacatgccaccctaaacgacggtgtggtggtccaggttatggggctcctttccaacaataaccaggctctctag

SEQ ID NO: 189985 - DNA, 369 bp, Artificial Sequence
  Description of Artificial Sequence: Synthetic coding sequence
atggtgatggagaagcccagccccctgctggtgggccgggagttcgtcagacagtattatactttactgaatcaagcccccgatatgctgcaccggttttacgggaagaatagtagttacgtgcacgggggcctagactcgaacggcaagccagcagatgctgtttacgggcagaaggaaattcacaggaaagtgatgtcccaaaatttcactaattgtcatacgaagatccgacacgtggatgcccacgcaactctgaatgatggagtggtggtccaggtgatgggattgctgtctaataataatcaggcgcttagacgattcatgcaaacttttgttcttgcccctgagtcccttaagaaaaaatag

SEQ ID NO: 189986 - DNA, 354 bp, Artificial Sequence
  Description of Artificial Sequence: Synthetic coding sequence
atggtgatggagaagcccagccccctgctggtgggccgggagttcgtgcggcagtattataccttgcttaatcaggccccggacatgctccaccggttctacggaaagaatagttcttacgtgcacggcggtctggatagtaatggaaagccggcagatgccgtctacggacaaaaagaaatccacaggaaggtgatgtcgcaaaattttaccaattgtcatacaaagatcagacacgtggacgcacacgccaccctgaatgacggcgttgtggttcaagtgatggggcttctgagcaacaacaaccaggctctgagacgattcatgcaaacttttgtgcttgctcccgagtag

SEQ ID NO: 189987 - DNA, 369 bp, Artificial Sequence
  Description of Artificial Sequence: Synthetic coding sequence
atggtgatggagaagcccagccccctgctggtgggccgggagttcgtcaggcaatattataccctcctgaaccaagctcctgacatgctacaccgcttctatggaaaaaatagctcctatgtgcatggaggcctcgactccaatggcaagcctgccgatgcggtgtacgggcagaaagaaattcacagaaaagtaatgtcccaaaactttaccaactgtcacaccaaaatacggcatgtggacgcccacgccacattgaatgacggcgtggtggtgcaggttatgggcctgctctccaacaacaatcaggcactgaggcgcttcatgcagaccttcgtcctcgcacctgaaagtctgaaaaaaaagtag

SEQ ID NO: 189988 - DNA, 321 bp, Artificial Sequence
  Description of Artificial Sequence: Synthetic coding sequence
atggtgatggagaagcccagccccctgctggtgggccgggagttcgtaaggcagtactacaccttactgaaccaggcacccgacatgttgcatcggttttacggtaaaaatagcagttatgttcatggtggcctcgactccaacggcaaacctgctgatgctgtgtatggccagaaggagatccaccggaaggtgatgagccagaactttacgaactgccacactaagatcaggcatgtggatgcccacgccactctcaacgatggggtggtcgtgcaggtgatgggtctgctgtcaaacaacaaccaagcacttcgatag

SEQ ID NO: 189989 - DNA, 855 bp, Artificial Sequence
  Description of Artificial Sequence: Synthetic coding sequence
atggaggagcacctggaggagcccgtggccgagcccgagcccgacccagagccagaaccagagcaagaaccggtcagcgagattcaggaagagaagccagagcctgtgcttgaagaaacagcgccagaggacgcccagaagtcctcctccccggcgcccgctgatatcgcccagacggtgcaggaggacctgaggacgtttagttgggcctccgttacatccaagaaccttccacctagcggagcagtgcctgttaccgggattcctccgcacgtggtgaaggttcccgccagccagccacgtcctgagtctaaaccagagagccagatcccacctcagcgcccccagcgagaccagcgggtcagagagcaaagaattaatattcccccccaaagaggcccccggcccatccgtgaagccggcgaacagggcgacattgagccaagacgaatggtcaggcaccccgactcacatcagcttttcatcggcaatctgcctcacgaagtcgataaatctgagcttaaagacttctttcaatcttacggtaatgttgtggaattaagaattaacagtggggggaagctcccgaacttcggatttgtggtgtttgacgattccgagccggttcagaaggtgctgtctaaccgccccataatgttcagaggtgaagtccggctgaatgtagaagaaaagaagaccagggctgcaagagagggagaccgacgggacaacagactgcgggggccgggcggcccacgaggtgggctgggcggcggcatgcgtggccccccgagaggcggtatggtccagaagccgggctttggcgtgggcaggggacttgcccctcgtcagtag

SEQ ID NO: 189990 - DNA, 4359 bp, Artificial Sequence
  Description of Artificial Sequence: Synthetic coding sequence
atggtgaagctggacatccacaccctggcccaccacctgaagcaggagagactgtatgtgaacagtgagaagcagcttatccaaagactgaatgctgatgtcctcaaaacagccgaaaagttataccgaaccgcgtggattgcaaagcaacagcgcatcaaccttgatcgactgatcataaccagcgccgaagccagccctgcggaatgttgtcagcatgccaaaatcctcgaggatacgcagttcgtcgacggatataagcaactcggtttccaagagaccgcatatggtgagtttctgtcaaggctgcgggagaatcctcggctgattgcctcaagcctggtagctggtgagaagcttaaccaagagaacacgcagagtgtcatttatactgtgttcacctccctctatggaaattgtattatgcaagaggacgaaagttatttattgcaggtccttaggtatctgattgagttcgagcttaaggaaagcgacaacccgaggagactgctgcggagaggtacctgtgccttttccatcctgttcaagttgttttccgaggggctgttcagcgctaagctgttccttaccgctacactccacgaacccataatgcagctcctagtagaggatgaagaccaccttgagaccgaccccaacaaattgattgagcggttttctcccagccagcaggagaaactttttggcgagaaggggtcagaccgttttagacagaaggtacaggaaatggttgaaagcaatgaagccaagttagttgcactggttaataaattcattggctacctcaaacaaaacacctattgtttcccccactccttgagatggattgtgtcccagatgtacaagacactgagctgcgtggatagactggaggtcggggaagtgcgggcgatgtgcacagatctgctgcttgcctgcttcatttgtccagccgtcgtgaatcctgagcaatatggaattatatccgatgcacccattaacgaagtggctaggtttaacctaatgcaggttgggcgactgctgcagcaactagccatgaccggctccgaagagggggacccacgaacaaaatcttccctgggtaagttcgacaaaagttgtgtagccgcctttcttgacgtcgtaattggtgggagggccgtggaaactccacctctgagcagcgtaaatcttctagagggattatctcgcaccgtggtctatattacctacagccagctcatcaccctggtgaattttatgaaatctgtaatgtcaggcgaccagctgcgagaggacaggatggcattagataacctactcgcaaatctgcctccagcaaaacccggcaagtctagtagtttggagatgacaccctacaacactccccagctaagtcccgctacgacgcctgccaacaagaagaatcgactgccaatagcaacacggtccagatctcggacaaatatgttgatggacctccacatggaccacgaaggcagcagccaggaaaccatccaggaagtccagccagaggaggtactggtcatctctctgggaaccggcccccagctcacacctggcatgatgagcgagaacgaggtgttaaatatgcaactcagcgacggcgggcagggcgacgtgccggtggacgagaataagttgcatgggaagcccgacaagaccttgagattttctctgtgctcagacaacctcgaaggtatttctgaagggcccagcaatcgtagtaacagtgtgtcatctctcgacctagaaggtgagagcgtttctgagctgggtgctggaccttccggcagcaatggggtggaggccctacagctgctggagcatgagcaggcaaccactcaggataatcttgacgacaagttgcgaaagttcgagatcagggatatgatgggactcacggacgaccgggatatatcggagacagtgagtgagacttggtcgacagacgtcctgggaagcgacttcgatcccaacattgatgaagaccggctgcaagaaatcgccggggctgccgcggaaaacatgcttggcagcctcctctgtcttcccggttcaggcagcgttttgctggacccctgtacaggatctacgatctccgaaaccacaagtgaagcctggtccgttgaggtcctgccctcggatagcgaggcccctgacctgaaacaggaagaaagattgcaagaattagaaagctgctctggactgggcagcaccagcgatgacacggacgtgcgagaggtctctagcagacctagtacccctggcctgtccgtggtgagcggtatctccgcgacctctgaggacatccctaataagattgaagatttgcgaagcgagtgtagcagcgattttgggggcaaggattccgtgactagtcccgatatggatgaaataactcatggagcctcagccgtcgtacgccctaaggtccattatgctcggccaagtcaccctcctccggatccgccgatacttgagggggccgtcgggggcaatgaagcaagactgcctaattttggcagtcatgtcctgacccctgcggaaatggaggcctttaagcagagacattcatatccagagagactggtgcgcagtaggtcatcggatatcgtgagctcagttaggaggcctatgtctgatccctcatggaacagaagaccggggaatgaggaacgcgagctaccacctgcagcagcaatcggtgctacctccctcgtggcggcccctcacagttcgtcaagcagccccagcaaagacagttctcgcggagaaacggaagagcgcaaggactcagacgacgagaagtctgaccggaataggccgtggtggagaaagaggttcgtgagcgctatgcctaaggcccctatcccttttcgaaagaaagaaaagcaggaaaaagataaagatgatctcgggcccgaccgtttcagtacactgaccgacgatccctccccccgcctgtctgcccaagcacaggttgccgaggatatcttagataagtatcgtaatgctatcaagaggactagcccgtctgatggagcaatggctaattacgagtcaacaggtgacaaccatgatcgcgacttgagcagcaaacttctctatcattctgataaagaggtaatgggggatggagagtctgctcatgacagccctcgggatgaagccctccagaacatctctgcggatgatctccctgactcagcgtcccaagctgcccacccccaggacagcgctttttcttaccgagatgcgaagaaaaagctcagactcgccctgtgcagtgctgacagtgtggcctttcccgttttaacccacagcactcggaatggtcttcctgatcataccgatcctgaggataacgagattgtgtgttttctgaaagtgcaaatcgctgaggccattaatctccaagataaaaaccttatggcacaactccaggagacaatgcgctgcgtctgcaggtttgacaacagaacatgcaggaagctactggcatccattgctgaggattaccgaaagcgcgccccatacatagcctatctgacgagatgccggcaggggttacagaccactcaggcacatctcgagcgcttactccaacgggtgctgcgtgacaaagaggtggccaatagatactttaccactgtatgtgtgcggctcctgctggaatccaaagagaagaaaattagggaatttattcaggattttcaaaagctcaccgctgccgatgacaaaacggctcaggtcgaggacttcttgcagtttctgtatggcgccatggcacaggacgtcatttggcagaatgcgtccgaggaacagctgcaggatgcacaactagccatagagagatctgtcatgaaccggattttcaaattggccttttatcctaaccaggatggtgacatcctgcgcgaccaggtgctccatgaacacattcaaagactgagtaaggttgtcaccgccaaccacagagccctgcaaattcccgaagtgtacctgagagaagctccctggccctccgctcagagcgaaatccgtaccatctcagcctataaaacccctagagataaagtgcagtgtatcctgcgcatgtgtagcactattatgaatctcttgtcgctagctaatgaagacagtgtcccaggcgctgatgactttgtgccagtgctggtgttcgttctcattaaggccaatccgccctgcttactgagcactgtgcaatacatctcctcattctatgcttcatgtctatccggcgaagagagttattggtggatgcagttcaccgctgcggtagaattcataaagacaatcgacgatcgtaagtag

SEQ ID NO: 189991 - DNA, 1494 bp, Artificial Sequence
  Description of Artificial Sequence: Synthetic coding sequence
atggtgaagctggacatccacaccctggcccaccacctgaagcaggaacggttgtacgtcaactctgaaaaacagctgatccaaagactcaatgccgatgtgcttaaaacagcagaaaagctgtataggaccgcatggattgccaaacagcaaaggatcaaccttgatcggctgatcataactagtgccgaagcgtccccagcggagtgttgccagcacgccaaaattttggaggatactcagtttgtggacggatacaagcagctagggttccaggagacagcctacggagagtttctgagtcggctgcgcgaaaacccaagattaatcgctagtagcctggtcgcaggggagaagctgaatcaagagaatactcagtctgtgatctataccgtgttcacctccctttacggaaattgcatcatgcaagaagacgagagttacctgcttcaggtgttaagatatctcatagagttcgagcttaaggaatcagacaacccacgccgcctactccgccgcggcacgtgtgcttttagtatcctcttcaaactattcagcgaaggcctgttctcagcaaaactatttctcacagccaccttacatgagccgattatgcaactgttggtcgaagacgaagaccacctcgaaaccgatcctaataaactgatcgagcggtttagtccaagccagcaggaaaaactgttcggcgaaaaaggctctgatcggtttcgccaaaaggtgcaggaaatggtcgaaagcaacgaagccaagctggttgcactggtgaacaagtttatcggctacctcaaacaaaatacctattgctttccacacagcctccgctggatcgtgagccagatgtacaagacactctcctgtgttgaccggctggaagtgggggaggtccgagccatgtgtacggacctcctgctggcctgcttcatttgtccagccgtagttaaccccgaacagtacggaattatctcagacgcgcctattaatgaggtcgcgcggttcaacctgatgcaagtgggcagactgcttcagcagttggcaatgaccggctccgaggaaggagatcccagaacaaagagttctcttggaaaattcgataaaagttgcgtggctgcgtttctggacgtcgtgattggtggcagagcggtcgagacccctccactgtcttctgtaaacctgctcgagggactcagccgcaccgtggtgtatataacttacagccagctgataactcttgttaactttatgaagtccgtgatgagtggcgaccagctccgggaggatcgcatggccttggacaatttgctagccaatctgccaccagcgaaacctggcaaatcatcgagcttggaaatgacgccttacaataccccccagctatcaccagctacaacccccgccaacaagaagaaccgactgcccatcggcaaggagaattttagctactggtcatttctccttaacctcattttccactag

SEQ ID NO: 189992 - DNA, 4437 bp, Artificial Sequence
  Description of Artificial Sequence: Synthetic coding sequence
atggtgaagctggacatccacaccctggcccaccacctgaagcaggagagactctacgtgaattccgaaaaacaactgatacagcgactaaatgccgacgtcctgaagaccgccgaaaagctctatagaaccgcatggatagcaaagcagcagaggatcaacctcgacaggttgatcatcacatcggcagaggccagcccagccgaatgttgtcaacatgccaaaatcttggaggacacacaattcgttgacgggtacaaacaactgggctttcaggaaacagcatatggcgagttccttagccgcctgcgggaaaatccacgactgattgccagcagtcttgttgcgggggagaagcttaaccaggagaatacccaatcagtgatttataccgtttttacatccctctacggcaattgtatcatgcaagaagacgaaagctacctgttgcaggtacttcggtatctaattgagtttgagttgaaggaatctgacaatcccaggaggctgctgcgccgtgggacctgcgcattcagtatactgtttaagctcttttcagaggggctgttcagcgcaaaactttttctgacagctacactacacgagcccatcatgcaactccttgtcgaagacgaggatcacctggaaacggaccccaataagctaattgaaagattttcaccttcacaacaagagaaattgtttggcgaaaagggttctgaccgcttccgccaaaaagttcaggagatggtcgaatccaacgaagccaagctggtggctctcgtgaataagtttattggctacctgaaacagaatacttattgtttcccacatagcctgaggtggattgtttcccagatgtacaagacattgagctgtgttgataggttggaagtcggggaggtgagagctatgtgtactgatctcctgctggcctgtttcatctgcccagctgtggtgaaccccgagcagtacggaattattagtgacgctccgatcaacgaagttgcacgttttaacctgatgcaagtcggaagactgctgcagcagttagcaatgactggcagcgaagagggggaccctcggacaaaatcctcactgggaaaattcgacaagagttgcgttgccgcctttctggatgtggtcattggtggaagggccgtcgagacccctcctctctcatctgtaaatttgctcgaaggtttgtctagaaccgtcgtctatatcacttactcccagcttatcaccctggttaatttcatgaagagcgtgatgtctggagaccagctccgggaggatcgcatggctttggacaatttgctcgcaaatctgccccctgccaagccggggaagtctagctcactagagatgactccatacaacacaccccagctgtctcctgctacaaccccagccaataaaaaaaaccgcctcccaattgcaacacgctcacgaagccgcacaaacatgcttatggacctccatatggatcacgaggggtcttctcaggaaactattcaggaggtgcagccagaggaggtgctggtgatcagtctcggcactgggccccaactcactcccgggatgatgagcgagaacgaggtcctcaacatgcagttatccgatggaggccagggagatgttcctgtggacgaaaacaaattacacggcaaaccagacaagactttgagattcagcctgtgctctgacaatcttgaggggatctccgagggacccagcaatcgctctaattccgttagctctctggacttggaaggtgagagcgtgtccgagctgggagccgggcccagcggaagtaatggggtggaagcgctgcagttacttgagcatgaacaggctaccacccaggacaatcttgatgacaagctgcggaaattcgagattagagacatgatgggtctcaccgatgacagggatatttctgaaaccgtgagtgaaacctggtctactgacgtattggggagcgacttcgatccaaacatcgacgaagataggctgcaagagatcgctggcgcagcagccgagaatatgcttggcagtctcctttgcttgcccggctccggttctgttctgttagacccctgcaccggcagtacaatcagcgaaactacatccgaggcctggtcagtggaagtacttccatcagactccgaggcccccgatttgaagcaagaggaacggcttcaagagttggaaagttgctccggcttagggagcaccagtgatgacacagacgttcgcgaggtcagctccagacccagtacgcccggacttagcgtggtttctggcatctccgctaccagtgaggatatccctaacaaaatcgaggatctccgttcagagtgctcttccgatttcggagggaaggactctgtgacttctccagatatggacgaaatcacacacggagcccaccagctgacttctccaccttcccagtcagaaagtttactggctatgttcgaccccctttcatcgcacgaaggagcctcagcagtggtccggcccaaggttcactatgcaagacccagccacccacctccggatcctccaatcctcgaaggggctgtaggaggcaacgaagcccgcctgcccaactttggatcacatgtgctgactcctgcggagatggaggcctttaagcagaggcacagttaccccgaaaggttggtacgctccagatcttctgatatcgtatcttctgtgcgccgccctatgtctgacccttcctggaacaggaggccaggtaatgaagaacgtgagctcccccccgctgctgccatcggtgccacctctctcgtggctgccccccactcctccagctcatcacctagtaaggactcatcacgcggcgagaccgaggaaaggaaagattccgatgatgaaaaaagtgatcgcaaccgtccatggtggagaaagcgttttgtgagcgccatgcccaaggccccaattccgtttaggaagaaggaaaagcaagagaaggacaaggatgatcttggaccagataggttttcaaccctgactgacgatccatctccccgcctgtccgcccaggcccaggtagctgaggatatcctggacaaatacagaaacgctatcaagaggactagccctagcgatggcgctatggcaaactatgagtctacgggcgataatcacgatagggacctgagtagtaagctcctgtaccactctgacaaagaagtgatgggagacggcgagtctgcccatgactcccctagggacgaagcactacagaatatttctgccgacgaccttcctgattcagccagtcaggctgcccacccacaggactctgccttcagttaccgtgacgccaagaagaagttacgactcgccctgtgttcggcagattccgtggcattccctgtgcttacccattcaactcggaacggcctgccggaccatacagacccagaagacaatgaaatcgtttgctttctgaaagtacaaattgccgaggccatcaacctccaggacaagaaccttatggcacaactacaagagacaatgaggtgtgtttgcaggttcgacaatcgtacttgcaggaagcttctagcctccatagcagaggattaccgaaaaagggccccttacatcgcttatcttactcgttgtcggcaaggattacagaccacccaagcgcatctggagaggctgttgcagcgagtcctccgcgacaaagaagtggccaatcggtacttcactaccgtatgtgtgaggctacttctggagtcgaaagaaaaaaagattcgggagttcatacaggacttccagaagcttaccgccgccgacgacaagaccgcgcaggttgaagacttcctccagtttctttacggagccatggctcaggacgtcatctggcagaatgcaagtgaagagcagttacaggatgctcaacttgctattgagcggagtgtgatgaatcggatcttcaaactggccttctaccccaatcaagatggggacatcctaagagaccaggttctgcatgagcatatccagcgcctgtcaaaagtggtcacggcaaatcatcgcgccctccaaatccctgaggtttatctcagagaggctccctggcccagcgcccagtccgagatccgaacgatcagtgcctacaaaaccccccgggataaggtccagtgtatactgaggatgtgctccactattatgaatcttctaagtctggccaatgaagatagtgtgcctggggcagacgactttgtgcccgtcttggtgtttgtcctgataaaggccaaccccccctgcctgctgagtaccgtgcaatacatatcgtccttttatgcatcatgcttgtcaggggaagagtcctactggtggatgcagttcaccgccgccgtggagtttatcaagacaattgacgacaggaagtag

SEQ ID NO: 189993 - DNA, 4464 bp, Artificial Sequence
  Description of Artificial Sequence: Synthetic coding sequence
atggtgaagctggacatccacaccctggcccaccacctgaagcaggaacgcttgtacgtaaatagcgagaagcagttaatccagcgattgaatgccgacgtattgaaaaccgctgagaaactctacaggaccgcttggatcgctaaacaacagagaataaacttggatcggttaatcattacgtcagcagaagcatcaccagccgagtgttgccagcacgccaaaatcctcgaagacacccagtttgtggatggttataaacaattaggattccaggagactgcctatggggagtttctctcacgactacgggagaaccctcgcttaattgcaagttcacttgttgccggcgaaaagttgaatcaggaaaacacgcagtcagttatttacacggtgtttacatcactttacgggaactgcataatgcaggaagacgaatcttatctgcttcaggtgctcaggtacctgattgagtttgaattgaaggaaagtgacaacccgcgccgcctgcttcggagagggacttgtgccttctctatactgttcaagttgttcagcgaggggctgtttagcgccaagctgtttcttacagccaccttgcatgaaccaattatgcaactgttggtcgaggacgaggaccatctggagaccgaccctaataaattgattgaacgcttctccccctctcagcaggagaagctgtttggcgagaagggctcagaccgttttagacagaaggtccaggagatggtagagagcaacgaggccaagttggtcgctctggtaaataaattcatcggatacctgaagcaaaacacttactgtttcccacacagcctgcgttggattgtgtctcagatgtacaagaccctttcctgtgtcgacagactcgaggttggagaggtccgggctatgtgcaccgacctgctgctggcttgtttcatttgcccagcggtggtgaaccctgaacagtatggtatcatcagcgatgcacctattaacgaggtagcaaggtttaatctgatgcaggtagggaggctactccagcagctggcaatgactggatccgaagaaggggaccctcgtaccaagtcgtcactcggaaaattcgacaagtcttgtgtggctgctttcctggacgtggtcattggtgggcgtgccgtggagacgccacctctctctagcgtcaacttgctcgaaggcttatcaagaactgtagtgtatattacatattcccagctaataactctggtcaacttcatgaagtcggtgatgtcaggagatcagctccgcgaggatcggatggccctagataatctcttagccaatctgcctcccgccaaacctggaaagagctcctcactagagatgaccccttacaatactccccagctgtcgcccgcgacaactcctgctaacaagaaaaaccgtctgcccattgccacccgcagccggtccagaaccaatatgcttatggatctgcatatggatcacgagggaagcagccaggagacgattcaagaagtgcaacctgaggaagtgttggtgatctccttagggacagggccgcagctgacccctggcatgatgtcagagaacgaagttctgaacatgcagctgtctgatggcggacagggcgacgtgccggtggacgaaaacaaattacatggtaaaccggataaaacgctgagatttagcttatgcagtgacaatttggagggcattagcgagggtccttccaacagaagcaattccgtgtctagcctggacctcgaaggagaatcagtgtctgaactcggcgctggcccgtccggttctaatggcgtcgaggcattgcagctccttgagcatgagcaggctacgacccaggacaatttggatgataagttacgtaaatttgaaatacgcgatatgatgggcctcaccgatgatagagatatatccgaaacagtgagtgaaacctggtccacggacgtgctaggatcagattttgatcccaacatagacgaggacaggctacaggaaatcgcaggggcagccgccgagaatatgctaggctcacttctctgcctgcccggaagtggcagtgtgctgctcgatccatgtactgggtctaccatttccgagactactagtgaggcctggtccgtggaggtcctgccatccgacagcgaagctccggatctgaagcaggaggaacggttgcaggaattggaatcatgttcgggcctgggaagcacgtccgacgacacagacgtgagggaagtctcaagtaggccctcaacgcctggtctgtctgtagtgagcggcattagtgccacaagtgaagacattcctaataaaatcgaagatctgcggtccgagtgctccagtgactttggcgggaaggattcagttaccagtcccgacatggacgaaattactcatgattttctgtatatcttacagccaaaacagcattttcaacacatcgaagctgaggccgacatgcgaattcagctctccagctccgcgcatcagctcactagcccgccgtcccagtccgaatccctcctagccatgttcgatccactgagcagtcacgaaggagcaagcgcggtcgtcagacccaaggttcactatgcgcgaccctctcatccaccgccagaccccccgattctggaaggagcagtgggcggcaacgaggcccgtctccccaacttcggaagtcacgttctcactccagccgaaatggaggccttcaaacaaaggcactcatacccggagaggctggtgcgcagtcggagtagtgacattgtgtcttccgtgagacggcccatgtctgacccatcctggaatcggaggcccggtaacgaagaaagggagctacccccagctgctgctattggggcaacaagcctggtggcagctccccatagttcgtcatcctcacctagcaaagattctagtcggggtgagacagaagaaaggaaagattccgatgatgagaaatccgacagaaacagaccgtggtggcgaaaacgcttcgtgagtgccatgccaaaagcccccatcccttttagaaagaaagagaagcaagagaaggataaagacgacctgggtccagataggtttagtacactgaccgatgacccttcacctaggctttcagcccaggcccaagtcgccgaggatattctggacaagtatagaaatgccatcaagaggacctctccaagtgatggggccatggccaactatgaatcaaccgaagtcatgggggacggcgagtccgcacacgactctccccgcgacgaggcgcttcaaaacatcagtgcagacgacttacccgactcagcgtcccaagccgctcacccccaggactctgcgttcagttatagagacgccaaaaagaagttgcgcctcgccttatgttccgcagattccgtggcattccccgtgttgacccatagcactaggaacggtctccccgaccacacagacccagaagacaacgagatagtctgctttctgaaagtgcagattgcagaagctatcaatttacaggataaaaacctcatggcgcagcttcaggagaccatgaggtgtgtttgtcggtttgacaatcgtacctgccgaaagctgcttgccagtatcgctgaagactaccgtaaaagggcgccatatattgcttatctcactcgttgccgacagggcctgcaaactactcaggcacatctggaacggctcctccaaagagtattacgcgataaagaggtcgccaataggtatttcaccacagtgtgcgtgcgcctgttgctcgagagcaaggagaagaagatcagggagttcattcaggattttcagaagctgacagcagcggacgataagacagcacaggtggaggacttcctgcagtttttgtacggtgccatggcccaagacgtcatttggcagaatgcatccgaagagcagcttcaggacgcccagttggctatagagaggagcgtcatgaatcgtatattcaaactggccttttaccctaatcaggatggagacatcctccgtgaccaggtactccacgaacatatccagcgcctgagcaaggttgtgaccgctaaccaccgagccctgcagatccccgaggtgtatttgagagaggcaccttggccctcggcccaatccgaaatccggactatctctgcctacaagacaccccgagataaggtgcagtgtatcctgcgaatgtgttcaacgattatgaatttgctcagcctggccaacgaggattccgtgccgggtgctgatgactttgtgccagtacttgtttttgtcctgatcaaagctaatccaccgtgtctactttccactgtacagtatatttcttccttctacgcgagctgtctgagcggcgaagaatcctactggtggatgcaatttacggccgcagtggagttcataaagacgatagatgaccggaagtag

SEQ ID NO: 189994 - DNA, 2514 bp, Artificial Sequence
  Description of Artificial Sequence: Synthetic coding sequence
tgaaactgcatcatgcaggaggacgagagctacctgctgcaggtgctgcggtacctgatcgaattcgaattgaaagagtctgacaatccccgaaggctcttgcgaaggggcacctgtgcgttttcaatccttttcaagctcttttctgagggcctgttcagcgcaaaactttttctgaccgccaccctgcatgagcctatcatgcagctgctggttgaggatgaagatcatctcgagacagatccaaacaaactgatcgagagattcagcccatcccagcaggaaaagttattcggagaaaaggggtccgacaggttccgtcagaaggtacaggaaatggtggagtcaaacgaggccaaactcgtcgcactggtgaacaagtttattgggtacctaaagcagaacacctattgtttcccccattccttgcgctggattgtgtcacaaatgtacaagacgctgtcatgtgtggaccgtctggaggtcggcgaagttagggcgatgtgtaccgacctgctcctcgcatgtttcatttgtcctgcggtcgtcaacccagagcagtatggaatcatctccgatgcgcccataaatgaagtggccaggttcaatctgatgcaggttgggaggctgttgcagcaactggccatgacgggcagcgaggagggcgacccccgtaccaaaagttcgcttgggaagttcgacaaatcctgcgtggccgctttccttgatgtggtgataggaggtcgcgccgtggaaaccccacccctttcttctgttaacttgttagaggggctgtccagaactgtagtgtacatcacttatagccagttgatcactctggtaaatttcatgaaatcagtgatgtctggggaccagcttcgagaagaccgaatggccctggacaacttgctcgccaacctcccgccagctaagccaggcaagtcctcttcccttgagatgaccccatataacacacctcagctctccccggcaactacgcctgctaataagaagaaccggctgcctattgctacacgatcacgctctcggaccaacatgctgatggacctacatatggatcacgaaggtagttcacaggagactatccaggaggttcaaccagaagaggtgttggttattagtctgggcaccggcccccagcttacaccggggatgatgtccgaaaacgaggtcctcaacatgcagttaagcgatggtggtcagggagatgttcccgttgatgagaacaagctccatgggaagcccgacaagacccttcgctttagtctgtgctctgataacttagagggcatctcagagggaccctccaataggagcaacagtgtctccagcctggatttagagggcgagagcgtcagtgaactcggggctgggcccagcggttccaacggcgtggaggcactgcagttactagagcacgagcaggccactactcaagataatctggacgataagctgcgaaaattcgagataagggacatgatgggcctcacagacgatagggacatatctgagactgtgtctgagacgtggtccactgatgtgctggggtctgacttcgatcccaatatcgatgaggaccgacttcaggagatcgctggagcggcagctgagaacatgctaggttctctgctctgtttgccgggatccggatcggttctgcttgacccctgtaccggttcaacaatttctgaaaccacctccgaagcctggagcgtcgaagttctcccaagcgattcagaagcccccgacctgaaacaggaggaacgcttacaagagctggagagttgtagcggcctcggcagtacaagcgatgacactgatgtgcgcgaggtgtctagccgcccgagtacccctgggttgtccgtagtgagtggcatttctgctacctctgaagatatcccaaacaaaatagaggacctacgttcagagtgtagctcggacttcggtggaaaagacagtgtcacgagcccggacatggatgaaatcacccatggcgctagcgctgtggtccgccctaaggtccactacgccaggccatcccaccctccaccagatccacccatcttagaaggcgccgtaggtggtaacgaggcccgactcccgaactttggctcccacgtactgacccctgccgagatggaagcatttaagcagcgacacagttacccagaacggctggtgcggtcgaggtctagtgacatagtgtcgagcgtgagaagacccatgtctgaccctagctggaaccggagacccggaaatgaggagagagagttaccacctgcggcagctataggagcaactagccttgtggcagcccctcactcctcctctagcagtccatcaaaggattcctctaggggcgagaccgaagaacgcaaggactcggatgacgagaaaagcgacagaaacaggccttggtggcggaagagattcgtgagtgcaatgccaaaggctccaatacccttcaggaaaaaggaaaagcaagagtag

SEQ ID NO: 189995 - DNA, 2493 bp, Artificial Sequence
  Description of Artificial Sequence: Synthetic coding sequence
tgactgcggcggggcacctgcgccttcagcatcctgttcaagctgttcagcgaaggcttgttctccgcaaaactgttcttgaccgcgactctgcacgagcccatcatgcagcttctggtggaagatgaggaccaccttgaaactgacccgaataagcttatcgagcggttctccccaagtcagcaggagaagctttttggcgaaaaaggatccgacagatttcgtcaaaaagttcaggagatggttgagtccaatgaggcgaaactcgtggcattggttaataagttcatcggttatctcaaacagaatacctactgtttcccccatagcctcagatggatcgtgtctcagatgtacaagactctatcttgcgtggaccgcctcgaagttggcgaggtgcgtgccatgtgcaccgacctgctgctggcgtgttttatttgtccggccgtggtgaaccccgagcagtacgggataatttcggacgctccgattaatgaggtggcaaggtttaatttgatgcaggtgggacggctgctccagcagcttgccatgaccggtagtgaagaaggagatccacgaaccaagtcaagtctcggaaaattcgacaagagttgcgtggcggctttcctggacgtggtgattggcggaagggccgtcgaaactcctcccctttcctcagtgaacctgctagaagggctgtcaagaacagtggtttacatcacttactcccagttgattacgttagttaacttcatgaagagcgtcatgtccggggaccaacttcgagaggacagaatggctctggataacctcctcgccaatcttccgcctgcgaagccaggcaaaagcagtagcctcgagatgacaccctacaatacccctcagctctctcccgccacaacccctgctaacaaaaaaaaccggctgcccatcggacagcagctcgcggctatcacagcatgggacagttcagccaccaatatcactagccacattacagtcgtgacaccattcgcaacgagaagccgatctagaaccaacatgctgatggacctgcatatggatcatgaaggatcatcacaggagaccatccaggaagtccaacctgaggaggtcctggttatctcccttgggaccgggccgcagctcacgccaggaatgatgtccgaaaatgaagtcttgaatatgcagctgtcagatggcggccagggagatgtgccggtcgacgagaataagctacatggaccttctaatcgaagcaacagtgttagcagtctggatctggagggcgaatccgtgtccgagctcggcgcgggaccctcaggcagcaacggagtggaggctctccagctcctggaacatgaacaggccaccacgcaggataatctggacgataagctccgcaaattcgaaataagagacatgatgggtcttactgatgatagagatatctctgagactgttagtgagacgtggtctacggatgtgctgggttcagactttgaccctaatatcgatgaagataggctccaggagatcgccggggctgctgccgagaacatgttgggcagtttgctctgtctccccggttccgggtccgtattgctggacccatgtactggaagcacaatttctgaaacgactagcgaagcctggtctgtggaggtcctgccttcggatagcgaggccccagacttaaagcaggaagaaaggctacaagaactggaatcttgttccgggctgggaagtacttcagatgatacggacgtcagagaggtgagcagcagaccttctaccccgggtttatcagttgtgagtgggatctctgccacgagcgaggacataccaaataagatcgaagacttgaggagtgaatgttcttccgacttcggagggaaagattctgtgacttctccagacatggacgaaatcacccacggtgcccatcaactaacgagccctccatcccagtccgaatctctgctggccatgttcgacccactttcctcgcacgaaggcgccagcgctgtggtcaggcctaaagtccattatgctcggccctcacatcctccaccagatccccctatactggaaggagcagttggcggcaatgaagctaggttacccaactttgggagtcatgtgctgaccccggctgaaatggaggctttcaaacaacggcactcttaccctgagagacttgtccgcagccggagttccgatatagtgagctctgtccgccgcccaatgagcgacccctcgtggaacagacggccgggaaatgaggagcgagagctaccccccgctgcagctatcggggccactagtctcgtggctgccccgcactcttccagctcaagcccttcaaaagacagtagcaggggagaaaccgaagaacggaaggactccgatgatgaaaagagcgacaggaatagaccatggtggcgtaagaggtttgttagtgccatgcccaaagcgccaatcccattttag

SEQ ID NO: 189996 - DNA, 516 bp, Artificial Sequence
  Description of Artificial Sequence: Synthetic coding sequence
atggtgcagtggccccggatgagctacggcaagacccgggtgatgaaccgcatattcaaactggccttttaccccaatcaggatggcgatattctgcgagaccaggttctccacgagcatatccaacgactaagcaaggtcgtgacagcaaaccacagggcgttgcagatacccgaggtgtatctgagggaagccccatggccctccgcacagtcagagattagaactataagcgcatataagacaccacgcgataaggtgcagtgcatactcagaatgtgctctacgataatgaacctcctttctctcgccaatgaagactccgtcccaggagccgacgatttcgtaccggtacttgtgttcgtcctgatcaaagccaaccctccatgtcttttaagcactgtgcagtatatatcgtctttctacgcgtcctgcctctctggcgaagagtcctactggtggatgcaatttacagcagccgtcgaatttatcaaaacgatcgatgatagaaagtag

SEQ ID NO: 189997 - DNA, 354 bp, Artificial Sequence
  Description of Artificial Sequence: Synthetic coding sequence
atggtgaagctggacatccacaccctggcccaccacctgaagcaggagaggctttacgtcaattctgagaagcagctgatccaaagactgaacgcagacgttctgaagactgctgagaagttgtaccgaactgcttggatcgcaaaacagcagcgcatcaaccttgacaggctcatcattacatccgctgaggctagtcccgcagaatgctgccagcacgctaagatcctggaggatactcagttcgttgacggctacaaacaactgggttttcaggaaacggcctatggtgaatttctgtcccgcctgagggaaaacccccggttaattgcctcttctctggtcgccggctag

SEQ ID NO: 189998 - DNA, 2967 bp, Artificial Sequence
  Description of Artificial Sequence: Synthetic coding sequence
atggtgaagctggacatccacaccctggcccaccacctgaagcaggagcgtctctatgttaattcggagaagcagctcatccagaggttaaatgccgacgttttgaaaaccgctgagaagctgtacaggacggcttggattgctaaacaacagcgcatcaacttagatcgcctgattatcacctccgctgaggctagtcccgctgaatgttgccaacatgctaagattctggaagacacccagtttgtcgacggttacaaacagctgggatttcaggaaactgcttacggggagttcctcagccggcttagagagaatccccgcttgattgcttcctcattggtagcaggagagaagttgaaccaagagaacacacaatcggtgatttacaccgtattcacatccctgtacggcaattgtatcatgcaggaagatgaaagttatctgttgcaggttttgcgctaccttattgagtttgagctgaaagagtccgacaacccccggaggttactgagacggggcacatgtgctttcagcatcctgttcaagctcttttccgaaggcctcttttctgctaaactgttcttgacagccactctgcatgagccaatcatgcagctgctggttgaagacgaagaccaccttgagaccgatcccaataaactaatcgagcggtttagtcctagccagcaggagaagctgtttggcgagaaggggtctgaccgctttaggcagaaggtacaggaaatggtcgaatcaaacgaggccaagttggtggcactggtcaacaagttcattggttacctcaaacagaatacctattgtttcccccacagcctcagatggatcgtctctcagatgtataagacgctgagttgcgtggaccgcttggaagtaggggaagtgagggccatgtgtactgacttacttttagcctgctttatttgccctgctgttgtgaaccccgagcagtatgggattatttctgacgctcctatcaatgaagtcgccagatttaacctgatgcaggtggggcgactgctgcagcagttggctatgacagggtctgaggaaggcgacccccgaactaaatctagcctcggaaagttcgataagtcctgcgtagcagccttcctggacgtggttataggggggagagctgtcgagacgccccccctctcgtccgttaatcttttggagggtctgtcacggacggtcgtgtacattacctattcccaattaattaccctggtaaactttatgaaatctgtgatgtccggggaccagctgcgagaggaccgtatggctctggataatttgcttgctaatttaccccctgccaagcccggtaagtcctcctccctggagatgacaccatacaataccccccaactgagcccggccactacccctgccaataaaaagaaccgcctgcctatcgcaaccaggtctcgctctaggaccaacatgctgatggacctacacatggaccacgaaggctctagccaggagacaatacaggaagtccagcccgaggaagttctcgtaattagtcttggcactggcccacagctgacccctgggatgatgtcagagaatgaagtgctcaacatgcagctcagcgacggcggacagggagacgtgcctgtggacgaaaacaagcttcacggtaagcctgacaaaacattgagattcagcctatgttccgacaaccttgagggcatctctgaaggtccatcaaatcgctccaactccgtgtcaagcctcgacctggaaggcgagagcgtatccgaactcggcgctggtccatcaggctccaacggcgttgaggcgctgcagttattggagcatgagcaggctacgacacaggataacctggatgacaaactcaggaagtttgaaatccgggacatgatggggctgacagacgaccgggacatttctgagacagtgtccgaaacatggagcacagatgtgctgggctcagactttgacccgaacatagacgaagatcggctgcaggagattgccggcgcagcagctgagaacatgttaggctcgttactctgtctaccaggtagcgggagcgtcctcctggacccttgcaccgggagtaccatcagtgagacaacttccgaggcgtggtctgtggaagtactaccttcggattcagaggcccctgacctaaaacaggaggagcgcttacaggaattggaatcgtgtagcggactgggcagtacctccgatgataccgacgtgagagaggtctcctcacggccctcgacgcctgggttgtctgtggtctctggaatttccgcaacaagcgaagacatcccaaataaaattgaagatctacggtccgagtgttcctcagacttcggcggcaaggattcagtgacgtcccccgatatggatgaaatcactcacggcgctcatcagctcacctcacctccatctcagtctgagagcctattggccatgtttgaccctctgagctctcacgagggagcctccgccgttgttcgccccaaggtgcattatgcccgtccgtcccatccccccccggaccccccaatcctcgaaggagccgttggggggaacgaagccaggttgccaaattttgggtctcacgttctgacaccagccgagatggaggccttcaaacaacgccacagctaccccgagagactcgtgcgatcacgcagctctgacatcgtctcctccgtgcggagacctatgagtgacccctcctggaaccgacgccctgggaacgaggagcgggagcttcccccagccgctgcgataggggccacctcgttagtagcggctccccacagcagctcatccagccccagcaaagacagtagcagaggagaaaccgaagagcgcaaggacagtgacgatgagaagtccgacagaaaccgcccttggtggagaaaacgattcgtgagtgcaatgcccaagtag

SEQ ID NO: 189999 - DNA, 4437 bp, Artificial Sequence
  Description of Artificial Sequence: Synthetic coding sequence
atggtgaagctggacatccacaccctggcccaccacctgaagcaggagagactgtatgtgaattctgaaaagcagctgatccagcggctgaatgccgatgtccttaagacagcagagaagctctacaggacagcctggatcgccaagcagcagaggatcaatctggacaggttaataatcacctcggcagaagcatcaccggctgaatgttgccagcacgccaagatcttagaagacacccagtttgtcgacgggtataagcagcttggctttcaggagacggcttacggtgaattcttatctcgacttcgagagaatccaagacttatagcttcttcactggtagcgggcgaaaaattgaaccaggaaaatacccaatccgtcatctatacggtgttcacgtcgctgtatggcaattgcattatgcaagaagacgaatcgtatttattgcaggtgcttcggtatttaatagagttcgagctgaaagagagtgacaatccacggcgactgcttcgacggggcacttgtgccttttctattctgtttaagctgttcagcgagggactgttttcggccaagctcttcctgaccgcaacattacatgagccaattatgcagctgctcgtggaagacgaggatcatcttgagaccgatcccaacaaactgattgagaggtttagccctagccagcaggagaaattatttggagagaaggggtcagacagatttcggcagaaagtccaggagatggtggagtccaatgaggccaaattagttgcattagtcaacaaattcattggctacttaaagcagaacacatactgtttcccacactcattaagatggatcgtttctcagatgtacaagactctttcttgcgttgatcgccttgaggtgggggaggttcgcgccatgtgtaccgatcttctcctcgcctgctttatttgtcctgccgtggtgaatccagaacagtatgggatcatctccgacgcacccatcaacgaggtggcacgtttcaatcttatgcaggtaggcaggcttctgcagcagctcgcaatgactggttctgaagagggagaccctcgcactaaaagcagtttgggaaagttcgacaagtcctgtgtggccgctttcctcgacgttgttattgggggaagagcggtggagactccccccctttcctccgtgaacctgctcgaaggccttagccgaaccgtagtttacatcacgtacagtcagcttatcacactcgtgaatttcatgaagtccgtgatgagcggtgatcagctgagagaagatcgtatggccctcgacaacctcctggctaatctgcctcccgcaaagccaggcaaaagctcttctcttgagatgacgccttataatacgcctcaattatcgcctgctactacaccagctaacaaaaaaaaccgtctgcccattgccactagaagcaggtctcggactaatatgctcatggacctccacatggatcacgaggggagctctcaggaaacgattcaagaggtgcaacccgaagaggtgcttgtgatctctcttggcacagggccacagctgactcctggaatgatgtctgaaaacgaggtgctcaatatgcagctctccgatggaggccagggagatgttcccgtcgacgagaacaagctgcatgggaaaccagataaaaccctccgattttccctgtgctccgataatctcgaaggcatcagtgagggacccagcaaccgtagcaacagtgtaagcagcctcgacctagagggcgaaagcgtaagcgagttgggcgccgggcctagcggcagcaacggggtcgaagccctccagctactcgagcacgaacaagccacgacccaggacaatctggatgataaactgaggaagttcgagattagagatatgatgggcctcacggatgaccgggatatttcggagacggttagcgaaacttggagcactgatgtgctaggatccgacttcgacccaaacattgatgaagataggttacaggagatcgccggagccgctgccgaaaacatgttaggctcgctgctgtgcctgcccggcagtgggagcgttctcctggacccttgcactggctcgacgattagtgagacgaccagcgaagcttggagtgttgaggtattacccagtgattccgaagcccctgatctgaagcaggaagagcggttacaagagttggagagttgctccggactcggctccaccagtgacgacaccgatgttagagaggttagctctaggccctcaactcccggcctcagcgtggtgtcagggattagtgccacatctgaggacattccaaataaaatagaagacctgcggtccgagtgttccagtgattttggtggcaaagactccgtgacctccccggacatggatgagattacccacggggctcaccagctcacctcgccaccaagtcaatctgaaagccttttggccatgttcgaccctctgtctagccacgagggagctagtgctgtagtcagaccaaaagtccattacgcaagaccttcccatcctccaccagaccctccaatcctggaaggcgccgtgggaggcaacgaagctcgtcttcctaattttgggtcccacgttctgacccctgcggaaatggaagccttcaagcagcgccattcttaccctgagaggctcgtgcggagccgcagctccgatattgtttcatccgtgcgaaggcctatgagtgacccatcctggaatcgtcgccccggtaacgaggaaagggagctgcccccggcagccgccatcggggctacttccctggtggcagcaccccattctagcagctctagcccttccaaggatagctctagaggggagactgaggagcgcaaagatagcgacgacgagaagtcagaccgcaatcgaccctggtggcggaaacggtttgtgtctgccatgcccaaggctcctataccgttccggaagaaggaaaagcaggagaaagacaaggatgatctggggcccgataggttctcgacccttaccgacgatccttcgccaaggttatccgctcaggcccaggtcgccgaggacatactggataaatacagaaatgcgatcaaacgcacttcaccctcggatggagcgatggccaattatgagagcaccggcgataaccacgatcgcgatctttccagtaaactcctgtatcactcagacaaggaggtgatgggggatggggagtccgcccacgattcacctcgtgacgaggctctgcagaatatctcagctgatgacctgccagactccgctagccaggccgcccatcctcaggattccgccttctcttaccgcgatgccaagaaaaagctcagactcgccctgtgcagcgccgactcggtcgccttcccagttcttacccacagcacccgcaacggactgcccgatcacaccgatcctgaggacaacgaaatcgtgtgcttcctcaaagtgcagatcgctgaagccattaacctgcaggataagaatttaatggcacaactgcaagagactatgagatgtgtgtgccgcttcgataacagaacctgccgtaaactgttggctagtattgctgaagattatcgcaagagagccccttacattgcttatctgactcgttgcaggcagggattacagacaacgcaggcccatctggaacggttgctgcaaagagtccttagagacaaagaggtggccaacagatattttacaactgtttgcgttaggctcctcctggaatctaaggaaaagaaaattagagaatttattcaggatttccaaaagctcaccgccgctgatgacaagacagcccaggtggaggatttcctacagttcctctatggggctatggcccaggacgtcatatggcaaaatgccagcgaagaacagcttcaggatgcacaattggctattgagagatccgtgatgaaccggatctttaaactggcgttttacccaaaccaggacggagacatccttcgggatcaggtactgcatgaacacattcaacggctgtctaaggtggtgacagcaaaccaccgcgcgctccaaatccctgaagtataccttcgtgaggccccatggccctccgcccaatctgagatcagaacaatctcagcttataagacaccccgagataaagtccagtgtatcttacggatgtgcagcaccattatgaatctgttgtccttagcaaatgaagactccgtgcccggggctgatgacttcgtgccagtgctggtgtttgtcctgatcaaggctaaccccccctgtctgctgtcaactgtgcaatatatcagcagtttctatgcgagctgcctgtcaggcgaagagagctactggtggatgcagttcaccgcagcagtagaatttatcaagacgatcgacgataggaagtag

SEQ ID NO: 190000 - DNA, 2271 bp, Artificial Sequence
  Description of Artificial Sequence: Synthetic coding sequence
atggtgaagctggacatccacaccctggcccaccacctgaagcaggaaagattgtatgtgaattccgagaaacagctcatccagcggcttaatgcagacgtgttaaagactgcggagaagctgtacagaaccgcttggatcgctaaacagcagcggatcaacctggatcgcctgattattaccagtgctgaagcctcacccgcagagtgctgccagcacgcaaagatcctcgaggatactcagtttgtcgatggttacaagcagctggggttccaagagaccgcatacggcgaattcctgagtagactgcgagagaatccacgcttgattgccagcagcctggtcgctggcgaaaaactcaatcaggaaaacactcagtcagtgatatacacggtgttcacatccctctatggaaattgcattatgcaggaagacgagagctacctacttcaagtccttaggtacttgattgagttcgagctgaaggagtcagacaatccaaggaggctgctacggagaggcacttgcgccttctccattctgttcaaactcttctccgaaggcttgtttagcgccaaattgttcctaacggccacattgcacgagcctattatgcagctgctcgtagaggatgaggaccacctcgagacagatcctaataaacttatcgagcggttcagtccgagccagcaagagaagcttttcggtgagaaggggtcagatcgctttcgccagaaagtgcaagaaatggtggaaagcaatgaggctaagctggtcgccctggtgaacaagttcattgggtatctgaagcaaaatacctactgttttccacacagcctccgctggattgtaagccaaatgtacaaaacactgagttgtgtggacagactcgaggtcggtgaggtgagggctatgtgtactgacctgctgctcgcatgcttcatctgccccgctgttgtgaatcccgagcagtatgggataataagcgacgctcccattaatgaggtggctcgctttaatttgatgcaggtaggcaggctactccagcagctagcaatgacaggctcagaggaaggcgacccccgcacaaagtcctccttagggaagtttgataagtcttgcgtggctgcattcctcgatgtcgtaattggcggtagagcagtcgagacccctcccctgagttctgtgaatctcctcgagggcctctcacgcacagtggtgtatatcacgtacagccagttgataacactcgtaaactttatgaaaagcgtcatgagcggggaccaattacgggaggatcgcatggcattagataacttactggccaatcttcccccggcaaaaccagggaaatcttccagcttagagatgacaccatacaatactccgcagttatcacctgccaccacccccgcgaacaaaaagaataggcttccaatcgcaacgcgctctcggagccggacgaacatgttgatggaccttcatatggatcacgaaggctcgagtcaggaaactatccaagaagtgcagccagaagaagtgctggtcattagcttaggtaccggacctcaactgactccaggtatgatgtccgagaatgaggtgctgaatatgcaactctcagacggaggtcaaggcgacgttcccgtggatgaaaataaattgcatggaaagcccgacaaaacattgaggttctctctttgctccgacaatcttgaaggcatatccgaggggccctccaaccgctccaatagcgtgtcaagcctggatctggagggcgaatctgtaagtgagcttggggcaggtccaagcgggtctaacggcgtggaagccttgcagctgctggaacacgaacaggcaacaacacaagataatctggacgataaactacgaaagtttgaaatcagggatatgatggggctaaccgatgacagggatatctccgagacagtttcggagacgtggtcgacagacgtgctcgggtcggactttgaccccaatatcgatgaggaccgcctacaggaaattgcaggcgcagccgcagagaatatgctgggatccctgctttgtctcccgggctctgggtcggtgttgctcgacccgtgcaccggctctaccattagtgagaccacctcagaagcctggtcagtcgaggttctcccttctgactctgaagctcccgacctgaagcaggaagaacggctgcaagagctcgagagctgctccgggctggggtccacgtccgatgacacagatgtgcgcgaggcttag

SEQ ID NO: 190001 - DNA, 921 bp, Artificial Sequence
  Description of Artificial Sequence: Synthetic coding sequence
atgggcggccggaagatggccaccgacgaggagaacgtgtacggccttgaggagaacgctcagtcacggcaggagtctacacgtagactcattctggtcggcagaactggtgccggaaaatcagcgactggcaactccatcttgggacagaggcggttcttcagtcgattaggcgccacctccgtcacgcgggcctgtactacagggtctcgacgttgggacaaatgccatgtggaggtggtcgatacccctgacatcttttccagccaggtcagtaaaactgaccctggctgtgaggagagaggacattgctacctgcttagcgcacccggccctcacgcactgcttctggtgacccagctcggaagatttaccgcacaggatcagcaggccgttcgccaggtacgtgatatgtttggtgaggacgtgctcaaatggatggtcattgttttcacaagaaaggaggatctcgcgggggggtcactgcacgattacgtatctaatacagaaaatagagctctgagagagttagtggctgaatgtggcgggcgagtatgcgcatttgataatcgcgcgactggaagagagcaagaagcccaggtggagcagcttctgggcatggtggaagggctggtgctagaacataagggggcacactacagtaatgaggtttatgaattagcacaagtgctgaggtgggccggcccagaagaaagactgcggcgggtcgctgaacgggtggcagctagggtgcagcggagaccatggggcgcctggttgtcagcaagactgtggaaatggttgaagtcgcctcgaagctggcgtctcggcctggctctcctgctggggggcgctctccttttctgggtgctgctgcaccgtagatggagtgaggctgtagccgaagtgggccctgattag

SEQ ID NO: 190002 - DNA, 681 bp, Artificial Sequence
  Description of Artificial Sequence: Synthetic coding sequence
atgagctgggtgcaggccgccagcctgatccagggccccggcgacaagggggacgtgtttgatgaagaggcagacgagagcctgttagcccaaagagaatggcagagcaacatgcaacgcagagtcaaggagggctatcgggacggtatcgatgctggaaaggctgtgacccttcaacaaggatttaaccagggctataagaagggagctgaagtaatcttgaactacgggcggctcagaggaaccctgagtgcgctgctctcttggtgccatctgcacaacaacaactcgacactcatcaataaaatcaataacctgttggatgcagtgggtcagtgcgaagagtatgtacttaagcatctcaaatctataacccctccttctcacgtcgtggaccttctggacagtatcgaggacatggacctgtgccatgtcgtgccagccgaaaagaaaattgatgaggcaaaggacgagcgcctttgtgagaacaatgccgaatttaataagaactgctcaaaatctcattccggcattgattgctcctatgtggaatgttgtcgcacacaggagcatgcccattccgaaaacccttcccccacttggattttggaacagacagcctccctggtgaagcagctggggctcagcgtggatgtcctgcaacatttaaagcaactgtag

SEQ ID NO: 190003 - DNA, 990 bp, Artificial Sequence
  Description of Artificial Sequence: Synthetic coding sequence
atggccgcccagtacggcagcatgagcttcaaccccagcacccccggggcgagctatggtccaggtcggcaggagccccggaatagccagctgaggattgttctggtggggaaaaccggggcgggaaagtccgccactgggaatagtatattggggcggaaagtcttccacagcggaacggccgcgaagtcaataaccaaaaagtgcgagaaacgctctagttcttggaaggagacggagctggtcgtggtggatactcccggcatcttcgatacagaagtgcccaatgccgagacttcaaaagagattattcggtgtatacttctgacatcaccaggcccacacgcattgctgctggtggtgcccctcggacgttatacggaggaggaacataaggccaccgaaaaaattttaaaaatgttcggagagagagctcgtagcttcatgatcttgatttttacgcggaaggatgatctgggggacactaacctacacgactacctccgggaggccccagaggacatccaggatctgatggacatctttggggatcgctattgcgccctcaataacaaggccaccggggccgaacaggaagcacagcgcgcacagctcttaggcctgatacagagagtagtgcgggaaaacaaagagggatgttacacaaatcggatgtatcagcgtgccgaagaggaaatccagaagcaaacccaggctatgcaagagttacaccgagtcgagctggaaagggagaaggcccggatcagagaagagtatgaagagaagatccggaagcttgaagacaaagttgaacaggaaaagcgcaaaaagcagatggagaagaagctagccgagcaggaggcccactacgccgtcagacagcagcgggcaagaacagaagtcgagtcgaaagacggaatcctcgagctcataatgacggccttacagatcgcctcattcattctcctgcgtctctttgctgaagactag

SEQ ID NO: 190004 - DNA, 786 bp, Artificial Sequence
  Description of Artificial Sequence: Synthetic coding sequence
atggccgcccagtacggcagcatgagcttcaaccccagcacccccggggcaagttacgggcccggccgccaggagccgcggaatagtcaacttaggatcgttctcgtcggtaagaccggtgcaggcaaaagcgctaccggcaacagcatcttaggacgcaaagtgtttcactccggcacagccgcgaagtcgataaccaagaagattctgaagatgttcggagaacgcgccagatccttcatgatacttatctttacacggaaggacgacctcggagataccaatcttcatgactatctgcgtgaggcacccgaggacatccaggatttaatggacatctttggcgacaggtactgtgcccttaacaataaagccacaggggcagaacaagaagcccaaagagcacagctcctcggcttaatccagcgagtggtacgagagaataaagagggctgttataccaatcggatgtatcagagggccgaggaggaaatacagaaacagacacaagccatgcaagagctacatagagtggaattggagcgggagaaagccaggatacgagaggaatacgaggaaaaaatccgtaaactcgaggataaagtcgaacaggaaaagaggaagaaacagatggaaaagaaactcgccgaacaggaggcccattacgccgtgcggcagcagcgggcgaggacagaggtcgagtctaaagatgggattctcgagctgataatgaccgccctgcagatcgcctcttttattctgctccgtctctttgcagaggactag

SEQ ID NO: 190005 - DNA, 456 bp, Artificial Sequence
  Description of Artificial Sequence: Synthetic coding sequence
atggccgcccagtacggcagcatgagcttcaaccccagcacccccggagcctcatacggcgaacgggcattctcagctccccagactaggctgcagggcggccccggtcggcaggaacccaggaattctcagctcaggattgtcctggtgggaaaaactggcgctggcaagagcgctacgggcaacagtatcttggggcggaaggtcttccatagtgggaccgccgctaagagcatcactaagaaatgcgaaaagcgaagctccagttggaaggagaccgagttagtggtcgtggacacgcccggcatttttgacactgaagtaccaaatgctgagacctctaaggagattatccgatgtatactcctgacgagccctggaccgcatgctcttctgctggtggtgccgctgggcaggtacaccgaagaagaacataaagctaccgagaaaatctag

SEQ ID NO: 190006 - DNA, 924 bp, Artificial Sequence
  Description of Artificial Sequence: Synthetic coding sequence
atgggcggcttccagcggggcaagtacggcaccatggccgagggcagatccgaagataacctctccgctaccccccccgccctgcggatcatactggtaggcaaaacgggatgtggcaaatctgccacgggaaattcgattctgggccagcccgtttttgagtcaaagctcagagcccagagcgtgacccgtacatgtcaggtgaaaactgggacctggaacggcaggaaggtgctggtggtcgatacaccctccatcttcgaaagccaagcagatacacaggaactgtataagaatattggcgactgctatttgctgagcgcccccgggccccacgtgttgctcctggtgatccagttaggtcgcttcactgcccaggacaccgtggccatcagaaaggtcaaagaagtgttcggaactggcgccatgagacatgtcgtgatcctctttacacacaaggaggatcttggtggccaggcgctggacgactacgttgccaacacagacaactgttctctgaaggatttggtgcgggagtgtgaaaggagatattgtgctttcaataattggggctcagtcgaagagcagaggcaacagcaagctgaacttctcgccgttatcgagagactcggcagggaaagggaggggtcgtttcactccaatgacctcttcctggacgcccaactgctgcagcgtacaggcgcaggggcatgccaggaagactaccgtcagtatcaggcaaaggttgagtggcaggtcgagaagcacaagcaggagctgagagagaacgagtctaactgggcttataaggctttactgcgcgttaagcacctaatgctcttacattacgagatctttgtgttcctgctgctgtgctctatcctgttttttattatatttctctttatcttccactacatttag

SEQ ID NO: 190007 - DNA, 1032 bp, Artificial Sequence
  Description of Artificial Sequence: Synthetic coding sequence
atggagctgagcgcccccgcccacggcagcagcctgaccgccagcgctcagccaccttcagtgacggctaccctggaggatcgggcccagcaaccgtttctggagaggatgggtggtttccaaaggggcaagtacgggactatggccgaggggagatctgaggacaatctaagcgcaacccccccagcgcttaggatcattctagtagggaagacggggtgtggcaagtctgccactgggaactctatcctcggccagcccgtgttcgagtctaaactgagagctcagagcgtgaccagaacctgccaggtaaagactggcacatggaatggtcgcaaggtgttggtggtagataccccatcaattttcgagtcacaggccgatactcaggaattatataaaaacatcggagactgctacttgctaagtgctcctgggccccacgttctgttgctcgtgatacaactggggcggtttactgcacaggacaccgtagctatccgaaaagtaaaagaagtctttggcacaggcgctatgcgacacgtggtaatcctgtttactcacaaagaggaccttggcgggcaggctctagacgattatgtggcgaacactgacaactgctctctgaaggatctcgtcagagaatgcgagagacggtattgtgctttcaacaactggggatccgtggaggaacaacgacaacaacaggccgaactactggcagtcattgagcggcttggacgtgagcgcgaaggctcttttcacagcaacgatcttttcctggatgcacagttactccaaagaactggtgctggcgcttgtcaggaggactaccgccaataccaagctaaggtggaatggcaggtagaaaaacacaaacaggagctgagggagaatgagagcaattgggcttacaaggccctcctgcgcgtcaagcacttaatgctccttcattacgagattttcgtgttccttctgctttgtagcatactcttttttattatattcctgttcatcttccattacatatag

SEQ ID NO: 190008 - DNA, 879 bp, Artificial Sequence
  Description of Artificial Sequence: Synthetic coding sequence
atggaggaggaggagtacgagcagatcccccaggagaacccccccgaggaacttagtcaggatccagtactggagttgagcgggggcctgcgcgaaaaggaacaaaaaactcccaggaggctgaggttgatactcatgggaaagacaggaagcggtaaaagcgctaccgggaattctattctcggtcgcgatgtgtttgaatcaaaattgagcaccaggcctgtgactaagacctcccagagaagatcccgcgaatgggccggaaaagagctagaagtgatcgatacacctaatatcctgagtcctcaggtttcacccgaagtggccgatgccatttgccaggcaattgtgctctccgctcctggacctcacgccgtgctcttggtaacccagctcgggagatttaccgacgaagatcagcaagtggtccggcggctgcaggaggtattcggagtgggtgtcctcgggcacacaatactggtgttcacgcgcaaagaggacctggctggcgggagcctcgaggattatgtaagggaaacgaataaccaggcgctcgcctggttggacgtaaccctcgcgcggcggcactgcggttttaataaccgtgcgcaaggcgaggaacaggaggcccagttgagagaactgatggagaaggtggaagccatcatgtgggaaaatgagggggattattattccaataaggcatatcagtacacgcagcagaacttccgactcaaagagctgcaggagcgccaggttagtcaaggccaaggttccgaggacgtgcccggggaggagtcctggctcgagggtctaagccagattcagaaggagtcagaagaagcccatagatgcctcctgggcaaagccgatctttag

SEQ ID NO: 190009 - DNA, 1062 bp, Artificial Sequence
  Description of Artificial Sequence: Synthetic coding sequence
aagccctggtactgggtgagctggtgcagcatcggccaggtgagcctgttcttcttgggcagcgcacttgcactcggagaaaacgtgcaaccccatctgcaaggctgtgggcccagaatggtggcccaacggtggtttcaggggagatgttggtcctttacaatctgcccatgttccctgggagtgcacccagaggcgcccggtgacgacaagatgggctacatggggccctaccccagcagtctgtgcttcctgtggattttcctggggctcagggagaaagaacagaagacgccacgccggctccgactgatattaatgggcaagaccggcagcggcaaaagtgccactggaaacagtatcttgggcagggatgtatttgagtcaaagctgtcaaccaggcctgtcaccaaaacatcacagaggcgatcaagggagtgggccggaaaggagctggaggtaatcgatacccccaacattttgtccccacaagtgtccccagaggtagccgatgccatttgccaagccatcgttctaagtgcacctggacctcatgccgtcctgctcgtcactcagttgggacgattcaccgatgaggaccagcaggttgtacgcagactacaggaagtatttggggtcggggtgctcggtcataccattttagtattcacccggaaggaggacctggctggcggcagcctcgaagactatgtgcgcgagacaaacaaccaggccctggcctggctcgatgtgaccctggccagacggcattgtgggtttaataatcgggctcagggcgaggaacaagaagcacagctgcgcgaactcatggaaaaagtcgaagcaatcatgtgggagaatgaaggagattactactctaataaggcttatcaatacactcaacagaactttaggctcaaagagctgcaagagcgccaagtgtctcagggacaggggagtgaagatgttcccggcgaggagagctggctggaaggcttgtctcaaattcaaaaagagtcagaagaagctcacaggtgtctcctgggaaaagccgatctctag

SEQ ID NO: 190010 - DNA, 189 bp, Artificial Sequence
  Description of Artificial Sequence: Synthetic coding sequence
atggaggaggaggagtacgagcagatcccccaggagaacccccccgaagagctgtcacaggatccggtcctagaactctcgggaggccttgcaagaggggggcggaggtacttgcctagtcatcggcttataagaccacgcgcacctaggagggccccaggcgacaccaccggaccggttcacggctag

SEQ ID NO: 190011 - DNA, 1266 bp, Artificial Sequence
  Description of Artificial Sequence: Synthetic coding sequence
atgcggtggatcctgttcatcggcgccctgatcggcagcagcatctgtggacaagaaaaattcttcggagatcaggtcttgaggataaacgtcagaaacggcgatgaaatcagtaagctgtcgcagttagtgaactcgaacaatctgaagttgaatttctggaagtctccgagcagttttaacagacctgttgatgtgcttgttccttccgtgtcgctgcaggcattcaagtcttttctcaggtcacaggggttggaatacgccgtgaccatcgaggatttacaggccctgcttgataatgaggacgatgagatgcagcacaacgagggccaagagaggtcctctaataacttcaattacggagcttatcatagtctggaggctatctaccatgagatggataacatagcagctgattttcccgatttagcgcgaagggtgaaaattgggcacagctttgagaatagacccatgtacgtgttgaagttctcgaccgggaagggcgtcaggcgtcccgccgtgtggctgaacgcgggcattcattctagagagtggatttcacaagcaacagccatctggactgctaggaagattgtgtcagattaccagagggacccagcaatcactagcattctggagaagatggacatttttctcctgcctgtcgccaacccagacggttatgtgtacactcagacacagaaccggctttggcgcaaaacgaggagccggaatcccgggagttcctgcataggcgctgacccaaaccgaaattggaatgcctcattcgcgggtaagggggccagcgacaatccctgctctgaagtgtaccacggtcctcacgccaactccgaagtggaggtcaagtccgtggtggactttattcagaaacatggcaacttcaagggattcatcgacttacactcttactcccagctgctgatgtacccctatggatactcagtaaagaaagccccggatgcagaagaactcgataaagtcgcaagactagcagcgaaagcactggccagcgtttccggtacagaatatcaggtgggccctacttgtaccacagtgtaccctgcatcaggatcaagtatcgattgggcgtacgacaacggaatcaagtttgcgttcacttttgagttaagggacactggtacgtatggattcctgcttcctgccaatcagataatccctaccgccgaggaaacctggttgggattgaaaacaattatggaacacgtgcgcgacaatctctactag

SEQ ID NO: 190012 - DNA, 927 bp, Artificial Sequence
  Description of Artificial Sequence: Synthetic coding sequence
atggtgcactgcagctgcgtgctgttccggaagtacggcaacttcatagataagctgagactctttaccaggggcgggtctggtggcatggggtatccccgactgggaggagagggcggaaagggcggtgatgtgtgggtggttgcccagaacaggatgaccttaaagcagcttaaagaccgctacccgagaaagagatttgtggcaggagtcggggcgaactccaagttccccaacgctggcaaatcatcgctcctaagttgtgttagccacgctaagcctgctattgcggattatgcctttactactctgaagccggagctggggaaaatcatgtactccgacttcaagcagatcagcgttgccgacctgccaggcctgatcgaaggtgcccacatgaacaaagggatgggccataagttcctgaaacatatcgaaagaacaagacagttgctgtttgttgtagacatttccggttttcagttgagctctcacacacagtaccgaaccgctttcgagactattatactcttaactaaggagttagagttgtacaaagaggagcttcagaccaaaccggcgttactggcagttaataagatggatctgcctgacgctcaggataaatttcacgaattgatgtctcaacttcagaaccctaaagacttcttgcatctgttcgaaaaaaatatgatccccgagcgaaccgtggaattccagcacatcattccaattagcgccgtgaccggtgagggaatagaggagctgaagaactgcatcagaaagagccttgatgaacaggccaatcaggaaaatgacgcccttcacaagaagcagctgctgaatctgtggattagcgataccatgtcttctactgaaccaccaagcaaacatgccgttaccacctcgaagatggacattatctag

SEQ ID NO: 190013 - DNA, 711 bp, Artificial Sequence
  Description of Artificial Sequence: Synthetic coding sequence
atgagcgcccccagcgccacccccatcttcgcccccggcgagaactgttcccccgcctggggcgcggccccggcagcctacgatgctgccgacacgcacttgcgcattctgggcaagcccgttatggagaggtgggagactccatatatgcatgccttagccgctgctgcgagtagtaagggaggaagagtgttggaggttgggtttggcatggcgatcgctgcgagcaaggtgcaagaggcccccatagacgaacattggattatcgaatgtaacgacggcgtattccagagactgcgggattgggcacccaggcaaacgcacaaagtaatacctcttaaaggactctgggaggacgtggcgccaaccctgcccgatggccattttgacggtatactctacgatacatatcctttgtccgaagaaacctggcacacgcaccagttcaatttcataaaaaatcacgcctttaggctgttgaagccagggggggtgctaacttactgtaatctgacttcttggggggagctgatgaaatccaagtactctgacatcacaatcatgttcgaagagacccaggtcccagcactcttggaagccggtttccgtagggaaaatattcgcacagaagtgatggccttggtgccgccagcagattgccggtattacgcatttcctcagatgataacgcctctggtgacaaaaggttag

SEQ ID NO: 190014 - DNA, 810 bp, Artificial Sequence
  Description of Artificial Sequence: Synthetic coding sequence
atgagcgcccccagcgccacccccatcttcgcccccggcgagaactgcagccccgcatggggggcagctcccgccgcctacgacgccgccgacacacacctaaggatactcgggaaacctgtaatggagagatgggaaaccccttatatgcacgcattggctgctgccgcttcatcaaaggggggtcgggtgttggaagtggggttcggaatggctatcgccgcctccaaggtccaggaggcccccatcgacgagcattggattatcgaatgtaacgacggtgtgtttcagaggctcagggattgggcgccacgccaaacccataaagtcatacccctgaaaggactctgggaggacgttgcgcctaccctacccgatggacatttcgatggcattctctacgacacttatccactgtccgaggaaacctggcatacacaccaattcaacttcattaagaaccacgccttcagactattaaagccgggcggtgttttgacttattgcaatctgaccagctggggggaactgatgaagtccaaatatagcgacatcacaatcatgtttgaagttcggccccccgaagtcccacacgggtcacccggttcagatctgggatggggctgggagggtgctgccggcgccaccctgctgcctggggaagggccgttcctcacaccgtgggtgggctggacagtgttggtgcatcttgaaattaaggtgctatgtcttgcacagtggttacccggcgccgttgctcaagtttacaacccctctactgtcgaggggaggggtggacagatcgcctag

SEQ ID NO: 190015 - DNA, 1416 bp, Artificial Sequence
  Description of Artificial Sequence: Synthetic coding sequence
atgtgcgccgcccagatgccccccctggcccacatcttccggggcacatttgttcactcaacgtggacctgtcctatggaggtgctaagagaccacctgctcggggttagtgactcaggcaaaattgtattcttggaagaggcttctcagcaggaaaagctcgccaaggaatggtgctttaaaccatgcgagatccgggaactgtcccaccatgaattcttcatgcctggactagtggacacccacatccacgcatcacagtattccttcgccgggtcctctattgacctgccattgctggagtggctcaccaagtataccttcccggcagagcataggttccaaaatatcgactttgcagaggaggtctacacgcgcgtcgtcagacgcaccctcaagaatgggacaacaaccgcctgttactttgctaccatccacacagatagttccctcctattggccgacattaccgataagtttgggcaacgagcctttgtgggcaaagtgtgtatggacctcaacgatacgtttcccgaatacaaagaaacaaccgaggagagcataaaggaaacggagaggtttgtgtctgagatgctccagaagaactacagccgggtgaagccaatcgtcacgccccgtttctccctatcttgtagcgagaccctcatgggggagttaggcaacatcgcgaagacacgtgacctgcatattcagagccacatcagtgaaaatagggatgaagtcgaggccgtcaaaaatttatatccctcctacaaaaattatacaagtgtctacgacaaaaataacctgctgactaacaaaacagtgatggctcacggctgctacttatcagccgaagaactgaatgtgttccatgagcgaggggcgtccatcgcccactgtccgaatagtaacctgtctctttctagtggatttctgaatgtcctggaagtacttaagcatgaggtgaagatcggtcttgggacggatgtggcaggagggtatagctactcgatgcttgatgcgatcagacgcgccgttatggtgtctaacattctactcattaacaaggtgaacgaaaagtctctcactctgaaagaagtcttccggctggctacactgggcggttcccaggccctgggactcgacggagagatcggaaattttgaggttggaaaagaatttgacgccatccttattaatcccaaagcttccgattccccaatcgatctgttttatggagacttcttcggggacatatcggaagccgttattcagaaattcctgtatctgggagatgacagaaacatagaggaagtgtatgtgggcgggaaacaggtggtgcccttctcctcttcagtgaaagagacaatacatctgcccgcctcatcaccacacccgcctcctttcccctag

SEQ ID NO: 190016 - DNA, 1365 bp, Artificial Sequence
  Description of Artificial Sequence: Synthetic coding sequence
atgtgcgccgcccagatgccccccctggcccacatcttccggggcacgttcgttcatagcacatggacttgtcctatggaagtgcttcgagatcacttgctcggcgtgtccgatagcggcaaaattgtgttccttgaggaggcatctcagcaagagaagctggctaaggaatggtgcttcaaaccctgtgaaatccgggagctgtctcaccacgaattctttatgcccggcctcgttgacacccacatccatgcctcccaatactcttttgccggtagctcgattgatctgccactgctcgagtggctgaccaagtataccttcccagcagagcatcgatttcagaatatcgattttgctgaagaggtttacacacgagtggtgaggagaaccctgaaaaacggaacgactactgcctgctatttcgctacaatccataccgacagctcactgctgctggctgatatcaccgataagtttggtcagagggcttttgtggggaaggtgtgtatggacctaaacgacaccttccctgagtacaaagagacaactgaggagtcaattaaggagactgaacgctttgtcagcgagatgctccagaagaactactcccgagtgaaacccattgttactccgcgtttctcactgagctgttccgagaccctcatgggcgaattggggaacatcgcaaagacacgggaccttcacatccaatcccatatcagcgagaatcgtgacgaagtggaagctgtgaagaacctgtaccccagctacaagaactacacatctgtttacgacaagaataacctgctgacaaacaagactgtgatggcccacggatgttacctcagcgccgaggaactgaatgttttccacgagcggggtgcttcgatcgctcattgccctaactccaacctcagcctgtcatctggcttcctgaacgtcctagaggtgcttaaacacgaggttaaaattggcctcggtacagacgtggccggcggatactcctacagcatgttggatgcgatccgacgagccgtgatggttagtaacatcttgctgattaacaaagttaacgagaaatcccttaccctgaaagaggtatttaggctggccaccctggggggatcccaagctctgggtttagatggtgaaattggaaactttgaggtgggcaaggagtttgacgccattctgataaaccccaaggcttccgattcaccaatagatctcttctatggcgatttcttcggtgacatcagtgaagctgtgattcaaaagttcctgtatctcggtgatgatcggaatattgaggaagtgtatgtgggcggtaaacaggtcgtgcccttctcttcttccgtgtag

SEQ ID NO: 190017 - DNA, 1182 bp, Artificial Sequence
  Description of Artificial Sequence: Synthetic coding sequence
atgttcctggaggaggccagccagcaggagaagctggccaaggagtggtgttttaagccatgcgagatacgggagctttctcaccacgagttttttatgcccggactggtggatacacacatccatgcttctcagtactcgttcgctggctcatccattgaccttccattactggaatggttgacgaaatacacttttcctgccgagcaccggttccagaacatcgacttcgcagaggaggtttatacaagggtggtgcggaggacattgaaaaacggaactactacggcctgttacttcgccaccattcacaccgatagctccctgctcttggccgatattacagataagttcggacagagggccttcgttggcaaggtgtgtatggatctcaatgataccttccccgaatacaaagagacaacggaggagtcaattaaggagacagaaagatttgtaagcgagatgctgcagaaaaatagtcatatctctgaaaatagagacgaggtggaagctgtcaaaaacttatatccttcatataaaaactatacctctgtatacgataaaaacaatctgctgaccaataaaacagtgatggcccatggctgctacctctccgctgaagaattgaacgtgttccacgagagaggagcgtcgatagctcactgccctaactcgaacttgtctctatcatcgggcttcttaaacgtgctagaggtgctcaaacacgaggtcaaaatcggtcttggaacggacgtcgctggtgggtattcttatagcatgcttgatgcaatccggcgcgcggtgatggtctctaacatcctgctgatcaacaaagtgaacgaaaaaagcctcaccttgaaagaggtgtttagattagccacactcggtggctcacaggctttgggactcgacggggagattgggaatttcgaggtgggtaaagagtttgatgcgatcttgataaatcccaaggcaagcgacagtcccatcgatctattttacggcgatttttttggggacatctccgaggccgtgatacagaagttcctgtatctgggcgatgatcgcaatatcgaagaagtgtacgtcggaggaaagcaggttgtccctttttccagttcagtcaaggagaccatccaccttcccgcaagcagccctcatcccccgccttttccttag

SEQ ID NO: 190018 - DNA, 1233 bp, Artificial Sequence
  Description of Artificial Sequence: Synthetic coding sequence
atggaggtgctgcgggaccacctgctgggcgtgagcgacagcggcaaaatcgttttcctggaagaggcttcgcagcaggagaaattggccaaagagtggtgtttcaagccttgcgagattcgagaactcagccaccacgaattcttcatgccaggccttgtcgatacacacattcatgcctcacagtattccttcgctggttcctccatcgaccttcccctgctggagtggcttacgaagtacaccttcccggcagaacatcgtttccaaaacattgactttgccgaagaggtctacacacgcgtggtgcgcagaactctgaaaaacggtacaacaaccgcctgttatttcgccactattcacaccgactctagcctcttgctggccgacattacagacaagttcggtcagcgcgccttcgttggaaaagtctgtatggatctcaatgacactttccctgagtataaagagaccactgaggagtccataaaggagacagagcgctttgtgtctgaaatgctccaaaagaattctcatatctcggaaaaccgcgacgaggtggaggcagtgaaaaacctctaccctagttataagaactacacctctgtgtatgataagaacaacctgctgacaaacaagactgtcatggcacacggttgctatctgagtgccgaagaacttaatgtgtttcatgagcgtggcgcctccatcgcacactgccccaattctaacttatccctaagtagcggcttcttgaacgttctggaggtgctgaaacacgaggtaaagataggactgggaacagacgtggccggcggctactcttactcgatgctggatgctatacgtagagccgtgatggtaagcaacattttgctcattaacaaggtgaatgaaaagagcctcacgcttaaggaggtcttcaggttggccactctggggggatcacaggccctcggactggatggtgagattggaaactttgaggtgggtaaggaatttgatgctatcctcattaacccgaaagcttccgatagtccaatcgacctgttttatggtgatttcttcggcgacatcagcgaggccgttatccagaagttcttgtatctgggcgatgaccggaacattgaggaagtttacgtgggggggaagcaggtcgtccctttctcaagcagtgtgaaggaaacaattcacttgcccgcctccagcccccaccccccgccctttccatag

SEQ ID NO: 190019 - DNA, 588 bp, Artificial Sequence
  Description of Artificial Sequence: Synthetic coding sequence
atgaccctgttccagaacacccggcggcccctgcggaaccggagcaggaagctgcgggactgtcatagcgtgactcaagctggagtgcaatggagagatttatccagtttgaagcctcccccccctgtctttaaaagatttagctgcctcagtctgccatcctcttgggactatcgattcgtgtccgagatgttgcaaaaaaactactctagggtcaaacctattgtcacaccaagattctctctctcttgttccgaaactcttatgggtgagctggggaacatcgctaagacccgcgatctacatattcagtcgcatatcagcgagaaccgggatgaggttgaggccgtgaagaatttgtacccctcttacaagaactacacaagcgtgtacgataagaacaacctgttaaccaataagactgttatggcgcacggatgttacctatctgctgaggaactgaacgtgttccatgagcgcggcgcttccatcgcccattgtccaaactccaatttgagtctatcctcaggatttctgaacgtgctggaagttctgaagcatgaggtgaaaataggactcggcacatag

SEQ ID NO: 190020 - DNA, 540 bp, Artificial Sequence
  Description of Artificial Sequence: Synthetic coding sequence
gagcggggcgccagcatcgcccactgccccaacagcaacctgagcctctccagtggcttcctgaatgtgttggaggtgctgaaacatgaagtgaagattggtttagggacagatgtggcaggtgggtactcctacagcatgctggatgcgatcaggagggccgtaatggtgtctaacatcctgctcataaataaggttaatgaaaaaagcctgactctcaaggaggtgtttagactagccaccctcggggggagtcaagcactcggtcttgacggcgaaataggcaacttcgaggtcggcaaggagtttgacgcgatacttattaatcctaaagcttctgacagcccgatagacctcttctacggagacttctttggcgacataagtgaagctgtcattcagaaatttctgtacctgggagatgatcgcaatatagaggaggtgtatgtgggcggaaagcaggttgtgccattttcctccagcgtgaaggagacaatacacctgcccgcaagttccccacacccccccccatttccatag

SEQ ID NO: 190021 - DNA, 1365 bp, Artificial Sequence
  Description of Artificial Sequence: Synthetic coding sequence
atgtgcgccgcccagatgccccccctggcccacatcttccggggcacttttgtccactccacatggacttgtcccatggaagtgctgagggaccatctactgggcgtgagtgacagcggaaagatcgtgttcctggaagaggcatcccaacaggagaaattggctaaggagtggtgtttcaagccgtgcgaaattagggagctgtcacatcatgaattctttatgcccggtttagtagacacgcacattcacgcgtcgcagtacagttttgctggatctagtatcgatctgccccttttggagtggcttactaaatatactttccccgcggaacacaggtttcagaatatcgactttgcagaagaggtgtatacccgagtggttaggcggaccctgaaaaatggcactaccaccgcctgttacttcgcaactattcacaccgattctagcctgctgctggccgatataactgacaaattcggccagcgcgcctttgtcggtaaagtgtgcatggacctgaacgatacatttccggaatacaaggagacgaccgaggagtccatcaaggaaactgaacggttcgtgtctgagatgctgcagaagaattatagccgtgtgaaacccatcgtgacaccacgattctccctaagctgctcggaaaccctcatgggtgagctgggcaatatcgctaaaactcgagacctgcatattcagtcccacattagcgaaaaccgcgatgaagtcgaagccgttaaaaatctttaccccagctacaagaattacactagcgtgtacgataagaataatcttctaacaaacaaaaccgtaatggcccatggctgttatctctcagcagaagaactgaacgtgttccacgagcgtggagcatccatcgctcactgtcctaactctaacctctcccttagctctggctttctcaatgttctggaggtactcaagcacgaagtgaagatcggtctgggaaccgatgtcgccggcgggtactcttatagtatgctagacgcaataagacgtgccgtaatggtgtccaatatcttgctgataaacaaggtaaacgagaagagcctgacgctgaaagaggtgttcaggctggctaccctaggaggaagccaggccctagggctggacggcgaaattggcaatttcgaagtggggaaagaatttgatgccattttaattaaccctaaagcctctgactcccccatagacctcttttatggagacttttttggggatattagcgaggcagtgattcaaaaattcctgtacctaggtgatgaccgaaacatcgaggaggtttacgttgggggcaaacaggtggtccccttctcaagcagcgtgtag

SEQ ID NO: 190022 - DNA, 1143 bp, Artificial Sequence
  Description of Artificial Sequence: Synthetic coding sequence
atgcccggcctggtggacacccacatccacgccagccagtacagctttgcaggcagcagcatcgacttgcccctattagagtggctgacaaagtatacttttcctgcggaacatcggttccagaacattgatttcgctgaagaggtctacacacgggttgtgcgccgcaccctgaaaaatggaacaaccactgcatgttactttgccaccattcacacggattccagcctgctgctggccgacattaccgataagtttggtcagagagctttcgtcggcaaagtctgtatggatctgaacgataccttcccggagtataaggagacaactgaggaaagcataaaggagaccgaaagattcgtgtccgaaatgttgcagaagaactactcacgtgtgaaacctatcgtgactccccgattttccctgtcatgttccgaaaccctgatgggagaactgggtaacatcgcgaagactcgcgacctgcacattcagtctcatatttccgagaatagagacgaggtggaagccgtgaagaatctatatccctcttacaagaactacacctcagtatatgataagaacaacctcttaaccaataagacagtgatggctcacggctgctacctctcggccgaggagctcaacgtgttccatgagcggggggcgtcaattgcccattgccccaactccaacctgtctctgtcctctgggtttttaaatgtgctggaggtgctgaagcacgaagtcaaaatagggctcgggacagatgtggctggcggctattcttactccatgctcgatgcgattagacgggccgtgatggtttctaacatcctgctcatcaacaaggttaacgagaaatctttgactttgaaggaggtgtttaggcttgctactttaggggggagccaggccctcgggcttgatggggaaattggaaattttgaggtggggaaggagtttgatgctatcttgatcaaccccaaagcttctgattcaccaatcgacctgttttacggggacttctttggggacatttcggaggctgttattcagaaattcctgtatctcggtgatgacagaaatatagaagaagtctacgtcgggggaaagcaggttgtgcccttcagttcctctgtttag

SEQ ID NO: 190023 - DNA, 2082 bp, Artificial Sequence
  Description of Artificial Sequence: Synthetic coding sequence
atggccctgtgcaacggcgacagcaagctggagaacgccggcggcgatctgaaagatggccaccaccactacgaaggcgctgttgttatcctggacgccggcgctcagtacggtaaagtgatcgataggcgggtgagagaactgtttgtgcaaagcgaaatttttccgttggagaccccagcctttgccatcaaggagcagggcttccgtgccatcatcatttccggcggtcctaactccgtctatgcagaggacgcgccctggttcgacccggccatttttactattggtaagcccgtgttgggcatctgttacggaatgcagatgatgaataaggtttttggaggcacagtccataagaagtctgtccgagaagatggcgtgtttaatatcagcgtcgacaacacttgctcactcttcagagggctgcaaaaagaagaggtggtgctgctgacgcatggcgatagtgtggacaaggtagcagacggatttaaggtggtcgcacgctctgggaacatagtggctggtatagcaaatgagtcaaaaaaattatacggagctcagtttcacccagaagtgggtctcaccgaaaacggtaaagtgatattaaagaactttctctacgatattgccgggtgctctggaaccttcaccgtgcagaaccgagagctcgagtgtattcgcgaaattaaggagagggtgggaactagcaaggtgctagtgctcttgtctgggggggtggattctactgtctgtacagccctactgaaccgggcccttaatcaagaacaggttattgctgttcacattgacaatggctttatgcgtaaacgggagtcccagagcgtggaggaggctctaaagaaactgggcattcaggtgaaggtcattaatgccgcacacagcttctataacggcaccacaactctgcctatctccgacgaggaccgtacccccagaaagcggatctctaagactctgaatatgaccacttctcctgaggaaaagagaaagatcatcggagatacctttgtgaaaattgccaatgaagtgattggcgaaatgaatttaaagcctgaggaggtctttctggctcagggaacattgcggcctgacctgattgagagcgccagcttagtcgcctccggaaaagcagagctaattaagacacaccataacgatacagaactgatacgaaaactccgagaagagggtaaggttatcgagcccctcaaggactttcataaagatgaggttaggattctcggaagggagctgggcctcccagaagagttggtatcccggcatcccttccccggcccaggactcgctataagagttatttgtgctgaagaaccttacatatgcaaggacttccccgagaccaataatatcctaaagattgtcgcagattttagcgcctccgtgaagaagcctcatactttattacaacgcgttaaggcttgcactaccgaggaagatcaggaaaaacttatgcagatcactagcttgcattccctgaacgctttcctcctgccaataaaaactgtgggcgtgcagggagactgcagatcctacagctacgtatgcggaatctctagcaaagatgagcccgattgggagagcctcatctttctcgctcggctgataccacgtatgtgccacaatgtgaacagggtggtgtatattttcggtccccccgtgaaagaaccccctaccgatgttaccccgacttttctgaccacaggtgtgttatcgacactgcggcaggcagactttgaagcccacaatattctgcgtgaaagcggttacgccggtaagatctcccagatgcccgtgatattaaccccactgcacttcgaccgggatccattgcagaagcagccgagctgccaacgctctgtggtaatacggaccttcatcacttccgactttatgaccggtattccagctaccccgggaaatgaaattcctgtagaggtcgtacttaaaatggtgaccgaaatcaagaagatcccaggcatcagccgcataatgtatgacctcacctctaaacctcccggcactactgagtgggaatag

SEQ ID NO: 190024 - DNA, 1929 bp, Artificial Sequence
  Description of Artificial Sequence: Synthetic coding sequence
atgctggaggagaccctgcggatggccaccaccaccatcaaggagcagggattccgtgccatcataatttctggaggcccaaatagcgtgtatgcggaggacgccccttggtttgaccctgctatcttcaccatagggaaaccagtgctgggcatctgctacggcatgcagatgatgaacaaggtgttcggtggtacagtacataagaagagcgttcgcgaggatggagttttcaacattagcgtggacaatacatgcagtctgtttaggggactacagaaagaggaagtggtcctgctgacacatggtgacagcgtcgacaaggtggctgacggtttcaaagttgtcgcccgtagtggaaacatcgtcgctggaatcgcaaatgaaagtaagaagctgtacggagcccagtttcacccggaagtgggacttactgagaacggaaaggtaatcctcaaaaattttctctacgacattgccgggtgctccggcacctttaccgtccagaatagagagttggagtgcatcagggagatcaaggaacgggttggcacctctaaggttctggtgctgcttagtggaggcgtggacagcaccgtgtgtacagccttacttaatcgggccctcaatcaggagcaagtcattgcagttcacatagacaatggctttatgagaaaaagggaatcgcagtctgtcgaggaagcactgaaaaaactgggaattcaggttaaagtcatcaatgctgcccatagcttctataacggaactaccactcttcccattagtgacgaggatagaacccctcggaagcggatctctaaaaccctcaatatgaccacttcaccggaggaaaaacgcaagatcatcggcgacacatttgtgaagattgcaaacgaagtcataggcgagatgaatctgaagccagaggaagtcttccttgcacagggtaccctccgacctgacctcatcgaatcagcctccctggttgcgtctggcaaagccgaactgattaaaactcatcacaacgacactgagctgatacgcaaactgcgggaggaaggcaaagttatcgagcctctgaaagattttcataaggatgaagttcggatactgggccgcgaactgggcctgccagaggaactagtatcaagacaccccttcccgggcccaggattggcaatacgtgtgatctgcgctgaggagccttacatctgcaaagacttcccagagacaaataatattctgaaaattgtggcagattttagcgctagtgtgaaaaagccgcacactctgctacagcgggtgaaggcatgcaccaccgaggaagatcaggagaaactgatgcagattacatccctgcactcgctcaacgccttcctactgcccataaaaactgtgggtgtgcagggtgattgtcgaagctactcctacgtgtgcggcatttcatctaaagatgagcccgactgggagagtctaatctttctggccagactgatccctagaatgtgtcataatgtaaaccgcgtcgtgtacatcttcgggccacccgtaaaggagccacctaccgacgttactcctactttcctcactacaggcgttctgagcacgctacggcaggctgactttgaagcccacaacatactcagggagagcggctacgccggcaagatcagtcaaatgcccgtaattctgacgcctcttcacttcgatcgggatcccttacaaaagcaaccatcttgccagcgctcagtggtgatccggacattcataacatccgactttatgaccggaatccctgccacccctggcaacgagatcccggtcgaggtggttctgaagatggtgactgaaattaagaaaattccaggtatctctagaatcatgtatgatctgacatctaagccaccagggaccactgagtgggagtag

SEQ ID NO: 190025 - DNA, 2082 bp, Artificial Sequence
  Description of Artificial Sequence: Synthetic coding sequence
atggccctgtgcaacggcgacagcaagctggagaacgccggcggcgatctcaaggatggacaccatcattacgaaggcgccgtggtcatactagatgcgggggcccagtacggcaaggtgattgaccggcgggttagggagctgttcgtccaatccgagatttttcctctggagacaccagcgtttgcgatcaaggagcagggatttcgcgccatcataatctctggaggacccaatagtgtctacgctgaagatgccccatggttcgacccagctatctttaccatcgggaagcctgtgctaggtatctgttatggtatgcagatgatgaacaaggtgtttggcggcaccgttcataagaagtctgtacgcgaggacggtgtttttaacatcagcgtcgataacacctgcagcttatttaggggcttacagaaagaagaggtagtgttactgacacacggcgattccgttgacaaagttgcagacggctttaaggtggtggcccgttctggtaacattgtggccgggatcgccaatgagagtaaaaaattatacggcgcccaattccatcctgaagtaggtttgaccgagaatggcaaagtcattttgaagaactttttatatgacatcgcaggatgttcaggtaccttcaccgtgcagaatagagagctggagtgcattagggagattaaagaacgagtaggcacttccaaagtattggtgttgctctcaggcggagttgatagcactgtatgtactgccctgttgaatcgggcccttaaccaggaacaggtcatagcggtgcacatcgataacggtttcatgaggaagcgggaaagtcaaagtgtagaggaggccttaaaaaagctgggcatccaggtcaaggtcatcaacgcggcacactctttttataacgggaccacaacgttacctatatctgacgaggacagaactccaagaaagcgtatctccaaaaccctgaacatgactacctccccagaagagaaaaggaagatcatcggcgacaccttcgtgaagatcgccaacgaggtgattggtgagatgaacttaaaacccgaagaggtctttttggcccagggcaccttgagacccgacctcatcgaatccgcttctctggtcgcttccggaaaggcggagctgataaaaacgcaccacaatgatactgaactgatccggaagctgagagaggaaggaaaagtgattgagcccctgaaagatttccacaaggacgaggttcgcattttgggccgggagttaggactgcccgaagagctagtctcgagacacccctttcccggccctgggttggctatccgcgtgatatgtgccgaggaaccttatatctgcaaagacttcccagagaccaataacattctgaaaatcgtggctgacttttccgccagtgtgaaaaaacctcacactctcctccagagggttaaagcctgcacaaccgaggaggaccaggagaagctcatgcagattacctctctgcactccctcaacgccttcctattgcccataaagaccgtgggagttcagggggactgtagaagttattcttatgtctgtggcatatcttccaaggatgagcccgactgggaaagtctcatctttctggcaagactcatacccagaatgtgtcataatgttaaccgcgtggtctatatctttggcccccccgttaaggaaccgcctaccgacgttacacctactttcctgaccactggcgtactgagtactctgcgtcaggcagactttgaagcccataatattctgagagagtcaggatacgctggtaagatatctcaaatgccggttatcctgacgccactgcacttcgatcgagatccgttacagaaacaaccttcctgtcagagatccgtggtgattagaacattcataacaagtgatttcatgacaggcattccagctacccctggaaacgaaatccctgtcgaggtggtgttgaaaatggtgaccgagattaagaagataccaggtatcagtaggataatgtacgatttaacctctaaaccacccggtaccaccgagtgggaatag

SEQ ID NO: 190026 - DNA, 1146 bp, Artificial Sequence
  Description of Artificial Sequence: Synthetic coding sequence
atgagcggcgtggtgcggaccctgagccggtgcctgctgcccgccgaggctgggggagcccgggagcgaagggcaggatccggagccagagacgccgagcgcgaagctcgacggcgcagtagagacattgatgcacttctggcccgtgaaaggagggctgtgcgcagacttgtgaagattctcctccttggagcgggcgagtccggcaaaagtaccttcctcaaacagatgcggataatccatggcagggagtttgaccagaaagctctcttggaattccgggacaccatctttgataatattctgaagggctcacgggtgttggtagacgcacgagacaaactgggtattccgtggcaatacagcgaaaacgagaagcacggcatgttccttatggccttcgagaacaaagctggcctgccggttgagccagccacttttcagctatacgtacctgccctttctgctctatggagggattccggtataagggaggccttttcaaggagaagtgaatttcagttaggtgagagtgtcaaatacttcttagacaatctggataggatagggcagctgaactacttccctagcaagcaggacatcctgctcgcccggaaagccacaaaagggatcgtagaacatgactttgtgataaagaaaatacctttcaagatggttgatgtaggtggacagagaagtcagaggcaaaaatggtttcagtgtttcgacggtatcacctccatcctgtttatggtgtcgagctccgagtacgaccaggtgcttatggaggaccggcgcacgaatagattggttgagtccatgaacatatttgaaaccatcgtgaacaacaaattattttttaacgtctccattatcctgttcttaaacaaaatggacctcttagtcgagaaggtgaagaccgtctcaataaagaaacacttcccagatttcaggggcgacccacatagactcgaagatgttcaaaggtatctggttcagtgctttgacagaaaaaggagaaatcgtagcaaaccgctgtttcaccacttcaccacggctattgacactgagaacgtgcgcttcgttttccacgctgtgaaggacaccatactgcaggagaacctgaaggacatcatgctccagtag

SEQ ID NO: 190027 - DNA, 702 bp, Artificial Sequence
  Description of Artificial Sequence: Synthetic coding sequence
atgatctaccccctgatcgtgctgcccctgtgcgccagctggcactgggggctgattcgcaaaggcatcgtgcttttctggggcgagtctgtgaaatattttctggataatctagacaggatcggccaacttaattactttcccagtaagcaggatatattgctcgcgagaaaggctacaaagggaattgtagagcatgattttgtgataaagaaaataccctttaaaatggttgatgtcgggggtcaaaggtcccagaggcaaaaatggtttcagtgcttcgacggaatcactagtatcctctttatggtctccagctccgaatacgaccaagtcctgatggaggaccgtcgcaccaatagactggttgagtccatgaatattttcgagacaatcgtcaataataagctgttcttcaacgtgtccatcattctctttctgaacaagatggacctgctcgtggaaaaggtaaagaccgtcagtatcaagaagcacttccccgactttcggggggatccacacaggttagaagatgtgcagcggtatttggtccagtgcttcgaccgcaaacgtcggaacaggagtaaacctttgttccaccatttcaccactgccatcgatactgaaaatgttcgcttcgtgttccacgctgtcaaagatacaatcctgcaggagaatcttaaagacattatgcttcaatag

SEQ ID NO: 190028 - DNA, 867 bp, Artificial Sequence
  Description of Artificial Sequence: Synthetic coding sequence
atgcggatcatccacggccgggagttcgaccagaaggccctgctggagttccgagataccatttttgataacatcctcaagggctcccgcgtgcttgtagatgcgcgagacaagctgggcatcccttggcaatacagcgagaatgaaaaacacggaatgtttctgatggcctttgagaacaaggcgggactccctgtggaacccgcaacatttcagttgtacgtgccagccctatcggcattgtggagagatagcggtatcagagaagcattttccaggaggagtgaattccagttgaattattttcctagtaaacaggacattctgctagctaggaaggctaccaaaggtattgtcgagcacgactttgtgatcaaaaagatcccatttaaaatggtggacgttgggggccaaaggtcccagaggcaaaagtggttccagtgctttgatggaatcacctccatcttattcatggtgagttctagtgagtacgaccaggtccttatggaggatcgccgcaccaacaggcttgtcgagtcgatgaacatctttgagaccatcgttaacaacaaactgttcttcaacgtcagcattattctgtttttgaataagatggatcttctggtggagaaggttaaaacagttagcattaaaaaacatttcccagattttcgcggcgacccgcacaggcttgaggatgttcagcgctatctggtccagtgttttgatcggaaaagacgtaaccgatccaagccactcttccatcactttacaacagccattgacactgagaatgtgcgcttcgtgtttcatgcagtaaaggatactatactgcaggagaaccttaaagatatcatgctccaatag

SEQ ID NO: 190029 - DNA, 1080 bp, Artificial Sequence
  Description of Artificial Sequence: Synthetic coding sequence
atgaccctggagagcatgatggcctgctgcctgagcgacgaggtgaaggagagcaaacggatcaacgcagagatcgaaaaacagttaagacgggacaaaagagatgcccgtcgggaactgaagctgctcctcctggggactggtgaatctggtaagtctacttttattaagcagatgagaattatccatggagccggatacagcgaggaggataagaggggcttcacaaaactggtttatcagaacattttcacagctatgcaagcaatgattagggcaatggagaccttgaagatattatataaatatgagcagaataaagccaacgctctgcttatcagggaagtggacgtagaaaaagtgaccacattcgagcaccagtatgtatcggcaattaagaccctttgggaagaccccggtattcaagaatgttatgacaggaggcgagagtaccagttgtccgattctgcgaagtattacctaaccgatgtggacagaattgctactttagggtatctgccaacacaacaggacgtgctcagggtgagagtccccacgaccggcataattgaataccctttcgatttggagaacattatattcaggatggtcgacgtcggtggccaaagaagtgagcgtaggaagtggatccattgctttgaaaacgtcacgtctataatgttccttgtggctttatccgaatacgatcaagttttggtcgagagcgataatgaaaataggatggaagaaagtaaagcacttttcaggaccattattacctatccttggtttcagaactccagtgtaattctctttcttaataagaaagaccttttggaggataagatcctgtacagtcacctcgttgactactttcccgaattcgacggaccccaacgtgatgctcaggcagcaagggaatttatcctgaaaatgttcgttgatctgaatcccgattccgacaagataatctactcccacttcacatgtgccactgacacagagaatatccggtttgtattcgcggctgtgaaggacacgatcctgcagctcaatctgaaggaatataatctggtctag

SEQ ID NO: 190030 - DNA, 1059 bp, Artificial Sequence
  Description of Artificial Sequence: Synthetic coding sequence
atggccgacttcctgcccagccggagcgtgctgagcgtgtgcttcccggggtgtctcctgacgtctggcgaagccgaacagcagaggaagtcaaaagaaattgataagtgtctgtcaagagaaaagacctacgtgaaacgactggtgaagattcttctcctgggcgcaggcgaatccgggaaatcgacgtactccaacgtcattaaagggatgagagtactcgtcgatgcaagggagaaactgcatatcccttggggggataacagtaatcagcagcatggggacaagatgatgtccttcgacacgagagctcctatggccgcgcagggaatggtggaaacacgggtatttttgcagtatctgcccgcgataagggccttatgggctgacagcggaattcaaaatgcgtatgatcgccgtcgcgaattccaattaggcgaatcagtgaaatattttttggacaatctggacaagctgggcgagcccgattatattccttcgcagcaggatatcctcttagcacgccgacctacgaaagggattcatgaatacgactttgaaattaaaaacgttcccttcaaaatggttgacgtgggcggacagcggagcgagcgaaagcgatggttcgaatgtttcgattcggtcacaagtatcttgtttctggtgtccagttccgagttcgatcaggttcttatggaagatagactgacaaataggctgacagaatccctaaacatctttgagactatagtcaacaatcgagttttcagcaatgtgagcatcatcctatttctcaacaaaactgacttgctggaggagaaggtacaaatagtatccataaaggattatttccttgagtttgagggtgaccctcactgcttgagggatgtccagaaattcctggttgaatgcttccggaataagaggcgagaccaacagcagaagcctctgtaccaccactttaccacagcaataaatactgagaatatacgactagtgtttcgggacgtgaaggataccatactgcatgataatctgaaacagttgatgctccagtag

SEQ ID NO: 190031 - DNA, 1134 bp, Artificial Sequence
  Description of Artificial Sequence: Synthetic coding sequence
atggccgacttcctgcccagccggagcgtgctgagcgtgtgcttccccggttgcctgctgacctccggagaggctgaacaacaacggaaatcgaaagaaatcgataagtgtctttcacgagaaaagacctatgtgaaacgcctggtaaagatactgttgctcggggccggagagtctggtaaatctacgtttctcaaacagatgcgaatcattcacgggcaagactttgatcagagagctagggaggaattccgccccaccatttattccaatgtcattaagggcatgagagtgctggttgacgcgcgcgagaagttgcacatcccttggggggacaactctaaccagcagcacggtgacaaaatgatgtcttttgataccagagcaccgatggcggcccagggaatggtcgagacgcgtgtatttctccagtacttaccagccattcgggcactgtgggccgattccgggattcaaaacgcctacgaccgaaggcgggaattccagctaggggagagcgtgaaatactttctggacaacctcgataagctgggagagccggattacattccatcacaacaggatatactcttggcaaggagaccaacaaaaggtatacatgagtacgactttgaaatcaagaatgtgccattcaaaatggtagatgttggcgggcagagaagcgaacggaagcggtggttcgaatgttttgattctgttacctccatactattcctcgtctccagttccgaattcgaccaggtgctgatggaggatcgcctgactaatcggctcacagaatctctgaacatcttcgagactatagtaaacaatagagtgtttagcaatgtaagtattatcttgtttctgaacaagaccgacctgctcgaagagaaagtccagattgtcagtatcaaagattatttcctggagttcgagggcgacccacactgtctgcgtgacgtccaaaaatttctggtcgagtgtttcaggaataagcggagggaccagcagcagaagcccctgtaccaccatttcactactgcgataaacacagaaaatatccgacttgtgtttagggatgtcaaagacacaatccttcacgacaatttgaagcagctgatgctccaatag

SEQ ID NO: 190032 - DNA, 849 bp, Artificial Sequence
  Description of Artificial Sequence: Synthetic coding sequence
atgcgggtgctggtggacgcccgggagaagctgcacatcccctggggagataatagcaaccagcagcatggggacaaaatgatgtccttcgatactcgagcaccaatggctgctcaggggatggtagagacgcgagtgttcttgcagtatctacctgccattagagcactttgggcagattccggaattcagaatgcctacgatcgtaggcgcgaattccagctgggagaatcagtcaagtacttccttgataacctcgataagttaggtgagcctgattatattcccagccagcaggatatcctgttagccaggcggcccactaagggcatccacgaatacgactttgaaatcaaaaatgtgccatttaagatggtagacgttggtggccagagatcggagcgtaagagatggtttgagtgcttcgattccgtgaccagcatactgttcctggtgagttcgtccgagtttgaccaggtgctgatggaagatagattgacgaaccgactcaccgagtcactgaacatcttcgaaacaatagtgaacaacagagtgttctccaatgttagtatcatcctgtttttgaacaagacggacctcctcgaggagaaagtacagatcgttagcataaaggattacttcttagagtttgaaggcgatccacactgcctacgcgacgttcagaagtttctggtcgaatgtttccgcaataaacggcgggatcagcagcagaaacccctgtatcatcacttcacaacggcaattaacacggagaacatacgcctagtgttccgagacgtcaaagacactatcttgcacgacaacctgaagcagcttatgctgcagtag

SEQ ID NO: 190033 - DNA, 1068 bp, Artificial Sequence
  Description of Artificial Sequence: Synthetic coding sequence
atggccggctgctgctgcctgagcgccgaggagaaggagagccagcgcatctctgccgagatcgaacggcaactcagacgggacaagaaggatgcccgaagagaactgaaactgcttcttcttgggaccggggaaagtggaaagtcaacatttatcaagcaaatgcgtatcatccacggctccggctatagtgacgaagataggaaaggtttcacgaaactggtctaccagaatatatttacagcgatgcaggcgatgatcagagccatggacaccttacgcatacagtatgtttgcgagcagaacaaggaaaacgcccagatcattagagaggtagaggtggacaaagtgagtatgctatcacgggaacaggtggaggcgattaaacagctgtggcaggacccgggtatccaggaatgctatgatcggaggcgagagtatcagctttcagattctgccaagtactatctgacggatattgacaggatagctacacccagtttcgtacccacacagcaagacgtgctacgcgtgagagttcctactactggcatcatcgagtacccatttgaccttgaaaatattatcttccgaatggtggatgtaggcggacagaggtctgagcggcgaaagtggattcactgtttcgagagcgttacgagcatcattttcctggtcgccctgagtgaatatgatcaggtactggccgaatgcgataacgagaaccgaatggaagaatccaaggcactcttcaagaccataatcacctacccttggttcttgaatagttcggtcatcttatttcttaataagaaagatctgctggaagaaaagattatgtactcccatctcatttcgtactttccagagtatacgggtccaaagcaggatgtacgggcagcacgtgacttcatcctgaagctctatcaagatcaaaaccctgacaaggaaaaagtgatttactcccattttacatgcgctacggacaccgacaacatccgtttcgtgttcgctgctgtcaaggatactatccttcagcttaacctgcgcgaatttaatttggtctag

SEQ ID NO: 190034 - DNA, 1125 bp, Artificial Sequence
  Description of Artificial Sequence: Synthetic coding sequence
atggcccggagcctgacctggcggtgctgcccctggtgcctgaccgaagacgaaaaagccgcagcaagagtggatcaggaaattaaccgcattctgctcgaacagaagaagcaggatcgtggcgaactgaaactcctcctcttgggaccaggagagtcgggaaagtccacattcataaaacaaatgcgcattattcacggagcgggatattctgaggaggaaaggaaggggtttcgaccactggtgtaccaaaacatcttcgtgtctatgagggccatgatcgaggctatggaaaggttgcagatccctttcagcaggcctgagagcaagcaccatgcgtccctggtgatgagtcaggatccttataaggtgaccacttttgagaagcgatatgccgctgctatgcagtggctttggcgcgacgccgggattcgagcatattatgaaagaaggagagagttccatttgctcgacagcgctgtgtactacttatctcatcttgagcgcataactgaagaaggctatgtgccgactgctcaggatgtgctgaggtcccgtatgccaacaaccggaattaatgagtattgcttttctgtccagaaaaccaacctgcgaatagtagatgttggcggccaaaagagcgaacggaagaagtggatccactgttttgagaatgtgattgcactgatatacctcgcaagcttgtccgagtatgaccagtgcttggaagaaaacaaccaggagaacagaatgaaggaaagtttggccctgtttggtactattctcgaactcccctggtttaaaagcacctcagtgatactatttctgaataagacggacatcctcgaggaaaagatccctacctctcatctggcaacttattttcctagttttcaaggtcccaaacaggacgctgaggcggcaaagcgtttcatcctggacatgtacacccggatgtataccgggtgtgtagacggacccgaaggaagcaaaaagggggctcgcagccggagattgttttcccactacacctgtgcaaccgacacacaaaatatcagaaaagttttcaaggatgtacgggattcagttcttgcccggtatctggacgaaattaacttgctgtag

SEQ ID NO: 190035 - DNA, 1065 bp, Artificial Sequence
  Description of Artificial Sequence: Synthetic coding sequence
atgggctgcaccctgagcgccgaggagcgggccgccctggagcggtctaaagccatcgagaaaaacctcaaagaagacggcatttccgctgcaaaagacgttaagctcctcctcttgggcgcaggtgaaagcggtaaaagcacaatcgtgaaacagatgaaaatcatccatgaagacggcttctcaggtgaagatgtcaagcagtataagcccgtggtctattcaaacacgatacaatctctggcagctatagtgagagcgatggatacactaggcatcgaatacggagacaaggagagaaaggctgatgcaaagatggtgtgtgacgtggtaagtcgcatggaagatactgaacccttctcagctgaactcctgtccgccatgatgagactgtggggggactccggcattcaggagtgcttcaacagatcacgcgaataccagcttaatgactccgccaagtactacctggactcacttgaccgtatcggagcagcggattaccagcccaccgagcaggatatcctgcgtacaagagtaaagaccaccggaattgtggagacccacttcactttcaagaatttgcattttaggttgtttgatgttggtggacaaaggtccgaacgcaaaaaatggattcactgttttgaagacgtcactgccatcatcttctgtgtcgctttatcagggtatgaccaggtcctccacgaagatgaaactacaaacaggatgcatgagtcactgatgttatttgattctatttgcaacaataaattcttcattgacacaagtattatcttatttctgaacaagaaggatctgttcggagaaaagatcaagaaaagcccgcttacaatctgctttccagaatataccggacccaatacctacgaggatgccgccgcctacattcaggcacagttcgagagcaaaaaccgcagtccaaacaaagaaatttactgccacatgacctgcgccaccgacaccaataacatacaggtggttttcgatgcagtgaccgacataatcattgcaaacaacctgcgtggttgcggactctactag

SEQ ID NO: 190036 - DNA, 1065 bp, Artificial Sequence
  Description of Artificial Sequence: Synthetic coding sequence
atgggctgcaccctgagcgccgaggagcgggccgccctggagcggagcaaggctattgaaaagaatctgaaggaggatgggattagcgccgctaaagacgtcaagctgcttctgctgggggcaggggagtccggcaagtccacgatcgtcaaacagatgaagatcattcacgaagacggattttccggtgaggatgtaaagcagtacaaacctgtggtttactccaacaccattcagtcactcgctgctatcgtccgcgcaatggataccctgggcatcgaatatggggacaaagagaggaaagccgatgcaaaaatggtgtgtgatgttgtgtcaagaatggaggataccgaacccttctcggccgagttgctgtccgcaatgatgagactgtggggcgattccgggattcaggagtgcttcaaccgcagcagagagtaccaactgaatgacagcgccaagtactacctggatagtctggacaggataggcgccgccgactatcaacctaccgaacaggatatcctgcggaccagagtgaagactacagggatagtggaaacccacttcacctttaagaatctgcattttcggcttttcgacgtggggggacagagaagtgagcgaaaaaagtggatacattgcttcgaggatgtgactgctatcatattttgcgtagcactgagtgggtacgaccaagtgctacacgaggacgagaccacgaaccgcatgcacgaatctctcaaactttttgactccatatgtaataataagtggtttaccgacactagcatcatactttttctaaacaagaaggacatcttcgaggaaaaaattaagaagagccccctgacaatatgcttcccggagtacacgggaccttcagccttcacagaagcggtggcttatattcaagcacagtacgagtccaagaataaaagtgcacataaggagatctatacccacgtcacatgcgccaccgatacaaacaatatccagtttgttttcgatgcggtgacagatgtgatcattgctaagaatctcagagggtgtgggctgtattag

SEQ ID NO: 190037 - DNA, 1146 bp, Artificial Sequence
  Description of Artificial Sequence: Synthetic coding sequence
atgggctgcctgggcggcaacagcaagaccaccgaggaccagggcgttgatgaaaaggaacgtagagaggcgaataaaaagatcgaaaaacagcttcaaaaggagcggctggcgtataaggccactcaccgattgctcttgctgggcgccggggaatcgggtaaatcgacgatcgtgaagcaaatgcgaattctgcacgttaacggcttcaatccggaggagaagaaacagaagatcctggacatacgcaagaacgtgaaggacgctattgtaactatcgtttccgccatgtcaactatcatccccccagtgccgctagcaaaccctgagaaccagtttcggagtgactacatcaagagtatcgcgccaattactgatttcgagtactcccaggagtttttcgatcacgttaagaagctatgggatgacgagggggttaaagcttgtttcgagaggagtaatgagtatcaactgatcgattgtgctcagtacttccttgagcggatcgactcggtaagcctggttgattatacaccaacagatcaggatctgcttaggtgtcgggtcttgacctcaggcatcttcgaaacccgcttccaggtagataaagtgaacttccacatgttcgatgtcggtggacagcgagacgagcgccgcaagtggattcagtgcttcaacgacgtaacagctattatttatgtcgccgcctgttccagctataatatggttattcgagaggacaataacacaaatagactaagagagagcctggatctgtttgaatctatctggaataaccgctggctgagaaccatctcaatcatcctattcctcaacaagcaggacatgctggccgagaaggtcctcgccggcaaaagcaagattgaagactattttcccgagtacgcaaattacacggttcccgaggacgctacaccagatgcaggagaggatccaaaggtgaccagggcaaaatttttcatccgagatcttttcctgcgtattagtacggctacaggagacggtaagcattactgttatccccactttacgtgtgcagtggataccgagaacattaggagggtcttcaacgactgtcgagatattatccagaggatgcatctcaaacaatacgagcttctttag

SEQ ID NO: 190038 - DNA, 1377 bp, Artificial Sequence
  Description of Artificial Sequence: Synthetic coding sequence
atgggcctgtgctacagcctgcggcccctgctgttcggcggccccggtgatgacccctgcgctgctagcgagccccccgtggaggacgcacagcccgccccggcccctgccctggcgccagtgagggcggccgcccgtgatacagccaggactctcctgccgagggggggagaagggtctccagcgtgtgcacggcccaaggctgataaacctaaggagaagaggcaacgaacggaacagctctccgcagaggagcgtgaggccgcaaaggagcgagaagccgttaaggaggcaaggaaagttagccgcggaatcgacagaatgttgcgggatcagaagagagatctccagcagacacatcgactgctgctactgggtgcaggggaaagcggcaagagtaccattgtgaaacagatgcggattcttcatgtgaatggcttcaatcctgaggaaaagaagcagaagattctggatattagaaagaacgtaaaagatgccatagttacgatcgtgtctgctatgtctaccatcatccctccggtccccctcgcgaatccagagaaccagtttaggagtgactatatcaagtccattgctcctattaccgacttcgagtactctcaggaattttttgaccatgtgaagaaactgtgggacgatgagggcgtgaaagcgtgtttcgagcggtctaatgaatatcagcttattgattgtgcccagtatttcctggagcggattgacagcgtatctctcgtggattacacacccaccgatcaggatctattgcggtgtagagtgctgaccagcgggattttcgagacacgcttccaggtggataaggtgaattttcacatgttcgatgtgggagggcagagagacgaacggcgcaagtggattcagtgcttcaacgatgttaccgctattatttacgtggctgcatgttcgagttacaatatggtgatccgtgaggataacaacaccaaccgcctccgtgagtctttggacctgtttgagtccatttggaacaatagatggctgcgaacaatatccataatcctgttcttgaataaacaagacatgcttgccgaaaaagtgctcgcagggaagagtaaaattgaggactacttcccggagtatgctaactataccgtgcctgaagatgccacacctgacgctggcgaggatccaaaagtcacacgagccaagtttttcatccgggatctcttccttaggatttccacagcaactggtgacggaaaacactactgctacccacactttacttgtgccgttgacacggagaacatacgacgagtgttcaatgactgcagagacatcattcagcgcatgcacctgaagcagtacgagctgctgtag

SEQ ID NO: 190039 - DNA, 1146 bp, Artificial Sequence
  Description of Artificial Sequence: Synthetic coding sequence
atgggctgcctgggcggcaacagcaagaccaccgaggaccagggcgtggacgaaaaagagaggagagaggcaaacaagaagatcgaaaagcagctgcagaaagaaagactggcgtataaagcgacccaccggctcctgcttctcggtgccggcgagtcagggaaatcaacaatcgtcaagcaaatgcgcattttgcacgtgaatggtttcaatcccgaagaaaagaagcagaagatcctggacatccgcaagaatgtcaaggatgctatcgttaccatcgtgagcgccatgagtacaatcatcccccccgttccactggccaaccccgaaaatcagtttagatccgactacattaagtccatcgcgccaatcaccgatttcgagtatagccaggaatttttcgatcatgtgaagaaactgtgggatgacgaaggcgtaaaagcttgtttcgagcggtccaatgaatatcagcttatcgactgcgctcagtacttcctggagaggattgattccgtcagcctggtggactatactccgaccgatcaggacttgctgaggtgcagagtactgaccagcgggattttcgagaccaggtttcaggtggataaagtgaactttcatatgtttgatgtggggggacagagagatgagaggcgtaagtggatccagtgtttcaacgatgtgaccgcaatcatttacgtggcggcctgctcctcgtataacatggttattcgcgaggacaacaacaccaaccgactgcgggagtccttagacttgtttgagtcaatttggaataataggtggctgagaaccatctctataattctcttcctgaacaaacaggatatgttggcagagaaggtgttggccggcaagtcaaagatcgaggattatttccctgagtatgctaactacaccgttccagaagatgctacacccgacgccggggaagaccccaaggtgacaagagccaaatttttcattcgagacctgttcctcaggatatccacagctacaggcgacggcaagcactactgttatccgcactttacctgtgccgtggatacagagaacattaggcgagtattcaatgattgcagggatataatccagaggatgcacctcaagcagtatgaactcctgtag

SEQ ID NO: 190040 - DNA, 1146 bp, Artificial Sequence
  Description of Artificial Sequence: Synthetic coding sequence
atgggctgcctgggcggcaacagcaagaccaccgaggaccagggcgtggatgagaaagagagaagggaagcaaacaaaaagattgagaagcagctccagaaagagaggcttgcttataaggctacacatcgcctgctcctgttgggagccggggagagtggcaaaagcactattgtgaagcagatgcgcatcctgcacgttaacgggtttaaccccgaggagaagaagcagaaaatcctcgacattcgcaaaaacgtcaaagacgccattgtgaccatcgtgtcagccatgagcactatcatcccgccagtccccctggccaatcccgaaaaccaatttcgctccgattatatcaaaagtatcgcccccattaccgacttcgagtacagtcaggaattctttgatcacgtcaaaaaactgtgggacgacgagggggtgaaggcttgctttgaacggtcaaacgagtaccagcttatcgattgcgctcaatattttctagagcgcattgattctgtgtctcttgtagattacactcccaccgaccaggatttgctcaggtgtcgagtattgacatcaggaatctttgagactcgatttcaggttgataaggtcaacttccatatgttcgatgtggggggacaacgcgatgagcgtcgcaaatggatccagtgctttaatgacgtgactgccatcatctatgtcgccgcctgtagttcatataacatggtgatacgggaggataacaatacaaaccgtctacgcgaaagcctagaccttttcgaatcaatctggaacaataggtggctaaggaccatatccataatcctgtttctgaacaagcaggatatgctcgccgagaaagttttagctgggaaaagtaagattgaagactactttcctgagtacgccaactacactgtgcccgaagacgctacccctgacgccggggaggaccctaaggtgactcgagccaagttcttcattagggaccttttcctgcgtatcagcacagctacaggggatgggaagcactactgctatcctcactttacttgtgccgtggacacagagaacatcaggagggtttttaatgattgcagggatattattcaacggatgcacctgaagcagtacgagctcctctag

SEQ ID NO: 190041 - DNA, 525 bp, Artificial Sequence
  Description of Artificial Sequence: Synthetic coding sequence
atgttcgacgtgggcggccagcgggacgagcggcggaagtggatccagtgcttcaacgacgtgactgcaattatatacgtcgccgcctgttcaagctacaacatggtcatacgcgaggataacaatacgaaccgtcttcgtgagtctctcgacctatttgagtcaatatggaacaatcgttggctgcgtacaatttctattatcctgttcctgaacaaacaggacatgcttgccgaaaaggtcctagcaggcaaatcgaagattgaggactattttcccgagtacgccaactataccgtgcctgaggatgctacacctgatgctggtgaggacccgaaggtcaccagggcaaagttctttatcagggatctattcctgcgtatctccacagccaccggcgacggaaaacactactgttatcctcattttacttgcgctgttgacacagaaaatattaggagagtgttcaacgattgcagggacattattcagcgcatgcacctgaaacaatacgaactgctgtag

SEQ ID NO: 190042 - DNA, 963 bp, Artificial Sequence
  Description of Artificial Sequence: Synthetic coding sequence
atgcggatcctgcacgtgaacggcttcaaccccgaggagaagaagcagaagatcctcgatataaggaagaacgtgaaagatgctatcgtaacgatcgtttctgctatgtccactatcattcctccagtccctctggccaatcctgaaaatcaatttaggagcgattacataaagtcaattgcacctattaccgatttcgaatattcacaagagttcttcgaccatgtgaagaaactttgggatgacgagggtgtgaaagcatgctttgagcgatccaacgagtaccagctcatcgactgcgcacaatacttcttggaacgtatcgactctgtgagcttggtcgactataccccaaccgaccaggacctcctgcggtgccgagtgctgacatcgggaattttcgaaaccaggtttcaagtcgacaaggtcaatttccatatgttcgatgtcggcggacagagagatgaacgccgaaaatggatccagtgcttcaacgatgtgaccgctattatttatgttgctgcatgtagctcctacaatatggtcatcagggaggataataataccaaccggcttagggaatcacttgatctgttcgagtccatatggaataaccgttggctgcgaactatatcaataatcttgttccttaacaaacaggacatgctggccgaaaaagtcctggcaggaaagtcaaaaatcgaggactattttccagagtacgcgaactacacagtccccgaggacgccacgcccgacgctggcgaggacccgaaggtcacacgggcaaaattttttatccgagacttgttcctgagaatatctacagcgactggagacggaaagcattattgctatccccacttcacctgtgccgtcgacacggagaacataaggcgtgtcttcaacgattgtcgggacatcatacagcgtatgcacttgaagcagtacgagctgctctag

SEQ ID NO: 190043 - DNA, 1065 bp, Artificial Sequence
  Description of Artificial Sequence: Synthetic coding sequence
atgggctgcaccctgagcgccgaggacaaggccgccgtggagcggtctaagatgatcgacaggaacctgagggaggatggtgaaaaggccgctcgagaggttaagctcctactgctcggagccggagaaagtggtaagagtactatcgtaaaacagatgaagattatacacgaggctggttatagcgaggaggagtgtaaacagtacaaagcagtggtgtacagcaatacgatccagtccatcatagcaattattagagctatgggccgtctaaagattgattttggtgattctgctagggccgacgacgctcggcagctattcgttttggccggcgccgccgaagaggggtttatgaccgctgaactggcgggcgttataaagagattgtggaaagatagcggcgttcaggcctgtttcaaccgtagtcgagaatatcaattgaatgattccgccgcctattatttaaacgatctggatcgaatcgcccagcctaactacatccctactcaacaggatgtccttaggactcgcgttaagactactggaatcgttgagacacacttcaccttcaaagatctacacttcaaaatgtttgatgtggggggccagagaagtgaaagaaaaaagtggatacattgctttgaaggcgtcaccgccatcatcttttgtgtcgcgctcagcgattacgatcttgtccttgctgaggatgaggagatgaaccgaatgcatgaatctatgaaactctttgattctatctgcaacaacaagtggttcactgacacgtcgattattttgtttcttaacaagaaggacctcttcgaagaaaagattaaaaaaagtcccctcacaatttgctaccctgagtacgcagggtctaacacgtacgaggaagccgcggcgtacattcagtgccagttcgaagacttaaacaagcggaaggacacaaaggaaatctacactcacttcacatgtgcaactgatacaaagaatgttcagttcgtctttgatgctgtaaccgatgtgatcattaagaataacctgaaagattgtggtttgttctag

SEQ ID NO: 190044 - DNA, 72 bp, Artificial Sequence
  Description of Artificial Sequence: Synthetic coding sequence
atgggctgcaccctgagcgccgaggacaaggccgccgtggagcggtccaaaatgatagataggaatctctag

SEQ ID NO: 190045 - DNA, 909 bp, Artificial Sequence
  Description of Artificial Sequence: Synthetic coding sequence
atgaagatcatccacgaggccggctacagcgaggaggagtgcaagcaatacaaagccgtggtctatagtaacacaatccagtcaatcatcgcaataataagagcaatggggcggctcaaaatcgacttcggcgacagcgcccgggccgatgatgcgcggcaactgtttgtgctggctggagctgccgaggaggggttcatgacggccgaactcgcaggagtcattaagcgtttatggaaagactccggtgtacaggcctgcttcaatagatcccgggagtatcagttgaacgactctgccgcttattacctaaatgatctggaccgcatcgcacagccaaactacattccaacccaacaggatgtactcagaacccgcgttaagacgacaggaatcgtcgaaacgcatttcacttttaaggaccttcacttcaagatgttcgatgtgggaggacagaggagtgagaggaaaaagtggatccattgttttgaaggggttacagctatcatattctgcgtggcactgtccgattacgacctggtcctggcagaggatgaagagatgaaccggatgcatgagagcatgaagctgttcgattcaatctgtaacaacaagtggtttactgacacgtccattatattatttttgaataaaaaagacctgtttgaagaaaagattaagaaatcccccctgacaatttgctaccccgaatacgcggggtcaaacacctatgaggaggctgccgcctatatccagtgccagttcgaagacttaaacaaacggaaagacactaaagaaatttacacccacttcacatgtgccaccgataccaaaaacgtccagttcgtgttcgacgccgtcaccgacgtcatcattaagaataacttgaaggactgtggcctgttctag

SEQ ID NO: 190046 - DNA, 1020 bp, Artificial Sequence
  Description of Artificial Sequence: Synthetic coding sequence
atggagtacgccggccacctgcccgccagcagcgcccagggcaccattcttgcttgtactagctgtaccggggccggcgagtccggcaaatccacaatagtcaaacaaatgaaaatcattcacgaggacggctatagcgaggaggagtgcagacagtatcgggcagtggtttattccaatacgatccagagtataatggctatcgttaaggccatgggtaatctacagatcgatttcgcagacccttctagagccgacgacgcacggcagctctttgcactatcatgtaccgcggaagagcagggagtgctgcctgatgatctatcaggtgttatccggcgactttgggctgatcacggcgtccaagcatgcttcggtcggagccgtgaatatcaacttaatgatagtgccgcttactacctgaacgatcttgaaaggatcgcccagtccgactatatccccacgcagcaagatgtgttgcggacaagggtcaaaaccactggcattgtggagacacacttcacgtttaaagacctacatttcaagatgttcgatgttggaggccaacgttccgagaggaaaaaatggatccactgcttcgagggggtgacggccattattttctgcgtcgcgctctcagcctacgatctcgttctcgccgaggatgaggagatgaacagaatgcacgaatcaatgaagctcttcgatagtatctgtaataataaatggtttactgacacgagcatcattctttttcttaataaaaaggacctcttcgaggagaaaattacacacagcccattaacaatatgtttcccagaatacacaggcgccaataaatacgacgaggctgccagttatattcaaagtaagttcgaagaccttaataagaggaaggataccaaggagatttacacacatttcacttgtgcaacagacaccaagaacgtgcagttcgtttttgatgccgtgactgatgtgatcatcaaaaacaacctaaaggattgtgggctgttttag

SEQ ID NO: 190047 - DNA, 1068 bp, Artificial Sequence
  Description of Artificial Sequence: Synthetic coding sequence
atgggctgcaccgtgagcgccgaggacaaggccgccgccgagcggtctaaaatgatcgacaaaaatctacgcgaggatggagagaaggctgcgcgggaggtgaagcttctgcttctgggcgccggcgaatccggtaagtctaccattgtgaagcagatgaaaatcatacacgaggacggctattctgaggaggagtgtcgacagtatcgggctgtagtgtactccaatactattcagtcaataatggcgattgtgaaagccatgggaaatttacagatagattttgcggatccttctagggccgacgatgctagacagctgttcgccttaagctgcaccgctgaggaacaaggggtgctgccggacgatcttagtggagtgattaggagactttgggcggaccatggggtgcaagcctgttttggcaggtcacgagaatatcagctcaacgattctgccgcatactatttgaacgatctagaacggatcgcccaatctgattacatcccaactcagcaggacgtgctcagaacccgcgtgaagactaccggtatcgtagagacccatttcacgtttaaggaccttcatttcaaaatgtttgatgtcggcggacagcgtagcgaaaggaagaaatggatccactgctttgagggagtaactgctattatcttttgtgtcgccctcagcgcctatgacttggttctcgctgaggacgaagagatgaacaggatgcacgagtccatgaagctgttcgattccatctgcaataataagtggttcactgacacgtccatcatactatttttgaataagaaggacctctttgaagagaagatcactcattcacccctaacaatctgtttccctgaatataccggggccaataaatacgacgaggctgcctcctatatccaaagtaagtttgaagacctcaacaagaggaaggacaccaaggaaatatacacacacttcacctgtgcgactgacaccaagaacgtgcaatttgtattcgacgccgttaccgacgttattatcaagaataatctcaaagattgcgggttgttttag

SEQ ID NO: 190048 - DNA, 1020 bp, Artificial Sequence
  Description of Artificial Sequence: Synthetic coding sequence
atgaccgagggcgtgaagaccctgggctggaccaagcagaagggcggctgtcattggggcagatctgagggcgcaggagaatccggaaaaagtaccattgtaaaacagatgaaaatcatacacgaagacggatactcggaggaggagtgtcggcaatatagagccgtggtatattccaacaccatccagagcatcatggccatcgtgaaagccatgggcaacctgcagatagactttgccgatccatcccgagccgacgacgcgaggcaactgttcgctctctcctgtacagcagaggaacaaggagtcctgcctgacgatctgagtggcgtgatacgacgcctgtgggccgatcacggggtgcaggcatgtttcggaagatctagagagtatcagttgaatgattctgccgcgtactacttaaacgatctggagaggatcgctcagtcagattacatccccactcagcaggacgtcctaaggacacgcgtcaaaaccaccggaatcgtcgagacacacttcacatttaaggaccttcactttaagatgttcgacgtgggcggacaacgatcagagaggaaaaaatggattcactgctttgaaggcgtgaccgccattatcttctgcgtggctctcagcgcgtatgaccttgtcctggcagaagacgaggaaatgaaccgtatgcatgaatccatgaagctgttcgactccatctgtaacaacaagtggtttaccgacacgtctatcatattgtttttaaataaaaaagacctgttcgaggagaagattacacactcacccctgactatttgtttccccgaatatacgggggccaataagtatgacgaggcagcctcctacattcagtccaagttcgaggatctcaataagaggaaggacaccaaggagatatacacacattttacttgtgcgaccgacacaaaaaatgttcaatttgtgttcgacgcggtgactgacgtgatcatcaagaacaacctgaaggattgcgggctgttctag

SEQ ID NO: 190049 - DNA, 912 bp, Artificial Sequence
  Description of Artificial Sequence: Synthetic coding sequence
atgaagatcatccacgaggacggctacagcgaggaggagtgccggcagtaccgcgccgttgtctatagcaataccatacagtctatcatggccatagtcaaggctatgggaaacttacagatagacttcgctgacccctctagagccgatgatgctcgccaattgtttgcgctgtcctgtactgcagaggagcagggtgttctgccagatgacctctctggtgtgattcggcgactgtgggcagaccacggcgtccaagcctgcttcgggaggagcagggagtaccaactgaacgattctgccgcatattacctgaacgacctcgaacgcatcgcccaaagcgattatataccaactcaacaagatgtgctcagaacaagggtgaagacaactggcatcgtggagactcactttacatttaaagacttgcacttcaagatgtttgacgtgggcgggcaacgctccgagaggaagaagtggatacactgttttgaaggagtgacagccattatcttttgcgtagcactgtccgcttatgatctggtgcttgcagaggatgaagagatgaataggatgcacgagagcatgaagctgttcgattctatctgcaacaacaagtggtttaccgatactagtatcatcctctttctgaacaaaaaagatctttttgaggagaagatcacacattctcctcttacaatctgtttcccagaatacacaggtgccaataagtatgacgaagcagctagttatattcagtccaaatttgaagacttaaataagaggaaagataccaaagagatttacacgcactttacctgtgcgactgacaccaagaatgtacagttcgtgttcgatgcagtcacagacgtgattattaagaataacctgaaggattgcggacttttttag

SEQ ID NO: 190050 - DNA, 957 bp, Artificial Sequence
  Description of Artificial Sequence: Synthetic coding sequence
atgcggggcgccggcgagagcggcaagagcaccatcgtgaagcagatgaaaataattcacgaggatggatactccgaggaagaatgtcgtcagtacagagcggtggtgtacagcaacacgatccagagcatcatggctattgtgaaagcaatgggcaatctccagatcgatttcgccgatccaagtcgagccgacgacgctaggcaactgttcgctttgtcttgtactgctgaagagcagggggtcttgcctgacgatttaagtggggtgattagaagactgtgggccgaccatggggtgcaagcttgtttcggacggagtcgtgaatatcaattaaacgacagtgccgcttactacctgaacgatctggagcggattgctcagagcgattacatcccaacccagcaggacgtgctgaggacaagagtcaagactactggtatcgtggagacacacttcacttttaaagatctgcatttcaaaatgttcgacgttggcggccagaggagtgagcggaagaaatggatccattgttttgagggagtcacagcaatcatcttctgcgtcgcactgagcgcctatgatcttgtgctggccgaggatgaagaaatgaatcgcatgcatgaatctatgaagctctttgactctatctgtaataacaagtggttcactgatacaagtattatcttattccttaacaaaaaagatttgtttgaagagaaaattacacacagccccctgacaatttgctttccagaatacacaggggccaataagtacgacgaggctgcgagctacatacaaagtaagtttgaggacctaaacaagaggaaggataccaaagaaatctacacgcacttcacgtgtgcgactgacaccaagaatgtgcagttcgtgttcgatgctgttacggatgtgatcattaagaataatttgaaggactgcggcctgttctag

SEQ ID NO: 190051 - DNA, 825 bp, Artificial Sequence
  Description of Artificial Sequence: Synthetic coding sequence
atggccatcgtgaaggccatgggcaacctgcagatcgacttcgccgacccgtccagggccgatgatgctcgccagctgtttgccctcagttgcacagccgaagaacagggcgtgttgcctgatgacctgagtggcgtaattcgtcggctctgggccgaccacggagttcaggcctgttttggcagaagccgcgaatatcaactgaacgattctgccgcttactacctaaacgacctcgagaggatcgcccagtcagactacattccaacacagcaagatgtgctgaggacccgagtgaaaaccactggcattgtggagacccattttacttttaaagacctgcacttcaaaatgttcgacgttgggggccagcggtccgagcgcaagaaatggattcattgcttcgagggcgttacagccattatcttttgcgtggcactctctgcctacgatttagtgctggcggaagatgaggagatgaataggatgcacgagagtatgaagctattcgattctatttgtaataataaatggttcaccgatacaagtatcattttatttttgaacaaaaaggacctgttcgaagagaagatcactcactccccattaactatttgctttccggagtatactggagccaacaagtacgacgaagccgccagttatatacagagtaagtttgaggatctcaacaaacggaaagacactaaagaaatttatactcacttcacgtgtgccacagacaccaaaaatgttcagttcgtgtttgacgccgtaacagacgtgattattaagaacaatctgaaagactgcggactgttttag

SEQ ID NO: 190052 - DNA, 1086 bp, Artificial Sequence
  Description of Artificial Sequence: Synthetic coding sequence
atgggctgcaccgtgagcgccgaggacaaggccgccgccgagcggtccaagatgatcgacaaaaacctgcgagaagacggggaaaaagccgcccgagaagtcaaattactgcttttgggcgcaggagagagcgggaaatcgacaatcgtgaaacagatgaaaatcatacatgaagatggctattccgaagaagagtgcaggcagtatagagcggtggtgtattctaacactattcagtccatcatggccatcgtgaaggccatgggcaatttacagatcgactttgccgatccaagcagggccgacgacgctcggcagctctttgccctgtcttgcactgcagaagaacagggagtgctgccagacgacctgagtggggtcatccgcaggctgtgggccgatcatggcgtccaggcttgctttggacggtcacgggagtaccagctaaatgacagcgccgcatattacctgaatgacctcgaaaggatcgcgcagtccgactacattcccacacaacaggatgtcctcagaacaagagttaagaccacaggtatagtggagactcactttacgttcaaggatctccactttaaaatgtttgatgtgggtggccaacgcagcgagaggaaaaaatggatacactgtttcgaaggcgtaaccgccatcatcttctgtgtggctctctcggcttatgacctggtcttggccgaagatgaagagatgaatcggatgcatgagagcatgaaactgtttgacagcatatgcaacaacaagtggtttactgatacctcgatcatcctctttctgaataaaaaggatcttttcgaagaaaagattactcatagccctcttacgatctgtttcccagaatacacaggcgctaacaaatacgatgaggctgcctcttatattcaatcaaaatttgaagacctaaacaagaggaaagatacaaaagagatatatacgcacttcacctgtgccaccgacacaaaaagccgaaaacttttccgtgagaactacctgaagctgtccgaccctgaccagcaacctccccccgcccctctccccagcgattctgtcccgtag

SEQ ID NO: 190053 - DNA, 1065 bp, Artificial Sequence
  Description of Artificial Sequence: Synthetic coding sequence
atgggctgcaccctgagcgccgaggacaaggccgccgtggagcggtccaagatgatagaccgtaatcttcgagaagatggtgagaaggctgctaaggaagttaaattgttgctcttgggcgccggggaaagcggaaaaagcactattgtcaagcaaatgaaaataatacacgaggacggttatagtgaagacgaatgcaagcagtataaggtggttgtgtactccaacaccattcagagcattatcgcaattatccgcgccatggggcgattaaagattgatttcggtgaagccgcccgcgctgatgacgcaaggcagttgttcgtcctagcaggatctgccgaggagggtgttatgacgcccgaactggctggcgtgatcaaaagactttggcgtgacgggggcgtgcaagcttgctttagccgcagccgagaataccagctgaacgatagcgcctcctactacttaaatgatctggataggatttcacagagcaactacatccctacacagcaggatgtgctgaggacacgcgttaaaacgacaggcattgtggagacccacttcacctttaaggacctttacttcaaaatgttcgacgtcggcggccaacgctccgaaagaaagaaatggatccactgctttgaaggagtgaccgcaattatattctgtgtcgcactgtccgactatgacctggtgctcgcggaggacgaagagatgaaccggatgcatgaaagcatgaagctgttcgactccatatgcaataacaaatggttcacagaaacatccatcattctatttctgaataaaaaggacttatttgaggagaagatcaaacgctcgcccctcaccatctgctatcccgaatataccgggagcaatacctatgaggaagcagctgcatatattcagtgccagtttgaggatcttaaccgacggaaagacacgaaggaaatttacacacattttacttgtgccaccgatactaaaaacgtccagtttgttttcgacgctgtcacagatgtcatcattaagaacaatttgaaggaatgtggcctttactag

SEQ ID NO: 190054 - DNA, 2652 bp, Artificial Sequence
  Description of Artificial Sequence: Synthetic coding sequence
atggccgagaacagcgtgctgaccagcaccaccggccggaccagccttgcagatagctccatctttgatagcaaggtgaccgagatctccaaagagaatctgctgatcggaagcacttcctatgttgaggaggaaatgccacagatcgagacacgcgtgattcttgttcaagaggccgggaagcaggaagagctaataaaagctttgaaggacatcaaagtggggtttgtgaagatggaaagcgtagaagagtttgagggcctggacagtccggagttcgagaatgtgttcgtcgtaacagatttccaggactccgtctttaacgacctgtacaaggcagattgcagagtcattggcccaccggtggttcttaactgttcccagaaaggggagccactgcccttttcatgcaggccactgtactgtacaagtatgatgaatttggtactgtgttttaccgggttcaggaaaaaggaggaactcgttcgcttggtgacccttgttcaccatatggggggagtgattcggaaggacttcaatagcaaggtgacccatcttgtagctaattgcacccaaggggaaaagttccgggttgcggtcagtctggggacccccattatgaagccggaatggatttataaggcttgggaaagacgcaacgaacaggatttctatgccgccgtggatgatttcaggaatgagtttaaggtgcctcctttccaggattgtatcctgtcatttttaggcttcagcgacgaggagaagaccaatatggaggagatgactgagatgcagggaggaaagtatcttccacttggtgacgaacgttgtactcatttggtggtggaggaaaatatcgttaaggacctcccctttgaacctagtaagaagctgtacgtggtcaagcaggagtggttttggggcagcatacagatggacgctagggctggagagaccatgtatctatatgagaaggctaatactcccgagttgaaaaaatcggtgagcatgttaagcttaaatacgccaaactctaacagaaagcgccgccggctgaaggaaacgttggcccagctgtcacgggaaacagacgtgtcaccattccctccaaggaaacggcctagcgctgagcactcattgtctatcgggtcccttcttgatatcagtaatacacccgagtccagcatcaattatggcgatacgcctaaaagctgcaccaagagttcaaagagcagtactcccgtcccgagtaagcagagtgcaagatggcaggtcgccaaggaattataccagaccgagtctaattatgtgaacatcctggcaaccatcatccagctgtttcaagtgcccctggaggaggagggccaacgcggcggaccgatcctggcccctgaggagatcaagacgatcttcggaagcataccagacatttttgacgttcatactaagattaaggatgatctcgaagatctcatcgtaaattgggatgagtccaagagtatcggtgatatcttcttaaaatacagtaaagaccttgtgaaaacctatcctccatttgtgaatttctttgagatgtcgaaagagactataatcaagtgtgagaagcagaagcccaggttccacgcctttctgaagattaatcaggctaaacctgagtgtggccggcagtccctggtagagctgttaattcggcccgtacaacgcctgcccagtgtggcccttctattgaacgacctgaaaaagcatactgccgacgagaaccctgataagagcacactggagaaagctatcggctctctcaaagaggtgatgacccacatcaatgaggataaaaggaagaccgaagctcaaaagcagatttttgacgtcgtctatgaggtcgacggatgtcccgccaaccttttatcttcccaccgatcattagttcaacgagtcgaaacaatctcattgggagaacacccctgtgacagaggggaacaggtgactttgttcctcttcaatgactgcctggagattgctcgcaagagacataaagtgattggcacgtttcggagcccccacggtcaaacacggccccccgcttctctgaaacatatccatctaatgccactgtcccagattaagaaagtgttggacattcgggagacggaagactgtcacaacgcctttgccctgctggtgagaccaccaaccgagcaggcaaacgtgctgctgagctttcagatgacctctgatgagttgcccaaggaaaactggctcaaaatgctgtgtcgtcatgtggctaatactatctgtaaagctgacgcggagaacctgatttacacagcggaccccgaaagtttcgaggtgaacaccaaagatatggatagcaccctgtctagggcatctcgcgctatcaagaagacttccaagaaagtaaccagagccttttccttttccaagacccctaagagggctttacgccgcgctcttatgacatcacacgggtctgtcgagggcagatcacccagttctaacgataaacacgtgatgagtaggctgtcttctacgtcttcactggcagggataccatcgcccagccttgtgtctttacctagctttttcgagcgaagatcacacaccttatcccgatccaccacacatctgatctag

SEQ ID NO: 190055 - DNA, 1053 bp, Artificial Sequence
  Description of Artificial Sequence: Synthetic coding sequence
atgggcgccggcgccagcgccgaggagaagcacagccgggagctggaaaaaaagctcaaagaggacgctgagaaggatgcccgtaccgtgaagctactgctcctcggggcaggtgagtccgggaagagcactatcgtcaagcagatgaaaatcatccaccaggatgggtattccctggaagagtgcttggaattcatcgcaattatttacggtaatacactgcagagcatactggccatagtaagggccatgaccacgctgaacatccaatatggcgactccgccaggcaggacgacgccaggaagctgatgcatatggcagacacaatcgaggagggtacaatgccgaaggagatgagtgatatcatccagcgattatggaaggactcaggcattcaggcttgctttgaaagagcttccgaatatcagctgaacgatagcgctggatactatctttctgacttggaaagactggtgaccccggggtacgtgcccacggagcaggacgtgttgaggagtcgagtgaaaaccaccggcatcattgagacccagttttctttcaaagaccttaacttcagaatgttcgacgtgggtggacagaggtctgaaagaaagaagtggattcattgtttcgagggtgttacttgtataatctttatcgcagcccttagcgcttatgacatggtactggtcgaggacgatgaagtaaataggatgcatgaatctctgcacctcttcaacagcatctgcaatcaccggtatttcgctaccaccagcattgtgcttttcttgaacaagaaggacgttttcttcgagaaaatcaagaaagcccacctcagcatatgtttcccagactacgatggacctaacacctacgaggacgcaggcaactacattaaagttcaattccttgaacttaatatgcggagagacgtgaaggaaatttactcacatatgacgtgcgccaccgacacacagaacgtgaagtttgtgttcgacgccgtgaccgatatcatcataaaagaaaacttgaaggactgcggtctcttctag

SEQ ID NO: 190056 - DNA, 1065 bp, Artificial Sequence
  Description of Artificial Sequence: Synthetic coding sequence
atgggcagcggcgccagcgccgaggacaaggagctggccaagcggtcgaaggagcttgaaaaaaaactccaagaggatgcagacaaggaggctaagacagtgaagctcctcttgctgggggccggcgagagcgggaaaagcaccatcgtgaagcagatgaagattatccatcaggacggctactctcctgaggaatgcctggaatttaaggcaattatctatggaaatgtgttacagagcatcctcgccatcattcgggcgatgaccacattaggtattgactacgctgaaccttcatgtgctgatgacgggagacagctcaataatctggcagatagcatagaggaagggacaatgccccccgaactggtggaggtaatccggcgtctgtggaaagatggaggcgtacaggcttgtttcgaaagagcagctgagtaccaactgaatgatagtgcgtcgtactacttaaaccagctggagagaatcacggatcctgagtatctccccagcgagcaagacgtgctgcgcagccgagtgaagaccacgggcatcattgagactaagttcagcgtgaaggacttgaattttcggatgttcgacgtgggcggacagaggtctgagcgcaaaaagtggatacactgcttcgagggcgtaacatgcattatcttctgtgccgccttatctgcttacgacatggtgctggtggaagacgatgaggtgaaccgtatgcatgagagcctgcacctgttcaactctatttgtaatcataaatttttcgccgcaacaagtattgtattattcttaaataagaaggacttgtttgaagagaagatcaaaaaggttcacctgagcatttgtttccccgaatatgacggcaacaatagttatgacgacgctggcaactatattaagtctcaattcttggacctcaatatgcggaaggatgtcaaagagatctacagccatatgacttgcgctaccgatacccaaaacgtgaagttcgtgttcgacgcagtcaccgatattataattaaagagaatcttaaggattgcgggctgttttag

SEQ ID NO: 190057 - DNA, 1068 bp, Artificial Sequence
  Description of Artificial Sequence: Synthetic coding sequence
atgggctgccggcagagcagcgaggagaaggaggccgcccggcggtctaggcggattgatcggcatctccgcagcgaaagccagcgccagagacgggagattaagctgcttctacttggcacatctaacagcgggaagtcgactatagtaaagcagatgaagatcattcacagcggggggttcaacctggaggcttgcaaggagtacaaacctcttataatctacaacgccattgactcacttaccagaattatacgggcactcgctgccctcagaattgacttccataatccagaccgtgcatatgacgctgttcagctgttcgcactaacaggtccagcagagagcaaaggcgagatcacccctgagttacttggcgtcatgcggcggctctgggccgatccaggcgcacaggcctgctttagtcggtcttctgagtaccacctggaagataatgcggcctattacctcaacgatctggagcgaatcgctgccgctgactatattcccaccgtggaggacatactccggagtcgtgatatgactaccggaatagtagaaaataagttcactttcaaggagctgacgttcaagatggtcgacgttgggggccaacgaagcgaacgaaagaagtggattcattgtttcgaaggcgtcaccgctatcatattctgtgtggagcttagcggatacgacctgaagctctacgaggataatcagacttcacgtatggctgagtcactgcggctgtttgatagcatctgtaataataactggtttatcaatacgagcctcatcctgttccttaacaagaaggatctccttgccgagaaaattaggcgtattcctctcaccatttgctttcccgagtacaagggccagaacacctacgaggaggcggcagtgtacatccaaaggcagttcgaggacctgaaccggaacaaggagaccaaagaaatctacagccactttacctgcgccactgatacatccaacatccaatttgtcttcgatgcagttacggatgtgatcatccaaaataacctcaaatacatcgggttgtgctag

SEQ ID NO: 190058 - DNA, 912 bp, Artificial Sequence
  Description of Artificial Sequence: Synthetic coding sequence
atgaagatcatccacagcggcggcttcaacctggaggcctgcaaggagtataagcctctgattatctacaacgccatagacagtttgactcgaattatcagggccctggccgctcttaggatcgatttccacaatcccgaccgcgcctacgacgcagttcagctctttgccctgactggaccagccgagtctaaaggcgagatcactcccgaactccttggggtgatgaggaggctctgggccgatcctggggcccaggcctgtttctcccgctcatccgagtaccatttggaggacaacgccgcctactacctcaacgatttagagagaattgcggcagctgactacatcccaacagtggaggacatactgcggagcagggacatgacaacgggcattgttgagaataagtttactttcaaggagctaaccttcaagatggtagatgtaggagggcagaggtccgagcggaaaaagtggatccactgctttgaaggtgtgactgcaattatcttctgcgttgagttgagcggctatgatttgaagctgtatgaagataaccagacctccagaatggcagagtccttgcgcctattcgacagtatttgtaataataattggtttatcaacacgagtctgattctgttcttgaacaagaaagacctgttggcagagaagattaggcggattcccctcaccatatgttttccagagtataaaggacaaaatacatacgaggaagccgccgtgtatattcaacggcagtttgaagatctgaaccgaaataaggagactaaagaaatctacagccactttacttgcgctacagacactagcaacatccagttcgtcttcgatgcagtcacagacgtaatcatccagaacaacctaaagtatataggcctttgttag

SEQ ID NO: 190059 - DNA, 1188 bp, Artificial Sequence
  Description of Artificial Sequence: Synthetic coding sequence
atgtgcgaccagaccttcctggtgaacgtgttcggcagctgcgacaagtgcttcaagcagagggcactccgacccgtgttcaagaagagccaacagctgtcatactgctccacctgcgctgaaattatggcaacagaaggactccatgaaaatgaaactttggcaagcctaaagtctgaagcagagagcctgaagggcaagctggaagaggaacgggccaaactgcacgatgtggagcttcaccaggttgccgagagggtagaagcattgggccagtttgtgatgaagacgaggcggaccttgaaggggcacggtaacaaagtgctgtgcatggactggtgtaaggacaaacgacggatcgtttcaagctcccaggacggcaaagttatcgtgtgggactcattcactaccaacaaggagcatgcggtgactatgccttgcacttgggttatggcatgcgcttacgccccctccggctgcgcaattgcctgcgggggtttggataataaatgcagcgtttaccctctgaccttcgataaaaacgagaacatggccgcaaaaaaaaagtccgtcgctatgcacactaactatctgtcagcttgctcctttactaactctgacatgcagatcctgactgctagtggggacggtacatgtgcactctgggatgtcgaaagtggccagttgctccagtcatttcatggacacggggctgatgtgctgtgcctggacctggcacctagtgaaactggcaacactttcgtttcaggaggctgtgataagaaggccatggtttgggatatgcgctctgggcaatgcgtgcaggcattcgaaacccacgagagcgacattaattccgttcgttactatcctagcggcgacgctttcgcgagcggaagtgacgacgccacctgccggttgtatgacctgcgcgctgatcgggaggttgccatctattcaaaggaatctatcatatttggcgcttcgagcgtcgacttctctctaagtgggagattactgttcgctgggtataatgactataccattaacgtgtgggatgtgctcaagggctcacgtgtctctatcctcttcgggcatgagaaccgagtcagcacattaagggtatctcctgacggaactgccttctgctcgggcagctgggatcacacactccgagtgtgggcctag

SEQ ID NO: 190060 - DNA, 1062 bp, Artificial Sequence
  Description of Artificial Sequence: Synthetic coding sequence
atggccaccgagggcctgcacgagaacgagaccctggccagcctgaaaagcgaagcagaaagcctgaaggggaagctggaggaggagcgggcaaaactgcatgacgtagaacttcaccaggtggctgagcgggtcgaggccttaggtcagttcgtgatgaagacaaggagaacactgaaaggacacgggaacaaggtgttgtgcatggattggtgcaaggacaaacggagaattgtcagcagctcccaggacggtaaggtaatcgtgtgggattcttttacaacaaataaggagcacgctgttacaatgccttgcacctgggtgatggcctgcgcctacgcgccatcaggttgtgccattgcctgtggggggctggacaacaagtgctcagtctaccccttgactttcgacaagaacgaaaacatggccgccaagaagaagagtgtggccatgcacacaaattacctctccgcctgcagtttcacaaattctgacatgcaaattctgacagcctccggcgatgggacctgcgcgctctgggacgtcgagtcgggccagcttcttcaatctttccacggccacggggctgatgtgctttgtctggacctggctccttcagagacgggcaacaccttcgtctctggggggtgcgataaaaaggcaatggtgtgggatatgaggtcaggccagtgcgtgcaggccttcgagacacacgaatctgacatcaatagcgtccggtattatcccagcggagatgcctttgcctcagggagcgacgacgctacttgtcgcttgtacgacctccgcgctgatcgtgaggtagccatttattcgaaagagtcaatcatttttggcgcaagtagcgtagactttagcctgtcgggacggttactgtttgccgggtataatgactatactattaatgtctgggacgtcctaaaaggttcccgagtttcaatactcttcggccacgaaaaccgcgtgtccacgctgcgggttagccccgacggcacggctttctgtagcgggagctgggaccatacactgagggtgtgggcctag

SEQ ID NO: 190061 - DNA, 852 bp, Artificial Sequence
  Description of Artificial Sequence: Synthetic coding sequence
atggccaccgagggcctgcacgagaacgagaccctggccagcctgaagagtgaggctgaatccttgaaggggaagcttgaagaggaacgcgccaagctccacgacgtcgaactgcatcaggtggccgaacgtgtagaagcgctgggacaattcgtgatgaaaaccagacgtacacttaaggggcatggcaacaaagtgttatgcatggattggtgtaaagataagcgcaggatcgtgagctcgagtcaagacggaaaggttattgtctgggattcttttaccactaataagatcttgaccgcgtctggggacggaacctgtgccttgtgggatgtcgaaagcggccaactgctacagtcattccacggtcacggggccgacgtcctgtgcctggatttagccccctccgaaacaggcaacacgtttgttagcggtggttgtgataagaaagccatggtctgggatatgcgatccgggcagtgcgtccaggcttttgagacacatgaatccgacatcaactccgtccgttattatccgagcggtgatgcctttgcttcgggatcagacgatgcaacctgcagactctatgatttaagagctgaccgcgaggtggcgatttacagcaaagaatcaattatctttggtgctagctccgtggacttcagtttgtctggccgcttgctcttcgccgggtataacgactatacgatcaatgtctgggacgttctcaaggggagccgcgtgtctatcctgtttggccacgagaacagagtgtctaccctccgcgtgagtcctgacgggaccgcattttgctccgggtcctgggatcacacactgcgggtgtgggcctag

SEQ ID NO: 190062 - DNA, 582 bp, Artificial Sequence
  Description of Artificial Sequence: Synthetic coding sequence
atgagcaagctgctgatcctgatcctgaccgccagcggcgacggcacgtgcgccctatgggacgtggaatcagggcagctgctgcagtcctttcacggccatggcgcggacgtgttatgtctggaccttgcccccagcgaaaccggcaatacttttgtgagcgggggctgcgacaaaaaggccatggtgtgggacatgagaagcggtcaatgtgtccaagcattcgagacacacgagtccgatatcaatagtgtgagatactacccaagcggagatgccttcgcttcgggttcggacgacgctacttgtcgcctctacgacctgagagctgatagggaagttgccatctactcaaaggagtcaatcatcttcggtgccagttctgtagatttttctttgtctggccggctactgttcgctggatacaatgactatacgatcaatgtgtgggatgtgctgaagggaagccgcgtctccatacttttcggccacgagaacagagtcagcacattaagagtgtccccagacggcacggccttttgctctggatcctgggaccacactctccgcgtttgggcctag

SEQ ID NO: 190063 - DNA, 1023 bp, Artificial Sequence
  Description of Artificial Sequence: Synthetic coding sequence
atgagcgagctggaccagctgcggcaggaggccgagcagctgaagaatcaaattagggatgctcgcaaggcctgtgccgatgcaacactctcccaaattaccaataatatagaccccgtcggacgaatccagatgcgaacccgccgaaccctgcggggccatttggccaagatctatgccatgcactggggtacagactctagactgctggtctctgcttcccaggacggaaagctgattatctgggatagctataccaccaacaaagtgcatgctattccgctgagaagcagctgggtcatgacgtgcgcttatgccccctctgggaactatgtggcctgtggcggtctagacaatatatgcagcatttacaatttgaaaacaagggaaggcaatgtgcgggtgagtcgcgaacttgccggccacaccggttatctgtcttgttgccgtttcctggatgataatcaaatagtcacaagttctggtgacacaacgtgtgcactttgggatattgaaacaggtcagcagacgactacgtttaccggccatactggggatgttatgtccctgtccctggcccctgatacaaggctttttgtgtccggagcatgtgacgcatctgccaaactgtgggacgtgcgggaaggcatgtgtcggcagaccttcacaggtcacgagagtgacatcaatgccatctgtttctttccaaacggcaacgccttcgccaccggcagcgatgacgcaacttgccgcctattcgatctccgcgcagatcaggaactaatgacctatagccatgataatatcatctgcggcattactagcgtctcgttctccaaaagtgggcgcctcctgttagcaggttacgacgacttcaattgtaacgtgtgggatgctcttaaggccgacagagccggggtgctcgccgggcacgacaatcgcgtgagttgcctgggagtcacagacgatggaatggcggttgccacaggaagctgggattcctttcttaaaatttggaactag

SEQ ID NO: 190064 - DNA, 1023 bp, Artificial Sequence
  Description of Artificial Sequence: Synthetic coding sequence
atgagcgagctggaccagctgcggcaggaggccgagcagctgaagaaccaaatacgggacgccaggaaggcctgtgccgacgcaaccctctcacagatcacaaacaatattgacccagtagggaggatacaaatgcggacaagaagaacactcagaggtcacctggcaaagatatacgcgatgcactggggcactgatagcaggctactggttagcgcttcccaggacggaaaattaatcatatgggactcatataccacaaacaaggttcacgcaattcctctgcgttcctcatgggtgatgacttgcgcctacgcccctagcgggaattatgttgcctgtggaggtctcgataatatttgctccatctataatctcaagaccagagagggcaacgtgcgcgtgtctcgagaattagccggtcatactggatacctctcatgttgtcgttttctggatgacaatcagatagtgactagttccggagataccacgtgtgccttgtgggacatagagaccgggcagcaaaccactactttcacaggtcacacaggcgatgtaatgagcctctctcttgcccccgacacccgtctgttcgtgagtggggcttgcgatgccagcgccaagctgtgggacgtgagagagggaatgtgtcgccagacgtttactgggcatgaatctgatataaacgctatatgcttttttcccaatggtaacgctttcgcaaccggcagcgacgacgccacctgtaggcttttcgatttaagggctgatcaagagctgatgacatattcgcacgataatatcatctgtggaattacatccgtctcattcagtaagtctggtcgccttctgcttgccggatatgacgatttcaattgcaatgtttgggatgccctcaaggctgatagagctggcgtcctcgcaggacatgataacagggtaagttgcctgggcgtcacagatgacgggatggcagtcgctaccggttcttgggactccttcctgaagatatggaattag

SEQ ID NO: 190065 - DNA, 597 bp, Artificial Sequence
  Description of Artificial Sequence: Synthetic coding sequence
tgaggctacctgagctgctgccggttcctggacgacaaccagatcgtcacaagctcaggcgataccacttgcgccctttgggacatagagaccggccagcaaacgacgactttcacggggcacaccggagacgtcatgtcgctgagcctggccccagacaccagattgtttgtctctggcgcatgcgacgccagcgccaaactatgggacgtgcgcgagggcatgtgcagacagaccttcaccggccatgaatcagacatcaatgcaatttgtttttttcctaatgggaatgcctttgccaccggctccgacgacgccacatgccgactgttcgacctccgtgccgaccaggagctaatgacttacagccacgataacattatctgcggcattacctccgtgtccttcagcaaaagtggtcgactgctgttagcgggctatgatgactttaactgcaacgtatgggatgcattgaaggccgatagagccggcgtcctcgcaggtcatgataatcgggtaagctgtctcggagttaccgacgacggaatggccgttgccaccggttcttgggatagcttccttaaaatatggaactag

SEQ ID NO: 190066 - DNA, 444 bp, Artificial Sequence
  Description of Artificial Sequence: Synthetic coding sequence
atgagcgagctggaccagctgcggcaggaggccgagcagctgaagaaccagattcgtgatgctcgaaaggcttgcgccgatgccacactgtcccaaatcacgaacaacattgacccagttgggcgcatccaaatgcgtacccgcaggactctccgtggacatcttgccaagatctatgcaatgcactgggggaccgacagtcgcctccttgtgagtgccagtcaggatggaaaactgatcatctgggactcctacaccacgaacaaggttcatgctattcctctgaggtcatcttgggtgatgacctgtgcctacgctccttcagggaattacgtggcatgcggcggactggataacatctgctcaatatataacctcaaaactagggagggcaacgttagggtgagtcgcgaattagccggacatacaggcacctgcccgtag

SEQ ID NO: 190067 - DNA, 327 bp, Artificial Sequence
  Description of Artificial Sequence: Synthetic coding sequence
atgagcgagctggaccagctgcggcaggaggccgagcagctgaagaaccagatccgagacgctagaaaggcctgcgcagacgctacactgagccagatcacaaacaacattgaccccgtgggtaggatacagatgcggacgcgccgcacactgcgtgggcacctggccaagatttatgcaatgcactggggcactgatagccgcctcctagtgtctgcctcccaggacggcaagctgataatctgggattcatataccactaataaagtgcacgccatccccttaagaagttcttgggttatgacctgtgcctacgcccctagctag

SEQ ID NO: 190068 - DNA, 405 bp, Artificial Sequence
  Description of Artificial Sequence: Synthetic coding sequence
atgagcgagctggaccagctgcggcaggaggccgagcagctgaagaaccagatcagaataacgaacaacatcgatccggtagggcgcattcagatgagaactaggagaaccctacgcggccatcttgcaaagatctacgctatgcactggggtacagatagtcgattgctcgtgtcagcatctcaagatggaaaattaatcatttgggatagctatactaccaataaggtacacgctattcccctgcggtcaagctgggtcatgacctgtgcgtacgccccatcggggaattacgtcgcctgcggcggtctggataatatatgttccatttacaatctgaagaccagagagggtaacgtgagagtgtctagagaattggccggacatactggtacttgcccctag

SEQ ID NO: 190069 - DNA, 723 bp, Artificial Sequence
  Description of Artificial Sequence: Synthetic coding sequence
atgacctgcgcctacgcccccagcggcaactacgtggcctgcggcggcctcgataatatctgcagtatctacaacctgaagaccagagaaggtaatgtgcgggtttcacgcgagctggccggtcacactgggtacctatcctgttgtcggttcctggacgacaaccagatagttacaagttcaggcgacactacctgcgctctatgggatattgaaacgggtcagcagacgacaactttcactggtcacacaggggacgttatgtctctgtcgctcgcaccagacaccagactcttcgtctccggagcctgcgatgcatccgctaaactttgggacgtgagagaggggatgtgtcggcagaccttcactgggcatgagtctgacattaatgccatttgtttctttcctaacggaaacgcattcgctacgggttcagacgatgccacctgtagactcttcgacctgcgcgctgaccaggagctgatgacatattcacacgacaatataatctgtggcattacttccgtgagctttagcaagtctgggagacttctgctcgctggatatgacgactttaactgtaacgtgtgggatgccctaaaggccgacagggcaggcgtgctagccggccacgataacagagtgtcttgccttggagtcaccgacgacggcatggccgtggccacagggagctgggatagttttctcaagatttggaactag

SEQ ID NO: 190070 - DNA, 984 bp, Artificial Sequence
  Description of Artificial Sequence: Synthetic coding sequence
atgaccgccccctgccccccccccccccccgacccccagttcgtgctccgcggaacccagtctcccgtgcatgctcttcacttctgcgaaggggcccaggcacagggtaggcctctgctgttctccgggagtcagtcgggtctggtccacatctggagcctccagacgcgaagagctgtcaccaccctcgacggccacgggggacagtgtgttacttggctgcagaccctgcctcaggggcgccagcttctctcccagggcagggatctgaagctctgtttatgggatctggctgagggtcgcagcgcagtcgtcgattctgtatgcctggagtccgtgggattctgtagatcttccatcctcgccgggggccagccacgctggactctggccgtgcctggaagaggttctgacgaggttcagatactcgagatgccctccaagaccagtgtgtgcgccctgaagcctaaggcggatgccaaactaggtatgccaatgtgtctgcggctttggcaggctgattgttcgtcccgacccttattactcgcaggctacgaggacggtagcgtggttctgtgggacgttagtgagcaaaaggtgtgctcccggatcgcttgccacgaggaacccgttatggatttagattttgacagccaaaaggctcggggcatttctggatctgccggaaaagctttggcagtctggtctttagactggcagcaggcacttcaggtacgcggtacacatgagctgacaaatcctgggattgcggaagtcacgattcggccagacaggaagattctggcaacggcaggctgggaccaccgcatccgcgtattccattggaggacaatgcaaccactggccgtgctggcattccacagtgctgctgtgcaatgcgtggcctttactgctgatgggctgctcgctgccgggagcaaggatcaacgaatctcgttgtggagcctgtacccccgagcctag

SEQ ID NO: 190071 - DNA, 984 bp, Artificial Sequence
  Description of Artificial Sequence: Synthetic coding sequence
atgaccgccccctgccccccccccccccccgacccccagttcgtgctgaggggtacacagtcccccgtgcatgccttacatttttgcgaaggagcccaagcccaaggtcggcctctgctctttagtggctctcagtccggcctggtgcatatctggtctctgcagacccgcagggctgtcacaaccttggatggacacggcggtcagtgtgtcacctggctacagactttgccacagggacgccagctgcttagccagggcagggacctgaagttgtgtttatgggacctagcggagggccggtccgctgtggtggattccgtgtgcctggaatccgtcggcttctgccggtcctccatactcgccggaggtcagcccaggtggaccctggctgtccccggtagaggcagtgacgaggtacagatccttgagatgccctccaagacaagcgtttgtgctctgaagccaaaagcggacgccaaacttggtatgcctatgtgtttaagactgtggcaggctgactgctctagcagaccactgctgctggccggctatgaggatggatcagtggtactttgggacgtctccgagcaaaaagtctgctcccggattgcctgccacgaggagcccgttatggatctagatttcgatagtcagaaggctcggggaatatccgggagtgccggtaaggccttagcggtttggtcccttgattggcagcaagcactgcaggtcagaggaacgcatgagctcaccaacccagggattgccgaggtgacaatccggccagatcggaagatcctggccaccgccggctgggatcatcgaatcagggtttttcattggcggacaatgcaaccccttgccgtgctcgctttccatagcgcggccgtgcagtgtgtcgcttttaccgcagatggcctactcgccgcaggatctaaagatcagcggatctcgctctggagtctgtacccgagggcatag

SEQ ID NO: 190072 - DNA, 639 bp, Artificial Sequence
  Description of Artificial Sequence: Synthetic coding sequence
atgaccgccccctgccccccccccccccccgacccccagttcgtgctgcggggtacacagtcccccgtgcatgcattacatttctgcgagggagcacaggcccagggcagacctctgctattcagtggtagtcagtccggacttgtacacatttggtcactgcaaacacggagggccgtgaccacactcgatggccacgggggtcagtgtgtgacgtggctccagactctgccacagggccggcagttgctctcccagggcagagaccttaagctgtgtctttgggacctagccgagggccgaagcgcggtggtggattctgtttgtttggagagtgttggcttttgtaggtcctcaattcttgcaggaggccagcccagatggacattggctgtgcctgggcgcggttccgacgaggtgcagatcttggagatgccaagcaagacctctgtctgcgcgctcaagccaaaggcggacgccaaacttgggatgcccatgtgccttcgcttatggcaggccgactgctcatctagacctctgcttctggctggttacgaggatggcagtgtcgtcttatgggatgtctcagagcagaaggtctgtagccgaatcgcttgccatgaagaacctggcctgtag

SEQ ID NO: 190073 - DNA, 1023 bp, Artificial Sequence
  Description of Artificial Sequence: Synthetic coding sequence
atgagcgagctggagcagctgcggcaggaggccgagcagctgcggaatcaaatacgagatgcacgcaaagcgtgcggggattctacactcactcaaattacagcaggcctggaccctgtgggcagaatacagatgcggacgagacgtacgctccgtggacatcttgccaaaatctacgctatgcactggggtacagatagcaggcttcttgtgagcgcctcgcaggacgggaaactcataatttgggattcatacacaaccaataaggttcacgctattcctttgaggtcatcatgggtcatgacgtgtgcatacgccccatcgggcaacttcgtggcctgtggcggtttggataatatatgctctatctacagcctcaagacgagagagggcaacgtgagggtctctcgcgagctcccagggcataccggctatctcagctgctgccgatttctcgacgataaccaaattatcacttccagcggagacaccacctgtgccctgtgggacatcgagactgggcagcagaccgttgggtttgccggccacagtggtgacgtgatgagcctcagtcttgctcccgacggccgtacatttgtctccggggcttgtgacgcatccatcaagctttgggatgtcagagactcaatgtgtcggcagacatttattgggcacgagtccgatatcaatgcagttgcattttttcccaatgggtacgcttttactacaggaagcgacgatgctacctgtagactcttcgatctcagagccgaccaggaattactgatgtacagccatgacaacatcatttgcgggataacatcggtggcattctcgcggagcggtagactgttgctggccggttatgatgactttaattgtaacatctgggatgctatgaaaggtgaccgagcaggggtgttggcagggcacgacaacagggtctcatgcttgggggtcactgacgatggcatggcagtggcaacaggatcatgggactcttttctgaaaatctggaactag

SEQ ID NO: 190074 - DNA, 1023 bp, Artificial Sequence
  Description of Artificial Sequence: Synthetic coding sequence
atgagcgagctggagcagctgcggcaggaggccgagcagctgcggaatcagatacgtgatgccagaaaagcctgcggagattcaaccctaacccagattactgcaggcctcgatcccgtcgggcgaattcagatgcgtacaagaagaacactgagaggtcatttagccaaaatatacgctatgcactggggtaccgattccaggcttcttgtgtcagcctcacaagacggaaagctaattatatgggattcctacacaactaacaaggtacatgctatccctctgagatccagttgggtcatgacatgtgcatacgccccgtctggaaattttgtggcctgcgggggcttggacaatatttgttcaatctactcactgaagacaagggagggcaacgtgcgcgtgagtcgagagctcccgggacacacaggctacctttcttgttgccgcttccttgatgataatcagatcatcacatcatctggggacacaacctgcgccctttgggatatagaaaccggtcagcaaactgtcggctttgcgggtcactccggagatgtaatgtctttgagcctcgctcctgacggcagaacatttgtgtccggggcatgcgacgcatcaatcaagctctgggacgtgagggactcaatgtgtcgacaaacattcatcgggcacgagtctgacatcaatgctgttgcattcttccctaatggctatgcctttacaaccggatctgacgacgcgacctgtagactgtttgatctgcgtgccgaccaggaattgctgatgtactcacacgacaatattatctgtggcattaccagcgtagcctttagccgaagtgggcgtcttctgctggcaggctacgatgacttcaattgcaacatttgggatgccatgaagggtgacagagctggtgtgctcgccggccacgacaaccgagtatcctgtttgggggtcacagacgacggcatggccgtggcaacagggtcttgggacagctttttaaaaatatggaactag

SEQ ID NO: 190075 - DNA, 1023 bp, Artificial Sequence
  Description of Artificial Sequence: Synthetic coding sequence
atgagcgagctggagcagctgcggcaggaggccgagcagctgcggaatcagattagagatgcgagaaaagcgtgtggtgactcgaccctgacccagattaccgcaggcctggacccggtaggccgcatccagatgagaactaggcggacgctccgcggccatctggcgaagatctacgctatgcattgggggacggactcaagactgctggtttctgcgagccaggatggcaagctgataatttgggactcttacactaccaacaaagtacatgccatcccactgcgtagctcgtgggttatgacatgcgcttatgccccgtccggcaacttcgtggcgtgtgggggactggataacatatgctccatttactctctgaaaacaagggaaggtaatgttcgagtgtctcgggaactgcctgggcatacaggttacctgtcatgctgccggttcctcgatgacaaccaaatcatcacctcgagcggagacacaacctgtgcactgtgggacatcgaaaccggacagcagacagttggcttcgccggccatagtggggatgttatgtccctgagtctggcccccgatggacggacttttgtttctggagcctgtgatgcaagcataaagctgtgggatgtgcgggacagcatgtgtcggcagacgtttatcggacatgaatctgacattaacgccgtcgcatttttccccaacggctatgctttcaccacaggctcagatgatgccacgtgtcgcctcttcgacctgcgtgcagaccaggagctgcttatgtactctcacgataatatcatttgcggcataaccagtgtggccttctcaagaagcggcaggctgctgctggccggttacgacgatttcaattgtaacatctgggatgctatgaagggagatagggcaggggtgctagccggccatgacaaccgcgtctcctgtcttggggtcaccgatgatggtatggctgttgctacaggttcctgggactcatttctgaagatttggaattag

SEQ ID NO: 190076 - DNA, 459 bp, Artificial Sequence
  Description of Artificial Sequence: Synthetic coding sequence
atgagcgagctggagcagctgcggcaggaggccgagcagctgcggaaccaaattagggacgcaagaaaggcttgcggagattctactctgacccagatcacagcaggactggaccccgtcgggagaatccagatgaggacacgtcggacacttagaggacacctcgcaaaaatctacgccatgcactggggaaccgattcgaggctcctcgtgtccgcctcccaagacgggaaactgatcatttgggactcttataccaccaacaaggtgcatgcgattcccctccgctccagttgggtgatgacatgcgcctacgccccctcggggaattttgtggcctgtggtggattggataacatttgctccatctactctttaaaaacacgggaaggcaatgtacgggtgtccagagagttgccaggccacaccgggtatctctcttgctgtcgcttcttatag

SEQ ID NO: 190077 - DNA, 723 bp, Artificial Sequence
  Description of Artificial Sequence: Synthetic coding sequence
atgacctgcgcctacgcccccagcggcaacttcgtggcctgcggcggcctggacaacatttgtagtatttactctttgaagacacgtgagggcaacgtccgcgtgtctagagagctgccaggacacacaggatacctgtcatgctgccggttcctcgatgataatcaaatcatcacttccagtggggacaccacatgcgccctctgggacattgagacgggtcagcagactgtgggatttgctggacactccggagacgtgatgtctctttccctggctcccgacggcagaacttttgtttctggagcctgtgacgccagcattaaactctgggacgtacgcgactccatgtgccgtcagaccttcatcgggcacgaatcagacatcaatgccgtcgcttttttccccaacggttacgcctttacaaccggatcggatgacgccacgtgtcggttgttcgatctgagggcggatcaggagcttctgatgtattcacatgataacattatctgcggaataacgagtgttgcgttttccagatccggtcggctgctgctggctgggtatgatgactttaattgtaatatctgggatgcaatgaaaggcgaccgtgctggggttttggctgggcacgacaaccgggtgagctgcttaggtgtgactgacgatggaatggccgttgccacaggtagttgggatagctttctgaaaatctggaactag

SEQ ID NO: 190078 - DNA, 891 bp, Artificial Sequence
  Description of Artificial Sequence: Synthetic coding sequence
atgcggacccggcggaccctgcggggccacctggccaagatctacgcgatgcactggggcaccgattcgcgattattagtaagtgcatcgcaagatggaaagttaatcatctgggactcatacaccaccaacaaagtccacgctatccccctgaggagtagctgggtgatgacgtgtgcatacgcaccctcgggtaatttcgtggcctgtggagggctggacaatatctgttccatttattcactcaagacccgcgaaggaaacgtgagagtgagccgggaacttcctggccacacgggatacctgtcttgctgccggttcctggacgataaccagattatcaccagcagcggagacaccacttgtgcattatgggacatcgagacagggcaacagactgtcggtttcgctgggcactctggagacgtgatgtcacttagcctggcaccagatgggagaacttttgtgagcggcgcctgcgacgcttcaattaaactctgggatgtgagagattcgatgtgccggcaaactttcatcgggcatgagtccgacattaatgcagtcgcgttctttccgaatggatatgcattcacgacgggctcagacgacgctacatgtcggttgttcgacctgcgcgccgatcaggaacttctgatgtactcacatgataatattatttgcggtatcaccagtgtggccttttcaagaagtggccggctcctgctggcaggatacgatgattttaattgtaatatctgggacgccatgaaaggcgatcgagccggagtattggcagggcatgacaatagagtgtcctgcctgggggtcactgacgacggcatggccgtggccacgggaagctgggatagttttctgaagatatggaactag

SEQ ID NO: 190079 - DNA, 723 bp, Artificial Sequence
  Description of Artificial Sequence: Synthetic coding sequence
atgacctgcgcctacgcccccagcggcaacttcgtggcctgcggcggcttagacaacatttgttctatctatagcttaaaaactagagaaggcaacgtgcgggtgtcccgggagctgccaggtcacactggttatcttagttgttgtcggttcctcgacgataaccagataatcacctcgagcggtgacaccacatgtgccttgtgggacatagaaactggccagcagacagtgggcttcgccgggcactccggagacgtcatgtctttatctcttgctccggatggtcgtacctttgtgtcgggcgcctgtgacgcctcgatcaaactgtgggacgtgagagattcaatgtgccgacaaaccttcataggacacgagagcgacattaatgcagttgctttttttccaaatggttatgccttcacaaccggtagcgatgacgcgacttgccgactgttcgatctaagagcagaccaggagctgttgatgtacagtcatgataacattatatgcggaatcacctctgttgccttctcccggtccgggaggcttcttttggcaggttatgatgactttaactgtaatatatgggacgcgatgaagggggatcgggccggggtactggcaggacacgacaatcgagtaagttgtctgggcgtgactgacgacggaatggcggtcgccaccggcagctgggactcgtttctgaagatatggaattag

SEQ ID NO: 190080 - DNA, 699 bp, Artificial Sequence
  Description of Artificial Sequence: Synthetic coding sequence
atgagcgagctggagcagctgcggcaggaggccgagcagctgcggaatcagatacgcgacgcccggaaggcctgtggagacagtacactaacacaaattaccgccggcctggaccccgtagggcgcatccagatgagaacccgccggacgctgagagggcatctggcgaaaatctatgcgatgcactggggcacagattcacggctgttggtctctgcatcgcaggacggtaaacttatcatctgggactcctacacaaccaataaagtacacgccataccgctcaggtctagctgggtgatgacatgtgcatacgccccttcagggaacttcgtcgcatgtggaggcctcgacaacatctgtagcatctattcactgaagaccagggagggaaatgttcgggtgtccagggaactgcccggccacacagggtatctgagttgttgccgcttcctggacgacaatcagattataacatcaagcggggatacgacctgtgcactctgggacattgaaaccggacaacagactgtagggttcgccggacacagtggggatgtgatgagcctgagtcttgcccccgacggccgcactttcgtcagcggcgcctgcgacgcatcgattaagctctgggatgtcagggattctatgtgtaggcagacctttattgggcacgaaagcgacattaatgccgtgtag

SEQ ID NO: 190081 - DNA, 891 bp, Artificial Sequence
  Description of Artificial Sequence: Synthetic coding sequence
atgcggacccggcggaccctgcggggccacctggccaagatctacgctatgcactggggcactgatagcagacttttggtgtccgcaagccaagacggcaagctcattatctgggacagctataccaccaataaagtccatgctatccctttgcgctcatcctgggttatgacttgcgcctacgcccctagcggcaacttcgtagcatgtggcggcttagacaacatctgtagcatttactctttgaaaactcgggaagggaatgtgagggtgtcacgcgagttgcccgggcatactggatacctgagctgttgtagattcctcgacgacaaccagattattacatcttccggggacactacctgcgctctgtgggatatagaaacaggacaacagacagtggggtttgcggggcattcgggtgacgtgatgtctttgtccctagcccccgatggcaggacattcgtgtcaggtgcctgtgatgccagtatcaaactgtgggatgtcagggatagtatgtgtagacagacttttatcggacacgagtctgacatcaacgctgttgcttttttccccaacgggtacgccttcacaacgggtagcgatgatgctacctgccggctgtttgacctccgcgccgaccaagaacttctgatgtatagtcacgataatatcatctgtgggatcacatctgtcgccttttctcggtctggtcggctgcttcttgcgggctatgatgactttaactgcaatatttgggacgctatgaaaggcgaccgcgcgggggtgctggcgggccacgacaaccgggtctcgtgtctgggtgtgaccgacgatgggatggcagtggctactgggtcatgggacagcttcctgaaaatctggaattag

SEQ ID NO: 190082 - DNA, 756 bp, Artificial Sequence
  Description of Artificial Sequence: Synthetic coding sequence
atgagcgagctggagcagctgcggcaggaggccgagcagctgcggaatcagatccgcgacgcccggaaagcatgcggagatagcaccctgacccagatcacagcaggacttgacccagtaggtaggattcagatgcgcactaggcggactctgcggggacacctggctaagatatacgcaatgcattggggcacagattcacgattgctagtgtctgccagccaggacggcaagctaattatctgggatagttatactacaaacaaagttcacgctatcccgctacggtcttcgtgggtaatgacttgcgcctatgcccccagcggcaattttgtagcctgtggaggactggataacatttgctccatatactctttgaaaacccgagagggaaatgtgagggtctctcgggagctgcctggccacactgggtatctgtcatgttgccgtttcctcgacgataatcaaatcataacctcatccggcgataccacttgtgctctgtgggacatcgagaccggacagcagactgttggtttcgcaggtcacagcggagacgtaatgtccttaagtcttgccccagacggtagaactttcgtttcgggagcatgtgatgcatccatcaaactgtgggacgtccgcgattccatgtgcagacagaccttcatcggacacgaatccgacattaatgctgtcgccttcttccctaatggctacgcttttactactggatcggatgacgctacttgtagatag

SEQ ID NO: 190083 - DNA, 828 bp, Artificial Sequence
  Description of Artificial Sequence: Synthetic coding sequence
atgagcgccgaggtgaaggtgaccggccagaaccaggagcagttccttcttctggccaagtccgcaaaaggcgccgcattagctaccttgatccatcaggtcctggaggctccaggcgtatatgttttcggcgagcttcttgatatgcccaacgtgcgagaactcgctgaaagtgactttgcgagtaccttccgtctgttgacagtctttgcatatggaacctatgctgattacctcgcggaggcgaggaacctgcccccgctcactgaggcgcagaaaaataagctgcggcacctcagcgtggtcactctcgccgccaaggtcaagtgcataccgtacgctgttctgttagaagcactggcccttcgcaatgtgaggcagctcgaagacctggtcatcgaagccgtttacgccgatgtactccggggcagccttgatcagaggaatcagagattagaggttgactactcaataggcagggatattcagcggcaagatcttagtgccattgccaggaccctacaggagtggtgtgtgggctgcgaagtcgtccttagtgggattgaggaacaggtgagtcgcgccaaccagcataaagagcaacagctaggcctcaaacaacagatagagtccgaagttgctaacctgaaaaagacaatcaaggtgaccaccgccgcagcggcggctgctacctcacaggaccccgaacagcacctcaccgaattgcgcgaacccgcgccaggaactaatcagcgccagccgtctaagaaagcgtccaaaggaaagggacttagaggcagtgccaaaatatggagcaagtccaattag

SEQ ID NO: 190084 - DNA, 387 bp, Artificial Sequence
  Description of Artificial Sequence: Synthetic coding sequence
atgaccagcctgttcgcccaggagatccggctgagcaagcggcacgaggagatagtgtcacagcgcctcatgttgctgcagcagatggaaaacaaactaggagaccagcacacagagaaagccagtcaactgcaaaccgttgagactgctttcaagagaaacctctcactgttaaaggatattgaagccgccgagaaaagcttgcagacgcgtatccatcccctgccgagaccagaagtggttagtcttgagacccgttattgggcatcagtggaggagtatattcccaaatgggaacagtttctgctgggaagagctccttatccatttgccgtagaaaaccagaacgaggccgaaaataccatccagaacgaagcccagagatag

SEQ ID NO: 190085 - DNA, 1023 bp, Artificial Sequence
  Description of Artificial Sequence: Synthetic coding sequence
atgagcgagctggagcagctgcggcaggaggccgagcagctgcggaaccagattcaggacgcacgaaaagcttgcaacgacgcaactctggtgcaaattacaagcaatatggactccgtcggcagaattcagatgcgaactcgtaggactctgcgtggacatctggcgaaaatctacgctatgcattggggatatgatagccggctgctggtgtccgcttcacaggacgggaagctgattatctgggattcttacaccactaacaaaatgcacgcaatcccactacggtcttcttgggtcatgacctgtgcatacgctccctcaggcaattacgttgcctgtggcggcctggacaatatctgttccatttacaatctcaagacacgggaaggcaacgtacgagtctccagagaactgcccggccacacagggtacctcagctgctgccggttcctggacgattcacagattgttacttcaagcggagacacaacctgtgccctctgggacatagaaactgcccagcagactactacttttaccgggcactccggcgacgtcatgtcactgtccctgtcaccggacatgagaactttcgtcagcggagcatgtgatgcttcttcgaaactttgggacataagggacggcatgtgccgccagagctttaccggccacgtgagcgacataaatgccgtctcattcttccccaatggatacgcattcgctacagggtccgacgacgctacctgcagactattcgacttgagagctgatcaagaactgctgttatacagccacgacaacatcatctgcggcatcacctccgtggccttttccaagagcgggcgtctgcttttagcaggttacgatgattttaattgcaacgtctgggacacgctcaagggcgaccgggcaggtgtgttggctggccatgataacagggtctcttgcctgggtgtgactgacgatggcatggccgtggctacgggctcctgggactctttcctcaggatatggaattag

SEQ ID NO: 190086 - DNA, 240 bp, Artificial Sequence
  Description of Artificial Sequence: Synthetic coding sequence
atgagcgagctggagcagctgcggcaggaggccgagcagctgcggaatcagatccaagacgctcgcaaagcatgtaacgacgcaacattggtccagatcacctctaatatggattcagtggggcgtatccagatgcgtactagacggacccttagaggccacctggccaagatctacgcaatgcattggggatacgactcacgccttcttgttagcgcgtctcaggatggtaagctctag

SEQ ID NO: 190087 - DNA, 204 bp, Artificial Sequence
  Description of Artificial Sequence: Synthetic coding sequence
atggaggagtgggacgtgccccagatgaagaaggaggtggagagcttaaagtaccaactcgcctttcaaagagagatggcctccaaaacaattccagagctcctgaaatggattgaagatggaatccccaaagacccatttctgaaccctgacctgatgaagaataacccctgggttgagaaagggaagtgtactatactttag

SEQ ID NO: 190088 - DNA, 216 bp, Artificial Sequence
  Description of Artificial Sequence: Synthetic coding sequence
atggccagcaacaacaccgccagcatcgcccaggcccggaagctggtcgaacaactgaagatggaagcaaacatagatcgaatcaaagtctctaaagccgctgctgacttgatggcatactgcgaagcccacgccaaggaagacccacttctgactccggtccctgcgtccgagaaccctttcagggagaaaaaatttttttgtgccattctttag

SEQ ID NO: 190089 - DNA, 309 bp, Artificial Sequence
  Description of Artificial Sequence: Synthetic coding sequence
atgcagggcaagctgcagccccccatggagcgggaggcccgggacggggtgccgtccggaaaggtgtttttgaaggacctgtctagcactccaatggcatctaataacaccgcaagtatcgcccaggcacgcaaactggttgagcagctgaaaatggaagctaatattgatcgtattaaagtgagtaaagctgcggcggatctgatggcgtactgcgaagcccatgccaaggaggatcccttattgaccccagttccggcaagcgaaaacccatttagagaaaaaaagtttttctgtgcaatactgtag

SEQ ID NO: 190090 - DNA, 216 bp, Artificial Sequence
  Description of Artificial Sequence: Synthetic coding sequence
atggccagcaacaacaccgccagcatcgcccaggcccggaagctggtcgaacagctcaagatggaggccaacatagacagaataaaagtgtcaaaagccgcagccgacctcatggcatattgtgaggctcacgccaaggaggacccgcttttgactcctgttccagcgagcgagaatccattcagagagaagaagtttttctgtgcgatcctatag

SEQ ID NO: 190091 - DNA, 216 bp, Artificial Sequence
  Description of Artificial Sequence: Synthetic coding sequence
atggccagcaacaacaccgccagcatcgcccaggcccggaagctggttgagcagttgaagatggaagctaacattgaccggatcaaagtgtccaaggccgccgctgacctgatggcctactgcgaggcccacgcaaaggaggaccctcttctgacccccgtgcccgccagcgagaacccttttagagagaagaagtttttttgcgcaatactgtag

SEQ ID NO: 190092 - DNA, 216 bp, Artificial Sequence
  Description of Artificial Sequence: Synthetic coding sequence
atggccagcaacaacaccgccagcatcgcccaggcccggaagctggtcgaacaattgaaaatggaagctaatatcgacaggatcaaagtgtcaaaggcagccgcagatctcatggcctattgcgaagcccacgccaaggaggacccacttctgaccccggtgcccgctagcgaaaaccccttccgcgaaaagaaattcttctgcgctattctgtag

SEQ ID NO: 190093 - DNA, 216 bp, Artificial Sequence
  Description of Artificial Sequence: Synthetic coding sequence
atggccagcaacaacaccgccagcatcgcccaggcccggaagctggtggagcagctgaaaatggaggccaacattgaccggatcaaggtctccaaagccgccgccgacttaatggcctactgcgaggcacacgccaaggaagatcccctgctcacaccggtaccagcttcagagaaccccttccgggagaagaagttcttctgcgccatcctctag

SEQ ID NO: 190094 - DNA, 333 bp, Artificial Sequence
  Description of Artificial Sequence: Synthetic coding sequence
atggtgtacctgcaggccaagacccggatccccgagcaccggaaggtgactcagctcattaaatgctggtccccggacctcaaccccgtgtttctcaaagacctctcaagcacccccatggccagcaataacaccgcatctatcgctcaggcacggaagctagtggaacagttgaagatggaggccaatatagaccgcattaaagtgtcaaaggcggctgccgatcttatggcatattgcgaagcccatgccaaggaagaccccctgcttacccctgtccctgcatccgaaaatccctttagagagaagaaattcttctgcgccatcctatag

SEQ ID NO: 190095 - DNA, 207 bp, Artificial Sequence
  Description of Artificial Sequence: Synthetic coding sequence
atgagcggcagcagcagcgtggccgccatgaagaaggtggtgcagcagttgcggcttgaagccggactgaatcgggtgaaggtaagtcaggctgcagccgacttaaaacagttctgtctgcaaaatgcacagcatgatcccttactcaccggggtctcttcctccaccaatccattccggccgcagaaggtctgcagttttctatag

SEQ ID NO: 190096 - DNA, 207 bp, Artificial Sequence
  Description of Artificial Sequence: Synthetic coding sequence
atgagcggcagcagcagcgtggccgccatgaagaaggtggtgcagcagctccggctggaggcagggttgaatagggtaaaagtttcacaggccgctgccgatcttaagcaattttgcctgcagaatgcccagcatgatcccttattaactggagtaagcagcagtacgaatcccttcagacctcaaaaggtctgcagcttcctgtag

SEQ ID NO: 190097 - DNA, 225 bp, Artificial Sequence
  Description of Artificial Sequence: Synthetic coding sequence
atgcccgtgatcaacatcgaggacctgaccgagaaggacaagctgaagatggaggtggatcagttgaagaaagaagtcactcttgagcggatgcttgtgtcgaaatgttgcgaggaggtccgagactacgtagaagagcggtcaggagaggatcccttggtcaaagggatcccagaagacaagaacccgttcaaggaattgaaaggcggctgcgtgatcagttag

SEQ ID NO: 190098 - DNA, 225 bp, Artificial Sequence
  Description of Artificial Sequence: Synthetic coding sequence
atgcccgtgatcaacatcgaggacctgaccgagaaggacaagctgaagatggaggtggatcagcttaagaaagaggtgacacttgagaggatgttggtcagcaagtgttgtgaagaagtgcgcgactacgtcgaagaacggtcaggtgaagaccctctcgtcaaagggatcccagaggacaaaaatccctttaaagagctcaagggcgggtgcgtcatttcttag

SEQ ID NO: 190099 - DNA, 210 bp, Artificial Sequence
  Description of Artificial Sequence: Synthetic coding sequence
atggcccaggacctgagcgagaaggacctgctgaagatggaggtggagcagcttaaaaaagaagtgaagaatacacggatcccaatctccaaggccggcaaagaaattaaagagtacgtcgaggctcaggctggaaacgaccccttccttaaaggcatccccgaggacaagaatccatttaaggaaaagggagggtgtctgatatcatag

SEQ ID NO: 190100 - DNA, 210 bp, Artificial Sequence
  Description of Artificial Sequence: Synthetic coding sequence
atggcccaggacctgagcgagaaggacctgctgaagatggaggtggagcaactgaaaaaagaggtcaagaatactcgcatcccaatctccaaagccgggaaggaaatcaaagaatacgtggaggctcaggccggtaacgatccattccttaaaggcatccctgaagacaaaaacccttttaaagagaaaggaggttgcctaatttcctag

SEQ ID NO: 190101 - DNA, 210 bp, Artificial Sequence
  Description of Artificial Sequence: Synthetic coding sequence
atggcccaggacctgagcgagaaggacctgctgaagatggaggtggaacaattgaagaaagaagtgaaaaacacgcgcattcccatctctaaggctggcaaggagatcaaagagtacgttgaagcacaggcagggaatgatccgtttctaaaaggaatcccagaggataagaatccgtttaaggagaagggcggctgtctgatctcatag

SEQ ID NO: 190102 - DNA, 210 bp, Artificial Sequence
  Description of Artificial Sequence: Synthetic coding sequence
atggcccaggacctgagcgagaaggacctgctgaagatggaggtggagcaactcaaaaaggaagtgaagaatactcgcatcccaatttctaaagcggggaaggagatcaaggagtatgtggaagctcaggctggcaacgaccctttcctgaagggaattcctgaggataaaaatcctttcaaggaaaaaggagggtgcctcatctcatag

SEQ ID NO: 190103 - DNA, 210 bp, Artificial Sequence
  Description of Artificial Sequence: Synthetic coding sequence
atggcccaggacctgagcgagaaggacctgctgaagatggaggtggaacagttgaagaaggaagtgaagaacacccggatcccgattagcaaggccggaaaagagatcaaagagtatgttgaagctcaggctggtaacgacccattcctgaaagggatcccagaagataaaaatcctttcaaagagaagggggggtgtctgataagttag

SEQ ID NO: 190104 - DNA, 1080 bp, Artificial Sequence
  Description of Artificial Sequence: Synthetic coding sequence
atgaccctggagagcatcatggcctgctgcctgagcgaggaggccaaggaggcaaggagaatcaacgatgagattgagcgacaattgagaagagataaacgagacgcacgtagggagttgaagttgctactcctgggaactggtgagagtgggaaatctacatttattaagcagatgcgaattattcatggaagcggatatagcgatgaggacaagagggggttcaccaaattggtataccagaatatttttacagctatgcaggccatgattcgtgccatggacaccctgaaaattccctataaatacgaacacaacaaggcacacgcacaactggtgagagaagtagatgttgaaaaagtctctgcttttgagaacccatatgtcgatgcgatcaaaagtctgtggaatgaccccggaatccaagagtgttacgacagaagaagggaataccagctgtcggactctacaaagtattacttgaatgatttggaccgagttgcggaccccgcctacctgcccacccagcaggatgttctccgagttcgggttcccaccaccggaatcattgaatacccctttgacctgcagagcgtgatcttccggatggttgatgttggaggccagagaagtgaaagacgcaaatggattcactgtttcgagaatgttaccagcataatgtttctcgttgcgctgtcggagtatgatcaagtgctagtggagtccgacaacgaaaataggatggaggaaagtaaggctctctttcgcacgataataacctatccttggtttcagaatagctcagttatactcttccttaacaaaaaggaccttctggaggagaagatcatgtattcccacctggtggattacttccctgagtacgatggacctcagagagacgcgcaagctgcgagggagttcatcctgaagatgttcgttgatctcaacccagattcagataagattatttatagtcatttcacttgtgccactgacacagaaaatatccggttcgtgtttgcagctgtgaaagacactattctccagcttaacctgaaagaatacaatttagtttag

SEQ ID NO: 190105 - DNA, 474 bp, Artificial Sequence
  Description of Artificial Sequence: Synthetic coding sequence
atggtggacgtgggcggccagcggagcgagcggcggaagtggatccattgtttcgaaaatgtaacctctataatgtttcttgtggccctgtcagagtacgaccaagtcctagtggaatcggataatgaaaatcgtatggaagagtccaaggccctgtttagaactatcatcacctatccttggttccagaacagctccgtcatactgttcctcaacaaaaaagacctgctagaggagaagattatgtacagccacctggtggattattttcccgaatatgacggaccccagcgggatgcgcaagccgctcgcgaatttatcctgaaaatgttcgtggatctgaatccggattctgacaaaattatctacagccacttcacgtgtgctactgacaccgagaatatacgatttgttttcgccgcagtcaaggataccattctgcagctgaacttaaaagagtataacctggtctag

SEQ ID NO: 190106 - DNA, 513 bp, Artificial Sequence
  Description of Artificial Sequence: Synthetic coding sequence
atgggcgagcggtgggccgacagccagctggacagccggagcacccacggaaccggcgagtccgggaagagtaccttcatcaaacagatgcgcataatacacgggtcaggctacagcgatgaggacaagagaggttttaccaaactggtttaccaaaacatcttcactgctatgcaagcaatgattagggccatggatacactgaaaatcccgtacaagtacgagcataacaaagcacacgcgcaacttgttagggaggtggacgtagagaaggtaagcgcctttgagaacccttatgttgatgccatcaagtccctgtggaatgaccctggcatccaggagtgctacgataggagaagggagtatcagttatcagattccacaaaatactatctgaatgacctggatcgtgtggccgaccctgcgtacctgccaacacagcaggatgtccttcgcgtgcgtgtccctactacaggtatcattgaatacccgttcgacctccagtcggtctag

SEQ ID NO: 190107 - DNA, 1824 bp, Artificial Sequence
  Description of Artificial Sequence: Synthetic coding sequence
atgccccggaagaagcccttcagcgtgaagcagaagaagaagcagctgcaagacaagcgtgaaaggaaaagagggctccaagatgggctgaggagctcttccaatagcagatcaggcagccgggaaaggcgggaagagcagacagacaccagtgatggagagtccgttacccaccacatccgccggctgaaccaacagccatcacaggggctcgggccgcgcgggtacgatcccaatcgatatagattgcacttcgagcgcgactcacgggaggaggtcgagcggcggaaaagagctgccagagagcaggtgttacagccagtcagcgccgaactcttggagctcgatataagggaagtctaccagccgggttcagttctcgatttcccccgtcgcccgccttggtcctatgagatgtccaaagagcagctcatgtcccaggaggagagaagtttccaggattacctaggcaagatccatggcgcctattcatcggagaaattatcctatttcgaacacaacctggaaacatggaggcagctctggcgcgtgttagaaatgagtgatatcgtcctgctcatcactgatatccgtcacccagtggtcaactttccgcctgctctctacgagtacgtgaccggcgagctggggctggcactagttctcgttctcaataaagttgatctggcgccccctgccctcgtggtcgcgtggaaacactattttcaccagcactatccccagctgcatgtagtcctattcacttcctttcctagagatccaagaacaccccaggacccatcctctgttctgaaaaagtcccgccggaggggcaggggatggaccagagcactcgggccggaacagctgctgagggcgtgcgaagccattaccgtcgggaaggttgacttatcctcctggagggagaagatagcgcgggacgttgctggggccacatggggcaacgggagtggggaagaagaggaggaggaagacgggccagctgtgctggtggagcaacaaacggattcagctatggaacccacagggccgactcaggagaggtataaggacggggtggttacgattggatgcgtcgggtttcctaacgtgggcaagtctagcctgataaatggcctcgtgggtaggaaggtggtgtcagtttctagaacacctggccatacaaggtattttcagacgtactttctgactcctagcgttaaactctgtgattgtccagggctgatatttccctcattgcttccacgccagctgcaggtcctggcggggatctacccaattgcgcagattcaagagccatacaccgcagtggggtatctcgcgtcaaggattcccgtgcaagccctgctgcacctgcggcatcccgaagctgaagacccctcggctgaacatccttggtgcgcatgggacatctgtgaggcgtgggccgagaagagaggatacaaaacggccaaggccgccagaaacgatgtttaccgggccgctaatagtctgttgagacttgcagttgatggccgactgagcctgtgctttcatccccctggctactccgaacagaaaggcacctgggagagtcaccccgagaccacagagctggtggtgctccagggcagagtgggcccagccggtgacgaagaggaggaggaagaagaggagttgtccagttcctgcgaggaggagggcgaggaggatcgcgacgccgacgaggagggcgaaggtgacgaggagacccccaccagtgcccctgggtcctctctcgctggacggaacccatacgctctacttggtgaggacgagtgctag

SEQ ID NO: 190108 - DNA, 1224 bp, Artificial Sequence
  Description of Artificial Sequence: Synthetic coding sequence
gtggtgaacttcccccccgccctgtacgagtacgtgaccggcgagttgggtctggcccttgtcctagttcttaacaaggtggacttagcaccgcccgctctcgttgttgcctggaaacactattttcatcaacattaccctcaactgcatgtggtcctcttcaccagttttcctcgcgaccccagaactcctcaggatccaagctcggttctgaaaaaatcaagaaggcggggccgcggctggacgagggccctgggaccagaacagcttctcagggcgtgcgaggctatcaccgtggggaaggtcgatctaagctcatggagggaaaaaattgcgcgcgatgttgctggagcaacctggggaaatggtagtggagaggaagaggaggaggaggacggtcccgctgtactcgtagaacagcagacagattccgccatggagcctaccggcccgacccaggaacgttacaaggatggcgttgtgaccattggctgcgtgggcttccctaatgtgggtaagtcctccctaatcaacggcctggtggggcggaaggtcgtctcagtttcccgcacacctggccacacgcgatactttcaaacttacttcctgactccttctgtaaaactttgtgattgtcccggtttgatcttcccttccctgttacctagacaactacaggtgcttgcagggatctaccccatcgcccaaattcaggaaccctatactgctgtcggctatcttgcctcccggatccctgtgcaggccctgctgcacctgcgtcaccctgaggctgaggatccaagtgcagagcacccctggtgtgcctgggacatatgtgaggcatgggccgagaaacggggatacaaaactgcgaaagccgccaggaatgacgtgtaccgcgcggccaattcccttttacgcctggctgtggacggacgtctgagcctttgtttccaccctccaggttactccgagcaaaaaggcacctgggagagccaccctgagacaaccgagcttgtggtcctacagggcagggttggacccgctggggatgaggaggaagaggaggaggaggaattgtcatcttcttgcgaagaggaaggtgaggaagatcgcgatgccgatgaggagggcgaaggggatgaggagacaccaacatctgctcctggttccagcttggcgggccggaatccttacgctctcctaggggaagacgaatgttag

SEQ ID NO: 190109 - DNA, 1824 bp, Artificial Sequence
  Description of Artificial Sequence: Synthetic coding sequence
atgccccggaagaagcccttcagcgtgaagcagaagaagaagcagctgcaagataaaagggagcggaagcgcggcttacaggacgggctgagatcatctagcaattcccggtcgggcagtagggagaggcgggaggagcagactgacacgtcggacggcgaatcggtaactcaccacatccgccggctaaaccaacagccatcccaaggacttggacctagggggtacgatcccaaccggtaccgattgcacttcgagagagattctagagaggaagtggagagacggaagcgggcagccagggagcaggtgctacagcctgtgtctgctgaactgttggaacttgacatacgcgaggtctaccagcctgggtcagtcctggacttcccaaggcgcccgccctggtcttacgaaatgtccaaagagcaactgatgagtcaagaggagcgatcctttcaggactacctaggaaaaatccacggagcatattcttctgaaaagctgagctacttcgagcacaacctcgagacatggcgtcaactgtggagggtcctcgaaatgagcgatatcgttctgctcatcacagatatccgacaccctgtggtgaacttccctcctgctctctacgaatacgtaactggcgaactaggactagcgcttgtgctggtcctgaataaagtggacctagcgccacccgccctggttgtggcctggaaacactacttccatcagcactatccgcagctgcatgtcgtgctgttcacttccttccccagggacccacggactccccaagatccaagtagtgttctgaaaaagagccgccggaggggtaggggatggacacgcgccctgggccctgagcagttgttacgggcttgtgaagcaatcacggtcggtaaggtcgatctgagcagctggcgggaaaagatcgcaagagatgtggctggggctacttggggaaacggatccggcgaggaggaagaagaggaggatgggccagccgtgctggtcgagcaacagaccgactcggcaatggagcccactggaccaacccaagagcgctacaaagacggggtcgtgacgatcggatgcgtggggttccctaatgtgggcaaatctagtttgattaacggcctggttggtagaaaggtagtatccgttagtcgcacccccgggcacactcgctattttcagacgtactttctcacacctagtgttaagctgtgcgactgtccggggttgatttttccttcattgctcccgaggcagctccaggtgctcgctggaatataccctattgcacaaattcaggaaccatacacggcagtggggtatctggcctcgagaatccccgtccaagctctgctgcacttaaggcatcccgaggctgaggatccttctgctgaacacccatggtgtgcctgggatatctgcgaggcatgggccgagaaaaggggctacaaaaccgccaaagcagccaggaacgacgtctatagggccgctaacagtctgctacgattagccgtagacggtcggctgtcgttgtgctttcaccccccagggtatagcgaacagaagggcacctgggagagtcatcctgagaccacggaacttgtcgtccttcaaggaagggtgggtcctgccggcgacgaggaagaagaagaggaagaagaactctcctcctcgtgcgaagaagagggcgaggaagatcgggatgccgacgaggagggcgaaggcgatgaggagacacctacctccgcacccggcagttctctagctggccgcaatccatatgcactcctcggagaggacgagtgctag

SEQ ID NO: 190110 - DNA, 795 bp, Artificial Sequence
  Description of Artificial Sequence: Synthetic coding sequence
atgggcgagcgggtgctgtggcccctgcgggccggccagcactggcgacaccgcccacttcctgctggacttcaggacggactccgcagttccagcaatagcaggtccggatcccgagagagaagggaggagcagaccgatacaagtgatggggagtccgtcacccaccatatccggcgactgaatcagcagccatcacaagggctcggccctcgtgggtatgacccaaaccggtataggcttcacttcgaacgggacagccgcgaggaagtggaaaggcggaagcgcgctgcaagagagcaggtcctccaacccgtttctgcagaactgctggaactcgacattagagaagtgtaccagcctggtagcgtgctcgacttccctcgacgacccccttggagctacgagatgtcaaaggaacagctgatgagtcaggaagagcgctccttccaagattatcttggcaagattcacggagcctattcttcagaaaaactgtcatattttgaacacaacttggagacatggcggcagctctggcgagtgctcgaaatgtcagatattgtgctgctcattaccgacatcaggcacccagtcgtaaactttccacctgccctgtacgaatacgtgaccggcgaactcggactggccctggtgctggtccttaacaaagtcgatctggcgcctccagctttggttgttgcttggaagcattacttccaccagcactacccacagctccacgttgtactctttacaagcttccccagggatccgagaacgccgcaggattag

SEQ ID NO: 190111 - DNA, 1824 bp, Artificial Sequence
  Description of Artificial Sequence: Synthetic coding sequence
atgccccggaagaagcccttcagcgtgaagcagaagaagaagcagctgcaagacaagagggagcgcaagcgagggctccaggacggacttcgttcttcttccaactcccggtccggcagccgcgagaggcgggaggaacaaactgatactagtgatggtgaatcagtaactcatcacattagaaggctgaaccagcaaccttcacagggcctggggccacggggttatgacccaaatcgctatcgtctgcacttcgaaagggactctagggaagaagttgagagaaggaaacgggcagctagggagcaggttctccagcccgtgtccgcagaactgctcgagttggacataagagaggtctaccagcctggctcggtgttagacttcccgaggcggcctccgtggagctacgagatgagcaaggagcagctgatgtcccaggaagaaaggtccttccaggactacttaggtaagattcacggcgcctatagctcagagaagctaagctacttcgagcacaatctggagacctggaggcaactttggagggtcctggaaatgtcagatattgttttgctgataacagatatccgccacccggtggtgaactttcctccagccctgtatgagtacgtaaccggggagcttggactcgctttggtcctcgtcctgaacaaagtggatttagcccctcctgcgcttgttgtggcctggaagcactacttccaccagcattatccacagctgcacgtcgtgctgttcacctcctttcctcgggatcctcggacccctcaggatccctcctcagttctgaagaagtctcgccgacgaggccgcgggtggactcgggccttgggcccggagcagctgttacgcgcgtgtgaggctataactgtgggaaaggtcgatctgtcatcttggcgagagaagatcgccagggatgtggcgggcgccacttggggaaatggaagcggcgaagaagaggaggaggaggacgggccagccgtgttggtggagcaacagactgatagtgcaatggaaccaacagggccaacccaggaaagatacaaagatggcgtggtaaccataggatgtgtcggatttcctaatgttggcaaaagcagtctgatcaacgggctcgtggggcgcaaggtcgtgagcgttagccggactcccggacatacaaggtactttcagacctactttctgaccccctccgtgaaactgtgcgattgccccggcctaatatttccctccctcctgcctcgccagttacaagttctggctggcatttatccaatcgcacagattcaggaaccctatacggccgttggctacctggccagccgaattccggtgcaggccctacttcaccttagacaccccgaagcggaggacccctcggccgagcatccctggtgcgcgtgggacatctgcgaagcgtgggccgaaaagaggggatataagacggcgaaggctgcaaggaacgatgtgtatcgtgcggccaatagcttgttaagactggcagttgacgggaggctctctctctgttttcaccccccgggatactcagagcagaagggcacctgggagagtcaccctgagacgactgaactggtggtcctgcagggcagggtgggtccagccggagacgaggaagaagaggaggaggaagagctgtccagctcctgcgaagaagagggtgaggaggaccgtgacgctgacgaagagggcgaaggcgacgaggaaacacctacttccgctccaggttcctccctcgccgggcgcaacccatatgctctcctgggtgaagacgagtgttag

SEQ ID NO: 190112 - DNA, 1290 bp, Artificial Sequence
  Description of Artificial Sequence: Synthetic coding sequence
atggaggccgccgtggtgctggagatgagcgacatcgtgctgctgatcacagatattcggcatcccgtggttaattttcccccagcattatacgagtacgttactggcgaacttggattagccctggtattggtgctgaataaagtggatctggcccctccagccctggtcgtagcctggaagcactactttcatcagcattacccacaacttcacgtagtgctgttcacatctttcccaagagatcctcggacgccacaggatccttctagtgtgcttaaaaaatctaggaggcgggggagaggatggactcgcgcgcttggtcccgagcagttgctcagggcttgcgaagctattacagtgggaaaagttgaccttagttcttggcgagaaaaaatcgcaagggacgtagccggggctacctggggaaacggatccggcgaagaggaggaagaagaagacggcccagcagtactggtcgagcagcagacagactccgccatggagccaacaggaccaacccaagagaggtacaaggatggtgtcgtgactatagggtgtgttggcttcccaaatgtcgggaaaagcagcctcatcaacgggttggtgggcagaaaggttgtatccgtgagccgcacacctggacacactcgttacttccagacatatttcctaacaccctcggtcaagttgtgcgattgccctggacttatctttccttcactgttgcctagacagcttcaggtgctcgctggaatttatccgattgcccagattcaagaaccctataccgccgtgggctacctcgccagccgcatccctgtccaggccctgctccatctgcgccacccggaagctgaggacccttccgctgagcacccttggtgcgcatgggacatttgcgaagcttgggctgaaaagcgcgggtataagaccgccaaggctgccaggaacgacgtctaccgcgcggctaacagtttgttaaggctggccgtagacggccgcctctctctctgctttcaccctcctgggtactcagagcagaagggaacctgggaaagtcatcccgagacgactgagttggtggtgctccaggggagggtggggcctgccggcgacgaagaagaggaggaggaggaagagctctcaagctcttgtgaagaggaaggcgaagaagatagggatgctgacgaagagggagaaggcgacgaagaaacccctacctcagcccctgggtcctctctggccggccgaaacccgtacgccctcctgggcgaggatgagtgctag

SEQ ID NO: 190113 - DNA, 1824 bp, Artificial Sequence
  Description of Artificial Sequence: Synthetic coding sequence
atgccccggaagaagcccttcagcgtgaagcagaagaagaagcagctgcaggacaagagggagcgaaagcggggattgcaggatggactcaggagctctagtaactcacgctccgggagtcgagagaggagagaagagcagactgatacaagtgacggggagagcgtgactcaccatatccggagactcaatcaacagcctagtcagggactcggcccccgggggtacgacccaaacaggtatagactccactttgaacgcgattctcgagaggaggtggaacgcaggaagagagccgcgcgcgaacaagtgctacagcccgtgtccgccgagctgctcgaactagatattcgggaagtttaccagcccggctcagtactggacttcccaagaaggcctccctggtcttacgagatgtctaaggagcagctgatgagccaagaggagcggtccttccaagattatctcggcaagatccatggcgcttattcatcagaaaagctaagctacttcgaacataacttggagacatggcgccaattatggcgagtgctggaaatgagtgacatcgtgctcttaatcaccgacattaggcatccggtcgttaacttcccgcctgctctttatgaatacgttacaggcgagttgggcctggctctcgttctggtgttgaacaaagttgatcttgcaccccccgccctagtagtcgcatggaaacactactttcaccaacactaccctcagctgcacgtggtcctgttcacctctttccccagagatcccaggacgcctcaggatccctcatctgtcctgaaaaaatcgagacggagaggtcggggttggacaagggcactggggcccgagcaactgctccgggcgtgtgaagccatcaccgtgggaaaggtggatctgtcaagctggagagagaagatcgcccgagatgtggcaggtgccacttgggggaacgggagtggtgaggaggaggaggaggaggacgggccagcggtgctggtagaacagcaaactgactccgcaatggagccaactggccctacccaggagcggtataaggatggcgtggttactatcggatgcgtggggtttccaaacgtgggaaagtccagcttgattaacggcctggttggtcgcaaagtcgtcagcgtgtccaggacccctggacacacacgctactttcagacatatttcttaactccatctgtcaaattgtgcgactgtcccgggcttatctttccgtccctgctccctaggcagttgcaggtgctcgcaggcatttacccaatcgcccagattcaggaaccgtatactgccgtcgggtatctcgcctcaaggattcctgtccaggcactcctgcatctacggcatccagaggccgaggaccccagcgctgaacacccctggtgcgcttgggacatatgtgaagcgtgggccgagaaacgaggatacaagaccgcaaaagccgcacgcaacgacgtgtacagggccgccaactctctactccgactggccgtcgacggacgcttatctttatgtttccatcccccaggttactccgaacagaaggggacatgggagtcccaccctgaaacgaccgagctcgtggtccttcaagggagagtgggccccgctggtgacgaagaggaggaagaggaagaagagctgtcatcgagctgcgaagaagagggtgaagaagacagggacgcagacgaagaaggcgagggcgacgaagaaacacccacatccgcgccaggatcatccttagccggccgtaacccctatgctctgctgggagaggatgagtgttag

SEQ ID NO: 190114 - DNA, 1215 bp, Artificial Sequence
  Description of Artificial Sequence: Synthetic coding sequence
atgagcaaggagcagctgatgagccaggaggagcggagcttccaggattacctgggaaagatccatggagcgtactcatcagagaagctttcctatttcgaacataacctggagacatggcgacagttatggagggtgctggagatgtctgacatcgtgctgttaataaccgatatccggcaccctgtcgtgaattttccccctgccttgtacgaatatgtgaccggcgagctcgggctggccttagtgctcgtgttgaataaagtagatttagctccacccgccttggttgtcgcatggaagcattacttccatcagcactacccccagttacatgttgtcctctttacaagctttcccagggaccccagaacaccacaggaccccagtagcgtgctgaagaaatcaaggcgccgcggccgcggatggaccagagccctgggccccgaacaattgcttagagcctgtgaggcaatcactgtcgggaaggggtttcctaacgtgggtaagagtagcctcattaatggactcgttggcaggaaggtcgtgtctgtatcccgtacccctggccacactcgctactttcagacttacttcctgacgccctcagtaaagttgtgtgattgtcccggtctgatcttccctagcttgttgcccaggcagctgcaggtgctcgcaggtatctatccaatcgcacagatccaggaaccatatactgctgtggggtacctggctagccggatccccgtgcaggcattattacacttgaggcatcccgaagccgaagacccgagcgccgagcacccttggtgtgcatgggacatttgcgaggcctgggccgagaagcgggggtataaaacagctaaagccgcgaggaacgatgtctaccgcgctgctaacagccttctcagactggccgtcgacggtcgcctttccctgtgcttccaccctccaggctactctgagcaaaaaggaacgtgggaatctcacccggagacaaccgaacttgtggtccttcagggacgggtgggcccagccggagatgaggaggaggaggaggaggaagagttatcaagctcatgtgaagaagagggcgaggaagaccgggacgctgatgaggagggagaaggcgacgaagaaacgccaacttctgcgcccggaagctccctggccggtcggaatccttacgcactcttgggagaggatgagtgttag

SEQ ID NO: 190115 - DNA, 795 bp, Artificial Sequence
  Description of Artificial Sequence: Synthetic coding sequence
atgggcgagcgggtgctgtggcccctgcgggccggccagcactggcgccacagaccgctccctgcaggactgcaggatggactgagatcaagcagcaattctagatccggctcccgcgaacgtagggaggaacagactgatacatcagacggagagtccgtgactcaccacatacgcagactgaaccaacagcctagtcagggattaggaccaagagggtacgaccctaaccgctatagactgcacttcgaacgagatagcagggaagaggtcgagcgacgaaaacgggcagccagagaacaggtgttgcaaccggtgtctgccgagctgttggaattggacattcgcgaagtctaccaacccgggagcgtgctggatttcccaagacgtccaccctggagctacgaaatgagcaaagagcagctgatgtcccaggaggagcgcagcttccaagactacttggggaagattcacggcgcttacagcagcgagaagctttcctacttcgaacacaatctggagacatggagacagctgtggagggtgttggaaatgagcgatattgtgctcctgataaccgatatacgtcaccccgtggtgaatttcccacctgcattgtatgagtatgtcaccggggagctgggccttgccttggtcctcgtgctgaacaaggtggatttagccccacctgccctggtggttgcttggaagcactacttccaccagcactacccacagctgcacgttgtgctctttacctcttttccacgggatcctcggacaccgcaggactag

SEQ ID NO: 190116 - DNA, 795 bp, Artificial Sequence
  Description of Artificial Sequence: Synthetic coding sequence
atgggcgagcgggtgctgtggcccctgcgggccggccagcactggcgtcacagacccttaccagcaggccttcaggatggactgcgcagctcctcaaacagccgctccggatccagggaacggcgtgaggaacagacagatacttccgatggcgagtcagtgactcaccacattagacgcctcaatcagcagccatctcagggacttggtcccaggggatacgacccgaaccgatatagactgcacttcgagcgggactctagagaagaggtggagcgtagaaagagggccgctagagagcaggtgcttcagcccgtctctgctgagttgttggaacttgatataagggaggtctaccaaccaggaagcgtgctcgatttccctcgcagacccccttggtcctacgaaatgagcaaggaacagttaatgtcgcaagaagaacggtctttccaggactatctgggaaaaatacatggcgcctattcatccgaaaagctttcctattttgagcacaatctcgaaacgtggaggcagttatggcgagttctggaaatgtccgacatcgtgctactgatcaccgacataagacatccggtcgtcaattttcctcctgcattgtacgaatatgtgacgggtgaactgggtttggccctggtactcgtgctgaataaggtcgacttggcaccaccagctcttgtggtcgcttggaaacactacttccatcagcattacccgcagctgcacgtcgtgctgttcacgtcatttcccagggaccctcgcaccccccaggactag

SEQ ID NO: 190117 - DNA, 795 bp, Artificial Sequence
  Description of Artificial Sequence: Synthetic coding sequence
atgggcgagcgggtgctgtggcccctgcgggccggccagcactggcggcaccgtcccctccccgcgggcttacaggatgggttacggagctcatcaaattctagaagtgggagcagagagcgccgggaagagcagactgacactagtgatggagagtccgtcactcaccacataagacggctgaatcagcaacccagccagggactgggacctagagggtacgacccaaatcggtatcgcttgcacttcgaacgagacagcagagaagaggtggaaagacgaaaacgtgccgctagagaacaagtgctgcagcctgtcagtgccgaactgctcgagctcgatatccgcgaagtctaccagcccggtagcgtgcttgattttccacgccgcccaccctggagctacgaaatgtccaaggaacagctgatgagccaggaagaacggtcgttccaggattacttgggcaagattcacggcgcctatagctccgaaaagctgtcatatttcgaacataatttggagacttggagacagctttggcgagtgttagaaatgagcgacatcgtgctcctgatcacggatattcggcaccctgttgtgaatttccctccagcactttacgaatacgtgaccggcgaactgggcctggcgctggtgctcgtgcttaataaagtggacctggccccaccggccctggtggtagcctggaaacactattttcaccagcactatccacagctgcacgttgtacttttcacttccttcccaagagatccaaggaccccacaagattag

SEQ ID NO: 190118 - DNA, 1824 bp, Artificial Sequence
  Description of Artificial Sequence: Synthetic coding sequence
atgccccggaagaagcccttcagcgtgaagcagaagaagaagcagctgcaggataagagggagagaaaaaggggactgcaggacgggctgagatcctcatccaacagtcggagtgggtcgcgggagcggcgcgaggaacagaccgataccagtgatggtgaaagtgttacccaccacattcggagactgaaccaacaaccttcccagggcttagggcccagaggatacgaccccaatagatatcggctacactttgaacgagacagtcgggaagaagtagagaggcgtaaaagggcggctcgggagcaagtgttacaaccagtgagcgcagagctccttgagttagacatacgcgaagtctaccaacctgggtccgtcctggatttccctcgccgcccgccatggagctacgaaatgtctaaggagcaactaatgagtcaagaggagcggtcttttcaggactatctgggtaagatccatggagcttacagttctgagaagctctcttactttgagcacaatcttgaaacttggagacagctgtggagggttttggagatgagtgatatagtgttattaatcactgacataaggcaccccgtcgtgaactttcccccggccttatacgaatacgtcaccggggagctgggcttggcactggttctcgtgctgaataaggtggatttagccccgcccgcgctcgtggtggcctggaaacactacttccaccagcactaccctcagctgcacgttgtactctttacatcattcccacgggatccccgtacgccccaggatcctagtagcgttctgaaaaagagtaggaggagggggagagggtggacaagagccctggggcccgagcagctactgcgagcctgcgaggccataacggttggtaaggtggatctctcatcttggagggagaaaattgcaagagatgttgcgggagccacgtggggcaatggctccggcgaggaggaagaggaagaggacggacctgccgtgctggtggagcaacagaccgatagcgctatggaacctactggacctacacaggaacggtacaaggacggcgtggtgactattggttgtgtgggcttccctaatgtggggaagtccagtctcattaatggtctcgtcgggagaaaggtcgtcagcgtcagcagaactcccggtcacaccagatacttccagacatactttctaacaccctctgtaaaactgtgcgattgtcctggcttgatatttccgtctttgctacctcgccagcttcaggtgctggctggaatttatcctatcgctcagatccaggaaccttataccgcagtcggttaccttgcctcgcgtatccccgtacaagcactgctacaccttcgtcatcccgaagccgaggatcctagcgccgagcacccttggtgtgcttgggacatctgcgaggcttgggctgagaaaagggggtataagactgccaaagccgcccgcaatgatgtatatcgagcagctaactctcttctgcggctcgccgtagatggtcgcctgagcctgtgtttccacccgccaggctactcagagcaaaagggcacttgggagagccaccccgagactactgagctggtggtattgcaagggcgagtgggacccgccggggatgaagaagaagaagaggaggaggaactaagcagctcgtgtgaggaagaaggagaggaggaccgcgacgccgacgaagagggcgagggggacgaagagacgccaaccagtgcccctgggagtagtctcgcaggacgaaatccttacgccctgcttggcgaggacgaatgttag

SEQ ID NO: 190119 - DNA, 1824 bp, Artificial Sequence
  Description of Artificial Sequence: Synthetic coding sequence
atgccccggaagaagcccttcagcgtgaagcagaagaagaagcagctgcaggacaaacgcgagcgaaagagaggtctgcaggatggcctaagatccagctctaattctaggagtggatctcgggagcggagggaggaacagacagatacaagcgacggcgaatctgtgactcatcatatccgaagactgaaccagcagccctctcagggtctgggccccagagggtacgacccaaaccgctataggctccattttgaaagggattctagagaagaagttgaaagacggaaacgtgctgcccgtgaacaggtgttgcagccagtgagcgcggagctccttgaattagatataagggaagtctatcagccgggcagcgttctggacttcccacgacggccaccatggtcctatgaaatgagcaaagaacagttgatgtctcaggaggagcggagtttccaagactacttgggaaaaatccacggggcctattcctccgaaaagctttcatactttgagcataacctggaaacttggagacagctctggagggtgttggaaatgtctgatatcgtcctcttaattacagacattcggcaccccgtggtgaacttccccccagccctatatgagtatgtgacaggcgaactgggcctggctcttgtgctagtgttgaataaagtggacttagccccacctgctctggtcgttgcttggaaacactacttccatcagcactacccacagctgcatgtcgtcctgttcaccagcttcccgagagatcctcggacaccccaggacccatccagtgtgcttaaaaagagccgcagacgtggaagagggtggaccagggcacttgggccagaacagcttcttcgcgcctgcgaggcaatcaccgtcggcaaggtggatctgtcctcctggagagagaagatagctcgggatgtggccggggcaacctggggcaacggtagcggagaggaggaagaagaggaggacggacccgccgtccttgtggaacagcagaccgattccgctatggagcctactggtccgacacaggagagatataaggacggtgtcgtgactatcgggtgtgtggggtttccaaatgtcggcaagagttccctgatcaatggcctggtgggtcgcaaggtagtatccgtctctcggacacctggacacactaggtacttccagacctactttctcaccccttccgttaaactgtgtgattgtcctggactcatcttcccatccctgctgccgagacagttgcaggtcctcgcgggtatttatccaatagctcagatccaagagccttacacggcagtaggctacttggcgtccagaatcccggtgcaagctcttctacatcttcggcatccagaagccgaagacccctcagctgagcatccctggtgcgcatgggatatttgcgaagcttgggcagagaaacgagggtacaagacagccaaagccgctagaaatgatgtctaccgagccgctaattcactgctgaggctcgctgttgacgggcgcttgagcctgtgttttcatccaccaggttactccgagcagaagggcacctgggaatcccatcctgaaactactgagctggtggtcctccagggacgggttggcccagccggcgacgaggaagaggaggaagaagaggaactgagtagcagctgtgaagaagaaggcgaggaggaccgtgatgccgatgaggaaggggagggcgacgaggagacccctacttcagcccctggctctagcttagcgggccgtaatccatatgctctgctgggagaagatgagtgctag

SEQ ID NO: 190120 - DNA, 795 bp, Artificial Sequence
  Description of Artificial Sequence: Synthetic coding sequence
atgggcgagcgggtgctgtggcccctgcgggccggccagcactggcgacaccgaccattacccgctggcttgcaagacggactccggtctagctccaattcccgcagcgggtcgcgagaaaggcgcgaggaacagactgatacttccgacggcgaaagcgttacacaccatatcagacggctgaaccaacagccctcgcagggtctaggtccccggggttacgaccctaaccgctaccgcctgcacttcgaacgagattctcgagaggaggtcgagcggcgcaagcgtgccgctagagagcaggtactccagcccgtcagtgcagagttattggagctcgacatcagagaggtgtatcagcctggttctgtgctcgactttccgaggcgccccccctggtcctacgagatgtcaaaggaacagcttatgtcccaggaggagagatcatttcaagattatctcggcaaaattcatggagcctacagtagcgaaaagctgtcatacttcgagcataatttggagacctggcggcagctgtggcgggtgttagaaatgtctgatatagtcctgttaatcaccgatatcagacatccggtggtcaatttccctcctgccttgtacgagtatgtcactggcgagctgggcctcgcactcgtcctggtgcttaacaaagtggacttagcccctcctgccctcgtcgtggcctggaaacactactttcaccagcactacccccaattgcatgttgtcttgttcacaagcttcccccgcgacccaagaactccccaagactag

SEQ ID NO: 190121 - DNA, 795 bp, Artificial Sequence
  Description of Artificial Sequence: Synthetic coding sequence
atgggcgagcgggtgctgtggcccctgcgggccggccagcactggaggcatcggcccctacctgctggactccaggatgggttaaggtcatcatccaactccaggtcaggaagccgagagcggcgcgaggagcagactgatacttctgacggggaatcagtaacacatcatatccgaaggctgaatcagcaacctagccaaggcctggggcctagaggctatgatccgaatcgttacaggcttcatttcgagagagattccagggaagaggtagagagaagaaaaagagcagctcgcgaacaggtgctccagccagtctctgccgaactgctcgaactagatattagagaagtgtaccaaccgggatcggttcttgacttcccgcgcaggccaccatggtcttacgaaatgtcaaaagagcagctgatgagtcaggaggaaaggagctttcaggattacctgggtaagattcacggggcttattcatccgagaaactgagctattttgagcacaatctcgagacgtggaggcaactgtggcgcgtgctcgagatgtccgatatcgttctcttgattactgatattcgacatccggtagtaaattttccacctgctctctacgaatacgtgaccggggagctgggcctggccttggttctggtcctcaacaaagtcgatcttgcaccacctgcactcgtggtggcctggaagcattactttcatcagcactatccccagttgcatgtagtgctatttacatcctttcccagagatccaaggactccccaggactag

SEQ ID NO: 190122 - DNA, 1824 bp, Artificial Sequence
  Description of Artificial Sequence: Synthetic coding sequence
atgccccggaagaagcccttcagcgtgaagcagaagaagaagcagcttcaggataaaagggagcgcaagcgaggcctccaggacgggcttcggagttccagcaactcaaggtcaggctctcgcgagcgccgggaggagcagacagatacttccgatggagaatcagtaacgcatcatatccggagactgaaccaacagccctcgcagggcttaggacccaggggctatgatcccaataggtatcggttgcactttgagcgcgacagtcgagaggaggtcgaacgccgaaaacgggccgccagagagcaggtcctacagcctgtgagcgctgaactgctcgaacttgatatccgggaagtataccaacctggatcagttttggacttcccaaggagaccaccttggtcctatgaaatgagtaaggagcagctgatgtcccaagaagaacgcagctttcaggactatcttggcaaaattcatggagcctactcaagtgagaagctgagttacttcgaacacaatctggagacatggaggcagttgtggagagttctggaaatgagcgatattgtcctgctcattactgatatacgtcacccagttgttaatttcccaccagccttgtatgaatatgtaaccggagaactcgggctggccctcgtcttggtgctgaacaaagtggacctggctcctccggcgctagtcgtcgcatggaaacattacttccaccagcattacccacaactccacgtagtactcttcacaagcttcccgcgggaccccagaacaccacaggacccctcatctgtcctgaaaaagagccggcgccgcggtaggggctggaccagggctctaggccctgaacaattattgcgggcctgtgaagccatcacagtgggaaaagtggatctgtcctcctggcgggagaagatcgcccgcgacgttgccggcgcaacatgggggaacggatccggtgaggaggaagaagaggaagacgggccggccgtactcgtggagcagcagactgactctgctatggaaccaacaggccctactcaggaaagatacaaggacggagtcgtaactattggctgcgtcggtttccccaatgtcgggaagtcctcgctgataaatggactcgtaggccgtaaggtggtctccgtgagtagaacgcctggacatacccggtatttccaaacctactttcttacaccctccgtcaagctttgcgattgccccggactgatattcccctccctgctcccccgccaacttcaggtgctggcaggaatctaccctattgcacagatccaggagccgtacaccgccgttgggtacctcgcttctaggatcccagtccaagccctgcttcatctccgccatcccgaggccgaagacccaagcgctgaacacccttggtgcgcttgggacatttgcgaggcctgggctgaaaaacgcggctacaagacggcgaaggccgcgcgcaatgacgtgtatcgggcagccaattccctcctgcgcttggcagtcgatggtcgcctgagcctgtgctttcaccctcccggctacagcgaacaaaaaggaacttgggaatctcatccagagaccaccgaactggtggtcctgcaggggagagtcggcccagcaggggatgaggaggaggaagaagaagaggaactgtcttcatcttgcgaggaggagggcgaggaggatcgcgacgcagacgaggaaggcgagggcgatgaggagacacctactagcgctcccggcagttctttggccgggcggaatccctatgccctgcttggggaggacgaatgctag

SEQ ID NO: 190123 - DNA, 201 bp, Artificial Sequence
  Description of Artificial Sequence: Synthetic coding sequence
gtggtgaacttcccccccgccctgtacgagtacgtgaccggcgagctcggattggccctggtgctggtgctgaacaaggtggaccttgctcctccagcactggtcgtggcttggaagcattatttccaccagcactacccccagttgcacgtggtattgttcaccagttttccccgggaccccagaaccccccaggactag

SEQ ID NO: 190124 - DNA, 795 bp, Artificial Sequence
  Description of Artificial Sequence: Synthetic coding sequence
atgggcgagcgggtgctgtggcccctgcgggccggccagcactggcgccaccgacccttgccagccgggttgcaggatgggctgcggagctcttccaatagcaggagcggcagccgcgagcggcgagaggagcaaactgatacgagtgacggcgaaagtgtaacacaccatattcggcggttgaaccagcaaccgtctcaaggcctggggcccagaggctacgaccccaacaggtataggctccactttgaacgggactcccgggaggaggtggaacgacgtaaacgtgccgcccgcgaacaggtacttcagccggtctcagccgagctactagaactcgacatccgggaggtgtatcaacccggttccgttctggactttccccggcgaccgccttggagttacgaaatgagtaaagagcagctgatgtcccaagaagagagatcctttcaggactatctgggcaaaatacacggcgcatactcaagcgagaaactttcctactttgagcacaacctggaaacttggaggcagctttggagagtgctggagatgtcggatatagtcttattaatcactgatattaggcaccctgtcgtgaatttccccccggccctgtacgaatatgttacaggagaactgggtttggctctggttctggttctgaataaggtggacctggctccccctgcacttgtggtagcctggaagcactacttccatcagcattatcctcagctccatgtggtccttttcacatcctttccccgagacccgagaacaccccaggattag

SEQ ID NO: 190125 - DNA, 1215 bp, Artificial Sequence
  Description of Artificial Sequence: Synthetic coding sequence
atgagcaaggagcagctgatgagccaggaggagcggagcttccaggattatctggggaagatacacggtgcatactctagcgaaaagctgagttattttgagcataatctggagacctggcgtcaattgtggcgcgtcctggaaatgtcagatattgtcctgctcatcacagacatccggcatccagtggttaattttccgccggcactatatgaatacgtgactggcgaactgggcctcgcccttgttctagtgctcaataaagtcgatttggctccgcctgccctcgtagtcgcttggaaacattacttccaccagcattaccctcagcttcatgttgtgctttttacatcctttcctcgcgaccctcgcacccctcaagatccctcaagcgtcctgaagaagtcgcgcaggagaggcaggggctggactagagcattgggcccagaacaactcctccgggcctgcgaggctatcaccgtgggtaagggcttcccaaacgttggcaagtcaagccttatcaatggactggttgggcgtaaggtggtcagtgtctcccggacccctgggcacacccgatacttccagacctattttctgacgcctagtgttaaattatgcgattgccccggtctgatctttccatccctgttacctaggcagttgcaggtgctcgccggcatctatcccatagcccagatccaagagccgtacaccgctgttggttatttggcctctcgcatcccagttcaagcactcctgcacttaaggcacccagaggcagaagacccgtcggcggagcatccatggtgcgcctgggatatttgcgaggcttgggccgaaaagagaggctataagactgctaaagccgcccgcaacgatgtgtaccgggccgccaactccctgcttagacttgctgttgatggccgcctgagcctctgttttcatccacctggctattctgagcaaaaaggtacttgggagtcccatcccgaaactacagaactggtcgtgttgcaggggcgtgtcggacctgccggagatgaggaggaggaagaggaggaagaattatcctccagttgtgaagaggagggcgaggaagaccgcgatgccgacgaggagggcgagggcgatgaggagacgccaaccagcgctccaggtagctctcttgctggtaggaacccctatgcactgctgggagaagatgagtgctag

SEQ ID NO: 190126 - DNA, 789 bp, Artificial Sequence
  Description of Artificial Sequence: Synthetic coding sequence
atggagcccaccggccccacccaggagcggtacaaggacggcgtggttaccataggatgcgtcggctttcccaatgtcggcaagtctagcttgatcaatggactggtgggcagaaaagtcgtctccgtgtctcgtaccccgggccacaccagatactttcagacttacttcctgactcccagcgtcaagctttgtgattgccctggattaatcttcccttccctgcttccaagacagttacaagttctggccgggatttatccaattgcgcaaatccaggaaccatacacagccgtaggatatctcgcatccaggatcccagtgcaggccctgttgcaccttcggcacccggaggctgaggatccaagcgctgagcatccatggtgtgcctgggatatttgcgaggcatgggcagagaaaaggggatacaagacagcgaaggccgcaagaaacgatgtgtatagagccgctaattctctgctgaggctggcagtggacggtagactcagtttgtgctttcatccccccggatattcagaacagaaaggcacatgggagtcgcatccagagacgactgagctcgtggttctacaaggacgtgtcggacctgccggagatgaggaggaagaggaagaggaagaattaagcagctcctgtgaggaggaaggggaagaggatcgcgacgcggatgaagagggcgaaggcgacgaggagacccccaccagcgcccctggaagcagtctcgccggaaggaacccttacgcacttctcggagaggatgagtgctag

SEQ ID NO: 190127 - DNA, 789 bp, Artificial Sequence
  Description of Artificial Sequence: Synthetic coding sequence
atggagcccaccggccccacccaggagcggtacaaggacggcgtggtgactatagggtgcgtcgggttccccaacgtcggaaaatctagtctaatcaacggactcgtggggcgtaaagtggtctctgtgtctagaactccaggacacacacggtacttccagacctactttctgactccttccgtcaagctgtgtgactgcccaggactcatctttccttcgctgctgccacgccagctccaggtactcgccggaatataccctattgcacagatccaggagccgtacacggccgtcggttacctggcttctcgtatacctgtgcaagccttgttgcacctccgtcaccctgaagcagaggacccatccgcagaacacccttggtgcgcctgggacatctgtgaggcttgggccgagaagcgtggttataagaccgctaaggcagctagaaacgacgtctatcgagcagctaattctttactcagactcgcggtagacggacggctgtcactttgcttccacccgcccggttatagtgagcagaagggtacttgggaaagtcatccagaaaccacagagttggtcgtcttgcaggggcgcgtcggccctgccggggacgaggaggaggaggaagaggaggaactaagctcgtcttgcgaagaggagggggaagaagatagggatgcagacgaagagggcgaaggcgacgaggaaacacccaccagcgcacccgggagctctttagccggacggaacccatacgccctgcttggcgaagatgaatgctag

SEQ ID NO: 190128 - DNA, 1290 bp, Artificial Sequence
  Description of Artificial Sequence: Synthetic coding sequence
atggaggccgccgtggtgctggagatgagcgacatcgtgctgctgattaccgatatccggcatcccgtcgtgaactttccccccgcactctacgagtatgtgacaggcgaactgggcctcgcactggttcttgtgctgaataaagtggacctggcgccaccagctctggttgttgcatggaagcattacttccatcagcattatcctcaattgcacgtagtcctgtttacctcatttccgcgagacccccgaacaccccaggacccctccagcgtactaaaaaagagccgcagacgcggcagggggtggacaagagccctgggacctgaacagctactgagagcatgcgaagccatcaccgtcgggaaggtagatctgtcatcctggagagagaaaattgcacgggatgttgctggcgccacctggggtaatggatctggtgaggaggaggaggaagaggatggcccagcagtgctcgtagaacagcaaactgactcggccatggaaccaaccggaccgacccaggagcggtataaagatggcgtggtgacgatcggctgcgtgggttttccgaacgttggaaaatccagcctgatcaacggcctggtcggacggaaggtcgtgtctgtgtcacggacaccaggacacaccaggtattttcagacatacttccttacaccttccgtgaagctctgcgactgccctggactcatattcccatctctgctacccaggcaactccaggtgctcgctggtatttaccccattgctcagatccaagaaccttatacagctgttggatacctcgcaagccgtattccggtgcaggccctgctgcatctgaggcaccctgaggcagaggatcccagcgctgagcatccatggtgtgcgtgggacatctgtgaggcctgggcagagaagcggggctataagaccgcgaaggctgcacggaacgatgtgtacagggccgccaattccctcctgagacttgcagtggatggacggctttcactctgcttccacccacctgggtactcagagcagaagggcacatgggaaagccacccggagactactgagcttgtcgttctacagggacgagtgggtcccgcaggcgacgaggaggaggaagaggaggaggaactttccagctcatgcgaagaggaaggagaggaagatagagatgcagatgaggaaggtgaaggagacgaggaaaccccaacatccgcccctggaagctccctggctggtaggaacccatacgccctcctgggcgaagatgagtgctag

SEQ ID NO: 190129 - DNA, 1215 bp, Artificial Sequence
  Description of Artificial Sequence: Synthetic coding sequence
atgagcaaggagcagctgatgagccaggaggagcggagcttccaggactatctaggaaagatccacggcgcttattcttccgagaaactgtcctattttgaacataaccttgagacctggcggcaactctggagagtgttagagatgtccgatattgtcttgctgataactgacattcggcatcctgtcgtgaactttccacccgccctgtacgagtatgttaccggcgagttgggtttagctttagttctggttcttaataaagtcgacctcgctcctcctgcgctggtggtggcatggaaacactacttccatcagcattatcctcagctgcacgttgtgctgttcacttctttccctcgcgatcctcggaccccacaggatccttcctcagtgctgaaaaaatcccgacgacgcggccggggttggactagagcattaggacccgaacaacttctccgtgcgtgcgaagctataaccgtaggcaaggggtttccaaacgttggtaaaagtagtctgatcaatggacttgtcggaaggaaggttgtgagcgtgtccagaacgccaggtcataccaggtacttccaaacatacttcctgacgcccagtgtgaaactgtgtgactgtcctggcctgatctttccgtcgctgctaccaaggcaactgcaggtcttggctggaatctacccgatcgcgcagatacaggaaccttacactgccgtcggatatctggcatcccggattcccgttcaggctctcctacaccttcggcatcccgaggcagaggatccttctgccgaacacccatggtgcgcctgggacatctgtgaagcttgggccgagaaacggggttacaagacagctaaagcagcaaggaacgacgtgtatagggcagccaatagtctgcttcgtttggcagttgacgggcggcttagcctgtgcttccatcccccaggctattccgagcagaaaggcacctgggagtctcaccccgagaccacggagctggtcgtactgcaagggagagtgggccctgcaggggatgaagaggaggaggaagaggaggagctgtcttcatcttgcgaggaagaaggcgaagaggacagggatgccgatgaagaaggagagggagatgaagagacaccaaccagtgctcctggttcttctctcgccggcaggaatccttatgccctgctcggcgaagatgagtgttag

SEQ ID NO: 190130 - DNA, 1215 bp, Artificial Sequence
  Description of Artificial Sequence: Synthetic coding sequence
atgagcaaggagcagctgatgagccaggaggagcggagcttccaggactatctgggtaagatacatggcgcctattcctccgaaaaactttcatactttgagcataacctggagacctggcggcagctctggagggtgctcgaaatgtccgatatcgtcctgctgatcacagacattcgtcacccagtggtaaactttccccctgccctgtacgaatacgtgaccggggaactcggtctggctttggtgctggtgctgaacaaagttgatctggctccacccgcattagttgtggcctggaagcattactttcaccagcattacccacagttgcatgtggtcttgtttacgtctttccccagagacccccggactccacaggatcccagttcagtgctaaagaaatctcggaggcggggacgcggatggacacgcgctctgggtcccgagcaactgcttagggcatgcgaagcaattactgttggtaaagggtttccaaatgtcggtaagtcctccctgattaacgggctggtcggcagaaaagtggtttctgtgtcgcgaaccccggggcacacccgatatttccagacttattttttaacgccctccgtcaaactctgtgactgccccggcctgatctttccgtccctgttaccgcgtcagcttcaggtgctggccggaatctaccctatcgcccaaatccaagaaccttataccgcggtgggctatctggcctccaggatccccgtgcaagcattgctccacctcaggcatcctgaggcagaggaccccagcgctgagcacccttggtgcgcttgggatatctgtgaggcatgggccgaaaaacggggatacaagactgccaaggccgcccgaaacgatgtataccgagctgctaattcactccttcgcctcgcggtagatgggagattgtccctctgctttcacccgccaggctattcagagcagaaaggcacatgggagtcccacccggagacaaccgagctcgtggtgctgcagggccgcgtgggaccagccggagacgaggaagaggaggaagaggaggagctgtccagttcttgcgaggaagagggcgaagaggaccgagacgctgacgaggaaggagagggggatgaggagaccccaacgtcagctccaggtagctctctggcgggaagaaacccatacgccctactgggggaggacgaatgctag

SEQ ID NO: 190131 - DNA, 789 bp, Artificial Sequence
  Description of Artificial Sequence: Synthetic coding sequence
atggagcccaccggccccacccaggagcggtacaaggacggcgtggtgaccatcggttgtgtgggatttccaaacgtgggaaagtcatccctgatcaatgggctcgtcgggcggaaggtcgtctctgtgtctcgaactccagggcacactcgctacttccaaacttacttcttgactccatctgtgaaactctgcgactgtcccggcctcatcttcccgagtctgttgccccggcagctgcaggtgctggccgggatttaccctatcgcgcagattcaggagccatatacagcagttggatatctagcctccaggatacctgtgcaggccctgctgcacctgaggcaccccgaggctgaggaccctagtgccgaacacccatggtgtgcatgggatatctgcgaggcttgggcagagaagcgcggatacaaaaccgccaaagcggccagaaacgacgtttatagagctgcaaatagcttattacgtcttgcagtcgacggacgcctgagtctgtgttttcatcctcctggatatagcgagcagaagggcacgtgggagtcacacccggagacaaccgagctggtggtgcttcagggaagggtgggtccagcaggagacgaagaggaagaagaggaggaagagctgagctcaagctgcgaagaggaaggcgaagaggacagggatgcagatgaggagggcgaaggagacgaggaaacgcccacctccgctccagggtcgtcgctcgctggccggaacccttatgccctgctgggcgaggacgagtgctag

SEQ ID NO: 190132 - DNA, 1290 bp, Artificial Sequence
  Description of Artificial Sequence: Synthetic coding sequence
atggaggccgccgtggtgctggagatgagcgacatcgtgctgctgatcacggatatcagacaccccgtagtgaattttcctccggctttgtatgaatacgtgacaggagagctaggtctggcgctggtgctggtgctgaataaagtggacctcgccccgcctgctctcgtagtcgcgtggaaacactattttcaccagcactatccccaactgcatgtggtgttgtttacttcctttcccagagatccgcgcacgccccaagacccgagctccgtgcttaaaaaaagtagacggcggggccgcggctggaccagagcactgggtcccgaacagctccttagagcctgtgaagccattacagtggggaaggtggatctttctagctggagagaaaagatagcccgtgacgtggcaggcgcaacctgggggaacggatccggcgaggaagaggaggaggaagacggtccagcagtgctggtggaacagcaaactgactcagctatggagcctaccggtcccactcaggagcgctacaaagacggtgtcgtaacaattggatgcgtgggctttcccaatgtcggaaagtcaagcctgattaatgggttagtcggcagaaaagtggtgagcgtgtcaagaactccgggtcatacacggtactttcaaacttacttccttaccccttccgtgaaactgtgcgattgtcccggcctgatattcccatcactcttaccacggcagcttcaagtgttggccggtatctaccctatcgctcagattcaggagccgtacaccgctgtggggtacttagcgtctcgcattcccgtccaggctctgctgcacctgagacaccccgaagcggaggacccaagtgccgaacatccctggtgtgcttgggatatctgtgaggcatgggctgaaaaaaggggatataaaaccgccaaagctgcacgcaacgatgtgtaccgcgcagcaaattcactgctcagactcgctgtcgacgggcgcttgtctctctgctttcaccccccaggttactccgagcagaagggaacctgggaaagccatcccgagactacagaactggtggtgcttcagggcagagtcggacccgcaggagacgaggaggaggaagaggaagaggagctgtcgtcctcttgtgaggaggaaggcgaagaggatagagacgccgacgaagagggtgagggcgatgaggagacaccaacatcagcaccagggtcttcgctcgcgggtcgcaacccctacgccctcttgggagaggatgagtgctag

SEQ ID NO: 190133 - DNA, 1290 bp, Artificial Sequence
  Description of Artificial Sequence: Synthetic coding sequence
atggaggccgccgtggtgctggagatgagcgacatcgtgctgctgattactgatatcaggcatcctgtggtcaacttccctccagctttatacgaatatgtgaccggtgagctgggtttggcccttgtgctagtccttaataaggtcgacctggcgcctcctgcactggtggtggcctggaagcactactttcatcagcactacccccaattgcatgttgtcctcttcacttcattcccgagggatccgaggacacctcaagacccatcttctgtactgaagaagtctcgacggagagggcgcgggtggacacgggcgctcgggcctgaacaattactgagggcctgcgaggccataacagttgggaaagtcgaccttagttcctggagggaaaagatcgcccgggatgtggccggggctacttggggcaacgggtcgggagaagaggaggaggaagaggatggcccggcagttctcgtggagcagcagacagacagcgctatggaacctaccggccctacccaggaacgctacaaagatggagtggtgaccatcggatgtgtgggttttccaaatgtagggaagagtagcttgattaatggactggtgggtcggaaggttgtgtccgtctccaggactcccggacatactcgctattttcagacttattttctgacccccagtgtgaaactgtgcgactgcccggggctcatcttcccttctttattaccgcgtcaactgcaggtgctggccgggatctacccaatcgcacaaatccaggaaccttataccgccgtcggatacctggcttcgaggattcccgtgcaggcccttttacatctgcggcacccagaagcggaggaccctagtgcagagcatccatggtgcgcttgggacatatgtgaggcatgggcggaaaaacgggggtataagaccgccaaggccgctcggaatgatgtctacagggctgccaattctctgctccgcttagctgtggacggacgcctctctctgtgcttccaccctccgggctactcagaacagaagggtacttgggaaagccatcccgagactaccgagctcgtggttttacaaggcagggtgggacctgcaggcgacgaggaggaggaggaggaggaggagttgtcctcttcatgcgaagaagaaggcgaagaagatagggacgcagatgaagaaggggagggagatgaggagaccccaacctcggcccctgggagcagtctggctggaaggaacccctacgccttgctgggcgaggacgagtgttag

SEQ ID NO: 190134 - DNA, 789 bp, Artificial Sequence
  Description of Artificial Sequence: Synthetic coding sequence
atggagcccaccggccccacccaggagcggtacaaggacggcgtggtgaccatcggatgtgtgggatttcccaacgtcggaaagagctccttgattaacgggttggtcgggagaaaggtggtctcagtgtccagaacacctggacacacaagatactttcaaacctattttcttacccctagtgtgaagctttgtgactgtccaggactgatatttccaagcctcctgccgaggcagctacaggtgctggcggggatctaccctatcgcccaaatccaggaaccttacaccgcagtgggatacttggcatctagaattccagtgcaggctctgctccatctgagacacccagaggctgaagatccaagtgctgagcacccttggtgtgcctgggatatttgcgaagcttgggctgagaagcggggctataaaaccgcaaaagccgccagaaatgacgtttatcgggcagccaatagtctgttgagactggctgttgatgggcgtctgtcactctgcttccacccacccggatattccgaacagaaaggaacgtgggaatcccaccccgaaactacagagctcgttgtgctgcaggggagggtggggcctgcaggtgacgaggaggaagaggaggaggaggaactgtcttcctcctgtgaagaggaaggagaagaagatcgtgacgccgacgaggagggagaaggagacgaagagacccctaccagtgcccccgggtcttctttagctggacgcaacccatacgccttgctgggcgaagatgagtgctag

SEQ ID NO: 190135 - DNA, 1215 bp, Artificial Sequence
  Description of Artificial Sequence: Synthetic coding sequence
atgagcaaggagcagctgatgagccaggaggagcggagcttccaggattatctggggaagatccacggcgcttactcatccgaaaaattgtcttactttgaacacaatctggaaacctggcggcagctttggcgagtgctggagatgagtgacatcgtgttgctcattaccgacatcagacacccagtggtaaattttccacctgcactttacgagtatgtcacaggagagcttggcctggcacttgttcttgttctgaacaaggtggacctcgcaccccccgcattggttgtggcttggaagcattacttccaccagcactacccccagcttcacgtggttctgttcacaagctttccccgtgatcctcggacccctcaggaccctagctcggtgttgaagaaatcccgtagacggggccgggggtggactcgagctctgggaccagaacaactcctgcgagcctgtgaggccataaccgttggcaagggcttcccaaacgttgggaagtctagcctgattaatgggttggtgggcaggaaggtggtcagcgtgtcgcgtacaccagggcacactcggtacttccagacatatttcctcacaccaagcgtgaagctgtgcgactgcccaggtttgattttcccctcccttctacctcgtcagctgcaagtgctggccgggatctaccccatcgcccagatacaggagccatataccgccgtcggttatttagcttcccgtattcctgtccaggccctgttacaccttaggcatcccgaagcagaagacccctctgccgagcacccctggtgtgcctgggacatttgtgaagcatgggctgagaagcggggatacaaaacagccaaagctgcgagaaacgacgtctaccgtgctgctaactcactcctgagactcgccgtggatggccgattgtcactgtgtttccatccaccaggatatagtgagcagaagggcacatgggaaagtcatcctgagaccactgaactcgtcgtgctgcaaggcagggtaggacctgcaggtgacgaggaggaggaagaggaggaggagctttccagctcctgcgaggaagaaggcgaagaagatcgggatgccgacgaggagggcgagggagatgaggaaactccaaccagtgcccctggaagtagcctggccggaagaaatccatacgcactcttaggcgaagacgaatgctag

SEQ ID NO: 190136 - DNA, 1290 bp, Artificial Sequence
  Description of Artificial Sequence: Synthetic coding sequence
atggaggccgccgtggtgctggagatgagcgacatcgtgctgctgattacagacatacgccaccccgttgtgaacttcccaccagccctctatgagtatgtgaccggagagctaggcctggccctggtcctggtgctgaacaaagtggacctcgctccccctgccctcgtggtagcttggaaacattactttcatcagcattacccccaacttcacgtggtgttattcacctctttccccagggacccgaggactccccaagatcccagcagtgttctgaagaagtcccggcgaagaggccgcggatggactcgggctttaggtcccgagcaactacttcgggcttgtgaggccatcacggtgggaaaggtcgacctctcttcatggcgcgaaaaaattgctcgtgatgtggctggcgcaacatggggcaatggttcaggagaggaagaggaggaggaggatggtcctgccgtcctcgtggagcagcagacagactccgctatggagcctactggtccgacacaagagagatacaaagacggcgtggttactatcgggtgcgtcggatttcccaatgttgggaagagctcattgatcaacggattggtggggaggaaggtggtctccgtttcgcgtactccaggccacacgcgatattttcaaacttacttcctcacaccaagtgtaaagctctgcgactgtcctggcctgatatttccttccctccttccccggcagttgcaggttctggcagggatttaccccattgcccagatccaggagccatatacagccgtggggtatcttgcatcccgcatccctgttcaggcgttactgcacctgagacatcccgaggctgaggaccccagcgccgaacacccgtggtgcgcttgggacatatgcgaagcctgggccgagaagcgaggctacaagactgccaaagccgcgcgaaacgacgtatatagggcggcaaacagcttgcttcgactagctgtcgatggacggttgtccttgtgctttcatccccctggatactctgagcaaaaggggacatgggagagccaccctgaaactaccgagcttgtcgttctgcagggacgcgtcggccctgccggagacgaggaggaggaggaggaggaagaactatccagctcatgtgaagaggaaggtgaggaagatcgcgacgctgacgaggagggagagggggacgaggagacccctacatcagcccccggatctagtcttgccggccggaatccttatgctttactgggcgaggacgagtgttag

SEQ ID NO: 190137 - DNA, 1290 bp, Artificial Sequence
  Description of Artificial Sequence: Synthetic coding sequence
atggaggccgccgtggtgctggagatgagcgacatcgtgctgctgattactgacattaggcaccctgtggtcaacttcccaccagcactctacgagtatgtaacaggtgagctgggtctggcactggtactggtcctgaataaagtagatctggctccacccgcgctcgtagtggcgtggaaacactacttccaccaacactaccctcagctgcacgttgtgttgtttacttcgttcccacgtgatcccagaaccccccaggatcctagctctgtgctgaagaaatctcgacgtagagggaggggatggacaagagccttggggccagagcagcttcttcgtgcgtgtgaggctatcacagtgggaaaggtggatctgtcttcttggcgggagaaaattgcccgcgatgttgccggagccacctgggggaacggctctggtgaggaagaggaagaagaagatggacccgcggttctggtcgagcagcagaccgatagcgccatggagcccacaggcccgacccaggagcggtataaagacggggtggtgaccatcggatgcgtgggattccctaacgtggggaaatccagcctgatcaacggcctggtagggcgcaaggtggttagtgtcagcagaacccccgggcatacccggtattttcagacatactttcttacacccagcgtcaagctctgtgactgccccggtttgattttcccatcccttttacccagacaattacaagtcctagctggtatatatcccatcgcccagattcaagagccgtacacagcagtaggctatctcgcatctcgaattcccgtgcaggctctccttcacttacggcaccccgaggccgaagatccgtccgcggaacacccttggtgcgcttgggatatctgcgaagcttgggccgaaaagcggggctataagactgccaaggctgctaggaacgatgtgtacagggccgctaacagcctgcttcggctggccgtggacggaagattgtccttgtgttttcatccacctggctattctgagcagaagggtacctgggagtcccatcctgagaccactgagctcgttgtgcttcagggaagggttggcccagcaggagacgaggaggaggaagaggaagaagaactgtcttcaagctgcgaggaagagggagaagaggatcgagatgctgatgaggagggagagggtgacgaagagactcccacatcagcccccggctcctccctcgccggccggaacccttacgctctgttgggcgaagacgagtgctag

SEQ ID NO: 190138 - DNA, 789 bp, Artificial Sequence
  Description of Artificial Sequence: Synthetic coding sequence
atggagcccaccggccccacccaggagcggtacaaggacggcgtggtcacgataggatgcgtgggatttccaaatgtcggaaagtcttcccttatcaacggactagtgggtcgaaaggtggtttccgtgtcacgaaccccagggcacactcggtatttccagacttattttctgacaccctcggtcaagctttgtgactgtcccggtctgatctttccctcgcttctgccacgacaactgcaggtgcttgccggcatctatcccatcgctcagatccaagagccgtatacagcagtgggttacctggcgtcacgtattcctgtgcaggcattgcttcacctgagacacccggaagcagaggacccatcggccgagcacccttggtgcgcatgggacatttgtgaagcttgggctgaaaagcgcggttataaaactgctaaagctgctcgtaatgatgtataccgtgctgccaattccttgctgaggctggccgtggatggccgcctgtccctgtgtttccatccacccggttattctgagcaaaaaggtacttgggagtcgcaccctgaaacaactgaactggtggtactgcagggcagggttgggccagccggcgatgaagaggaagaggaagaagaggagctttctagttcctgcgaggaagagggggaggaagatcgggacgcggatgaggagggtgaaggcgacgaggaaaccccaacaagcgctccagggtcctcactcgccggtaggaatccctatgcccttttgggagaagatgaatgctag

SEQ ID NO: 190139 - DNA, 1290 bp, Artificial Sequence
  Description of Artificial Sequence: Synthetic coding sequence
atggaggccgccgtggtgctggagatgagcgacatcgtgctgctgatcacagatatccggcacccggtcgtgaacttcccgcctgccctctatgagtatgttactggagagctgggactggccctcgttttggtccttaataaggtggatctggcaccacctgctttagtggtagcctggaaacattattttcatcagcattacccccagctccacgtggtcctgttcacctcctttccaagggatcctagaacacctcaagacccctcgagcgtgcttaaaaagtcaagacgccgggggaggggttggacacgtgctctgggccctgagcagttattaagggcatgcgaggctatcaccgtgggaaaagttgacctgtcaagttggcgtgaaaagattgcacgcgatgtggccggagcgacttggggtaacggatcaggagaagaggaggaggaggaggatggtccagccgtgctcgttgagcaacagaccgactccgcaatggaacccaccggaccgacccaggagaggtataaagacggagtggtcaccataggctgtgtggggttcccaaatgtcggcaaatcatccctaattaatggactggtgggcaggaaggtggtttcagtcagccgcacacctggacacacaagatattttcagacttattttctcaccccctcggttaagctgtgtgattgtcccggactgatcttcccttcactgcttcctagacagctccaagtactggccggcatctaccctatagcccagattcaggagccctataccgctgtgggctatctcgcttcgagaattcccgtacaggcccttctgcacctcagacatcctgaagcagaggacccatctgccgaacatccttggtgcgcctgggatatctgcgaggcctgggccgaaaaacgcgggtacaagacagcgaaggcggctagaaatgatgtataccgagccgcgaattccctgctgcgccttgctgtggacggccggttgtcgctgtgttttcacccccctgggtacagcgaacaaaaaggcacatgggaatcccaccccgagacgaccgagctggtcgtactgcagggccgggtcggccctgccggagatgaagaggaagaggaagaggaggaattgagttcctcctgcgaagaagaaggtgaggaagatcgcgacgccgacgaagaaggtgagggagatgaggaaacccctactagtgctccaggctcaagtcttgccgggcgaaatccctacgcgctgctgggcgaggacgagtgctag

SEQ ID NO: 190140 - DNA, 1215 bp, Artificial Sequence
  Description of Artificial Sequence: Synthetic coding sequence
atgagcaaggagcagctgatgagccaggaggagcggagcttccaggattatttaggtaagatccatggggcatactcatccgaaaaactaagttatttcgaacacaacctagagacatggagacagttatggagggtgctcgagatgtctgatatcgtgctgctgatcactgatattcggcacccagtcgttaacttccctcctgctctttacgagtacgtgaccggtgagctggggctcgcccttgtcttggtgttaaacaaagtcgaccttgcaccaccagcgctggtggtcgcatggaagcattacttccaccaacactaccctcagctacacgtggtcttattcaccagcttcccccgggacccccggactccgcaagatccgtcatccgtgcttaagaagtctcgtcgacggggtagaggttggactcgcgccctggggcccgaacagttgcttcgagcatgtgaggctattacagtcggtaaggggttccccaacgtagggaaaagttccttgattaatggactggtggggcggaaggtcgtgtcggtgtctcggaccccgggtcacacacgctattttcagacttatttccttactcccagtgttaagctgtgcgattgccctgggctcatttttcctagtctgcttcctcggcagctgcaggtcctggccggaatctatccaatagcccagatccaggagccgtataccgctgttggatacctggccagtcgcattcctgttcaggccctcctgcacctacgccaccccgaggctgaggacccctccgcagagcatccatggtgcgcatgggacatctgcgaggcctgggccgagaagagggggtacaaaacagccaaggccgcacggaacgacgtatatagagccgcaaactccttactgcggctggcagtagacggaaggttgtctctgtgtttccaccccccgggctacagcgaacaaaagggcacatgggaaagtcatcctgaaacgactgagctcgtggtcttgcagggaagggtcggaccagccggcgatgaggaggaagaggaagaggaggaactgtcatccagttgtgaggaagaaggtgaagaggaccgggacgccgatgaagaaggagaaggagacgaagaaacccccacttcagctcccggctcgtcccttgctggacgtaatccctacgccctgttgggagaggacgagtgttag

SEQ ID NO: 190141 - DNA, 1215 bp, Artificial Sequence
  Description of Artificial Sequence: Synthetic coding sequence
atgagcaaggagcagctgatgagccaggaggagcggagcttccaggattatcttggaaagatccacggcgcgtactcctcagaaaagctgagttacttcgaacacaatctggaaacttggagacaactctggagagtgctcgagatgtctgatattgtcttgctaattactgacattcgccatccagtggtcaactttccacctgccctgtacgagtatgtgacgggtgaattgggcctggccctggtactcgtgctgaacaaagtcgatctggctccaccagctctggtggtagcctggaagcactatttccatcagcactaccctcagttacacgtggtacttttcacctcattccctagagacccacggacccctcaggaccccagctcagtgctcaagaaaagtcggagacgggggaggggatggacacgggctcttggacctgagcagctgcttcgggcttgtgaggcaatcaccgttgggaaaggcttcccaaatgtaggcaaatcctcactgataaacgggctggtgggacggaaggtagtgagtgttagtcggacccctggacacacgaggtactttcagacctattttttgacaccatccgttaagctgtgtgattgccccgggcttatattccctagcctgctgcctagacagcttcaagtgctggcaggaatatatccaattgctcagatacaggagccatacaccgcggtaggatatctcgccagccgcatccccgtgcaggccctactccacctacgccatccagaagcggaagacccttcagcagaacatccctggtgtgcttgggatatctgcgaagcttgggctgagaaaaggggatacaagacggcaaaagccgccaggaacgacgtgtatagggctgcaaatagtcttctgagactcgccgtggacgggcggctgtccctctgctttcacccgcctggctatagcgagcagaagggcacatgggaaagtcatcctgagacaacggaattggtggtgctccagggtcgcgtgggaccggccggggacgaggaagaagaggaggaggaagaactgtcaagctcatgcgaggaagaaggggaagaggaccgggacgccgatgaggagggggagggggatgaagaaactcccacatctgcacctggaagcagcttggccgggaggaacccatatgccctgctcggcgaggatgaatgctag

SEQ ID NO: 190142 - DNA, 789 bp, Artificial Sequence
  Description of Artificial Sequence: Synthetic coding sequence
atggagcccaccggccccacccaggagcggtacaaggacggcgtggttacaatcggctgcgtgggattcccaaatgtcggtaaatcctctctaatcaacggcttggtcgggagaaaagttgtctctgtgtctagaacaccaggacacacgcgatacttccagacctactttctgaccccctcagtaaaactttgcgactgcccagggttgatctttccatctctgcttccgcgccagctccaagtcctggccggcatatatccgatagctcaaatccaggaaccctatactgctgtcgggtaccttgcctctcgtatcccagtccaagcactacttcacttgcggcaccctgaagccgaggaccccagtgccgagcacccttggtgtgcttgggacatttgcgaggcctgggcggagaagcgtggctataagacagcgaaagctgctcggaatgacgtgtatcgagctgctaacagcttactgagactggccgttgacggtcggctatctttatgttttcacccacccggctatagtgagcagaagggcacttgggaatctcacccagagaccaccgaattggtcgtgctccagggcagagtcgggcccgcaggcgacgaagaggaggaagaggaggaggagctctctagctcatgtgaggaggaaggtgaagaggatagagacgctgatgaagagggcgaaggagatgaggaaacccccactagcgcgcccggttcatcccttgctggcaggaacccttatgctttgttaggcgaagacgagtgttag

SEQ ID NO: 190143 - DNA, 2196 bp, Artificial Sequence
  Description of Artificial Sequence: Synthetic coding sequence
atggtgaagcccaagtacaagggccggagcaccatcaaccccagcaaagcgtcaaccaatccagatagggtgcagggcgcaggaggccagaacatgcgcgacagggccaccatccggcggcttaatatgtaccgacagaaagagcggcgcaatagtagagggaagatcattaagccgctgcagtatcagagcacagtggcaagtggaacagtggctcgggtggagcccaacattaaatggtttggcaatacccgcgtcatcaagcagagttcgcttcagaaattccaggaagaaatggacacagtcatgaaggatccatacaaggtggtcatgaaacagtcgaaactacccatgtcgctcctccacgatcgaattcggccccataacttgaaggttcacatacttgacaccgagagttttgagaccacattcggccccaagagccagaggaaaagacctaatctgttcgcctccgatatgcagtcactcattgaaaatgctgaaatgagtacagaaagctacgaccagggaaaagaccgggatctggttaccgaagataccggcgttagaaacgaggcacaggaagaaatatataaaaaagggcagtccaagagaatttggggcgagctctataaagtgattgattccagcgatgtggtagtacaagttctggatgccagagacccaatgggtacccgctcaccacatattgaaacctatctcaaaaaagaaaaaccttggaaacacctgatttttgtgttaaacaagtgcgatctggtacctacttgggctacaaagcgttgggtggctgttctgtcacaggattatcctacccttgctttccacgcttcactgacaaatccgttcggaaaaggtgccttcatccagctgttgagacagtttggtaaattacacactgataagaagcagattagtgtgggcttcatcggctatccgaacgttggcaagagctcagtgataaacacactccgctccaagaaggtgtgtaatgttgcgcccattgccggagagacaaaggtttggcagtacattaccctgatgcgccgcattttcctgatcgactgcccaggcgtagtctacccatccgaagattcggaaaccgacatcgtgttgaagggcgtggttcaggtggagaaaataaaatccccagaggaccatatcggggccgtactagaacgggctaagccagagtatatatccaagacatacaagattgactcctgggaaaatgctgaagatttcctggaaaaattggccttccggaccgggaaactgctgaagggaggcgagcccgatctgcagacagtcggcaaaatggtgctgaacgattggcagcgcggtcgcatacctttcttcgttaagccccctaatgctgagcctcttgtggctccgcagttgttaccgtccagctcccttgaagttgtgcccgaggccgctcagaataaccctggtgaagaggttactgaaacagcaggggagggatcagagtccataatcaaagaagagactgaggagaatagccattgcgacgccaacactgaaatgcagcagatcctgacgcgagtgcgccagaattttggcaaaatcaatgttgtgccgcagttctcaggcgatgacctcgtgcccgtggaggtctccgacttggaggaggagctcgaatctttttccgacgaagaggaggaggagcaggaacagcaaagagacgacgctgaagagtcatcctctgagcccgaggaagagaacgtcggtaatgacaccaaagcagttatcaaggcgctggatgaaaagattgccaaatatcagaagttcctagataaggcaaaggccaagaaattctccgcggtgaggatcagtaaaggccttagcgaaaaaatttttgcgaagcccgaggaacagcggaagaccctggaggaggatgtggacgatagggctcccagcaagaaaggcaaaaaacgcaaggctcaacgggaagaggaacaggagcactctaacaaagcccctcgcgctctcactagcaaagagcggaggcgggccgttcgccagcaacggcccaagaaggttggcgtgagatattacgaaacccacaatgtgaagaaccgcaatcggaacaagaaaaaaacaaacgactctgagggacagaaacataagaggaaaaaatttcgccaaaagcagtag

SEQ ID NO: 190144 - DNA, 579 bp, Artificial Sequence
  Description of Artificial Sequence: Synthetic coding sequence
atgcagagcctgatcgagaacgccgagatgagcaccgagagctacgatcagggcaaggatagggacctagtaactgaagataccggcgtgagaaacgaagcacaagaggagatttataaaaaaggccaaagtaagcggatctggggagagctgtacaaggttattgactcctctgacgtggtcgtgcaggtgttggacgcccgagacccaatgggcaccagatctccccatatcgagacttacctaaagaaagagaagccctggaagcatctgattttcgtattaaataagtgtgatctcgtgcccacttgggccaccaagcgctgggtggccgttctgtcccaagattaccctaccttggcctttcatgcgagtctgaccaacccctttgggaagggcgctttcattcagctgcttaggcagttcgggaagctgcatactgacaaaaaacaaatcagtgtcggctttatcgggtacccaaacgtagggaaatcttcggtaatcaataccttgcgatcgaagaaagtgtgcaatgttgccccgatcgccggcgagacaaaggtttccattctgctgtag

SEQ ID NO: 190145 - DNA, 1614 bp, Artificial Sequence
  Description of Artificial Sequence: Synthetic coding sequence
atgacctgccacaagcggtacaagatccagaagaaggtgcgggagcatcatcgtaagttgaggaaggaggccaagaaacgaggtcacaagaaacctaggaaagatccaggagtaccaaatagcgccccctttaaggaggctctgctcagggaagctgaactaaggaagcagaggttggaagagctgaagcagcagcagaagctggatcgtcaaaaagaactggagaagaaacgaaagctggagactaatccggacatcaaacctagtaacgtggagcctatggagaaggaattcggactttgcaagactgagaataaagccaaatccggaaagcagaatagtaaaaagctatactgtcaggagttgaagaaagttatagaagcttcggatgtggtgttggaagtgctagacgcgcgtgaccctctgggttgtcgctgtccgcaggtcgaggaggcgatcgtccagagtggccagaagaagctggtcctaatactgaacaaaagtgatctggttcctaaagagaatctggagtcctggttgaactatctcaagaaggaattgcctaccgtcgtgtttcgtgcttccacaaagcccaaagataaaggcaaaatcacaaaacgggttaaggctaagaagaatgcggcccccttccggtccgaggtgtgttttgggaaagaggggttgtggaaactgttgggcggcttccaggaaacctgtagtaaagctatcagggtgggcgtaatcggatttccaaacgttggcaaatcttctatcatcaacagcctcaagcaggaacagatgtgcaatgtaggtgtgtcgatggggctcacccgatccatgcaggtggtgcccctggacaaacaaatcaccattatagattcaccatcattcatcgtgagccctcttaacagcagctccgccctggctctgagatccccggcatcgattgaagtggtgaaaccaatggaggccgcctccgcaatcttaagccaagcagacgcgaggcaggtagtccttaagtatacggtgcccgggtaccgcaactctctggagttcttcacggttctagctcaaaggagggggatgcatcagaagggcggcatcccaaacgttgagggcgctgcaaagctgctttggagcgagtggaccggagccagcctagcttactattgtcatccccctactagctggactcctccaccttacttcaatgagagcatagtcgtagacatgaagtcagggtttaacctcgaggagcttgaaaaaaataacgcccagtcaatcagagcaatcaaggggcctcacctcgctaacagtatattgtttcagtcttctggcttgacaaatggtattattgaagagaaggacatccacgaggagcttcccaagagaaaagaaagaaaacaagaggaacgtgaggacgataaagattctgaccaggaaaccgtcgatgaagaagtggatgaaaattccagcggaatgttcgctgccgaagaaactggcgaggcattgtccgaggagaccacagccggcgaacaatccacaaggtcctttattttggataaaattatcgaggaggatgacgcgtatgacttttctaccgactacgtgtag

SEQ ID NO: 190146 - DNA, 1650 bp, Artificial Sequence
  Description of Artificial Sequence: Synthetic coding sequence
atgaagcggcccaagctgaagaaggccagcaagcggatgacctgccataagcgctataaaattcaaaaaaaagtccgcgaacaccaccggaaattgcggaaggaggcaaaaaagcgcggacataaaaaaccgaggaaagacccgggtgttccgaactctgcccccttcaaggaagccctcctccgcgaagctgaattaaggaaacagaggttagaggagctcaagcagcaacagaagctggaccggcaaaaagagctggagaagaagcgcaaattagagaccaaccctgatattaaaccttcaaacgtggagcctatggagaaggaatttggcctgtgcaaaacagagaacaaggcgaaatctggcaaacagaacagtaagaaactgtattgccaggagttaaagaaagtcatcgaagcctctgatgtggttctcgaggtgctggacgctcgcgatccactaggctgccgctgcccccaggtggaagaggctattgtgcagtccggacagaagaagctggtattaattttgaataaaagtgatctggtcccaaaggaaaacctggagagctggttaaattatctgaaaaaagaactgcccaccgtagtgtttagggccagcacgaagccaaaggataaggggaagattacaaagagagttaaggctaaaaaaaatgctgccccatttcgttcagaagtctgttttgggaaagagggcctctggaagttacttggtgggtttcaagagacttgcagcaaggccatcagggttggggtgattggctttcccaatgtgggcaaatcctcaattatcaatagtctgaaacaagagcagatgtgcaatgtgggagttagtatgggccttaccagaagcatgcaagtcgttcccctggataagcagatcaccattattgactcgccatcttttatagtgtctcccctcaacagctccagcgccctggccttacgcagcccagcgtctatagaggtcgtgaagccaatggaggctgcctctgctattctatcccaggccgatgcccggcaggtggtgttaaagtacaccgttccagggtataggaattctctggaattttttacggtgctggctcagagaaggggaatgcatcagaaaggaggaattcccaatgtggaaggagccgccaagctgctgtggtccgaatggacgggcgcgtccttagcctattactgtcacccacccacatcctggactcctccaccttactttaatgaaagcatagtggtggacatgaagtcagggtttaatctggaggagctagagaaaaacaacgcccagtcaatacgtgccattaaagggccccaccttgcaaattccatcttatttcaaagttctggcttgactaatggtatcatcgaagagaaggatatacacgaggaactgcccaagaggaaggaacgtaagcaagaggagcgagaggatgataaggactctgatcaagagaccgtggatgaagaggtggacgaaaattccagtggaatgtttgccgccgaggagaccggagaggccctgagcgaagaaaccacagctggagaacagtcgacacggtccttcatccttgacaagattattgaagaggatgacgcttatgactttagtaccgactatgtgtag

SEQ ID NO: 190147 - DNA, 291 bp, Artificial Sequence
  Description of Artificial Sequence: Synthetic coding sequence
atgacctgccacaagcggtacaagatccagaagaaggtgcgggagcaccacaggaagctcaggaaagaggccaagaagcgcggacataaaaaacctcgcaaagacccaggcgtccccaactcagccccgtttaaagaagctctcttaagagaagctgaactgcgcaagcagcggcttgaggaactcaagcagcagcagaaactggaccggcagaaagagctggagaagaaacggaagctggaaactaatccagatatcaagccatctaacgtggaacccatggaaaaatag

SEQ ID NO: 190148 - DNA, 408 bp, Artificial Sequence
  Description of Artificial Sequence: Synthetic coding sequence
atgacctgccacaagcggtacaagatccagaagaaggtgcgggagcaccatcggaagctgcggaaagaggctaagaagaggggacataagaagcctagaaaagatcccggtgtaccaaacagcgccccttttaaggaggccctgctgagggaggcggaactgcgtaaacagcgactggaggaacttaaacagcagcaaaaactcgaccgtcaaaaggagctggagaagaagcgtaaacttgaaaccaatcccgacatcaagccgagcaacgtcgagcctatggaaaaagaattcgggctgtgcaagactgagaataaggcgaaaagcgggaaacagaattcaaaaaagctgtactgccaggaactcaagaaggtcatagaggccagtgatgtggtcttggaagtgtag

SEQ ID NO: 190149 - DNA, 417 bp, Artificial Sequence
  Description of Artificial Sequence: Synthetic coding sequence
atgaagcggcccaagctgaagaaggccagcaagcggatgacctgccacaaacgatacaaaatccagaaaaaagttagagagcatcataggaagctcagaaaggaagcaaaaaaacgtggacacaaaaaaccacgaaaggacccaggcgttccaaattctgccccgttcaaagaggcactacttcgagaagcagagctccgcaaacaacggcttgaagaacttaagcagcagcaaaaacttgataggcaaaaagaactggagaagaaaaggaagcttgagaccaaccctgacataaagccatctaacgtggaacccatggaaaaagagtttgggttatgtaagaccgagaacaaagctaagtcagggaagcaaaatagcaagaagctttactgtcaagagttgaagaaggtgtcttag

SEQ ID NO: 190150 - DNA, 1038 bp, Artificial Sequence
  Description of Artificial Sequence: Synthetic coding sequence
atgccccggatcgacgccgacctgaagctggacttcaaggacgtgctcctgcgtccaaaacgctcctctctgaagagccgcgctgaggtagatttggaacgtacatttacatttcgaaattccaagcagacttatagtggcattcccattatagtcgctaacatggacaccgtgggcaccttcgaaatggccgcggtaatgagccagcactccatgttcacagctattcacaaacactacagcctagatgactggaaactgtttgctacaaatcaccccgaatgcctgcagaacgttgccgttagctccgggagcggacagaatgacctggagaagatgacctcaattctggaggccgtgccacaggttaagtttatctgtttggacgttgcaaatgggtattccgagcatttcgtggaattcgtaaaactggtgagggccaagttcccggaacataccattatggccggcaatgtggtgaccggggaaatggtggaggagctcatcctgtctggagcagacatcataaaagtgggtgttgggcccgggtccgtgtgcacaactcgtacaaagactggcgttgggtacccccagttaagcgccgtgatcgaatgcgccgatagcgctcatggcctgaaaggccacattatcagtgatggggggtgcacctgcccaggtgatgtggcaaaggctttcggggcaggggccgattttgtgatgctcgggggtatgtttagtgggcatacagaatgcgcaggcgaggtatttgagcgcaacggacggaagctgaaactcttttatggaatgtcttcagacactgccatgaataaacacgccggaggcgtggctgagtaccgtgcatcggaaggcaagaccgttgaagtgccttataaaggggacgtcgagaatacgatactggacatcctgggggggctgagaagcacatgcacctatgtgggagccgccaaattgaaagaactgagccgtagagccacttttatacgtgtgactcagcagcacaacactgtcttctcttag

SEQ ID NO: 190151 - DNA, 1230 bp, Artificial Sequence
  Description of Artificial Sequence: Synthetic coding sequence
atgccccacatcgacaacgacgtgaagctggacttcaaggacgtgctcctccggccaaagagatctactctgaagagtaggtccgaggtcgacctgacacggtctttcagtttcagaaattccaaacaaacatatagcggggtgcctatcatcgccgccaacatggatacagttggcactttcgaaatggctaaggtgttatgcaaatttagcctttttacggccgttcacaagcactacagtcttgtccagtggcaggagtttgctggtcagaatccagactgcttagagcacctcgcggcctcgagtggtacgggcagctctgatttcgagcaactcgaacagattctggaagcgatccctcaggtgaaatacatctgtttagacgtggctaacggttacagcgagcactttgttgaatttgtcaaggatgtgaggaagcggttccctcagcacaccataatggctggaaacgtagtgacaggagaaatggtggaggagctgatcctatccggagcagacataatcaaggtcggtatcggccctggatcagtgtgcacaacaagaaagaagacaggagtcggctacccacagctctcagcagtcatggaatgcgccgacgcagcccatgggctcaaaggacatatcatatctgatgggggatgctcctgccctggagatgtcgcaaaagcctttggggcaggcgcagatttcgtgatgttgggcggcatgctggctggacactccgagtcaggcggcgaactgatagagagggatggaaaaaagtacaaactgttttacggcatgtccagtgagatggcaatgaagaagtatgccggcggggtggccgaatatcgctatgtgtggaggcctcggagcctggtgattgtgtggagacaaaacagctggctccttcggggcggatggtacagcagccaaaggtccatggtgaacagggggtccatgctggggagcgtggaaaagtctcttggtctaagaaaccccgagggcgaagataataaggtgttccccaccctgagagccagtgagggcaagacagttgaagtgccattcaaaggggatgtagaacacaccattcgagatatcctgggcggcatccgtagcacttgcacctacgtcggcgctgctaagttaaaagagctgagccgtcgaacaacatttatcagggtaacccagcaggtcaacccaatcttctccgaggcctgctag

SEQ ID NO: 190152 - DNA, 1047 bp, Artificial Sequence
  Description of Artificial Sequence: Synthetic coding sequence
atgccccacatcgacaacgacgtgaagctggacttcaaggacgtgttgctccggccgaagaggagtaccctgaaaagcagatcagaggttgacctcaccagatcttttagctttaggaatagcaagcagacttactcaggtgtcccaataatcgccgcaaacatggataccgtgggaacttttgaaatggccaaggttctttgcaaattttcactcttcacggctgtgcacaaacattattctttggtacagtggcaggaattcgcagggcagaaccccgactgtctcgagcatttagcagcctctagcggaacgggttcaagcgactttgaacagttagaacagattctagaagctatcccccaggttaaatacatttgtctggacgtggctaatggctactccgaacattttgtggagtttgttaaggatgtgagaaaacgctttccccagcacaccattatggcaggcaacgttgttaccggagagatggtggaagagctgattctgtccggcgcagacatcattaaagttggtataggtcccggttcggtttgtacaacccggaagaaaactggcgttgggtatccccagctgtcagcagtgatggagtgtgctgacgcagctcacgggcttaaaggacatatcatttccgatggtggatgtagctgtccgggagacgtagccaaggcctttggagctggtgcggacttcgtgatgctgggcggtatgcttgccggacattccgagagtggaggagaactcatcgagcgtgatggaaaaaaatacaaacttttttacgggatgtcatcggaaatggcaatgaagaaatatgcggggggtgtggccgagtaccgcgctagcgaggggaagactgtcgaggtgccctttaagggagacgtggagcatacgatccgagacatcctgggaggtatcagaagcacatgcacatatgtcggggcggccaaactgaaggaattatcccgcagaaccaccttcattagggtgacccaacaggttaacccaatctttagtgaggcctgttag

SEQ ID NO: 190153 - DNA, 1047 bp, Artificial Sequence
  Description of Artificial Sequence: Synthetic coding sequence
atgccccacatcgacaacgacgtgaagctggacttcaaggacgtgcttctccggccaaagcgctcaactttgaaatcacggtcggaagtggacctcactcgcagcttttccttccggaactctaaacagacatatagtggcgtcccaatcatcgccgctaatatggacacagtgggcacctttgaaatggctaaagtcctctgcaaattctcgctgtttacagcggtgcataaacactacagcctggtccagtggcaggagttcgcaggtcaaaacccagactgcctcgagcaccttgcagcgtcctcggggaccggttcgtccgactttgagcaacttgagcagatccttgaggccatcccccaagttaagtatatatgcctcgacgtggctaatggctactcagaacacttcgtggaattcgtaaaggacgtgagaaaacggtttccccaacatacaatcatggcagggaatgtggtcactggagagatggtggaagagttgattctttccggggccgacataattaaagtcgggattggaccagggtctgtttgtaccaccaggaaaaagaccggggtgggctacccacagctgagtgcagttatggagtgcgctgatgctgctcatggtctcaaggggcacattatttctgacggagggtgttcgtgtcccggggacgtggctaaagccttcggagccggcgccgactttgtcatgctgggaggtatgctggcaggacattcagaatccggcggggaattgatcgagagggatggcaaaaagtataaacttttctatggaatgtcttcagaaatggctatgaaaaagtacgccggaggcgtcgccgagtaccgcgcttcagaaggaaagaccgtcgaagtgccttttaagggcgatgtggaacatactatcagggatatactaggggggattcgctcaacctgcacctacgttggggcagcgaagctgaaggaattgagtcggagaacaacttttataagggtgacacagcaagtcaaccctatcttctccgaagcatgctag

SEQ ID NO: 190154 - DNA, 1101 bp, Artificial Sequence
  Description of Artificial Sequence: Synthetic coding sequence
atgaccagctgcctgcccgccctgcggttcatcgccaccccccggttgagtgccatgccacatatagataacgacgttaagctcgacttcaaggatgttctgctgcgtccaaagcggtctacactgaagtcacgttctgaagttgatcttacccgcagcttttctttccgcaacagcaaacaaacttatagcggggtgcctattatcgcagccaacatggatactgtaggtacatttgaaatggccaaggtcctgtgcaagttttctctgtttacagccgtccacaaacattactccctcgtccaatggcaggaatttgcgggccagaacccagactgtcttgaacacctggccgcaagttcaggtaccgggtcttccgattttgaacaactggagcaaattctcgaagccattccccaggtgaagtatatttgcctcgacgtcgctaacggctacagcgagcatttcgtcgaatttgtcaaagacgttcgtaagaggttccctcagcacactataatggccgggaacgtggtgaccggagaaatggttgaagaactcattctgagtggagctgatattatcaaagtgggtattgggcccggcagcgtatgtaccacccggaagaaaaccggggtgggttacccacagctcagtgcagtaatggaatgtgccgatgccgcccatgggctcaaggggcacataatcagtgatggtggatgctcatgtcccggtgacgtggccaaagcattcggcgcaggcgccgattttgtgatgctcggcggcatgctcgctgggcactccgagtcaggcggagagctgatcgagagggatggaaagaaatacaaactgttctacggaatgtccagtgaaatggccatgaaaaagtatgccggcggtgttgcagagtaccgagctagcgagggaaaaacagtggaagtgcccttcaagggggacgttgaacatacaatcagggatatactgggaggaatacggagcacctgcacgtatgtgggcgcagccaaattgaaggaactatcccgccggactacattcattagagtcacacagcaggtcaatcctatattttcagaagcgtgctag

SEQ ID NO: 190155 - DNA, 1047 bp, Artificial Sequence
  Description of Artificial Sequence: Synthetic coding sequence
atgccccacatcgacaacgacgtgaagctggacttcaaggacgtgctcctgaggccaaaaagaagtaccctcaagagcaggtctgaagtggacctgacaagatcctttagctttcgcaatagtaaacagacttacagcggcgtgccgatcatcgctgccaatatggatactgtggggactttcgagatggcgaaggtcctctgcaagttctccctcttcacagccgtgcataagcattattccctcgtgcagtggcaggagttcgccggccagaacccggactgtctcgagtcaatttggctcccagctcaggctcaggccctgcttaccctgagcagctggaatcgctcctggaagctctttccacgaaaatacatctgtttggacgtcgctaacggttactcagagcacttcgtggagtttgtcaaagacgtgagaaaaaggtttccgcagcacaccatcatggcaggcaatgtggtaaccggcgagatggtagaggagttgatcctgtccggagcagacattatcaaggtaggcatcggtcctgggtcagtgtgcactacacgcaagaagactggggttggttatccccaactctcagcagtaatggagtgcgccgatgctgctcacggcctcaaaggacacataatctcagatggtggctgcagctgtccaggcgacgttgctaaagccttcggtgcgggcgctgacttcgtcatgctagggggaatgttggccggccatagcgagtcaggcggagagctaatagaacgcgatggaaaaaaatacaaactgttctatggaatgagttctgaaatggccatgaaaaaatatgccggcggagtggcagaatatcgggccagcgagggcaaaaccgtggaggtgcctttcaagggtgatgtcgagcatacaatccgagacatcctgggtgggattcgtagtacctgcacgtatgtgggtgccgctaagttgaaagaacttagtcgccgaaccacttttattcgggtgactcaacaagtgaacccgattttcagcgaggcttgctag

SEQ ID NO: 190156 - DNA, 1047 bp, Artificial Sequence
  Description of Artificial Sequence: Synthetic coding sequence
atgccccacatcgacaacgacgtgaagctggacttcaaggacgtgctgctcagacctaaaaggagcacacttaagtcacgaagcgaagtcgaccttacacggtcattctcctttaggaacagtaaacagacctacagcggggtgcctattatagctgccaatatggatactgtgggcaccttcgagatggctaaagtgctctgcaagttctcattgtttacagcagtccacaagcattatagcctcgtgcaatggcaggagtttgcgggtcaaaatcctgactgcctggagcatctggccgcgtcttccggaaccggttcttcagacttcgaacagctggagcagatactagaagctataccccaggtgaaatacatctgtctggatgttgcaaacggatacagcgagcatttcgtcgagtttgtgaaagacgttcgtaaaagatttccgcagcatacaatcatggccggcaacgtggtgaccggagaaatggttgaagaattaatcttgagcggggccgacatcattaaggtcggaattggacctgggagcgtctgcacgacccgtaagaagacgggagtcggatacccacagctgtccgccgtgatggagtgcgcagatgctgcccatgggctcaaagggcatatcatttcagacggcggctgctcatgtcctggcgacgtggcaaaggcatttggtgctggagcggatttcgtgatgctcggcgggatgctggccggacacagcgaatctggaggagagctaatcgagagggacggcaagaaatacaagcttttttacggcatgtcatctgaaatggccatgaagaagtacgccggtggagtcgctgagtatcgggccagtgagggcaagactgtggaagtgccttttaaaggggatgtggaacacaccatccgtgacatcctcgggggcatccgatccacttgcacatatgtgggagccgccaagttgaaggagttgagcaggcggaccaccttcattagggtgactcagcaggtaaatccaatattctctgaggcgtgctag

SEQ ID NO: 190157 - DNA, 1779 bp, Artificial Sequence
  Description of Artificial Sequence: Synthetic coding sequence
atggccagcgagatccacatgaccggccccatgtgcctgatcgagaatacgaatggacggctcatggccaaccccgaggcactcaaaattctgagtgctattacacagccaatggtggtggttgccattgtcggactgtaccgtaccggaaagtcgtacctgatgaacaaactcgccggcaaaaaaaaaggttttagtcttggaagtactgtgcagtcgcatactaaaggcatttggatgtggtgtgttcctcacccaaagaagccgggccatattctggtgctactggataccgaggggctgggggacgtggaaaagggagataaccagaacgacagttggatctttgcactagcagtgttgctgtctagcacatttgtctataattccatcggcaccataaaccagcaggcaatggatcagttatattatgtgaccgagcttactcacagaattaggtccaaaagctctcccgatgagaacgaaaacgaggtagaggactctgcagactttgtttcttttttccccgattttgtgtggacactcagggacttctctctagacttggaggctgacgggcagcccctaaccccggatgaatatttgacctactcccttaaactcaagaagggaacctcccaaaaagacgaaactttcaatttgccacggctgtgcatcagaaaatttttccccaaaaagaagtgttttgtgtttgatagacccgtgcatcgcaggaagttggcccagttagagaaactgcaggacgaggagcttgatccggagttcgtgcagcaggtcgccgacttctgcagctacattttttctaacagcaagactaaaacgctctctggaggcattcaagtgaacggcccccgacttgagagtctcgtgcttacctatgtgaacgccatcagctccggtgacctgccctgtatggagaacgccgtgcttgcccttgctcaaatagaaaactcagcggcggtgcaaaaggccatcgcccactatgaacagcaaatgggacagaaagtgcagcttcctaccgaaaccctgcaagagctccttgatctgcaccgagactccgaacgagaagccatcgaggtcttcatccgcagctccttcaaagatgtggatcacctgttccagaaggagttagctgcacagcttgagaagaagcgggacgacttctgcaagcaaaaccaagaggccagtagcgatagatgttctgccttgttacaggtcattttctccccattggaggaggaagtcaaggccgggatctacagcaagccggggggctatcgcctcttcgtgcagaagctgcaagacctgaaaaagaaatattatgaggaaccccgcaaaggtatacaggctgaggagatcctccaaacatatctcaaaagcaaggaaagcatgaccgacgccattttgcaaaccgatcaaacccttaccgagaaggagaaggaaatagaagttgagagagtcaaagccgaatctgctcaggcttctgccaaaatgctgcaggagatgcagagaaagaacgagcaaatgatggaacaaaaggagagatcctaccaggagcatctcaaacagctcactgaaaaaatggaaaacgaccgagtccagctgctgaaggagcaggaaaggaccttggccttaaaattacaagaacaggagcaactgctgaaggagggatttcaaaaggagtctcgcatcatgaagaacgaaattcaggatctgcagaccaagatgcgcagaagaaaagcctgcacgataagctag

SEQ ID NO: 190158 - DNA, 1668 bp, Artificial Sequence
  Description of Artificial Sequence: Synthetic coding sequence
atggtggtggtggccatcgtgggcctgtaccggaccggcaagagctacctgatgaacaagctggcaggcaagaagaagggtttcagtctgggcagcactgttcagagccacaccaaaggtatttggatgtggtgcgtgccccatccaaaaaagcccggccacatattagtgctgctggacacagagggcctgggggacgttgagaaaggtgataaccagaatgatagctggatctttgccctcgctgtgttgctgtcctccacgtttgtctataactcgatcggcacaatcaaccaacaggctatggaccagctgtattacgtaaccgagctgacacatcgaatccgttctaagtctagccctgatgagaacgaaaacgaggtcgaggattcagccgactttgtctctttctttccggacttcgtgtggactttgagagacttcagtcttgatctggaagctgacggtcagccactgactcccgacgaatacctgacctactccctcaagttgaaaaaagggacctcccagaaggacgaaaccttcaacctgcccagactatgcattcgcaaattctttcctaagaaaaaatgctttgtctttgaccggccggtccacaggcgcaagctggcccagcttgagaagctccaggacgaggaacttgacccagagttcgtacagcaggtggctgacttctgtagctatatattttctaatagcaagactaagactctgtcagggggaattcaggtgaatggtccacgattggaaagcttagtcctcacgtacgtcaatgccatatccagtggggacttaccatgtatggagaatgcagttctggcactggcccagatcgaaaattcagcggctgttcagaaggccattgcccattatgaacaacagatgggccagaaggtgcaattgcctacagaaactttgcaggagctgctagatttgcatagagatagcgagagggaagcaatcgaagtcttcattcgctcttccttcaaagatgtagaccacctgttccagaaggagctggccgctcagctggagaagaaacgagatgatttttgtaagcagaaccaagaagctagttccgatcgatgctctgccttgctccaggtgatttttagtcctctcgaagaagaagtcaaggcaggcatctattcgaaaccaggggggtacagactgttcgtacaaaaacttcaggacctgaaaaaaaagtattacgaggagccccggaaaggcatccaggccgaggaaattttacaaacctacctgaagtcaaaagagagtatgactgacgcaatcttgcagaccgatcagactcttacggagaaggagaaggagatcgaggtcgaacgcgttaaagcagaatcagcacaggcatctgctaaaatgcttcaggaaatgcaaaggaagaacgagcagatgatggaacagaaggaaagatcctaccaggagcatttgaagcaactgacagagaaaatggaaaacgaccgagtgcagctccttaaggagcaggagagaacacttgctctcaaattacaggaacaggagcagctgctgaaggaaggatttcagaaagagtctaggataatgaagaacgaaatccaggacctccaaaccaagatgagaaggcgaaaagcctgtactataagctag

SEQ ID NO: 190159 - DNA, 1776 bp, Artificial Sequence
  Description of Artificial Sequence: Synthetic coding sequence
atggcccccgagatcaacctgcccggccccatgagcctgatcgacaataccaaaggacagcttgttgtaaatccggaggcattgaaaatcctgagtgcgattacacaacccgtcgtggtcgtggcgatagtgggcctgtatcgcacgggcaaatcttacctcatgaacaaattggcgggcaagaagaacgggttttccctggggtccacggtcaagtcacataccaaagggatctggatgtggtgcgtcccgcacccaaagaagccggagcacacgcttgtcctcttagacacagaggggttgggcgacatcgaaaaaggcgacaacgaaaatgacagctggattttcgctctggcaatcctcttgagttctaccttcgtatataactcaatgggcaccataaaccagcaggccatggaccagcttcactacgtaacggagctcaccgataggattaaggctaattcatcacccggaaataactcggtcgacgattccgccgactttgtgtcattcttccccgcatttgtctggacactgcgagactttacccttgagcttgaggtggacggcgaacctatcacggccgacgactacctcgaattgagtttgaaactccgaaaggggacggacaagaaatccaagtcatttaacgaccctcggctttgcatcaggaaattttttcctaaaagaaagtgttttgttttcgactggcccgctccaaagaagtatctcgctcacttagagcagctgaaagaagaagaactaaacccggacttcatcgagcaggtcgccgaattctgctcctacattctttctcacagcaatgtcaagactctgtccggcggcatacctgtgaacggtcctagattggagagtttggtcctgacctacgtgaacgcaatctctagtggagacctgccttgcatggaaaacgctgtgctagcgctggcccagattgagaattccgcagccgtggaaaaagcaatcgcacactatgagcaacagatgggtcaaaaagtgcagctgcccacagagaccctgcaggaacttctggatctgcacagagatagtgagagggaggccattgaagtcttcatgaagaattcctttaaggacgtagatcagatgtttcagagaaagctgggggctcaactggaggcccgtagggatgacttctgtaagcagaattccaaagcaagctctgactgctgtatggccctgctgcaggatatcttcggcccccttgaagaagacgtcaagcagggtacttttagcaaaccaggtgggtaccggcttttcactcagaaattacaggagctgaagaacaaatactatcaggtgcctagaaaggggattcaggcaaaggaggtacttaagaagtatctggagtcaaaggaggatgtcgctgatgctctactccagacagatcagagtctgtcagagaaagagaaagcgattgaagttgagagaattaaagcagagtctgccgaagcggccaaaaagatgcttgaggaaatccagaaaaaaaatgaggaaatgatggaacaaaaagagaaatcctatcaagagcacgtcaagcaacttactgaaaaaatggaaagagaccgcgcacagctaatggccgaacaggagaaaaccctggcactgaagctgcaggaacaggaacgacttctaaaagaaggatttgagaacgagagcaagaggctacagaaagatatttgggacatccagatgcgttccaagtcactcgaaccaatttgcaatatactgtag

SEQ ID NO: 190160 - DNA, 1776 bp, Artificial Sequence
  Description of Artificial Sequence: Synthetic coding sequence
atggcccccgagatcaacctgcccggccccatgagcctgatcgacaatacgaaagggcagctagtcgtaaatcctgaggctttgaagattctctccgcgattactcagcctgtggtggtggtggccatcgtaggcctgtaccgcacgggcaagtcctacctcatgaataaactggccggtaaaaaaaatgggttcagcctgggctcgactgtgaaatcccacacgaagggcatctggatgtggtgtgtccctcaccccaaaaagccggaacatacactggtgctgctcgataccgagggcctgggcgacattgagaagggggacaacgagaatgatagttggatctttgcgttggccatcttgctatcgtccacttttgtctacaatagcatgggcactatcaaccagcaggccatggatcagctgcactatgtcaccgagctgaccgacaggatcaaagccaacagtagcccggggaacaattcagtggacgattcggccgacttcgtttctttcttcccggccttcgtctggacgctcagagactttacccttgaacttgaggtggacggagaacctatcacggctgatgattatcttgagctgtcgcttaagttacgcaaaggcactgataaaaaatcaaaatcattcaatgatccacgactgtgcattagaaagttttttcccaagcggaagtgcttcgtatttgactggcccgcccctaagaagtacttagcgcacctggaacagcttaaggaggaagaactgaaccctgatttcatcgaacaagtcgccgaattctgcagctatatactctcccatagcaacgtcaaaaccctgtcagggggcatcccggttaatgggcctaggctcgaaagtcttgttctgacttacgttaatgctatttcatcaggggacctgccttgtatggagaatgcagtgctcgcgctggcccagattgaaaacagtgctgcagtggaaaaggcaatcgctcattacgagcagcagatgggtcagaaagtgcagcttccgaccgagaccctgcaggaattgctggatcttcatcgggactctgaaagggaggccattgaagtgttcatgaagaattcgttcaaagacgttgatcagatgtttcaaagaaagctgggcgctcagttggaggctcgacgtgatgatttctgcaaacagaattcaaaggccagcagcgactgctgtatggcccttttacaagatatttttggacccctggaagaggacgttaagcaaggcaccttttccaagcctggaggttatcggttgtttactcaaaagcttcaggagttgaagaacaaatactatcaggttcctcgtaaggggattcaggccaaagaagtgcttaagaaatatcttgaatccaaggaagatgtcgccgatgccttgttgcagaccgaccagtctctaagcgagaaggaaaaagctatcgaggtggagcgtattaaggctgagagtgcagaggcagccaagaaaatgctggaggaaatccaaaagaaaaacgaggagatgatggaacaaaaagagaagtcctaccaggaacatgttaaacaactgacggaaaagatggagagggaccgcgcacaactcatggcagaacaggagaagactctcgccctcaaactgcaggagcaggaacggctactgaaagaggggttcgaaaacgaatcaaagaggttacagaaggatatttgggatatccagatgagatccaaatccttagaaccaatttgcaacatcttgtag

SEQ ID NO: 190161 - DNA, 1323 bp, Artificial Sequence
  Description of Artificial Sequence: Synthetic coding sequence
atggcccccgagatccacatgaccggccccatgtgcctgatcgagaataccaacggcgagctggtggctaaccccgaagctctgaagatcctgtctgcaataacgcagcccgtggttgtcgtggctatcgtcgggctatacagaactggtaagtcctatctcatgaataaacttgccggcaaaaataagggcttctccttggggtctaccgttaagagtcacaccaagggaatatggatgtggtgtgttccccatccgaagaagcctgagcacacattggtgctgctcgatacggagggcctcggcgacgtgaagaaaggcgacaaccagaacgattcatggattttcaccttggcggtgctgttgtcaagcacacttgtgtacaactcaatgggaaccattaaccagcaagcaatggaccagctctattatgtcacagaactcacccatcgaatccggagtaagagctcgccagatgaaaacgagaacgaggatagcgcggattttgtcagcttttttcccgattttgtttggaccctcagggacttcagtctggacctagaggccgatggccagcctctaacaccagacgaatacttagagtattctctgaagctaacacaaggcactagccagaaggacaagaatttcaacctgcctcgcctctgcattagaaagtttttcccaaaaaagaagtgctttgtcttcgacctcccaattcatagaagaaagcttgcccagttggagaagctccaggatgaagaactggatccagaatttgtacagcaggttgcagacttttgctcctatatcttttccaattctaaaaccaagacattatcaggaggaattaaagtaaacggaccccggctggagagtctggtactgacttatatcaacgcaatttcccggggagacctgccctgcatggagaacgcagtccttgctctcgctcaaatagagaattccgccgccgtccagaaagctatcgcacactacgatcaacaaatgggccagaaggttcagcttcctgccgaaaccctgcaggagctgctcgacctgcatagagtttcagaacgggaggcgactgaggtctatatgaagaattcctttaaggatgtagaccatcttttccagaaaaagctcgccgcccagcttgataagaagagagatgacttttgtaagcagaatcaggaagccagctctgataggtgctctgcactcctccaagtgatcttcagtcctctggaagaagaggtgaaggcaggcatctactccaagcccggtggctactgcctgtttatacagaaactgcaggactag

SEQ ID NO: 190162 - DNA, 1788 bp, Artificial Sequence
  Description of Artificial Sequence: Synthetic coding sequence
atggcccccgagatccacatgaccggccccatgtgcctgatcgagaacaccaatggcgagctagtcgcaaaccccgaggccctgaagattctgagtgcaattacacaacccgtggtcgtggtggctatagtgggcctctaccgcacagggaaaagctacttgatgaacaagttggcgggaaagaataagggtttttccctcgggtcaactgtgaaaagccacacaaaaggaatctggatgtggtgtgtaccccaccctaagaagccagagcatacactggttttgctggacaccgagggcctgggtgacgtcaagaagggcgataatcagaacgactcttggatattcaccctcgctgtcctactaagcagcaccctggtttataactcaatgggcaccattaatcagcaagcaatggatcaattgtattacgtgacggagctgacccaccggattcgatccaagtcatcacccgacgaaaacgagaacgaggattccgctgactttgttagctttttccccgacttcgtgtggacactgagggacttctctctggatctcgaggctgacggacaacctcttacccccgatgaatatctggaatacagtttgaaactaacccagggaaccagccagaaggataagaactttaacctcccacggctgtgtatcagaaagttcttcccaaagaagaagtgcttcgtgttcgatctccctatacataggcggaagttggcccagttggaaaagttgcaggacgaggagctcgaccccgaattcgtacagcaggtggctgatttttgttcatacattttctccaactcaaaaacgaagacactgtcaggaggtattaaggtgaacggaccgagacttgagtctctggtgctgacatatatcaatgcaattagtaggggggatttaccctgcatggaaaacgcggtgttagcgcttgcccagatcgagaactccgccgctgtacagaaggccattgcccactacgaccagcagatgggccagaaagtacaactcccagccgaaaccttgcaggagctgctggacctccaccgtgtgagtgagcgagaggctaccgaggtctatatgaagaatagttttaaggacgtggatcacctgttccagaagaagttggccgcacaactcgacaagaagcgtgacgatttttgtaagcagaaccaggaagcgtctagcgacaggtgttccgccctgcttcaagtgatattcagccctctggaagaggaagttaaagccggaatttattctaagcctggtggatattgtcttttcattcagaaactccaagacttagagaagaaatactacgaggagccacgaaaggggatccaggcggaggagatcctccaaacctatctcaaatctaaagaatccgttacggacgctatcctccagaccgatcagatcctgaccgagaaggaaaaagagatagaagttgaatgcgtaaaagcagaaagcgcccaggcgtccgccaaaatggtggaagagatgcagattaagtatcagcaaatgatggaggagaaggagaaatcatatcaggagcatgtgaaacagctcacggaaaagatggagcgagagcgggcacagctactggaggagcaggagaagacccttacctcaaagctccaggagcaggcacgcgtcctgaaagagaggtgccagggagaatctactcaactgcaaaacgaaattcaaaaactgcagaagaccctgaagaaaaagacaaaacgttatatgtcccataagttaaagatctag

SEQ ID NO: 190163 - DNA, 1692 bp, Artificial Sequence
  Description of Artificial Sequence: Synthetic coding sequence
atggcccccgagatccacatgaccggccccatgtgcctgatcgagaacacaaacggagagctggtggcgaaccccgaggctttaaaaatcctgtctgctatcacacagcccgtggtcgtggtggccatcgtgggcttgtatagaacaggtaaaagttatctcatgaacaagctggccggcaagaacaagggcttctcactcgggagtaccgtgaaatctcatacaaaaggaatatggatgtggtgcgtaccccatccgaagaagcctgagcacactctggtgctgttagatactgagggcctgggcgacgtcaaaaagggtgacaaccagaatgactcctggatatttacactggctgtgcttttgagtagtaccctggtctacaactccatgggcacaattaaccagcaggctatggaccagctgtactacgttacggaattgacccataggatcagaagcaagagctctccagatgagaatgagaatgaggattcagccgacttcgtctcgttcttccctgattttgtatggacattgcgggactttagtctcgatttggaggctgacgggcagccgctgacgccagatgagtatctggaatacagtctgaaactcacacaaggcaacagaaagcttgctcagctcgagaaactccaggatgaggagttagaccctgagtttgttcagcaggtggctgacttctgctcttacatttttagtaattctaaaactaagactctgtctgggggcatcaaagtgaacggtcccaggttggagtcgctggtgctgacctacattaacgctatctctcggggtgatctcccatgcatggagaacgccgtcctcgccttggcccagatagaaaacagcgctgcagtccagaaggcaatcgcacactacgaccagcagatggggcagaaggtccagctgcccgccgagaccttacaggaactactggacctgcatcgggtgtcagaaagggaggcgacagaggtctacatgaaaaactccttcaaggatgtggaccatctgtttcagaaaaagctcgccgctcaactggacaagaaaagggacgacttctgtaaacagaaccaggaggcatcatcagatcggtgcagcgctctgctgcaggtcattttctctccattggaggaggaggtaaaggccggcatttactccaagcccggcggatactgtctctttatccagaagttgcaggatctggaaaaaaagtactacgaagagccacgcaagggaatccaagctgaggagatcttgcaaacatatctcaaatcgaaagaatctgtgactgacgcgatactgcagaccgaccagatcctcactgaaaaggagaaggagatcgaagtggagtgcgtgaaagccgagtcggcacaggcgtccgctaagatggtggaggagatgcagatcaagtaccagcagatgatggaagagaaggaaaaatcataccaagaacatgtaaaacagttaaccgagaagatggaacgcgagcgtgcccagttattagaagaacaagagaagacactgaccagtaaactgcaggaacaggctagggtgctgaaggagagatgtcagggggagagcactcagctgcagaatgaaatccagaagttgcaaaagactcttaagaagaagaccaaaagatacatgagccataagctgaaaatttag

SEQ ID NO: 190164 - DNA, 414 bp, Artificial Sequence
  Description of Artificial Sequence: Synthetic coding sequence
caggacgaggagctggaccccgagttcgtgcagcaggtggccgacttctgcagctatattttctccaatagcaaaacaaagaccctgagtggcggtatcaaggcagaggagattctgcagacgtatctaaaaagtaaagagagtgtgacggatgctatcctgcaaaccgaccagattcttaccgagaaagaaaaggagattgaagtggagtgcgtcaaggcggaaagtgcccaggcgtccgcaaaaatggttgaggagatgcagatcaagtaccaacagatgatggaggagaaggagaaatcttaccaggagcatgttaagcagctcactgagaagatggagcgggaacgcgcccagctgcttgaagaacaggagaaaactttgacttcgaaactgcaggtttccaagtgctag

SEQ ID NO: 190165 - DNA, 1923 bp, Artificial Sequence
  Description of Artificial Sequence: Synthetic coding sequence
atgggcgagcggaccctgcacgccgccgtgcccacccccggctaccctgaatccgaatctattatgatggctcctatatgtctcgtggagaaccaggaggaacagttgaccgtgaattccaaggccctcgaaatactggacaagatctcacagccagtcgtcgtggtggctattgtgggactgtatcggacaggcaaatcatacctgatgaaccgtctggccgggaaaagaaatggatttccactgggatctacggtccagtcagagacaaaaggaatttggatgtggtgtgtgcctcacctctctaagcccaaccacacacttgtgctcctggacacggagggtctgggagacgtcgagaaatctaatccaaaaaacgactcatggattttcgctctggcggtcctgttaagcagtagcttcgtgtacaactctgtcagcactataaatcatcaagcgcttgaacagctccattatgtgactgagctcgcagagcttataagggccaagtcctgccctcgcccagatgaggccgaagactctagcgagtttgcatcctttttcccagacttcatatggaccgtgcgcgacttcacccttgagttgaagctcgatgggaatcccatcactgaagatgagtacctcgagaacgcactgaaactgatccccggcaaaaaccccaagatccagaactcaaatatgcctcgcgagtgcattagacacttctttagaaaaagaaaatgttttgtctttgatcgacctaccaacgataagcagtaccttaaccacatggatgaggtacctgaggagaaccttgaacgccatttcctgatgcaatcggacaacttttgctcgtatatttttacacacgctaagacaaagactttaagagaagggataatagttacaggcaagaggttggggacactggtagtgacgtacgttgatgctatcaactccggcgctgttccatgtctcgagaatgcagttaccgccttggctcaacttgaaaaccctgcagctgtgcagcgcgccgccgaccattatagccagcagatggcacagcagttgcggctgcccacagatacactccaggagcttctcgacgtacacgcagcatgtgaaagagaagccattgctgtttttatggagcactcttttaaggatgagaaccacgaatttcagaagaaactcgtggacacaatcgaaaagaagaaaggagacttcgtgctacagaatgaggaggcatccgccaagtattgccaagctgagttgaaacgtctgtccgagcacctaactgagagcatcctgagaggcatctttagtgttcctggcggccacaacctgtacctggaggagaagaaacaagtggagtgggattacaagctcgtgccccgtaagggggtgaaggcaaacgaagtgcttcagaacttcctgcagagccaggttgtagtcgaggagagcattcttcagtcagataaggccctcacggctggagagaaggctatcgcagcagagcgggcgatgaaggaggccgctgaaaaggagcaggagctcctacgcgaaaagcagaaggaacagcaacagatgatggaagcccaggagcggtccttccaggagtatatggcccagatggagaagaaactggaggaagagagggaaaacctgcttcgagagcatgagagattgctgaagcacaaactgaaggtccaggaggagatgttgaaggaggagttccagaagaagtcagaacagctgaataaggagatcaatcagctgaaagagaagatcgagtccaccaagaacgagcaactgcgcctactgaaaatactagacatggcaagtaatatcatgattgttacgctccctggggcctccaaactgctaggagtggggactaaatatctcggtagccggatctag

SEQ ID NO: 190166 - DNA, 1761 bp, Artificial Sequence
  Description of Artificial Sequence: Synthetic coding sequence
atggccctggagatccacatgagcgaccccatgtgcctgatcgagaacttcaacgagcagctgaaagtcaatcaggaagccctcgaaattctgagcgccattacacagcctgtggtcgtggtggccatcgtagggctttatcgcaccggcaagagctatctgatgaataaactcgctggtaagaacaaaggcttttcggtagcttccaccgtgcaaagtcataccaagggaatctggatctggtgcgtcccacaccctaattggccgaaccatactctggtgctgcttgacacagagggcttgggtgatgtcgagaaggctgacaataagaacgacattcaaatattcgcgttagctcttcttctctcaagcacgttcgtttacaataccgtgaataagattgatcagggggctatcgatctgctgcacaatgtaacagaattgaccgacctcctgaaggccagaaattctccagacctggaccgggttgaagaccctgccgactcagcgtccttctttcctgacctggtgtggacattacgggatttttgtctggggcttgaaattgacggacagctggtaacaccagacgagtacctggagaacagcctgaggcccaagcaggggagcgatcagagggttcagaactttaacctgccacgattgtgtattcaaaaatttttccccaaaaaaaagtgtttcatattcgatctccctgcacatcagaaaaagttagcccaactggagacccttcccgacgacgagctggagcccgaattcgtccagcaggttactgagttctgtagctacattttctcacactccatgacgaagaccctgccgggaggcatcatggtcaacggaagccgactgaagaatttagttctgacctacgtgaatgcaattagttctggtgatctgccatgtatagaaaacgcggtgcttgccctggcccagcgtgagaatagcgccgctgtgcagaaagctatcgcacattacgatcaacagatggggcagaaagtgcagctgccaatggagaccttgcaggagttgctggatctgcatcgcacatccgagagagaggcaatcgaagtgttcatgaaaaactcgttcaaggatgtcgatcagagcttccagaaggagctagaaacactcctggacgccaagcagaacgacatttgtaagagaaacctcgaggcttcaagtgattactgttccgcgctacttaaagatatctttggaccacttgaggaggctgttaagcagggaatctactccaagcctggaggacacaacctcttcatccagaaaacagaagagttgaaggccaaatactatagggagccacgtaagggaatccaggctgaggaagtgttgcagaaatatttgaaatccaaagagtcagtgtctcatgctattttgcagaccgaccaggctttgacagaaactgagaaaaagaaaaaagaggcacaggtaaaggcagaagcagaaaaggccgaggcccagagattggctgcgatccagagacagaatgagcagatgatgcaagagcgagagcgcctgcaccaagagcaggtacggcaaatggagattgcaaagcagaactggctcgcagaacagcagaagatgcaagaacagcagatgcaggagcaggcagcccagctaagtacgacattccaggcacagaataggtcactcctgtccgagctgcagcacgcccagcggactgtcaataacgacgacccttgtgttctgctttag

SEQ ID NO: 190167 - DNA, 1761 bp, Artificial Sequence
  Description of Artificial Sequence: Synthetic coding sequence
atggccctggagatccacatgagcgaccccatgtgcctgatcgagaacttcaatgagcagctgaaggtgaaccaagaggccctggaaatactgtccgccataactcagcctgttgtggtggtagctattgtgggcctataccggaccggcaagagctatcttatgaataagctggctgggaagaataagggcttcagtgtggcttccacggtgcagtctcacacgaaaggcatttggatttggtgcgtcccccaccctaattggcctaaccacaccctagtgctgctagataccgaaggacttggggatgtggagaaggccgacaacaaaaatgacattcagatttttgccctggcgttgctgctttcctctaccttcgtgtacaacacagtgaataaaatcgaccaaggagctattgacctcctgcacaacgtgaccgaactaacggacctgctgaaggccaggaactctccggatctggatcgtgtcgaagaccctgcagatagcgcgtctttctttcctgatttggtgtggaccctgagggatttctgtctggggctcgaaatcgacggtcagcttgtgacccctgacgagtatctcgagaatagtctgagaccaaaacagggctccgaccaacgggtgcaaaattttaacttaccaagactgtgtattcagaagtttttccccaagaaaaaatgcttcatttttgacctcccagcacatcaaaagaagctcgcacagctggaaaccctccccgatgatgaactagaacctgaattcgttcaacaggttaccgaattttgttcgtatatcttttcacacagcatgacaaaaactctgccgggcggtatcatggtgaatggatcaaggctgaagaacctggtgctgacctatgtcaacgccataagttccggcgacctcccctgtatcgagaacgccgtactcgccctagcccagcgggaaaatagcgcagctgtacagaaagctatcgcccattacgaccaacagatgggccagaaagtgcagctgcctatggagacactacaggagctgttggacttgcacagaacgtccgagagggaagctatcgaagtctttatgaaaaactcatttaaagatgtggaccagtctttccagaaggaattggaaactcttctcgatgcaaagcaaaatgacatttgtaaacggaatctggaagcatcctccgactattgctctgccctccttaaagacatttttgggccactggaggaggccgttaaacaggggatatacagtaagcccggcggacacaacctcttcatacagaaaacagaagaactgaaggccaagtactatcgggaacctcggaagggcatacaggctgaagaggttctgcagaaatatctgaagtctaaggaatcggtctcccatgccattctccagaccgatcaggctctcaccgagacagagaaaaagaaaaaggaagcccaggtgaaagctgaggctgaaaaggcggaggcacagagattggcagctatccagcggcagaacgagcagatgatgcaagaacgggaaagattgcatcaagagcaggtgaggcagatggagatcgctaagcaaaattggcttgccgagcaacagaaaatgcaggaacaacaaatgcaagaacaggctgctcagttgagcacaacatttcaggcccaaaacagaagcctgctttcagagttacagcacgcccaacgcacagtcaacaatgacgatccttgcgtactcctatag

SEQ ID NO: 190168 - DNA, 1452 bp, Artificial Sequence
  Description of Artificial Sequence: Synthetic coding sequence
atggccctggagatccacatgagcgaccccatgtgcctgatcgagaattttaatgagcagctgaaggtgaaccaggaagcgctggagatattatcggcgataacacagcccgtggtggtggtggccatcgtaggcctttatcggacggggaagtcctatcttatgaacaagctggcagggaaaaacaaggggttcagcgtcgctagcactgtccagagccataccaaaggtatttggatctggtgcgtcccccatcctaattggcctaatcacactctggtcctgctcgatacagagggtctgggagatgtcgagaaggccgataataaaaatgatatacagatcttcgccctggctttgttactgtccagcacattcgtttacaacacagtcaataagatcgaccaaggcgccatagatcttcttcataatgtaaccgagcttacggacctgctcaaagcaagaaactcccctgatttagatagggtggaagatccagcagacagcgcttcattcttccctgacttagtatggacactgcgggacttttgtctagggctcgagattgacggacagctcgtcacacccgatgagtatctcgaaaactcactccggcccaaacaagggtcagaccagcgagttcagaatttcaatctgccgaggttgtgcattcagaagttctttccaaagaagaaatgcttcattttcgacttacccgcccatcagaagaagctggcacagctggaaacattgccagacgacgagctggagcctgaattcgtccagcaggtgaccgaattttgttcctacatattctcccattcaatgacaaaaacactccccggagggattatggtcaatggatcccggcttaaaaaccttgtgttgacatacgtgaatgctatttcttcgggggatcttccctgtatagaaaacgcagtgttagccctggcccagagggaaaacagcgccgccgttcagaaggcaattgcgcactatgaccagcagatgggccaaaaagtacagttaccgatggagacgcttcaggagctactggatctgcatcggacctcagagcgtgaagccatagaagtctttatgaagaactctttcaaggatgttgatcaatcttttcagaaagagctcgagacgctgcttgacgccaagcagaacgatatatgtaaaaggaacctggaagcctccagcgattactgctccgccttgctcaaggatatattcggaccactcgaagaggccgtgaagcagggcatctattctaagccgggcgggcataatctgttcattcagaaaacagaggagctcaaagccaaatattaccgcgagccacggaaaggaattcaagccgaggaagtcctccaaaaatatctgaagagtaaagagtccgtcagtcacgccatcttgcaaacagaccaggctctcaccgagacttag

SEQ ID NO: 190169 - DNA, 1917 bp, Artificial Sequence
  Description of Artificial Sequence: Synthetic coding sequence
atggccagcgagatccacatgcccggccccgtgtgcctgaccgagaacaccaaggggcacctggtggtgaactctgaagctctggaaatcttgtccgccattacgcagcccgtggttgttgttgcgattgtgggattatatcgcacagggaagtcctatctaatgaataagttagcaggcaaaaataagggattccccctgggctgtacagtgaagagcgaaaccaaagggatctggatgtggtgtgtccctcatccttctaagcccaaccacaccctgatactgctggacaccgaggggcttggggacatggagaagtcagaccccaaaagtgactcctggatcttcgccctggcagttctgttatcttcctcatttgtgtataattccatgggtaccattaatcatcaagcgctcgagcagctccactacgttactgagttaaccgaattaatccgcgccaaatcctgccctagaccagacgaagtagaagacagcagtgagtttgtttcgttcttccccgacttcatatggacagtgagggacttcacactcgagctcaaactcgacggacatccgattaccgaggatgagtacctggaaaacgcgctcaagctcatatccggcaagaacccacagattcagaacagcaataagccccgtgagtggattcggcatttctttccaaaacaaaaatgcttcgtgtttgatcgcccgatcaacgacaaaaagctcctcctgcacgtggaagaggtgcgggaagatcaactggatagtaatttccagatgcagtcagagaacttctgttcctacatttttacacatgccaaaacaaagaccctccgcgaaggcatccttgtgactgggaacagactgggcatgcttgtcgagacgtatttggacgcaattaatagcggcgctacaccctgcttggagaacgcaatggctgtactcgcgcagtgcgagaatagcgccgctgtccaacgggccgccaatcactactcacagcagatggcccagcaagtccgttttccaaccgatacactgcaggaactgctagatgtacacgcggtttgcgaacgtgaggcaatagctgtattcatggagtatagttttaaagacaagtcccaggagttccagaaaaaattagtagataccatggagaaaaagaaagaggactttgttttgcagaatgaggaggcgagtgccaagtactgtcaggccgagttgaaacgcctatcagagctgctcactgaatcgatctctagaggcacgttttttgtgccagggggccacaatatttatctggaggccaagaagaaaatagaacaggattataccctggtgccacggaagggcgtcaaggctgatgaagtcctacagagtttccttcaatcacaggtcgtgatcgaggagtctattctccagtcggacaaggcactgacagccggggagaaagctatcgctgctaagcaagccaaaaaggaagcagctgagaaagagcaagaactgctgagacaaaaacagaaggagcagcagcaaatgatggaagcacaagagcggagttttcaggaaaatattgctcaattaaagaagaaaatggagagggagcgggagaactacatgagagagctgagaaaaatgctgagccataagatgaaggttcttgaggagctgcttaccgaggggtttaaggagatcttcgagtctctcaacgaggagatcaacaggttaaaggagcaaattgaggccgccgagaatgaggaaccaagtgtattctcccagattctggacgttgcagggtctatcttcatcgctgctctcccaggcgccgccaagttggtggatttgggtatgaaaatcctgtcttctttgtgcaacagactaaggaatccaggcaagaagatcatctcgtag

SEQ ID NO: 190170 - DNA, 1902 bp, Artificial Sequence
  Description of Artificial Sequence: Synthetic coding sequence
atggagagcggccccaagatgctggcccccgtgtgcctggtggagaacaataacgagcagctgctcgtgaatcagcaggccatccagattttagagaagataagccaaccagtggttgtggtagcaattgtgggcctgtatcggacaggcaagtcttatctgatgaatcacctggcaggccagaatcacgggtttcctttgggatcaacagttcagagcgagacaaaagggatatggatgtggtgcgtgccccatcccagtaagccaaaccacacactggtccttcttgacactgagggtcttggtgatgtggagaagggcgaccccaagaatgatagttggattttcgccctcgcggttctgctttgctctacgttcgtgtacaatagcatgtctacaattaaccaccaggccctggaacagcttcactatgtcacggagcttacagaactcatcaaggcgaaatctagcccacggcccgacggtgtagaagacagtacggagtttgtaagcttcttcccagattttctctggaccgtgagggattttacactcgaattaaaacttaacggacatccaattacagaggacgagtatctggagaatgcattgaaactcattcaagggaataaccctagggtccagacttccaattttccaagggagtgcataagaaggttcttcccaaagcgcaaatgctttgttttcgacagaccgactaacgataaggaccttctcgctaacatcgagaaggtctcagagaaacagctcgatcccaagttccaagaacagaccaatatattttgcagctacatattcacacacgctcgcacaaaaacactgagagagggcattacggtaaccggaaacaggctggggacattggcagtcacctatgtggaagccatcaattcaggcgcggtaccatgtctggagaacgccgtgattacattggcccagcgggaaaactccgcggctgtgcagagagccgcagattattattcccaacaaatggctcagcgcgtgaaactcccaactgatacactgcaggagttactcgatatgcacgcggcatgcgaacgggaagctatcgccatcttcatggaacatagttttaaagatgagaaccaggaattccaaaaaaaatttatggagactaccatgaacaaaaaaggggatttcctgttacagaacgaggagagctctgtgcagtactgccaggccaagctcaatgagctgtcaaagggactaatggagtctatttccgccggaagtttctccgtgcccggcggacacaagctctacatggagacaaaggagcgaatagagcaggactactggcaagtgccacggaaaggtgtcaaagccaaggaggtgtttcagcgttttcttgagagtcagatggtaatcgaggaatctattctgcagagtgataaagcgctgacagatcgggaaaaggccgttgccgtcgatcgggcgaaaaaggaggctgcagaaaaggaacaggagttactcaagcaaaagctgcaggaacagcaacaacagatggaggcccaggataagtctcgaaaagagaatattgcccaactgaaagagaagctgcagatggaacgagaacatcttctcagagagcagattatgatgctcgagcatacacagaaagtgcagaatgactggttgcatgaaggctttaaaaaaaaatacgaggagatgaatgcagagattagccagtttaagcgcatgatcgacactaccaaaaacgacgacaccccctggattgctaggacacttgacaacttggcagacgaattgactgcgatcttgagtgcacccgccaagctgatagggcacggtgtgaagggtgtcagctccctgttcaaaaaacacaagctccctttttag

SEQ ID NO: 190171 - DNA, 1512 bp, Artificial Sequence
  Description of Artificial Sequence: Synthetic coding sequence
atgagcaccatcaaccaccaggccctggagcagctgcactacgtgaccgaactgactgaactgattaaagctaagtcaagcccaaggcctgatggggttgaggactcaacggaatttgtcagctttttccctgactttctctggactgtgcgtgacttcacattggaactgaaacttaacggccatccgattacggaggatgaatatctggaaaacgcgcttaagttgatccaggggaataatccaagggtacagacctcaaactttccgagggaatgcatcagacgcttcttcccgaaacggaagtgttttgtttttgaccggcccaccaacgataaggacctcctcgccaacatagagaaggtgtccgagaagcaactggaccccaagtttcaggagcagacaaatatcttttgcagttacattttcacgcacgcacgaactaagacattacgcgagggcattactgtgacaggtaacagacttggcacactggccgtgacatatgtcgaggccatcaacagcggagctgttccttgcttggaaaatgcagtgattacactggcccagagggagaactcagcagccgtccagcgggcagccgactactattcgcaacagatggcccagcgggtaaaactgccaactgatacactgcaagaacttctggatatgcatgccgcgtgtgaaagagaggccattgctatctttatggagcatagtttcaaggacgagaatcaagaatttcagaagaagttcatggaaaccaccatgaataagaagggcgactttttactccaaaacgaggagagctcagtgcaatactgccaggccaaactcaacgaactctctaaagggctcatggagtccatatcagcggggtccttctccgtaccaggaggacacaagctgtatatggagactaaggagaggatcgagcaggattattggcaggtgccgcggaagggcgtgaaggctaaggaagtttttcagcgattcttagagagccagatggttattgaggagagcattcttcagagtgataaagctctcaccgaccgggagaaagctgtcgctgtagatcgcgctaagaaagaggccgctgagaaggagcaggaacttttgaaacaaaagctgcaggaacagcaacagcaaatggaggcccaggacaaatcccgaaaagaaaatatagcccagttgaaggagaagctgcagatggagcgggagcacctattgagagaacagatcatgatgctcgaacacacacaaaaggtgcaaaacgactggctgcacgagggctttaagaagaagtatgaggagatgaatgcagaaattagccagtttaaaagaatgatcgacactacaaagaatgatgatactccttggatcgctagaacactggataatttggccgatgagcttacagcgatcctgtccgccccagccaagctgattggacatggagtgaaaggtgttagttccttattcaagaagcacaagcttcctttttag

SEQ ID NO: 190172 - DNA, 1815 bp, Artificial Sequence
  Description of Artificial Sequence: Synthetic coding sequence
atggagagcggccccaagatgctggcccccgtgtgcctggtggagaataacaacgagcaactgctcgtgaatcagcaggctatacaaattctcgagaaaatctctcagcctgtggtggtcgttgctattgtggggttataccggaccggcaagtcttacctcatgaatcacctggctgggcagaaccatgggttccccctggatactgaggggctgggagacgtagagaagggcgaccctaagaatgacagttggattttcgccctggctgtgctgctttgtagtacgtttgtgtacaattcaatgagtaccattaaccatcaagctttggagcagttgcactacgtcacagagcttacagagcttattaaggcaaaaagctcaccccgccctgacggagtcgaagacagtacagagtttgtcagcttttttcctgactttctgtggactgttcgggacttcaccctggaactgaagttgaacgggcacccgattaccgaagacgaatacctcgaaaacgcactcaagctgatccaggggaacaatccacgtgtccaaacaagcaatttccctcgagagtgcataaggcgctttttcccaaagcggaaatgtttcgttttcgatcgaccaactaacgacaaagacctgctggccaatattgagaaagtgagtgagaagcagctagaccctaagttccaagagcagaccaatatcttttgctcctacatttttacacacgccagaaccaagaccctcagggaaggaatcaccgttaccggcaacagactgggcacacttgccgtaacatacgttgaggctatcaactctggagctgtaccatgcctggagaacgcagtgatcaccctggcccagcgtgaaaatagtgctgcagtacagcgggccgctgattactactcccaacaaatggctcagcgagtcaagttgcccacagatacactgcaggagcttctcgatatgcacgcagcatgcgaaagggaggcgattgccatcttcatggagcactcattcaaggacgagaaccaagaatttcagaagaaattcatggagaccacaatgaataagaagggagacttcctgctccagaacgaggaaagcagcgtgcagtattgccaggctaagcttaacgagttgtcaaaagggctaatggaatctattagcgctgggtccttttccgtgcctggcggccacaaactctacatggagactaaggagaggattgagcaggattattggcaagttcccagaaaaggggtgaaagccaaggaagtgttccagcgtttcctcgagtcgcagatggtgatagaagaatctatcctgcaaagtgacaaggccttaaccgatcgcgagaaggccgtggccgtggatcgcgccaagaaggaagcagctgagaaagagcaggagttgctcaagcaaaaacttcaggagcagcagcagcagatggaggcccaggacaagagccgcaaagagaatattgcccagttaaaggagaagctacagatggaacgggagcatctgctcagggagcaaataatgatgctagaacacacacagaaggtccagaatgattggttacacgaggggttcaagaagaagtacgaggaaatgaacgccgagatctctcaattcaagcggatgatcgataccaccaaaaacgacgacactccttggatcgcccgcacactcgacaatttagcagacgagctgaccgcaatcctgtccgcgcctgcaaagctgatcggacacggggtcaagggggtgtcttccctgttcaaaaaacataagcttcctttctag

SEQ ID NO: 190173 - DNA, 1299 bp, Artificial Sequence
  Description of Artificial Sequence: Synthetic coding sequence
atgaagagcaccaagcccagcctgagccccagcaagccccagagctctctggttataccaaccagcctattttgcaaaacgtttcccttccacttcatgtttgataaggatatgaccattctgcagttcggcaacggaatccggagacttatgaacagacgggacttccagggtaagcctaactttgaggagtactttgagattctcacgccaaagattaatcagaccttcagcgggatcatgacaatgctcaacatgcaattcgtagtcagggtgagaagatgggataattcagtaaagaagagcagtagggtcatggacttgaagggccaaatgatctacatcgtggagagtagtgctatcctgtttctcggctctccatgtgtcgataggctggaagacttcacggggagaggcctatatctatctgatattcccatccacaacgccctcagagacgttgttctgataggtgagcaagcacgtgctcaggacggcctgaagaaacgtctgggaaagctgaaggccactctggagcaagcgcaccaggcgctggaggaggaaaaaaaaaaaactgttgatctcttatgcagcatctttccttgcgaagtggcacagcaactgtggcaggggcaggtcgtgcaggccaaaaaattcagcaacgtgacgatgctgttttcagatatcgtgggattcacagccatttgtagtcagtgtagccccttacaagtcataacgatgctgaatgccctgtatacccggttcgatcaacagtgcggagagcttgacgtttacaaagtggaaacaattggggatgcatactgtgtggcaggtggcttgcacaaagagtctgatacacacgccgtacagatcgcactcatggcgttgaaaatgatggaactcagcgacgaggtgatgtctcctcatggagaacctattaagatgcgcatcggtctgcacagcggaagcgtctttgcgggagttgtcggagtaaagatgcctaggtactgcctgttcggtaacaacgtgactcttgcaaataagtttgagtcttgttccgtgccccgtaaaatcaatgtcagcccaactacctatcgcctgcttaaggattgtcccgggtttgtgtttactccacggagcagggaagaacttcctccaaacttcccgtcggaaatccccggtatctgtcatttcctggatgcttaccagcagggcacaaattccaaaccctgcttccagaaaaaggacgtggaggacggcaatgctaactttctgggaaaagcttcggggatagactag

SEQ ID NO: 190174 - DNA, 1875 bp, Artificial Sequence
  Description of Artificial Sequence: Synthetic coding sequence
atgttctgcaccaagctgaaggacctgaagatcaccggcgagtgccctttttcgcttttggcccccgggcaggtccccaatgaatcatcagaggaagctgccggcagctccgagtcttgtaaagcaacagtacctatttgtcaggacatacccgaaaaaaacatccaggagtctctccctcagagaaaaacatcccgtagcagagtctatcttcacacccttgccgagtcaatttgcaagctgatctttcctgaatttgagagactgaacgttgctctccagaggaccctggccaagcacaaaatcaaggaaagtaggaaatccctggaacgtgaggattttgaaaaaactattgccgaacaagctgttgcggctggggtaccagtagaagtgatcaaagagagcctgggagaggaggtcttcaagatctgctatgaggaggatgaaaacatcctcggggtggtcgggggaacactaaaggacttcctgaactccttctcaactctcctgaaacagtctagccactgccaggaggccggtaaaaggggtcggcttgaagatgccagcatattatgcctcgataaggaagatgattttctccacgtctattacttcttcccaaaacggaccacctcgctgatcctgcctggaatcatcaaggcggctgcacacgtgctgtatgagacagaagtagaagtttccctgatgcctccttgctttcataacgattgctccgaattcgtgaaccagccgtacttactgtacagcgtgcatatgaaaagcaccaaacccagcttgagccctagcaaacctcagtcctctctcgttattcccacttcgctgttctgcaagacgtttccattccacttcatgtttgacaaagacatgaccattctccagttcgggaacggtataaggcgcctcatgaacaggcgcgatttccagggaaagccaaactttgaggaatacttcgagatcctcacccctaaaattaatcaaacattttccgggatcatgactatgctgaatatgcagttcgtcgtaagagtgagacgatgggataacagcgtgaagaaaagctcacgagtcatggacctgaagggacaaatgatatatattgtagaatctagcgctattttatttctcgggagcccttgtgtcgacagacttgaggatttcaccgggcgaggtttatacctatctgacattcctatccacaacgcgctgcgggacgttgtgcttattggcgaacaggcacgagcccaagacggcctaaaaaagcgcctgggaaagctgaaagcaaccctggagcaggcccatcaggcattagaagaagaaaagaagaaaacagttgatctgctgtgttccatctttccttgtgaggtggcccagcaactgtggcagggtcaggttgttcaggcgaagaaattttcaaatgtgaccatgttgttttctgatattgttggcttcaccgctatctgctctcagtgcagcccactgcaagtgatcaccatgctgaacgcattgtacacccgcttcgatcaacagtgcggcgaattggacgtatataaggtggaaaccatcggtgacgcctactgtgttgctggcggactgcataaagagtcagacacacatgccgtgcagattgccttaatggcactgaaaatgatggagctttctgacgaggtcatgtcaccgcacggggaacctatcaagatgcggattggcttgcacagcggttctgtgttcgctggcgttgtgggggttaagatgccccgctactgtctttttggcaataacgtcaccctggccaataaatttgagtcctgtagtgttccccgcaaaatcaacgtgtcacctacgacttatcgctag

SEQ ID NO: 190175 - DNA, 2292 bp, Artificial Sequence
  Description of Artificial Sequence: Synthetic coding sequence
atgagccggcggaagatcagcagcgagagcttcagcagcctgggctcagattaccttgaaactagtccggaagaggaaggcgaatgtccacttagtcgcctctgttggaacggcagtaggtcacctcccggcccattagagcccagccctgctgcggccgcagccgccgcggcccccgctccaaccccagctgcatctgccgccgcagcggctgccacggccggagcacgccgggtgcaacgaagaagacgcgtgaatttggactccctaggtgagagcatcagcaggctgactgcaccaagcccccagactattcagcagaccttaaaacggactcttcagtattatgagcaccaggtgattgggtatcgggatgccgaaaagaatttccacaacatcagtaaccgatgcagctatgcagatcactcaaataaagaagaaatcgaagatgtctctggcatcttgcagtgcaccgctaacattctgggtctgaaatttgaggagatccagaagagatttggtgaggagttttttaatatctgtttccatgagaacgagagagtgctgcgggcagtagggggtaccttgcaggatttttttaacggctttgatgccctgttggaacacatccggacatcttttggtaagcaggcgacactggagtcaccaagcttcctgtgcaaagagcttcccgaggggaccttaatgctccactactttcacccccaccatattgttgggttcgctatgctgggaatgattaaggccgcaggaaaaaagatttaccggctggacgtggaggtggagcaggtggctaatgaaaagctttgtagcgacgtgtccaatccaggaaattgttcatgcctgacgttcttgattaaggagtgcgagaatacaaatattatgaagaacttgccacagggaacctcccaggtgcctgccgatttgagaataagcattaacaccttttgccgagcgtttccctttcatctgatgttcgatccatctatgagcgttctccagctaggggaaggccttcggaaacagttgcgctgcgatactcataaagtgctgaagtttgaagactgttttgagattgtgtcccctaaggtcaacgctacctttgaacgtgttctgctccgtctgagcactccgttcgtaattaggacgaaacccgaggctagtggaagcgaaaataaggacaaggttatggaggtgaaaggacagatgatccatgtacctgagtccaatagcatcctcttccttggcagcccctgcgtggacaagctggatgaactaatggggcggggcctgcacctgtctgatatccccatccatgacgccacacgcgacgttatcctggtgggggaacaggcgaaggcgcaagatgggctgaaaaagagaatggataaactgaaggcaacactggaacggacgcaccaggccttggaggaggagaagaagaaaacagtcgacctgctttattctatcttccccggagatgttgcacagcaactctggcaagggcaacaggtccaggccaggaagttcgacgatgtcaccatgctttttagcgacatcgtggggttcacagccatctgcgcgcagtgtaccccaatgcaagtgatcagtatgttgaatgaactgtatacccgcttcgatcaccagtgtgggttcctggacatatataaggttgagaccatcggcgatgcctattgcgtagcagcaggcctgcaccgaaagtcactgtgtcacgctaagcccattgctttaatggccctcaagatgatggaactgagtgaggaagtgctgaccccagacggacgaccaattcaaccacagcgatccgagctcctgttttctttcccagtctctatccagctggtgccagaccagcatcaaagcgaaacagacttgggaacggagaaaatgcgtatcggcattcatagcggcagcgtgctggcaggtgtcgtcggcgtgcgtatgccccgctactgtttgttcggtaacaatgtcacactggcaagtaagtttgaatccggctcccacccgaggaggatcaatgtttcgccgaccacttaccaattgttaaagcgagaggaaagtttcacttttattcctcggtcgcgagaggaactgcctgacaattttccaaaggagattcccggaatatgctacttcctagaagtccgcacaggcccgaagccccccaagccctccttatcctcttcccgaatcaagaaggtgagttataacatcggaacaatgttcttacgtgaaaccagtctgtag

SEQ ID NO: 190176 - DNA, 2199 bp, Artificial Sequence
  Description of Artificial Sequence: Synthetic coding sequence
atgagccggcggaagatcagcagcgagagcttcagcagcctgggctctgactacctggagaccagcccagaagaggagggagagtgcccactgagccggttgtgttggaacggttccaggtcccctcctgggcccctggaaccgagcccggccgctgcagcagcagctgctgctccagctcccacacccgccgcctccgcggccgccgcggccgccaccgcaggggcccggagagtgcagcggcgacggcgagttaatttggatagtcttggagagtccatttcaaggttgacagcaccttcaccccagactatccagcaaactctgaagcgcacactacaatactacgagcatcaggtcattggctaccgcgacgcagagaaaaacttccacaatatctccaatagatgttcttacgctgaccactcgaacaaagaggagattgaggatgtgtccggcatcctgcagtgcacggccaatattctgggcctcaagttcgaagagatccaaaaacgatttggagaagaattctttaatatttgttttcatgagaacgagcgagtcttgagggctgtaggggggacgctgcaagacttttttaatgggtttgatgccctgctcgagcatatccgcacctcctttggaaagcaagcgactcttgagagccctagcttcctctgtaaggagctaccggagggcactctcatgttacactattttcacccgcaccatatcgtgggattcgccatgctgggaatgatcaaagccgctggcaagaagatttatcgcctggacgtggaggtggagcaagtggccaatgaaaaactgtgctcggacgtgagtaatccaggcaactgttcttgtctgacatttctgatcaaggagtgcgagaacaccaacatcatgaaaaaccttcctcagggtacctctcaggtccccgccgatcttaggatttccattaatacattttgccgcgccttcccctttcacctgatgtttgatccctctatgagcgttctgcagctgggcgaagggttaaggaaacagctccgctgtgatacccataaggttctcaaatttgaagactgctttgagatagtttcacccaaagttaatgcaacatttgagagggtactgcttaggctatcgacaccttttgttatccggaccaaacctgaagcctcaggctccgagaacaaggacaaagtcatggaagtgaagggacaaatgattcacgtgcccgagagcaattccatcctctttctagggagtccatgtgtggacaaacttgatgagcttatgggacgcgggttgcaccttagcgatattccaatacacgacgctactcgtgacgtcatcttagttggggagcaggcaaaggctcaagatggactgaaaaagcggatggacaagcttaaggctacactagagcgaacacaccaggccttggaggaggagaaaaagaaaactgtcgacctcttgtattctatattccccggcgacgttgctcaacaactctggcaagggcagcaggtgcaggctaggaagtttgacgatgtaaccatgctcttttctgatatcgttggcttcaccgctatctgcgctcaatgcacccccatgcaagtgattagtatgctcaacgaattatacacgcggtttgatcaccagtgtgggttcctcgatatctacaaagtggaaactatcggcgatgcctactgcgtggcggccggtttacacaggaagtcactgtgccatgccaaacccatcgcactaatggctctaaaaatgatggaattgtccgaagaggtgctcacacctgatggaagaccaattcaaatgcgcattggaatacactccggttccgtgctagccggcgttgtcggcgttcggatgcctcgatactgtttattcggcaataacgtcactctcgcatctaaatttgaatcaggctcccacccacgcaggattaatgttagcccgactacctaccaattgcttaagcgagaagagagtttcacatttataccgcgtagtcgcgaggagctgccggataattttccgaaagaaatcccgggcatctgttacttcctcgaggttagaacggggccgaagccaccaaagccctctctatcaagcagccggattaagaaagtaagttacaatatcggtacaatgttccttcgagagacatctctatag

SEQ ID NO: 190177 - DNA, 2073 bp, Artificial Sequence
  Description of Artificial Sequence: Synthetic coding sequence
atgttctgcaccaagctgaaggacctgaagatcaccggcgagtgccctttttctctcttagctcccgggcaggtccctaacgagagcagcgaagaggccgccggttctagtgaatcttgcaaggccaccgtcccaatctgtcaagacattccggagaagaacattcaggagtcactgcctcaacgaaagaccagccggtctcgggtctatctacataccctggccgagagtatatgcaaattgatctttccagagtttgaaaggcttaacgtggctctgcaacggaccctggctaagcacaaaatcaaggaaagcagaaagtctctagagagggaggacttcgaaaaaaccatcgccgaacaggcagtggcagccggcgtacccgtggaagtgatcaaggaatcactgggcgaagaagttttcaaaatttgctacgaggaggatgagaacatattgggtgtcgtaggtgggaccttgaaagactttctcaatagcttctctacactgctgaagcaaagcagccactgccaggaggccgggaagaggggtaggctggaggatgcttcgattctgtgtcttgataaggaggatgactttcttcacgtgtattactttttccctaagcggaccacaagccttattttaccaggcatcatcaaagcggcggcccacgtcctgtatgagaccgaagtggaagtgtcccttatgcccccatgctttcataacgactgcagtgagttcgtcaaccaaccttatttactctattctgttcatatgaaatcaacaaagcccagcctttcccctagtaaacctcagagtagtctggtgatccctacgagtctgttctgcaaaaccttccctttccactttatgtttgacaaagacatgaccatcctgcagttcggaaacggcatccgacgactgatgaaccgacgcgactttcaggggaagccaaacttcgaagaatactttgagatcctgacacctaagataaaccagaccttctccgggatcatgacaatgctgaacatgcaattcgtcgtgcgagtgcgccggtgggataattctgtgaaaaaatcctccagagtcatggacctgaagggacagatgatctatattgtagaatcgagcgcaattctgttcctgggatccccatgcgtcgatcgtctggaagactttacgggccggggcttatacttgagtgacattcccatccacaacgcgcttagggatgtcgtgttaattggagaacaggctagagcccaggacggtctaaaaaagcggttgggcaagctcaaggctacgctagagcaggcacatcaggccctggaggaagagaagaagaagactgtggaccttctctgtagtatcttcccctgcgaggtggcccagcagctgtggcaagggcaggtggtgcaggcgaaaaagttcagcaatgtcacaatgctcttttcagatatcgtgggtttcaccgctatctgttcccaatgttctcctctccaggttattacaatgctgaacgcactgtatactagatttgaccagcagtgtggagaactcgacgtgtacaaggtggagaccataggtgatgcgtactgtgtcgctggggggctccataaggaaagcgacacacacgccgttcagatcgctttgatggctctgaagatgatggaactttccgacgaggttatgagcccacatggcgagccaattaaaatgcggatcgggctccactccgggtctgtgtttgccggcgtagtgggggtgaaaatgcctcgctactgcctgttcggcaataacgtaacgctggcgaacaaattcgagagctgctctgtgccccgcaagattaatgtgtcaccaaccacataccgactgctgaaggattgcccaggcttcgtgtttactcccagatcacgtgaggaactgccgcccaatttcccttcggagattcccggaatctgccattttctggacgcataccaacaggggacaaacagcaaaccgtgttttcagaagaaggacgttgaagacgggaacgccaactttttgggtaaggcctcagggatagattag

SEQ ID NO: 190178 - DNA, 2073 bp, Artificial Sequence
  Description of Artificial Sequence: Synthetic coding sequence
atgttctgcaccaagctgaaggacctgaagatcaccggcgagtgcccattttccctcctggcaccgggacaggtcccaaatgaaagcagtgaggaggctgcgggtagcagcgagtcctgtaaggccaccgtccccatctgtcaggatatccctgagaaaaacattcaggagtcccttcctcagagaaaaacaagcaggtcccgggtgtacctccacactctggcggaatccatttgcaaacttatttttcctgagttcgagcgtctcaatgtcgccttacaacgtacactggccaagcacaagataaaagaaagcaggaagtcgctggagagagaggattttgagaagaccatcgctgaacaagcagttgcggcaggagtgccagtggaggtgattaaagagagtttgggcgaggaggtcttcaaaatttgctacgaggaagatgaaaacatcctgggtgtcgttggcgggacacttaaagacttcctgaatagcttctctaccctgctgaagcagagtagtcattgccaagaagccggcaaacgcggccgcttggaagatgcttcaatattgtgcttagataaagaagatgattttcttcacgtatattattttttcccaaaacgcacaacctcattaatactgccgggaatcataaaggctgctgctcacgtgctgtatgagacagaggtggaagtaagtcttatgcctccatgcttccacaatgattgtagtgagttcgttaatcaaccctacctcctttattctgtgcacatgaagagtactaagccctcccttagcccgtccaaaccacagagttctctcgtgatccccacgtcactcttctgcaagacattcccttttcacttcatgtttgacaaagacatgacaattcttcagttcggaaatggcatcaggagactgatgaaccgccgggactttcaggggaagccaaattttgaggaatactttgagatacttacaccaaagattaaccaaacattttctgggattatgactatgttgaacatgcagtttgtggtgcgagttaggagatgggataacagtgtcaagaagtcgtctcgtgtaatggatcttaagggacagatgatttacatcgtggagtcatccgcaatcctgttcttggggtcaccgtgtgtggacagactggaggactttaccggacgcgggctgtacctctcagatattccaatccataacgctctgcgtgacgtggtcctcattggggaacaggctcgcgctcaggatggcttaaagaagcgcttggggaagctgaaggcaactcttgagcaggctcatcaggcgctggaagaagaaaagaagaaaaccgttgacctgttgtgctcaatatttccatgcgaagtggcccagcagctgtggcagggccaagtcgtacaggccaaaaaatttagtaatgtgactatgctattctcagatatcgtgggctttacagcaatttgttctcagtgctctccactacaggtgatcactatgctcaatgcgctctacactagatttgatcagcagtgcggcgagctggacgtgtataaggttgagacaattggggacgcctactgtgtggcgggcgggctacataaagagagcgacacacacgccgtccagattgccctgatggcgctcaagatgatggagctgtcagacgaagtgatgtccccacatggggaacccatcaaaatgcgaatagggctgcattcaggaagtgtttttgccggagtcgtgggtgtaaaaatgcctcgatactgtctttttggaaataacgtgaccctagcaaacaagtttgagtcctgctcagtgccacgcaaaattaatgttagtccaaccacatatcgcctgctgaaggactgccctggtttcgtctttacacctcgctcacgggaagagctgccccccaactttcccagcgaaatccctggaatatgccactttctcgatgcctatcaacagggcacaaattccaaaccctgcttccagaagaaagacgtcgaggacggtaatgcaaactttctaggcaaggccagcggcattgactag

SEQ ID NO: 190179 - DNA, 2073 bp, Artificial Sequence
  Description of Artificial Sequence: Synthetic coding sequence
atgttctgcaccaagctgaaggacctgaagatcaccggcgagtgccctttttccttgttggcccctggccaggtgccgaacgaatcaagtgaggaggctgccgggtcttcagaatcatgcaaggcgacggtaccgatctgtcaggatattcccgagaagaatatccaggagtccctgccgcaaaggaaaacttctcggtctcgcgtgtatctacacactttggccgagtctatatgtaagctgattttcccagaatttgaacggctcaatgtcgcccttcaacggacgttagccaaacataagatcaaggagagccgtaaatccctggaacgggaagatttcgagaaaacaatagctgaacaagccgtcgctgcaggtgtccctgtcgaagtgatcaaagagtccctaggagaagaagtgttcaagatttgttatgaagaagacgaaaacattctcggggttgttggcggcacactcaaggacttcctcaatagtttttcaaccttgctgaaacagagctcccattgtcaggaagccgggaagagaggccgactcgaggacgcgtctatcttgtgcttagacaaagaagacgactttctgcatgtgtattatttcttccccaaacgcaccactagcttaatcctgcctgggatcataaaggctgcagcccacgtcttgtacgagaccgaagttgaggtgtccctaatgcccccatgtttccacaacgattgcagcgaattcgtgaatcagccatacctcctgtactctgttcacatgaaatccactaagccatctttatctccctctaagcctcagagctctctggtcatccccacaagcctgttctgcaagaccttcccatttcactttatgtttgacaaagacatgaccatcctgcaattcgggaatggcatccggcggttaatgaatcgtagggatttccaggggaaacctaactttgaagaatactttgagatactgacacctaaaatcaaccagacctttagcgggataatgaccatgctcaacatgcaatttgtggtcagggtccgtcggtgggacaacagtgtaaagaagtccagcagagtaatggacctgaaggggcaaatgatctatattgtggaaagctccgcaattctttttcttggtagcccttgtgtggacagacttgaagacttcacgggcaggggcctctacctctccgacattccgatccacaacgcgctccgtgatgtcgtgctgatcggggaacaggcccgcgctcaggatggtcttaaaaagagactggggaaactgaaggcgactctggaacaggcccaccaggcattggaggaggaaaaaaagaagacagtcgacctcctgtgttccatctttccatgcgaggtggctcagcagctgtggcagggacaggttgtgcaagctaaaaaattttcaaatgtcactatgctgttcagcgacatagtcggtttcaccgcaatttgctctcagtgctccccactgcaagttatcaccatgctaaacgctctgtacactagatttgaccagcagtgtggtgagctggatgtgtataaggttgaaacaatcggtgatgcttattgcgtggctgggggactgcataaggaatctgatacgcatgctgtccaaatagctctcatggccttaaagatgatggaactatctgatgaggtgatgagcccccacggcgaacctattaagatgcgcataggattgcattccgggagtgtctttgctggcgtggtgggggtgaagatgcctcggtattgcttattcggtaacaacgtgaccctggccaataaatttgaatcctgcagcgtgcccagaaagatcaacgtctcccccacaacttaccgattgctcaaggattgcccaggattcgtgtttaccccgagatccagagaagagctgccaccaaactttcccagcgagattccaggaatctgtcactttctcgacgcctatcagcagggaacaaacagcaagccctgcttccagaagaaagatgttgaagacggaaatgccaactttctggggaaagctagtggcatcgactag

SEQ ID NO: 190180 - DNA, 2073 bp, Artificial Sequence
  Description of Artificial Sequence: Synthetic coding sequence
atgttctgcaccaagctgaaggacctgaagatcaccggcgagtgcccattctctctactggcgccgggccaggtgcccaacgagtcatctgaggaggccgctggatcttctgaatcttgcaaagccaccgtccctatttgccaagatattcctgagaagaacatacaggagtctctccctcaaaggaaaacctcaagaagcagagtgtacctacacacgttagccgaatccatatgtaagctgatttttcctgagttcgagagattgaatgtggccctgcagcgtacccttgccaagcataaaattaaggagagtaggaagtcacttgaaagggaggacttcgagaagaccatcgctgagcaggctgtggccgcaggcgtgcccgtggaggttatcaaggagagtttgggtgaggaggtgtttaaaatttgctacgaagaagatgaaaatatcctgggggtcgttggaggtaccctcaaagatttccttaattcttttagcacattactcaaacaatcctcacactgccaagaagccggaaagcgcggaaggctggaagacgcatctatcctttgtcttgacaaggaagatgactttctccacgtgtactacttcttccccaaacgaacaacatctctcatattgccaggtatcataaaagctgctgcacacgtgctgtacgagacggaagttgaggtatctctgatgccaccatgttttcataacgactgttctgaattcgtaaatcaaccatacctgctgtactccgtgcatatgaagtccacaaagccctcactctctccttcaaaaccacaatcttctctggtgattcccacaagcctgttttgtaagaccttccccttccacttcatgtttgataaagatatgaccatcctgcagtttggcaatggcatccgcaggctgatgaatagacgcgattttcaaggtaagcccaattttgaggaatacttcgaaatcttaacgcctaaaatcaaccagaccttttcaggcatcatgaccatgctcaatatgcaattcgttgtgcgtgtcagacggtgggacaactcagtgaagaaaagttccagagttatggacttgaaaggacagatgatctatatcgtagagtcttctgccattctcttcctgggaagcccatgcgtagaccggctggaagattttaccgggcggggcttgtacttgtcagatattccaattcacaacgcactccgcgacgtggtcctaatcggcgagcaagcacgtgcacaggatgggctaaaaaaaaggctagggaagttaaaggccacattggaacaggctcaccaagcattagaggaagaaaaaaaaaaaacggtggaccttttatgctctatattcccctgtgaggtagctcaacagctctggcagggccaggtcgtacaagccaagaaattcagcaatgttacaatgctattctccgatattgtgggtttcaccgctatttgttctcagtgctccccccttcaggttattaccatgctgaacgccctgtacacaaggtttgatcagcagtgcggcgagttagatgtgtataaagtcgagaccattggagacgcgtattgcgtggctggtggactccacaaagagtcagatacccatgccgtgcagattgccctgatggccctgaagatgatggaattgtcagacgaagtcatgtcaccccacggggagcccatcaagatgagaattggtcttcacagtggtagcgtgtttgccggagtcgtcggggttaagatgcccagatactgcttattcggaaataatgtgactttggcaaataaattcgagagctgctccgttccccgtaagattaatgtatcccctactacatatagattgctgaaggattgccctggtttcgtgttcacaccacggtcccgtgaggaactgcctcccaactttccgtccgagattcctggtatttgccacttcctcgatgcttatcaacaaggaactaattccaaaccatgcttccaaaagaaggacgtggaagacggcaatgcgaattttctgggaaaagctagcggaatcgactag

SEQ ID NO: 190181 - DNA, 2073 bp, Artificial Sequence
  Description of Artificial Sequence: Synthetic coding sequence
atgttctgcaccaagctgaaggacctgaagatcaccggcgagtgccctttctcactcttggcgccgggacaagtgcccaacgagagtagcgaggaggccgcgggctccagcgagagctgcaaagctactgttccaatctgtcaagatatccccgaaaagaatatccaggaaagtcttccacaacggaaaacctcccgcagtcgtgtgtacttacacactctggctgaatcaatttgcaagttgatattcccagagtttgagcgactgaatgtggccttacaaaggaccctggccaagcacaaaatcaaggaaagtaggaagtcactggaacgggaggatttcgagaaaactattgcagagcaggccgtggccgctggcgtccctgtcgaggtcatcaaagagtctcttggagaagaggtgttcaaaatctgctacgaagaggacgaaaacattctcggcgttgtcggcgggacactcaaggactttcttaatagtttttctaccttgctgaagcagagctcccactgccaggaggccggcaagcgtggccgattggaagatgcctccattctctgtctggacaaagaagatgactttcttcacgtgtactacttcttcccgaaacgaacaaccagtctgatcctgcccggcatcatcaaagctgctgcacacgttctgtatgaaactgaggtggaggtatcactgatgccaccttgcttccataacgactgttccgagttcgttaatcagccctatttgctgtatagcgtgcatatgaagtctacaaagccgtccctttccccgtcaaagccccagtcgtcgctggtcatccctacctccttgttctgtaaaactttccccttccactttatgttcgacaaggacatgaccattctgcagttcggcaacggcatccgcaggcttatgaatcgccgggacttccagggcaaacccaattttgaagaatattttgaaattctgacaccaaagattaaccagacattctctggtattatgacaatgctgaacatgcagttcgtagtccgggttcgcaggtgggataattcagtcaaaaagtcgagtagagtgatggaccttaaaggacagatgatctacattgtggagtcctctgctatcttatttctgggaagcccttgtgtggatcggctggaggattttacagggcggggcttgtacctttccgacataccaattcataacgccctcagggacgttgtactcatcggggaacaggctcgtgcgcaggatggccttaaaaagcgcctgggtaagttgaaggctacactggagcaagcccatcaggctctcgaggaggagaaaaagaagaccgtggatcttctgtgttcgatattcccatgcgaggtcgcacagcaattatggcagggccaggtcgtccaagctaagaaattcagcaacgtcacaatgctgttttccgatattgtaggcttcactgcgatctgctctcagtgtagcccgcttcaggtgataaccatgctcaatgcattgtacacaagatttgatcagcagtgcggggagctagatgtatacaaagtcgaaacaatcggtgacgcctactgcgttgccggggggctgcataaagaaagcgacacacacgctgtacagatcgctctgatggccctgaagatgatggagttatcagatgaggtcatgtctccccacggagagcccatcaagatgcgaatagggttacacagtggaagcgtgttcgccggtgtggttggagtaaaaatgcctaggtactgtttgttcggcaataacgtcactctggcaaacaagtttgagagctgtagcgtgccccggaagataaatgtctcccccacaacatatcgcctgctcaaggattgtccaggtttcgtgtttactccccgatccagggaagagctacccccaaatttcccctctgaaatccccggtatttgccacttcctggacgcataccagcagggcactaactctaaaccgtgctttcagaaaaaggacgtggaggacggaaacgctaattttttggggaaggcatccgggatagactag

SEQ ID NO: 190182 - DNA, 1860 bp, Artificial Sequence
  Description of Artificial Sequence: Synthetic coding sequence
atgtacggcttcgtgaaccacgccctggagctgctggtgatccggaattatgggcccgaggtgtgggaagatatcaagaaagaggcacagctagacgaggagggacaatttttggtgcgcatcatatatgatgattctaagacgtatgacctagttgccgctgcaagcaaagtgcttaacctaaatgccggggagatcctgcaaatgtttgggaagatgttcttcgtattctgtcaagagtcgggctacgacaccatcctgagagtgctgggaagcaacgtgcgggagtttttacaaaatcttgatgccttgcacgaccacctggcaaccatctatcctggaatgcgcgccccctctttccggtgtaccgacgcggagaaggggaagggactgattctgcactactactcagaaagagagggccttcaggatatcgttatcggcattattaaaacagtggcccaacagatccacggtacagaaatcgacatgaaggtaatacagcagagaaatgaggagtgcgaccacacgcaatttcttatcgaggagaaagaatccaaagaggaagacttctacgaagaccttgatcgtttcgaagagaacgggacccaggaaagcaggatttctccttacacgttttgcaaggcattccccttccatataatttttgatcgagatcttgtggtgacccaatgtggaaatgcgatttacagagtccttccgcagctacagcccgggaattgctcactactgagtgttttttctctcgtaaggccacatattgatatttcattccacggaatcttgtcgcacatcaacactgtgttcgtactgcgaagcaaggaaggattgctcgacgtagaaaaactggagtgcgaggatgagctgacgggaactgaaatctcatgcttgcgattgaaaggtcaaatgatttacctgccagaggctgactccattctgtttttatgttctccaagcgtcatgaatctagacgatctgactagacgcgggctgtacctgtcagacatcccactgcatgatgcaaccagggatctcgttctccttggcgaacagtttcgggaagaatacaagttaactcaggagctggagatcctgactgatcggctacagctgaccctccgcgcactggaagacgagaaaaaaaaaactgacacgttgctctattctgtgctccccccctcagttgccaatgaactcagacacaaaagaccagtgcctgcaaaaaggtatgacaatgtaaccatcctgttctccggcatcgtcggattcaatgccttctgctctaagcacgctagcggggagggggccatgaagatcgtcaatctgttgaacgatctgtatacccgattcgatacccttactgacagccgcaagaacccttttgtttataaggtcgaaactgtgggagacaagtacatgaccgtcagcggcctgcccgaaccctgtattcaccacgcccgctctatttgtcatttagctctcgacatgatggagattgcaggacaggtgcaggtagatggtgaatccgtccagatcaccattggaattcataccggagaggtggtcactggagttattgggcagagaatgcccaggtattgtctttttgggaatactgtgaatcttaccagccggactgagaccaccggagagaagggcaaaatcaacgtttctgaatacacttatcgctgccttatgtcaccagagaattcagacccacagttccatctggagcatcgggggcctgtgtccatgaaggggaagaaagagcccatgcaggtatggttcctttcaagaaagaacactggaactgaggagactaagcaggatgatgattag

SEQ ID NO: 190183 - DNA, 1656 bp, Artificial Sequence
  Description of Artificial Sequence: Synthetic coding sequence
atgttcggcaagatgttcttcgtgttctgccaggagagcggctacgacaccatcctgcgagtactcggctctaatgtgagggaatttctgcagaacctcgacgctctgcacgaccaccttgctacaatttaccctggcatgcgggctccaagcttccgatgcaccgatgccgagaagggaaagggactgatcctgcactattacagtgagagagagggcttgcaagacattgttattggcattatcaaaaccgtcgcgcagcagattcacgggaccgaaatcgatatgaaagtaattcagcagagaaacgaggagtgcgatcacacacagttcctgatagaagaaaaagaatccaaagaggaggacttttacgaggacctcgaccggtttgaagaaaacggaacgcaagaatcccgcatttccccttacaccttctgtaaggcatttccttttcacatcatttttgatagggatctggttgtgacacagtgtggcaacgctatatacagggtgctcccccagttacagccggggaattgcagcttgctgtcggtttttagtctcgtgagaccacatatagacatcagctttcacggaattttaagtcacattaatacagtcttcgttcttaggtccaaggaggggctgctcgatgtggaaaaactggaatgcgaggatgaactaacaggcaccgagatatcttgcctgagactcaaggggcaaatgatatatcttccggaagccgatagcatactattcctatgctccccaagcgtgatgaacttggacgacctgacacgccgcgggctgtacctgtctgacatacctctacatgatgccaccagggacctggttcttctgggcgaacagttcagggaggaatacaagttgacacaggagctggagatcctcactgacagactacagttgaccttgagggcgctcgaggatgaaaaaaagaagacagatacactgttgtactccgtcttgcccccttctgtggccaatgagctccgacataagcggccggtgccagccaagaggtatgataatgtcaccatcctgttttctggaatcgtgggttttaacgctttttgctctaagcacgcctctggcgaaggcgctatgaaaatcgttaacctgctgaatgatctgtatacccggtttgatactctcaccgatagcaggaagaacccatttgtgtataaagtggagacggtgggtgataagtacatgacagtttcgggcctcccagaaccatgcatccaccacgcgcgctctatttgtcatttggcactcgacatgatggagatagcaggtcaggtgcaggtggacggagaaagcgtgcaaattacaatcggaatccataccggcgaagtcgttaccggcgtgatcgggcagagaatgcctagatattgcttgttcgggaacacagtgaacctaacatcacggaccgagacaacaggggaaaaaggcaagatcaacgtctcagagtacacctacaggtgcctcatgtctccagagaattctgatcctcagtttcatctggaacaccggggacctgtttcaatgaaggggaagaaggagccgatgcaggtctggtttttatcacgcaaaaataccgggaccgaggagactaaacaggacgatgattag

SEQ ID NO: 190184 - DNA, 1800 bp, Artificial Sequence
  Description of Artificial Sequence: Synthetic coding sequence
atgctgatgtgcttcatcaaggaggcccagctggacgaggagggccaattccttgtgcgtattatttatgatgattcgaaaacctacgatctggtggcggcagctagcaaagtacttaacctcaacgccggcgagatcctgcagatgttcggcaaaatgtttttcgtgttctgtcaagagagtggatatgacactatcctcagagtcctgggaagtaacgttagagagttcttacagaatctggatgccttgcatgaccacctggctacaatctatcctggaatgcgggcccccagctttaggtgtacagacgcagaaaaaggcaaagggctaattctgcactactactccgaacgggaggggctgcaagatatcgtaattggaatcatcaaaactgtggctcaacagattcacggaacagagatcgacatgaaagtcattcagcagcggaacgaagagtgtgatcacactcagtttctgatcgaagaaaaggagagtaaagaggaagatttctacgaagatctggatagatttgaagaaaacgggacccaggaatctagaatttctccatacaccttctgcaaggcttttcccttccacattatttttgatagagatcttgtcgtaactcagtgtggaaatgccatctatagagtcctgcctcagctacagcccggcaattgtagcctgttgagtgtgttctccctggtgcggccccatattgacatatcctttcacggaatccttagccatattaatacagttttcgtgcttcgctcaaaagaggggctcctggacgtcgaaaagcttgaatgtgaagatgagctgactggcactgaaatctcatgtctgagattgaagggacaaatgatctatcttccagaggcggattccatcctgtttctgtgtagcccatccgtgatgaaccttgatgatttgacgcggcgtggactgtacttgagtgacatccctctccacgatgccacacgagacctcgtcctccttggggaacagtttcgcgaggaatataaactgacccaagagctggagattttgactgatagactccagttgacattgagggctctagaggatgaaaaaaaaaaaaccgacactcttctctatagcgtgctccctcctagcgtggccaacgaactccggcataagcgtcccgtccccgccaaacgatacgacaatgtgaccatactgttctccggtatcgtgggattcaatgctttctgctccaagcacgcctctggggagggggccatgaagatagtgaacctccttaatgacctgtatacaagattcgacactcttaccgattctcgcaagaacccctttgtttacaaagtggagactgttggagacaagtacatgactgtatcggggctgcctgaaccttgcatccaccacgctaggagtatctgccaccttgcattggatatgatggaaatcgccggtcaagtgcaggtagacggggagagcgtccagataacgatcgggatacacacaggcgaggttgtcaccggagtgattggccagcgaatgccacgatattgcctattcggaaatactgttaacctaacaagccgcacagagacaacaggagaaaagggcaagattaatgttagcgaatacacctaccgatgccttatgagccccgaaaacagtgacccccagttccatctcgaacatcggggacctgtgtccatgaaaggaaagaaggagcctatgcaggtgtggttcctgtctagaaagaatacaggaaccgaagagacgaagcaggacgatgattag

SEQ ID NO: 190185 - DNA, 1656 bp, Artificial Sequence
  Description of Artificial Sequence: Synthetic coding sequence
atgttcggcaagatgttcttcgtgttctgccaggagagcggctacgatactattcttcgggtactggggtccaatgtaagagaatttctgcagaaccttgacgctttgcatgatcacctcgccacaatttaccccggcatgagagccccctcctttagatgtacggatgctgaaaagggaaagggcctaatcctgcattattactctgagagagaagggctccaggatattgtgatcgggatcattaaaacagttgcccagcagatccacggcacagagatcgacatgaaagtgatacaacaacgcaacgaagagtgcgatcacactcagttcctgatcgaagaaaaggaaagcaaggaagaggatttttacgaagacctggaccgctttgaggagaacgggactcaagaaagcaggatctccccatacacattttgtaaggcgtttccctttcacatcatcttcgacagagatctggtggtgacacaatgtgggaatgcaatctacagggttctgccgcagctccaacccggcaactgcagcttgctctccgtttttagccttgtgagaccccatatcgacatcagctttcatggaatcctttcacacatcaatacagtctttgtccttcggagcaaggaggggctgctggacgtggagaagttggaatgtgaggatgagctcactgggacggaaattagctgcctgagactcaagggacagatgatttatctgccggaagccgactctatcctcttcttatgctcaccatcagtgatgaacctcgatgatttaacccggcggggcctgtatttgtctgatatccccctacacgacgcgacgagggaccttgttctcttaggagagcagttcagggaagaatataagttgactcaggagctggagatcctaactgacagactgcagttgaccctgcgggccctggaagacgaaaagaaaaagactgacacactcttatacagtgtcctgccccctagtgtggccaacgaactccgccacaagaggcctgtacctgcgaaacggtacgataatgtgacgatcttgttctccggaatcgttggctttaacgccttctgtagcaaacatgccagtggcgagggtgccatgaagatcgtcaatttactaaatgatctgtacacacggttcgatacccttaccgactctcggaagaacccctttgtttataaagtagaaactgtcggggataaatatatgactgtctctggtcttccagaaccttgcatccaccatgccaggtccatctgtcacctggccctggacatgatggagattgctggtcaagtgcaggtcgacggcgagtccgtacagatcactattgggatccacactggggaggttgtcactggagtgatcgggcagaggatgcccagatattgcctttttggaaacaccgtaaacctcaccagtagaaccgagaccaccggcgagaaaggcaaaatcaacgtgagcgaatacacctaccgctgtctcatgtcacctgaaaacagcgacccccagtttcatctggagcaccggggtccggtctcaatgaagggcaaaaaggagcccatgcaggtgtggtttttaagtcgcaagaacacgggtactgaagagaccaagcaagatgatgattag

SEQ ID NO: 190186 - DNA, 3222 bp, Artificial Sequence
  Description of Artificial Sequence: Synthetic coding sequence
atgaagaccctgctgctggacctggccctgtggagcctgctgttccaaccgggatggctgtcctttagcagtcaagtgtcccagaattgtcacaacggtagctacgagataagtgtactgatgatgggcaattctgccttcgcagaacctttgaaaaatcttgaggacgcggtgaacgaggggctggagattgtgagaggaaggttacagaacgccggactcaatgtcactgtgaatgcaacctttatgtactctgatgggcttatccacaattcgggtgactgccggtccagtacttgtgaaggcctggacttactgagaaagatcagtaatgcacaaagaatggggtgcgtccttatcgggccatcgtgcacttactccactttccagatgtatctggatactgaactgagctacccaatgatttccgcgggtagcttcggtctatcctgcgattacaaggaaacccttacccggctcatgtcgcccgccagaaagcttatgtatttcctggtcaatttttggaagaccaatgatttgccattcaaaacgtactcgtggtccactagctatgtgtataagaatggtaccgagaccgaggactgcttctggtacctgaacgccctagaagcctctgtatcatatttctcccatgaactgggctttaaggtagttcttaggcaggataaggagttccaggatatattaatggatcacaaccgcaagagcaatgttatcatcatgtgtggtggacctgaattcttgtacaaattgaaaggagatagggccgtggccgaagacatcgtaattatactggtcgatctgtttaatgaccagtactttgaggataacgtcactgcccctgattatatgaagaacgtgcttgttctgaccctgtctccaggcaattctttgctgaacagtagttttagtcgcaacttgtcaccaactaaacgagacttcgccctagcgtaccttaacggaatcttacttttcggtcacatgttgaagattttcctcgagaacggagaaaacataacgacacccaagttcgcacacgcattcaggaatctcaccttcgagggatacgacggcccggtcactcttgacgattggggcgacgttgacagcactatggtgttgctctacacgagtgtcgataccaagaaatataaggtgctgcttacctacgacactcacgtgaataagacttaccccgtcgatatgtctcctacttttacatggaaaaattccaaactccccaacgatattaccgggagggggcctcaaattcttatgatcgccgtgtttactcttacgggcgccgtggtgttgctgctgttggtggccctgctgatgttgcggaaatatcggaaagactatgagctgaggcagaagaaatggagccatatccctccagagaatatcttccctcttgaaaccaacgagacaaaccatgttagtctcaaaattgacgatgataagagacgagataccattcaaaggctgcgccaatgtaagtacgacaagaaaagagtaattctcaaagatctgaaacacaacgatggcaattttacggagaaacagaaaatagaactcaataagctgctccaaattgattactacaacctgaccaagttttatggcacagtgaagctggatactatgatttttggggtcatcgaatattgtgagagaggtagcttgagggaagttctgaacgacacaatctcttacccagatgggaccttcatggactgggagtttaaaattagcgtgttgtatgatatcgctaaggggatgtcctacttgcacagcagcaaaactgaggtccatggaagactgaaatccactaattgcgtcgttgacagtcggatggtagtgaagattacagatttcggctgtaattccatactcccaccaaagaaagatctgtggaccgcccctgaacacttgagacaggccaatatttcacaaaaaggagatgtgtactcttatggaatcattgcacaggagatcattttacggaaagaaacgttctataccttgagctgtcgcgataggaacgaaaagatctttcgagttgagaattccaacggcatgaagccattccgacccgacttgtttctcgagacggcagaggaaaaagagctggaagtttacctcctcgtgaagaactgttgggaggaagaccctgagaagcgcccagattttaaaaaaatcgagactactctcgccaaaatcttcggactgtttcacgatcagaagaatgagtcttatatggacacactgatcaggcgactgcagctttatagcaggaacctcgaacatctggtcgaggagcgcacacaactgtacaaagcagagagggatcgggccgaccgcttaaatttcatgctactgccccgcttagttgtcaagtcgttgaaggaaaaaggatttgtggagccggagctttatgaggaagtaacaatctatttctctgacatcgttgggttcacgacaatatgtaaatacagcacgcctatggaagtagtcgatatgctgaacgacatctacaagtcattcgatcacatcgtggatcatcacgatgtgtacaaggtcgaaacaattggcgacgcctacatggtcgctagcggactgcccaagcgtaacggcaacagacatgcgattgacatagccaagatggctctggagattctgtcctttatggggactttcgagttggagcatttgcctgggttgcctatttggattagaataggcgtgcacagcggcccatgtgccgcgggagtggtggggataaaaatgcctaggtattgcctatttggcgatacggtgaacacagcatctcgtatggaaagcaccggcttgccactcaggattcatgtgagtggatcgaccatagccattttgaagagaactgagtgccagtttctctacgaggtccgaggggagacttatcttaagggcaggggcaatgaaactacctattggcttacaggcatgaaggatcaaaaatttaatctgccaacacctcccaccgtggaaaaccagcagcgccttcaggccgaattcagcgacatgatcgcaaattccttgcagaagcggcaggcggccggaatccgctctcagaagcctcggagggtggccagttacaagaagggaaccttggagtatctgcagttaaataccacagataaagagtctacttacttttag

SEQ ID NO: 190187 - DNA, 3312 bp, Artificial Sequence
  Description of Artificial Sequence: Synthetic coding sequence
atgaccgcctgcgcccggcgggccggcggcctgcccgaccccggcctgtgcggccctgcatggtgggcaccatctctcccccgccttcccagggcactgcccaggctgccattgctgctgcttttgctgctgctccagccccctgctttgtcagcagtctttaccgtgggggttctgggcccatgggcatgtgaccccatcttttctcgagccaggccagatctcgccgccagactggccgccgctcgcttgaaccgtgatcctggactggcaggaggaccgcggttcgaggtggctttactcccggagccatgcaggactcctgggtctctcggcgcagtgtcttcagccctcgcaagggtgtctgggttagtgggccctgtaaatcctgcggcttgcaggcctgcggaacttctggctgaagaggccgggatcgcactggtcccatggggctgtccgtggactcaggcggagggaaccaccgccccggcagtgacacccgcggccgacgctctgtacgcgttgctcagagccttcgggtgggcgcgagttgccctcgtaacggcgcctcaggatctgtgggtggaagcagggcgatcactatctaccgcgctgcgcgctagaggactgcctgttgcctccgtgacatctatggagcctctcgacctttctggcgcacgggaagccctccgcaaagtgagggacggcccccgggtaacggccgtcataatggtaatgcattctgtattactcggcggcgaagaacaaagatatctgctggaagctgcagaagagctggggctgacggatggctcactcgtctttctgccttttgacactattcactacgcgttgagtcccggtcctgaagccttggctgctcttgctaatagcagccagctgagacgggcacatgatgccgtgctgacacttacccgccattgcccaagcgagggctctgtcctagacagtctccggagagcccaggaaagacgagaattacctagcgatctgaatttacaacaggtcagccctttgtttgggacaatctacgacgccgtctttttactggctcggggcgtggccgaggcacgcgcagcagccggggggcggtgggtttctggcgcagccgtggccaggcacatccgcgatgcacaggttcccggattttgtggcgaccttgggggggacgaagagcctcctttcgtgcttcttgatacagatgctgctggagaccgattgtttgccacatatatgctcgaccctgcccgcggttcatttctgagcgcgggcacacgaatgcactttcctagaggtggtagtgcccctggcccggaccctagttgctggttcgatcccaataacatatgcggcggcggattagagccaggacttgtctttctgggatttctcctggtagtgggtatgggactggcgggggcttttctggctcactatgtgcgacaccgccttctgcacatgcagatggtgagtggaccaaataagattattctcaccgttgatgatatcacattcctccacccacacggtggaacaagtcgcaaagtggctcagggctcccgctcttctctgggcgcgagatccatgtctgacatccggagtggaccttcccaacatctggactccccaaacatcggagtttacgagggcgacagggtctggctgaaaaagttccctggggaccagcatatcgctattcggcctgccacgaaaactgcgttctccaagctgcaggaactgcgacacgaaaacgtggccctttatctcgggctcttcctggctcggggtgcagagggacctgccgccctgtgggaaggaaatttggccgtcgtctccgagcactgcacccgtggaagtctgcaagatttactcgcgcagagggagatcaagctcgactggatgttcaaaagttcgctgctgcttgatcttatcaagggaattcggtacctgcaccaccggggggtagctcatggaagacttaagagccgtaactgtatcgtggatggaaggttcgtgctgaaaattaccgatcatggacatggcagattgctggaggctcagaaggtgctgcccgaaccaccgcgggccgaggatcaactctggaccgctccggagttgctgcgggaccccgctttggagcggcgcggaaccttggcgggggacgtgttttcactggccataattatgcaggaggtggtctgtcgctccgctccctacgctatgttggagctgacacccgaagaggtggtgcagagagtcaggtctccgcctccattgtgtcgcccactggtgagcatggatcaggctccagtcgaatgcattctgctgatgaagcaatgttgggccgagcaaccagaattgcggccatcaatggaccacacatttgacctgttcaaaaatattaataagggccgcaaaaccaacattatagactctatgcttagaatgctcgagcagtacagcagtaatctggaagacttgatcagggagagaaccgaagagttggagctcgagaaacagaaaacggacagactgctgactcagatgctccctcctagcgtagctgaagctttaaagacaggaacccccgtggagcccgaatattttgaacaggtgacgctttacttttctgacatagtaggctttaccactattagcgctatgtccgagccaattgaggtggtggacctgctcaacgacctctatactctgtttgacgccataattggctcccacgacgtgtacaaagtcgagaccattggagacgcttatatggtagcttcaggcctacctcaaagaaacggtcagcggcatgcagccgaaatcgctaatatgtctctggatatcttgagcgccgtcggcacctttagaatgcgtcatatgcctgaagttccagtccgtattaggattggattgcatagcggcccatgtgtggctggggtggtgggcctgactatgccgcgatactgcctattcggggatacagtgaatactgcatccagaatggagtcaaccggactaccgtataggatccacgtgaatctcagcactgtcggcatattacgggccttggattcaggctaccaggtcgaactgcgagggcgcacagagttaaaaggaaagggggccgaagatacattctggttagtgggccgtagagggttcaataagccaatccctaaaccccccgacctacagccaggaagctctaatcatggaattagtcttcaggagatccctccagagaggcggcggaaactggagaaggccagacccggacaattctcttag

SEQ ID NO: 190188 - DNA, 594 bp, Artificial Sequence
  Description of Artificial Sequence: Synthetic coding sequence
atgcggaagtaccggagccactggagccagggcgaccgggagggctatcagcggagatctaactactacgaaggtccgcacacatcacactcctcaccggcggatcggactcgggaagaggtggtgaccccgacgctacccgagcatactgccaccaggtctcaaatggcaacttctctggatttcaaaacatacgtcgaccaggcctgccgggcagccgaagaatttgtgaacatttattatgaaaccatggacaaacggagaagggctttgacaagactctacctagataaagccaccctgatctggaacggcaatgcagtttcaggtctggacgccctcaacaacttcttcgacacgctgccctcctcggagtttcaggtgaacatgttagattgtcagccagttcacgagcaagccactcagtcacaaacaaccgtcttagtcgtcaccagcggcaccgtaaaattcgacggcaataagcagcacttctttaatcagaattttctgctcactgcccagagtacgccgaacaatactgtgtggaagatcgcttcagattgctttagatttcaggactggagttcgtcttag

SEQ ID NO: 190189 - DNA, 606 bp, Artificial Sequence
  Description of Artificial Sequence: Synthetic coding sequence
atgggcaacgtgatggagggcaagagcgtggaggagctgagcagcaccgagtgtcaccagtggtacaagaagttcatgacagagtgcccttcaggccagctgaccctctacgagttccgccagttttttggtctcaagaatctcagtcccagcgcaagtcaatacgtagagcaaatgtttgaaacattcgattttaacaaggacgggtacatcgactttatggagtacgtcgcagcactgagcttggttttgaaagggaaggtcgagcagaaactgaggtggtactttaagttgtacgacgtggatggcaatggctgtatagacagggatgagctcctcactattattcaggctattagagcaattaatccctgctctgacaccactatgaccgcagaagaattcaccgataccgtcttttcgaagatcgatgtgaacggggatggcgagctgagcctcgaggagttcattgagggcgtgcagaaggatcaaatgcttctcgacacactgacaagatccctggacctcacacggattgtacggcgcctgcagaacggagagcaggatgaagaaggggccgacgaggctgctgaggcagctggatag

SEQ ID NO: 190190 - DNA, 606 bp, Artificial Sequence
  Description of Artificial Sequence: Synthetic coding sequence
atgggcaacgtgatggagggcaagagcgtggaggagctgagcagcaccgagtgtcaccagtggtataagaaattcatgaccgaatgcccatctggacaactgaccctatatgaattccgccaattctttggcctgaaaaacttatcaccatcagccagtcagtatgtcgaacagatgtttgaaactttcgacttcaataaggatgggtacattgatttcatggagtacgtggcggcactttcactggtattgaaggggaaggtggaacagaaactgaggtggtacttcaagctttacgacgttgatgggaatgggtgcattgatagggacgagcttctcactattatccaggccatcagagcgatcaacccatgttctgacactaccatgacggccgaagagtttactgacacagtctttagtaagatagacgtcaacggcgacggcgagttgtccctggaagaattcattgaaggtgttcagaaggaccagatgttgctcgataccctgaccagatctcttgacctgacccggattgtgcgccggctgcagaacggcgagcaggacgaggaaggagcagacgaggctgctgaagctgcgggctag

SEQ ID NO: 190191 - DNA, 618 bp, Artificial Sequence
  Description of Artificial Sequence: Synthetic coding sequence
atggagggcaagagcgtggaggagctgagcagcaccgagtgccaccagtggtataagaaattcatgactgagtgcccctcgggacagctcaccctgtatgaattccgccagttcttcggactcaagaacttgtccccttctgctagccagtacgtggagcagatgttcgagacattcgacttcaacaaagatgggtacatagatttcatggaatacgtggctgccctctccctggtgcttaaggggaaggtagagcagaaacttcgctggtactttaagctctacgacgtggacggtaacgggtgcattgatagagacgagctacttacaatcatacagttcccgcaccaataccagaaaacagccatccgagcaattaatccatgttctgatacgactatgactgccgaggaattcaccgataccgtattctctaaaattgatgtgaacggagatggggagctgagcctggaggagttcattgagggcgtgcagaaggatcagatgctgctggatacattgactagatctctcgacctaaccaggattgtgcgacgccttcagaacggcgaacaagatgaggagggcgctgatgaggccgctgaggcggccggctag

SEQ ID NO: 190192 - DNA, 606 bp, Artificial Sequence
  Description of Artificial Sequence: Synthetic coding sequence
atgggcaacgtgatggagggcaagagcgtggaggagctgagcagcacggagtgtcaccagtggtacaaaaagtttatgaccgaatgtccctcagggcagcttaccctatatgaattccgtcagtttttcggattaaagaatctcagcccgagtgcttcgcagtatgtggaacaaatgtttgaaactttcgattttaataaggatggatacatcgattttatggagtatgtggcagcactgtccctggtgctgaaaggcaaagtcgaacagaaactgagatggtacttcaagctttacgatgttgatggtaatggatgcatcgatcgagacgagcttttgaccataatccaggcaattagggcgattaacccttgttcagatacaacaatgactgcagaggagtttactgacaccgtcttctcaaagatcgacgtgaatggggatggagagctcagcctcgaagagtttatcgaaggagttcagaaggaccagatgctgctggatacccttacacggagcctcgatctgacaaggatcgtgagacgcttacagaatggtgaacaagacgaagagggcgccgacgaagctgctgaggctgccgggtag

SEQ ID NO: 190193 - DNA, 267 bp, Artificial Sequence
  Description of Artificial Sequence: Synthetic coding sequence
atgggcaacgtgatggagggcaagagcgtggaggagctgagcagcacagaatgtcaccagtggtataagaaatttatgaccgaatgcccatctgggcagctgaccctgtacgaatttagacagtttttcggccttaagaacctctcccccagcgcttcccagtacgtggagcagatgtttgagacatttgactttaataaagatggttatattgattttatggaatatgtggcagccctgtcactcgtcttaaaaggaaaagtctag

SEQ ID NO: 190194 - DNA, 606 bp, Artificial Sequence
  Description of Artificial Sequence: Synthetic coding sequence
atgggcaacgtgatggagggcaagagcgtggaggagctgagcagcacggagtgtcaccagtggtataagaagttcatgactgaatgcccctctggacagctcacactctacgagttcaggcaatttttcgggctgaagaacctgtcaccttcagcatctcaatacgtggaacagatgttcgaaacgtttgactttaataaagacggatacatcgacttcatggaatatgtcgctgccttgtcactggtcctaaaaggaaaagttgagcagaaactgagatggtattttaagttgtatgatgtggacggcaatggctgtatcgaccgggacgagctgctgacaattatccaggcaattagagcgatcaacccttgctcagatacaactatgaccgccgaggaatttacagataccgtgttttctaagatcgatgtaaatggagatggggaattgtccctagaggaatttatcgagggtgtgcaaaaggatcagatgcttctggacaccctcacaagatccttggacctgacacgcatcgtccggagactgcagaacggggagcaagacgaagagggagccgatgaggctgctgaagccgctgggtag

SEQ ID NO: 190195 - DNA, 1020 bp, Artificial Sequence
  Description of Artificial Sequence: Synthetic coding sequence
atggaccagaacaacagcctgcccccctacgcccagggcctggcctccccccagggcgcaatgacccccggaattccaattttttctcccatgatgccatacgggacaggattgactccacagcctattcaaaatactaatagcctgtctatcctggaggaacaacagcggcagcagcaacaacaacagcagcagcagcagcagcaacagcagcagcagcaacaacagcagcagcaacaacagcagcagcagcagcagcagcagcagcagcagcagcagcaacaggccgtggccgcagccgcagtgcaacaatcaacaagccagcaagcaacccagggcactagcggacaggctccccaactgttccacagtcagactctcaccaccgcccctctgcctggaaccacaccactttacccttctcccatgacgccaatgacacctatcacgcctgccacgccggcctcagagagctccggtattgttccacaactgcagaatattgtctcgactgtgaatcttggatgcaagctggaccttaagacgatcgctctgcgcgcacggaacgctgagtacaatccaaagaggtttgctgctgtgatcatgagaatacgagagccaaggacgactgcattgatttttagctcgggcaaaatggtgtgtacaggcgccaagtcagaggaacagagcagacttgctgcacgcaagtacgcaagagtcgtgcagaagctgggcttccccgccaaattcttggactttaagattcaaaatatggtaggatcttgcgacgtaaaattcccgattcgcttagaaggactggttctgacccaccaacagttcagttcttacgagcccgaacttttcccaggccttatatatcggatgatcaaaccccgtattgtgttgctcatctttgtaagtggaaaggtcgtactaacaggggccaaggttagggccgagatctatgaggccttcgagaacatctatccaatcttaaaaggtttccggaagacgacctag

SEQ ID NO: 190196 - DNA, 519 bp, Artificial Sequence
  Description of Artificial Sequence: Synthetic coding sequence
atgggccaggagttcagctgggaggaggccgaggccgccggcgagatcgacgttgccgagctgcaggaatggtacaaaaagtttgttatggaatgcccatccggaacactgttcatgcacgaatttaagcgcttttttaaggttaccgacgatgaggaggcatcccagtacgtggaagggatgtttcgggctttcgataagaacggtgacaataccatcgactttctggaatacgtcgcagctttaaacctggtgctgaggggtaccctggagcacaaactcaaatggacttttaaaatatacgataaggacgggaacggctgtatagataggttagaattgctcaatatagtggaatgtagaagagagctgcagaccgagcaaggacaattgttgacacccgaggaggtggtcgacaggatattcctgctggtcgatgaaaacggcgacggccagctctctctgaatgagtttgtcgaaggagccagacgggataacttactgatgcccaccctttag

SEQ ID NO: 190197 - DNA, 630 bp, Artificial Sequence
  Description of Artificial Sequence: Synthetic coding sequence
atgggcaacggcaagagcatcgccggcgaccagaaggccgtgcccacccaagagacccacgtatggtatagaacattcatgatggagtatccttctggtctgcagacactccacgagttcaagacgcttttaggactccagggtttgaaccagaaagcgaataagcatatagatcaggtgtataacacctttgacacaaacaaagacggctttgtggactttctggaatttattgctgctgtgaacttgattatgcaagagaagatggagcagaaactgaagtggtatttcaaactgtatgacgccgatggcaacggttcaatcgataagaatgaacttctggatatgtttatggcggttcaggcattgaacggacagcagacgctcagcccagaggaattcattaatctggtgttccataaaatcgacattaacaatgatggagagttgacactggaggaattcatcaatggcatggctaaagatcaggatcttctggagatcgtgtataaatcttttgattttagcaacgtgctgagggtgatctgcaacggaaaacagcccgatatggagactgacagcagcaaaagtcccgataaagccggcttaggaaaggtcaaaatgaaatag

SEQ ID NO: 190198 - DNA, 591 bp, Artificial Sequence
  Description of Artificial Sequence: Synthetic coding sequence
atgggcaacggcaagagcatcgccggcgaccagaaggccgtgcccacccaggagacccacgtgtggtacagaacttttatgatggagtaccccagcggactccaaaccttgcatgagttcaaaactctgctaggactgcaaggcctgaatcagaaggccaataagcacatcgaccaggtctacaacacatttgacacgaataaggatggtttcgtggacttcctggaattcattgcagctgtcaacttgattatgcaggaaaagatggagcagaagctgaaatggtacttcaaattatacgacgctgacggcaatggctcaattgataagaatgaactgttggatatgtttatggctgtgcaggcccttaacgggcagcaaaccctttccccagaagagtttattaacctggtgttccacaagatcgacatcaataatgatgggaatggcgctactttatattggatcacattccccactaaagggattgactttagacggatctaccagtggcacggaaaaaggtctggaagtccaggcgactgtctgcaggagctccgcttgctgcagtgtgctgagtctaatctgtag

SEQ ID NO: 190199 - DNA, 348 bp, Artificial Sequence
  Description of Artificial Sequence: Synthetic coding sequence
atgaacgccttcctgctgagcgccctgtgcctgctgggcgcctgggccgcactggcgggaggcgtaaccgtgcaagatggcaatttcagtttcagccttgaatctgtaaagaagctcaaagacctgcaggagcctcaggagcctagggtcggaaaattgcgcaattttgcaccgatccccggtgaacccgtcgttcccatcctctgctctaacccaaattttcccgaagagttaaagccattatgcaaagagcccaatgcacaggagatcctgcagcgccttgaggagattgccgaagatcccggaacgtgtgaaatttgtgcatatgccgcttgtactgggtgctag

SEQ ID NO: 190200 - DNA, 339 bp, Artificial Sequence
  Description of Artificial Sequence: Synthetic coding sequence
atgggctgccgggccgccagcggcctgctgcccggcgtggccgtggtgttgcttctcctccttcaaagcacacagagcgtgtacatccagtatcagggattcagagtccaactggagtccatgaagaaattgtccgacctggaagcacagtgggctcccagcccccgactacaggcacagtcgctgctgccagcggtctgccaccacccagctctcccccaggaccttcagcccgtatgcgcctctcaggaggcctcaagcatattcaagaccctgcgaacgatcgccaacgatgactgcgaactgtgcgtaaacgtggcatgcacaggttgtctttag

SEQ ID NO: 190201 - DNA, 594 bp, Artificial Sequence
  Description of Artificial Sequence: Synthetic coding sequence
atgagcggcccccggcccgtggtgctgagcggccccagcggcgccggcaaaagcaccctactgaagagactgttacaggagcattccggaatctttggttttagcgtaagccatacaaccaggaatcctagacccggcgaagagaacgggaaggattactattttgttactcgggaggtgatgcagcgggatattgcggccggggatttcatagaacacgctgaattcagcggcaatctctacggaacatcaaaagtggccgtgcaagcagtgcaggctatgaaccggatttgcgtcttggacgttgaccttcaaggggtccggaatatcaaagccaccgatctccgccctatatacatttcagtacagcccccatccttgcacgtgctggagcagcgccttaggcaaagaaataccgagaccgaggagtctctagtgaagaggctggccgccgctcaggccgacatggagagctctaaagagcccggtctgtttgatgtggtcatcattaacgattctcttgatcaggcctatgccgaactgaaggaagccttaagcgaggaaattaaaaaggctcagcggacaggggcttag

SEQ ID NO: 190202 - DNA, 594 bp, Artificial Sequence
  Description of Artificial Sequence: Synthetic coding sequence
atgagcggcccccggcccgtggtgctgagcggccccagcggcgccgggaaaagtacactactcaaaagactgttacaagaacactcgggcattttcgggttttcggtttctcatacaaccagaaatccccggcctggagaggaaaacggaaaggattactatttcgtgacacgggaggtgatgcagagggatatcgccgcaggagattttattgagcacgccgagttttcgggcaacctgtacgggacaagcaaggttgctgtgcaggcagtgcaggcaatgaataggatatgcgtgctcgatgtcgacctgcagggcgtcaggaacatcaaggccacagacttacgtcccatttatatttctgttcaaccaccgtccttgcacgtgctggaacagagactgcgtcagaggaataccgaaactgaagagtcactagtaaagcggctggcggcggcacaggccgatatggagtcctcgaaggagcctgggctgtttgacgtggtcataattaacgactctctagaccaagcatacgccgagcttaaagaggctttatccgaggagatcaagaaagcacagaggaccggtgcgtag

SEQ ID NO: 190203 - DNA, 594 bp, Artificial Sequence
  Description of Artificial Sequence: Synthetic coding sequence
atgagcggcccccggcccgtggtgctgagcggccccagcggcgccggcaaaagtactttgctcaagaggctgctccaagagcattctggaatctttggcttttccgttagccacactactcgtaatcccagacctggggaggaaaatggaaaagactactacttcgttactagggaggtgatgcaacgtgacattgccgcgggagactttatagagcatgctgagttctccggcaatttatatggaacaagcaaagtcgccgtacaagctgttcaggccatgaaccggatctgtgtcttagacgtcgacctgcaaggagtgcgcaatatcaaggccactgacctgaggccaatctatatatctgtacagcccccctccttgcacgtccttgagcaaaggctaaggcagaggaacacagaaaccgaggaatctttggtgaagaggttggcagccgctcaggccgatatggagtcgagcaaggaacccggattattcgacgtagtgatcatcaatgattcactcgatcaggcctatgctgagctgaaagaagcactgagcgaggagatcaaaaaagcccaacgcacgggcgcttag

SEQ ID NO: 190204 - DNA, 600 bp, Artificial Sequence
  Description of Artificial Sequence: Synthetic coding sequence
atgagcggcccccggcccgtggtgctgagcggccccagcggcgccggcaaatctacgctgctgaaaaggctgttgcaggagcattccggcatttttggtttcagcgtcagtcgcgaatcaagagccttggtcgagggctaccatgaagagccggaggcacggcgcggtgagaggcagcgggaggtcatgcagagggacatcgctgccggagactttatcgagcatgccgaattctctgggaacctgtacggaacaagcaaagtagctgtccaggccgttcaggcaatgaataggatctgtgtcctggatgtagacttgcagggggtaaggaacatcaaggccacggacctgcgcccaatctacattagcgttcagcctcctagtctccacgtactggagcagcggctgcgacagcgtaataccgagacagaagaatccctggtcaaacgtctggcggctgcacaagcagatatggagtcgagtaaagagcccggcctgttcgatgttgtcatcatcaacgactctttagatcaggcctacgctgagctcaaggaggccctcagcgaagagatcaagaaagcccaacggactggagcttag

SEQ ID NO: 190205 - DNA, 729 bp, Artificial Sequence
  Description of Artificial Sequence: Synthetic coding sequence
atgagcggcccccggcccgtggtgctgagcggccccagcggcgccgggaaatccacactcctgaagcgactcctgcaggagcactccgggatattcggtttctcggtcagtcacaccacgagaaatccacgccccggtgaggaaaatggtaaagactactactttgtgacccgggaggtgatgcagcgggatattgcggctggcgatttcatcgagcatgcggagtttagtggcaacttgtacggaacaagcaaggtagctgtccaggcagttcaggctatgaacaggatctgcgtgctcgatgtcgatctccagggcgtacgaaatataaaggctacagatttacggcccatttatatcagcgtgcagcccccatctctccatgtcttacgtctgcggcaaagaaacacagaaaccgaggagagtctagtgaaaaggctggccgcagcccaagctgatatggaatccagtaaggaacccgggctgtttgatgtggtgatcatcaacgactctttagaccaggcgtacgccgaacttaaagaggccctgtcagaagtggggccttctctctgccttcctggtcagggtcctcgaggagggctgggggccaggcccctcttgtccatgagacccttgcgcaaatcccggaaattgaaggggcccgctcctgaggcatgttgcttgttctcagctcctagggcccacactggccctggacagcagcattag

SEQ ID NO: 190206 - DNA, 657 bp, Artificial Sequence
  Description of Artificial Sequence: Synthetic coding sequence
atgctgcggcggcccctggccggcctggccgccgccgccctgggcagggccccacctgacggcatgagcgggccccggcctgtggttctgagtggcccgagcggagcaggcaagagcaccctgctgaaacgtctgttgcaggagcatagcggaatcttcggctttagcgtgagtcacaccacacgcaatccccggccaggggaggaaaatggcaaggattattactttgtgacccgagaagttatgcagcgagatatagccgcaggcgacttcatcgagcacgcagagtttagtggcaacctctacggtactagtaaggtagccgtacaggccgttcaggctatgaaccggatatgcgtgctggatgtggatcttcagggagttaggaacatcaaggcgacagacctgcgacccatttacatctctgtccaacctccatcgttgcacgtgctggagcagagactgcggcagagaaatactgagactgaagagtctctcgtgaaaaggctcgctgccgcacaggcggacatggaatcttcacccgccgggttggaatcctgccctacggccgccgtgagaaccgctgccggtcaatctcctgcgtgcctgatgtggtcctcgctgaccactgcctggactcggccaacacagtcttag

SEQ ID NO: 190207 - DNA, 594 bp, Artificial Sequence
  Description of Artificial Sequence: Synthetic coding sequence
atgagcggcccccggcccgtggtgctgagcggccccagcggcgccggaaagagcaccttgctgaaacgcctacttcaggaacactctgggattttcggcttttctgtctcacatacaacaagaaacccaaggccaggtgaagagaacgggaaggactactatttcgtcacccgcgaggtcatgcaaagagatatcgcagcgggtgattttatagaacacgctgaattcagcggcaatctctacggcacctctaaggtagcagtgcaggccgtgcaagccatgaacaggatctgcgtcttagatgtcgatcttcagggcgtccgaaatattaaggccacagacctccggccgatttacatcagcgtccagccaccctccttacacgtgctggagcagcgactccgccagcggaacaccgaaacagaggaatccctggttaagcggctagctgccgcccaggccgatatggagtccagcaaagaacctggcctcttcgacgtcgtcatcataaacgactccctggatcaggcctacgcagagctgaaggaggcattgagtgaggaaattaaaaaagcccagaggaccggggcatag

SEQ ID NO: 190208 - DNA, 726 bp, Artificial Sequence
  Description of Artificial Sequence: Synthetic coding sequence
atgctgcggcggcccctggccggcctggccgccgccgccctgggcagggctccccccgacgggatgagcggccctcgcccagtggtcctgagtggaccttccggcgccggcaagtctaccttactgaaacgtctgctccaagaacactcagggatatttggcttctccgtctctcataccactcgtaacccgaggcccggtgaagagaatgggaaggactattactttgtcacccgggaggtgatgcagcgcgatattgcagcaggggatttcattgagcacgcggagttttctgggaatctctatgggactagcaaagttgccgtacaagcagtccaggctatgaaccggatctgcgtactcgatgtcgatctgcagggagttcggaacattaaagcgacagatctgcggccaatctatatttccgttcagccacccagcctccacgtgctggaacagcgattgcgacagagaaacacagaaactgaggagagcctcgtgaaacgcctggcagccgcccaggctgacatggagagccggaaccaagaatcctcaaaggatcgtaggctcaggctggctgtgtgcagtcgtcatcctgggcccatccaggaccagggttcttccatcgaaccccctccgtggcaggccattaggcagttatgcgctcttgggcagcacgttgagtggaggcgatgttgcccctgtgggtggaatattctgggatag

SEQ ID NO: 190209 - DNA, 594 bp, Artificial Sequence
  Description of Artificial Sequence: Synthetic coding sequence
atgagcggcccccggcccgtggtgctgagcggccccagcggcgccggcaagagcaccttgctcaaacgccttctacaggagcattctgggatatttggattttcggtaagtcacacaacaaggaatccgcggcctggagaggagaatggaaaggactactacttcgtcacccgtgaggttatgcagcgggatatagctgctggagactttatcgagcatgcagagttcagcggaaacctctacggtaccagtaaggtagccgtgcaagccgtgcaagccatgaaccgcatttgtgtacttgacgtggatctccaaggcgtgcgcaacatcaaagccactgatctgaggcctatctacatttctgtgcagccaccaagtttacatgtcctggagcagcgactgcggcagagaaataccgaaactgaggaatctcttgtaaaacggctagctgctgctcaagccgacatggagagcagtaaagagcccggcttatttgacgtggtcatcattaatgactcacttgatcaggcctacgcggaactcaaagaggctttgtccgaggagatcaaaaaagcgcagcgaactggcgcctag

SEQ ID NO: 190210 - DNA, 657 bp, Artificial Sequence
  Description of Artificial Sequence: Synthetic coding sequence
atgctgcggcggcccctggccggcctggccgccgccgccctgggcagggccccgcctgacggtatgtcaggcccccggccagtcgtgttaagcggtccatctggagcagggaaaagcacacttctgaagcggctgttgcaggagcactccggtatctttggatttagcgtcagtcacaccacacggaaccctagaccgggagaagagaacggtaaagattattactttgtaacccgagaagtgatgcagcgggacatcgcagccggcgatttcatcgaacacgcagaattttcaggaaacctctatggtacttccaaagtagccgtgcaggctgtgcaggcaatgaatcggatctgcgtcctggatgtcgatctgcagggcgtgcgcaatataaaagctacagatctgcgacctatatacatctcggtacaaccaccttctctgcacgtgctggagcaaaggttgagacagaggaataccgagactgaagagagcctggtgaagaggctagcagccgcgcaggctgatatggagagtagcaaagagccaggcttgttcgacgtggtgataattaatgactctctcgatcaagcttatgcagagctcaaagaggctctgtctgaggagattaagaaggcacagaggacgggggcatag

SEQ ID NO: 190211 - DNA, 762 bp, Artificial Sequence
  Description of Artificial Sequence: Synthetic coding sequence
atggccggcagccagaaggaggagatcatgcccccccagcagggcgtgccattccaggaaagcggctgttgggggagcatgggagctcagagccgggagagatccggtcgcgatcatagcggcacatggatctgcgccggcggatcgcaagagacctttcatttaggagccccagtcgaaacaacttgtctggccggcatgagcggtccaaggcctgttgtcttatcgggccctagcggggcagggaaatctaccctgctgaagagattgttgcaggaacacagcgggatttttggcttttcagtgagccacacaactaggaaccctagaccaggagaggaaaatggcaaggattattacttcgttaccagggaggttatgcagcgggatattgccgctggagattttattgaacacgcggaattctccggtaacctgtacggaaccagcaaggtggcagtgcaggccgtccaagccatgaacagaatctgcgtccttgacgtcgatcttcagggcgtacggaatatcaaggctactgacctgaggccaatatacatttccgtgcagcccccctccctgcacgtgctcgagcagcggctgcgccagagaaataccgaaaccgaagaatccctggtgaagagactggccgctgcccaggccgatatggagagctctaaagaacctggcctgttcgatgtcgtgatcatcaacgactccttggaccaggcatacgccgaattgaaagaggccctgtctgagtag

SEQ ID NO: 190212 - DNA, 516 bp, Artificial Sequence
  Description of Artificial Sequence: Synthetic coding sequence
atgagcggcccccggcccgtggtgctgagcggccccagcggcgccggaaaatcaaccttgctgaagagactgcttcaggagcatagcggaatcttcgggttctctgtctcgcgcgagtctaacactaccagaaaccctaggcctggcgaggagaatggcaaggactactacttcgtaacaagagaagtcatgcaaagagatatcgccgcaggtgactttatcgagcacgccgagttctccgggaacttatacggaacaagtaaagtggctgtgcaggctgtccaggcaatgaaccggatatgcgtgctagatgtggatttgcagggtgtccggaatatcaaggcaacagatctcaggcctatctatattagcgtccagccaccctctctacatgtactggagcagcgtctaagacaaagaaatactgaaacagaggagagcctggtgaagcgcctggccgccgcccaagccgacatggagagcgagatcaaaaaagctcagaggacaggcgcctag

SEQ ID NO: 190213 - DNA, 819 bp, Artificial Sequence
  Description of Artificial Sequence: Synthetic coding sequence
atggccggcagccagaaggaggagatcatgcccccccagcagggcgtgccattccaagagagtggttgctggggatccatgggcgcccaatctagggagaggtccggcagggatcactccggaacctggatttgcgcaggcggcagccaggagaccttccacttaggggctccagtcgaaacaacgtgtcttgcagcatcactgctaactccaaggcatgtgggccctcaggcgtgtggggccgagagagcctttgggagctgggaggagcatccagcagaggaggccgctccgggtgcccagcgacacctgtggctgcagcgggtaccgtaccacgaggaaccagaggctcgaaggggagaaaggcagcgcgaagtgatgcaaagggacatcgccgcaggcgacttcattgagcacgcagagttcagtgggaatctttatggaaccagcaaggtcgccgtgcaagccgtacaggctatgaaccggatctgtgtcttggatgtggatcttcagggtgtcagaaacataaaggccacagatttacgccctatctacatatccgtgcagccgccgtctttgcacgtcctggaacagaggttacggcagagaaacacagagaccgaagagtctttagtcaaacgcttggctgccgcacaggccgacatggaatcccgcaaccaggagagtagcaaggacagacgtctacgtctggccgtgtgctctcggcatccaggacccattcaggaccagggctcatctatcgaaccccctccctggcaagcaatcagacagctgtgcgccttaggacaacacgtatag

SEQ ID NO: 190214 - DNA, 654 bp, Artificial Sequence
  Description of Artificial Sequence: Synthetic coding sequence
atgctgcggcggcccctggccggcctggccgccgccgccctgggccgtgccccacccgacggaatgtccgggccccggccagttgtcctttctggccctagcggggcggggaagagtacacttttgaaaaggctgctacaggagcattccggcatcttcggtttttcagtgagtcacacaactcgtaatccacgaccaggagaagaaaatggtaaggactattactttgtgacccgggaggtgatgcagcgtgacattgctgcgggggacttcattgaacatgctgagtttagcggcaacctgtatggcacaagtaaagttgccgtgcaggccgtgcaggccatgaacagaatctgtgtgctggatgttgacctccagggcgtgcggaacatcaaggctacagaccttcggcccatctatatctccgtgcagccacccagtctccacgtgctggaacagaggctccggcagcggaacacagaaacggaagagtcactggtcaagcgcctggcggccgcccaggcagacatggagtcttccaaggagcctggactctttgatgtagtcattattaacgacagcctggatcaggcttacgccgagctcaaagaagcattatccgaagagatcaagaaagcgcaaaggactggttag

SEQ ID NO: 190215 - DNA, 915 bp, Artificial Sequence
  Description of Artificial Sequence: Synthetic coding sequence
atgaaccgggccttcagccggaagaaggacaagacctggatgcacactcccgaagcactgtccaaacacttcattccctacaacgccaagttcttgggcagtacagaagtggaacagccgaagggaaccgaggtcgtgagagatgccgtcaggaagctcaagtttgcgagacacataaaaaaatcagaaggccaaaagatccctaaagtggaattgcagatcagtatttacggagtgaagattttagagcccaaaaccaaggaggttcagcataattgtcagctgcacagaatcagtttctgtgcagatgacaaaactgataaacgaatttttacatttatctgtaaagactcagaaagtaacaaacacctttgttacgttttcgacagcgagaaatgtgcggaagaaattacactaacaatagggcaagctttcgatctcgcataccgaaagtttctagagtctgggggtaaagatgtggagacacgcaagcagatagccggcctgcagaagcgcatccaagaccttgaaacagagaacatggaactgaagaataaagtgcaagacttggagaatcagcttcggatcacacaggtgtctgccccacccgctggcagcatgacacctaagtcaccgtccactgatatctttgacatgataccgttttcaccaatttcccatcaatcctccatgccaaccaggaatggaacccaacccccaccggtcccgtcccggtccacagaaatcaagcgggacctttttggagcagagccgttcgaccctttcaattgtggagctgccgactttcccccagatatccagtccaagctggatgaaatgcaggagggctttaagatgggcctaacattggagggaactgtgttctgcctggacccactcgactcaagatgttag

SEQ ID NO: 190216 - DNA, 915 bp, Artificial Sequence
  Description of Artificial Sequence: Synthetic coding sequence
atgaaccgggccttcagccggaagaaggacaagacctggatgcacacccccgaagccctctctaagcacttcatcccctacaacgccaaatttctgggctctacagaagtagaacaacctaaagggacagaagtcgtccgagacgctgttagaaagctcaagtttgcacgccacattaaaaaaagcgaagggcaaaagatccccaaggtggagctgcagattagtatttacggagtgaaaatcctcgagcctaagacaaaagaggtccagcataactgccagctgcacagaattagcttctgcgcagacgacaagacagacaagcgtatctttacctttatttgcaaggactctgagagtaacaaacacttgtgttatgtcttcgatagtgaaaagtgcgcggaagagattactctcacgattggacaggcatttgatctggcctataggaaattcctggagagcggcggcaaagatgttgaaactcggaagcagattgccgggctccagaagagaattcaagacctggaaacagagaatatggaactgaagaataaagttcaggatctcgagaatcagttacgtattacacaagtatctgctccaccagcgggtagcatgaccccaaaatcaccttcaacagatatcttcgatatgattcctttctccccaatctcgcatcagtccagcatgcccactcggaacggaacacagccccctcccgtgccgtcacgaagtactgaaatcaaaagggatctgttcggtgccgagccgttcgatccttttaactgtggtgcggccgacttccctccagatatccaatctaagctcgatgaaatgcaggagggattcaaaatggggctgacacttgagggcactgtgttttgccttgacccacttgatagccggtgttag

SEQ ID NO: 190217 - DNA, 915 bp, Artificial Sequence
  Description of Artificial Sequence: Synthetic coding sequence
atgaaccgggccttcagccggaagaaggacaagacctggatgcacactccagaagctttatctaagcatttcatcccttataacgccaagttcctgggtagcaccgaagtggagcagcccaaggggacagaagtggttcgggacgctgtccgcaaactcaaattcgcccggcacatcaagaagagcgagggacagaaaatccccaaggtggaactccagatctctatctatggcgtaaagattctcgagcctaaaaccaaggaggtgcagcataactgccagctgcataggatcagtttctgcgctgacgacaagactgataagagaatctttacatttatttgtaaagattccgagtccaataagcacctatgctatgtgtttgacagcgaaaagtgcgctgaagagataacgctgacaataggacaggccttcgatcttgcttaccggaagttcctggaaagtggaggcaaggacgttgaaacaaggaagcaaatcgctggtctgcagaagcgaatccaagacctcgagactgagaatatggagctgaaaaataaagtccaggatttggaaaatcagctgagaataacacaggtctccgccccacccgcaggctcaatgacaccaaaatccccatccacagacatattcgatatgatcccgttcagtcctatttctcatcaatccagtatgcccacccggaatggcacccagcccccaccagttccttccagaagtactgagattaagcgcgaccttttcggcgctgagccctttgacccattcaattgcggggctgccgattttcccccagatatccaaagcaaactggatgagatgcaggagggtttcaaaatgggcttgaccctagaagggaccgtattctgcctggatcccctggactctcggtgttag

SEQ ID NO: 190218 - DNA, 504 bp, Artificial Sequence
  Description of Artificial Sequence: Synthetic coding sequence
atgaaccgggccttcagccggaagaaggacaagacctggatgcacactccggaagctctaagtaaacattttatcccttataacgcaaagttcctgggaagcactgaagtcgagcagcccaaggggacagaggttgtgagagatgctgtgagaaaactgaagttcgctcgtcatattaaaaagagcgagggccagaaaattccgaaggtggagctgcagatttccatttacggtgtcaagatcctagaacccaagacaaaggaagtgcagcacaattgccagctgcataggatctccttttgtgcagacgataaaaccgataaacgaattttcacctttatttgtaaggacagtgaatctaacaagcatctttgctacgtgttcgatagcgaaaagtgcgtgtcgattcccgatgtggtgggctggtttgtattgttctataaaccagggatagtacttcttctggccctggcaaagtacctcaagatgaacaactttctgtag

SEQ ID NO: 190219 - DNA, 915 bp, Artificial Sequence
  Description of Artificial Sequence: Synthetic coding sequence
atgaaccgggccttcagccggaagaaggacaagacctggatgcacaccccagaagctctgagcaaacacttcatcccatataatgccaaattcctggggagcaccgaggtggagcagccaaaaggcacggaggtggtgcgcgacgcagtacggaagctgaagttcgcccgtcatataaagaagtcggagggacagaagatcccgaaagttgaactgcagatcagcatttatggtgtgaagatcctagaacccaagaccaaggaagtccagcataattgtcaactgcacagaatctccttttgtgcagacgataagaccgacaaacggatatttacttttatttgtaaggatagcgaatccaacaagcacttgtgttacgtgttcgatagcgaaaagtgcgcggaggagatcaccttgaccatcggccaagccttcgatttagcctacagaaaatttcttgaaagcggaggaaaagacgtggaaactcgaaagcagatcgcggggcttcagaagagaatccaagacttggagacagagaacatggagcttaaaaataaagtacaagacctcgaaaaccaactgagaattacccaagtctctgcgcctcccgccggttctatgacaccaaagtccccctctaccgatatctttgatatgatccctttttctccaatctcccaccagtcatctatgcctactcgcaatggaacccagccccctccggttccaagccgcagcaccgagattaaaagagacctgtttggagctgagcctttcgatccatttaattgtggagcagcagacttcccacctgacatccagagtaagctggatgaaatgcaggagggttttaagatgggtctgacgctcgaggggacagtgttctgtcttgacccactcgactctagatgctag

SEQ ID NO: 190220 - DNA, 207 bp, Artificial Sequence
  Description of Artificial Sequence: Synthetic coding sequence
atgaaccgggccttcagccggaagaaggacaagacctggatgcacactcctgaggccttgtccaagcattttataccctacaacgccaaattcctggggtcaactgaggtcgagcagccaaagggaacagaggtggtgcgcgacgccgtgaggaaactcaagttcgcccgacacatcaagaaatcagagggccagaaaatcccttag

SEQ ID NO: 190221 - DNA, 504 bp, Artificial Sequence
  Description of Artificial Sequence: Synthetic coding sequence
atgaaccgggccttcagccggaagaaggacaagacctggatgcacaccccagaggcactgtcaaaacattttatcccttataatgccaaatttctaggaagtacggaggtggagcaacctaaaggtactgaggtggtgagggacgcagtgcgtaagctgaagtttgccaggcacatcaagaagagcgagggtcagaaaattccaaaggtggaactgcagatttctatttatggcgtgaagatcttggaacccaagactaaagaagtacagcacaattgccagttgcacagaatctctttctgtgccgatgataagacagataagagaatcttcacgtttatttgcaaggattcagagagcaataagcacttgtgttacgtatttgactctgaaaagtgtgtgtctattccagacgtggttgggtggttcgtgctcttttataagcccggcatagtgctccttttagcccttgcaaagtacttgaagatgaacaattttctgtag

SEQ ID NO: 190222 - DNA, 585 bp, Artificial Sequence
  Description of Artificial Sequence: Synthetic coding sequence
atgaccgagaacagcaccagcgcccccgccgccaagcccaagcgggccaaggcttcaaaaaagagcaccgaccatcctaagtattcagacatgattgtggccgctatccaggccgaaaagaatcgagccggctcaagcagacagtccatccagaagtacattaaatcacattataaagttggtgaaaacgcagactcccagataaaactgtctatcaagaggctggtgaccaccggcgttctgaagcagactaagggcgtaggcgcatctggatcttttagactggcaaaaagtgacgagcctaagaaatccgttgccttcaagaaaacaaaaaaggagattaagaaagtggccacacccaaaaaagccagcaagcctaagaaagcggctagcaaggcaccgacaaagaagcctaaagccacgcccgtgaagaaggcgaaaaagaaacttgctgcaaccccaaagaaggcaaagaaaccaaaaaccgtgaaagccaaaccagttaaggcctccaagcctaagaaagcaaagcctgtcaagccaaaggctaagagctctgcaaaaagagcaggcaaaaagaaatag

SEQ ID NO: 190223 - DNA, 534 bp, Artificial Sequence
  Description of Artificial Sequence: Synthetic coding sequence
atgaccgagaagagcaccgaccaccccaagtacagcgacatgatcgtcgctgcgatccaagccgaaaaaaaccgggctggttccagtcggcagtccattcaaaagtatattaaatcacattacaaggtgggcgagaacgctgacagccaaatcaagctgtcgatcaagcgtttagtgaccaccggagttctcaaacagacaaagggtgtgggagcatccggcagtttccgcctcgccaaatcggatgaacctaagaaaagcgtggcctttaagaagacaaagaaagaaattaagaaagtagccacaccaaagaaagcatcaaagcctaagaaagccgcctctaaggccccgacgaaaaaacccaaggcgactccggtgaagaaagcaaagaaaaagctggcagctacaccaaaaaaggccaagaaaccaaaaacagttaaagccaagcccgtgaaagcctcgaagcctaaaaaggcaaagcccgttaagcccaaagctaagtcctccgccaagagggctggaaaaaaaaagtag

SEQ ID NO: 190224 - DNA, 411 bp, Artificial Sequence
  Description of Artificial Sequence: Synthetic coding sequence
atggcccggaccaagcagaccgcccggaagagcaccggcggcaaggctcctcggaagcagctggctactaaagccgctaggaaatcagccccgagcacagggggtgtgaagaagccacacagatatcggccaggcactgtggctttgagggaaatccgaagataccaaaaatcaaccgaactcctgatccggaagctcccgttccaacgcctggttagggagatagcccaggacttcaagacagacctgagattccagtctgccgcgatcggggccctccaagaggccagcgaagcctacctcgtgggtctgttcgaagataccaatctctgtgcaattcatgccaagcgagtaaccatcatgcccaaagatattcagctggctcggcgcattagaggcgaaagagcgtag

SEQ ID NO: 190225 - DNA, 372 bp, Artificial Sequence
  Description of Artificial Sequence: Synthetic coding sequence
atggcccggaccaagcagaccgcccggaagagcaccggcggcaaggctccaagaaagcagcttgcaactaaggcggctcggaagagcgcgccctccaccggcggggtaaagaagccacaccgttacagacccggcacagtcgctctgcgcgaaattaggcggtaccaaaaaagcacagagcttttaatacgaaaactcccatttcagcgcctggtgagggaaatcgcacaagattttaagactgacctccggttccaatccgccgccattggggctctccaggtcaagtggtgggttggccgcctacgcgtgtgtatccccgtggtgtatcaagaacaatttcagattgtagcttgcgcctacatcatatag

SEQ ID NO: 190226 - DNA, 411 bp, Artificial Sequence
  Description of Artificial Sequence: Synthetic coding sequence
atggcccggaccaagcagaccgcccggaagagcaccggcggcaaggcccctcgcaaacaactggccacaaaggccgcgcgaaaatcagcgccctccaccgggggcgtcaagaagccgcatagataccggcctggaacagtggctctgagggagatccgaagataccagaagtccacagagctgcttattagaaagctgccttttcagcgcctggttagagagattgcacaggatttcaagacagacctgagatttcagtcggcagccattggtgccctccaggaggcatcagaagcttacctcgtcggactattcgaggatacgaatctatgcgcgatccacgcaaagcgggtgactattatgccaaaggacattcagctggcacggcgcattagaggcgagcgggcatag

SEQ ID NO: 190227 - DNA, 411 bp, Artificial Sequence
  Description of Artificial Sequence: Synthetic coding sequence
atggcccggaccaagcagaccgcccggaagagcaccggcggcaaggcacctcgcaaacagttggctactaaagccgcccgtaagtcagcaccctcaacggggggcgtaaaaaagcctcaccgctacagaccggggaccgtcgctctgagagaaatccggaggtaccagaagtccactgaattactcattaggaagctcccctttcaacgactggttcgtgaaatcgcgcaggattttaagaccgatctgaggtttcagagcgctgccattggagctttacaggaagcttctgaggcttaccttgtgggactattcgaagacactaacctgtgcgcaatccacgcgaagagagtcactataatgcctaaggacatacagctcgcgcgtagaatcaggggagagcgtgcttag

SEQ ID NO: 190228 - DNA, 411 bp, Artificial Sequence
  Description of Artificial Sequence: Synthetic coding sequence
atggcccggaccaagcagaccgcccggaagagcaccggcggcaaggcccctcggaaacaactggctaccaaggccgccagaaagtcagccccttccaccggtggagtgaaaaagccacatcggtacaggccggggacagtcgctctgcgcgaaattaggcgctatcagaagtctactgaattgctgatccgaaagctcccttttcagagactggtccgtgagatcgctcaggactttaaaactgaccttcggttccagagtgcggcaatcggtgcattgcaagaggcgtccgaagcttacttggtagggctattcgaggacactaacctctgtgctatccatgcgaaacgcgtgacaattatgcccaaagatatccagctggcgaggagaattaggggggagagggcttag

SEQ ID NO: 190229 - DNA, 1047 bp, Artificial Sequence
  Description of Artificial Sequence: Synthetic coding sequence
atgcccgacgagctgaccgagcccggccgggccacccccgcccgggctagctcttttcttattgagaacttactcgctgccgaggctaaaggtgcgggacgcgccacacagggggatggtagcagggaggatgaggaagaggacgacgatgatccagaggacgaagacgctgagcaggctaggcggcgacggttacagaggcggcggcagctgttggcgggcactggcccgggcggcgaggctagagctcgggcactcctcggacctggggccctgggcttgggaccccgaccaccgcccggacccggacctcctttcgctctcggttgtgggggcgctgccaggtggtatccccgcgcccacggaggctatggtggcggactgtcacccgatacctctgacagagattcaccagagactggagaagagatgggacgagctgagggggcctggcctcgtggacctgggccgggagccgtccagagggaagcggcagagctggctgccaggggacctgcagccggcactgaagaagcttcggagctggctgaggtccccgctgcggcaggtgaaacgagaggcggggtgggcgtgggcggaggtaggaagaagaaaactcggactgtattcagcaggtcccaggtattccagctggagtcaacctttgacctgaaacgatacctatcatccgcagaaagagcgggcctggctgcaagcctgcagctgacggaaacacaagtgaaaatctggttccagaacagacggaataaatggaagcggcaactggctgctgagctagaagccgccagcctgagccctccaggagctcagcgactcgtgagagttccagtactgtaccacgagagcccccctgccgcagccgccgccggccctccggctacactgccctttccccttgctccggccgcaccagctcctcccccccccctcttagggttcagtggggcgctggcctaccctcttgcagcctttcccgctgccgcttccgtacccttccttcgcgcccagatgcctggcctggtctag

SEQ ID NO: 190230 - DNA, 822 bp, Artificial Sequence
  Description of Artificial Sequence: Synthetic coding sequence
atgggcagcaaggaggacgccggcaagggctgccccgccgccggcggggtcagtagctttaccattcagtccattcttggcggcggaccctccgaggctccacgtgagccagtaggctggcctgcccggaagagatcactaagcgtttcatcagaggaggaggagccagacgatgggtggaaagcacccgcttgtttctgccccgaccagcacggaccaaaggaacaaggtcctaagcaccatcctccaattcctttcccctgtctcggcacaccgaagggctccggcgggagcggccccggcggcctggagagaacaccatttctgtcaccaagtcactctgatttcaaggaagaaaaggagaggctgctgcccgccggcagcccttctcccggtagcgaacgaccccgcgacggcggggccgagcggcaggccggggctgcgaaaaagaaaactcggaccgtgttcagcaggtcccaagtatatcagctggagtcaacattcgacatgaaacggtatctaagctccagtgagcgggcctgtctggcctcctccctgcagctgaccgaaacgcaggtgaagacctggttccagaacaggaggaataaatggaagagacaattgtccgctgagttggaagccgccaatatggcccacgcctccgcacagactttggtttccatgccactcgtgtttagagatagctcactgcttagagtcccggtgccaaggtccttggccttcccggccccattatattacccgggttccaatctgagtgcactacctctttacaacctgtataataagctggactattag

SEQ ID NO: 190231 - DNA, 1074 bp, Artificial Sequence
  Description of Artificial Sequence: Synthetic coding sequence
atgcccgagcccggccccgacgccgccggcaccgccagcgcccagccccagcccccaccccccccacctccggcgcccaaggagtctcccttctctatcaagaaccttttaaatggagaccaccatcgcccccctcctaagccccagccgcccccacggactctttttgcacccgcatccgccgctgcggcagccgccgccgctgctgcagctgccgcaaagggggccttagaaggggcggccggttttgctttgagccaagttggcgacctggcctttccacgctttgaaattccggcccagcgcttcgcattgcctgctcattacctggaaaggtcacctgcctggtggtacccatacaccctgaccccggctggaggacatctgccaagacctgaggctagcgaaaaagccctactgcgagattcaagtcccgccagtggaacagatagggatagtcccgaacctctgcttaaggctgatcccgaccacaaagagctggactccaagtctcctgatgaaattatcctggaagaaagcgattccgaggagagcaagaaagagggggaggccgcacctggagctgccggcgcctcagtgggggcagccgcggctaccccgggcgctgaggattggaaaaaaggagctgagtcacctgagaagaagcccgcttgtaggaagaagaagacaagaacggtgttttcccgatcccaggtgtttcagttagagtctacatttgacatgaagcggtacctatcttcttcagagagggccggcttagctgctagcctgcatctgactgaaactcaagttaaaatttggtttcaaaacaggcggaataaatggaagcgtcagctggcggcagagctcgaagcagccaacctgagtcacgctgccgctcagcgtatcgtgagagttcccatcctctaccacgagaactctgcggcagaaggagctgcggccgccgctgccggagctcccgtaccagtttcccagccgctgctcacttttccccatccggtgtattactcccaccccgtggtttcctccgtgccccttcttcggcctgtgtag

SEQ ID NO: 190232 - DNA, 3405 bp, Artificial Sequence
  Description of Artificial Sequence: Synthetic coding sequence
atggagagcacccccagcttcctgaagggcacccccacctgggagaaaaccgcccctgagaacgggatcgtcaggcaagagccaggttctcctccccgagatgggctgcaccatgggcccctttgtctgggcgagcccgcccccttctggcgaggcgtgctgtccactcctgatagttggctgccacccgggtttcctcagggtcctaaagacatgttgcccctagttgagggtgagggacctcagaatggggaaagaaaggtgaactggctgggatccaaagaggggcttagatggaaagaggcaatgctgacacaccctttagccttttgcggtcccgcctgtcccccccgctgcggaccactgatgccagagcattccgggggtcatctgaaatctgatcccgtggcgttccggccttggcactgccctttcctgctggaaactaagattctggaacgcgccccattttgggtgcccacgtgcctacccccttacttggtgagcggactgccacctgagcacccctgcgactggcctcttaccccacacccttgggtctacagcgggggacaaccaaaagtaccctccgcattctctctgggtagcaaagggttttattacaaggatccatcaatccccagacttgctaaagagccactggcggcagcagaacccggcttgtttggactgaacagcggagggcatctgcagagagctggagaggcggagaggccttccctgcaccagagagacggagagatgggggccggcagacagcagaatccctgtccactgtttctggggcagcccgacaccgtaccctggacgagctggcccgcttgtcccccagggctggtgcataccctgggtaatgtgtgggctggccctggagatgggaacctcgggtaccagctcgggccacccgcaacacccagatgtccctccccagagcccccagtaacgcagcgcggctgctgctcgtcctaccctccgactaaaggcggcgggctcgggccatgcggcaaatgtcaagagggcctcgagggcggcgccagtggcgcctctgagccttccgaggaggtgaacaaagccagcggtccgcgcgcatgtcctcctagtcatcatacgaagctgaaaaaaacctggctgacccgtcattctgagcagtttgaatgtcccagagggtgccctgaggtcgaggaaaggcccgtggcccgtctgagagcattgaagagagccggctctcctgaggttcaaggcgcaatggggtctcccgccccaaaaagacctcccgacccctttcccgggaccgccgagcaaggggccggcggatggcaggaggtgcgagacaccagtattggaaacaaggatgtagactccggccagcatgacgagcagaagggaccccaagacgggcaggctagcctgcaagacccaggcctgcaggacattccatgtctggctcttcccgccaaactggcccagtgccagagttgcgctcaagccgccggcgaggggggtggccacgcttgtcatagccagcaggtacgtcggtctcccctaggcggcgagctgcagcaagaggaggacacagccaccaactcatcctcggaagaaggacctgggagtgggcctgattctagactgtcaacaggactggcaaaacatctgctaagtggcctgggagacaggctgtgcaggttgctgcgaagagagcgagaggctcttgcgtgggcgcagcgggagggtcaggggcctgccgtcactgaggacagccctgggatcccccggtgctgctctaggtgccaccatggcctttttaatacgcattggcgatgcccgcgatgttcccaccggctctgtgtggcttgcggcagggtggctggcacagggagagccagagaaaaggcagggttccaggaacagtcagctgaagaatgcacccaggaagccgggcacgctgcctgcagcttgatgctgacccagttcgttagcagtcaggccctggccgagctcagtactgcaatgcatcaagtgtgggtgaaattcgacattagggggcattgcccatgtcaggcggatgcaagagtttgggccccgggagatgctggccaacagaaggaatcaacgcaaaaaacgccacctactccacagccttcatgcaacggcgacactcacaggaccaaaagcattaaggaggagactcctgactccgctgagacccccgccgaggaccgagcggggaggggacccttaccatgtccatcactatgcgaactcttagcgtcgactgcggtcaaactgtgcctgggacatgaacggatccatatggcatttgcccccgtgacacctgctctaccttctgacgacagaatcactaatatcttagactctatcatagcccaagtcgtggagaggaagatccaagagaaggctttaggcccgggattaagagccggaccgggtctgcgcaagggcctgggcctgccattgtctcctgtccgccctcggctccctccccccggcgctctgctctggttgcaggaaccccagccatgccctaggcggggcttccacctgtttcaagagcactggcggcaaggccagcctgttctcgtgtctggcattcagaggacgctgcaggggaatctctggggcaccgaagctcttggcgccctcggggggcaggttcaggccctttctccattgggtcccccccagccgtcctcccttgggtctaccaccttctgggaaggatttagttggcccgagcttcggcccaagtcagacgaagggtccgtgttgctattacaccgggctctcggggacgaagatacttctcgcgtggaaaatctggctgccagccttcctcttcccgaatactgcgctttgcatggcaaattgaatctggccagctacctgccccccggactggcacttcggccactggaaccccagctctgggctgcctatggagtttccccccacaggggtcatctgggaactaagaacctgtgtgtcgaggtggccgacctcgtgtccatcctggtgcacgccgacaccccactgcccgcttggcaccgggcacagaaagatttcttgtcagggctggatggtgaggggctgtggtcccctggctcacaggttagtacagtctggcacgtgtttcgagcccaagacgcgcagcgtatccggcggttccttcagatggttcaaggacttgtctcaaccgtcagtgtcactcagcactttctcagcccggagacgtctgcactctccgcccagctgtgccatcagggcccctccctgccaccagattgtcacctgctctatgcccaaatggactgggcagtcttccaggctgttaaagtcgccgttggaaccctgcaggaagccaaatag

SEQ ID NO: 190233 - DNA, 3570 bp, Artificial Sequence
  Description of Artificial Sequence: Synthetic coding sequence
atggagagcacccccagcttcctgaagggcacccccacctgggagaagaccgcccctgagaacgggatcgttaggcaggagcccgggtccccacccagagacggactgcatcacggaccactctgcttgggcgagcccgctcctttttggcgaggggtgctttccacgccagatagttggctcccccctggtttcccacagggtccgaaggatatgctacccctggtggagggcgagggaccacagaatggggaacggaaggtcaactggctcggcagcaaggagggactcaggtggaaggaggcaatgctcacacatcccctcgccttttgcggccccgcctgtcccccacggtgtggacctcttatgccagaacacagcggcggtcatttgaagagtgacccggtggcatttcggccatggcattgtcctttcctgcttgaaaccaagattctcgaacgcgctccattctgggttcccacctgcctaccaccttatctggtttccggactgccgcccgagcacccttgcgattggcccttaaccccccacccctgggtttactctggtggacagccgaaggttccttcggccttcagcctaggcagtaaaggcttctactacaaggaccccagtatcccacggttagcgaaggaacccctcgctgctgcagagccaggtctattcgggttaaatagtggaggacaccttcaaagggctggggaagcggaaaggcctagcctgcatcagcgcgatggtgaaatgggcgctggccggcagcagaatccatgtccgttattccttggccagcctgatactgttccctggacttcttggccagcttgtcctccaggcctggttcacaccttggggaatgtatgggctggaccgggcgacggaaacctgggctaccaactgggaccccccgcaacgcctcggtgtccgagccctgaacctcctgtgacccagagagggtgctgctctagttatcctccaacaaaaggtggggggttgggcccttgcggcaaatgccaagaaggcctggaagggggggcaagtggagcttccgagccttctgaagaagtaaacaaggcgtcgggcccgagggcctgccccccatctcatcataccaagctgaaaaagacatggttgacgcgccacagcgaacagtttgagtgcccacggggctgtccggaagttgaggaaaggcccgttgcacgcttacgagcactcaagcgagctggatctccggaagtgcagggcgctatgggctcacccgccccaaaacgcccccccgacccttttcctgggacggctgagcagggagccgggggctggcaagaggtccgtgacaccagcattggcaacaaggatgtggattcggggcaacacgacgaacaaaaggggccccaggatgggcaagccagtcttcaagaccccgggctacaggatatcccctgcctcgctttacctgctaagctggcccaatgtcagtcgtgcgcacaggcggctggtgaaggtggcgggcatgcatgtcacagtcagcaggttcgcaggagtccgctggggggcgaacttcaacaggaagaggacaccgccacaaacagtagctctgaagaaggccccggctctgggcctgatagtcgattaagtaccggtcttgcaaaacatttactgtctgggctgggcgacaggttatgtagattgttacgtcgcgagcgcgaagcactggcctgggcccagagggagggtcaggggcccgccgtgacagaggactctcccgggataccccgttgctgcagcaggtgccatcatgggctcttcaacactcattggcgctgcccccgctgcagtcacaggctgtgcgtcgcctgtgggcgggtagcaggtactggccgcgcgagggaaaaggcaggattccaggagcagtccgcggaggaatgtacacaagaggcggggcatgccgcctgttctctaatgctgacacaatttgtgtctagtcaggctcttgccgagctgagcaccgcaatgcaccaggtgtgggtgaagtttgacatcagaggacattgcccatgtcaagctgacgctcgcgtatgggccccaggggatgccggtcagcaaaaagagtcaacgcagaagaccccccctacccctcagccaagctgtaacggtgacactcatagaacaaagtccattaaagaagagacccccgacagcgccgaaactccggctgaagaccgggctggccgaggtccccttccatgcccatccctatgtgagctgcttgcctcaacggcagtgaagctgtgcctggggcacgaacgcattcatatggctttcgcccccgtgacacccgcactccccagcgatgatcggatcaccaatattctcgatagtattattgcgcaggtagtcgaaaggaagatacaggaaaaggcacttgggccaggactccgtgccggccccggacttcgtaaaggactcggcctgcctctatcgcccgtgaggccacgactgcccccccccggcgctctgctctggctgcaggaacctcaaccatgtcctaggcgggggttccatctctttcaggagcattggaggcagggacaaccagtgctggtttcggggattcagcggaccctgcaagggaacttgtgggggactgaagctctgggggcattgggaggccaagtccaagccctctctcctctgggccccccacagcctagctccctcggttccactaccttttgggagggtttcagttggccagaactgcgacccaagagtgatgaaggctcagtgttactgctgcatcgtgcgctgggagacgaggatacctctagggtggaaaatctggcagcatctcttccgctgcccgagtactgcgctctacatggcaagctgaatctggcgtcttacttaccacctggccttgcgctgagacctctggaaccacaactgtgggccgcttatggagtgtcgccacaccgaggacatctgggaacaaagaatctgtgtgttgaagtggctgatcttgtctccatactggttcatgctgacactccacttcctgcctggcatagggcacagaaggacttcctctccggcctggacggggaaggcctctggtcacccggttcgcaggtgagcaccgtgtggcatgtgtttcgggcccaggacgcccagaggatccggcgattcctacaaatggtttgccccgccggggccggtgcccttgaaccgggcgcccctggatcttgttacttggatgcaggactccgcagacgcctccgggaagagtggggagtttcttgttggacgctgttgcaggcgcccggggaagccgtgctcgtgcccgctggcgcaccacatcaggtccaaggtctggtgtcgacagtcagcgtgactcagcatttcttgagtccagagactagtgccttgtccgctcagctgtgtcatcagggaccaagtctgcctccggattgtcacctgctgtacgcccaaatggactgggccgtgttccaagccgttaaagtggccgtcgggacccttcaggaggctaaatag

SEQ ID NO: 190234 - DNA, 1410 bp, Artificial Sequence
  Description of Artificial Sequence: Synthetic coding sequence
atggccagcccccgggagctgacccagaaccccctgaagaagatctggatgccatacagcaatgggcgcccagcacttcacgcatgccaaagaggagtttgtatgaccaattgtcccaccctcatagtcatggtcggactgcccgcaagggggaagacctatatcagtaagaagttgacacggtacctgaactggattggagtaccgacacgcgagttcaacgtggggcagtatcggcgggatgttgtcaagacctacaaaagtttcgagtttttcctgccagacaacgaggaggggctcaagatccgaaagcaatgcgctctagccgccctccgcgacgtgcggcggttcttgtctgaagagggcggacacgtggcggtgttcgacgccaccaataccaccagggaacgccgagccacgatattcaattttggtgagcagaacggctacaagacattcttcgtggagagcatttgcgtggatcccgaggtgatagccgccaatatcgtccaggtgaaactcggctcacccgactacgttaacagagatagcgacgaggctactgaggatttcatgagacgaattgagtgctacgaaaactcttacgagagcctggacgaagatctggacagagacctttcctatattaaaatcatggatgtgggccagtcttatgttgtgaacagagtggccgaccatatccagtctcggattgtttactatttaatgaatattcacgttacaccaagatctatttatttatgcaggcacggtgagtccgagttaaacctcaagggcaggattggcggagacccggggctgagcccccgtggtcgtgaatttgccaagagtttagctcagtttatttcggaccaaaacatcaaggatctgaaagtgtggaccagccagatgaaaaggactatccagactgctgaagcactcggcgtcccttacgagcagtggaaggttctgaacgaaatcgacgcaggagtatgcgaagaaatgacatatgaggaaatccaggacaattacccactcgagttcgctttgcgagatcaagataaataccgctaccgttaccctaagggggaatcctacgaagacttggtacagcggctcgaaccggtgataatggagctggagcgccaagagaacgtcctcgtaatctgccaccaggccgtaatgaggtgcttactcgcctattttctcgataaggcagccgaacagctgccctatctgaaatgccctcttcatacagtgctgaagttaaccccagtagcctatgggtgtaaagtggagagtatcttcctgaacgtcgctgctgtcaatacgcaccgagatcgcccgcagaacgtggacataagcagaccccccgaagaggcactcgtgacagtgcctgctcaccagtag

SEQ ID NO: 190235 - DNA, 522 bp, Artificial Sequence
  Description of Artificial Sequence: Synthetic coding sequence
atgggcctgccccggcgggccggcgacgccgccgagctgcggaagtcacttaagccactccttgagaaaagacgtagggcacgcattaatcaatcgctatcacaactaaagggcttgatccttccacttctggggagagagaacagcaattgttcgaagcttgaaaaggctgacgttctagagatgaccgtcagatttctgcaagagctgcctgcgagtagttggcccacagccgcacccctgccctgcgattcctaccgggaaggatattccgcctgcgtagctcgcctcgctcgcgtcctgccagcctgtagggtgctggagcccgccgtatctgcccggctcctggagcacctgtggcggagggctgcatccgccacgttggacggcggccgggccggagattcaagtggaccatcggcacctgctccagccccagctagcgcccctgaacctgcctctgctcctgttccatcaccccccagccctccctgtggtccagggctatggagaccatggtag

SEQ ID NO: 190236 - DNA, 231 bp, Artificial Sequence
  Description of Artificial Sequence: Synthetic coding sequence
atgggcctgccccggcgggccggcgacgccgccgagctgcggaagtccctcaaacctctgctcgagaaaagaaggcgggcaaggatcaatcagtctctcagtcagctgaaaggactaatattgccgctgctcgggcgcgaggacgcctccggctggcatacttggctgccgctgcacgcgcagaactgttttctcctctatatacaggcacccgagcagccccctgcgtag

SEQ ID NO: 190237 - DNA, 231 bp, Artificial Sequence
  Description of Artificial Sequence: Synthetic coding sequence
atgggcctgccccggcgggccggcgacgccgccgagctgcggaagtctctgaagcctttattagagaagcgccggagggcaagaataaaccagagcctctcccagttaaaaggcctcattctgcctctgttaggaagagaagacgcgtctggctggcacacttggctcccactacatgcgcagaactgcttccttctgtatatccaagctccagagcaacccccagcttag

SEQ ID NO: 190238 - DNA, 561 bp, Artificial Sequence
  Description of Artificial Sequence: Synthetic coding sequence
atggagaagaagcggcgggcccggatcaacgtgagcctggagcagctgaagtcactcctcgaaaagcactacagccatcagattcggaagcgaaaactggagaaggccgatatattggagctctctgttaagtatatgcggtcactgcagaactctctccagggtctttggccagtgcctaggggtgcggagcagcccagcgggtttcgcagctgccttccaggtgtgtcacaactcctccggagaggtgacgaagttggcagtgggctacgatgtcctctagtaccagagtctgcagctgggtccactatggattccgccgggctcggacaagaagcaccagctctgtttcgaccatgtacaccagccgtatgggctccagcccccgcagccggtggcccccgctctccaccaccactgctgctgctgccagagagcctcccaggctctagcgcttccgtgcccccaccccagccagcctcttctagatgcgcagagagcccaggcttgggcctgcgcgtttggcgcccatgggggagtcccggggacgaccttaattag

SEQ ID NO: 190239 - DNA, 666 bp, Artificial Sequence
  Description of Artificial Sequence: Synthetic coding sequence
atggccgccgacacccccggcaagcccagcgccagccccatggccggggctccagcttccgccagtcgaacaccagataagccacggagtgccgctgagcatcgtaagagcagtaagcccgttatggaaaaaaggcgtcgggcgcggattaatgaaagcttagcccaactgaagactctcattctcgatgccctgagaaaagagagctcaaggcactcgaagctggagaaggctgatattctagagatgacagtccggcacttacgaagtctgaggagagtgcaggtcactgcggctctgagcgcggatcctgcagttctcgggaaatatcgcgcaggatttcacgaatgcttagccgaagtgaaccggttcctcgcaggttgcgagggagtcccagctgatgtacgctctcgcctgctgggccacctcgcggcctgcctgcgacagctgggcccgtcacggcgtcccgcgtcactgtcgccggccgcccccgccgaggccccagctccagaggtgtacgcgggaagacctctgttgccctccctgggtggccccttccccctgttagctccgccactcctccccggtttaacacgagccttgcctgccgctcctcgcgccggcccacagggtcccggcggcccgtggaggccgtggctgagatag

SEQ ID NO: 190240 - DNA, 744 bp, Artificial Sequence
  Description of Artificial Sequence: Synthetic coding sequence
atggccgccgacacccccggcaagcccagcgccagccccatggccggagctccagctagtgctagtaggaccccagacaaaccccggagtgccgctgagcaccggaaggtagggtcacgccccggcgtgaggggggctaccggcggccgagaagggaggggcacacagcccgtccctgatcctcaatcttcaaaacctgtgatggaaaaaaggcggcgtgcccgaattaatgagtcactggcccagctcaagactctgatcctggatgctttgaggaaggaatcttcccgccacagcaagctggagaaagctgacattctagagatgaccgtaaggcacctgagaagtctcagacgcgtccaagtgactgcagccttgtctgccgatcccgcagtgctgggcaagtaccgcgcagggttccatgagtgtctggctgaagtgaatcgttttctggctgggtgtgagggggttcctgctgacgtgcgatcacgtctcctgggccacctcgctgcttgcctgaggcaactaggtccctctagacgcccagcctccctgagtcctgctgcccctgctgaggcccctgcccccgaagtatatgctgggagacctctgctgcccagcctaggaggcccttttcctctgctcgccccccccttgcttcctgggctgacacgtgctttgcctgccgccccacgtgcaggcccccagggccccggaggtccttggcgaccctggcttcgctag

SEQ ID NO: 190241 - DNA, 501 bp, Artificial Sequence
  Description of Artificial Sequence: Synthetic coding sequence
atggcccccagcaccgtggccgtggagctgctgagccccaaggagaaaaacagactgcgtaagcctgttgtcgagaagatgcgccgggaccgtattaattcatcgatcgagcaactcaaactccttcttgaacaggaatttgcacgccaccagccaaattccaagctggagaaagcagatatcctcgagatggccgtgagttatctcaagcactccaaggcttttgtcgccgcagctggacccaagtcactgcaccaggactactctgaagggtattcctggtgcctccaagaggccgtgcagttcctcactctccacgcagccagtgatacccaaatgaagctgctctaccactttcagaggcctcctgccgcacccgccgcaccagccaaggagcctaaggcgcccggagccgcaccacctcccgcgctgtccgctaaagctaccgcagctgcagctgctgcccaccaaccggcttgcggtctgtggcgtccatggtag

SEQ ID NO: 190242 - DNA, 675 bp, Artificial Sequence
  Description of Artificial Sequence: Synthetic coding sequence
atggccccccccgccgcccccggccgggaccgggtgggccgggaggatgaagacggatgggagacccgcggagacaggaaagcaaggaagcccctggtcgaaaagaagcgcagggctcgcattaacgagtccctgcaggaattgcgcttgctcttagctggcgccgaggtgcaggccaagttggaaaacgcagaagttctggagctgaccgtgaggagagtgcagggcgttctgcgggggcgagcccgagaacgtgaacagttacaggcagaggcatctgagcggtttgcagccggctacattcagtgcatgcacgaggtgcacacattcgtgagcacctgtcaggcgattgacgctactgttgccgctgaactcttgaaccacctgctcgaatctatgcccctcagggagggctcctcattccaggatctgttgggggacgccttggccgggccacctagagctccagggcgctcaggttggcctgccgggggggccccgggcagccctattcccagcccccctggcccaggggacgacttgtgctccgacttggaggaagcccctgaggccgaattatcccaggccccggctgaagggcctgacctggtcccggctgccctcggtagcttgactactgctcaaatcgctagatccgtttggaggccttggtag

SEQ ID NO: 190243 - DNA, 645 bp, Artificial Sequence
  Description of Artificial Sequence: Synthetic coding sequence
atggccccccccgccgcccccggccgggaccgggtgggccgggaggacgaggacggttgggagaccagaggcgacagaaaggccaggaagcctctagtagaaaaaaaaagacgggcccgcatcaatgagagtcttcaagagcttcggctacttctcgctggggcggaagttcaggctaagctcgagaacgccgaggtgctcgagcttaccgtgcgtcgggtgcagggagtgcttcgtggcagagcccggggtgagtggaggcgagggggacgcgggagacgcccccgagcccctgtgacacccgcgagaagacgcacatctctacccgctccactgagctgcaggcgcagaggtctgccacctgaacagggtgcacccccaaggctgctgggggagccacgaccacgggggcccggggggttgggccacgccgtggccgcccatcgcgcggggcgcggatcactccctccaacactgggcccgcgcgctcgcgcggctgccggcggcagcgagagagccttgcgctgcagactccacccagtccatgcccgcggcgcgcatgtgcgggttcatgtaccagggcaccggaggtacagaaggtgtagagcacccgagccttcagctcgggtccacgccgcagcctag

SEQ ID NO: 190244 - DNA, 669 bp, Artificial Sequence
  Description of Artificial Sequence: Synthetic coding sequence
atggccccccccgccgcccccggccgggaccgggtgggccgggaggatgaggatggatgggagacacgcggagatcggaaagccaggaagcccctggtggaaaagaaaaggagggctcgcatcaatgaaagcctccaagagctgcgcttgctgctggccggggctgaggccaagttggaaaacgccgaggtgctcgaacttacagtgaggcgggtgcaaggagtactgagaggaagggcgcgcgagcgcgagcaactgcaggctgaggcctcagaacggttcgctgctgggtatatccaatgtatgcatgaggtgcacaccttcgtctccacctgtcaggccattgacgcgaccgttgctgccgaactcctcaatcacttgctggaaagtatgcccctgagggaggggagttctttccaggatctgctgggggacgctctggcagggccacctagggcccccgggcgatccggctggcccgccggaggagctcccggaagtcccatacctagtcctcccgggcctggggatgatctatgctccgatctggaggaggctcccgaggccgagttgtcacaggctcccgccgaaggacctgacttagtgcctgcggccctaggttctctgaccacagcacaaatcgcgagatcagtgtggagaccatggtag

SEQ ID NO: 190245 - DNA, 678 bp, Artificial Sequence
  Description of Artificial Sequence: Synthetic coding sequence
atggtgacccgggaccgggccgagaaccgggacggccccaagatgctgaagccgctggtggaaaaaagaaggcgcgataggattaaccgttcgctggaggaacttcgtcttctgctcctagagcgcacccgagaccaaaacctgcgcaatcctaagcttgaaaaggccgaaatacttgagtttgccgtgggttatctgcgcgaacgctctcgcgttgaacctcctggagtgcctcggagcccggtacaggacgcagaggcattagcgagctgctacctgtctggtttcagagagtgcttgctgcgcctggcagcgtttgcacacgacgctagtcctgccgcgcgtgcgcaattattttccgcgctgcatggatacctgagacccaaacccccccgccccaaacctgtggatccacgacctcctgccccacggccttccttggacccagcagcacctgctctcggaccggctctccaccagaggcctcctgtccatcagggccatccatcccctagatgcgcatggtcccccagcctatgctcccctcgggcaggagattccggcgctcctgcaccgctgacaggcttgcttccgccgccccctcctcctcatcgacaagatggcgctcctaaagctcctctgcctccaccaccagcgttctggcggccctggccatag

SEQ ID NO: 190246 - DNA, 693 bp, Artificial Sequence
  Description of Artificial Sequence: Synthetic coding sequence
atggtgacccgggaccgggccgagaaccgggacggccccaagatgctcaagcccttggtcgaaaagagaaggagagaccggatcaacaggtctctggaagagctccggttactgcttctggagaggacaagggaccagaatcttcggaacccaaaactggaaaaagcagagattctggagttcgccgtaggttacctgcgtgaacggagccgagtggaaccacctgccgcagcagcccctggtgtcccaaggtctcccgtgcaagacgctgaggcacttgcatcatgttacctgtctggatttcgtgaatgccttctgcgtttggctgcttttgcccatgacgcttccccagctgccagggcccaactcttttcggctctacacggctacctgagacccaaaccacctcgcccaaagcccgttgatcccaggccacccgcaccacgaccatcactggaccccgccgctcctgccctgggacctgccctgcatcagcggccaccagtgcatcaggggcatcctagcccccgctgcgcatggtcaccctctctgtgctcaccccgggcaggtgactccggggcacccgcccccctgactgggttgctcccacccccccctcctccccaccgacaagacggtgcacccaaggcacctctgcctccacctcctgcattctggcgcccgtggccttag

SEQ ID NO: 190247 - DNA, 1014 bp, Artificial Sequence
  Description of Artificial Sequence: Synthetic coding sequence
atgaagcggccctgcgaggagaccaccagcgagagcgacatggacgagacaattgatgtaggatcggaaaataattacagcgggcagtctacctcaagcgtgatccgcctgaactcaccaaccactaccagccaaatcatggcaaggaagaaacgtaggggcatcatagagaaacgacgccgagatcgtatcaataactctctctctgaactccgccggttagttccgacagcttttgaaaaacagggttctgcaaaacttgagaaggccgagatccttcagatgacagtcgaccacctgaaaatgctacaggcaactggcggaaagggttacttcgatgcccacgcccttgctatggatttcatgagtataggctttagggagtgcctgaccgaggttgcccgctacctttcatccgtggagggcctggacagctcagacccgcttcgggtgcgactggtaagccacctgtcaacatgcgcaacgcaaagagaagccgccgctatgaccagctcgatggctcaccaccaccacccattgcaccctcaccattgggccgccgctttccaccatctgcccgctgcactgctacaaccgaacggccttcacgcatccgaatcaacgccttgtaggctgagcaccacgtcagaggtcccccccgcacatggctccgccctgttgactgccacctttgcccatgcagacagtgcactgcggatgccttcaactggttcagtcgccccatgcgtgccacctctgtcaacatcactcctgtctctttccgcaaccgtgcacgctgccgcagccgctgcgaccgctgctgctcactcttttccactgtcctttgctggagccttcccaatgctcccccccaacgcagccgcagcagtcgccgcggctaccgctatctcaccgcccctgtctgtgagtgccacgagctccccgcaacagacgtcttctggcactaacaacaaaccatatcgcccctgggggaccgaggtgggagccttttag

SEQ ID NO: 190248 - DNA, 876 bp, Artificial Sequence
  Description of Artificial Sequence: Synthetic coding sequence
atggcccggaagaagcggcggggcatcatcgagaagcggcggcgggaccggatcaacaattccctctctgagctccggcggctcgttcctacggctttcgaaaaacagggtagtgctaagttagaaaaggcggagatcctgcagatgacggtcgaccatcttaaaatgttgcaggccacagggggcaagggctactttgatgctcatgcactggcaatggattttatgagcatcggctttagggagtgcctcactgaggtcgcaagatatctatcttcagtggaagggttggatagctcagatccacttagggtgaggctcgtgtctcacctttcaacatgcgcaacacagcgcgaggcagcggcgatgactagctccatggctcaccatcatcatcccttgcatccgcaccactgggccgctgctttccatcacttaccagcagctttgctccagcctaacggcctgcacgcatcggaaagtaccccttgccggctgagcactactagtgaagtgcccccagctcacggaagcgccttgctcaccgccacctttgcccacgccgactccgcgctacggatgcccagcaccggatctgtcgcgccttgcgtcccaccgctttcaacatctctgctgagcctgtcagccacagttcacgcggccgccgctgctgcaaccgctgctgctcactcctttccattaagctttgctggggctttccccatgctccctccaaatgctgccgcagccgttgcagccgctacagcgatctcaccccccctgtctgtgtctgctacttcctcacctcagcagacttctagtggtacaaataacaagccatatcgtccgtgggggacggaagtgggggccttctag

SEQ ID NO: 190249 - DNA, 1221 bp, Artificial Sequence
  Description of Artificial Sequence: Synthetic coding sequence
atgagcgccctgggcgccgtgatcgccctgctgctgtggggccagctgttcgcagtcgactctggtaatgacgttacagatatcgcagacgatggctgtcctaagccacctgagatcgcccacggatacgttgaacacagcgtgcgctatcaatgtaagaactattataaactgaggaccgagggagacggggtctacactctgaatgataagaaacagtggatcaataaggcagtgggagacaaactccccgagtgcgaagccgacgacggttgccctaagcccccggaaatagctcacgggtatgttgaacactctgtgagataccagtgtaaaaattactataagcttcgcacggagggggatggggtatacacattaaacaacgagaagcagtggattaacaaggctgtgggcgacaaattgcctgaatgcgaagccgtttgtgggaagcccaaaaaccctgcgaacccggtccagcgcattctaggtggccatttagatgctaagggtagcttcccatggcaggctaagatggtgagtcaccacaatctcactacgggggccaccctcatcaacgaacagtggctcttgactacagccaaaaacctctttttaaatcacagtgagaacgccacagccaaggacattgctcctaccctgacgctgtacgtcggcaagaaacagttggttgagatcgaaaaagttgtgctgcaccctaactattctcaggtcgatatcgggctcatcaagctcaaacagaaagtcagcgtgaacgagcgggttatgcccatctgtctgcctagcaaggactatgctgaggtgggccgggttggatatgtgagtggatggggaaggaacgcaaacttcaagtttacagatcacctaaagtacgtgatgctcccagtggcagatcaggatcaatgcattcgtcactacgagggtagcaccgtgcccgagaaaaagacaccaaagtctccagtaggagtgcaacctattttaaacgagcacacattctgcgcagggatgagcaaataccaggaggatacttgttatggcgatgctggtagtgcatttgctgttcatgacctggaggaggatacctggtacgctacaggaattcttagctttgataaaagttgcgctgtggccgagtacggggtgtacgttaaagtgaccagcattcaggattgggtgcagaaaaccattgccgagaattag

SEQ ID NO: 190250 - DNA, 1149 bp, Artificial Sequence
  Description of Artificial Sequence: Synthetic coding sequence
gtgtacgcctgcgtgtgcgtgtgcgtgtacatgcacgtgtgcgtggacgcctgtatgtgctgtgaagctggacgtctggccttccatagctccctttcttccctttgctctgctctgggtgcggttatagccctgctgctgtggggacagttattcgcagtagacagtgggaatgatgtgacagacatcgcggatgacgggtgcccgaaacctccagaaatcgcccatggttatgtagagcattccgtgcggtatcagtgcaagaactactataagcttaggacagagggagacggagtttacactctgaacgacaagaaacagtggatcaataaagcagtcggggataaactgcctgagtgtgaagcagtgtgtggcaagcccaagaatcctgcgaaccccgtgcagcgcatcctgggcggacacctcgacgctaaggggtcctttccttggcaggcgaagatggtctctcaccacaatctcaccacaggcgcgacgctcataaacgaacagtggttactgaccaccgccaaaaatctgtttctcaaccacagcgagaatgccaccgcaaaagatatcgcgccaaccctaacactatacgtcggaaagaagcagctcgttgaaatcgagaaggttgttctccacccaaactattcccaggttgatattggactgattaagttaaagcagaaggtaagcgtgaatgagcgcgtaatgcctatctgcctgcctagcaaagattatgccgaagtgggaagggtgggttacgtgtccggttgggggaggaacgccaacttcaaattcacagaccacctcaaatacgttatgctccctgtcgcggatcaggaccaatgtattaggcattatgaagggagtactgtgccagagaaaaagaccccaaagtcccctgtcggcgttcagccgattctcaatgagcacacattttgcgctggcatgtccaagtatcaggaggatacttgctatggcgacgcgggttctgccttcgccgtgcacgatttggaggaagacacatggtatgcaacaggcattctgagtttcgacaagtcatgtgccgttgctgagtatggcgtgtatgtgaaggtgacatccattcaggactgggtgcagaagactatcgccgaaaattag

SEQ ID NO: 190251 - DNA, 1044 bp, Artificial Sequence
  Description of Artificial Sequence: Synthetic coding sequence
atgagcgccctgggcgccgtgatcgccctgctgctgtggggccagctcttcgctgtcgattctggaaacgatgtgactgatattgctgatgatggttgtcccaaaccccctgaaatcgcgcatggctatgtagaacattcggttcgctaccagtgcaagaattattataaactccggaccgaaggcgatggcgtctacactcttaacaatgaaaaacaatggatcaacaaagccgtgggcgacaagttgcctgagtgtgaggccgtgtgcggtaagcctaaaaatcctgccaatccagtccagagaatcttggggggacacctagacgctaaaggctccttcccttggcaagccaaaatggtttcccatcataacttgactacaggcgccactttgatcaacgagcaatggctccttacaactgccaagaatttattcttgaaccactctgaaaacgccaccgccaaggacatcgcacctaccctgactctgtatgttggcaagaagcagctggtagaaatcgagaaggtagttctgcacccaaattactcccaagttgatataggcctcatcaagcttaagcagaaggttagtgtgaacgagcgcgttatgcccatctgccttccctccaaagactacgctgaggtggggcgggtcggatacgtgagcgggtggggccgcaacgcaaactttaaatttaccgaccacctcaagtacgtcatgctgcccgttgcggatcaggatcagtgtataagacactatgaaggcagtacagtccccgaaaagaagacccctaaaagccccgtgggcgtgcaacccatcctcaacgaacacacgttctgcgccggtatgtcaaagtaccaggaagacacttgttacggtgacgctggctcggcctttgccgtgcatgacctcgaggaagacacttggtacgcgaccggtattctgtcttttgataaatcatgcgccgttgccgaatacggggtttacgtgaaagtaacctcaatccaggactgggtgcagaagaccatcgcggaaaactag

SEQ ID NO: 190252 - DNA, 846 bp, Artificial Sequence
  Description of Artificial Sequence: Synthetic coding sequence
atgagccggatcagccagatgaccgccgcccggagccccccccggctacacatggccatgtggagcactagattcgcgacctcagtacggaccaatccagtgcaacggatcctgggaggacacctagatgccaaggggagctttccctggcaagcaaagatggtgtcccaccataacctgaccacgggtgcaactctcatcaacgaacaatggttattgaccactgccaaaaacttatttctcaaccattccgagaacgcaaccgctaaagacatagcacccacgctgacgctctatgttgggaaaaagcaactggtggaaatcgagaaggtggtactgcatccgaattacagtcaagtagatatcggactcatcaaactgaaacagaaagttagcgtcaatgaaagagtgatgccaatatgccttccaagcaaagactatgcagaggtgggcagagttggctatgtgtccgggtggggacgtaatgccaactttaaattcactgaccatttgaaatatgtgatgctgccagtggcagatcaagatcagtgcatacgacattatgaggggtcgacagtccctgagaagaagacccccaaaagtcccgtgggtgtccaacccattctcaacgagcacaccttctgtgctggcatgagcaaataccaagaagatacctgttacggtgacgccggaagcgccttcgctgttcatgaccttgaggaggatacctggtacgccaccggaatccttagctttgataagagttgcgccgtcgccgaatacggcgtgtatgtcaaagttacatcaattcaggattgggttcagaagaccattgcggagaactag

SEQ ID NO: 190253 - DNA, 552 bp, Artificial Sequence
  Description of Artificial Sequence: Synthetic coding sequence
atgagcgccgcccgggagagccacccccacggcgtgaagcggagcgcctcccctgacgatgatttaggaagctccaattgggaggccgccgacctcggtaatgaagagcgcaagcagaagtttttacggttgatgggtgccggtaagaaagagcataccggacggttagtcataggtgaccataaaagcactagtcattttagaaccggcgaggaagacaagaaaataaacgaagaacttgagagtcagtatcagcagagtatggacagcaaactatctggcagatatagaagacattgcggcttaggcttctcagaagttgaggatcatgatggagaaggagacgtcgctggggacgatgacgatgacgacgacgactctccagatccagaaagtcccgacgacagcgagagcgacagcgaaagcgagaaggaggaatctgccgaggaactccaagctgcagagcatcctgatgaggtggaagatccaaagaataaaaaggatgctaaatcaaattataaaatgatgtttgtaaaaagtagtggctcttag

SEQ ID NO: 190254 - DNA, 1047 bp, Artificial Sequence
  Description of Artificial Sequence: Synthetic coding sequence
atgagcgacctgggcgccgtgatcagcctgctgctgtggggccggcaactcttcgcactgtatagcggtaacgacgtaacggacatctccgacgacagatttcccaaacctcccgagatcgcaaatggttacgtggagcatctgttcaggtaccagtgcaagaattattataggctgaggacagagggtgacggcgtgtacacactcaacgacaaaaaacagtggattaataaggcggttggcgataagctgcccgagtgcgaagcagtttgtgggaagccaaagaaccctgcaaaccctgtgcaaagaattcttggcggccacctcgatgccaaggggtcgttcccctggcaagcaaagatggtcagtcatcataacttgaccactggcgccactcttattaatgagcaatggctgctcacgacagcgaaaaacttattcctcaaccacagcgaaaatgctacagcgaaagacattgcgcctaccctcacactctacgttggaaaaaaacagcttgtagaaattgaaaaggtagttctgcatccaaattatcatcaggtggacatcgggttaataaagctgaagcagaaagtgctcgtgaatgaacgggtgatgcctatttgtctgccctccaagaactacgcggaggtcgggcgcgttggatacgtgagtggctggggccagagcgataactttaagctcacagatcatctgaagtacgtgatgctgcctgtggccgaccagtacgactgcattactcattacgagggctcaacttgccccaagtggaaagctccaaaatcccccgtaggcgtccaacccatcctcaatgagcacaccttctgcgttgggatgagtaagtaccaagaagacacctgttacggggatgcaggatctgcctttgctgtgcacgacctggaggaagacacatggtacgccgctgggatcctcagctttgataagtcttgcgctgtcgccgaatacggcgtttatgtaaaagtgacatctatccagcactgggtgcagaagacaatagccgagaactag

SEQ ID NO: 190255 - DNA, 1047 bp, Artificial Sequence
  Description of Artificial Sequence: Synthetic coding sequence
atgagcgacctgggcgccgtgatcagcctgctgctgtggggccggcaactgttcgccctatactccggaaatgatgtgacagatatcagtgacgatcggtttcctaaaccaccagaaatcgcaaatggttatgtcgaacacctcttccggtaccagtgcaaaaactactatcgactccgcacagagggcgacggagtttacacactgaacgacaagaaacagtggatcaataaggcagtcggagacaaactgcccgaatgtgaggctgtgtgcggaaagccaaagaaccccgctaaccctgtgcagaggatactgggggggcacctcgacgctaagggtagttttccatggcaggccaagatggttagccatcataacctcaccacaggagcaaccctgatcaatgaacagtggctcctgactactgccaagaatctttttctgaaccactccgaaaacgccactgcaaaagatatcgcgcctacacttacactctacgtgggcaagaagcagcttgtggagatcgagaaggtcgttcttcaccccaactatcatcaggtagacataggccttattaagttaaagcagaaggttcttgtcaacgaaagagtcatgccgatttgtctgccatctaaaaattacgccgaagtgggccgggttgggtatgttagcggttggggccagagcgataattttaagttaacagaccacttaaaatatgtgatgctgcctgtagcagaccagtacgattgcataacgcactacgaaggcagtacatgtcccaaatggaaggccccaaaatcccctgtcggagtccaacccattctgaatgaacatacattctgtgttgggatgtctaaatatcaagaggacacttgttatggggatgctggctctgcgtttgccgtccacgatttagaggaagacacatggtatgcagcaggcatcttgagcttcgataaatcgtgtgctgtggcggaatatggcgtatatgtgaaggtcaccagcattcagcattgggtccaaaagactattgccgaaaactag

SEQ ID NO: 190256 - DNA, 615 bp, Artificial Sequence
  Description of Artificial Sequence: Synthetic coding sequence
atggccgccgccaacccctgggaccccgccagcgcccccaacggcgctgggctggtgctcggccactttattgcatctggcatggtcaaccagaaaaaccttgaaattgagttgctgaagctggagaaggacactgccgacgtggtgcacccctttttccttgcccagaaatgccatacactgcagagtatgaacaatcatttggaagctgtcctgaaagaaaagcggtctctgaggcagagattgttgaaaccgatgtgccaagagaacctgcctatcgaggccgtgtatcacagatacatggtccacttgctggaactggcggtgacttttatcgagcgactggaaacccaccttgagaccatacgcaatattccacacttggccgccaatctgaagaagatgaaccaggcactggctaagatggatatcctggtgacagaaaccgaagagctcgcggaaaacattcttaaatggaggaagcagcagaacgaggtctctagttgtattcccaagatcctagctgaggagtcctacctttataaacatgacatcattatgcccccactgcctttcacctcaaaagtccatgtgcagaccattaatgctaagtag

SEQ ID NO: 190257 - DNA, 837 bp, Artificial Sequence
  Description of Artificial Sequence: Synthetic coding sequence
atggagccccaggaggagcgggagacccaggtggccgcctggctgaaaaagatatttggtgaccaccccatcccccaatacgaagtgaacccacggactaccgagattctgcatcatctctccgaaaggaacagagtgcgagatagggacgtgtacctagtgatcgaggacctcaaacaaaaggcgtcagaatatgagagtgaagccaaatacctgcaggacctgcttatggagtcagtgaatttcagtcctgccaacctgagcagcaccgggtctcgatacctgaatgctctggttgattcagctgtcgctctggaaaccaaggatacttcgttggcgtcgttcatccccgcagttaatgacttgaccagtgacctgttcagaaccaagtccaagagtgaggagattaagatcgaacttgagaaattggaaaagaatctgactgcaactctggtgctggagaaatgtctccaggaagatgtcaaaaaagctgagctccatctcagcactgagcgcgcaaaggtggacaaccgcaggcagaacatggactttttaaaagctaaatccgaagagttccggtttggcatcaaagccgcagaggagcagttgtctgctaggggtatggatgcttccttgagccaccaatctctggtagccctgtccgagaaactcgcaagactcaaacagcagaccattccgctgaagaagaagctcgaatcttaccttgacctgatgccaaacccttccctcgcgcaagtcaaaattgaggaagctaaacgggaactggatagtatagaagccgagctgacaaggagggttgatatgatggagctgtag

SEQ ID NO: 190258 - DNA, 708 bp, Artificial Sequence
  Description of Artificial Sequence: Synthetic coding sequence
atggccgccgccaacccctgggaccccgccagcgcccccaacggcgctgggctggtattgggacacttcatcgcttcaggcatggtgaaccaggaaatgttaaacatgtctaaaaagaccgtctcatgcttcgtcaacttcacccggctgcagcaaattactaacattcaggccgaaatttaccagaagaaccttgagatagaactcctgaaactggaaaaagataccgcagatgtggttcacccctttttcttggcccaaaagtgtcatacacttcagagtatgaataatcaccttgaggccgtcctgaaggagaagcgtagccttcgacagagactactcaagccaatgtgtcaggagaacctgccaatcgaagctgtgtatcatagatacatggtgcatttgctggagctcgccgtgacctttatcgaacgacttgagacacatctggagacaattcgaaacatccctcaccttgccgccaacctgaaaaagatgaatcaggctctcgctaagatggacatccttgttacagagacggaggagttggcagagaatatcttaaagtggaggaaacagcaaaatgaggtgtcatcttgtatccctaaaattctagcagaggagtcttacctgtacaaacatgacatcatcatgccccctctgccgtttacatccaaggtacacgtgcagacgatcaacgctaagtag

SEQ ID NO: 190259 - DNA, 615 bp, Artificial Sequence
  Description of Artificial Sequence: Synthetic coding sequence
atggccgccgccaacccctgggaccccgccagcgcccccaacggcgccgggctggttctgggacattttatcgcaagcggcatggtcaaccaaaaaaatttggagatcgaacttcttaagcttgagaaggacactgcagacgttgtgcaccccttcttcctcgcacagaaatgtcacaccctgcaatccatgaacaaccatcttgaagccgtccttaaggagaagcgatccttacgacagcggcttctcaaacccatgtgtcaggagaatctccccatagaggccgtataccacagatacatggtgcacctgctggaactggcagtgacatttatagaacggcttgaaacgcacctggaaactattagaaacatccctcatctggctgcaaatctcaagaagatgaaccaggcccttgccaagatggatatactggtgacggagactgaggaactagcagagaacatcctaaagtggcggaaacagcaaaatgaagtcagttcttgcatccccaagatcctcgctgaggagtcctatttgtataagcacgatataatcatgcctcctttaccgtttaccagtaaagtgcacgtgcagacaatcaacgccaagtag

SEQ ID NO: 190260 - DNA, 1812 bp, Artificial Sequence
  Description of Artificial Sequence: Synthetic coding sequence
atgagctgcggcaacgagttcgtggagaccctgaagaagatcggctatcccaaagcggacaatctgaacggcgaggattttgactggctgtttgaaggcgttgaggacgaaagctttctgaaatggttttgtggcaatgtaaacgagcagaacgtgctgtcggagagagagctcgaagcgttctccatactgcagaagtccggcaaaccaattctggaaggcgcagccctggatgaggcccttaaaacttgcaagaccagcgatctcaaaactccacgtcttgacgacaaagagttggagaaactcgaagacgaggttcaaaccctcctaaaattgaaaaatctcaagattcaacgacgaaacaaatgccagttaatggcaagcgtcacctcacataagtctttgagactgaacgctaaggaagaagaagccacaaaaaaactaaagcagtcccaaggaatccttaatgcgatgattacaaagattagcaatgagttacaggccctcaccgacgaggtgacccagcttatgatgttcttccgccactccaatctcggtcaaggtaccaatcctctagtattcctcagtcaatttagcttggaaaagtacctgagccaggaggagcagtccaccgccgcactcaccctgtacactaaaaagcagttttttcaagggatccacgaagtcgtggagagctcgaacgaggacaatttccagcttttggacattcagaccccgtctatctgcgacaatcaggaaatcctggaggaaagacggcttgaaatggcgcgccttcaactagcctacatctgcgcccaacaccaactcatccatttgaaggctagtaactcctctatgaaatcgagcatcaagtgggcagaggagtctcttcactctctcacatccaaagctgttgataaagaaaacttggacgcaaagatctccagcttgactagcgagatcatgaaactcgagaaggaggtcactcagataaaggacaggtcccttccagctgtagtccgcgagaatgcacagttgctcaatatgcctgtggttaaaggcgatttcgatttgcagattgccaaacaagattactatacagctcgacaggagcttgttctgaatcagctgattaaacagaaagcatcctttgagcttctccaattgtcctatgagattgagctccggaaacatagggatatataccgccagctggagaacctcgtacaggagttgtcacagagcaacatgatgctctacaagcaactggaaatgttgactgacccatcagtcagtcagcagatcaacccacgtaataccattgataccaaagactatagcacccatcgcctctatcaggttctcgagggggagaacaagaaaaaggaactcttcttaacacacggtaatctcgaggaggtggccgaaaagctgaagcagaatatctcgctggtccaggatcagctggcggtgtccgctcaggagcattctttcttcttgagtaagagaaataaggatgtagatatgctgtgcgacacactttatcagggtggaaaccagctcctgttatcagatcaggagctgacagagcagtttcacaaggtggagtcccagttgaacaagcttaaccacctgttgaccgacattttagccgacgtcaagaccaaaagaaagacactcgcaaataacaagcttcatcagatggagcgggaattttacgtgtatttcctgaaagatgaggactatctgaaggacattgtggagaacttggagacgcaatcaaaaataaaagccgtcagcttggaggactag

SEQ ID NO: 190261 - DNA, 1812 bp, Artificial Sequence
  Description of Artificial Sequence: Synthetic coding sequence
atgagctgcggcaacgagttcgtggagaccctgaagaagatcggctaccctaaagcagataacctgaacggagaagattttgattggctctttgaaggggtggaggatgaatcattcctgaagtggttctgtggcaatgtgaatgagcagaacgtcctcagcgaacgagaactggaagcattcagcatcctgcaaaagtctggtaaaccaattcttgagggagccgcccttgatgaagcgctaaagacctgtaagacgtctgatctgaaaactccacggctagatgacaaagagttagagaagctcgaggatgaggtgcagacactactgaaactaaaaaatcttaagatccagcgaaggaacaagtgtcagcttatggccagtgtgacgagccataagagtctcaggttgaatgcaaaggaagaggaggcgacgaagaagttaaagcagagccagggaatcttaaacgccatgatcaccaaaattagcaatgaactgcaggctctgacagacgaagttacccagctgatgatgttctttaggcactctaatctgggacagggcacaaacccgctggtgttcctctcacaattctcactggaaaaataccttagccaggaggaacagtctaccgccgcactgaccctatatactaagaagcaatttttccagggaatccacgaggtggtggaatcgagtaacgaggacaacttccagctgctcgacattcagaccccttcgatttgcgataaccaggagatcttggaggagcgaagactggaaatggcccggctgcagcttgcgtatatctgtgcccagcaccagctgatccacctcaaggcctcgaactccagcatgaaaagctccataaagtgggccgaagagtccttacactcactgaccagtaaagctgtagacaaagagaacttggatgcaaaaatctcctctctcacctcagagatcatgaaactggaaaaggaagtcacacagattaaagatcgttcactccccgctgtagtcagagagaatgcccaattgctgaatatgcctgtcgtgaaaggtgacttcgatttacagatcgcgaagcaggactactacactgcgcgacaggaactggtactgaatcagcttattaagcagaaagcaagcttcgaactgttgcaactctcttatgaaattgaactgcgcaagcatagagatatctaccgacagctcgagaacctggtgcaggagctcagccaaagcaatatgatgctgtacaagcagttggaaatgctcaccgacccctctgtgtcccaacaaattaacccccggaacacaatcgataccaaggactatagcacacatcggttatatcaggtacttgaaggtgaaaacaagaagaaggagctttttctcacacacggcaacctggaggaggttgcagagaaactgaaacaaaacataagtctggtgcaggatcaactggctgtctctgcacaggagcattctttctttttgtcgaagaggaacaaggatgtcgacatgctctgcgacaccctgtaccaaggagggaaccagttgctgttgtccgatcaggagctcacggaacagtttcacaaggtggaatcccaactcaacaagttgaaccacctactcaccgacattttggcagacgtgaagaccaagcgaaagactcttgcgaacaacaaattacaccaaatggagcgggaattttatgtgtactttctcaaagacgaggattatctgaaagacattgttgaaaatctggagacacagagcaagataaaggcggtgtcgttggaagattag

SEQ ID NO: 190262 - DNA, 33 bp, Artificial Sequence; identical to SEQ ID NO: 84068
  Description of Artificial Sequence: Synthetic coding sequence

SEQ ID NO: 190263 - DNA, 102 bp, Artificial Sequence
  Description of Artificial Sequence: Synthetic coding sequence
atgagctgcggcaacgagttcgtggagaccctgaagaagatcggctatccgaaggctgataatcttaatggcgaagatttcgactggctctttgagggttag

SEQ ID NO: 190264 - DNA, 456 bp, Artificial Sequence
  Description of Artificial Sequence: Synthetic coding sequence
atgggcaagcggcccaacctgctggccctgcagctgagcgacagcacactcgccgacatcattgcaagattacaggccggacagaaactaagcgggtcaagtccgtttagctctgctttcaacagcctaagtcttgacaaggaaagcgggctgctaatgttcaagggagacaagaaacctcgagtctgggtggtcccaactcagctgcggcgtgacttaatcttcagcgtgcatgacataccactaggcgcccaccaaagacctgaagagacctataaaaaactgcgcctgctgggctggtggccaggcatgcaagagcatgtcaaggactactgccgctcgtgcttgttttgcattcctaggaacttgattggaagcgaattgaaggtcatcgaatctccccccgcttctgtgctgcggggccagggtgtctgcaatcggagcggaacaagatag

SEQ ID NO: 190265 - DNA, 957 bp, Artificial Sequence
  Description of Artificial Sequence: Synthetic coding sequence
atggccagcggcgacttctgcagccccggcgagggcatggagatcctgcagcaggtatgcagtaaacaactcccaccatgcaatctgtccaaagaggacctgctgcagaacccttattttagcaagctccttctgaatttgtctcagcacgtggacgaatccggacttagtctgactctagctaaggagcaggcacaggcctggaaggaagtcagacttcacaaaacgacttggctgcgctccgaaatattacatcgagtgatccaggaactcctggttgattactacgtaaagatccaagatactaatgtcacgtctgaagacaaaaaggatttcgtctggatgagagccaggctgcagcaggaggtggaggagcagctcaagaaaaagtgcttcactcttctctgttactacgatccaaactccgatgccgacagcgaaactgtcaaggccgctaaagtatggaagctagctgaggtcctggtgggggagcagcagcaatgccaagacgccaagtctcagcaaaaagagcagatgctactgctcgaaaaaaaatcagctgcctactcgcaagtgctgctgcgatgtctcacactcctgcagaggctcctgcaggaacacaggctgaagacccagtctgaactcgacagaatcaatgctcagtatctggaagtgaagtgcggtgccatgatccttaaactgagaatggaggaactcaaaattctgtcggatacctataccgtcgaaaaagttgaagtgcatagactgattcgcgataggctagaaggtgccatccatctgcaagagcaggatatggagaactctcgtcaggtgctcaacagctacgaggttctgggcgaggaattcgaccgccttgttaaagaatataccgtactgaagcaggcaactgagaacaagagatgggccctccaggagttcagtaaggtctatcgttag

SEQ ID NO: 190266 - DNA, 714 bp, Artificial Sequence
  Description of Artificial Sequence: Synthetic coding sequence
atggccagcggcgacttctgcagccccggcgagggcatggagatcctccagcaggtatgtagtaagcaactgcccccgtgtaacctgtccaaggaggatcttctgcagaatccctatttcagcaaattgctgttaaacctgtcccagcacgtggacgagtccggcctgagcctgactttggcaaaggaacaggcccaggcctggaaggaggtgaggctgcacaaaaccacgtggttgaggtccgagatcttgcacagggtgattcaggaactgctggtggactattacgttaagatccaggacacgaacgttacaagcgaggacaagaaagtccttctgaggtgtcttaccctacttcaaaggttgctccaagagcacaggttaaagactcagagtgaactcgatagaatcaatgctcaatacttggaggtcaagtgtggagcgatgattcttaaactgcggatggaggaactcaaaatcctgtccgacacatataccgtggagaaggttgaagtgcacaggctcattcgggatagattggagggagcaatacacctgcaggaacaggacatggaaaactctcgccaggtcttgaactcctatgaggtactcggagaggagttcgatcgcctagttaaggaatatacggtgctcaaacaggcaactgagaacaagcgatgggccctacaggagttttccaaggtttatcgctag

SEQ ID NO: 190267 - DNA, 714 bp, Artificial Sequence
  Description of Artificial Sequence: Synthetic coding sequence
atggccagcggcgacttctgcagccccggcgagggcatggagatcctgcaacaggtttgctcaaaacaactgcccccttgtaacctgagtaaagaggacctgctgcagaatccctactttagcaagttactgctgaacctcagtcagcacgtggatgaatccgggctgagcctgaccctggccaaggagcaggcacaggcttggaaggaggtcaggcttcataagaccacatggctgcggtctgaaatacttcacagagttatccaggagctgttagtcgactactacgtcaagattcaggacacgaacgttactagcgaggataagaaagtgctcctacgctgcctcaccctactgcaacgtctgctccaggaacaccgtctgaagacgcagtcagaactcgatcgcatcaatgcccagtacctagaggtgaaatgtggggctatgatacttaagctacgaatggaggagcttaaaatcctgtccgacacttatacagtggagaaggttgaggtgcaccgcctgattcgagaccgtctagagggcgccatccatcttcaggagcaagacatggagaactcaagacaggtcctgaacagctatgaggtgctcggggaggagtttgatcggcttgttaaggaatatacagtgttaaaacaagcaactgaaaataaaaggtgggccctgcaggagttttctaaggtgtataggtag

SEQ ID NO: 190268 - DNA, 720 bp, Artificial Sequence
  Description of Artificial Sequence: Synthetic coding sequence
atgcggctgctgggccccagccaggagcgggagatcccccccctgctgggactggagaaggccgatttgctcgaattaatgcctctgtcagaggactttgtgtggatgcgtgcaagactacagcaggaagtcgaggagcagctcaagaaaaagtgttttacccttctttgctactacgatcccaactccgacgccgacagcgagaccgtgaaggcagctaaggtctggaagcttgctgaggttttggtgggagagcagcagcagtgccaggacgccaagagccagcaaaaggagcaaatgcttctgttggagaaaaagagtgcagcttactcacaggtgctcctgagatgcctgacattacttcagcggctgttgcaagaacataggcttaaaacacagtctgagctggacagaataaacgcccagtatctcgaagtgaaatgcggtgcaatgatcctcaaacttagaatggaagagctgaaaatcctctctgacacctacaccgtggaaaaggtcgaggtgcatagattgattagggaccgcctggagggagccatccacctgcaagagcaggatatggagaacagccgtcaagtcctgaactcgtacgaagttcttggagaagaatttgatagactggtgaaggagtacacagtgctgaaacaagcaaccgagaacaaacgttgggcgttgcaagagtttagcaaggtgtaccggtag

SEQ ID NO: 190269 - DNA, 1092 bp, Artificial Sequence
  Description of Artificial Sequence: Synthetic coding sequence
atggccagcggcgacttctgcagccccggcgagggcatggagatcctccaacaggtgtgctcaaaacaattacctccctgtaatctgtctaaggaagacctgctccagaatccctacttcagtaagctgttgttaaatcttagtcagcacgtcgacgagtctgggttgagtctgacactggccaaggaacaggcccaggcctggaaagaagttcggcttcataagaccacatggcttagaagcgagatacttcaccgggttattcaggagctgctagtggactattacgtgaagattcaggataccaatgtgacttccgaggacaaaaagtttcacgagaccttggagcaacgccttctcgtaaccgaactgatgaggctgctgggtccctcgcaggagcgcgagatcccacccctgcttggtcttgagaaggccgacttacttgagttaatgcccctgtccgaagacttcgtttggatgagagcacggcttcaacaggaagtggaagaacagttgaagaagaagtgttttacgctcctctgctactacgaccctaactctgatgccgattctgaaacagtgaaagccgcgaaagtgtggaaacttgctgaggttttagtgggcgaacagcagcagtgtcaagatgccaagagccagcaaaaagagcagatgttgctgcttgagaagaaaagtgctgcctatagtcaggtgttgctgcgctgcttaactcttttgcagagactgctgcaagagcacagactgaagacacagtctgaactcgaccgaataaacgcccaatatctcgaggtgaaatgtggcgcaatgatcctcaagctcagaatggaggaactcaagatcttgtctgacacttacacagtcgagaaggtggaagtgcatagactgattagagaccgcctagagggagcaatccatctacaggaacaggacatggagaattcccgtcaggtcctcaattcatacgaggtgctgggagaggaattcgatcgtctggtgaaggaatatacggtattgaagcaggcaacagaaaataaacgatgggccctccaggagttcagtaaggtgtacagatag

SEQ ID NO: 190270 - DNA, 54 bp, Artificial Sequence
  Description of Artificial Sequence: Synthetic coding sequence
atgcggctgctgggccccagccaggagcgggagatcccccccctgctgggttag

SEQ ID NO: 190271 - DNA, 564 bp, Artificial Sequence
  Description of Artificial Sequence: Synthetic coding sequence
atggccagcggcgacttctgcagccccggcgagggcatggagatcttgcagcaggtttgctctaagcaactgcccccctgtaacctctctaaggaagacctgctgcaaaacccctactttagcaaattgctccttaatctcagccagcacgtagatgagagtggtctgagcctgactctcgctaaagaacaggcccaggcttggaaggaggtcaggctccataaaacaacctggctgcgctctgaaatcctgcatcgcgtcattcaggagctgcttgttgattattatgtgaagatacaggatacgaacgtgacctctgaggacaagaagtttcacgagactctggagcaaaggttgttagtgactgagctgatgcggcttctgggccccagccaggaacgtgagatcccaccgctgcttggactagagaaagctgaccttctggagctaatgcctctatccgaagatttcgtttggatgcgggcccggttgcaacaggaggtggaagaacagctaaagaagaaatgtttcacgctgctctgctactacgatccaaactcttag

SEQ ID NO: 190272 - DNA, 840 bp, Artificial Sequence
  Description of Artificial Sequence: Synthetic coding sequence
atggccagcggcgacttctgcagccccggcgagggcatggagatcctgcagcaggtgtgtagcaaacagctgccaccctgtaatctttcaaaagaggatcttctgcagaatccttacttcagtaaactgctcttaaatctgtcacagcacgtggatgagtccggcctgagtttaacactggccaaagagcaggcccaagcttggaaggaagttcgcctgcacaagaccacatggcttcggtccgagattctgcaccgcgtcatccaagagctcctggtcgactactatgttaagatccaggacaccaatgtgacaagcgaagacaagaagttccacgagacactggagcagcgactgctggtgacagagctgatgagactactcgggccctcgcaggagcgcgagatccccccactgctggggctagagaaggcggatctcctggagcttatgcctttatcagaagattttgtgtggatgagggctaggctgcagcaggaggttgaagagcagctgaaaaaaaaatgctttaccttgctgtgttactacgatccaaacagcgatgccgactccgaaactgtgaaggccgcgaaagtgtggaagctcgcggaggttctggttggcgagcaacagcagtgccaagacgccaagtcccaacaaaaggaacagatgctgctgttagagaagaagtctgcggcttattcccaggtgttgttacggtgtctgacgctacttcagcgattgttgcaggagcatagattgaaaacccagagcgagcttgatcgcatcaatgcgcagtatctggaggtgaagtgcggcgcaatgatcctgaaactgtag

SEQ ID NO: 190273 - DNA, 957 bp, Artificial Sequence
  Description of Artificial Sequence: Synthetic coding sequence
atggccagcggcgacttctgcagccccggcgagggcatggagatcctccagcaggtttgcagtaagcagctgcctccatgcaatctttcaaaggaagatctgctacagaatccatactttagcaagctgctgttgaatctatcacagcatgtcgacgagtctggtttatctctcaccttggcaaaagaacaggcccaggcttggaaggaggtccgactgcataagacaacatggttgagatcagagatcctgcatagagtgattcaggagttgctggtagactattacgttaagatccaagatacgaatgttacttccgaggacaaaaaagattttgtctggatgagagcacggctgcaacaagaagtcgaagaacagttgaagaaaaaatgcttcacactattgtgctattatgaccccaattccgatgcagattccgagactgtcaaagccgctaaagtatggaaactggcagaggtattggtaggggagcaacagcagtgccaggatgcgaaatcgcagcaaaaggagcagatgctgttgttggagaaaaagagcgcagcctatagtcaagttttgcttagatgcctgactctcctccagcggctactgcaggagcaccgactaaagacgcaaagcgagttggatcggattaacgcccagtatttagaagttaaatgtggagccatgatccttaaattacggatggaggaactcaagatcctgagtgacacctacactgttgagaaagtcgaggttcatagactcatccgagaccgcctggagggtgccattcatcttcaagagcaagatatggagaactcacggcaggtactgaactcttacgaagtcttaggcgaggaattcgatcgcctggttaaagaatataccgtcttaaagcaggccaccgaaaataaacgctgggctctccaagagttctccaaagtgtaccgctag

SEQ ID NO: 190274 - DNA, 957 bp, Artificial Sequence
  Description of Artificial Sequence: Synthetic coding sequence
atggccagcggcgacttctgcagccccggcgagggcatggagatccttcagcaagtctgttccaaacaattgccaccctgcaatctctctaaagaagatctgctgcagaacccgtacttcagtaagttactcctgaatctctctcaacacgtggacgaatccggattaagtctgaccctcgcgaaagagcaggcacaagcgtggaaggaggtcaggctccataaaactacttggctccgctccgagatattacatagggttattcaggaactgcttgtggattattatgttaaaatccaagacacaaatgtgactagtgaagataaaaaggactttgtgtggatgcgggcgcggctccagcaggaggttgaggagcagctgaagaaaaagtgcttcactcttttgtgctactacgaccccaattccgatgccgactctgaaactgttaaagcagccaaggtgtggaaactggctgaagtcctggtgggagagcagcagcaatgccaggatgccaagagtcagcagaaggagcagatgctgcttctggagaaaaagtcagctgcatacagccaggtgctgcttagatgcctgaccttactgcaaagactgctgcaggaacacaggctgaagacccagtctgagctggatcgaatcaatgctcagtacctcgaggtgaagtgcggggcaatgattctaaaactccgtatggaggaactgaagatcctgtccgatacgtacacagttgagaaggtggaggttcaccggctcattcgcgataggctggaaggcgccatccacttgcaagaacaagatatggagaacagccgacaggtactcaatagctacgaggtcttgggtgaagaatttgaccggctggtgaaggagtataccgttctcaaacaggccacggaaaataagcgctgggcccttcaggagttttcaaaggtataccggtag

SEQ ID NO: 190275 - DNA, 483 bp, Artificial Sequence
  Description of Artificial Sequence: Synthetic coding sequence
atggccagcggcgacttctgcagccccggcgagggcatggagatcctccagcaggtgtgttccaaacagctccctccatgtaacttaagcaaggaggacctgctccagaatccttacttctccaagctccttttgaacttgagccagcacgttgacgagtcaggactgtctcttactcttgcgaaagaacaggctcaggcctggaaggaggtccgactgcataagacgacctggctccgatccgagatactgcaccgagtcatacaagagctgttggtcgactactacgtgaaaatccaggatacgaatgtgaccagcgaggataaaaaattccatgagacactggaacagaggctcctggtgactgagctgatgcgcctactcgggccaagccaggaaagagagatccctccactgctgggcttggagaaagccgacctcttagagctgatgcctctgtctgaggactttgtctggatgtag

SEQ ID NO: 190276 - DNA, 1902 bp, Artificial Sequence
  Description of Artificial Sequence: Synthetic coding sequence
atggagctggcccaggaggcccgggagctgggctgctgggccgtggaagaaatgggggtgcccgtggccgcccgcgctccagaatctactctgagacgcctatgtctggggcagggagctgatatctgggcctacattctacagcatgtgcactcccagaggactgtaaaaaaaatccgcggcaacttgctttggtacggacatcaggattcccctcaagtaagacgtaagctggagctcgaggcagctgtgactcgactcagggcggaaattcaagagcttgatcaaagtctggaattgatggaacgagatacagaagcgcaggacacagccatggagcaggccagacagcacacacaggatacccagcgacgggctctcctcctacgtgcccaggctggcgcaatgagaaggcaacagcacacactgcgtgatccgatgcaacgactgcagaaccaactccgccgcctgcaggacatggagcgcaaggcaaaggttgacgttacattcgggtctctgacttcagccgccctgggcctcgagcccgtagtgctgagagatgttcgaactgcctgcactctgcgggcgcagttccttcagaacctgctgctccctcaggctaaacggggatcactgcctacaccccatgacgaccattttggtacttcttaccagcagtggctgtcctccgtagaaacactgctgacgaaccacccgcccggtcacgtgctggctgccctggagcacctggctgccgagagggaggccgaaatccgtagtctatgctctggcgatggactgggtgacacagaaatcagccgcccacaagctcccgaccagtctgacagctcccagacgttaccgtccatggttcacctgattcaggaaggatggaggaccgttggagtactggtgtcacagaggtctacattgctgaaggagaggcaggtacttactcagcgcctgcagggccttgtggaggaggtggagcgccgggtattaggttcgagcgaaagacaggtcctgattctgggactcagacgttgctgcctgtggacagaacttaaagcccttcacgatcagtcgcaagagctgcaggacgctgccggccacaggcaacttctgctgcgcgaattacaggcaaaacagcagcggatattacattggaggcagctagtagaggagacgcaagagcaggttagactgctgatcaaagggaattctgcttctaagaccagattgtgccgatcaccaggggaagttctggcgcttgtccagcgcaaggtggtgcccacattcgaagccgtcgccccccagtctcgggagctcctccgttgcctggaagaagaagtgcggcatttgccgcacatcctgttgggtactctgctgagacatcgaccgggtgaactgaagccccttcccacagtactcccgtctattcatcagctccaccccgcctccccgcgcggatcttctttcatagcactgtcgcacaagctgggactgcctccaggcaaggcctcagaattgctgcttccagccgcggcttctttgaggcaggatttgcttctgcttcaggaccaaaggtccctgtggtgctgggacctccttcatatgaaaacttcgctgccaccaggactgccaacccaagaactccttcagatccaagcctcacaagaaaaacagcagaaggagaatctgggccaggcgcttaagaggcttgagaaacttctgaaacaagccttagagcgtattcccgaacttcaggggatcgttggggactggtgggagcaacccggtcaggccgccctctctgaagagctttgccaggggctgtctctcccacaatggcgcctccggtgggttcaggcgcagggtgccctacaaaagctgtgctcttag

SEQ ID NO: 190277 - DNA, 873 bp, Artificial Sequence
  Description of Artificial Sequence: Synthetic coding sequence
atggagctggcccaggaggcccgggagctgggctgctgggccgtggaagagatgggtgttccagtagcggcccgagcgccagaatctacactgaggcggctgtgcctgggtcagggcgcagacatctgggcttacatactccagcatgtccactcccagaggaccgtgaagaaaatacgcggaaatctgttgtggtacgggcaccaagattcccctcaggtgagacgaaagctcgaactggaggctgcagtcacccgacttcgggccgagatccaggaactcgaccagtccctggaactgatggaaagggatacagaggcccaggacacggccatggagcaggccaggcaacacactcaagatacgcagcgacgtgcccttctgctgagggcgcaggccggggcgatgaggcgccagcagcacacactgcgtgatcctatgcagcgcctccaaaatcagctgcggagactacaggacatggagcggaaggccaaagtggatgttacctttggtagcctgacctcagccgcactcgggctggagcctgtggttttgagagatgtgcgtaccgcttgcacgctgcgagcccagttcttacagaatcttttgctgccacaggcaaagcgcggtagcttacctacgccacacgatgatcacttcgggacctcatatcagcaatggctatctagcgtcgaaaccttgctcacaaaccaccctcccggccacgtgctcgctgcgttagaacacctcgccgcggaacgtgaagcagaaatacgatctctgtgcagcggagatggcttgggggacactgaaatctccaggcgagccggggggctgtgggtttgctggtcaccgtctggagccccgtcttag

SEQ ID NO: 190278 - DNA, 2409 bp, Artificial Sequence
  Description of Artificial Sequence: Synthetic coding sequence
atgaagtacatcaagagcaacagcaagaacagcagccaccacttcgttgaaacatttaatatcaagccacaggacctgcataagtgtatcgctcgctgtcactttgcgaggtcccgttttctgcagatactgcagcgccaggattgcgttacgcagaagtaccaggagaatgcccagctgtccgtgaagcaggtccgcaatctccgctccgagtgcatcggcctggagaaccagatcaagaagatggagccctatgacgatcactctaatatggaggaaaagatacaaaaggtgcggtcactttgggctagcgtaaatgaaactctcatgtttcttgagaaagagagggaagtggtttcctcagtgctgtcgcttgtgaatcaatacgccctggacggcaccaatgtggcaattaatataccccgcctgctgttagacaagatagaaaagcaaatgttccagctccacattggaaatgtctacgaagccgggaaactgaacctcttgactgtgattcaattgctgaatgaagtcttgaaggtgatgaagtacgaaagatgccaggccgatcaggcgcggcttactgtcgacctccattatctcgagaaagagactaaatttcagaaggaacgcctgtcagatctcaagcacatgagatacagaattaaggacgaccttacaactataagacattcagtggttgagaagcagggtgaatggcacaagaaatggaaggagtttctcggcctctccccatttagtctgattaagggctggactccaagcgtcgatttgctgccacccatgtctcctctgtccttcgaccctgccagtgaggaggtttacgcaaagtccattctctgtcagtatccagcaagcctaccggatgctcacaaacagcacaatcaagagaacggatgcaggggcgactctgacacgttaggggctctccacgacttggccaactcacctgcctcattcttgtctcaaagtgtgagcagttctgacaggaattctgtaactgtgttagagaaggacaccaagatggggacccccaaggaaaagaacgaagcaatctctaaaaaaatcccagaattcgaagttgagaattcgcccctctctgatgtcgctaaaaatacagagagttcggcattcggtggctcgctgcccgccaagaagagcgaccccttccagaaggagcaggaccatctggtcgaggaggtggcacgtgccgtcctgtccgattcccctcagctgagtgagggaaaggagatcaaattggaggaactcatcgattctcttgggagcaatccctttttgacccgtaatcagattcctaggacccctgagaacctaatcacagaaatacgcagctcttggcggaaggccatagaaatggaggaaaacagaaccaaagagccaatccaaatggacgcagaacatagggaggtgctacctgaatctttgcccgtgctccacaatcagcgagagttcagtatggcagattttctgctggagacaacagtgagcgatttcggccaatcccacctgaccgaggagaaagtgatatccgattgcgagtgtgtcccacagaaacatgtactaaccagccacatagacgagccccctacccaaaaccagtcagacctgctgaataagaaagttatctgtaaacaagatctggaatgtctcgcatttaccaagctgtctgagacaagccgtatggagacattcagcccagccgtgggcaataggatcgatgtaatgggtggctctgaggaagaattcatgaagattctcgatcatctggaagtaagttgcaataaaccatccacaaataaaaccatgttatggaacagctttcaaatttctagtgggatttcaagcaagtcttttaaagacaacgatttcgggatccttcacgaaactcttcctgaggaagtgggacacctctcttttaacagtagttcctcttctgaggctaatttcaagctggaacctaattcaccaatgcacggagggactctgctggaggacgtagtgggtggacggcagaccactccagagagcgactttaacttgcaggccctccgctcacgatatgaggctctcaagaagtccctctctaaaaagcgcgaagaatcctacctctctaactctcagactcccgaaaggcataagcctgagcttagcccgactccccagaacgtacagacggacgacaccttgaattttctggacacatgcgatctacatacggaacacatcaaaccatcgctccgcacatctatcggagagcgtaaacggtctctctctccccttatcaaatttagtcccgtggagcagcgccttagaactaccattgcttgttcccttggagaattgcctaatctgaaaggtaaggtctag

SEQ ID NO: 190279 - DNA, 2868 bp, Artificial Sequence
  Description of Artificial Sequence: Synthetic coding sequence
atgagcagcgccagcgtgaccgccttcgagaaggagcacctgtggatgtatttgcaggccctgggttttgagccaggacctgctactattgcctgcggaaagattgtaagccacactcacctgggcgttaatatgtttgataagttaaatagagacgccttccatattatttcttattttctgtttcaggttctcgatcagtccttgaccaaagaggtttttaaattctgttggccgccatttgaccagaaatccgacactgagtttaggaagcattgctgcgaatggatcaaaaggatctctggcgaatgcgggtcaagcttcccacaggtagtggggagcttattcctgagccccgggggcccaaagttcattcatctgatgtatcattttgctcgctttgttgcaatgaaatatatcaaaagtaattcgaaaaactcaagccatcattttgtggaaactttcaacataaaacctcaggatttgcacaagtgcattgcacggtgtcactttgctaggtccagattcctgcagatacttcaacgtcaggactgtgttactcaaaaatatcaagaaaacgcacaactgagcgtgaagcaagtgaggaacctaagaagcgagtgcataggcctggaaaatcaaatcaagaagatggagccatatgacgatcatagtaacatggaggaaaaaatccagaaggtgcgctcgctgtgggcctcggtcaatgaaacattaatgttcctcgagaaagagcgcgaggtagtcagttctgtgctgtcacttgtcaatcaatacgcgctcgatggcactaacgtcgccatcaacattccgcgtctgctcctcgacaagattgagaaacagatgtttcaactgcatatcggaaatgtgtacgaagcagggaaactgaatctgcttactgtcatccaactgctgaatgaggttctgaaagtgatgaagtatgaacgctgccaggccgaccaagcccggttgactgtggatctgcattatctggagaaggagactaagtttcaaaaggaacggctgtctgacctgaaacacatgcggtaccggataaaagacgacctcacaactattcgccattcagtggttgaaaaacagggggaatggcacaaaaagtggaaggaattccttggtctcagccctttcagcctgattaagggctggaccccaagtgtggacttgctgccaccgatgagtcccctgtcatttgaccctgcgagcgaggaggtctatgccaaatctattctgtgtcagtacccagccagcctgcccgacgcacataagcagcataaccaagaaaatgggtgtagaggagattcagatacccttggagcgctgcatgatcttgctaatagtcctgcctccttcctgtcccaatccgtaagttctagtgacagaaactcagtcaccgtgttggagaaggacaccaagatggggactccgaaggagaagaatgaggccatttccaaaaagattccggagtttgaagttgagaatagccctctgagcgacgtcgcgaaaaacaccgagtcctccgcattcgggggatctctgccggcgaagaagagcgacccttttcagaaagagcaggaccacctggtggaggaggtggccagggcagtgctgtctgatagcccccagctgagcgaggggaaggagattaagttggaggaactaatcgactctttaggaagtaatccatttcttactcggaaccagatacctaggactcccgagaatttgatcacggaaattagatcgagttggcgcaaagctatagagatggaagagaacaggacaaaggaaccaattcagatggacgccgaacatcgggaggtgttgcctgagtccctcccggttctgcacaatcagcgagagttcagtatggccgatttcttattggaaactactgtctcggattttggacagagccatctgacagaagagaaagtgatctccgactgtgaatgtgtcccacagaaacatgtcctcacgtctcacattgacgagcctccaacgcaaaaccagtcggacttactcaacaagaaggtaatttgtaagcaggaccttgaatgcctggcctttacgaagctgtcggaaacatctcggatggaaaccttttctcccgcggtgggcaatcggatagatgtaatgggaggatcagaagaggagttcatgaagatcctcgatcatctcgaggtatcatgtaataaaccgtcgaccaacaagacgatgttgtggaatagcttccagataagctcaggtatatcgagcaagtccttcaaggacaacgactttggaatcttgcatgaaacactcccagaggaggtaggacacctgtccttcaactcaagcagtagctccgaggcaaacttcaagctggagcctaactctccgatgcatggcggtacacttcttgaggacgtggtcggaggacgacagacaacaccggagtccgactttaatctccaggcactgcggtctcgttatgaggccctgaagaaatccctgtccaagaaacgtgaggaatcatacctgagtaacagccagactcccgagagacataaaccagagttgtcacctaccccacagaatgtccaaacggacgacaccttgaacttcctggacacatgcgaccttcataccgaacatatcaagcctagcttgagaacgtcaattggagagcgtaagcgctccctgagtcctctgattaaattcagcccagtggagcagcgactccgtactacaatagcatgttccttgggtgagctgccgaatctgaaggaggaagacatcctcaacaagagtctcgatgcaaaggagcccccatctgacctgactagatag

SEQ ID NO: 190280 - DNA, 552 bp, Artificial Sequence
  Description of Artificial Sequence: Synthetic coding sequence
atgggcacccccaaggagaagaacgaggccatcagcaagaagatccccgaatttgaagtggaaaactcgcccctcagcgacgtggccaagaatacagagagtagcgcattcggaggcagcctgccggcaaagaaatctgatccattccaaaaggaacaagatcacctggtcgaggaggttgctagggccgtgctctctgacagccctcagctgtctgaaggaaaggagataaaattagaggagctgatagactcactgggatctaatccgttcctgacccggaatcagatcccacgcacccccgagaatttaatcacagagataaggtcttcatggagaaaagccatcgagatggaggaaaatagaacaaaagagccaatccagatggacgcggaacaccgggaggtactcccggagtcactacctgtgctgcacaatcaacgcgagttttcaatggctgactttctgctggagacaacagttagcgacttcggacaatcacacctgacagaagagaaagtgatatcagattgcgaatgcgttccacaatag

SEQ ID NO: 190281 - DNA, 1077 bp, Artificial Sequence
  Description of Artificial Sequence: Synthetic coding sequence
atggccggccaggacgccggctgcggccggggcggcgacgactactcagaggacgaaggcgactccagcgtatcacgagctgccgtggaggtgttcggcaaactgaaggacctgaattgcccattcttagagggattgtacataacggagcctaaaactatccaggagttgctgtgttctcctagcgaataccggctggaaatcctggaatggatgtgcacccgcgtctggccctcccttcaggacaggttctcttccctgaagggcgtacccaccgaagtgaaaatccaggagatgacaaaactcgggcacgagctgatgctctgcgctccggacgatcaagagctcttaaaaggctgcgcttgcgcccagaagcagctgcacttcatggaccagctactagataccatacgatccctgaccatcggctgctcatcatgttcctctttaatggagcattttgaagatacaagggagaagaatgaagctctgctgggagagctgttctcatctccgcatctgcagatgctgctcaaccccgaatgcgacccctggccactggatatgcaaccactgctcaacaaacaaagtgacgactggcagtgggctagtgcaagcgctaagagcgaagaagaggaaaaactggcagagttggcccggcagctccaggaatcagctgctaagctgcatgccctccgcacagagtacttcgcacagcatgagcagggcgcagcggccggcgccgctgacatctctaccctcgatcaaaaactgcgcttggtgacgtcagattttcatcagctgattctcgcttttctacaagtgtacgacgatgagctcggagaatgctgccagaggcccggccctgatctgcacccatgtggtcctatcattcaggccactcaccagaatttgacttcttacagtcaactgctgcaggtcgttatggccgttgctgatacatcagctaaagctgtggaaacagtcaagaagcagcagggggagcagatctgctggggcggttcgtctagcgttatgtcactcgcgacaaagatgaatgaactaatggagaaatag

SEQ ID NO: 190282 - DNA, 1284 bp, Artificial Sequence
  Description of Artificial Sequence: Synthetic coding sequence
atgggcggcgcccggctgggcgcccggaacatggccggccaggacgcaggatgtggacgcggcggcgacgattatagtgaagatgaaggggacagctccgtctctagggccgcggtagaggtatttggtaagttgaaggacctcaattgcccatttctggagggattatatataactgagccgaaaaccatccaggagttactctgttcccccagtgaatataggctggagatactggagtggatgtgtaccagagtatggccctcactgcaggatagattttcctcgctgaaaggggtgcccactgaggtgaagatccaggaaatgaccaaacttggccacgagttaatgttatgtgcacccgacgatcaggagctgctgaagggctgtgcctgcgctcagaaacagcttcatttcatggaccagcttctggacacaatccggtcattgaccattggttgttccagttgttcttctctcatggagcattttgaggacaccagagaaaagaacgaggcgctccttggagagctcttctcaagccctcatctgcagatgctccttaaccccgaatgcgatccctggccactggacatgcaacccctgctgaataaacagtcggacgactggcagtgggctagtgcctctgcaaagagcgaggaagaagagaaattagccgagctggcacggcagttacaggaaagcgccgctaagttacatgccctccggaccgagtactttgctcaacacgagcagggcgccgctgccggtgcggctgatatcagcacacttgatcagaagttaagattggtgacttctgattttcaccagctcatcctggccttccttcaggtttacgatgacgagcttggagagtgctgccaaaggcctggacctgacctgcacccatgcggcccaatcatacaagcgacacaccaaaatctgacctcctactcccagattcctaggggccaacccaaaaagccggctctggtgacaatgacgacggtaccgacctgcgccactctcccactggctcaaggatttagagacgtccatttcggattcctcagcgagagactgcgagcatttcagcctctaactgggtggtcttgtgagacccctagaagcggaatgttgttgcaagttgtcatggccgtcgctgacactagtgccaaggctgttgaaaccgtgaagaagcagcaaggggaacagatatgctggggaggcagtagcagcgtgatgtctctcgctaccaaaatgaatgaactcatggaaaagtag

SEQ ID NO: 190283 - DNA, 1107 bp, Artificial Sequence
  Description of Artificial Sequence: Synthetic coding sequence
atgggcggcgcccggctgggcgcccggaacatggccggccaggacgccgggtgtgggcgcggaggcgatgactatagcgaggatgagggagacagttccgtgagtagagctgctgtggaagtcttcggcaagcttaaggacttgaactgcccattcctggagggcctatatattaccgagcccaagacaatccaagagctcctgtgcagtcccagcgagtatcgcttagagatcctggaatggatgtgtacccgggtatggccaagcctgcaagatagattcagcagccttaaaggcgtgcccaccgaggttaaaatccaggagatgaccaagctggggcatgaattgatgttatgcgccccggatgatcaggaactattgaagggatgtgcctgcgcacagaagcaactccactttatggaccagttactagatacaatccggtctctcaccatcggctgtagtagctgtagctccctcatggaacattttgaagacactcgagaaaaaaacgaagcgctgctcggagaacttttttcctccccgcacctccaaatgctattaaatcccgagtgcgatccatggcctctggatatgcagccacttctcaataagcagagcgacgactggcagtgggcctctgcctcggccaagtccgaggaggaagagaagctagcagagctggcccggcagttgcaggagtcggccgccaagttacatgcactaagaacggaatacttcgctcagcacgagcagggagcagcagccggcgcggcagatatcagtaccctggaccagaagctgagactcgtgacctcagactttcatcagttaatcctcgcatttttacaagtgtatgatgacgagctgggggaatgctgtcagcggcccggccctgacctgcatccctgtggtcccattatccaggccactcaccagaatctgacctcatactcacagttgctgcaggtcgtcatggctgtcgcagacacctcagcaaaagccgtagaaacagtaaagaaacagcaaggtgagcaaatttgttggggaggatcttccagtgttatgtccctcgccacaaagatgaatgagcttatggaaaagtag

SEQ ID NO: 190284 - DNA, 411 bp, Artificial Sequence
  Description of Artificial Sequence: Synthetic coding sequence
atggaccagctgctggacaccatccggagcctgaccatcggctgcagctcctgctcaagcctgatggaacattttgaggacacaagggaaaagaacgaggctcttcttggcgagctcttctcttccccccatctgcagatgctcttgaatcctgagtgcgatccttggcccctggacatgcagccactactcaataaacagtcggatgactggcagtgggcttctgcctccgctaagtctgaagaagaggaaaagttagccgagcttgcaagacagctccaggaatccgccgccaagctgcacgcactgcgcaccgaatcaaccacaacatcttgggcatctgcagcttctgcccaggcattgacgtccaccagagcagccccatcctctagacctaggacgcgtatttag

SEQ ID NO: 190285 - DNA, 516 bp, Artificial Sequence
  Description of Artificial Sequence: Synthetic coding sequence
atggtgaagcggcggcggagccccgccctgggcgaggagcggttctccccgtcttctatcttacaccccagattgcctctggtgctccttggaacccgggttccgctctcaggcggaggcccaggtgagcctgatcagggcaggagcgcaccatcatggaagtcactggcttccacacatcaccactctcggccagctgccggggctactcctgcgagacccgcaacccagagccagctggggcctttcgcgcccccacttccaggcgtgcgcccggccccatttccggctgtagaggtgttcggaaaacttaaggatctgaactgtccatttctggagggcctgtacataactgaacccaagaccattcaagagctgctgtgctcaccctctgagtaccgactcgagatacttgaatggatgtgtacccgtgtgtggcctagcctgcaagataggttctctagtttaaaaggagtacctacagaggtgaagatacaggggctgctagccgggtag

SEQ ID NO: 190286 - DNA, 1233 bp, Artificial Sequence
  Description of Artificial Sequence: Synthetic coding sequence
atggccgacagcagcggccggggcgccggcaagcccgccaccggcccaactaactcaagctcagcaaagaaaaaggacaaacgagtgcaggggggccgcgtgattgaaagtcgttacctgcagtacgaaaagaagactacacagaaggctcccgcaggcgacggctcacaaacacgcgggaagatgtccgaagggggaagaaagtcttccctgttacagaaaagcaaagctgattcttccggcgtcggcaagggggatctgcagagcaccttattagagggccatggcacagcgccaccggatctagacctgtccgccatcaatgacaaaagtatcgtgaaaaagacacctcagctcgctaaaacaataagcaagaaacccgagtcgacatcttttagcgccccacggaaaaaatctcctgacctctcagaagccatggagatgatggagagccaaaccctgttgctgacattgctgtctgtcaaaatggaaaacaatttggccgaatttgagcggcgcgctgagaaaaatcttctgataatgtgtaaagagaaggagaaacttcagaaaaaggcacacgagcttaaacgtagactcttactgtcccagcgaaaacgggagctcgccgatgtgctagatgcacagattgagatgctgtcaccttttgaagccgtggccaccagattcaaagagcagtatagaacattcgcaaccgctttggacactacaaggcacgaactgccggtgcgctcgatacatcttgagggggacggccagcagcttttagatgctctgcaacacgagctggtcacaacccagcggctgctgggagagctcgatgtgggagactccgaagagaacgtgcaggttctggacctcttatctgagcttaaggatgtcactgccaaaaaagatctggagttaaggcggagctttgcgcaagtattggagttaagtgcagaggccagcaaggaagcggccctggccaatcaggaggtatgggaagagacacagggtatggcccccccctctaggtggtacttcaatcaagattctgcttgccgggagtccgggggagcccccaaaaacacacccttgtctgaagacgacaatccgggcgcaagctctgccccggcccaggcaacattcatatcgccgagcgaggatttctcctccagctcacaggcagaagtcccgccttcactttctaggtctggccgggacctatcttag

SEQ ID NO: 190287 - DNA, 1230 bp, Artificial Sequence
  Description of Artificial Sequence: Synthetic coding sequence
atggccgacagcagcggccggggcgccggcaagcccgccaccggcccgaccaactcatcctccgcgaaaaagaaagataaaagagtgcagggtgggagggtgatcgaaagcagatacctgcagtacgagaaaaagaccacacagaaggcccctgctggagatggctcgcaaacaagaggcaagatgagcgaaggagggcgcaaatcttccctgcttcagaagtctaaggactccagcggggtgggcaaaggcgacctacaatccaccctgctggaaggccacggaaccgctcctccggacctggatctttccgccattaacgataagtcaatcgtgaagaaaaccccccagctcgctaagaccatttcaaaaaaacctgagtccacctcgttttctgctccgcggaagaagtcacccgacctcagtgaggctatggagatgatggagagtcagaccctcctactgaccctgctgagtgtgaaaatggagaataatctggcggaattcgagagaagagccgagaagaatttactcattatgtgtaaagaaaaggagaagttgcaaaagaaggctcacgaattgaagaggcgactattactatcacagaggaaacgtgagctggcagatgtgctagacgctcagatagaaatgctgtcgccttttgaggcggtggctacacgctttaaggagcaataccgcacctttgccaccgccttggacactactaggcatgagttacccgtaaggagcatccacttagagggagatggtcagcagttactggatgccctacaacacgaactcgtcactacacagcgcctgcttggcgaattagacgtaggcgatagtgaggagaacgtccaggttctggacctgctgtcagagctcaaagacgtcactgccaagaaagacctggagctccggcggtccttcgctcaggtcctggagctcagtgccgaggcctccaaggaggccgcattggcaaaccaggaggtgtgggaagagacccagggcatggcacctccaagccgatggtacttcaatcaggattccgcttgtagagaatctggtggggctccaaagaacacccctctgtcggaggacgataatccaggcgcaagcagcgctcctgcacaggcaacttttatttcaccgtctgaggacttctcttcctcgtcccaagcggaagtgccaccctccctttcccgcagtggacgggatctctcatag

SEQ ID NO: 190288 - DNA, 1899 bp, Artificial Sequence
  Description of Artificial Sequence: Synthetic coding sequence
atggcccggcaccggaacgtgcggggctacaactacgacgaggacttcgaggacgacgacctatacggccagtctgtagaggacgattactgtataagcccgagtactgcggctcagttcatttactctaggcgagacaagcctagcgtggaacctgtggaggagtacgactacgaagatctgaaggagtcatccaattctgtgtccaaccaccaactttctggcttcgatcaagctagactctacagttgtctcgaccatatgcgggaggtactcggcgacgccgtacccgacgaaattctgattgaagctgttttgaagaacaagttcgacgtgcagaaagccctgtcaggagtgctggagcaggatagggtccagtctctgaaagataaaaacgaggctacggtttccactgggaagatcgcaaagggggtgctgttcagttcttctgaagtgagcgctgataatgtacagtcatcatatccccagtccgccaaccacctggactacagcagcaagccttttgacttcgcatcctctgtgggaaagtatggcctcagccacaatagctcagttcccacccactgtctgctgcatcgcaaaaagaagctggatactagaaagagcgaaaaaaaactcgagtcttgcaagctgacgaaggaacttagcctggctaatctcatccacgatatgagcagagattcatgcgaatcacagccctccgtgagactgagcagtactgacagcctagaatcactcctgtctaaaaatttagatgccgatttgcttagaccacacgcgagcgagtgtataagtaaagatgatagtgcctttaaagagattccagacctcaagacaattatcattaagggcacaacacctaacaacagcctttacatacaaaacaattcactctccgactttcagaatattcctgtccaagacagtctggggtcaagcaataacccactctacctcaccagctcattagaaaacatgacagtagataatctcaacgcctcaaaggaaactgaagtcggtaacgtctctctcgtcgagcagtccgccaaaaaccatacctttaagaacgataacctacagttctctcagtgcgaaagtccttcccttacagaactgtttcaagaacacaaggagaacaacatctcacagtgcttcacactgagtgacctgtgtaaccagtcttctgctagctttacggatctgtccctcggtagcttccctttaagccaattggcaaataggtgtcaatcctctcccggcatctccgaattgactggatcgctgtcttcactagcctttcataaagcatcccctacgagggacttggaaaacttgagcctgtcggagctgatagcagagacgatcgacgtggacaatagccagatcaagaaggagtctttcgaagtcagtttgtctgaggtcagatccccaggaattgatagtaatatcgacttatcagtactaatcaaaaatccagactttgtgcctaaaccagtcgtggatcctagcatagccccaagcagccggacgaaggtgctgtcgtcgaagttagggaaaaactcaaacttcgccaaggacaataagaagaacaataagggttcactgacgagaaaacctccattttccctatcatggactaaagcacttgccgcacgcccgagtgccttcgcctccacactgtgtctgcgttatccgctcaagtcctgtaagcggagaacccttgacctgtacaagacattcttgtactcccggcaggttcaggatgtcaaggataaggagataagcccacttgttgcaatcacacccttcgatttcaaatctgcatcacccgacgacatcgtcaaggccaaccaaaaaaaagccttcactagagagtag

SEQ ID NO: 190289 - DNA, 1563 bp, Artificial Sequence
  Description of Artificial Sequence: Synthetic coding sequence
atgaccgtgagcggcaagaagcagaccatgggcttcgaggtgcccggtgtgagcagcgaggaaaacgggcatagcttccatactccacagaagggaccccccattgaggacgcgattgcctcctccgacgttctggagacagcttccaagagcgctaatccgccacatacgattcaggccagtgaggagcagagcagcacccccgcacctgtaaaaaaatccgggaagctgcgtcaacagatagatgttaaagctgaactggagaagcggcagggcggaaaacaactactgaacctggtggtgatcggtcacgtggacgctggaaagagcaccctgatgggacatatgctgtacctgctcgggaacattaacaagagaacgatgcacaaatatgagcaggaatcaaagaaggccggcaaggcttcgtttgcctatgcctgggtgctcgacgagactggggaggaacgtgaaaggggtgtgactatggacgttggaatgactaagttcgaaaccactacgaaggtaattacactcatggatgctccaggccataaggatttcatcccaaatatgattaccggcgccgctcaggctgatgtcgctgtgctggttgtggacgcaagcaggggtgagtttgaagcaggatttgaaactggtggccagacacgagaacacggcctcctggttcggtctctcggagttacccagctggctgtagctgtaaataaaatggaccaggtaaattggcagcaggaaaggttccaggaaatcacaggcaaactcggccacttcttaaaacaagccggattcaaggaatcggatgtaggcttcatccctacgagtggcttgtcaggcgagaacctcataacacgaagccaaagttccgagctgactaaatggtacaagggtctctgcctgcttgaacagatcgactctttcaaacctcctcagagatcaatcgacaagcccttcagactctgtgtttcagacgtatttaaagatcaagggtcaggattttgcataactgggaagattgaggcaggatacattcagactggcgaccggttgctggccatgcctccaaatgaaacttgcaccgtgaaaggcatcacgctgcacgatgaaccagtagactgggcagcggctggagatcacgtatctctgactcttgtggggatggatatcattaaaatcaatgtcggatgtatcttttgtgggcccaaagtaccaattaaagcctgcacacgattccgagcacgtattcttatatttaatatcgagatcccaatcaccaagggattccctgtactactgcactatcagaccgtcagtgaacctgccgttatcaaacggctaattagcgtgttaaataaatccactggcgaagtcacaaaaaagaagcccaagtttttgactaagggacagaacgctctagtcgaattgcagactcagcgcccgatagctctggaactatataaggactttaaagagctggggaggttcatgctgaggtacgggggatctactatagccgccggcgtggtcaccgagattaaggaatag

SEQ ID NO: 190290 - DNA, 1929 bp, Artificial Sequence
  Description of Artificial Sequence: Synthetic coding sequence
atggcccggcaccggaacgtgcggggctacaactacgacgaggacttcgaagatgatgacctttacggccagtctgtagaggatgattactgtatttccccatccaccgccaggctttattcgtgcctggatcatatgagggaggtcttgggagacgccgtgccagacgagattttaattgaggctgtcctcaagaacaagttcgacgtgcaaaaggccttatccggtgtgctggaacaggaccgtgtacagtctctgaaggataagaatgaagctactgtgagcacaggtaagatcgctaagggcaaacccgtagattctcagacatcccggtctgaatcagagatcgtacccaaggttgctaagatgaccgtttctgggaagaagcagacgatggggttcgaagtacctggcgtctcatctgaggaaaatggccacagcttccacacaccgcagaaagggcctcccatagaggacgctatcgcctcttccgacgtgttggagaccgcatccaagtctgccaaccctccgcacaccatacaggctagtgaggagcagtcgagtactcccgccccggttaaaaaatctggaaagctgcggcaacaaatagatgtcaaggccgaattggaaaagagacaaggcggtaagcagctgttgaatcttgtcgtgatcggtcacgttgatgccggaaagtccactctgatgggacacatgctgtatctactggggaacataaacaagcgaaccatgcataagtacgagcaggaaagcaagaaagccggcaaagcttcctttgcctatgcatgggttctggatgagaccggggaagagcgcgagcggggggtgaccatggacgttggtatgactaaattcgagactaccaccaaggtgatcaccctgatggatgcgcctgggcacaaggattttataccaaatatgatcaccggtgctgcgcaggccgacgttgcagttctggtagtggacgcatcgaggggcgaattcgaggccggttttgagacgggaggacaaacacgcgagcacggactgctcgtcagaagcctgggcgtgactcagctcgctgtggccgtaaacaagatggatcaagtcaattggcaacaggagagattccaggagattacgggcaaactgggacatttccttaaacaggccggattcaaggagagtgatgtgggcttcatacccactagcggactctccggcgaaaacttgataactagatcccagtcttcagagcttacaaagtggtacaaggggctgtgcctgctggaacagatcgattcctttaagccaccacagcgctcaatcgataagccattcagattgtgcgtgtctgatgtgtttaaagaccagggctctggcttctgtatcacaggaaagatcgaggccggatacattcagacaggtgatcgtctgctcgcaatgcctccaaatgaaacctgcaccgtgaaaggcatcacgctccacgacgagccagtggattgggccgcagctggcgatcatgtctcccttactcttgtcggcatggatattattaagattaatgtgggctgcatcttctgcggtccgaaagtgcctataaaagcatgcacaaggttccgcgcccgtatcctgattttcaatatcgaaatacctataacaaagggcttcccagtgctgttacattatcaaactgtttcagagcccgccgtcattaagcgtctgatctctgtactgaataagtcgacaggcgaggttacaaagaaaaaaccaaagttcctgactaaaggtcagaacgctctagttgaattacaaacacagcgcccaatagctcttgagctttataaagacttcaaggagcttggccgctttatgttgcggtatggaggatcaacgatcgctgcaggggtggttacggagatcaaggaatag

SEQ ID NO: 190291 - DNA, 2055 bp, Artificial Sequence
  Description of Artificial Sequence: Synthetic coding sequence
atggcccggcaccggaacgtgcggggctacaactacgacgaggacttcgaggatgacgatctgtacggacagtcggtcgaagatgattactgcatcagcccttcaaccgccgctcagtttatctactcccgcagggacaagccgagcgttgagcctgttgaggagtatgattacgaggatttaaaggagagcagcaattccgtatccaatcatcagctgtcaggcttcgatcaagctagattgtactcatgtcttgatcatatgcgggaggtcctgggcgacgccgtgcccgacgaaatcctgatcgaggcagtcttaaaaaataagttcgatgtacagaaagctctcagcggagtgctcgaacaagaccgcgtgcaatcactgaaagataaaaatgaggctacagtgagcaccggaaaaatcgcgaaggggaaaccggtcgacagtcagacgagccgaagtgaaagcgaaatagttccaaaggtggctaagatgaccgtgtccggcaaaaagcagaccatggggttcgaagtgcctggcgtctcttccgaagagaacggacactctttccatacgccacaaaagggccccccaatcgaagacgctatcgcaagcagtgacgtgctcgagacagcctcaaagtctgccaacccaccacacacaatccaggcatctgaggaacagagttcaaccccagccccagtgaagaagtccggtaagctccggcagcagattgacgtcaaagctgaactagagaaacggcaaggagggaagcagctgttgaatctggtggtgattggtcatgttgacgcaggcaaatccaccctcatgggacatatgctgtacctgttggggaacataaataaaaggaccatgcacaagtatgagcaggaaagtaagaaggccgggaaggcctcattcgcttacgcctgggtcctggacgagactggagaggagagggagcgcggcgtaactatggacgtaggaatgaccaaatttgagaccacaacaaaggtgatcacactcatggacgccccagggcacaaggactttatccctaacatgattacaggggccgcacaagcggatgtcgcggttctggtggtggacgcttccagaggggagtttgaggcgggatttgagaccggcggccagacgcgagaacacggattacttgtccgttcacttggagtgactcagttggctgtcgccgttaataagatggatcaggtgaactggcagcaagaaaggttccaggaaatcactggcaaactcggacactttttaaagcaggccggcttcaaagagagcgatgtcgggtttattcctacttcgggactgagtggggagaatctgataacccggagccaatctagcgaacttaccaagtggtataaaggactatgcctgcttgagcagatcgatagtttcaaaccacctcagaggtctatagataagcctttcaggctatgcgtcagtgacgtattcaaagaccaagggtcaggcttttgcatcaccggtaagatcgaggctggctatatacaaaccggggaccgccttctggcgatgcctcccaacgagacttgtaccgtgaagggtataactctgcacgatgaacccgtggactgggctgccgccggcgatcatgtctccctgacactcgtcggtatggacatcatcaagattaacgtcgggtgcattttctgcggcccaaaggtgcctattaaagcatgcacccgctttagagcccgcattttgatcttcaacattgagatacccattacaaaaggctttcccgtgttgctccactaccagactgtatccgaacccgccgttatcaaaagactgatcagcgtgcttaacaaaagtactggcgaagtgaccaaaaagaaacccaaattcctgaccaagggccaaaatgcattagttgaactacagacgcaacgcccaatcgcattggagctctacaaggatttcaaggagctgggccgctttatgctcagatatggtggttcaacaatcgctgctggagttgttacagagattaaggagtag

SEQ ID NO: 190292 - DNA, 1227 bp, Artificial Sequence
  Description of Artificial Sequence: Synthetic coding sequence
atgggccacatgctgtacctgctgggcaacatcaacaagcggaccatgcataagtatgagcaggaatccaaaaaggccggcaaagcatctttcgcatacgcatgggttctggacgaaacaggggaagaacgggaacgtggggtgaccatggatgtcggcatgaccaagttcgagactacaacaaaggttatcaccctaatggacgcccccggccacaaggactttattcccaacatgattacaggcgcggcccaggccgatgtggcggtgcttgtagtcgacgcctcacgaggagaatttgaggctgggtttgaaaccggaggccagaccagggaacatgggctgctggtcagaagtctgggggtgactcagttggctgtagcggtgaacaagatggaccaggtgaactggcagcaagagcgctttcaggaaattactggaaaactcggacacttccttaagcaagctggattcaaagagtccgacgtcggcttcatccctacatcagggttgtcaggcgagaatttaattacacgctcccaatcttctgagttgacaaagtggtacaaagggctatgtttgctggagcaaattgactctttcaagccaccccagcggtccattgataagccctttcgcttgtgcgtgagcgacgtgtttaaagatcaaggatcgggtttttgcataaccggaaaaatcgaggccggatacattcagaccggagaccggttgctggctatgccgccaaacgagacgtgcaccgtcaagggcataaccttgcacgatgaacccgtggactgggccgccgcaggcgaccacgtgtcgcttactctggtgggcatggacattatcaagattaatgtaggatgcatcttctgcggcccaaaagtgcctatcaaggcttgtactcgctttagggcccgcattttaatctttaacattgaaatccctatcactaaaggttttcctgtcctgctgcactaccaaactgtcagtgaacccgcggtaataaaaaggctgatatcagtgctgaacaagagcaccggtgaggtgacaaaaaagaagccaaagtttctgacaaagggccagaatgcgctggtcgaactgcaaacacagcggccaattgctctagaattgtataaagattttaaggagctcggccgattcatgctcagatacggaggctctacaatcgcggcaggagtcgtgaccgagataaaagaatag

SEQ ID NO: 190293 - DNA, 840 bp, Artificial Sequence
  Description of Artificial Sequence: Synthetic coding sequence
atgagcctgttcgacctgttccggggcttcttcggcttccccggccctcggagtcaccgggatcccttctttggagggatgacccgcgatgaggatgacgacgaagaggaggaggaggagggcgggagctggggaaggggcaacccgaggttccactcgccacagcatccccctgaggagtttggcttcggattctcattctccccggggggtgggataagatttcatgacaattttggatttgacgacctggtccgtgattttaatagtatcttcagcgacatgggcgcttggacattgccatcacatccaccggagctacctggaccagagtccgagacacccggcgaacgcctgagggaaggtcagacgttaagggactctatgctgaagtatccagattctcaccagccaagaatctttggtggtgtgcttgagtccgatgcaaggtctgagtcgccgcagcctgctccagattggggcagccagaggcccttccaccgcttcgacgatgtgtggcccatggacccccacccccgcaccagggaggacaacgacctggactctcaggtttcccaagagggcctgggacctgtgctccaacctcagccaaaatcctatttcaagtctatatcggtcacaaagatcacaaagcccgacggcattgtagaggagcggaggactgtagtggactccgagggccggactgaaactactgtgactagacacgaggctgatagcagtcccagaggtgacccagagagtcctcggccccccgcactcgatgatgcgttcagtatactggatctcttcctgggccgctggtttagatcccgatag

SEQ ID NO: 190294 - DNA, 696 bp, Artificial Sequence
  Description of Artificial Sequence: Synthetic coding sequence
atgagcctgttcgacctgttccggggcttcttcggcttccccggcccccggtcattttctccaggggggggcatccgtttccacgacaattttggattcgacgacctcgtgcgcgactttaatagtatatttagcgatatgggagcatggacactgccttcccatccacctgagctgcccggcccagagtcggagacaccgggtgagcgcttaagagagggccagactcttagggactcaatgttgaagtaccctgattcacatcagccccgcatttttgggggcgtcctagagagcgatgcccggtctgagtctccacagcctgctcctgactggggaagccagcgccccttccaccggttcgatgacgtgtggccaatggacccacaccctcggacacgggaggacaacgatctggattctcaggtgtcacaggaggggctgggccccgttctccaaccacaacccaagtcctatttcaagtccatttctgtgacgaagattactaaacctgacggaatcgtcgaggaaagacgcactgtagtagattccgagggccggaccgagactactgtgactaggcacgaagccgatagctcccctaggggcgatccggaaagcccccgacccccagccctggatgatgccttctcaattctcgacctgtttctgggccgctggtttagatcacgttag

SEQ ID NO: 190295 - DNA, 864 bp, Artificial Sequence
  Description of Artificial Sequence: Synthetic coding sequence
atgagcctgttcgacctgttccggggcttcttcggcttccccggcccccgctcacaccgggaccccttctttggcggcatgacaagggacgaggatgacgacgaagaagaggaggaggaaggcgggagctggggacgcggtaatccaaggttccacagcccccaacaccctccagaggaattcgggttcggattttctttttctccaggtggcggcattaggttccatgataacttcgggtttgatgatctggtaagggattttaactctatcttctctgatatgggggcctggacactccccagccatcctcccgccaatacttgtcatctgtccgcggaactgcctggccccgaatctgaaacccccggggagagacttcgggaaggccagacattgagagatagtatgcttaaataccctgattcccatcagccaagaattttcgggggtgtgcttgaatccgatgcgcgatccgagagtccccagccggctccagattggggctcccagcgccccttccacaggtttgatgatgtgtggccaatggatccacacccaagaacccgggaagacaacgacttggatagccaggtgtcgcaagagggcctgggcccagtccttcagccccagcctaaatcatactttaaaagcatcagtgtgacaaagatcacaaaaccagacgggatagttgaagagcgcaggactgtagttgactccgaagggcgtaccgagaccactgtgacccgccacgaggccgactcttctcccaggggggatcccgagagtcccaggcctccggcactggatgacgctttctcaattcttgatctcttccttggccgctggttcaggagccgctag

SEQ ID NO: 190296 - DNA, 1179 bp, Artificial Sequence
  Description of Artificial Sequence: Synthetic coding sequence
atgcagagccccgccgtgctggtgaccagccggcggctgcagaacgcccatacaggcctcgacctcaccgttccacagcatcaagaagtcagagggaagatgatgtctggccatgtggagtaccagatactcgtggtaacccgcctagcagcctttaaatcggctaaacaccgacccgaggacgttgttcagttcctggtgagtaagaagtattcggaaattgaagagttctaccagaagctgtcctctagatacgcggcggcgagtctgccacccctgccaaggaaggtcctgttcgtgggcgagagtgacatccgcgaacgtcgcgctgtcttcaacgagatattgagatgcgtttccaaagatgccgagctagctgggagcccggaattactggagttcctgggaacaagatcaccgggtgctgccggcctgacctctcgagacagtagtgtcttggacgggactgattcccagaccggaaatgatgaggaggcctttgacttcttcgaggagcaggaccaggtagctgaggagggccccccagtgcagagtttaaagggagaagacgccgaagaatcgttagaagaggaagaggccctagatccactgggaatcatgcgcagtaagaagcctaaaaaacatcctaaagttgccgtaaaagccaagccatccccccgccttaccatcttcgatgaggaggtcgatcctgatgagggactgtttggtcctggccgcaaactgtcaccccaggatcctagcgaggacgtgtcctctgtggatccacttaaactgtttgacgacccagacttgggcggggctattccattgggcgactcattactgcttcctgctgcatgtgaatccggcggaccaactccttccctatcccatcgagatgccagtaaggaactttttcgggtggaagaggatctggaccaaatacttaacttgggagcggagcccaaaccgaagccacagttaaagcctaaaccaccagtggcggccaagcccgtgatcccccgcaaacccgctgtccctcctaaggcaggccctgctgaggccgtcgctggccaacagaaaccccaagaacaaattcaagccatggacgaaatggatattctgcagtatatccaagatcacgacacgcctgcacaggcggccccatccctgttctag

SEQ ID NO: 190297 - DNA, 654 bp, Artificial Sequence
  Description of Artificial Sequence: Synthetic coding sequence
atgagcctggtgggcggcttcccccaccaccccgtggtgcaccacgaggggtacccgttcgctgctgccgcagccgctgccgctgctgcggcagccagtagatgctctcacgaggagaacccttatttccacgggtggctgataggacatcctgagatgagtccacccgactactctatggccttgagttattcacccgaatatgcctcaggagcagccggcctggaccactcgcattatggcggggtacctcccggggccgggcccccgggactcgggggaccacgccctgtcaagcgccggggaacagcgaatcgcaaggagaggagacgaacacagagcatcaactcagccttcgcggaactgcgcgaatgcatacccaacgtccctgccgacactaagctctctaagatcaagaccctccgacttgccacgagttatatcgcctatcttatggatctactcgctaaggacgaccagaatggggaagccgaggccttcaaagcagagatcaagaaaaccgacgtgaaggaggagaaacgaaaaaaagaactgaacgaaatcctgaagtccacagtgtcaagcaatgataagaagactaaggggcgaaccggatggccacagcacgtctgggcactggaactgaaacagtag

SEQ ID NO: 190298 - DNA, 561 bp, Artificial Sequence
  Description of Artificial Sequence: Synthetic coding sequence
atgagcctggtgggcggcttcccccaccaccccgtggtgcaccacgagggctatccatttgcagcagccgccgcggcagctgctgcagcagcagcatccagatgttcccacgaggagaatccctacttccacgggtggctgattgggcacccagagatgtccccccccgattacagcatggcactatcctactcacccgaatatgcttctggcaccgccaatcggaaagagcggcgcaggacgcagagtattaatagcgcattcgcagagctgagagagtgcatccccaatgttcccgcagatacaaagctgagtaagatcaagactctgcgtctggcaacctcgtacatagcttacctcatggatcttttggcaaaagatgatcaaaacggggaggcagaagcttttaaggccgagatcaagaagactgatgtaaaggaggaaaagcggaagaaagagctgaacgagattctgaagtctacagtatctagtaatgacaagaagactaaagggcggacaggctggccccagcacgtctgggcactcgagcttaagcagtag

SEQ ID NO: 190299 - DNA, 498 bp, Artificial Sequence
  Description of Artificial Sequence: Synthetic coding sequence
atgagcccccccgactacagcatggccctgagctacagccccgagtacgcttcgggggcagccggactggaccactcccactatggcggcgtccctcctggtgctggcccacctggcctaggtggacctagaccagtcaaacggagggggacagctaatagaaaagaaaggcgaaggactcagtcaattaactcagcctttgccgaactccgtgagtgtattccaaacgtccccgctgacaccaagctatctaaaattaagactttgcgtctcgccacctcttacatcgcatatctgatggatttactggccaaggatgaccagaacggggaagctgaggcgtttaaggccgaaatcaagaaaaccgacgttaaagaggagaagaggaaaaaggagctgaatgagattctgaaatcaacggtctcgtccaacgataaaaagaccaaagggcgcacaggctggccacaacacgtctgggcactggagctcaagcaatag

SEQ ID NO: 190300 - DNA, 2577 bp, Artificial Sequence
  Description of Artificial Sequence: Synthetic coding sequence
atgagcgtggtgggcctggacgtgggcagccagagctgctacatcgccgtggcacgcgccggggggatcgaaaccatcgccaacgagttctccgaccgctgtaccccctctgtgataagtttcgggtcaaagaaccgtaccatcggggtggcagccaagaatcagcagataacgcacgccaataacaccgtctcaaactttaagcgcttccacggacgcgccttcaatgatccctttatacaaaaagagaaggaaaacctctcctacgacttggtgcccctgaagaacgggggcgtgggcattaaagtgatgtatatgggcgaggaacatctgttctctgtggagcagatcaccgctatgctgctgacaaagttaaaagagacagcggagaacagcctgaagaaacccgtgactgactgcgttatatccgtgccttccttctttaccgacgccgaacgcaggtcagtgctcgacgcagcccagatcgttggcttaaactgtctccgccttatgaatgatatgacggctgtcgctctgaattacggcatttacaagcaggacttgccctctctggatgaaaagccgagaatcgtggtgttcgtggatatgggccacagcgcatttcaggtcagcgcctgtgcattcaacaagggcaagctaaaggtcctgggaactgcatttgaccccttcctcggaggtaagaatttcgacgaaaagctcgtcgaacacttctgtgccgaatttaagactaagtacaaacttgatgccaagtctaagatcagagcattgttgcgactgtatcaggagtgcgagaaactgaagaagctaatgtcttcaaatagcaccgatctgccccttaatatcgagtgtttcatgaacgataaagacgtgtcaggaaaaatgaaccggagccagtttgaagaattatgcgccgagctcctccaaaaaatcgaagtccccttgtatagtcttctagagcagactcatctgaaagtggaagatgttagcgcggtggaaatcgtgggcggagccacaaggatccccgccgtaaaggaacgcatcgccaaattcttcggcaaggacatcagtactacattgaatgcagatgaagccgtggcgagaggctgtgctctgcagtgcgcaattctctcaccggcctttaaggtccgtgagttctcagtcaccgacgctgtacccttcccaatcagcctaatttggaaccatgacagcgaggacaccgagggtgtacacgaagtgttttctaggaaccacgccgcccccttttcaaaagttctgactttcctgcgccgcgggcctttcgagctggaggctttctatagtgaccctcagggagtaccctaccctgaggccaaaattggcagatttgtggtgcaaaacgtctcggcgcagaaggacggtgaaaagagtcgagtgaaagtcaaggtccgcgtgaacacccacggcatctttacgatctctactgcttcgatggtcgagaaggtccccacagaggagaacgaaatgagctcagaggcggatatggagtgtctgaaccagcgcccccccgaaaatccggataccgataagaatgtacaacaggataatagcgaagcaggaacccagccgcaggttcagacagacgcccagcaaacatcacagagtccgccctcaccagaattgacttcagaagaaaataagatccccgatgccgacaaggccaatgagaaaaaggtggatcaaccaccagaggctaaaaagccaaaaatcaaagtagtgaacgttgagctgcccattgaagccaatttagtgtggcaactggggaaagacttgctgaatatgtacattgaaaccgagggcaaaatgatcatgcaggacaaactagaaaaggaaagaaacgacgcaaagaacgcggtggaggagtatgtgtacgagttccgagacaagctgtgtgggccctatgaaaagttcatttgcgagcaggaccatcaaaacttcctcagactcctcacggaaacagaagactggctctacgaggagggcgaggaccaagccaaacaggcctacgtcgacaagttggaagagctgatgaaaattggcactcccgtgaaggttagattccaggaggcagaggagagaccgaagatgtttgaggaactgggccagcggctccagcattacgctaaaattgccgcggatttcagaaacaaggatgagaaatataaccacattgatgaaagtgaaatgaaaaaggtggagaaaagcgtgaacgaggtaatggaatggatgaataacgtgatgaatgcccaagccaagaaaagccttgaccaggatccagtagtgcgcgcgcaggaaataaaaaccaaaattaaggagttgaacaacacttgtgaacccgtcgtgacacaacctaagcccaaaatcgaatctcccaaactagaacgtacccctaatggtccaaacattgacaagaaagaggaggaccttgaggataagaacaatttcggtgctgagcctccacatcagaacggtgaatgctacccaaacgagaaaaacagtgtcaatatggatttggactag

SEQ ID NO: 190301 - DNA, 414 bp, Artificial Sequence
  Description of Artificial Sequence: Synthetic coding sequence
atgttcgaggagctgggccagcggctgcagcactacgccaagatcgccgctgatttccgaaataaggacgagaagtataatcatattgacgagagcgagatgaagaaagtggaaaagtccgtcaacgaggtaatggagtggatgaacaatgtcatgaacgcgcaggccaaaaaatctctcgaccaagaccccgttgtgcgcgctcaggagattaagactaaaattaaggagctcaataatacctgcgagcctgtcgtgacacagcctaagcctaagatagaaagccctaaactggagcgcactcccaatggacctaatatcgataaaaaagaggaggacctcgaagataagaataattttggagctgaacctcctcatcagaatgactcctgtgggatcgtaaattcatattag

SEQ ID NO: 190302 - DNA, 2034 bp, Artificial Sequence
  Description of Artificial Sequence: Synthetic coding sequence
atgtacatgggcgaggagcacctgttcagcgtggagcagatcaccgcgatgctactcactaaactcaaagaaactgccgagaatagcttgaagaagccggtgacagactgcgtaatctcagtcctcggcacagcatttgatccttttctgggaggaaaaaattttgacgagaagctggtagaacacttctgtgcagaatttaaaaccaagtataagctcgacgccaaatcaaagatccgtgctctcttaaggctgtaccaggagtgcgagaagttgaaaaagttaatgagctcaaacagcacagacctgccattaaacattgagtgcttcatgaatgacaaagacgtttctggaaagatgaatcgctctcagtttgaggagttgtgtgccgagctgctgcagaaaatcgaggtccccctgtacagcttgctggagcagactcatctgaaagtggaggatgtcagtgctgtagagatagtgggaggggctacaaggatacccgcagtgaaagagcgcatcgccaaattctttggcaaagacatcagcaccacactcaatgccgatgaggcggtggcacgggggtgcgcactgcagtgcgccatccttagccctgccttcaaggtccgggagttctcagtgaccgacgcagtgcccttcccaatctcgttgatctggaatcacgactccgaggatactgagggcgtccacgaggttttcagcagaaaccatgccgcacccttttcgaaggtactgacgttcctccgaagggggcctttcgagctggaagccttctatagcgatccccagggcgtgccatacccagaagctaagataggcaggttcgttgtgcagaatgtgtccgctcagaaagacggcgagaaatcacgggtcaaggtaaaggtgcgagtgaatacccatgggatttttactatctcaaccgccagcatggtggaaaaggtcccgacagaggagaatgaaatgtcctccgaagcggacatggaatgccttaatcagaggccacccgagaaccccgatacagacaagaatgtccaacaagacaattccgaagcaggaacacaaccgcaggttcagactgacgcccagcagacatcgcagagcccaccgagtccagagttaacgtccgaagaaaataaaattccagatgcagataaggcgaacgaaaagaaggtcgatcagcccccggaggccaaaaagcctaagatcaaagttgtgaatgtggagctgcccatagaggcaaacctggtgtggcagctcggcaaggacctgctcaatatgtacatcgagacagaggggaaaatgatcatgcaagacaagttagaaaaggaaaggaatgatgctaagaacgctgtggaggagtatgtgtatgagttccgggataaattgtgtggcccatacgagaagttcatttgcgaacaggaccaccagaattttctccggctcctgacagaaacagaggactggttgtatgaagagggagaagaccaggctaagcaggcatatgttgataaactggaggagcttatgaaaatcggaacgcccgtcaaagtccgcttccaggaagccgaagaaaggccaaaaatgtttgaagagctcggccaacgtctgcagcactacgctaaaatcgcggctgattttcggaacaaggacgagaagtacaaccacatcgacgagagcgaaatgaaaaaggtcgagaagtcagtgaacgaagtcatggagtggatgaacaatgttatgaatgcccaagccaagaagagtctggatcaggatccagtggttagggcacaggaaatcaaaactaaaatcaaggaactaaacaacacctgcgaacccgttgtcactcagcccaagccaaagatcgagtctcccaagctggagcggaccccgaatgggccaaatatcgacaagaaggaggaagacctggaggacaagaacaacttcggcgcagaacccccccatcaaaacggcgagtgttacccaaacgagaaaaatagcgttaatatggatctggactag

SEQ ID NO: 190303 - DNA, 1920 bp, Artificial Sequence
  Description of Artificial Sequence: Synthetic coding sequence
atggcccgggagcggccctgccggtgccacggcaacggcggccggtccccaggaactggctgcccactggggcggatcttccccgaaggatctcgccgtcgcaaacgcaagtggcatgttgaaggaccagtagaagcgccacgcaatggacagacacccagagcaggtgcggagcggggacagggtcgaaagcggcgccaggagaagcaggccggagggattgaaaccatcgccaatgagttctccgatcggtgcactccaagcgtgattagtttcggctctaagaataggacaatcggagtggcagcaaaaaaccagcaaatcactcacgccaacaatactgtttccaactttaaacggttccatggccgggcatttaatgacccttttattcagaaggagaaggaaaacctctcctacgatctggtgcccttgaagaatggcggagtaggtattaaggttatgtacatgggagaagagcatcttttcagcgtcgagcaaattacggccatgttgctcactaagctcaaagagaccgccgagaattccctgaagaaacccgtgaccgattgcgtgatctccgtcccctctttttttacagacgccgaaagacgctctgttctcgatgccgcgcagatcgtagggctgaactgcctccgtctgatgaacgatatgacagctgttgcactgaactacggtatttataagcaagacctaccgtccttggacgagaaacccagaattgtagtgttcgtggatatgggccattcagcgttccaagtgagcgcctgcgcttttaacaagggtaagttgaaggtcctaggcacagcattcgatccgttcctcggcggaaaaaactttgatgagaagctcgtggaacatttttgtgcagagtttaagactaagtataaattagatgctaagtcgaaaatccgtgcactcctccgcctgtaccaggagtgtgaaaagctcaagaagcttatgtcctccaactcgaccgaccttccactcaacatcgagtgctttatgaacgataaggacgtcagcggaaagatgaataggagccaattcgaggagttgtgtgctgagctacttcaaaagattgaagtgcccctgtacagcctcctcgagcaaacacacctgaaggtggaggacgtgagtgcagtggagattgttgggggcgccacacgaatccctgcagtcaaggagaggatcgccaaattctttggcaaagatatttcaaccactctgaatgctgatgaggcggtggccagagggtgtgccttacaatgtgctatcctctccccagcttttaaggtgcgagaatttagtgtgactgatgctgttccattccccatctctcttatctggaatcacgactctgaggacaccgagggcgtacacgaagtgttcagccgaaaccatgccgcaccatttagcaaagtgttgacttttctccgtagggggcccttcgaactcgaggcattttactctgacccacaaggggtaccatatccagaagctaagatcgggagatttgtggtccagaacgtaagcgcgcaaaaggacggggagaagtctcgagtaaaggttaaagtccgggttaatacccatgggatcttcaccatttccacagccagtatggtggaaaaagtccctacagaggaaaatgaaatgagctccgaggctgatatggagtgccttaatcagagacccccggaaaacccggacactgacaagaacgtgcagcaagacaactccgaagcaggcactcaaccccaggttcagacagatgcgcagcagacttcccagtcgccacccagtcctgaactcacatcagaggagaataagattcctgatgctgataagcagatgaagaaaaaacttacctcactccagaagctgaaatctcctaaatag

SEQ ID NO: 190304 - DNA, 2583 bp, Artificial Sequence
  Description of Artificial Sequence: Synthetic coding sequence
atggccaccgccgccgtgctgcggggccccgccgcccactgggtggaatcatttcagaaggcgagggaggaagggagcggcagtggtacctggagggggaggtggcgccgaagatctgtgatttcgtttggttcgaaaaatcgcacgatcggcgtggcagccaagaatcagcagataactcacgccaacaacacggtttccaattttaaaagattccacggtagggccttcaacgatccattcatccagaaggaaaaagaaaatttgtcctacgacttggtgccactgaagaatggcggggtgggtattaaggtgatgtatatgggagaggaacacctgttctcagtcgagcagatcaccgcgatgctgctcaccaaattgaaagaaaccgctgagaactcacttaagaaacccgtaacggactgcgtgatcagtgtgccttcgttctttactgatgccgagcgacgcagcgtccttgatgctgctcagatcgtagggctcaattgtcttcgcctgatgaatgatatgacggctgtggcactgaattacggtatctacaagcaggacctgccaagcctggatgagaagcccaggatcgttgtgtttgtggatatgggccattccgcgtttcaggtaagcgcctgtgcgttcaacaagggcaaactaaaagttctggggacggcctttgatcccttcttgggaggcaaaaactttgacgagaaattagtggaacacttttgcgccgaattcaagacgaagtacaagctcgatgctaagagcaagattcgcgcgctcttgcgcttgtatcaggagtgtgagaagctaaaaaagcttatgtcctccaactcaacagaccttccgctcaatatcgaatgtttcatgaatgataaggacgtgtctgggaagatgaacaggtcacaattcgaggaactgtgcgctgaactgcttcagaagatagaggtgccgctttatagcctgctagagcagactcatctgaaggtggaagatgtgtctgccgtcgagatcgtcggcggcgccaccagaatccccgcggtaaaagagaggattgccaagttttttggcaaggatatttcaaccacactgaacgctgacgaggccgtagctcgcgggtgcgcgctgcaatgcgccattctctccccggccttcaaagtgcgagaatttagtgtgacagacgcagtgccctttccaatcagcctgatttggaaccacgattcagaggatactgaaggggtgcacgaagtctttagccgcaaccacgctgctcctttcagtaaggtgttaacgttcctgagaaggggcccttttgagctggaagcattttacagtgacccccaaggggtgccatatccggaggctaagattggtcggtttgtcgttcagaatgtgagcgcccagaaggatggagagaagagcagagtgaaggtgaaggtaagagtgaatacgcatggcatttttaccattagcacagcctcaatggtggagaaggtgcctacggaggaaaacgagatgtcatccgaggccgacatggagtgcctgaaccagcgcccccctgagaaccccgataccgataagaacgtccagcaggacaattccgaagctggaacccagccgcaagtgcagaccgacgcgcaacagacatctcagtcacctccatcccccgagttaacttctgaggagaataaaatacctgatgcagacaaagcgaatgagaagaaggtggaccagccacccgaggccaaaaagcctaaaatcaaggtcgtgaatgtggaactccccatcgaagcaaacttggtatggcagctgggtaaagacctcttgaatatgtacatcgagaccgaggggaaaatgattatgcaggacaaactggagaaggaaagaaatgatgctaaaaatgcggtagaagaatatgtgtacgagtttagggacaaactgtgcgggccctacgagaaatttatctgcgagcaggaccaccaaaactttttaaggctgctgacagaaactgaggattggctctatgaagagggcgaggaccaagccaagcaggcctacgtggacaaactggaagaactgatgaagattggtactccggttaaagtgaggttccaggaggctgaggagcggcctaagatgtttgaggaactggggcagcggctgcagcactatgctaagattgccgccgacttccgcaacaaagacgagaaatataaccatatcgacgaaagcgaaatgaagaaggtcgagaagagcgtcaacgaggtgatggaatggatgaataacgtgatgaacgctcaggccaagaagagcttggaccaggaccctgtggtcagggctcaagaaatcaagaccaagatcaaagagctcaacaatacctgcgagcccgtggttacccagcccaaacccaagatcgagtcacccaagctcgaacgcacacctaatgggcctaatattgacaagaaggaagaggacctagaagacaaaaataactttggtgcagagccaccccaccagaatggggaatgctatcctaacgagaagaactcagtaaatatggatctggactag

SEQ ID NO: 190305 - DNA, 582 bp, Artificial Sequence
  Description of Artificial Sequence: Synthetic coding sequence
atggacagcaccctggccgtgcagcagtacatccagcagaacatccgggccgattgctctaacatagacaagatcttggagcccccggagggccaggacgagggagtgtggaaatacgagcatttaaggcagttttgtctggaactgaatgggctcgccgtgaaactacagtcagagtgtcatcctgatacatgtacgcagatgacagccactgaacagtggatctttctttgtgcagcacacaaaacgccaaaagaatgccccgcaatcgactacactagacatactttagacggagcagcttgtctgctcaatagtaacaaatacttcccaagcagagttagcattaaagagtcttccgtggctaagctcgggagcgtgtgccgacgcatctaccgaatcttctctcacgcatactttcaccatcgacaaatattcgacgagtacgaaaacgaaaccttcttgtgccaccgcttcactaaattcgttatgaagtacaacctcatgtctaaggacaacctgatcgtgccaatccttgaggaagaagtgcaaaattcggtgtccggtgagtctgaagcttag

SEQ ID NO: 190306 - DNA, 306 bp, Artificial Sequence
  Description of Artificial Sequence: Synthetic coding sequence
atggccggccaggccttccggaagttcctgcccctgttcgaccgggtcctggtggagaggtctgccgcagagacagttaccaagggcggcattatgctgcctgagaaatctcagggaaaggtgctacaggcaaccgtggtcgccgtgggttctggttctaaaggaaaggggggtgaaatccagccggtgagtgtcaaggtgggggataaagtgcttcttccagaatatggcggtaccaaggttgtcctcgacgataaggtgtgcaaactgaacaacagcaagaagaagagtgatatttgcaattag

SEQ ID NO: 190307 - DNA, 144 bp, Artificial Sequence
  Description of Artificial Sequence: Synthetic coding sequence
atgggcggcgagatccagcccgtgagcgtgaaggtgggcgacaaggtactgctccccgagtacggtgggacaaaggtggtgttggacgataaggattattttcttttccgcgacggtgatattttgggtaaatatgtggactag

SEQ ID NO: 190308 - DNA, 591 bp, Artificial Sequence
  Description of Artificial Sequence: Synthetic coding sequence
atggccgacggccagatgcccttcagctgccactaccccagccggctgagacgcgatccatttcgggatagtccactgagcagtcgactgctcgatgacggatttggcatggatccgtttcccgacgacttaaccgcctcgtggccggactgggccctgcctcgtttgagcagtgcttggccggggacattgcggtctgggatggtgccacgtggtccgactgcgacagctcggttcggggtgcctgcagaaggccggacccctccaccttttccaggagagccatggaaagtgtgtgtgaatgtgcactcatttaaacctgaggagttgatggtgaaaactaaagacggatacgtagaggtgtccggaaagcacgaggagaaacagcaggaaggcggcatcgtgtccaaaaactttactaaaaagatccagctgccagcagaggtggatcccgttacagtctttgccagtctgtcaccagaagggttgctgatcatcgaggcaccccaggtcccaccctacagtacgtttggtgagagctcttttaataatgagttgcctcaggattcacaggaggtaacatgtacttag

SEQ ID NO: 190309 - DNA, 453 bp, Artificial Sequence
  Description of Artificial Sequence: Synthetic coding sequence
atggccaagatcatcctgcggcacctgatcgagatccccgtgcggtatcaggaggagtttgaggctcgcggcctcgaagactgccgtctggaccatgcgctttatgccctgcccggcccgactatagtggatctgagaaagacacgagccgcccagtctccgcccgtggacagcgcagctgaaacccctcctcgggaaggcaaatctcacttccagatcctgctggacgtggtgcaattcttacccgaggacatcattattcagacttttgaagggtggcttctcattaaggcccagcatgggacaaggatggatgaacacggctttattagccgcagcttcactcgtcagtacaaattacctgacggagttgaaatcaaagatctgagcgcagtgttgtgtcatgacggcatactggtcgtggaagtgaaggatccggtaggaacaaaatag

SEQ ID NO: 190310 - DNA, 513 bp, Artificial Sequence
  Description of Artificial Sequence: Synthetic coding sequence
atgagccaccggaccagcagcaccttccgggccgagcggagcttccatagctcgagttcctcgtcctcttcttcaacatcttcctctgcttcacgggcattacccgcccaggacccacctatggagaaggcactgtctatgttctccgacgactttggttcttttatgcggccacattccgaaccccttgccttcccggctcggcctggcggcgcaggcaatatcaaaaccctgggcgacgcttacgagtttgcagttgacgtgcgcgacttctctcccgaagatatcattgtcacgaccagtaataaccacatcgaggtgcgcgccgagaagctggctgctgatggcactgttatgaacacctttgcgcataagtgccagctgccggaggacgtggatcccactagtgtaacgagcgctttgcgggaagacggatctcttacaatccgagcccgccgccatccccatactgagcacgtacagcagacattccgcacagagatcaaaatttag

SEQ ID NO: 190311 - DNA, 792 bp, Artificial Sequence
  Description of Artificial Sequence: Synthetic coding sequence
atgagcggctgcgagctgagccccctgggcctgcgggtgggcctgagcgcaggtccagcgcacggcagacggttccctgccccatctggcccgtggcggggcctaaacctagcaagccgacaaggagcaggccctaagccacgtgacagccgtccatacaaagcggcggccgtgggagcttggcacgctcgacccgaagcctgtgcccatacactcagttgtcctgccctcgcaaggctgggcagggctcgtagaaggccctggatgagccatcgcacaagctccactttccgggctgaacgctcctttcactctagcagcagctcctcatccagcagtacgtcctcatctgccagccgggctctcccagcccaggacccgccgatggagaaagctcttagcatgttcagtgatgattttgggagcttcatgaggccccacagcgaacccctcgcattccctgctgcccatcccacggcgaggccaggcggagcaggtaatattaagactctcggtgacgcctacgagttcgcagtcgacgtccgggacttcagtccagaagatatcatcgtgactactagcaataaccacatagaggtaagagccgagaagctcgcagcagatgggacagtgatgaacacgttcgctcataaatgccagcttcccgaagatgtagacccaacttcagtgacaagcgcattgcgcgaggatggctccctgacaatccgggcacgaagacatccacacactgagcatgtacagcagacattcagaaccgaaatcaaaatttag

SEQ ID NO: 190312 - DNA, 528 bp, Artificial Sequence
  Description of Artificial Sequence: Synthetic coding sequence
atgagccaccggaccagcagcaccttccgggccgagcggagcttccattcttctagttcctcttcatcctcttccacctccagcagtgcctcacgtgcgttgccagctcaggacccacctatggagaaggcgctgtccatgttcagtgacgatttcggcagcttcatgagaccacacagtgaacctttggccttccctgctgctcacccaactgcacggccaggtggtgctggaaatatcaagacactcggcgacgcatatgagtttgccgtagacgtgcgcgacttctcacccgaagacataatcgttactacctctaataatcatatcgaggttagagctgagaaacttgcggccgatggaacagtcatgaacacttttgcccacaagtgtcagctgcccgaggacgttgacccaacatccgttactagcgcactgcgggaagatggcagtctgaccataagggcacggcgtcatccccacaccgagcatgtgcaacaaacattcagaacggagattaagatctag

SEQ ID NO: 190313 - DNA, 207 bp, Artificial Sequence
  Description of Artificial Sequence: Synthetic coding sequence
atgagccaccggaccagcagcaccttccgggccgagcggagcttccacagcagctcctcgagctcaagtagttctacatccagttccgcttctcgagcccttccggcccaggatccgccgatggagaaagctctttctatgttctcagatgacttcggctcctttatgcggcctcattcagaacccctcgcattcccaggaaaatag

SEQ ID NO: 190314 - DNA, 1722 bp, Artificial Sequence
  Description of Artificial Sequence: Synthetic coding sequence
atgctgcggctgcccaccgtgttccggcagatgcggcccgtgagcagagtgctagctccacatcttaccagagcctatgctaaggacgttaaatttggcgccgacgccagggccttaatgctgcagggcgtggatctattggccgatgccgtggctgtgactatggggcctaaaggccgtaccgtgataatagagcagagttgggggagccccaaggtcactaaagacggcgtaacagtggcgaagtccattgaccttaaagacaaatacaagaatattggcgcaaaactggttcaagacgtggctaacaataccaatgaggaagcaggggatggcactaccacggccaccgtgttggcgaggtccatcgcgaaagagggctttgagaagattagcaagggagccaaccctgttgagatccgcaggggcgtgatgctggctgtggacgcagtgattgctgaactgaagaaacagagcaaaccagtaactacccctgaggagattgcacaggtcgcgaccatttccgctaatggtgacaaagaaatcggcaatatcatcagcgacgcaatgaagaaagtggggcggaaaggagtgataaccgtgaaggacggcaagacactgaatgacgagctggaaatcattgaaggcatgaagtttgatcgggggtacatttccccctattttataaacacatctaagggacaaaaatgtgagttccaggacgcatatgtcctgctgagtgaaaagaaaatttccagtatccaaagtatagttcccgctctcgaaattgcgaacgcccataggaaacccttggtcatcatcgcggaggatgtagacggggaggcactaagtaccttggtcctaaaccggctcaaggtcggccttcaggtagtcgcggtgaaagcaccagggttcggagataaccggaagaatcagctgaaggacatggccatcgctaccggaggtgccgtttttggtgaggaggggcttacattgaacttagaggacgtccagccacacgacctgggtaaagtcggcgaggtgattgttacgaaagatgatgccatgctgctgaaggggaagggagacaaggcacagatcgagaagcgcatccaggaaattattgaacaactggacgtgactacctccgagtacgaaaaagagaagctcaacgagaggctggcgaaactgtccgatggggtcgctgttctgaaggtggggggaactagcgacgtggaagtgaacgaaaaaaaagaccgggtcaccgatgctctgaatgcaactcgcgctgctgttgaggaaggtatcgtgctcggcggcgggtgcgcattgctgagatgcatcccagccctggatagcctgacacctgctaatgaagaccagaaaatagggattgaaatcattaaaagaacacttaaaattccggcgatgacaatcgctaaaaatgctggtgtcgagggctcccttatagtggagaagatcatgcagtcctcaagcgaggtaggctacgacgccatggcgggtgacttcgtgaatatggtggagaagggtattattgacccaaccaaagttgtgagaacagccctactggacgccgccggagtcgccagtctgcttactaccgctgaagtagtggtgaccgaaatccccaaggaggaaaaggatccagggatgggtgccatgggcggcatggggggcggcatgggtggcggaatgttttag

SEQ ID NO: 190315 - DNA, 1722 bp, Artificial Sequence
  Description of Artificial Sequence: Synthetic coding sequence
atgctgcggctgcccaccgtgttccggcagatgcggcccgtgagcagagtgttagcaccacatctgacccgggcatacgccaaagatgtcaaatttggcgctgacgcaagggcccttatgctccagggtgtcgatctcctggctgacgccgtggctgtgaccatgggcccgaaagggcggaccgtgattatcgaacagagttggggctcaccaaaggtcacaaaagacggcgtgaccgttgccaaatctattgaccttaaagataaatacaaaaacatcggcgcaaagctggtccaggatgtggcaaacaatacaaatgaagaggctggagacgggaccaccaccgcgactgtgctcgctagaagcattgctaaagagggctttgaaaagatctccaaaggtgctaatcccgtggagattcggcgaggggtgatgctggccgttgatgcagtaattgcagaattgaagaaacaatctaagcctgtcacaactcccgaggaaatcgcgcaagttgccaccataagtgctaacggagataaggagatcgggaacattatcagcgacgccatgaagaaagttgggcggaagggcgttatcactgtgaaggacggtaaaactctcaacgatgagttggagatcattgaaggaatgaagtttgaccgcggatacattagtccttactttatcaacacttcgaaagggcagaagtgcgagttccaggatgcatacgttctgttatccgaaaaaaagatctcttccatccagtctatcgtgcccgccctggagatagccaatgcgcacaggaaaccccttgtcatcattgcggaagatgtggatggggaggctctaagcactctcgtgctcaaccgactgaaagtgggtttgcaagtggtcgctgtcaaagcgccgggctttggggacaaccgaaagaaccagcttaaggacatggcaatagccaccggcggcgcggtcttcggtgaagaggggcttaccttgaatctagaagacgttcagccccatgatcttggcaaggtgggcgaagtgatcgtaacgaaggacgacgccatgctgctaaaaggaaagggggacaaggctcaaatcgagaagcgaatacaggagatcattgaacagctggatgtgacgacttccgaatacgagaaagagaagttaaacgagaggctggcaaagcttagcgacggcgtagctgtgcttaaagttggcggcacatctgacgttgaggtgaacgagaagaaggatagggtgactgatgccctgaacgccacccgggctgctgtagaagagggtattgtcctcgggggggggtgcgccctcttgcgctgcatcccagccttagatagccttacacctgcaaacgaggatcaaaagattgggatcgagatcatcaaaaggacacttaagattccagcgatgaccattgctaagaacgcaggcgtagaaggatccctgatagttgagaaaatcatgcaaagctcatctgaggtgggatatgacgcgatggccggggattttgtgaacatggtggagaaagggatcatagaccctacaaaggttgtaaggacagctcttttggacgccgctggggtcgcctcacttctgaccacagccgaggtcgtcgttactgagatcccgaaggaggagaaagacccagggatgggtgccatgggtgggatgggaggcggaatgggtggcggcatgttctag

SEQ ID NO: 190316 - DNA, 177 bp, Artificial Sequence
  Description of Artificial Sequence: Synthetic coding sequence
atgctgcggctgcccaccgtgttccggcagatgcggcccgtgagcagagtgctggccccccatctgaccagggcatacgcaaaagacgttaaatttggggcagatgccagagccctgatgctgcaaggtgtggatctgctggcagatgccgtggccgtgactatgggccccaaatag

SEQ ID NO: 190317 - DNA, 285 bp, Artificial Sequence
  Description of Artificial Sequence: Synthetic coding sequence
atgctgcggctgcccaccgtgttccggcagatgcggcccgtgagcagagtactggccccgcacttgacaagagcctacgcgaaggatgtcaagttcggcgccgatgctcgcgcgttgatgctgcagggagtggatctacttgcagacgctgttgccgtaacaatgggcccaaagggccgtacagtcattatcgaacagtcatggggcagccccaaggtcacaaaggacggcgttactgttgccaagtctattgaccttaaggacaagtataagaatataggatag

SEQ ID NO: 190318 - DNA, 705 bp, Artificial Sequence
  Description of Artificial Sequence: Synthetic coding sequence
atgctgcggctgcccaccgtgttccggcagatgcggcccgtgagcagagtgctggcaccacacttgacccgtgcatacgcaaaggatgttaagtttggggcagatgctagagctttgatgctccagggagtggacctgcttgcggacgccgttgccgttacaatgggccctaaggggcgaacggttatcatcgagcagtcatgggggtccccgaaagtcaccaaagacggggtcaccgtcgccaagtctattgatctgaaggataaatacaaaaacatcggggccaaacttgtgcaggatgtggcaaataacactaacgaggaggccggcgatggaaccaccactgctacagtgctcgcgcgcagcatcgccaaagaaggttttgagaaaatttcaaagggcgccaaccccgtggaaatcaggcggggggtgatgcttgcagtagacgccgtaatcgcagagcttaagaagcagtcgaagccagttacaactccggaagagatcgctcaggtcgctacaattagcgccaacggcgataaagagattggaaacattatatccgacgccatgaagaaggtgggacgcaaaggggtcatcacagatggcaagaccctgaatgatgaactcgagatcattgaggggatgaaattcgacagaggatacatatccccgtattttattaatacatctaaaggcaagaactag

SEQ ID NO: 190319 - DNA, 252 bp, Artificial Sequence
  Description of Artificial Sequence: Synthetic coding sequence
atgctgcggctgcccaccgtgttccggcagatgcggcccgtgagccgagtccttgcgcctcatctgacgcgcgcctacgccaaagacgtcaaattcggcgccgacgcccgagcactgatgcttcagggagttgacctactagccgacgccgtggcagttaccatgggtccaaaggggaggactgtaatcattgagcaatcgtgggggtcaccaaaggtcacaaaggatggggtaacagtagccaagtcatag

SEQ ID NO: 190320 - DNA, 666 bp, Artificial Sequence
  Description of Artificial Sequence: Synthetic coding sequence
atgctgcggctgcccaccgtgttccggcagatgcggcccgtgagccgggtgcttgctccccacctgacgcgggcctacgccaaagatgtgaagttcggcgccgatgccagggctctgatgctgcaaggcgtggatctgctcgccgacgcagtggctgtgacaatgggacctaaggggaggactgtaatcatcgagcaaagctggggctcacccaaagtgaccaaagacggggttactgtcgccaaatcaatcgacctgaaggacaagtataagaacatcggagcaaaactagtgcaagatgtcgctaataatacaaacgaagaggctggggatggaacaaccactgccactgtcttggctcgctcaatcgcaaaggaaggattcgaaaagatatccaaaggggctaaccccgtggaaatcaggaggggggtgatgctagctgtcgatgccgtcatcgccgagctcaagaagcagagcaagcctgtcacaactcccgaggaaattgctcaggtggccaccatctctgctaatggagataaagaaataggtaatattatatcagatgccatgaagaaagtgggacgcaagggcgtgattactgtcaaggacggtaagaccctgaacgatgaactggagatcatcgagggtatgaaatttgaccgatag

SEQ ID NO: 190321 - DNA, 738 bp, Artificial Sequence
  Description of Artificial Sequence: Synthetic coding sequence
atgctggccgtggacgccgtgatcgccgagctgaagaagcagagcaagccagtcacaacaccagaagaaatcgcccaagtggcaactatatcagcaaatggcgacaaagagataggaaatatcatttctgatgcaatgaaaaaagtgggcagaaaaggcgtaattacagtgaaagacggtaaaactctgaacgatgaactcgagataattgagggcatgaaattcgatcgcggctacatttcaccctactttatcaataccagtaagggccaaaaatgtgagtttcaagacgcatatgtactgttgtcagagaaaaagatttctagtattcagtctatcgttcctgccctcgaaattgcgaacgctcacaggaaaccactagtgatcattgccgaagatgtggatggcgaagcattgagcacactagttctgaacagactgaaggttggtctgcaggtagtggccgtcaaggccccaggctttggtgacaaccgtaaaaaccaactcaaagacatggctatagcaactggcggggccgtgttcggcgaagaggggcttactttgaaccttgaggatgtgcagccccacgatctcggaaaggtgggagaagttattgtcacaaaggacgatgcaatgttgctgaaggggaaaggcgataaagctcaaatcgaaaaaagaattcaggagattatcgagcagttagatgtgactacgagcgagtacgaaaaagagaactag

SEQ ID NO: 190322 - DNA, 477 bp, Artificial Sequence
  Description of Artificial Sequence: Synthetic coding sequence
atgctgcggctgcccaccgtgttccggcagatgcggcccgtgagcagggtactcgcgccacacctgacccgggcttacgctaaggacgttaagtttggagcagacgccagagccctgatgctgcagggggtcgatttgctggccgatgccgtggcggtcacgatggggccaaaggggcgaacagtgattattgagcagtcctggggtagtccaaaagtgacaaaagacggagtgaccgtcgcgaaaagcatcgacctgaaggataaatacaaaaacattggggccaagctcgtccaagatgtggccaacaacactaatgaagaagcgggcgatgggaccaccacagccactgtgctggcaagatccatcgcaaaagaagggtttgaaaagatttcgaagggagccaaccctgtcgagatcaggcgtggccggaacgtgtgttgccaccattctgtgctgaatttctccgtactgtag

SEQ ID NO: 190323 - DNA, 2061 bp, Artificial Sequence
  Description of Artificial Sequence: Synthetic coding sequence
atgctggccgtgcccgagatgggcctgcagggcctgtacatcggctcctcccctgagaggagccctgtaccaagtccacctggatcaccccgaacccaggagtcttgtggaattgctcccctcacaccctctcaaagccccaaacccgaggtacgcgccccccaacaagcctcattttccgttgtcgtggcaatcgatttcggcactacgagctccggctacgcgttttccttcgcatccgatccagaggctatacacatgatgcgcaagtgggaagggggcgatcccggggtggcacatcagaaaaccccaacctgtctgctgctcacaccggagggagcatttcattcttttgggtatacagccagggactattatcacgatcttgatccggaggaagcacgggactggctgtatttcgagaaatttaagatgaaaattcacagtgccaccgacctcaccctgaagacgcagttagaagcagtgaatggtaaaacgatgcctgccttggaggtattcgcacacgctctccgcttcttcagagaacatgcccttcaggagctgcgcgagcagtccccttcccttcccgagaaggataccgtacggtgggtactgactgtgcccgccatctggaagcagcctgcaaagcaattcatgcgcgaagccgcctacctcgccggactcgtcagtcgcgaaaacgccgaacagctgctaattgctcttgaacctgaagccgcctctgtgtattgccggaagctccgccttcatcaattactcgacctgtctgggcgggccccaggcggcggaagactcggagagcgcagatcaatcgattccagcttcaggcaggccagagaacaactgcggcgaagtcgacactcaaggacattcctagtcgaaagtggcgtcggagagttgtgggccgagatgcaggctggcgataggtacgttgtggcggattgcggcggcggtactgtggatttgactgtacatcaattggaacaacctcacggaactctcaaggaattgtataaagcctcggggggaccatatggcgccgtcggtgtagacctggctttcgagcagctcttatgccgaatattcggggaggatttcattgctacttttaagaggcaacgaccggccgcctgggtagatttgacgatcgccttcgaagcccgaaagagaacagccggccctcaccgcgccggagctcttaatatctcactccctttctcctttatcgacttctatcgcaaacagcgaggccacaacgtggagaccgcattgcgacggtcttctgttaactttgttaaatggtcatcacagggaatgctgcgtatgagctgtgaagctatgaatgagctcttccagcctactgtctccggaataattcagcacatcgaggccctgctggcaagaccagaggtgcagggagtgaaactgctgttcctggttggtggctttgctgagtccgctgtgttgcaacatgccgtccaggcagccctgggggcccgagggctcagagtcgtggttcctcacgacgttggcctcacgatcctgaaaggtgctgtattgtttgggcaagcacctggtgtggttagagtacgccgtagccccttgacgtatggagtaggcgtcctcaataggttcgtaccaggaagacatccccctgagaagcttctggtgcgtgacggcaggagatggtgtaccgacgtattcgagcgcttcgtggccgccgagcaatctgtagcactgggtgaagaagtccgacgatcatattgccccgctcggcccggtcaacgccgggtactgatcaatctatactgctgcgccgcagaggatgctaggtttatcaccgaccccggagtgagaaaatgcggcgcactgtctcttgagctggagccagccgattgtgggcaagatactgcgggcgctccccccggccgacgggaaattcgcgcggccatgcagttcggcgacaccgagatcaaggttaccgctgtggacgtaagcacaaaccgcagcgtacgggctagtattgacttcctgagcaactag

SEQ ID NO: 190324 - DNA, 1803 bp, Artificial Sequence
  Description of Artificial Sequence: Synthetic coding sequence
atgatgcggaagtgggagggcggcgaccccggcgtggcccaccagaagacccccacctgtttgttgctgacaccggaaggtgctttccactcgttcggatataccgccagagactattaccatgatctcgaccccgaggaggcaagggattggctttattttgaaaagtttaaaatgaagatccatagcgccacagatctcaccctgaaaacccagctggaggctgttaacggtaaaaccatgcctgccttagaggtgtttgcccacgccctgagatttttccgcgagcacgctttgcaagagctgagagaacaaagcccttcactgccggaaaaggatacagtgaggtgggttttaacagttcctgctatatggaagcagcctgccaagcaatttatgagggaggcagcttacctggccggattggtgagcagagagaatgccgaacagctcctgatcgcactggagcccgaagctgctagcgtctactgccgaaaactgcggttacatcaattgctggatctctctggccgcgctccgggtggaggcagactgggcgaacgccgcagcattgactcaagcttccgccaggctagagagcagcttcgtaggagcagacacagtcgaactttccttgttgagagcggtgtgggagagctctgggctgagatgcaggccggtgacagatatgtggtggcagactgcggcggcggaaccgtggatctaacagtccatcagctagagcagcctcatggcactctgaaggagctgtacaaagcctcaggagggccttatggggcggtcggtgttgatttagctttcgaacagctactatgtagaatctttggagaggatttcattgctacctttaaaagacagcgccctgctgcttgggtggacctgaccattgcatttgaagcaagaaaacgcaccgccgggccacaccgcgccggggccctgaacatcagtttaccgttttcgttcattgacttttaccggaaacagaggggacataatgtcgagaccgctctcaggaggagttccgtaaacttcgtgaagtggtcttcccaagggatgttgagaatgtcttgcgaggccatgaacgaactttttcagcccacggtttcgggaataatccagcacattgaggcactcctggccagacctgaggttcagggagttaagctgctgtttttggtgggtggttttgccgaatcggccgttttgcagcacgcagtgcaggcagccctgggcgcgcgaggtcttcgtgtggtcgtgccccacgacgtgggactgacgatcttgaagggcgcagtgctttttggtcaggctcctggcgtcgtgcgggtcagacgctcaccgttaacgtatggggtaggagtgctaaacagattcgtccccggccggcacccccccgaaaagttgctggttagggacgggaggcggtggtgcaccgacgtatttgaacgctttgtcgccgcggagcaaagcgtcgctcttggggaagaagtgagacgctcttattgtcctgcacgaccgggacagcgaagagtgttaattaacctttactgttgcgccgcagaagacgcccggttcataacggaccccggggtgagaaagtgcggcgccctctcactagagctggaacccgcagattgcggccaggataccgctggcgcccctcccggcagaagggagattcgagctgctatgcagtttggtgacacagagatcaaagtgaccgctgtcgacgtcagcaccaatcgctctgtaagagcctctatcgacttcctatcaaattag

SEQ ID NO: 190325 - DNA, 1563 bp, Artificial Sequence
  Description of Artificial Sequence: Synthetic coding sequence
atgcccgccctggaggtgttcgcccacgccctgcggttcttccgggaacacgctcttcaggagctcagagagcagagcccaagtctgcctgagaaggatacagtgcgctgggtcttaaccgtcccggcgatctggaagcagcccgccaagcagttcatgcgagaggccgcatacctggccggtcttgtatcccgtgagaatgctgaacagctcctcatcgctctagagccagaagcagcatcggtgtactgcaggaagctaaggctgcaccagctgttggacttatcaggccgagccccaggcggggggcggttaggggagcgacgaagcatcgatagctccttcagacaggcccgagagcagcttcggcgatctcgtcactctcgaactttcctagtggagtccggggtgggcgaattgtgggcagaaatgcaggcaggggataggtacgtcgtcgccgactgtggggggggtactgttgatttgacagtgcatcagctcgagcaaccgcatggcacgctgaaagagttgtacaaagcctctggaggcccgtatggagccgtgggagtcgatctagctttcgagcagttactttgcaggatattcggggaagatttcatcgcaacattcaagagacaaaggccagccgcgtgggtggaccttactatagcgtttgaggctaggaagagaacggctggtcctcaccgggcaggagctctaaatatatctttacccttcagctttattgatttctataggaagcagaggggccacaacgtcgaaactgcgctccggcgttcctccgtcaatttcgtgaaatggagctcccagggaatgctgcggatgtcctgcgaggcaatgaacgaactttttcagcctacggtgtccggcatcatccagcacatcgaggctctgctggcacgtcctgaggtgcagggggtcaaactgctttttctcgtgggcgggttcgccgagtccgctgtgttgcagcacgccgtgcaggctgctttgggcgcccggggcctgagggtcgtggtgccccacgatgtgggattaaccatcttgaaaggagcagtcctattcggccaggcccccggcgtggtcagggtgcggcgctcgccactaacctacggtgtcggggtgctgaatagatttgttcctggaagacatcctccagaaaaactcctggtgcgtgacggtcgccgctggtgcaccgacgtatttgaaaggttcgtcgccgccgagcaaagcgtggccctaggcgaggaggtgcggcgcagttactgccccgcccgccccgggcagagaagggtgctgatcaatctctattgttgtgccgccgaagacgcacgattcatcactgaccctggagtgcgcaaatgtggcgctctgagcctggaactggaacccgccgattgcggccaagataccgcaggtgcacctcctgggcggagggagatccgggctgccatgcaattcggcgataccgaaattaaggtcaccgccgtggatgtgagcacaaaccggtcggtccgagcatcaattgactttcttagcaactag

SEQ ID NO: 190326 - DNA, 2028 bp, Artificial Sequence
  Description of Artificial Sequence: Synthetic coding sequence
atggccgacaaggaggccggcggcagcgacggcccccgggagaccgctcccacgtccgcatatagcagtcctgcacgctccctaggagataccggcatcactcctctgtcacctagccatattgtgaatgacactgacagcaacgtgtccgagcagcaatcttttttggtcgtggtcgccgttgacttcggaacgaccagtagtgggtatgcctactctttcacaaaggagccagaatgtatccacgtgatgcgtagatgggaaggaggtgaccctggagtgtccaaccaaaaaactccaactacaattctgctgaccccagagagaaaatttcatagtttcggctatgccgctcgcgacttctatcacgacctagaccccaatgaggccaagcagtggctctaccttgagaagtttaagatgaagctccacacaactggtgatctcaccatggatacagatctgaccgcagccaacggcaagaaagttaaggccctggagattttcgcttacgccctgcaatatttcaaagagcaggcattgaaagagctttccgatcaggcaggctctgaatttgaaaactcagacgtccggtgggtcattacggtccccgccatctggaagcagcccgccaaacaattcatgcgacaggcggcctaccaggcaggcctcgcaagcccagagaatagcgagcagttgatcattgcgctggagcccgaggccgcaagcatttactgtagaaagctgcgactgcaccagatgatcgagctgtcgagcaaagcagctgtcaacggatattcgggatccgataccgtgggtgccggctttactcaggcaaaagaacacataagacgcaaccgccagagccgaacgtttttagtggaaaacgtaatcggtgaaatctggtctgagttagaggaaggcgacaagtacgtggtggttgactctggcggagggacggtggacctgactgtccaccagatccggctgcccgagggccacttgaaagagctgtataaggctaccggggggccatacggatcacttggcgtcgattatgaattcgaaaagctcctgtacaaaatctttggcgaggactttatcgagcagttcaaaattaagagacctgcagcctgggtggacttaatgatcgcgttcgagagcaggaaaagggcagctgccccagatcgcacaaacccattaaatatcactttgccattcagctttatcgattactataaaaagttccgaggtcatagcgtcgagcatgcattgagaaaatccaatgtggattttgttaaatggagctcccaggggatgttgagaatgagccctgatgccatgaatgcactgttcaaaccgaccatcgatagtatcatcgagcaccttagagatttgttccagaagcccgaagtctctaccgttaagtttctgttcttggtgggaggattcgctgaggcacctctcctccaacaagccgtccaagccgcttttggcgatcagtgtcggatcattatccctcaagacgtgggcctcactattctcaaaggcgcagtactgttcggtctcgatccagccgtgattaaggtaagaagaagcccacttacatatggagtgggagtgctcaacaggtacgtggagggtaaacacccccctgagaaactgctcgtgaaagatggcacgagatggtgtacagacgttttcgacaagtttattagtgcagatcagtccgtggccctgggtgaactggtgaagcggtcctacacaccagctaaaccatcacagctggtgattgttataaacatttattccagcgaacatgataacgtgtccttcatcacagatcccggggtgaaaaaatgtggtaccttgcgactggatttaactggcacctctgggacagcagtccccgcaaggcgggaaattcagactttgatgcagtttggcgacaccgaaattaaggctaccgccattgatatagcgaccagcaagtccgtcaaagtaggcatcgacttcctgaactactag

SEQ ID NO: 190327 - DNA, 819 bp, Artificial Sequence
  Description of Artificial Sequence: Synthetic coding sequence
atgcggagcctggacctggccagccagctgctgcggaaccagatcgtgaccgaccccgacaatttgatggaagacgccgcctgggcaaaacattgtgatcagaacttagttgccagcgatgcaccaggagaagagggtacaggtatcctgaagagtaagcgtacacaagccgcagaccaccagccaatcttaaagaccgtcaaagcctccgacgaggactgccagttgagaatttctgatcgcattcgtgagacatccgaccttgaagactcatgggacgaatcctcaggcgcaggctgctcgcagggtaccccctcatacagttcctctcattcgctgttcaggggcgctgtggcaccctgccagagtagtcccatggccagactgggcgtcagtggagaaccctcaccatgtacttccacaaacaggagcactcccggggttgcctcgacaccacagacccccgtgtccagctctcgtgctggtttcgtttccggcggagaccgacctctcacctccgagcccccacccaggtgggccaggaggcgccgcagaagtgtggcccggacaattgcagcggaactcgcagagaaccgaagattggcccgggaactttcaaagcgggaagaagagaaactggaccgccttattgctataggtgaggaggcgtccgcacaacaggacaccgccaatgaattgcggagagatgcagtgatcgcagttcgtaggctggcgaccgccgtcgaggaggccactggggccttccagctgggcttagaaaaactactgcagagactaatctctaacacaaagtcgtag

SEQ ID NO: 190328 - DNA, 1530 bp, Artificial Sequence
  Description of Artificial Sequence: Synthetic coding sequence
atggccgccatcggcgtgcacctgggctgcaccagcgcctgcgtggccgtctataaggatggcagagctggggtggtagccaatgatgctggggacagagtgacccccgccgtggtcgcctactccgaaaacgaagagatcgtgggccttgctgccaaacaatctaggataagaaatatcagcaacacagtcatgaaagtcaagcaaatcctgggtagatcctcctctgaccctcaagcccaaaagtacattgcagagtctaaatgtctcgtaattgagaagaatggcaaactccgatacgaaatcgataccggggaggaaactaaattcgtgaaccctgaagacgttgccagactcatcttctcgaagatgaaggaaactgcccactctgtgcttggttccgacgccaacgacgtggtgatcacggtcccctttgattttggagagaaacagaagaatgctctaggtgaagcggcaagggccgccggcttcaacgtgctaagactaatccacgagccttccgccgcccttctggcgtacggcatcgggcaggacagccccactggcaagtctaatatcctcgtgttcaagcttggcggaacaagccttagcctcagcgtcatggaggtgaatagcgggatttaccgtgtcttgagcaccaatactgatgacaatatcggcggggctcacttcacggagaccctggcccagtacctcgcctctgaattccaaaggagctttaaacacgatgttaggggtaacgcccgagccatgatgaagctaactaactccgctgaagtggcaaagcacagtctctccaccctggggagtgccaactgtttcctcgatagtctgtatgagggacaggacttcgattgcaacgtgtccagagccagattcgaactcttatgtagcccattgtttaacaagtgcattgaggctattaggggattgttggatcagaacggcttcactgcagatgacattaacaaagtcgtgctgtgtggtggctccagcaggatccctaagctgcagcagctcattaaagacttgttcccagcggtcgagcttttgaactctatccccccagatgaggtgatcccaatcggtgccgcaattgaggctggaatcctgatcggtaaggagaatctcctggtggaggacagcttgatgatcgaatgtagcgctagggacatattggtcaagggggtggatgaaagtggtgcaagccgcttcacggtgctgttccctagtggcacacctctgccagcccgacggcagcacactctccaggcccccggctctatctcctcagtatgtctcgagctgtacgaatccgatgggaagaacagtgctaaggaagagaccaagtttgcacaggtggtactgcaagacctcgacaagaaggaaaacgggttacgggatatcttggccgtgctgaccatgaagcgcgacggttctctgcacgtgacatgcaccgatcaggagaccggaaaatgtgaagcaatcagcatcgaaatcgccagttag

SEQ ID NO: 190329 - DNA, 432 bp, Artificial Sequence
  Description of Artificial Sequence: Synthetic coding sequence
atggccgccatcggcgtgcacctgggctgcaccagcgcctgcgtggcagtgtacaaggatggcagagccggagtagtcgctaacgacgctggagaccgcgtgacacccgccgtggtagcatattcggagaatgaagagatcgtaggtctcgcagctaagcagtccaggataagaaatatctcaaatacagtcatgaaggtcaaacagatcttagggcgccgtgtactgtctagagacccgcagctgcagcagcttcctcagccctttcagcgatgttcatgtagtctgagtgaacagcctcacgggcagaccgggtgtgttcgcggagcacaacctcttcaccagcatcagccacaacattcatggggatcattgcatactgccgatagttctttacttttcgagtcttggttttgcttctggtggggctag

SEQ ID NO: 190330 - DNA, 387 bp, Artificial Sequence
  Description of Artificial Sequence: Synthetic coding sequence
tgagcctgcgtggccgtgtacaaggacggccgggccggcgtggtggctaacgacgccggcgaccgagtgacccccgctgtggtcgcctactccgagaacgaggaaattgtggggctggccgcgaagcaatccaggatacgaaacatctcgaatacagtcatgaaggtgaagcagatactaggccgcagcagtagcgatcctcaggcccagaagtacatcgcagaaagtaagtgcctggtgattgaaaaaaatggtaagctgcggtatgagatcgatacaggggaggagacaaagttcgttaacccagaagacgtggcgcgtcttattttttccaagatgaaaggtgcatatagtccctggtcccagagcaatagtgaggatggctag

SEQ ID NO: 190331 - DNA, 1926 bp, Artificial Sequence
  Description of Artificial Sequence: Synthetic coding sequence
atggccaaggccgccgccatcggcatcgacctgggcaccacctacagctgcgtaggcgtgttccagcatgggaaagtggaaattatcgccaacgaccagggcaaccgaacaaccccaagctacgtagcttttacagacaccgagaggctcattggcgacgccgctaagaaccaggtggctcttaatccccagaatactgtgttcgacgccaagaggttaattggtaggaagtttggagaccccgtggtacagtcagatatgaaacactggcccttccaggtgatcaacgacggggacaaaccaaaggtacaggtgagttacaagggggaaacaaaggctttttacccagaggagataagttcaatggtcctaactaaaatgaaagaaatcgctgaggcctaccttgggtacccagtaacaaacgctgttattaccgtgcctgcatattttaacgactctcaacggcaggccaccaaggacgccggtgtcattgctggtttgaacgtcctccggataatcaacgaacctaccgccgcagccattgcttatggcttggaccgcactgggaaaggtgagaggaatgttttgatctttgatctgggcggcgggaccttcgatgtctccatcctgactatagacgatggaattttcgaggtgaaagccactgcgggcgatacccatctgggcggggaggatttcgacaaccggttagtgaaccattttgtcgaggagttcaaacggaaacataagaaagacatttcacagaataagcgggcggttagacgtctcaggacagcctgtgagcgagccaagcgaactctgtcctcttccacacaggcctcgctggagatcgattctcttttcgagggcatcgacttttacacctccatcactcgcgctcgcttcgaggagttatgttccgacctatttcggtctacacttgagcctgtagaaaaagcgcttagggacgcgaaactcgataaagctcagatacacgacttggtcctcgtagggggctcgaccagaatacccaaagtgcagaagcttttacaggatttcttcaacggccgagatctaaataagagcattaatcctgatgaagccgttgcctacggcgccgccgtccaggccgccatcctgatgggggataaatcagagaacgtgcaggatctgctgctcttggacgttgcccctctgtcacttggactggaaactgcaggaggtgtaatgaccgcactgatcaagaggaattccacgatacctactaagcagacacaaattttcactacatacagcgacaatcagccaggggtactcattcaggtgtatgagggcgaacgtgcaatgactaaagacaataatctgctgggtaggtttgagttatctggcatcccgcctgcgcccagaggtgtaccccaaatcgaggttacgttcgacattgacgctaacggcattctcaatgtgaccgccaccgataagtcaaccgggaaggcaaataaaatcactattacaaatgacaaggggagactttccaaagaagagatcgagcgcatggtccaggaagccgagaagtacaaagctgaggatgaagtccaacgggaaagagtgagcgcgaagaacgcattagagagctatgccttcaatatgaagagcgccgtggaggatgagggcttgaaaggcaagatctccgaggccgacaaaaagaaggtcttggacaagtgtcaggaggtgatctcctggcttgatgccaacaccctggctgagaaggatgagttcgagcacaagaggaaagagttagagcaggtctgcaatcccattatatcaggcctataccagggagctgggggccccgggcccggaggcttcggggctcagggcccaaaggggggatcaggctctggaccaactatcgaggaagtggattag

SEQ ID NO: 190332 - DNA, 1431 bp, Artificial Sequence
  Description of Artificial Sequence: Synthetic coding sequence
atggccaaggccgccgccatcggcatcgacctgggcaccacctactcttgcgttggcgtgttccaacacgggaagggtgagaggaacgtactcatcttcgaccttggcgggggaacattcgacgtttcgattttgactattgacgatgggatattcgaggttaaggcaacggctggagacacccacctgggcggagaagatttcgataacaggttggtgaaccacttcgtggaagagttcaagcgcaagcataagaaagatatatcacaaaataagagagctgtccggagactgaggacggcttgcgagagggctaagaggacactgtctagctctacccaggctagcctggagattgatagtctcttcgaaggcattgacttctacacatcaatcacgcgggcacggtttgaggaactgtgctcagatctgttccgcagcacactcgagccagtcgaaaaagcactgcgggacgctaagttggacaaggcccaaatccatgacctcgtgctcgtgggaggatctacacgaattccgaaagtgcagaaactactgcaggacttctttaacggccgcgacctgaacaaatctataaatccagatgaggctgtcgcctacggcgcagcggtccaggcggccattctcatgggagataaatcagagaacgttcaggacttgctgctgctcgacgtggctcctctgagcctgggattggagacagccggtggtgtgatgaccgctctgattaagagaaattcaaccatacccacgaagcaaactcagattttcacaacgtactccgataatcagccaggcgtgctcatccaagtttacgaaggagaacgggccatgacgaaagacaataatctgttggggagattcgagctctccggcatcccgccggcgcctcgtggtgtacctcagatcgaggttacgtttgacatcgacgcgaacggcattctgaacgtaaccgcaacagacaaatcgacagggaaagccaacaaaatcaccatcacaaacgacaaagggagactaagcaaggaggagatagaaagaatggtccaggaagctgagaagtacaaagctgaggacgaggtgcagcgggagcgagtcagtgccaagaatgccctcgagtcttacgctttcaatatgaaaagcgcagttgaagatgagggccttaaaggcaagatttccgaggcagacaaaaaaaaggttctggacaagtgccaagaggtcatttcctggttggacgccaacacacttgccgaaaaagacgagtttgagcacaagcggaaggagttggagcaagtgtgcaatcctattatctcaggcctgtatcagggtgctggcgggccaggacccggcggattcggagcccagggaccgaagggcgggtctggttccggacctacaatcgaggaagtcgactag

SEQ ID NO: 190333 - DNA, 1431 bp, Artificial Sequence
  Description of Artificial Sequence: Synthetic coding sequence
atggccaaggccgccgccatcggcatcgacctgggcaccacctactcctgcgtcggggtgttccagcatggaaagggagaaaggaatgtgttaatatttgacctgggcggagggacttttgatgttagcattctgacaatagatgatggaatttttgaagttaaagccactgcaggggatacccacctggggggggaggattttgataaccgcctagtcaatcacttcgttgaagaattcaagcggaaacataagaaggacatttcacagaataagagggcagttaggagactgcgcactgcatgtgaacgggctaagaggactttgagtagctccacccaggccagcctggagatagactccctttttgagggaatcgacttctatacttcaattacgcgcgcccgattcgaggagttatgctcagacctattccgaagtaccctggaacctgtggagaaggccctgcgcgatgccaaactcgacaaggcgcagatccatgacctagtgttggttggaggcagtacccggattcctaaagtacagaaactgctacaggacttcttcaacggccgcgaccttaacaagtccatcaatccagatgaagccgtggcttatggggccgccgtgcaagctgcaatcctcatgggggataaatccgaaaacgtgcaggatctcctgctcctcgatgtggcaccactctcactaggcctcgagaccgcaggtggcgtgatgaccgctttgattaaacgcaactcaaccattcccaccaagcagacgcagatatttacaacgtacagcgacaatcagcctggagtgctcatccaggtgtatgagggtgaacgcgccatgaccaaggataataacctgctgggtcggttcgagctgtctgggatacccccagcacctagaggtgttccccaaatcgaggttacatttgacatagacgccaacggcattttgaacgtaactgccactgacaaaagcactggcaaggccaataaaatcaccatcactaacgataaaggacgattatcgaaggaggaaatcgagaggatggtgcaggaagccgagaaatataaagctgaggatgaggtgcagcgagagagagtcagcgcaaagaacgcccttgaaagctacgcctttaatatgaagagcgccgtcgaagatgagggattgaagggaaaaattagcgaggctgacaagaagaaggtcctcgataaatgtcaggaagttatttcttggctggatgcaaacacgctggcagaaaaagatgagtttgagcacaaaagaaaagagttggaacaggtctgcaacccgatcatctcgggcctgtatcaaggagctggtggccctgggccaggaggttttggagctcagggaccaaaaggcgggtctggcagtggccccacaattgaggaagtagattag

SEQ ID NO: 190334 - DNA, 1926 bp, Artificial Sequence
  Description of Artificial Sequence: Synthetic coding sequence
atggccaaggccgccgccatcggcatcgacctgggcaccacctactcctgtgtgggcgtttttcaacatggaaaggtggagattatcgcgaatgaccaaggcaaccgaacgacaccctcttacgtagcctttactgatacggaaagacttatcggagacgccgccaagaaccaggtggcccttaatccccagaacactgtcttcgatgccaagaggcttatcggccgtaagttcggcgaccctgtggtgcagtcagatatgaagcactggccttttcaggttattaatgatggggacaaacccaaagtccaggtgtcctataaaggggataccaaggcgttctaccccgaggagatatccagcatggtgttgacaaagatgaaggagattgccgaagcgtacttgggctatcctgtgacaaatgccgtgattaccgtgccagcctactttaacgattcacagcgacaagcaaccaaggatgctggcgtgatcgcaggactgaacgtgctcagaattatcaatgagccaacagcagcggccattgcctacgggctcgatcgaactggaaagggtgagcgcaacgttcttatattcgatctcggtgggggcacgttcgatgtttcaattttgactatagatgacggcatttttgaggttaaggccactgccggcgacactcatctgggtggagaggatttcgacaaccgactggtcaaccatttcgtggaggagtttaagcggaaacataagaaagacatctctcagaacaagagggctgtgcggagactgcgcacagcctgcgagcgtgccaagcggactttgtcctcctccacccaggcttcccttgagattgacagtctgttcgagggcatcgatttttacacatcaatcacccgtgccaggtttgaggagctctgctccgatctgtttcgatctactcttgaacccgtggagaaagctctgagggacgctaagctggacaaggcgcagatccatgacctcgtgcttgtcggcggttctacacggatccccaaggtccagaaactgctgcaagatttcttcaacgggagagatctcaacaaaagcattaatcctgatgaggcagtggcatacggagccgccgtacaggccgccatcctgatgggagataaaagcgagaatgtccaggatctcctactgctggacgtggctcctctcagcctgggtcttgagacagctggaggcgttatgactgctcttattaagagaaactctacgattcccactaagcagacacagatatttacaacgtatagtgacaatcagccaggcgttctaattcaggtgtatgagggagagcgggcaatgaccaaagataataatctcctcggccgcttcgagctctcgggcatccctcctgctcctcgtggagtcccccagatcgaggttacatttgacatcgacgctaacggaattctgaatgtgaccgccacagataagagcaccgggaaagcaaataagatcacaattaccaacgataaggggcgcctgagtaaggaagaaatagaaagaatggtgcaagaggctgaaaaatataaggccgaagacgaggtgcagagagaacgcgtctcagctaaaaacgctctcgagtcctacgcattcaatatgaagtctgctgtggaagatgagggacttaaagggaagataagtgaagccgataagaagaaagtgctcgacaaatgccaagaagtgatttcgtggcttgatgccaataccctggccgagaaggacgaatttgaacataagcgaaaagaactggaacaggtgtgcaaccctatcatctccggactctaccagggcgctggaggcccaggcccaggaggttttggggctcagggccctaagggtggcagtggctccggccctaccattgaggaggtggattag

SEQ ID NO: 190335 - DNA, 1431 bp, Artificial Sequence
  Description of Artificial Sequence: Synthetic coding sequence
atggccaaggccgccgccatcggcatcgacctgggcaccacctactcctgtgttggcgtgtttcaacatggcaaaggggaacgcaacgtgctgatcttcgacttgggaggaggtacattcgacgtaagcattctgactattgatgatgggatctttgaggtaaaggcaacagccggggacacccaccttgggggcgaagattttgacaaccgattggttaatcatttcgtggaggaatttaagagaaaacataaaaaagatatatctcaaaacaagagagccgtgaggaggttgagaaccgcatgcgaacgagccaaaagaacactctcttctagcacccaggcttccctggaaatcgactcgctatttgagggcatagacttctacactagcatcacccgggctcgattcgaggaactgtgctccgatctgttcagatccactctggagcccgtggagaaagcccttagggacgccaagctcgataaggcccagatccacgatctcgtactagtgggagggtcgacacgcattccaaaagtccagaagctactgcaggacttttttaatggaagggatctgaataagagcatcaaccctgacgaggcggtcgcttacggagctgcggtgcaagcggcgattctgatgggggataagagcgaaaatgtccaggacctgcttctcttagacgtggcccctttgagtctcggacttgagacagccggcggtgttatgacggcactgatcaaacggaattccactatcccgacaaaacagacacagattttcactacatacagcgataatcagcccggagtgttaattcaggtgtatgagggtgaacgagcgatgactaaagataacaatctcctcgggcgtttcgagctcagtggcatccccccagcgccgagaggggtgccacagatcgaagtcaccttcgatattgacgcgaatggcatcctgaacgtgacagctaccgacaagagcaccggaaaagccaataaaataacgatcaccaacgataaagggcgactgagtaaggaagaaattgagcgtatggtacaggaagcggagaagtataaggccgaagacgaagtccagcgggaacgcgtgagcgcgaaaaatgccctcgagtcatacgcattcaatatgaagtctgcggtggaagacgaaggattaaagggaaagatctccgaggccgataaaaaaaaggtcctggacaaatgtcaggaggtcatcagctggcttgatgccaatacactggctgagaaagacgaatttgagcataagcgcaaggagctggagcaggtatgtaatcctattatttccgggctttatcagggggctggcggtccaggtccaggtggtttcggcgcccaggggcctaaaggggggtctggttctggccccaccatcgaagaggttgattag

SEQ ID NO: 190336 - DNA, 1926 bp, Artificial Sequence
  Description of Artificial Sequence: Synthetic coding sequence
atggccaaggccgccgccatcggcatcgacctgggcaccacctactcatgcgtgggtgtgtttcagcacggaaaggtggagatcatcgcaaatgaccagggcaatcgcaccaccccctcatatgttgcatttaccgatactgagcgcctcatcggtgacgccgcaaagaaccaagtggcactgaaccctcaaaatacggtgttcgatgcgaaacgccttattggcaggaagttcggcgatcctgtagtgcagtcagacatgaagcactggccatttcaggtgataaacgacggcgataagccgaaagtacaagtgagttataaaggcgaaacaaaggcattctatccagaagagatctcatccatggtgctgaccaagatgaaagaaattgccgaggcatacctcggctacccggttaccaatgctgtgattaccgtgcccgcttacttcaacgactcccagagacaagccactaaagacgctggagtgatcgccggtctcaacgtgctgagaatcataaacgagccgactgccgctgcaattgcgtacggccttgacaggacaggtaagggagaacgaaatgttctgatcttcgacttgggcggcggaaccttcgatgttagtatccttactattgacgacggcatctttgaagtgaaggcaacggcaggagacacacatctcgggggcgaagacttcgacaatcgattggttaaccacttcgtagaggaattcaaacgcaaacacaagaaggatatttcccagaacaagcgagcggttcgccggctgagaacggcatgcgagcgcgccaagagaaccctatcctcttccacccaggcatctcttgaaatcgactcgctgttcgaaggcatcgacttttatacttccattactagagctagattcgaggaactctgctctgatttgtttagatccacactcgaaccagtagagaaggccctgcgcgacgccaagctagacaaagcccagatccacgacctggtgctggtaggggggagcacacggatcccaaaagtgcagaaactcctgcaggacttctttaatggcagggacctgaacaagagcatcaatccagacgaggctgttgcatacggtgccgcagttcaggcagctatcctcatgggtgacaaaagcgaaaacgttcaagaccttttgttgttggacgtggctccgctctcactggggctcgagactgccgggggagttatgacggcactgatcaagcggaacagcacaattcctaccaaacaaacccagatttttacaacctactcagataatcagccaggggttcttatccaggtttatgagggggagcgtgccatgactaaggacaataatctcttgggtcgctttgaactctctgggattcctcccgctccccgaggagtgccccaaatagaggtgacatttgacatcgacgccaacggcatcctgaacgttacggctaccgataagtccacaggcaaagccaacaaaattaccatcactaacgacaaagggcgccttagtaaagaagaaatcgaacgcatggttcaagaggctgaaaaatacaaggctgaggatgaagtgcagagggagcgggtatccgctaaaaacgcattggaatcttatgccttcaacatgaagtccgctgtggaggacgaaggcctgaagggaaagatatcagaggcggataaaaaaaaggtgctggacaagtgtcaagaggtaattagttggcttgatgccaacaccctggccgagaaagacgagttcgaacataagaggaaggagctggaacaggtgtgcaatccaattatcagcggcctgtaccagggtgccggaggccccggaccagggggattcggagcgcaaggccctaagggcggatctggaagcggccccacgatagaggaggtggactag

SEQ ID NO: 190337 - DNA, 1926 bp, Artificial Sequence
  Description of Artificial Sequence: Synthetic coding sequence
atggccaaggccgccgccatcggcatcgacctgggcaccacctactcttgtgttggtgtatttcagcacgggaaggttgagatcattgccaacgatcagggaaaccgtacaactccttcttacgtggccttcacggacacagagcgtctaatcggcgatgcggcaaaaaaccaagttgccctgaatcctcagaataccgtgttcgacgccaaacgactgatcggccgcaagttcggcgaccccgtagtacagagcgatatgaaacactggccgtttcaggtgattaatgatggagataagccaaaggtccaggtgagctacaagggtgaaaccaaggccttctacccagaggagatctcgtccatggtgcttacgaagatgaaggagatcgctgaagcttacctcggctatcccgtgactaacgccgtgatcacagtcccggcctacttcaatgattcgcagagacaggccacaaaagatgcgggtgtcatagccggcctgaatgtgctcaggatcattaacgagcccaccgctgcagctatcgcttacggattagatcgaaccggaaagggtgaaagaaacgtcctcatttttgatttaggcggaggcacattcgacgtgagtatcctgacgattgacgatgggatctttgaggtcaaggcgacggccggagatacgcacctgggtggggaggattttgacaaccgtttggtgaaccactttgtggaagaattcaagagaaagcataaaaaggacatctctcaaaacaaacgtgctgtgaggagactgagaactgcatgcgagcgtgcaaagaggacgctgagttcttccacacaagcctcactggagatagacagcctcttcgagggtatcgacttttatacctctatcacgagggctaggtttgaagagctttgttctgacctgtttagaagtaccctagagcctgttgaaaaggccctgcgcgatgctaaattagataaagctcaaattcacgacctggtgctggtgggagggtccacacgcatccccaaggtccagaagctgcttcaggacttcttcaacgggagggatttgaacaagagcatcaatcctgacgaggcggtcgcctatggtgcagccgttcaggcagcaattttgatgggcgacaagtcagaaaatgtccaggatcttctgcttcttgacgtggcaccactgagcctcgggctcgagacagcagggggggtaatgacagcgttaattaaaagaaacagtactatacccaccaagcagacacagatattcaccacctactcggataaccagcctggagtgctcattcaggtctatgagggcgaaagggccatgactaaagataataacctgctgggccgattcgagttaagcgggatcccgcctgccccacgaggagtgccacaaatagaagtgacgtttgatatcgacgccaatggtatattgaacgtgactgccacggacaagtcgaccggcaaggctaacaagatcaccataaccaacgacaaagggagactctcgaaggaagaaatcgaaagaatggtgcaagaggccgagaagtataaagccgaggacgaggtccagcgggagagagttagtgccaagaacgctctggagtcctatgctttcaacatgaagagcgccgtcgaagatgaggggctaaaggggaaaatctctgaggccgacaagaagaaagttctggacaaatgtcaggaggtgatctcatggctggatgcaaatacccttgcagaaaaggatgagtttgaacataaaagaaaagagctggagcaggtgtgtaatccaatcataagtgggctctaccagggagcaggtggtcccggccccggtggctttggggcacaggggcccaagggtgggtccgggtcggggcccactatagaagaggtggattag

SEQ ID NO: 190338 - DNA, 699 bp, Artificial Sequence
  Description of Artificial Sequence: Synthetic coding sequence
atggccaaggccgccgccatcggcatcgacctgggcaccacctacagctgcgtgggcgtcttccagcatggaaaggtggaaatcatcgccaacgatcagggcaaccgaacgactccaagttacgttgcattcacagacaccgagaggctaatcggggatgccggcgtgatagcaggactcaatgtgttgcggatcattaacgagcctacagcagccgcaatcgcctacggacttgacagaacggggaaaggggagaggaatgtgcttatctttgatttgggtgggggtaccttcgacgtgtctatcctgaccatcgatgatggaatctttgaggtcaaggccactgccggagacacacacctggggggtgaggacttcgataatcggctagtgaaccacttcgtagaggagtttaaacgaaagcataaaaaggatatctcacagaacaagagggcagtgcgacggctccggaccgcctgtgagcgggcaaagagaacattatcttcatccacacaggcctcgctggagatcgactctctgtttgagggtatagacttctacacctccatcactagggcccgattcgaggaactctgctctgatctgttcagatccacgctggagcccgtcgaaaaggcaccgcctgcaagccccagatgccgcagttgttgccgcaccagcagtaccggagccacctag

SEQ ID NO: 190339 - DNA, 1926 bp, Artificial Sequence
  Description of Artificial Sequence: Synthetic coding sequence
atggccaaggccgccgccatcggcatcgacctgggcaccacctacagttgtgtaggcgtgttccaacacggaaaagttgagattatcgctaacgatcaggggaacaggacaaccccatcctacgtcgcatttaccgatacagagagactaatcggggatgctgctaaaaaccaggttgcgttgaatcctcagaatacagtatttgatgcgaagagactgatcggacggaagtttggtgaccccgtcgttcagagcgacatgaagcactggcccttccaggtaatcaacgatggagacaagcccaaggttcaggttagctataagggcgagacaaaagccttttaccccgaggagatttcttctatggtgctcactaagatgaaggagattgcggaagcgtatctggggtatccagtgaccaacgcagttatcactgtacctgcttacttcaacgactcgcaacggcaggctactaaggacgccggtgtgatagctggtctgaatgtgctgcggatcatcaacgagcccacagccgctgccattgcttacggtctggacaggaccggcaagggagagcggaacgtgctcatattcgatttgggaggagggacctttgatgtatccattcttacgatagacgatggcatcttcgaagttaaagctactgcaggggacactcaccttgggggcgaagactttgataaccgcttagttaatcatttcgtggaggagttcaagcggaaacataagaaagatatctcccaaaacaagagagctgtccggagactgcgtaccgcctgcgaaagagccaaacggacactgtcctccagcactcaggcctccctagaaattgacagtctgtttgagggcatcgatttctacacctccattacccgcgcccgcttcgaggaactgtgctccgatctctttcgctccaccctggaacccgtggaaaaggcgttgagagacgcaaagctggacaaggctcagattcatgatctggtgctggtaggaggcagtactcgaattccgaaagtgcagaagttgctgcaggacttctttaatggtcgggacttgaacaagtctatcaatccggatgaggccgtggcttacggcgctgcagtccaggccgccatccttatgggagacaaatcagaaaatgtccaggatctcctgctgcttgacgttgctcccctctccctcggccttgaaacagccggcggggtaatgacagctctgattaaacggaattccacaatccccaccaagcagacccagatcttcacaacatattctgacaatcaaccgggggtgctcatccaggtatacgaaggagagagagccatgacgaaggataacaacttgcttggacgcttcgaactatctggcataccaccggcgccccggggcgtgcctcagattgaggtgaccttcgacatcgacgcaaatggcatcctgaacgtgaccgcaaccgacaagtcaacagggaaggccaataagatcacgattacaaacgacaaaggacgtcttagcaaggaggagattgagagaatggtgcaggaggccgagaaatacaaagccgaggacgaagttcagcgcgagagggtgtcagccaaaaacgctctggagagctatgcttttaatatgaaaagtgcagtggaagacgaaggcctgaaaggcaagattagtgaggccgacaagaaaaaagtactagataagtgtcaggaagtgatcagttggctggacgcaaataccctagctgagaaggatgaattcgaacacaagcggaaagagttggaacaggtgtgtaacccgattatttcaggcctctaccaaggagccgggggacctgggcctggtggatttggcgctcagggcccaaaaggaggctctggcagcgggccgactatcgaagaagtggactag

SEQ ID NO: 190340 - DNA, 1431 bp, Artificial Sequence
  Description of Artificial Sequence: Synthetic coding sequence
atggccaaggccgccgccatcggcatcgacctgggcaccacctactcctgtgttggcgtgtttcagcatgggaagggcgagaggaatgtgctgatctttgacctgggaggcggcacgtttgacgtgtccatcctcacaattgatgacggtatcttcgaggtgaaagccactgccggagacacacatctgggcggagaggactttgataaccggctggtgaatcactttgtcgaggaattcaagagaaagcataagaaggatatcagccagaataaacgggctgtgcggcggttgcgcaccgcttgtgagcgggcaaagagaactctgtccagcagcacccaggccagccttgagatcgactcgctgttcgaaggcatagacttttatacttccataaccagagctaggtttgaagagttatgttccgacttgttccgtagcacgctggaaccagttgaaaaagccttgcgagacgccaagcttgacaaggctcagatacacgatctggtactggttgggggttcaactcgaattcccaaagtacagaagttgctccaggacttcttcaacggaagggacctgaataaatccattaacccagacgaggccgtcgcctacggcgcggctgtacaggccgccatactcatgggcgacaagagcgagaatgtgcaggaccttctgctgttagacgttgctcccctaagcttgggcctggagacagctggtggtgttatgacagctctcattaaacgtaatagtactattccgacgaagcagacccagatatttacaacatattccgacaaccagccaggggtcctcatacaggtctatgagggggagcgggccatgaccaaagacaacaaccttctggggaggttcgaattatctggcatccctcctgcacccaggggcgttccccagattgaagtaacgttcgacattgacgccaatgggatcctcaatgttacggccaccgacaaatctaccgggaaagcaaacaagattacaatcacaaacgataagggcaggctgtcaaaggaggaaatcgaacgcatggtacaagaggcggagaagtataaagcagaggatgaagtgcaacgagagagagtgtctgcaaagaacgctctcgaatcatatgcgttcaatatgaagtctgcggtcgaagatgaaggtctgaagggcaagatctcagaggcagacaaaaagaaggttttggataagtgccaggaagtgatctcctggctcgatgccaatacactcgctgagaaagacgagttcgagcataagcggaaggagctcgagcaggtgtgtaacccgattataagcggactttaccagggcgccggcggtcccggcccaggcggctttggtgctcagggtccaaaaggtggatctggaagcggcccaaccatagaggaggtagactag

SEQ ID NO: 190341 - DNA, 1431 bp, Artificial Sequence
  Description of Artificial Sequence: Synthetic coding sequence
atggccaaggccgccgccatcggcatcgacctgggcaccacctacagttgtgtaggggtcttccaacatggcaagggcgagcggaacgtgctgattttcgacctcgggggcggaacgttcgacgtttctatcctgacaatcgatgacggcatcttcgaggtgaaggcaaccgctggcgatacccacttgggcggcgaggacttcgataacagactcgtgaaccactttgtggaggagtttaaacgaaaacacaagaaggacatttctcaaaacaagcgtgccgtgcggcgcctgcggacggcctgtgagcgcgccaaacgcaccctaagtagcagcacacaggccagtttggaaatcgattcgctgtttgagggtattgacttctatacctctatcactagagcgcggttcgaggagctgtgctccgatttgtttagaagcactctcgagccagtggagaaggcattgagagatgcaaaactggataaagctcagattcatgacctagtgctcgtcggtggttccaccagaatcccaaaggtgcagaagctcctgcaggatttttttaacggaagagacctcaacaaaagtattaatcctgacgaagctgtggcttacggcgcggccgtacaggcggctatcctgatgggggataaaagtgaaaacgtacaggatcttttgctgctcgatgtggcccctctgagtctgggcctggagactgcaggcggcgtgatgaccgccctcattaaacggaattcaacaatccctaccaaacaaacccagattttcactacctatagtgacaatcagccaggagtcttgattcaggtgtacgagggcgagagagcaatgactaaggacaacaacctgctgggccggtttgaactcagcggcataccaccagcacctaggggagttccccagatcgaagtgacgtttgatatcgacgcaaacgggatcttgaacgtgacggccaccgataagtcaaccggaaaagccaacaagatcactattacaaacgacaagggcaggctctcaaaagaagaaatagagcggatggtacaggaggctgaaaaatacaaagccgaggacgaggtccagcgagaacgcgtttctgctaagaatgccctggaaagctacgcattcaatatgaagtcagcggtggaggacgaaggcctgaagggtaaaatttccgaggccgacaaaaagaaagtgttagataaatgccaggaagtgatcagttggctcgatgcaaatacattagcagaaaaggacgagttcgaacacaagaggaaagagctagagcaggtgtgcaatcccatcatatcgggactgtaccagggtgccggcggtcctggccccggaggtttcggcgcgcaggggcccaagggaggcagtgggagcggcccaaccatagaagaggtggattag

SEQ ID NO: 190342 - DNA, 1653 bp, Artificial Sequence
  Description of Artificial Sequence: Synthetic coding sequence
atggccaaggccgccgccatcggcatcgacctgggcaccacctactcgtgcgtcggagtcttccagcatgggaaggtccagatttcctccatggtgctcacaaaaatgaaagagattgctgaagcttacttgggctaccctgttacaaatgccgtgattaccgtaccggcgtacttcaatgacagccagcggcaggcaacgaaagatgctggagtgatcgccgggcttaacgtactgagaatcatcaatgagccaactgccgcagcaatagcgtatgggcttgaccgaaccggcaaaggtgaaaggaatgtcttaatttttgacctcggcggtggaacctttgacgtcagcatcctgaccattgatgacggcatatttgaggtgaaagctacagccggggacacccatctaggtggtgaggattttgataatcgcctcgtaaaccacttcgtggaggagtttaagcgtaagcacaaaaaagacattagtcagaataagagggctgtgagacggcttcgcactgcgtgcgagagagcgaaacgcacccttagtagttccactcaggctagcctggaaattgatagcttgtttgaaggaattgacttctacacgtctatcactagagcccgtttcgaggagctgtgctcagacctgtttaggtccaccttggaaccagtggagaaggctttacgcgacgctaagctggacaaagcccaaatccatgacctcgtacttgtgggaggatctactcggattcccaaagtccagaagctcctgcaggacttcttcaatgggagagacctgaacaaatcaattaatcccgacgaggcggtcgcttacggcgcagccgtccaggctgccattctgatgggggacaaatctgagaatgtgcaggatctgttgctattggacgttgcacccctgagcctgggcctagaaactgctggcggggttatgaccgcactgattaaacggaactccaccatcccaacaaagcagacacaaatctttaccacatactctgataatcaacccggggtgcttattcaggtgtatgaaggagaacgcgctatgacaaaggacaataaccttctaggcaggtttgaactcagcggcattccccccgcgccgagaggagttccacagatagaagtaaccttcgacattgatgctaatggaattctgaatgttactgctaccgacaagtccactggaaaagctaataaaatcaccatcacgaatgacaaaggccgattaagtaaggaggagattgaaagaatggtccaggaggcagaaaaatacaaagccgaagacgaggtacaacgcgaaagggtgagcgctaagaacgcactggaatcttacgcatttaatatgaaatcggctgtggaagacgaggggttgaagggaaagataagtgaggccgacaagaaaaaagtcctggacaagtgtcaggaagtgatcagctggctggacgccaacactctggctgaaaaagatgaattcgaacataagaggaaggagttggagcaggtgtgcaaccctataatcagtggcctgtatcaaggggcaggtgggcctggtccgggcggatttggagcccagggcccaaaggggggatctggatccggaccaaccattgaggaggttgactag

SEQ ID NO: 190343 - DNA, 1872 bp, Artificial Sequence
  Description of Artificial Sequence: Synthetic coding sequence
atggccaaggccgccgccatcggcatcgacctgggcaccacctactcttgcgtcggcgtattccagcatgggaaagtggaaatcatagccaatgaccagggaaatagaaccactccaagctacgtcgcattcacggacaccgagcgcctgatcggtgatgcagcgaaaaaccaggtggccttaaatccggtagtgcaatctgatatgaaacattggccatttcaagtgataaatgacggtgacaaaccaaaagtacaggtgtcctataagggggaaaccaaagcattctacccggaagaaatttcttccatggtgctcaccaagatgaaagagatcgcagaggcatatttgggctaccctgtgactaatgccgtgattactgtgccagcatatttcaacgactctcagagacaagccaccaaggacgccggagtcatcgccggcctgaacgttctgcggataatcaacgagcccactgctgccgcaattgcgtacggcttggatcgaacaggaaagggtgaacggaacgtgcttattttcgatcttggaggggggacttttgatgtttccattctgacaattgacgatggcatcttcgaggtaaaagcgaccgccggtgatactcatctgggcggagaggacttcgacaaccgactcgtgaatcatttcgtggaggaattcaagcgtaaacacaagaaggatatctcccagaacaagcgagcagtacgcaggctcagaaccgcttgcgagcgggccaaacgcacgttaagcagttccacacaagctagcttggaaatcgactccctgttcgaggggatagatttttacactagtattactcgcgcacgcttcgaagagctctgctccgacttattccgctctaccctagagccggtggaaaaagccttgagggatgccaaactggataaagcacagatccacgatctagttcttgttggggggtcgacacgcatccctaaagtacagaaactactacaggatttttttaatggccgagatctgaataaaagcataaatcccgacgaggcagtcgcgtatggggcggcggtgcaggcggccatccttatgggcgataagagcgagaacgtccaggatctgttactacttgacgtggctccactgagcttagggctggagaccgctggaggggtgatgactgcgcttataaaaaggaatagcacaatccccacaaagcaaactcaaattttcaccacctactcagacaatcaacccggcgtcttgatccaggtgtacgagggtgaaagggcaatgaccaaagacaacaatctcctgggacgttttgaactctccggcattccaccggcccccagaggtgttccacagattgaggttacgtttgatattgatgcaaatggcatcctaaacgtcactgccaccgataaatccacgggaaaggctaataagatcacgatcaccaacgacaaaggccgacttagcaaggaagagattgagcgaatggtccaggaggccgagaaatacaaagctgaagatgaggtgcagcgcgaaagggtctccgcaaagaatgctttggaatcctatgcatttaatatgaaatccgctgtcgaagatgagggactgaaaggcaagatttctgaggcagacaagaaaaaagtgctcgataaatgccaagaggtcatatcctggcttgatgctaacaccttggccgagaaagacgaatttgagcacaagcggaaggaactcgaacaggtttgcaaccctataatttcaggactctatcagggcgcaggcgggcctggtcccggagggttcggtgcccagggaccgaagggaggctctggtagcggtccaacaatcgaagaagtggattag

SEQ ID NO: 190344 - DNA, 1653 bp, Artificial Sequence
  Description of Artificial Sequence: Synthetic coding sequence
atggccaaggccgccgccatcggcatcgacctgggcaccacctactcttgcgttggtgttttccagcacggcaaagtgcagatctcatctatggtgttaacaaagatgaaggagatagccgaggcctatcttggataccccgtgaccaatgcagtcatcacagtgcccgcatatttcaatgactcccaacggcaggccaccaaagacgctggtgttattgccgggttaaatgtgctgaggattataaatgagccaacagcagctgcaattgcttacggcctggacagaacaggcaaaggtgaacggaacgtcttaattttcgacctgggcggcggcacatttgacgtctctatcttaaccattgatgacggaatatttgaggtcaaagctactgcgggcgacacccatcttggaggtgaggacttcgataataggctggtcaatcatttcgtggaagagttcaagcgtaagcataaaaaagatatctcacagaacaaaagggccgtgcgacgcttgcgcaccgcctgcgaaagagctaaaaggacactcagctctagcacccaggcctccttggagatcgatagtcttttcgaaggcattgatttctacacatctattacgcgggcaagatttgaagaactgtgctcggacctcttcagaagtaccctcgaaccagttgagaaggcactccgagacgctaaactagacaaggcccaaatccacgacctggtcctggtcggggggtccaccaggatacccaaggtgcaaaaactgctccaggacttttttaacggtcgtgatctcaataagtccataaaccccgacgaggctgttgcttacggggccgctgtgcaggcagcaatactgatgggggacaagtctgagaacgtgcaggacctgctcctgttggatgtcgcccctctatcactcggactggagactgcagggggggtcatgaccgccctgatcaagaggaactctaccatccccactaagcagacccaaatattcactacttactccgacaaccagccaggagttttgatccaggtgtacgaaggtgaaagagctatgactaaggataacaacctgttaggccggtttgaactctcaggcatacctcccgccccccgaggtgtgcctcaaatcgaagtcacattcgatatagacgctaatggaatactgaacgtcaccgccactgacaaaagcacaggaaaggctaacaaaatcaccattaccaatgacaagggaaggctgtccaaggaagagatcgagcgtatggtgcaggaagctgaaaagtacaaggccgaagatgaggtccaaagggaaagggtctccgcaaaaaacgcgctggagtcctatgcattcaacatgaaaagcgctgtcgaggatgaaggacttaagggcaagatcagcgaagccgataaaaagaaggtgctcgataagtgccaagaggtgattagctggcttgatgcgaacacactcgcagaaaaggatgagttcgagcataagagaaaggagctcgagcaggtgtgcaatcccattatctctggcctataccagggcgcaggcgggcccggaccgggcggattcggagctcaggggcctaaaggaggctccgggtctggaccaaccattgaagaggtggactag

SEQ ID NO: 190345 - DNA, 1653 bp, Artificial Sequence
  Description of Artificial Sequence: Synthetic coding sequence
atggccaaggccgccgccatcggcatcgacctgggcaccacctactcatgtgtgggagtcttccagcatggcaaggtccagatcagtagtatggttcttacaaaaatgaaagagatcgctgaggcttatctggggtacccagtaaccaacgccgtcatcacggtcccggcctacttcaacgatagccagaggcaggcgaccaaggacgcaggagtgattgccggtctgaatgtgctcaggatcataaatgaaccaactgctgcagccattgcctatggcctggacaggaccgggaaaggggaaagaaacgttttgatcttcgaccttggcgggggcacatttgatgtgagtatcttgaccattgatgatggtatctttgaggtcaaggccactgcgggtgatactcacctaggaggggaggacttcgacaatagactggtcaaccattttgtggaggagtttaagcggaagcacaaaaaggacatcagccaaaataaacgcgccgtgcgcaggcttcggacagcttgcgaacgagctaagcggactctctcctcctccacccaggcctccctcgagatcgactcactgtttgagggcatcgacttctacacttccataacgcgcgcccggtttgaagagttatgcagcgacctcttccgcagcaccttggagcccgtcgaaaaagctctgagagatgccaagctcgacaaggcgcagatacatgaccttgtgttagtcggcgggtcaactcggattccaaaggtgcaaaagttgctgcaggacttcttcaacgggcgggacctgaacaagtcgatcaaccctgacgaagcggttgcttatggagctgctgtccaagcggcaatcttgatgggtgataagtctgagaacgtgcaagaccttctcctcctggatgtggcacccttgtcgctagggctggagacagcgggaggcgtgatgaccgctctgattaagaggaactctacgatccccacaaaacagacccagatcttcactacgtatagtgacaaccagcccggcgtgcttatccaggtctatgaaggtgaaagggccatgacaaaggacaataacctgctcggaaggttcgagctttccggaatcccgcccgcaccccgcggcgtgcctcaaatagaggtgacatttgacatagacgctaacgggatcctgaacgtaacagccactgacaagtccaccgggaaggcgaacaagattactatcaccaacgataaaggaaggctgtccaaggaggaaatcgagcgaatggtgcaggaggctgaaaagtacaaggctgaggacgaagtgcagagggagcgggtgtctgctaaaaatgctttggagtcctacgccttcaatatgaaatctgctgttgaagacgagggcctgaaagggaagattagcgaagctgataaaaagaaggtcctggataagtgtcaggaggtcatttcttggctggatgccaatacattggctgagaaggatgagtttgaacataagaggaaggagttagaacaggtttgcaacccaatcatcagtggtctctaccagggggcgggtgggcctggtccagggggcttcggtgcccaaggcccaaagggcggctctggatctggaccaaccatcgaggaagtggattag

SEQ ID NO: 190346 - DNA, 1653 bp, Artificial Sequence
  Description of Artificial Sequence: Synthetic coding sequence
atggccaaggccgccgccatcggcatcgacctgggcaccacctactcttgtgtcggagtcttccagcatggaaaagtccagattagttccatggtgctaaccaaaatgaaagagatcgccgaagcataccttggttacccagtgaccaacgctgtgatcaccgttcctgcctattttaatgatagccaaaggcaggctaccaaggatgcaggtgtgatcgctggcttgaatgtgttacggatcattaacgagccgaccgccgccgcaatcgcatacgggctggaccggaccgggaagggcgaacggaacgtcctgatcttcgacctgggagggggcacgtttgacgtttcaattctcactattgacgatggcattttcgaagtgaaggccactgccggagacactcacctcggtggagaggactttgacaatcgccttgtcaatcattttgttgaggaattcaagaggaaacacaaaaaggatatcagccagaataagcgagcggtccgcagattgcggactgcatgtgagagggcaaagagaacactctcatctagcacccaggcatcccttgagattgactctctgttcgagggaattgacttctacactagcatcacccgcgcccgcttcgaggaactctgttccgatctcttccgttctaccctggaaccagtcgaaaaggccctacgggatgcaaagttagacaaagcccagattcatgatctggtgttggtcgggggatccacgcgcattcctaaggtccagaagctcctgcaggattttttcaacggccgcgatcttaataaatccataaaccccgatgaggccgtcgcatatggagccgcagttcaagccgctatccttatgggggataagtccgaaaatgtgcaggacctcctgcttctggatgttgcccctctgagcttggggttggaaaccgcgggtggcgtcatgactgcgttaataaagcggaacagtacaattccgacaaaacaaacccagattttcactacttactccgacaaccagccgggcgtgctcatccaggtgtacgagggtgagcgggctatgactaaggataacaacttactgggccgatttgagctgtcaggcattccgccagcgcctcggggtgtgccacagatcgaggtgaccttcgatatcgatgccaatggtattctcaatgtgactgccacagacaagtcaacaggcaaggctaataagatcaccatcaccaatgacaaaggacggctatctaaggaagaaattgaaaggatggtgcaggaagcagagaagtataaggctgaggacgaggtccaaagagagcgtgtttctgccaaaaatgccctcgaatcctacgcctttaatatgaaaagtgccgtggaggatgagggcctcaagggcaagatttccgaggctgacaagaagaaggtacttgacaaatgccaagaagtaattagctggctggacgccaacacactcgcagagaaagacgagtttgagcacaagaggaaggagttagagcaggtgtgcaatcctatcatatcgggcctctatcaaggagcgggcggtcccggtcccggaggtttcggagcccaaggtcccaagggaggaagcgggtctgggcccacaatagaagaggtcgattag

SEQ ID NO: 190347 - DNA, 699 bp, Artificial Sequence
  Description of Artificial Sequence: Synthetic coding sequence
atggccaaggccgccgccatcggcatcgacctgggcaccacctacagctgtgtgggggtatttcagcacggaaaggttgaaatcatcgctaatgatcaggggaaccggacaaccccctcttacgttgcatttaccgacacggagcgcctaattggcgacgccggggtgatcgctgggctgaatgtgttgaggattattaatgagccgaccgctgcagccatcgcgtacggcctggacagaactggcaagggtgagagaaatgtccttatcttcgacttggggggcggtacctttgatgtctctatcctgactatagatgacggcatctttgaggtgaaggctacagcgggcgacacccaccttgggggagaagatttcgacaaccgactggtgaatcactttgtagaggagtttaagcgcaaacataagaaagatattagccagaataagcgggctgtgcgtagactgagaaccgcttgtgagcgggcaaaaagaaccctgtcttccagcacacaggcatccctggagatagatagcctgttcgaaggtatcgacttctatacatctattacaagagctcgtttcgaagaattatgcagcgacctgtttcgctcaaccctcgaacccgtggaaaaggcacctcccgctagtcctcgctgcagatcgtgctgtcggacctcgtcaacaggcgcaacctag

SEQ ID NO: 190348 - DNA, 1653 bp, Artificial Sequence
  Description of Artificial Sequence: Synthetic coding sequence
atggccaaggccgccgccatcggcatcgacctgggcaccacctacagttgtgtgggcgtcttccagcacggcaaggtgcagattagcagcatggtgctcacaaagatgaaagagatcgctgaggcttatttagggtacccagtgactaatgcggtgattactgttccagcttactttaatgacagccagaggcaagcaactaaagatgcaggagtaatcgccggacttaacgtactgcgtattatcaacgagccgacggcagcagcaattgcctacggtctggacaggacgggcaaaggagagaggaacgtgctgatcttcgaccttggcggcggaacatttgatgtgagcatacttaccatcgatgacggaatcttcgaggtcaaggctacagccggagacacgcacctgggtggcgaggatttcgacaacaggctggtgaaccatttcgtggaagaatttaagaggaagcataaaaaggacatctcccagaacaaaagggcggtgcgtaggttgcgcactgcttgtgaaagggccaagcggaccctgtccagttccactcaggcttctctggagatcgactctctgttcgagggcattgacttttacaccagcataacccgcgctaggttcgaggaactctgctccgatctttttagatctactttggagccagttgaaaaggctctgcgagatgcgaaactggacaaggcccagatccatgatttggtcttggtgggaggaagtacacgcattccaaaggtccagaaactactccaggactttttcaacggacgcgacttgaataaaagcatcaaccccgacgaggcagtagcgtatggagccgcagtccaagcagccattctcatgggagataagagcgagaacgtccaggatcttcttctcctggatgttgcacctctgtcactaggcctggagacggctggtggtgtaatgaccgctcttattaagagaaatagcactatccctaccaagcaaacacagatctttacaacatactccgataaccagccgggtgtgctgattcaagtatatgagggtgaaagggccatgaccaaagacaacaacctgctgggcaggttcgagctgtccggcattccgcccgccccaagaggcgtgcctcagatcgaggttactttcgacattgatgccaacgggatcctcaacgtcaccgctacggacaagtccacaggcaaggctaataagataaccattacaaacgacaaggggagactgagcaaggaggaaattgaaagaatggtccaggaggccgaaaagtacaaggccgaggatgaggtccaacgggaacgagtcagcgccaagaatgcactggagtcgtacgcctttaatatgaaatccgccgttgaagatgaggggttgaaaggaaagatctcagaagcagacaaaaagaaagtcttggacaaatgccaggaggtcatctcttggctggatgccaacaccttggctgaaaaggacgagttcgagcacaagcgcaaagagctcgagcaggtgtgtaatccaattatttcaggtctctaccagggagctggcgggcccggccctggagggtttggagcccagggacccaagggaggctcgggaagcgggccgaccatcgaagaggtggactag

SEQ ID NO: 190349 - DNA, 699 bp, Artificial Sequence
  Description of Artificial Sequence: Synthetic coding sequence
atggccaaggccgccgccatcggcatcgacctgggcaccacctacagctgtgtgggtgtgtttcagcacggaaaagtggagatcatcgcgaacgatcagggaaatcgaaccacgcctagttatgtggccttcactgatactgaaaggctgatcggtgatgcaggggttatcgctggcctgaatgtgcttagaattattaacgaaccgactgccgctgcaattgcctacggtctggatcggacaggcaaaggcgagcggaacgtcctcattttcgacctcgggggaggaactttcgacgtctccatcctcaccattgacgacggcatatttgaagtgaaagctacagctggagacacacatctcgggggcgaggatttcgacaatcggctggtgaatcatttcgtagaggaattcaagcggaagcacaaaaaagatatctctcagaataaaagagcggtgagaagactacgaacagcctgtgaaagggcaaaacgcaccttatcgtcatcaacacaggcgagcctagagatagactctttgttcgagggaatcgatttttatacgtccatcacacgggcgcggttcgaggagttgtgcagtgacttatttagatctactctcgagcctgtcgagaaagctcccccagcttctcctagatgccgttcttgctgccggacatctagtacaggagctacatag

SEQ ID NO: 190350 - DNA, 699 bp, Artificial Sequence
  Description of Artificial Sequence: Synthetic coding sequence
atggccaaggccgccgccatcggcatcgacctgggcaccacctactcctgcgtcggggttttccaacacggaaaagtcgagatcatcgccaatgatcagggcaaccgaactactccctcgtacgttgcctttacagacactgaaaggctcatcggagacgcgggggtgattgctggactcaatgtgctcaggatcatcaacgaacccaccgcagccgctattgcgtacggcctggacagaaccggtaagggggagagaaatgtgcttatcttcgacctgggcggaggaacatttgatgtctctattctgaccatagacgacggcatatttgaggttaaggcaacagccggagatacacacctgggcggcgaggattttgacaatcggctggtgaaccactttgttgaagagtttaagcgcaaacataaaaaagatatctctcagaacaagcgcgctgtgaggcgactgcggaccgcgtgtgagagggccaaacggacgttatcaagctctacacaggcttccctggaaattgactcgctctttgaaggtatcgatttttacacaagcatcactagggcccgatttgaggaactctgcagcgacctttttcgatctacactggaaccagtggaaaaggcacctcccgcctcccctcgttgtcggagctgctgtcgaacatcctctacaggcgctacctag

SEQ ID NO: 190351 - DNA, 699 bp, Artificial Sequence
  Description of Artificial Sequence: Synthetic coding sequence
atggccaaggccgccgccatcggcatcgacctgggcaccacctacagctgtgtaggggtatttcagcatgggaaagtagaaatcatcgctaacgaccaagggaatcgaacaacaccgtcctacgtggcattcactgataccgagcggctcatcggcgacgccggagtgattgctggactcaacgttttaagaatcattaacgagccaactgccgccgccatcgcctatgggttagacagaaccggaaaaggcgagagaaatgtgctcattttcgatctggggggcggcaccttcgacgtttctattcttaccattgatgatggcatatttgaagttaaagctacggcaggcgacactcacctcggaggggaggattttgataaccgactggtgaaccacttcgttgaggaatttaagcggaaacataagaaggacatttctcagaataagagggcagtgcgtcggctgaggaccgcctgtgagagggccaagagaacactcagttccagcacacaggctagtctagaaatcgactcattgttcgaaggcatagacttttatacatcaataactagagctaggtttgaggagttgtgttccgacctgtttagatctacgcttgaaccggtggaaaaggccccccctgcgtctccacgctgtaggagttgctgccgcacatccagtaccggagctacctag

SEQ ID NO: 190352 - DNA, 1926 bp, Artificial Sequence
  Description of Artificial Sequence: Synthetic coding sequence
atggccaaggccgccgccatcggcatcgacctgggcaccacctacagctgcgtcggagtgttccagcatggtaaagtggaaatcatcgccaatgatcagggtaaccgcacaactccttcatacgtcgcctttaccgacactgagagactcatcggggacgccgccaagaatcaagtcgcgctgaatcctcagaacaccgtcttcgatgctaaacgcctgattggtcggaaatttggagacccagtggtgcaatctgatatgaagcactggcctttccaggtcatcaatgatggtgacaaacctaaagtgcaggtgtcctataagggagagactaaggccttctatcccgaggagatctcatcaatggtcctgacaaaaatgaaagagattgccgaagcctacctcgggtacccggtaacaaacgccgtcattactgtgcccgcgtatttcaacgacagtcagcggcaggcaacaaaggacgccggggtgatcgctggtcttaacgttcttcggattatcaatgagcctaccgcggcagccatcgcctacggtctggatagaaccgggaaaggcgaaagaaacgtcctcatcttcgacctcggaggcggcaccttcgacgtgagcatactcacaatcgacgatgggatcttcgaggtaaaagctactgcgggggatacacatttgggaggggaggatttcgataacaggctggttaatcacttcgtggaggaattcaaaagaaagcacaagaaagacatctctcagaataagagggcagtgcgacgcctgcggaccgcctgcgaacgagcaaagcgcacactttccagcagcacccaggcttctctagaaattgattccttgtttgagggcatcgacttctataccagcatcacgcgggcccgctttgaggagctctgctccgacctctttcgatcaacactcgaacccgtagagaaggccctgagggacgctaagctggacaaagcccagatccacgacctcgtgctggtcgggggctctactcgcatcccgaaggttcaaaagctgctgcaggacttcttcaacggccgtgatcttaataagtcaatcaatcctgatgaagccgttgcttatggggctgctgttcaggccgccattctcatgggtgacaaatccgagaatgtgcaggatctgctgttgctggacgtggccccattgagtctcggactggagacagctggaggcgtaatgactgccctaataaagaggaattccacaataccaactaagcaaacacaaatctttaccacatacagtgacaatcagccaggcgttctgatccaagtgtacgagggggaacgggcaatgacaaaggataataatttgttaggccgctttgagctcagcggcatccccccggcccctaggggagtgccacagattgaagtaacatttgatattgacgcaaatgggattctgaacgttactgccaccgacaagtctacaggaaaggcaaacaaaatcaccattactaacgataaggggcggctgtccaaggaggaaattgaaagaatggttcaggaagctgagaagtataaggccgaagatgaagtccaaagggagagagtgtctgctaaaaatgcgttagaatcgtatgcgttcaatatgaaatccgcagtggaggatgaggggttgaagggcaaaattagcgaggcagataagaagaaggtactggacaagtgccaggaggttatctcatggctggacgccaatacgctagctgagaaggatgaattcgaacataagcggaaagaactggaacaggtatgtaatcccatcatcagtggtctctatcagggcgccggtggtcctgggcccggaggcttcggagcccaagggcctaaaggcggttctggctcagggccgaccatagaagaggtggattag

SEQ ID NO: 190353 - DNA, 1926 bp, Artificial Sequence
  Description of Artificial Sequence: Synthetic coding sequence
atggccaaggccgccgccatcggcatcgacctgggcaccacctacagttgcgtaggggtgtttcagcatgggaaagtggaaatcatagcaaacgaccagggcaatcgcactaccccatcctacgtggcattcacagataccgaaagattaataggtgacgccgcaaagaaccaggttgcgctcaacccccagaatacagtgtttgacgccaagcgacttattggaaggaagtttggcgacccagtggtgcagagcgatatgaaacactggccttttcaggtgataaatgacggagataagcccaaggtacaggtatcgtacaagggcgagaccaaagcgttttacccagaggagatcagctcaatggtgcttaccaaaatgaaggaaattgcagaagcctatctggggtaccccgtcaccaacgctgtaataaccgtacctgcatacttcaatgatagtcagcgtcaggctaccaaggatgccggcgtcattgcgggactgaacgtcctgagaatcatcaacgagccaacagcggctgccattgcctatggactggatagaacgggaaaaggcgagaggaatgtcctcatcttcgatcttggcggagggacctttgacgtttcaatcctaacaattgacgacgggatctttgaagttaaggctactgctggagatacccatttgggcggagaagactttgacaaccgacttgtgaatcattttgttgaggaatttaagagaaaacacaagaaagatatctctcagaacaagcgggccgtgaggagactgagaacagcgtgtgagagggccaagcgtacactttcatcttccacccaagcttcgctcgagattgacagcttattcgaagggatagacttctacacatccattactagagctaggtttgaggaactgtgttctgatctgtttcggagtaccctcgaaccagtggaaaaggccttgcgcgacgcaaaactggataaagcccaaatccacgatctggtgctggtggggggtagtactaggattcctaaggtgcagaagctgcttcaggacttcttcaacggcagagacttgaacaagtccattaatcctgatgaagccgttgcctatggtgccgccgtgcaggctgccattctcatgggcgataagagtgaaaacgtccaggacctgcttctcttggatgttgccccattgtcgctggggctggagaccgcaggcggtgtgatgacagcgttaatcaaacgaaactctactattccaactaaacaaacccaaatttttaccacctactctgataaccaacctggcgtattaatccaggtgtacgagggcgagcgggctatgaccaaggacaacaatcttctgggccggttcgaactcagtgggattcccccagcccccaggggagtccctcagattgaggtgactttcgacatagatgctaacgggatactgaatgtgactgccaccgataagtcaactggaaaagcgaacaagattaccatcacaaacgacaagggacgtctatccaaggaggaaatcgagcggatggtacaggaggcggaaaaatacaaagcagaggatgaggtgcaacgggaacgggttagcgccaaaaacgctctagagagctacgcatttaatatgaagtcagcagtggaagatgaaggcctaaagggcaagattagtgaagcggacaagaaaaaggtactggataaatgtcaagaggtaatctcctggctcgatgccaatacccttgccgaaaaggatgaattcgaacacaaaaggaaagagctagaacaggtatgtaatcccataatttccgggttatatcaaggggctggcggtcctggaccaggaggcttcggcgcccaaggaccaaaggggggcagtggaagcggtcctactatagaggaggtggattag

SEQ ID NO: 190354 - DNA, 1926 bp, Artificial Sequence
  Description of Artificial Sequence: Synthetic coding sequence
atggccaaggccgccgccatcggcatcgacctgggcaccacctacagctgcgtcggagtgtttcagcacggaaaagtggagataatcgctaacgaccaggggaacagaacaacaccatcttacgtagccttcacagatactgaacggttgatcggtgatgcagccaaaaaccaggtagccttaaacccccagaatactgtctttgatgccaaaagactgatcggccggaaattcggagaccccgtggtgcagtccgatatgaaacactggcctttccaagtgatcaacgacggcgacaaacccaaggttcaagtttcttataaaggagaaaccaaagccttttacccagaggagattagttctatggtgttgacaaagatgaaggagattgccgaagcctacctgggttatcctgtaacgaacgcagtaatcactgtgcccgcgtacttcaatgattcccagcgacaggctaccaaagacgccggcgttatagccggactcaatgttctccgtattatcaatgaaccaacagctgctgccatcgcctatggattggacagaaccggcaaaggcgagcgcaatgtactaatattcgatttaggcggcggtacttttgacgtgagtatcctcaccatcgatgacggcatattcgaggtgaaagctaccgccggtgacacgcaccttggaggcgaggacttcgataaccgtctagtaaatcactttgtggaggagttcaagcgaaagcataagaaagacattagtcagaataagagagcggtcaggaggcttcgaactgcctgcgaacgagcgaagaggaccttatcctcgtcgactcaggcttctctggaaatcgattcacttttcgaaggaattgacttctacacgtctattacacgtgcccggtttgaggagctgtgtagtgacctgttccgcagtactctcgagcccgtcgaaaaggcactgagggatgccaagctcgataaagctcaaatccacgacctggtgctggtgggcggatccacacgtatccctaaagtccaaaagctgcttcaagacttcttcaatggccgggacctgaacaagagcattaatccagacgaagccgtagcatacggagcagcagttcaggcagctatcctgatgggcgataaatcagagaacgttcaggatcttctgcttctggacgtcgcccctctttccttaggcttggagaccgctggaggggtgatgaccgccttaatcaaaaggaacagcacaattccaaccaaacagactcagatatttacaacctacagcgataaccagccaggcgtgctaatacaggtgtacgagggtgaacgcgcaatgacaaaggacaacaatttactagggcgttttgagctatccggtatcccccctgctcccagaggcgtgcctcagatcgaagtgacctttgatattgacgccaacgggatcctgaacgtcactgccaccgataagagcaccggtaaggccaacaaaattaccattacaaatgacaagggcagattgtctaaggaagagattgaacgtatggttcaggaagcggagaaatacaaggccgaagatgaggtgcagagagagcgcgttagcgccaagaatgcacttgaatcctacgcatttaacatgaagtcagccgtggaggacgagggcctcaagggcaaaatatccgaagccgataagaaaaaggtgctggataaatgccaggaggtgatctcctggctggatgctaacactctggctgaaaaagacgaattcgaacacaaaaggaaggagttggaacaagtgtgtaatcctatcatttccggtctgtaccagggcgcagggggcccaggcccgggaggctttggagcccagggtccgaagggaggctcaggctcgggcccgacaattgaggaagtggactag

SEQ ID NO: 190355 - DNA, 699 bp, Artificial Sequence
  Description of Artificial Sequence: Synthetic coding sequence
atggccaaggccgccgccatcggcatcgacctgggcaccacctactcttgtgttggcgtgtttcagcatggcaaggttgagattatcgcgaatgatcagggtaaccggacaaccccttcctatgtggctttcaccgacactgaacgattaataggagatgctggagtgatcgctggtcttaacgtcctccggataatcaatgaaccaactgcggccgctatcgcttacggtctggataggactggaaagggagagcggaatgtgctgatattcgatctaggcggcggcacctttgacgtcagtattttaaccattgacgatgggatctttgaggtgaaggcaaccgccggcgatacacacttgggcggagaagacttcgacaacagactggtgaaccacttcgttgaagaatttaagaggaaacataagaaggatatctctcagaacaagagggcagtgagacgactccggacagcttgcgagcgggcaaaacggaccttgagctcctccacccaggccagcctggaaatcgattctctgttcgagggaattgatttttatacttcgatcactcgggcccggtttgaggagctgtgtagtgatctgtttagaagcacacttgaacccgtagaaaaggcaccgcccgcatctccacgctgcagatcttgttgcagaacttcaagcaccggggccacttag

SEQ ID NO: 190356 - DNA, 1926 bp, Artificial Sequence
  Description of Artificial Sequence: Synthetic coding sequence
atggccaaggccgccgccatcggcatcgacctgggcaccacctactcttgcgtcggagtgtttcagcacggcaaagttgaaatcattgccaacgatcaagggaacaggacgacaccctcatacgtggcctttaccgataccgagaggttaatcggggatgcagcaaagaaccaagtggcgctgaatccacagaataccgtcttcgatgctaagcgccttatcggaagaaaattcggcgatcctgttgtccagtctgacatgaaacactggcccttccaggtaattaatgacggcgacaagcccaaagttcaagtgagttacaagggtgagacgaaagcattttacccagaagagatctcttctatggttctgacgaaaatgaaggaaattgcggaggcctatttggggtatcccgtgactaatgccgtcattacagtacctgcttactttaatgattcccagaggcaggcgactaaggatgccggtgttattgccggtctgaatgtgctgcgcatcatcaacgagccaacagccgccgccattgcttacggactggatcgcacaggaaagggcgagcggaatgtgttaattttcgatctggggggtggcacgttcgacgtatccattctgaccatcgacgatggcatttttgaggtcaaggccacagcgggagatacgcacctggggggagaggacttcgacaatcgactcgtcaatcattttgttgaggagttcaagaggaagcataagaaagatatctcacagaacaaaagggctgtgcgacggttgagaacagcatgcgagcgtgcgaagaggaccctgagttcctccacgcaagccagtttggagatagatagtctttttgagggcatcgacttctacacaagtattacgagagctcgctttgaggagctgtgttccgacctcttccgctccaccctggagcctgtggaaaaagcgcttagagatgcaaagctggataaagcccaaatccacgatctggtgttggtgggagggagcaccagaattcctaaggtgcagaagcttcttcaggacttctttaacggaagagatctcaataaatcaatcaaccccgatgaggccgtcgcctacggtgctgctgtgcaagctgctatcttgatgggcgacaagtcagaaaatgttcaagacctcctcctcctcgacgtggccccactttcattgggcctggagaccgctggcggggtaatgaccgctctgattaaacggaattcaacaatacctaccaaacaaacacagatctttacaacttactccgacaaccagccaggcgtcttaatccaggtctatgaaggggagcgcgcaatgacgaaggacaacaacctcttgggaagattcgagctctcagggatcccacctgctccccgtggtgtaccccaaatagaagtgacctttgatatcgacgccaatggaattcttaatgttaccgccacagataagagcaccggtaaagctaacaagatcaccatcactaacgacaagggcagactgagcaaagaggaaattgaacggatggtgcaggaggccgaaaagtacaaagctgaggacgaggtacaacgcgagagagtctctgccaagaacgcattggaaagttacgccttcaacatgaagtcagcagttgaggacgagggcctcaagggaaaaatcagcgaggccgacaaaaagaaggtgctcgataaatgccaggaggtcatttcttggcttgacgctaatacactggctgaaaaggacgagttcgaacacaagagaaaggagctggagcaagtttgtaatccaatcatcagcggcttgtatcagggggcaggaggtcctgggcccggggggttcggtgcccaaggcccgaaagggggctcaggctccggacctacaattgaggaggtcgattag

SEQ ID NO: 190357 - DNA, 1926 bp, Artificial Sequence
  Description of Artificial Sequence: Synthetic coding sequence
atggccaaggccgccgccatcggcatcgacctgggcaccacctactcttgtgtcggggtcttccagcacggcaaagtggagatcatcgcaaacgaccagggaaataggactactccctcctatgtggctttcaccgacacagagcgcttaatcggtgacgccgctaagaatcaggtggccctaaatccccagaatactgtatttgatgcgaagagattaatcggtcggaaattcggggatccagttgtgcagtcagacatgaagcattggccttttcaagtaattaacgacggtgacaagcccaaggtgcaggtgtcctacaaaggagagacgaaagctttctacccagaagagatctcgtctatggttctcacaaagatgaaggagattgcggaagcttaccttgggtaccccgtcacaaacgcagtcattacagtgccagcttatttcaacgatagccagaggcaggccacaaaggatgctggtgttatcgctgggctcaacgtgctgaggataattaacgaaccgacagctgccgctatcgcttatggactggatcgtacaggcaaaggggagagaaacgtgctcatatttgatctggggggggggacctttgacgtaagcatcctgactatcgacgacggaatctttgaggttaaggcaaccgcgggagacacacacctcgggggagaagatttcgataatagactagtaaaccacttcgtcgaggagtttaagagaaagcataagaaggatatcagccaaaataaacgggccgtgaggcggctccgaacggcttgcgaacgtgccaagaggacactgagctccagcacacaggcgtcacttgagatcgatagcctgtttgaaggaattgacttttacaccagcattacccgtgctagattcgaagaactatgtagtgatttgtttaggtcaacactggaacctgtggagaaagcccttcgggacgcaaagctggataaagcacaaattcatgatctagtgctcgtaggtgggagtacgaggatcccaaaggtacaaaagctgctgcaggatttcttcaatggccgcgatctgaacaagagcatcaatccagatgaagcagttgcctacggggcagccgtgcaagccgccattctgatgggcgacaagagcgaaaacgtacaggatcttctgttgctggatgtggcaccgctgtcattagggctcgagaccgcgggaggcgtcatgacagcgttaattaagagaaattcgacaattcccactaagcaaacacaaatttttaccacatactcagacaaccagcctggagtgcttattcaggtgtatgagggtgagagggcgatgacgaaagataataatctgctgggtcgattcgagctaagtggcatcccacccgcccctagaggggttccacagatcgaggttaccttcgatatcgacgccaatggaatcctaaacgtaaccgccacggataagtccaccggaaaggctaacaagattactataaccaacgacaagggaaggctgtccaaggaggagattgagagaatggtgcaagaggctgagaagtataaagccgaagatgaagtccaacgggaacgagtgtccgctaagaatgcgttagaaagctacgcgtttaacatgaagtccgctgtcgaagatgaggggctgaaaggcaagatttcagaagctgataagaagaaagtgctcgacaagtgccaggaggtgatctcctggcttgacgccaataccctggccgagaaggacgagttcgagcacaaaagaaaagagctagagcaggtgtgtaaccccattatcagtggcctgtatcaaggggcgggcgggcctggcccaggcggttttggcgcacagggtcctaagggcggttcaggatcgggaccaaccatcgaggaggttgactag

SEQ ID NO: 190358 - DNA, 2127 bp, Artificial Sequence
  Description of Artificial Sequence: Synthetic coding sequence
ctgcggagctgctgcgagggccccctgcggctgagccgggtgaccccggccgtgccgcgtctgtcacgggccaacctgtgcgggtgcagacacaggcgcgtggaattcccagcttttcgccgcactgagttattgtcacggatcccgtctgcggtgagctccccacagtctcaaagtggggcccatcgccaggggacaggtatggcaaaggccgccgctattggcatagacctgggcacaacctacagttgcgtgggcgtgtttcaacatggaaaggtagagattatagctaatgaccagggcaatcggactaccccttcctatgtagccttcaccgataccgagcgactcataggcgacgctgccaaaaatcaagtggcactgaacccccaaaacactgtatttgatgctaagaggctgatcgggcgcaaatttggcgaccccgtggtgcagtcggacatgaagcactggccattccaagttatcaatgatggggacaaacctaaagtgcaggtctcttacaagggcgaaaccaaggcgttctaccctgaagaaatttctagcatggtattaacgaagatgaaagaaattgcagaggcctatctgggatatcctgttacaaacgctgttatcactgtccccgcttacttcaacgacagtcaacgccaggctacaaaagacgccggcgtaattgcgggcctgaacgtcttaaggatcattaatgaacccactgccgctgcaatcgcttacgggctcgaccgcacagggaagggagagagaaacgtcctcattttcgatctgggcggaggaacatttgatgttagtattctgacaatagacgacggcatcttcgaggttaaagcaactgcaggcgatacccaccttggcggcgaggattttgataatagattggtgaaccactttgtggaagagtttaaacgcaaacataagaaggacatcagccagaataagcgcgccgtcaggagattgaggacagcctgcgaacgggccaaacggaccctgagcagctcgacccaggctagtctggaaatcgactccctgttcgagggaattgatttctacaccagcatcacccgagcacgctttgaggaactgtgcagcgatctgttccgctccaccctcgagcccgtcgagaaagccctgcgagatgccaaactggacaaggcgcagattcacgatctcgtgctggtcggggggagcactcgaatcccaaaagtgcagaaactactgcaagatttttttaacggtcgggatctgaacaaatcaatcaatccagacgaggcagtggcgtacggagcagccgtacaggctgccatcctcatgggcgacaaatccgagaacgttcaggatctactcctcctcgacgtcgctcctctatccctcggacttgagaccgctgggggggttatgactgccctgatcaagaggaattctacaattcctactaaacagacccagatttttactacctatagcgataaccagcccggggtgctaattcaagtctacgaaggggaacgggctatgacgaaagataataaccttcttggccgcttcgaactgagcggcatacccccagccccgcggggcgtgccccagattgaagttacctttgatatcgatgctaatgggatcttaaacgtgacagctacagacaaatctactggtaaggccaataagatcaccatcacgaacgataaaggtaggctcagcaaagaggagatagaacgaatggttcaggaggctgagaagtataaggccgaggacgaggtgcaacgggaaagggtcagtgctaagaacgccctggagtcttatgcgtttaacatgaagtcagccgtggaggatgaaggactaaagggcaaaatctctgaggcagataagaaaaaggttcttgacaagtgtcaggaagtgatcagttggctggatgccaatacactggccgagaaggacgagttcgagcataagagaaaagagttagagcaagtctgtaaccctataataagtgggctataccagggggcaggcggtccaggccccggcggctttggtgctcagggccccaagggaggctcaggatcaggcccaaccattgaagaagtggattag

SEQ ID NO: 190359 - DNA, 1653 bp, Artificial Sequence
  Description of Artificial Sequence: Synthetic coding sequence
atggccaaggccgccgccatcggcatcgacctgggcaccacctactcttgtgtaggtgtgttccagcacggaaaagtgcaaatctcatccatggtgctcaccaagatgaaggagattgctgaagcatacctgggctatccagtcaccaatgccgtgatcactgtcccagcttatttcaatgattcgcagaggcaggcgacgaaggatgctggtgtgatcgctgggctgaacgtgctgaggataatcaacgaaccaacagccgccgctattgcctatggacttgaccgcacgggtaagggtgaacgcaacgttttgatcttcgacctgggtggaggaaccttcgacgtgtctattctaaccatcgatgacgggattttcgaggtgaaagcaaccgcaggagacactcatttgggaggcgaggatttcgacaacaggctagtgaaccattttgtcgaagagtttaaaagaaaacataaaaaggatatctcccagaataagcgcgccgtcagaagactcaggacagcgtgcgagagagcaaagcgtactctatccagcagcacacaggcatcgctggaaatcgattccttgtttgagggtatcgacttctacacttcaataaccagggcccgattcgaggaactctgtagcgacctgttcaggtctaccttggaacctgttgaaaaagcattgcgggacgctaagctggataaagcccaaattcacgaccttgtgttggtcggtggaagcactcggattcccaaagtccagaaactgcttcaggatttcttcaacggaagggatctcaacaaatctatcaacccagatgaagctgttgcctatggcgccgcagttcaggcagctattctgatgggcgacaagagtgagaacgtccaggatctcttacttctagatgtcgctccactctcactcggtctggaaactgctggaggcgtgatgaccgctctgatcaaacgcaacagcaccatccccactaaacagactcagatcttcaccacatacagtgataaccagcccggcgtacttatccaggtgtacgagggagagcgagccatgaccaaggataacaatctgcttggccgctttgaactgagtggcataccccccgctcctaggggtgtacctcagatcgaggtgacattcgatatcgatgccaacggcattctcaatgtaacagcaaccgacaagtcaacgggaaaagcgaacaagatcacgatcactaatgataaagggcgcctgtcgaaagaagaaatcgaacgtatggtccaagaggcagagaagtacaaggctgaagacgaggtccagcgtgagcgggtgagtgcaaagaatgccctcgagtcctatgctttcaacatgaagagcgcagttgaggacgagggactgaagggaaagatatccgaggcagataaaaaaaaagtgcttgataaatgtcaagaggtgatttcgtggctagatgctaatacactagctgagaaagacgagttcgagcataaacggaaggagttggagcaggtgtgcaacccaatcatcagcggtctctatcagggggctggcggcccgggcccaggtgggtttggcgcccagggcccaaagggcggatctggcagtggcccaactatcgaggaagtggattag

SEQ ID NO: 190360 - DNA, 1875 bp, Artificial Sequence
  Description of Artificial Sequence: Synthetic coding sequence
atggccaaggccgccgccatcggcatcgacctgggcaccacctactcctgcgtgggcgtgttccagcacgggaaggtagagattatcgccaatgatcaggggaataggacgacccccagttacgttgcttttacggacactgaacgtctgattggagatgccgccaaaaaccaggtggccctgaacccccctgtcgttcagtcagatatgaagcattggccctttcaggtgatcaacgacggcgataagccaaaggtgcaggtttcatacaaaggggaaactaaggcattctacccggaggagatcagcagcatggtgctcactaaaatgaaagaaattgctgaagcctacttggggtacccggtgaccaacgctgttataactgttcctgcctacttcaatgattctcagcgccaggccaccaaggacgcaggtgtcattgcagggctgaatgtgctgcgaatcatcaatgagcccacagcagccgccatagcgtacggcctggacagaaccggaaaaggcgaaagaaatgtgctgatcttcgacctgggaggagggactttcgacgtctctatactcacgattgacgacgggatttttgaagtcaaggcaaccgcaggcgacactcacctaggtggagaagacttcgataatcggctggttaatcacttcgtggaggaatttaagcgcaaacacaaaaaagatatctcacagaataaaagggcagtgaggcgactccggactgcctgtgaaagggctaagaggaccctatcctcctctacccaagcctctcttgagatagattctctttttgaaggcatcgacttttacacgagtatcacccgggcccgctttgaagaactgtgtagcgatctgtttaggtccacactagaaccagtcgagaaggctctcagagatgcaaaactcgataaagcccaaatccacgacttggtcctcgtgggcggtagcacccgaattcccaaagtccaaaaactgctgcaggactttttcaatggccgcgacttaaacaagtctattaatcccgatgaagcagtggcgtacggcgccgctgttcaggcagccattctgatgggggacaaatctgaaaacgtacaggacctgttactgctggacgtggctcctttaagccttgggttagaaaccgcaggcggagtcatgacagccctaatcaaacgcaactctaccatccccactaagcaaacgcaaattttcacaacctatagcgacaatcagcccggggtattgatccaggtttacgagggggagcgggctatgaccaaagacaacaatcttctaggtcgattcgaattgtctggaattccaccagcaccaaggggtgtcccccagattgaggttacattcgatattgatgcgaacggcatccttaatgtaaccgcgaccgataaatctactggcaaggctaacaaaatcactattacgaatgacaagggccgtctcagtaaagaggagatcgaaagaatggtacaggaggcagaaaagtataaagcggaggacgaagtccagcgagaacgcgtctcagcaaagaacgcactcgagagctatgcatttaacatgaaatccgctgtagaggacgagggcctgaaaggaaagatctccgaagctgacaagaagaaggtcctggataagtgtcaggaagtgatttcttggctggacgctaacactttggccgaaaaagacgaattcgagcacaagcgcaaggaactggaacaggtctgtaatccaatcatcagcgggctgtaccagggcgccggcgggccagggcctggcggttttggtgcccaaggcccaaaagggggatcggggtccgggccaactatcgaagaggttgactag

SEQ ID NO: 190361 - DNA, 1857 bp, Artificial Sequence
  Description of Artificial Sequence: Synthetic coding sequence
atggccaaggccgccgccatcggcatcgacctgggcaccacctacagctgtgtaggagtgttccaacatggcaaggtcgaaatcatcgccaacgatcaaggaaaccggacaaccccttcatatgtcgcctttacagatactgagcgactgattggggacgccgcgaaaaaccaagtggtgcaatcagacatgaaacattggcccttccaggtcatcaacgacggggataaacctaaggtgcaggtgagctacaaaggggaaactaaggccttttaccccgaagagatctcatcaatggtgctgaccaagatgaaagaaattgcggaggcttatttagggtatccagtgactaacgccgtaataactgtccctgcctatttcaacgacagccagaggcaggccacgaaggatgcaggcgtgatcgccggcttaaatgtgttgagaatcattaatgagcctacagccgcggctattgcttatggccttgaccgtacaggcaagggagaaagaaatgttcttattttcgacctggggggcggaactttcgacgtttcaatactgacaatagatgacggaatttttgaggtgaaagctaccgccggcgacacccatctaggaggcgaggatttcgacaatagattagtaaaccacttcgtggaagaatttaagaggaagcataaaaaagacattagccagaataaacgagcggtcaggcgcctccgcactgcctgtgaaagggccaagcggactcttagctcctccactcaagcctccttagaaatcgacagcttgttcgagggcatcgacttttacacttcaatcacccgcgccaggttcgaggagctctgctccgacctgtttcggtccacccttgagcccgttgagaaggcactgcgggacgccaagttggacaaagcacagattcatgacctggtgctggttggaggctctacccgaatccccaaggtgcaaaagctgcttcaggatttctttaacggccgagacttgaataaatctataaatcctgatgaggccgttgcatatggagctgctgtccaggcagccatcctgatgggcgacaagtccgagaatgtccaagacttactactcctggatgtggctccgctctccctcggtcttgagaccgctggcggggtgatgacagccctgatcaaacgtaacagcaccattcccacaaagcagacccagatcttcacgacgtactctgataaccagccgggcgtgctgatccaggtgtatgaaggcgaaagagccatgaccaaagataataacctcttgggaaggttcgaattaagcggcataccacctgccccgcgcggcgtaccacaaatcgaagtgaccttcgatatagacgcaaatggcatactaaacgtgacggcaacagataagagcacgggcaaagccaacaagattacaataaccaacgacaaaggacggctaagcaaggaagaaatcgaacgcatggtacaagaagctgaaaaatacaaggctgaggatgaggtccaacgggaacgcgtgtcggccaagaatgcactcgagagctatgccttcaacatgaaatcagccgttgaggatgaaggcctgaaaggaaaaataagcgaggctgacaaaaagaaagtgcttgacaaatgtcaggaggtgatttcgtggctcgatgctaacacactggccgagaaagatgaatttgagcacaaaagaaaggagttagaacaagtgtgtaacccgattatcagtggattgtatcaaggcgctggcggtccaggtccaggcgggtttggtgctcaaggaccgaaaggaggctctggctctggccccacgatcgaagaagttgattag

SEQ ID NO: 190362 - DNA, 1857 bp, Artificial Sequence
  Description of Artificial Sequence: Synthetic coding sequence
atggccaaggccgccgccatcggcatcgacctgggcaccacctactcctgcgtcggagtgtttcagcacgggaaagtggagattatagccaacgaccaggggaacagaacaacccctagctatgtagcctttaccgatacggagaggctgattggagatgccgcaaagaaccaggtggtgcagtcagatatgaagcactggccattccaggtgattaatgacggcgataaacccaaggtgcaggtgtcctacaagggcgagacaaaagccttctaccctgaggaaatcagctccatggttctgactaagatgaaggagatcgcggaggcatatctcggctatcccgtcaccaacgccgtgatcacagtccccgcctacttcaatgactcacagagacaagccaccaaggatgccggcgtgatagcaggactcaatgtgctgaggatcattaacgagcctaccgctgccgccatagcctatggtcttgacaggacagggaagggagaacgaaacgtgctaatatttgacctcggagggggcacgttcgacgtatcaatccttacaatagatgacggcatcttcgaggtaaaagcaacagctggggacacacacttgggcggggaggacttcgataatagacttgtgaatcacttcgtggaagagtttaaaaggaaacataagaaagatatttctcagaacaaacgtgcggtacggaggctaagaaccgcctgcgagcgggcgaagcgtactctcagctcaagcacccaagccagtcttgaaattgattcactttttgagggtattgacttttatacatcgatcaccagagctagattcgaggaactctgttctgatctctttagatcaactctggaaccggtggaaaaagcactcagagatgcaaagctggataaggcacagattcatgatcttgttcttgtcgggggttccacacggattcctaaggtgcaaaagctgctccaagatttttttaacggtcgggatctgaacaaatctataaaccccgacgaggcagtggcttacggtgccgccgtgcaagccgccatattgatgggggacaaatccgaaaacgtccaggatctgctgttgctcgatgtcgctccgctgtcgctgggcctggagacggccgggggggtgatgaccgctctgatcaagagaaatagcacaatccctacgaagcaaacacaaattttcacaacatattccgataaccaaccaggagtccttattcaagtatatgagggagagagagcaatgacaaaagacaataacctgctgggcaggtttgaactcagtgggatcccccccgcgcctaggggcgtaccccagatagaagtcaccttcgatattgacgcgaatgggatccttaatgtgacggccactgacaagtcgacaggcaaggccaacaagattactattaccaacgataaaggcagactatcaaaagaagaaatagagaggatggttcaagaggcagagaagtataaggctgaggatgaagtgcagcgagagcgcgtctctgccaaaaacgcactggagagctacgcattcaacatgaaatctgccgtggaggacgagggcctgaaggggaagatcagtgaggcagataagaaaaaggtattggacaaatgccaggaggttattagctggttggacgctaacactctggccgagaaagacgagttcgaacataaaaggaaagaactcgagcaggtctgtaatcccataatttcaggtctctatcagggagctgggggtccaggaccggggggttttggcgcacaggggcctaaagggggttcagggtctgggccgacaattgaggaagttgactag

SEQ ID NO: 190363 - DNA, 1653 bp, Artificial Sequence
  Description of Artificial Sequence: Synthetic coding sequence
atggccaaggccgccgccatcggcatcgacctgggcaccacctacagctgcgtaggcgtgttccagcacggtaaagtgcagatatcatcaatggttctaaccaaaatgaaagaaatagcggaagcctacctgggttaccctgtaacaaacgcagtgattactgtgccagcttactttaatgacagtcagcgtcaagccactaaagatgcaggagtaatagctgggctaaacgtactgcggataatcaatgaacccactgccgccgctatcgcgtatggtctggacaggactggcaaaggagagaggaacgtcctcatctttgatctaggcggggggacgttcgatgtcagcatactaacaattgacgacgggatctttgaggtgaaggccaccgccggcgacactcatctgggaggagaggacttcgacaaccggctggttaaccactttgtcgaggaattcaaacgaaagcataagaaggatatcagccagaacaaaagggctgtgcgacgtctgaggactgcatgtgagagggccaaacgcacgctgtcaagctcaacacaggcaagtcttgagatcgacagcctcttcgagggaattgacttctatacatccataacccgcgccaggtttgaggagctgtgctccgatctgtttcgttcgacactggagccagtcgagaaagcgctcagagacgcaaagctggacaaggcacagatccacgacctcgtcctcgtgggtggatccactaggattcctaaggtccagaagctgctgcaagatttcttcaacggtagagatttgaataaatccatcaaccctgacgaggcagtcgcctacggggctgccgtgcaggccgctatcctcatgggggacaagtcagagaacgtgcaagacctcctcctgcttgacgtggccccactcagcctcggactcgagacagctggcggggttatgacagcactgattaaaagaaactccaccataccgacgaaacagacacagatcttcaccacctactccgataaccagccaggggtcttgattcaagtgtacgaaggagaacgcgccatgacaaaggataacaatctgctggggcgtttcgaactcagcggtattccacctgctcctcggggggtaccccagattgaagtgacatttgatattgatgccaatgggattctgaatgtgaccgcaactgacaagtcgacggggaaggcaaataaaattactataaccaacgataaaggccgcctgtctaaagaggaaatcgagcggatggtccaggaagccgagaaatataaggcggaggatgaagtccagagggagcgggtcagtgccaaaaatgctctggaatcctacgcattcaacatgaaatccgctgtggaggacgaggggctaaagggcaagattagtgaagcggacaaaaaaaaagtgctcgataagtgccaggaggtaatctcctggctggacgccaatacccttgccgagaaggacgagtttgagcacaagagaaaggagctggagcaggtctgcaaccccattatctccgggttgtatcagggtgcaggaggccctggacctggcgggttcggtgcccagggcccgaaagggggtagtgggagcggacccactatcgaggaggtggactag

SEQ ID NO: 190364 - DNA, 1857 bp, Artificial Sequence
  Description of Artificial Sequence: Synthetic coding sequence
atggccaaggccgccgccatcggcatcgacctgggcaccacctactcgtgcgttggcgtcttccagcacggcaaagttgaaattattgcaaatgaccagggtaaccgcaccaccccaagttatgtggccttcaccgacactgagagactcatcggcgacgctgccaagaaccaggttgtgcagtctgacatgaagcattggccgtttcaggtcatcaacgatggtgacaagcccaaggtacaggtatcctacaaaggcgaaacaaaagcgttttaccccgaagaaatctcttctatggtgctgactaaaatgaaggaaatcgctgaagcatacctcggttatccggttacgaacgccgtcattaccgtgccggcatactttaacgatagccagaggcaggctacaaaagacgcgggggtaattgccggcctcaatgtactgcgaattatcaacgagcccaccgccgccgcaatcgcgtacggcttagatcggacaggcaaaggggaacgcaatgtgctgatatttgatcttggaggcgggacttttgatgtctcgatcttaacaattgacgacgggatctttgaagtgaaagctaccgccggagatacccatctagggggcgaggatttcgacaatcggttagtgaatcatttcgtcgaggaattcaaacgaaaacacaagaaggacattagtcagaataagcgggcagttcgacggctgagaaccgcctgcgaacgagcgaaaagaaccctgagtagctctacgcaggcaagtttagaaattgatagtctttttgagggaatcgatttttacacttcaattactagggctcggttcgaggaactgtgtagtgatctgtttcgctccactttagaaccagtggagaaagcactgagagacgccaagctggacaaagcacagatccacgacctggtacttgtgggcgggtcaaccaggatccccaaagttcagaaactcctacaagacttctttaatggtcgagacttgaataaatcaatcaacccagatgaggctgtggcttatggcgcagctgttcaagccgcaatcctcatgggagacaaaagcgagaacgtgcaggatctgttactgttagatgtggcccctttgagcctggggctggaaacagctggaggcgtgatgacggcccttatcaaacgtaactccaccatccccaccaaacaaacccagatctttacaacatactctgacaaccagccgggcgtgctcattcaagtgtacgaaggggagagggccatgaccaaagacaataatctgctggggaggttcgagctgtcggggatacccccagcgccacgaggggtgccacagatcgaagtgacctttgacatcgacgctaatggtatcctgaacgtgacagcaaccgacaaatccaccggtaaagccaataagataaccattactaatgataaggggagattgtctaaggaggagattgagaggatggtgcaggaggctgagaaatacaaggctgaggacgaggtgcagagggaacgggtctctgctaaaaacgcactggaatcgtatgcttttaacatgaaaagcgctgttgaggatgagggactaaaggggaagattagcgaagcggataaaaaaaaggttctggacaagtgccaggaagttatcagctggctggatgccaacacacttgccgagaaagacgagtttgagcataaacgcaaagaactggagcaggtgtgcaaccccattatcagcgggctctaccagggcgctggcggcccaggtccagggggcttcggagcccagggaccaaagggcggttccggatcaggacctactatcgaggaggtcgactag

SEQ ID NO: 190365 - DNA, 1653 bp, Artificial Sequence
  Description of Artificial Sequence: Synthetic coding sequence
atggccaaggccgccgccatcggcatcgacctgggcaccacctactcatgcgtgggagtcttccagcacggtaaggtgcagatttccagcatggtcctgaccaagatgaaagaaatcgccgaggcataccttggatatccagtcacaaatgctgtcatcactgtgcctgcctacttcaacgatagtcaaaggcaggccacgaaggacgcgggcgttattgcggggctgaatgtcctccgaatcatcaatgaaccaacggccgctgccatcgcttatgggcttgaccgaacgggcaaaggagaacggaatgttttaatattcgatctgggcggggggacattcgacgtaagcattctgacaatagacgacggcatcttcgaagtgaaggctactgccggggacacacaccttggcggcgaggactttgataatcgactcgtcaaccacttcgtggaagagtttaagaggaaacataaaaaggacatcagccagaacaaaagggcagtgcggcgcctgcggacggcttgtgagagggctaaaagaaccctgagctccagcacacaggcctccttggaaattgatagccttttcgagggcattgacttttatacttctatcactagggcaagattcgaagagctgtgcagtgaccttttcaggagtaccctggagcccgtggagaaagcactgcgcgacgccaaactagacaaagcacagattcacgacttagtgctggtcggtggatctacccgaattcctaaggtgcagaagttgctgcaagatttttttaacggccgtgacctgaataagtccatcaaccccgatgaggcagttgcatacggcgctgccgtgcaggcggccattcttatgggcgataaatccgagaacgtccaggacctgttgctgctggatgtggccccattatccctagggctcgaaacggcaggcggagtcatgaccgctttaattaaacggaactctaccatcccaacgaaacaaactcagatattcactacctatagtgataatcaaccaggtgtgctcattcaggtgtatgagggtgaacgtgccatgacaaaggataataatttgctcggtcgtttcgagctcagcgggatccctcctgctcccaggggagtgccacagatcgaggtgactttcgatatcgacgctaacggaattctgaacgtgacagcaactgacaaaagcactggcaaggccaacaaaataacaattacaaacgataaaggaagactgagcaaggaggagatcgagagaatggtgcaggaggccgagaagtacaaagccgaagatgaggtgcagagagaacgtgtgtccgctaaaaacgcactcgagtcttatgcattcaacatgaaaagcgctgtggaggatgaggggttaaagggcaaaatctccgaagcagataaaaaaaaagtgttggacaagtgtcaggaagtaatatcatggctggacgcaaataccctcgcagaaaaggatgagtttgagcacaagaggaaagaactggaacaagtctgtaacccaatcataagtggcctgtatcaaggtgccgggggccccggccctgggggtttcggcgctcagggcccaaagggaggttctgggtcagggcccaccatcgaagaggttgactag

SEQ ID NO: 190366 - DNA, 1761 bp, Artificial Sequence
  Description of Artificial Sequence: Synthetic coding sequence
atggccaccgccaagggcatcgccatcggcatcgacctgggcaccacctattcctgcgtgggagtgtttcagcatggcaaggtggagattatcgccaatgatcagggaaacagaacaactcccagttacgtggcatttaccgataccgagaggctcatcggtgacgctgcaaaaaaccaggtagccatgaatccccaaaatacagtctttgacgctaaacgactaatcggaagaaaatttaacgacccagtggtgcaggctgatatgaagttgtggccattccaagttatcaatgacagtcagcgtcaggccacgaaagatgcgggcgttatagcgggcctcaacgttctgaggatcatcaatgaaccaaccgcggctgcaattgcatacggcctagataagggaggacaaggagaacgtcatgtcctgatcttcgacctcggaggtggcaccttcgacgtgagcatcttgaccattgatgacgggatcttcgaagtgaaagccaccgccggcgacactcatctgggaggggaggacttcgacaatcgacttgtgtcccacttcgttgaggagtttaagaggaagcataagaaggatatctctcagaataaacgtgctgtccggaggttgaggactgcctgcgaaagggctaaacgaacgctgagttccagcacacaagccaacctcgagatagattcactgtatgagggaattgatttctatacaagcattacaagagctcgattcgaagagctctgtgccgatctgttcaggggaaccctcgagcctgttgaaaaagcactgcgcgatgccaaaatggacaaagcaaaaatccatgacatcgtactcgtcggagggtcaactcgtatccctaaagttcaaaggctgttacaggattacttcaacggacgcgacctcaacaagtccatcaacccagatgaggctgtggcatatggagccgccgttcaggcagcaatcctgatgggcgataagtccgagaaggtgcaggacctacttctgttagatgttgcccctctatccctcgggctcgagactgcgggcggcgtgatgacggcactgattaaacgcaacagtaccatccctaccaaacagacccaaatctttaccacctactccgacaatcagccaggggtgcttatccaggtctacgagggtgaacgtgctatgaccaaagacaacaatcttctgggaagattcgatcttacagggatcccgccagccccccgcggtgtcccacaaatcgaggtgacctttgatatcgacgcaaatggaattctcaacgtgacagcaacggacaaatcaaccgggaaagtgaataaaataacaatcaccaatgacaagggaagattgagcaaggaagagattgaaaggatggttctcgacgctgaaaagtataaggctgaggatgaggtccaacgggagaagatagcagccaagaacgccttggaatcctacgcatttaatatgaaatccgtggtcagcgacgaaggtctgaaagggaagatctccgagtcagataagaacaagatcttggacaaatgtaatgagctcttgtcttggctcgaggtcaaccaactggcagagaaagatgagttcgatcacaaacgaaaagagttggagcagatgtgcaacccaattattaccaagctgtaccaaggtggctgcaccgggcccgcctgtggaacaggctacgtacccggccgccccgccacgggacctaccatcgaggaagtggattag

SEQ ID NO: 190367 - DNA, 1926 bp, Artificial Sequence
  Description of Artificial Sequence: Synthetic coding sequence
atggccaccgccaagggcatcgccatcggcatcgacctgggcaccacgtactcctgtgttggcgttttccagcacggaaaagtggaaattattgcgaacgaccagggcaacagaacgactcctagttacgtcgcattcactgacaccgagcgactgattggggacgctgccaagaatcaggttgccatgaacccacagaacacagtgtttgacgcgaaaaggctcataggtcggaagttcaatgatcccgtggtacaagctgacatgaagctctggccattccaggtcatcaacgagggaggtaagcctaaggtgcttgtttcttataaaggcgagaataaggcgttctacccagaggagatcagctctatggtcctgactaagctgaaggagaccgctgaagctttcttggggcaccccgtgacaaatgctgtgatcactgtccctgcatatttcaatgactctcagaggcaagctactaaagatgctggcgtgatcgccggcttaaacgtccttaggattattaatgagcctaccgccgctgccattgcgtacgggttggacaaaggtggacagggcgaaagacatgttctaatcttcgacttaggaggagggactttcgatgtgagtattctaactatcgacgacgggatttttgaagtcaaggctactgctggagatactcacctaggcggagaagactttgataataggctggtctcccacttcgtggaggaattcaaacggaaacataagaaggatatcagtcagaacaaaagagcagtgaggcgcctgcgaactgcttgcgagagagccaagcggacgctgtcatccagcacacaggctaatctggaaatcgacagcctttatgaagggatagatttctatactagcataacgcgggcaaggtttgaagagctgtgcgctgatctttttcggggcaccctcgagcctgtggaaaaggccctgcgtgacgctaagatggacaaagcaaagatccacgatatcgtcctggtcgggggatctacaagaatccctaaagtgcagagattgttacaggactacttcaacggaagggacctcaataaaagcattaatcccgacgaggccgtggcttacggagcagcagttcaggccgctatcttgatgggtgacaaatcagagaaggtacaagatctactcctcttagatgtggcaccattgtcgttaggcctggaaaccgctggaggggtcatgactgccctgatcaaacggaacagtactattcctacaaaacagacccagatctttaccacctactccgacaatcagcccggagtactcatacaggtatatgaaggagagcgagccatgacgaaagataataatctattggggcgctttgatttaacggggattcccccagcccctcgcggcgtgccccagatcgaggtgacttttgacatcgacgcaaatggcatacttaatgtaactgctaccgataaatctactggcaaggtcaacaagatcactatcactaatgacaaagggcgtttatccaaagaggagattgagcgtatggttctggacgcagagaagtacaaggcggaagatgaggtgcagagggagaagatagccgctaagaatgctctggagtcctatgcttttaacatgaagtcggtcgtgagcgacgaaggcctgaaagggaagatctctgagagcgataagaataaaattctggacaaatgcaatgagttgcttagctggctcgaagtaaatcagctggctgagaaagacgaatttgaccacaaaagaaaggagctcgagcagatgtgcaatcctatcataacgaaactttatcagggcgggtgtaccgggccagcttgcggaacaggatatgtacccggccggccggctaccggccccacaatcgaggaggtggattag

SEQ ID NO: 190368 - DNA, 1926 bp, Artificial Sequence
  Description of Artificial Sequence: Synthetic coding sequence
atggccaccgccaagggcatcgccatcggcatcgacctgggcaccacctattcatgtgtgggcgtgttccaacatggcaaggtcgaaattatcgccaacgaccaaggcaacaggactacgccttcatacgtggcgttcaccgatactgaaagactgatcggcgacgccgccaagaaccaggtggccatgaatccacaaaacaccgttttcgacgccaagagactgattggtcgaaaattcaatgacccagttgtccaagccgacatgaagctttggcctttccaggtgatcaatgagggaggtaagcctaaggtcctggttagttacaagggggaaaacaaggccttttacccagaggagatttcatccatggtcttgaccaaactcaaagagacagccgaggcctttctgggccacccggtgactaatgccgtcataacggttccagcttacttcaatgactcccagcgccaagcaactaaagatgctggcgtgattgctgggttgaacgttctgcgcatcatcaatgaaccgacagccgcagccatagcttacgggctggacaagggcggtcagggtgagcggcacgtgctcatttttgatctgggaggcggaacgttcgatgtaagcattttaaccattgacgatgggattttcgaggtaaaggccacagctggagacacccatctgggcggcgaggacttcgataacagacttgtcagccacttcgtagaagaattcaagaggaaacacaagaaagacatcagccagaataagcgggctgtgcgcaggctcaggaccgcttgtgagcgcgccaagcgtacactgagtagttctacccaagcgaaccttgaaatcgatagcttgtacgaggggattgatttctacacttctatcaccagagccaggttcgaggagttgtgcgcagacctgttcaggggcaccttggagcccgtcgagaaagcactgcgagacgccaagatggataaagcaaaaatccacgatattgtgctcgtggggggcagtacccggattcccaaagtgcaaagactcttgcaggactatttcaatggtagggatctgaacaagtctattaatcccgacgaagcagtggcctatggggcggctgtgcaggctgcaattctgatgggcgacaaatctgaaaaagtgcaagatctcctactgctagacgtggctccccttagcctgggcctggagacggcaggaggggtcatgacggctttaattaaacgtaatagtactatccccaccaaacagactcagatcttcaccacttactcagataaccagccaggcgtcctgatacaagtgtatgagggggagcgggcaatgactaaggataataatcttcttggccggttcgacctgacaggtatccctcctgcgccacggggggtccctcagatagaggtgaccttcgacattgacgccaatggcatccttaatgtcactgcgatggataagagtacaggcaaggtgaataagattactattaccaacgataaaggacggctcagcaaggaggagattgagcgcatggtactggacgcagaaaaatacaaagccgaggatgaggttcaaagggagaagattgcggccaagaatgcactggagtcgtacgcatttaacatgaaatccgtggtgagtgacgaagggctcaaaggcaagatctcggaaagcgacaagaacaaaattctagataaatgcaatgaactgctgtcatggttggaagtgaaccagctggctgagaaggatgaatttgatcataagcggaaggagctcgagcagatgtgtaatcccataattacaaaactttaccagggggggtgcactggccctgcatgtggcaccggctacgtgccagggcggcccgcaaccgggcccacaatcgaggaagttgactag

SEQ ID NO: 190369 - DNA, 1926 bp, Artificial Sequence
  Description of Artificial Sequence: Synthetic coding sequence
atggccaccgccaagggcatcgccatcggcatcgacctgggcaccacttactcatgtgtcggagtctttcagcacggtaaggtggagattattgctaacgatcagggaaatagaacaacaccgtcttacgtagcattcactgacacagagcggttaatcggggacgccgcaaaaaaccaggtcgccatgaacccgcaaaacacagtctttgacgccaagagactcatcggaagaaagtttaatgacccagtggtccaggccgacatgaagctctggccattccaggtcattaacgagggtggtaagcctaaagtgctggttagttataaaggcgagaacaaggccttttaccccgaggagatcagttcaatggtactcacgaagcttaaagaaactgccgaagcctttcttgggcacccagtgaccaatgcagtcatcacagtgcctgcgtacttcaacgactcgcagcgacaggcaacaaaagacgctggggttatcgcggggttgaatgtcctcagaattatcaatgagcctacggccgccgccatcgcttacggattggataaaggcggacagggtgaaaggcacgtcctcatattcgacctcggagggggtactttcgacgtgtcaatactcactattgatgacgggattttcgaagtgaaagcgactgccggcgacacacatctcgggggagaggattttgacaataggctagtgagccacttcgttgaggaatttaagaggaagcacaaaaaggatattagccagaacaagagagccgttcgccgcctgagaaccgcttgcgaacgggccaaacgcaccctgtctagttccacacaggcgaatttagaaattgatagcctttacgaaggaattgatttctacaccagcatcactcgagcccgcttcgaagaactctgcgctgatctcttcagaggcactttggaaccagtggagaaggcattacgtgacgctaagatggacaaagccaaaattcatgacattgtactcgtaggggggagtacgcggatccccaaggtgcaacgccttctgcaggattacttcaatgggagagatttaaacaagtctataaatccagacgaggccgtcgcctacggagcagcggtgcaggcagcaatattgatgggcgataagagtgaaaaagtgcaggatctgcttctcttagacgtggcacctctgtccttgggcctggagaccgccggaggcgtcatgaccgccctaatcaagcgcaatagtactatccctaccaagcaaactcagatctttacaacctattcagacaatcaacctggggtgcttatccaggtatacgagggcgaacgtgctatgacaaaagacaacaatctgttaggtagatttgacttaacgggtataccccctgccccaagaggcgtgcctcaaatcgaggtgacgttcgacattgacgcaaatggcattctgaacgtcacagctacggacaagtccaccggaaaggttaacaaaatcaccatcacaaacgataaaggcagattatctaaagaggaaattgaacgcatggtgctggacgccgaaaaatacaaggctgaagacgaagtccagagggaaaaaatcgcagccaagaacgcattggaatcctacgcattcaacatgaaaagcgtcgttagcgacgaaggccttaaaggaaagatcagtgagagcgacaaaaataagattcttgataagtgtaatgaactcctgtcgtggctggaggtcaatcaattggctgagaaggacgaatttgaccacaaacgtaaggagttggaacagatgtgtaacccaataatcaccaaactgtatcagggagggtgcactggcccagcttgcggcacaggctacgttccaggtaggccagccactggcccaactatagaagaagttgattag

SEQ ID NO: 190370 - DNA, 1926 bp, Artificial Sequence
  Description of Artificial Sequence: Synthetic coding sequence
atggccaccgccaagggcatcgccatcggcatcgacctgggcaccacttactcatgtgtgggtgtctttcagcacgggaaagtcgagattattgcaaacgatcagggaaatcgcacgacaccttcttatgtcgcttttactgacacggaaagattgataggtgacgccgctaaaaaccaggtagcaatgaatccgcagaatactgtgttcgacgcaaaaaggttgattggaagaaagtttaacgaccccgtggtacaggcagacatgaagttatggcccttccaggtcatcaatgagggaggcaagcctaaagtgctggtttcttataagggcgagaataaggctttttacccagaggagatctcgtccatggtactaacaaaactgaaggaaactgcggaggccttcctcgggcaccccgtgaccaatgctgtgattactgtgcccgcatactttaatgattcccagaggcaggccaccaaggacgccggcgtgattgccggcttaaatgtgcttcggattatcaacgaaccgactgcggccgcaatcgcctacgggctggacaaaggcggccagggtgagaggcatgtgctgatatttgacctgggggggggaacttttgacgtgtccatcttaacaatcgacgacggaatcttcgaagtgaaagcaacagccggagatacccacttgggaggggaggacttcgataaccgcctggtgagccatttcgtggaagagttcaagaggaagcacaaaaaggatatttcccagaacaagcgcgcggttcgtcgacttcgtactgcatgcgagcgtgccaaaaggaccttatcttcaagtactcaggcaaacctcgagattgacagtctctacgaggggattgacttctatacgtcgatcacacgtgctcgcttcgaggaactgtgcgccgatttatttcgtggaactctggaacccgtagaaaaggcactacgtgacgccaagatggataaggccaagatccatgacattgtgctcgtgggcgggagtacacgcatcccaaaagtacagcggttgctacaagactactttaatggaagggatctgaacaaaagtataaatcccgatgaagctgtcgcctatggagcagcggttcaggctgccattctgatgggcgacaagagcgaaaaggttcaggatctcttactcctggatgtggcccccttgtcgctgggcctggaaactgccggaggggtcatgactgcactcatcaagagaaattcaacaatccctactaagcagacccagattttcactacatactccgacaaccagcccggggtgcttatccaggtgtacgagggcgagcgggcaatgactaaggacaataacctgcttgggcgatttgatcttaccggaataccacccgcaccccgaggcgttcctcagatcgaagttacttttgacatagacgcaaatggtatcctgaacgtcactgccactgacaagtcaaccggcaaagtcaacaaaattacaataacaaatgataaggggcggctgtcgaaagaagagatagaacgtatggtactggacgctgagaagtataaagcggaggacgaggtacaacgagagaaaattgctgccaaaaacgccctggagtcgtatgcctttaacatgaagtcagtggtcagtgatgaggggctgaaaggtaagatatctgaaagcgacaagaacaagattttagataaatgcaacgagctgttatcctggttagaggtgaaccagctcgccgagaaagatgagtttgaccataaacggaaggaattggagcagatgtgcaatcccatcataactaagctgtaccaaggtggttgcactggcccagcatgcggtaccggctatgttccggggaggcctgctaccgggcctactatcgaagaggtcgattag

SEQ ID NO: 190371 - DNA, 699 bp, Artificial Sequence
  Description of Artificial Sequence: Synthetic coding sequence
gccaagggcatcgccatcggcatcgacctgggcaccacctacagctgcgtaggagtatttcagcacggaaaggtcgagataatagccaatgaccaggggaacagaacaactccatcctatgtggccttcacagatacagagcgtcttattggagatgcaggcgtgatagcgggactgaacgtcttacgaatcatcaacgagcctactgccgctgctatagcatacggcctggataaaggaggccagggagaaaggcacgtgcttatctttgaccttggtggagggacattcgatgtgagtattctcacaatcgatgatggtatttttgaggttaaggctacggccggcgacacccacttaggaggagaggacttcgacaatcgcctggttagccacttcgttgaagaatttaagcgtaagcataaaaaggatatctcccagaataaacgggcggtccgtagacttcggacagcctgcgagcgagcaaagcgaactctcagttcatctactcaggcaaatctcgagatcgatagtctgtacgagggcatagatttctatacctccattacgagggccagattcgaagaattatgtgccgatctgtttcgagggaccctggagcctgttgagaaaggggccccacctgcgtctccccggtgctccggttgttttcggactacctctatggacgttatctag

SEQ ID NO: 190372 - DNA, 1926 bp, Artificial Sequence
  Description of Artificial Sequence: Synthetic coding sequence
atggccaccgccaagggcatcgccatcggcatcgacctgggcaccacctattcctgcgtgggggtgttccagcacggcaaggtggagatcatcgccaatgatcagggcaacaggacaaccccctcttatgtggcattcactgatacagagcggctcatcggggacgcagcgaaaaatcaggtggcgatgaatccacaaaataccgtgttcgacgcaaaacgactgattgggcgaaagtttaacgaccccgtggtccaagcagatatgaaactgtggccctttcaggtgatcaatgaggggggaaaacccaaagtgttggtgtcctacaagggggagaataaagcattttatcctgaagaaatatcctccatggtgctgaccaaattgaaagaaaccgcagaggcctttttgggccacccagtgacaaacgctgtgatcacagtgcccgcctattttaatgactctcagcgacaggctacgaaagatgcaggtgtgatcgcgggcctgaatgtcctgcggatcattaacgagccaacagctgccgctatcgcctatggactcgataaaggaggacagggcgaacggcacgtgttaatattcgacctcggaggcggcaccttcgacgtgagcatcctcacaatcgacgatgggatattcgaagtgaaagcaacggccggtgatactcacctgggcggggaagacttcgacaatagactagtgagccattttgtagaggaatttaagagaaagcataaaaaggacatatcacagaacaagcgtgctgtgcggcgcctgaggacggcgtgcgaaagggccaagagaaccctcagctcttctacccaggctaacctggagattgattccctgtacgagggtatcgatttctacacctccatcacacgtgccagattcgaagaactgtgcgcagaccttttcagagggacacttgaacctgttgaaaaggctctgcgcgacgctaagatggataaggcaaaaattcacgacattgtcttggtcggtgggtcaacaagaatccctaaggtacagcgactcctccaggattacttcaatggccgagatttaaacaagtcaataaacccggacgaagccgtcgcctatggtgccgctgtgcaggcggcaattttgatgggcgacaaatctgaaaaggtacaagatttactcttgctcgacgtcgcgcccttatccttaggcttagagacagccggaggcgtaatgaccgcgctgatcaaaagaaactcaactattcctaccaaacagacccagatctttacaacatatagcgataatcagcctggcgtgctgattcaggtgtatgaaggtgagcgggccatgaccaaagataacaatctgttgggaaggttcgacctgacggggatcccaccagcgccccgcggcgtgcctcaaatagaggtcaccttcgatatcgatgctaatgggatcctgaatgtgactgcaatggataagtccacagggaaggtgaacaaaatcacaattaccaatgacaaaggacgcttaagtaaggaggagatcgagcgcatggtgctggatgccgagaaatacaaagcagaggatgaggtccagagagaaaagatcgctgccaagaatgcccttgaatcctacgcttttaatatgaaatctgtggtcagtgatgagggccttaaggggaagatatctgagtctgataaaaacaagatcttggacaaatgtaatgaactgctcagttggttagaagtgaaccaacttgccgaaaaggacgagttcgaccataagagaaaggagctggaacagatgtgcaatcctattatcacaaagttataccagggaggctgcacaggacccgcctgcggaaccggctacgttcccggacgacctgccactgggcctacaatcgaggaggtcgactag

SEQ ID NO: 190373 - DNA, 1599 bp, Artificial Sequence
  Description of Artificial Sequence: Synthetic coding sequence
atggccaccgccaagggcatcgccatcggcatcgacctgggcaccacatactcctgtgtcggcgtgtttcagcacgggaaggtcgagatcatcgctaatgaccaaggaaataggacaactccatcttacgtcgcctttacggacacagagagactgatcggagacgccgctaaaaatcaggtggctatgaatccacagaatacggtgttcgacgctaagcggcttatcggtcgaaaattcaatgacccagttgtccaagcggatatgaagctgtggccttttcaggtgataaacgagggcggcaagccaaaagttttggttagttataagggggagaacaaggcgttctaccccgaggagattagcagtatggtactaaccaaattgaaagagaccgctgaggcgttcctggggcatccagttaccaacgctgtcattactgtcccagcttatttcaatgattcccagcgtcaggcgaccaaagatgcaggcgttatcgcaggcctcaacgttttgcggataataaacgagcctaccgcagccgccatagcttacggcctggataaggggggacagggagagcgacatgttctcattttcgatctcggggggggaactttcgacgtgtctattcttacaatcgatgacgggattttcgaggtaaaggccaccgcaggagatacacatctaggcggggaagattttgacaaccgcctggtgagtcatttcgtcgaggaattcaaacgaaaacataagaaagacattagtcagaacaaacgggctgtccgtcgactaagaactgcgtgtgagagagctaagaggaccctctcatcgtctacacaggctaacctcgagatcgacagtctttatgaaggcatcgacttctatacttctatcacgagagcccggttcgaggagttatgcgcagatctgtttcgcggaaccctggagcccgtggagaaggccttaagagatgccaagatggacaaggccaagatccatgatattgtgctggtgggtggttccacacggatccctaaggtacaaagacttttgcaggattatttcaacggccgcgatctgaacaagagcattaatccggatgaagccgtggcctacggcgctgccgtccaggccgcaatcctcatgggcgacaagtccgaaaaagtgcaggatctgcttttactcgatgtagccccattatcattaggactggaaaccgctggaggcgtgatgaccgcactaatcaagcggaatagcaccatcccaactaagcagacccagatcttcaccacatattccgacaaccagccaggagttttgattcaagtgtacgagggagagagagccatgactaaggacaacaacctgttagggcgatttgatctcaccggcattcctccagccccgaggggagtccctcagattgaggtgacgtttgatatcgatgctaatggaatcctgaacgtcaccgctatggataaatctacgggaaaggtcaacaagattactattaccaatgataaggggcgtctaagcaaggaagagatcgagcgcatggtcctagatgccgaaaaatacaaggccgaagacgtgtag

SEQ ID NO: 190374 - DNA, 699 bp, Artificial Sequence
  Description of Artificial Sequence: Synthetic coding sequence
gccaagggcatcgccatcggcatcgacctgggcaccacctacagctgcgtgggggtgtttcagcatggaaaagtggagatcatcgctaatgatcagggaaaccgcacgaccccctcatatgtagcgttcaccgacactgaaagactcatcggggacgcaggtgtgatcgcaggtctcaatgttttacgcattattaacgaacccacggcagcggcaattgcctatggacttgataagggcggacagggggagcggcacgttctcattttcgatctgggcggaggcacttttgatgtgtctatcctgactatcgatgatggcatcttcgaggtcaaagccaccgccggcgatacccacctggggggggaggatttcgataatagacttgttagtcacttcgtcgaggagtttaaacgcaagcacaagaaagatattagtcagaacaagcgtgctgtgcgcaggcttagaacagcctgtgagcgggccaaaagaacactgagtagttccactcaggccaatctggagattgatagcttgtacgaaggcattgacttctatacaagcatcactcgtgctaggttcgaagaattgtgtgctgacttgtttcgtggcacactggaacccgtggaaaaaggagcccccccggccagcccgcgttgtagtgggtgtttccgaactaccagtatggatgttatttag

SEQ ID NO: 190375 - DNA, 1926 bp, Artificial Sequence
  Description of Artificial Sequence: Synthetic coding sequence
atggccaccgccaagggcatcgccatcggcatcgacctgggcaccacttactcttgtgtgggagtgttccagcacggtaaagtggaaattattgcaaatgatcagggaaaccgcaccactcccagctatgtagccttcactgatacagagcgactgattggcgacgcagcgaagaatcaagttgccatgaacccccagaataccgtgttcgatgcaaagagactgataggaagaaaattcaatgaccccgtggtgcaggcagatatgaagctttggccattccaggtgataaatgagggaggcaaacccaaggttttggtctcctacaagggtgagaacaaagcattctaccctgaggagatcagctccatggtcctgacaaaactaaaagaaacggccgaggcatttctgggccaccccgtgacaaatgcagtcattacagtccccgcgtactttaacgatagccagagacaagccaccaaggatgcgggagtgatcgccggacttaatgtgttacgaattattaatgaaccaacagccgccgcaatcgcctatgggctggataaaggcgggcagggagagaggcacgtgctgatctttgatctcggcggggggaccttcgacgttagcatcctgactatcgacgatggcatctttgaagttaaggcaactgcaggagatactcacttgggcggcgaagattttgataatcggctggttagccactttgttgaagaatttaagaggaaacataagaaggatatttcccagaacaagagggcagttcgccggctccggacggcctgcgaacgggctaagagaaccctgtctagcagtactcaggccaatctagaaatcgactcattgtacgaaggaatcgatttctatacttctatcaccagggcccgattcgaggagctgtgtgcggatctgttccgggggaccttggagcctgtggagaaagccctgagggacgcaaaaatggataaggcaaaaatacacgatattgtgcttgtgggagggtccactcgcatcccaaaggttcaaagactgctacaggactattttaacggccgggacctcaacaagagtattaatccagacgaagccgtagcctatggcgcagcggttcaagctgccatccttatgggtgataaaagcgagaaagttcaggacctgcttctgctcgatgtagccccgctctccctgggtctcgagaccgcgggtggagtgatgacagccctcataaagaggaatagcaccatccccaccaagcagacacagatcttcacaacatattccgacaaccaacccggtgtgctgattcaagtgtacgagggggaacgcgcaatgaccaaagacaacaaccttctggggagattcgacttgactggcatcccccctgccccaagaggtgtgccacagattgaagtgacgttcgacatcgacgctaacggcatattaaatgttacggctaccgacaaaagtaccggtaaggtaaataagattacgatcacaaacgacaaaggccggctttcaaaggaggagatagagaggatggtccttgacgctgaaaagtacaaggctgaggatgaagtgcagcgtgagaaaatcgcggctaagaatgccctggagtcctatgctttcaatatgaaatcagtggtgagcgatgaaggtctaaaagggaagattagtgaatctgacaaaaataagatattggacaagtgtaacgagctcctcagctggttagaggtcaatcagctggcagagaaggatgagttcgaccacaagcggaaagagctagaacagatgtgcaatccaatcataaccaagctgtatcagggcggttgcaccgggccagcctgcggcaccggctacgtacccggacgtccagccacgggaccaaccatcgaagaggtcgactag

SEQ ID NO: 190376 - DNA, 1599 bp, Artificial Sequence
  Description of Artificial Sequence: Synthetic coding sequence
atggccaccgccaagggcatcgccatcggcatcgacctgggcaccacctatagttgcgttggcgttttccagcatggaaaggtcgaaatcatcgcgaatgaccagggtaatcgtacgacaccttcctatgtggcttttacagatacagagaggctgatcggggatgcagctaaaaaccaggtggccatgaacccgcaaaacaccgtattcgatgctaagaggctaataggacgaaagttcaatgatcctgttgtgcaggcagacatgaaactctggccatttcaggttataaatgaggggggaaagcccaaggtcctcgtttcttacaagggtgagaacaaggccttctaccccgaggagatcagtagcatggttttgactaagttgaaggagactgccgaggctttcctgggtcatcctgtcacgaatgctgttatcaccgttccagcttacttcaatgatagtcaacgacaagccaccaaggatgcgggtgtcatcgcaggtcttaacgtcctcaggattatcaacgaaccgaccgccgctgcaatcgcgtacggactagataaggggggccagggagaacgacatgtgctgatttttgatctcggcggaggtacattcgatgtgtccattctgaccattgacgatggaattttcgaagtgaaggcgactgctggggatacacatctggggggggaagacttcgacaaccggctggtaagtcatttcgtcgaagaattcaaaaggaagcataagaaggatataagccagaataagagggctgtgcgaaggctgcggactgcctgcgaaagagccaaaagaactctgtcctcatcaacacaggccaatttagaaattgattctctttacgaagggattgatttctatacgagcatcacaagggcccggttcgaggagttgtgcgctgacctcttcagagggactctggagcctgttgaaaaagccttgcgggatgctaagatggataaagcaaaaatccatgacatagtgttggtgggaggctctacgcgaatccccaaggtgcaacggctcctgcaggattactttaacggccgtgacctcaacaagagcatcaacccggacgaggccgtcgcatacggcgcggccgtgcaagcagcgatcttgatgggggataagtccgaaaaggtgcaagacctcctcctgctggacgtcgcgccactgtcactgggcttggagaccgccggtggagtcatgacagccttaatcaaacggaatagtaccatcccgacaaagcagacacagatttttacgacctattctgataaccagcccggcgttctcatacaggtatatgagggcgaacgggcaatgactaaggacaataacctgttaggccggttcgacctgacaggcatccctcccgctcccaggggcgttccccagatcgaagtgacatttgatattgatgctaacgggatcctgaacgtgaccgccatggacaaatcgaccgggaaagtaaataaaatcacaatcactaatgacaagggcaggctgtctaaggaagaaatcgagaggatggtccttgatgcagagaaatacaaggccgaggatgtgtag

SEQ ID NO: 190377 - DNA, 1599 bp, Artificial Sequence
  Description of Artificial Sequence: Synthetic coding sequence
atggccaccgccaagggcatcgccatcggcatcgacctgggcaccacgtatagctgtgtgggggtgttccagcatgggaaggttgagatcatcgctaacgaccagggcaaccgcactacaccctcgtatgttgccttcacggatacagaacggctgatcggggatgcggctaagaaccaggttgcaatgaatcctcaaaatacggtgtttgacgctaaacggctaattggaaggaagtttaatgatcccgtcgtgcaagccgatatgaaactgtggccattccaggtgattaacgaagggggcaagcctaaagtcctcgtaagttacaaaggagaaaataaagctttctatcccgaagaaatttcgtccatggtactgaccaagcttaaagaaaccgccgaggcatttcttggtcacccagttactaatgccgtaattaccgttcccgcttattttaatgactctcagaggcaggcaacaaaagacgcgggtgtgatagccgggctgaacgttctccgtataatcaacgagcccacagcggcagccattgcatacggcttggacaagggaggtcagggtgaaaggcatgtgttgatctttgatcttggaggaggtaccttcgatgtttccatattgacaatcgacgatggaattttcgaagtcaaagccacggcaggagacacgcatctgggcggcgaggacttcgataacaggcttgtaagtcacttcgtggaggaattcaaacgaaagcacaaaaaggacatttctcagaataagcgtgctgtgaggaggctccgcaccgcttgtgagagggccaaacggaccttgtcatccagtactcaggccaacctggaaatcgacagtctgtacgaggggattgatttctacaccagcattacacgggcccgcttcgaggagctgtgcgcggacttatttcgtggcacactcgaacccgtcgagaaggcactccgagatgccaaaatggacaaggccaaaattcatgacatcgttctggtcggaggctctacacggatccccaaggtgcagcggctgctgcaagattattttaatgggagggacttgaacaagtcaataaatccagatgaggcggttgcttatggcgccgccgtccaggcagccatactaatgggagacaagagcgaaaaggtgcaggatttactgcttctggatgtggcacccctgtccttggggctcgaaaccgccggtggagtcatgacagctctgataaaacgcaattctactattccaaccaagcaaacccagatttttaccacatactctgataaccagccaggagtgttaatccaggtgtatgaaggggagcgtgccatgaccaaagacaacaatttactgggtaggttcgacttgactgggatcccacctgcccctcgcggggtcccacagatcgaggttacttttgatatcgatgctaacggcattttaaatgtcaccgccacggataagtccactggaaaggtcaacaagatcacgatcactaacgacaaagggcggctcagcaaagaagagatcgaacgaatggtactggatgctgaaaaatacaaagcggaggacgtttag

SEQ ID NO: 190378 - DNA, 1926 bp, Artificial Sequence
  Description of Artificial Sequence: Synthetic coding sequence
atggccaccgccaagggcatcgccatcggcatcgacctgggcaccacctactcttgcgtgggagtgttccaacatggcaaagttgagatcattgctaatgatcagggaaatcgcactaccccaagttatgtggcttttactgacacggaaaggctgatcggcgacgcagccaagaatcaggtcgccatgaatccccagaacacggtgttcgatgccaagagactgatcgggagaaaattcaacgaccctgtagtgcaggcagatatgaagctgtggccatttcaggtcatcaatgaaggcggtaaaccaaaagttctggtcagttataaaggcgaaaataaagccttttatcctgaggagataagcagcatggtccttacaaagcttaaagagaccgcagaggcatttctgggccacccagtgactaatgctgtcatcacggtgccggcctacttcaacgacagccagaggcaagccaccaaagatgctggcgtcatcgccggcctgaacgtcctccggatcataaacgagcctactgccgccgccatcgcttatggcctggataaaggcggtcagggcgaacggcacgtcctgatttttgatctcggtggcggcacctttgacgtcagcattctaactatcgatgatggaatcttcgaggtgaaggctactgctggcgacacccacctaggtggcgaggattttgataacagactagtgagccatttcgtggaagagtttaagagaaagcacaaaaaagatatctctcaaaacaaacgagctgtccgccgactgagaaccgcgtgcgaacgggctaaacgcaccctttcttctagcacacaggccaatctggaaatagatagtctgtatgaagggatcgacttctacacttcgataacacgggcacgtttcgaagaactctgcgctgacttgttccgtggcactttggagcctgtggagaaggccttacgcgacgcgaaaatggataaagctaagattcatgatatcgtcttggtaggcggttcaacaaggattccgaaagtgcagagactgctgcaagactactttaatggtcgggacctcaacaagtcgattaaccccgacgaagccgtggcatatggagcggcggtacaagccgctattctgatgggtgacaagtcagagaaagtgcaggatcttctgttgctggacgtcgctccactatcacttggactggagaccgcaggtggtgtgatgaccgccctcataaaacgaaactctaccatccctaccaaacagactcagatttttacgacttactctgacaaccaacccggtgtgcttatccaagtatacgagggggaaagggcgatgacgaaagataacaacctgttaggcaggttcgatctaactggtattccccctgccccgcgcggtgtgcctcagatcgaagttactttcgacatcgacgccaatgggattttgaacgtgacggctatggacaagtctaccggcaaggtgaataagattacaatcaccaatgacaagggacgcctgtcaaaagaagaaatcgagagaatggtgttggacgccgagaagtataaagctgaagacgaggtccaacgtgagaagatcgctgcgaagaacgcattggaaagctacgctttcaacatgaaaagcgtagtgagcgatgaaggccttaagggcaaaattagtgagtcagacaagaacaagatcttagataaatgcaatgagctactgtcatggctggaagtaaaccagctggccgaaaaggacgaattcgaccacaaaagaaaggaattggaacaaatgtgcaaccctataatcactaagctctaccaggggggatgcaccggtcctgcgtgtgggactgggtatgtacccggccggccagccaccggcccaactatcgaggaggtggattag

SEQ ID NO: 190379 - DNA, 699 bp, Artificial Sequence
  Description of Artificial Sequence: Synthetic coding sequence
gccaagggcatcgccatcggcatcgacctgggcaccacctacagctgcgtgggggttttccagcacggaaaagtagagattatcgcaaacgaccagggcaatcgtaccacacccagttatgttgctttcacagacacggaaaggcttatcggagacgccggtgtaatcgccggactgaacgtgttacgaatcatcaatgaaccaacagcggctgcaatcgcttatggcctcgacaaaggtggtcagggcgaacggcacgtgttaatattcgacctggggggcgggacgtttgatgtgagtatcctcactatcgatgatggaatttttgaggtgaaagccacagccggagacacccacctcgggggagaagatttcgacaacagactagtttctcatttcgttgaagaatttaagaggaagcataagaaagatatttcacaaaacaagagggccgtgagacgactgagaaccgcctgcgaacgggcaaaacgtactctcagctcttccacgcaggccaatctggaaattgattcgctgtatgagggcattgatttctacacctccatcacgagggccagatttgaggaactctgtgccgacctgtttaggggaactctggagccagtggaaaagggagctccccccgcctctcctcggtgctcgggatgctttagaacgacctccatggatgtcatttag

SEQ ID NO: 190380 - DNA, 699 bp, Artificial Sequence
  Description of Artificial Sequence: Synthetic coding sequence
gccaagggcatcgccatcggcatcgacctgggcaccacctacagctgtgtgggagtcttccagcatggaaaggtggaaatcattgcaaatgaccaaggtaatagaacaacaccaagctatgttgcattcacagatacagaaaggctaatcggtgacgccggggtcattgcaggcttgaatgtcctccgcatcatcaacgagcctacagccgctgccattgcctatggcctggataaggggggtcaaggagagaggcatgtgcttatcttcgatctgggcggcggcactttcgatgtttcgatcctcactatagacgatgggatctttgaggtgaaggctaccgccggggacacacacctcggcggtgaggatttcgacaatcgacttgttagccacttcgtggaggagttcaagcgcaagcacaagaaagatatctcacaaaacaaaagagccgtgcgacgccttcggaccgcatgcgaaagagccaagagaacccttagctccagcacgcaagcaaatctggagatcgattcattgtacgagggtatagatttttatacctccattacccgcgctcggtttgaagagctttgcgctgatctctttcgcggaacactcgagcccgttgagaaaggagctccacccgctagcccaagatgctccggatgcttccggactacttcgatggatgttatctag

SEQ ID NO: 190381 - DNA, 1926 bp, Artificial Sequence
  Description of Artificial Sequence: Synthetic coding sequence
atggccaccgccaagggcatcgccatcggcatcgacctgggcaccacatacagctgtgttggcgtcttccagcatggaaaggtggagatcattgcaaatgaccagggaaacaggaccacaccttcttatgtggcatttacagataccgagagactcataggggatgcggccaagaaccaggtcgctatgaacccacagaatactgtgtttgatgcaaaaagactgataggtcgcaagtttaatgatcctgtggtgcaggctgacatgaaactgtggcccttccaagtgataaacgaaggagggaagccaaaagtgctcgtttcttacaagggcgaaaacaaagccttttatcccgaagagatctccagtatggttctgacaaaactgaaagaaactgcggaggcctttctggggcaccctgttaccaatgctgtgatcaccgtgccagcttacttcaacgattcccagagacaggcgacaaaagacgccggcgtaattgcaggactgaatgttttgcggattataaacgagcctactgcagccgccattgcctacggtctggataaagggggtcaaggagagaggcatgttttgatctttgacctaggggggggaacgttcgacgtttccattttgacgatcgacgatggtatcttcgaggtaaaagccacggccggagacacacatctcgggggagaggactttgataataggttggttagccacttcgtcgaggagttcaagagaaaacacaagaaggacatctcccagaataaacgagccgtgcgccggctgcgaacggcatgcgagcgcgctaagcgtacactgtcatcttctacacaggccaacctggagattgattccctgtatgaagggatcgatttctacacaagtatcacgcgtgccaggtttgaggagctgtgcgctgacctgtttcgtggcaccttggaacccgtggaaaaagcattgagggatgccaaaatggacaaggctaagatccacgacatcgtcctggtgggaggtagcacccgtatccctaaggtgcaacgcctactccaggactactttaatggcagagacctgaacaagtcaattaacccagatgaagctgtagcctatggggcggccgttcaggcggctatcctaatgggagacaaatcagagaaagtacaggacctgttattgttggatgtagcccccctgagtcttggactggaaaccgcgggaggggtgatgaccgctctgattaagcgcaactccaccatccccactaaacagactcagatatttaccacatatagcgacaaccagcctggagtcttgatccaggtatatgagggagagagggccatgactaaggataacaacctcctgggtcgttttgacttgaccggtatcccccccgccccaaggggcgttcctcagatcgaagtcacattcgatatagatgccaacggcatcctgaacgtgacagccatggataagagcaccggtaaagtgaataagattactattacgaacgacaagggccgcttatccaaggaagagattgaacgcatggttcttgacgccgaaaaatataaagctgaagatgaggtgcagcgtgaaaagatcgctgctaaaaacgccttagagagctatgcatttaatatgaagtcagtggtgagtgacgagggtctcaaagggaagatcagcgagagcgacaagaataaaattctggataagtgcaacgaactcctaagttggctggaggtgaaccagctagctgagaaagatgagttcgaccacaagcgcaaagaattggaacagatgtgtaatcctatcatcaccaagctgtatcagggcggttgcactggtcctgcctgcgggacgggatacgtgccagggagacctgcgaccggacctactattgaggaagtagattag

SEQ ID NO: 190382 - DNA, 1920 bp, Artificial Sequence
  Description of Artificial Sequence: Synthetic coding sequence
atgagcgcccggggccccgccatcggcatcgacctgggcaccacctatagttgtgtaggagtgtttcagcatggaaaggttgagatcatcgctaacgatcagggcaacagaaccacgccttcatatgtcgcatttacagacactgagaggctaattggggatgccgccaaaaatcaggtggcaatgaaccccaccaacacgatttttgatgccaaacggcttattggccggaaatttgaggacgcaacagtgcagagtgatatgaagcactggccattcagagtggtcagcgaaggaggaaagccgaaggttcaagtcgagtataagggagaaacgaaaaccttcttcccagaagagatttcctccatggtcctgaccaaaatgaaggagatcgcagaagcttatttaggtggcaaggtgcattccgcggtgattaccgtgccggcctattttaatgatagtcagcggcaggccactaaggacgccggcaccatcacaggcctgaacgtcctgcgaattattaatgagcccacagccgccgccattgcttacggactcgataagaaagggtgtgccggtggggagaaaaacgtcctgatcttcgacttggggggggggacatttgatgtgtctatcctgactatcgaagacggcatctttgaagttaagtccaccgccggagatactcacctcggtggggaggattttgacaaccgcatggtgagccatctggccgaagagttcaagaggaagcacaagaaggacataggccctaataagagagccgtaagacgccttcgtactgcctgcgaaagagctaaacgcactctaagcagtagcactcaagcaagtattgagatcgactcactgtatgagggagtagacttctacacttctatcactagggcaaggttcgaagaactgaacgccgatctttttcgcggcacgctggaaccggttgagaaggctctgcgggatgccaagttggacaagggacagattcaggaaattgtgctcgttggcggctccacacgcattcctaagattcagaaactgttgcaggacttcttcaatggcaaggagcttaacaaaagtattaaccccgacgaagctgtagcctacggagctgccgtccaggccgccattttgatcggcgacaagtctgagaatgttcaagaccttctcttattggatgtgacacccctgagtctcggcatcgaaactgccggtggggtcatgacccctctgattaagagaaacaccaccatcccaaccaaacaaactcagacttttaccacatatagcgacaaccagagctctgtgctagttcaggtatatgagggcgagcgggctatgacaaaagacaataacttactcggaaagtttgacctcacgggcataccaccagctcccagaggtgtgccccagatcgaagtaaccttcgacattgatgccaacggcatactgaacgtcaccgccgccgacaagtccaccggcaaggagaacaaaatcacgataacaaacgacaaagggagattgtccaaggatgatatcgatcggatggtgcaagaggctgagcggtacaagtcggaggatgaggcaaacagggatcgggtggccgctaagaacgctctggaatcatatacctacaatatcaagcagacagtggaagacgagaaactgcggggtaagatctcagagcaggacaagaacaagattctggacaagtgtcaggaggttatcaactggctggatcgcaatcagatggcagagaaggacgaatatgagcacaaacagaaagagctcgagcgagtgtgcaaccccattatcagcaaattatatcagggtgggcctggcgggggaagcggggggggaggttctggtgcgtctggggggcccaccatcgaagaggtggattag

SEQ ID NO: 190383 - DNA, 1920 bp, Artificial Sequence
  Description of Artificial Sequence: Synthetic coding sequence
atgagcgcccggggccccgccatcggcatcgacctgggcaccacctattcctgcgttggagtgttccaacacggcaaggtagaaatcatcgcaaatgatcagggaaacaggaccacccccagctatgtggcattcacggatactgaacggttgattggtgacgcagccaagaaccaagtggccatgaacccaacaaatacaattttcgacgctaaaagattgatcgggaggaagttcgaagatgccaccgtgcaatcagatatgaagcattggccttttagggtcgtgtcagagggtggcaaaccaaaggtgcaagtagagtataagggggaaacaaagactttctttccggaggaaatctctagcatggtcctaacaaaaatgaaagaaatcgccgaggcctatctgggagggaaagtgcactccgccgtgatcactgtgcctgcttacttcaatgatagccaaagacaggctacgaaggacgccggaacgatcacaggcttgaatgtgttgcggattataaatgagccgacagctgcagccatcgcgtatgggttagacaaaaaaggttgtgcaggcggcgaaaagaatgtgctcattttcgacctggggggaggcacgttcgacgtgagcattcttaccattgaggatggcatctttgaggtcaagtctacagcaggggatacacacttgggtggagaggactttgataaccggatggtctcccacttggccgaggagtttaagcggaaacacaaaaaagatatcgggccgaacaagcgcgcagtccggaggctgcggacagcatgtgaacgggccaaaaggacattatctagtagtacgcaggccagcatcgagattgatagcctctacgaaggagtggatttctatacatctatcacaagggcaaggtttgaggaactcaatgcggatttgtttcgcgggaccctggaacccgtagagaaagccctcagggacgccaagctggacaagggccagattcaagagatcgtgttggtgggcggaagtacccgaatcccaaagattcagaagcttctgcaagactttttcaatggtaaagaactcaacaaatccatcaaccctgatgaggcagtggcctacggagctgccgtccaagccgccattctgattggtgacaaaagtgagaacgtgcaggacttactcttgctggacgtcaccccgttgagccttgggatcgaaaccgctgggggtgtcatgactcctcttataaagaggaacaccaccatcccaacaaaacagactcagacattcactacctattcagataaccagagctccgtgttagttcaggtctatgagggcgagcgcgctatgactaaagataacaacttgctgggaaagttcgatttgacgggcattccgcccgctccacgaggagtgccccagatcgaagtgacgtttgacatagatgcgaacgggattttgaacgtgaccgctgcagataaatctacggggaaggaaaataaaataaccattacaaacgataaaggaaggctgtccaaggatgacatcgaccgcatggtgcaggaagcagaacgatacaaatctgaagatgaagcaaatcgcgatcgggtggcagccaagaacgccctggagtcctatacgtacaacataaagcagacagtggaagatgagaaactgagaggcaagatctcagaacaggacaagaataaaattctcgataaatgccaggaggtaatcaattggctcgatcgcaaccagatggcggagaaggacgagtatgaacataaacagaaagagctggagagagtatgcaatcctatcatctcaaagctttaccagggggggccaggcggcgggagcggaggtggagggagcggggcctcaggagggccaacgatcgaagaagtggattag

SEQ ID NO: 190384 - DNA, 1242 bp, Artificial Sequence
  Description of Artificial Sequence: Synthetic coding sequence
atgagcgcccggggccccgccatcggcatcgacctgggcaccacctacagttgcgttggtgtatttcagcacggcaaagtagaaatcattgcaaatgaccaggggaatcggactacaccctcatacgtggctttcactgataccgaaagactcatcggtgacgctgccaaaaaccaggttgctatgaacccaaccaacacaatattcgacgctaaacggctcattgggagaaaatttgaggagctgaatgcggacctgttcaggggcactctggaaccagttgagaaggccctcagggatgcaaaactggataaggggcagatccaggagatagtactggtgggcggctctaccagaattccaaagatccaaaaactactccaggacttctttaatggcaaggagctcaacaaatctatcaacccagatgaggccgtggcctatggcgctgctgtacaggctgccattctgattggggataaatccgaaaacgtacaagaccttctactgctggacgtcactcctctctcacttgggatagagactgccggtggagtaatgactcccctcatcaagagaaacacaacgattccaactaagcaaacccagaccttcaccacttattccgacaaccagtcatccgtcttggttcaggtgtacgaaggcgagagggcgatgactaaggacaacaacctgctcgggaagttcgatctgaccgggattccgcctgccccacggggcgtaccgcaaattgaagtcacctttgacatcgatgcaaacggaattctcaacgtcacagcagccgataaaagtactgggaaagagaataaaatcactatcacgaacgacaaaggcaggctcagcaaggatgacatagatagaatggtgcaggaagccgaacggtataagtccgaggatgaggccaatcgggacagagttgcagctaaaaatgccttggaaagttacacatacaacatcaaacagactgttgaggatgaaaaactgaggggcaaaatctctgagcaagacaagaataagatactcgacaagtgccaggaggtgattaactggctcgatagaaaccagatggccgaaaaggacgaatacgaacataagcagaaagaacttgagcgggtgtgcaatcccataatcagcaaactttaccagggagggccgggtggtgggagcgggggtggcggcagtggcgcttccggaggtccaactatagaagaggtggactag

SEQ ID NO: 190385 - DNA, 2523 bp, Artificial Sequence
  Description of Artificial Sequence: Synthetic coding sequence
atgagcgtggtgggcatcgacctgggcttccagagctgctacgtggccgtggcacgcgcggggggcatcgaaacaatcgccaatgagtacagtgaccgctgtaccccggcctgcatctcattcggccccaagaacagatctatcggtgccgccgccaaaagtcaggtgatcagcaacgctaagaatacagtgcaaggattcaagcggttccacggaagggcttttagcgacccgtttgttgaggcagaaaagtccaacttggcctatgacattgtgcagctgccaactggcctgaccgggatcaaagtgacgtacatggaggaagaaagaaattttaccaccgaacaggtcacagctatgctgctcagcaagctcaaagagaccgcggagagtgtgcttaaaaaaccggtggtcgattgcgttgtgagcgttccatgcttttacaccgacgctgaaaggcggtccgtaatggacgctacacagattgcaggattaaattgcctgcggctgatgaacgaaaccaccgccgtggccctggcctacggaatatacaagcaggacttacctgctctagaagaaaagcctcgaaatgtcgtgtttgttgacatgggccatagtgcttaccaggtgagcgtgtgtgccttcaatcgaggtaaattaaaggtgctggccaccgctttcgataccacactgggggggagaaagtttgacgaggtgttggtgaaccatttttgtgaagagttcggcaagaaatacaaacttgatattaagtcaaagatcagagccctgttgaggctatcacaggagtgtgagaagctgaaaaagctgatgtcggctaatgcctccgacttaccattgtccattgaatgtttcatgaacgatgtcgacgtgtcggggacaatgaatcgtggaaaattcctggaaatgtgcaacgacttgcttgctcgcgtggagcccccactgcgtagcgtgctagagcagaccaaactgaaaaaagaagacatttacgccgtggaaatcgtggggggagccaccagaatcccagccgtcaaagagaagatttccaagttttttggaaaagaacttagtacaacactcaacgccgacgaagcagtgacccggggctgtgctttgcagtgcgcgatcctctcccctgcatttaaggttagggaattctccatcaccgatgtggtaccttacccgatttctctaaggtggaactcccctgccgaagagggaagctctgattgtgaggtttttagcaagaaccatgccgcccctttcagtaaggttctcacattttatcgcaaggagccttttacgctggaggcctattattcctcccctcaggacttaccataccctgatccagcaatcgcgcagtttagtgttcagaaggtaacaccccagagtgacggaagttccagcaaggtgaaggtgaaagtacgagtgaacgtacatgggatattctccgtttcctctgcctctctcgtcgaagtgcacaaatccgaggaaaacgaagagcccatggaaaccgatcagaatgctaaggaggaggagaagatgcaagtcgatcaggaagaacctcatgtggaagaacagcagcaacagaccccagccgagaacaaagctgaatccgaggagatggaaacgagtcaagctggtagtaaagacaaaaagatggatcagccaccccaagctaagaaagcaaaagtgaaaacgtcaaccgttgatctccccattgagaaccagctcctttggcagattgacagggagatgctgaatttgtatattgagaatgagggtaagatgatcatgcaggataagctggagaaagaacgaaatgatgctaagaatgccgtcgaagagtatgtgtacgagatgagggataaactgagcggagaatatgaaaaattcgttagtgaggacgaccgcaattcctttaccctgaaactcgaggacacagaaaactggctatacgaggatggagaggatcagcccaaacaggtgtacgttgacaaattagccgaactcaagaacctcggccaaccaatcaaaattcgcttccaggaatcagaggagcgtccaaaattgttcgaggaacttggcaagcagatccagcagtacatgaagattatctcctctttcaaaaacaaggaagatcagtatgatcatctggatgctgccgatatgacgaaagttgaaaagtctaccaatgaggctatggaatggatgaataacaaactgaatctgcagaacaagcagtccctaactatggacccagtggtcaagtcaaaggagattgaagctaagataaaagagctgactagcacctgctctccgatcattagtaagccaaaacctaaggtggagccacccaaagaggaacaaaaaaatgcggaacagaacgggccggtggatgggcagggagacaatcctggcccacaggccgccgagcaaggtactgacacggccgtcccttcagacagtgacaagaaactgcccgagatggacatcgactag

SEQ ID NO: 190386 - DNA, 447 bp, Artificial Sequence
  Description of Artificial Sequence: Synthetic coding sequence
atgagcgtggtgggcatcgacctgggcttccagagctgctacgtggccgtcgctcgggctggagggatcgaaactatcgcaaacgaatactctgaccggtgcaccccagcctgcatttctttcggcccaaagaataggagcattggcgcagccgccaagtctcaggtgatcagtaatgccaaaaataccgtacagggtttcaagagattccatggacgagccttttcagaccctttcgtggaagcggaaaagtcaaatcttgcatacgatattgtacagctgcccaccggcctgaccggaattaaagtgacctacatggaggaagaacaaaacggacctgtggacgggcagggcgacaacccgggtccccaggctgctgagcaaggcactgatactgcagttccatctgactcggacaagaagctgcccgaaatggacatagactag

SEQ ID NO: 190387 - DNA, 1422 bp, Artificial Sequence
  Description of Artificial Sequence: Synthetic coding sequence
atgagcgtggtgggcatcgacctgggcttccagagctgctacgtggcagtagccagggcaggcgggatcgagaccattgccaatgagtactctgaccggtgcacgccagcctgtatcagttttggcccaaaaaacagaagtatcggtgcagctgccaagtcccaagtgatttctaacgcaaaaaacactgtgcagggcttcaagaggtttcatggacgggccttctcagatccttttgtggaggcggagaagtctaatcttgcatatgacattgtgcagttaccgacaggcttgacaggaattaaagtgacctatatggaagaggaaagaaatttcacaacagagcaggtgacagccatgctactgagtaaactcaaggagacggcagagagcgtgttgaagaagcccgttgttgactgcgtggtgtccgtcccctgcttctacaccgatgcggaaaggaggtctgtaatggacgcaactcagatagccggacttaattgtctgcgcttaatgaatgaaacaactgccgtggccctggcatacgggatctataagcaggacctgcccgccctggaggagaaaccacggaacgtcgtgttcgttgacatgggacacagcgcataccaggtttcagtgtgcgcatttaaccgcggcaaactgaaagttcttgccacagcctttgatactaccttgggggggcgcaagtttgatgaagtgttggtgaaccacttctgcgaagagtttggaaagaagtataaactcgatattaagtcgaagatccgggccctactccgcctcagtcaggagtgtgagaaacttaagaaattgatgtcagccaacgcctcagatttgccactttccattgagtgtttcatgaatgacgtcgacgtctcaggaaccatgaatagaggcaaattcttagagatgtgtaacgatcttctcgctagagtggaaccaccactgcgttctgtgctagagcagaccaagttaaaaaaggaggatatttatgccgtcgaaattgtgggtggtgccacacgcatacccgcagttaaggagaagatctctaaattctttggcaaagagttatcaaccaccctaaatgccgatgaggcagttactcgcggatgtgcactccaatgcgccatcctgtcgcctgctttcaaagtgcgtgaattcagtatcacagacgtggtcccttaccccatctcactgaggtggaattcaccagccgaggagggtagttcagattgcgaggtgttttcaaagaaccacgcggctcccttcagcaaagtccttaccttctatcggaaggagccgtttactttggaggcttattactcatcgcctggctttgctttgagccgatcctgctactccatcatcaaatcgctgctctcactcatggctcctgtccagaagtag

SEQ ID NO: 190388 - DNA, 1965 bp, Artificial Sequence
  Description of Artificial Sequence: Synthetic coding sequence
atgaagctgagcctggtggccgccatgctgctgctgctgagcgccgccagagccgaagaagaggacaaaaaggaagatgtcggtacagttgttggcattgacctcgggactacatattcgtgtgtgggcgtgttcaaaaacggacgcgtggagattatcgccaatgatcagggaaatcggattaccccctcctacgtagcctttacccctgaaggtgagcggctgatcggagacgcagccaaaaaccagctgacatccaaccccgagaacacggtttttgacgccaagcgtcttattggccgaacatggaatgacccttctgtccagcaggatatcaaattcttgccttttaaggtagtagaaaagaagaccaaaccttatatacaggtggatatagggggaggccagacgaagaccttcgctcccgaggaaatcagcgcgatggttttgacgaagatgaaggaaacggcggaggcttatttgggaaagaaggtcacccatgccgtggtcactgtaccagcttactttaatgacgcgcagcggcaggctactaaagacgcaggaacaatcgctggtctaaatgtaatgcgcatcataaacgaaccgaccgccgccgccatcgcttatggactggataaacgtgaaggcgagaagaacattctcgtttttgatctcggcggtggaacattcgatgtgagtctgttgacaattgacaatggagtatttgaggttgttgccaccaacggggatacccatctagggggcgaggattttgaccagcgggtgatggagcactttataaagttgtataagaagaaaactggcaaggatgttcgtaaagacaatcgtgctgtgcagaaactgcgacgcgaagtcgaaaaagccaaacgggctctgagctctcagcatcaggctcgaatcgagatagaaagcttttacgaaggcgaagacttctctgaaactctgacgcgagcaaaatttgaagagcttaatatggacctgtttcggagtacaatgaaacctgtgcagaaggtcctggaggactccgacctgaaaaaaagtgacatcgacgagatagttctggtgggcggttctacccgcatccctaaaattcagcaactcgtcaaggaatttttcaacggaaaggagccgtctcgtggcatcaaccccgatgaagctgtcgcttatggggcagctgttcaagccggggtcctttcgggtgaccaggacaccggcgatttggtgctcctggacgtgtgcccactcaccttaggcatcgagactgttggaggggtgatgaccaagctgatcccccggaacactgttgtgccaactaagaagtcccagatcttttcgactgcatctgataaccagcctaccgttacaatcaaagtttatgagggggagaggccactgactaaagataatcacctactgggcacattcgatctcactggaatcccccccgccccccgtggagtcccccagatagaggtgaccttcgaaattgatgtaaacggcatcctccgggttacagctgaggataagggaactggtaataagaacaaaatcactattacaaacgatcagaaccgattaacgcctgaggagattgagagaatggtgaacgacgctgagaaatttgctgaagaagacaaaaagctcaaggagcgcatcgatacccgaaatgaacttgagtcatacgcctacagtctgaagaatcagatcggcgacaaggaaaaactcggaggaaagctgagttctgaggacaaggaaacgatggaaaaagccgtggaagagaaaatcgagtggttggagagtcatcaggacgcagatatcgaggattttaaggcgaagaagaaagagctcgaggagattgttcagcccatcataagtaaattgtatggtagtgccggtcccccccccacgggcgaggaagacacagcggagaaagacgaactgtag

SEQ ID NO: 190389 - DNA, 837 bp, Artificial Sequence
  Description of Artificial Sequence: Synthetic coding sequence
atgaagctgagcctggtggccgccatgctgctgctgctgagcgccgctagagccgaagaggaagacaaaaaggaggacgtaggcacggtggtgggaatagatctcggcacaacatattcttgcgttggcgtttttaaaaatggccgggtcgaaattatcgccaatgaccagggcaaccgcattactccgtcgtacgtggcttttactcccgagggcgagcgtttaatcggagacgcggctaagaatcagttgacttcaaatccagagaatactgttttcgacgcgaagagactgattggacggacctggaatgacccaagcgtccagcaagatattaagtttctgccttttaaggttgtagaaaagaaaactaaaccgtatatacaagtcgatattggcggggggcagacaaaaacgtttgctcctgaagaaatctctgccatggtgctgacgaaaatgaaggagactgctgaagcctatctgggcaagaaagttactcatgcagttgttacggtgccggcttatttcaatgatgctcagagacaggcgacaaaggatgccggcactatcgccggcttgaacgtgatgcgtattattaatgagccaactgcagcagcaatagcttatggacttgataaaagagaaggtgaaaaaaacattttggtctttgatttgggaggtggaacctttgatgtgtctcttctgactattgataatggcgttttcgaggtggtcgccacaaatggcgacactcaccttggcggcgaagactttgaccagagagtgatggaacatttcattaagctgtataagaagaagaccttcctccgtccatag

SEQ ID NO: 190390 - DNA, 1932 bp, Artificial Sequence
  Description of Artificial Sequence: Synthetic coding sequence
atgcaggccccccgggagctggccgtgggcatcgacctgggcaccacctattcttgtgtgggagtgttccagcagggccgcgttgagatactggctaacgaccaggggaatcggactacaccctcgtatgtggctttcactgataccgagagacttgtaggggatgccgccaagagccaggcagccttgaatccccacaacacagtctttgacgcaaaacggcttatcgggagaaagttcgccgatacgacggtgcagagtgacatgaagcactggccttttagggttgtaagtgagggaggtaagcccaaggtcagggtatgctatcgtggggaagataagacattctatccagaagaaatatcttctatggtcctatcaaaaatgaaggaaacagccgaagcttatctggggcaacccgtgaaacacgcagtaatcaccgtgccagcctactttaacgactcacagagacaggctacaaaggacgccggtgcaatcgcaggccttaatgtgctgcggatcattaatgagcctacggccgcggcaatcgcatatggtttagacagacgcggcgcaggagaaaggaacgtgttgatcttcgaccttggcggcgggacatttgatgtctctgtgctcagtattgacgccggcgtgttcgaggtgaaggccaccgccggggatacgcatttagggggcgaagattttgataacaggctggtcaatcactttatggaggagtttagaagaaagcatgggaaggacctgagcggcaataagcgggcgttgcggcgcctcagaactgcttgcgagcgcgctaagaggaccctgtcctcttctacccaggcgacgcttgagatcgattcgttatttgagggagttgatttctacacgagtattacccgtgcacgtttcgaggaactgtgttccgatctgtttagatctactcttgaacccgtggagaaggctttgagggatgccaagctcgataaggcgcagatccacgacgtggtgctagtaggcggctctacacggattcccaaggtccagaaacttctccaggacttcttcaacgggaaggaactgaacaaaagtattaaccctgatgaagcagtggcctacggagcagctgtgcaggcggccgtcctcatgggagataagtgtgagaaggtgcaggatctgctgctgctggacgttgcgcccttaagcttaggtctggagacagccggtggggtgatgacaacattgatccagcggaacgccaccatcccaactaagcagactcagacatttactacctattctgataatcagcccggtgtgtttatccaggtgtatgaaggggagcgcgccatgacaaaagataacaacctgctcggacgttttgagctttccgggattccacctgcacctaggggtgtacctcagatagaggttacgtttgacattgatgctaatggcattctgtcggtcacggcgacggaccgctcaactgggaaggcaaataagatcactatcactaacgacaagggtagactgtccaaagaggaagtggagcgaatggttcatgaggccgaacaatataaggcagaggacgaagcacaaagagatcgcgtggctgccaagaactctcttgaggcacatgtctttcatgtcaagggtagcctgcaggaagaatccctgagggacaaaattccggaagaggaccggcgcaaaatgcaagataaatgccgcgaggtattagcatggctggaacacaaccagttggccgaaaaggaagagtatgaacatcaaaaaagggagctggaacagatctgtaggcctatcttctcgagactgtatggcggtcccggcgtgccaggcggctcttcgtgcgggacgcaagcacggcagggggatcccagcacaggaccaattatcgaggaggtagactag

SEQ ID NO: 190391 - DNA, 1860 bp, Artificial Sequence
  Description of Artificial Sequence: Synthetic coding sequence
atgcaggccccccgggagctggccgtgggcatcgacctgggcaccacatattcttgtgtggcatttaccgataccgagaggctggtgggggatgctgctaagtctcaggccgctctaaaccctcacaacaccgtttttgacgccaaaagactgattggcagaaagtttgctgacacaaccgttcaaagtgatatgaagcattggccttttcgggtggtcagtgaagggggcaaacctaaggtcagagtttgctatcggggggaggacaaaaccttttaccccgaggagatttcaagtatggttttatctaagatgaaagagacagccgaggcctaccttgggcagccagtaaagcacgccgtaatcacagtccccgcttactttaacgacagccaaaggcaggccactaaagacgccggcgctattgcgggattgaatgtcttaagaattatcaatgaaccgacagctgcagccatcgcctacggcttggatcgtagaggcgcaggcgaacgcaacgtattaattttcgacctggggggaggaacattcgacgtctccgttttatctatcgacgctggagtttttgaagtgaaggcaaccgccggcgacactcacctcgggggcgaggacttcgataacagactcgtcaatcattttatggaagagtttagacgtaagcatggaaaggacctcagcgggaacaagcgcgccctcagacgtctgcgcacagcctgtgaaagagcaaagcggactctgagttctagcacccaggctacactagaaattgactctcttttcgagggggttgatttctatacaagcatcaccagggcaaggttcgaggagctttgctctgacttgtttcgctctacactcgaaccagtggaaaaggcactccgtgatgctaaacttgacaaggctcaaatacacgacgtggtgctggtcggaggatccacaagaataccgaaagtgcaaaagcttctccaggatttcttcaatggcaaggagcttaacaaatctatcaaccccgatgaagccgtggcatacggcgccgccgtacaagccgccgtgctcatgggtgataaatgcgaaaaggtacaggatcttctgctgttggatgtggctcccctgagtctgggccttgaaacagccgggggtgtgatgacaactctcatccagcgcaacgctaccatcccgacgaagcagactcaaacattcactacctatagcgataaccagcccggcgttttcattcaagtctatgagggtgagcgtgccatgacaaaggacaacaatctgctgggcagattcgaactgtcggggattccgcccgcccctcgcggcgtcccgcagatagaggtcaccttcgatatagacgccaacggtattctgagcgtcactgccaccgaccgatctactggcaaggccaataagataaccattacaaacgataagggcaggctgtccaaggaggaggtggaaaggatggttcatgaagcagaacagtacaaagcagaggacgaagcccagagggaccgagtggccgcgaagaattctttggaggcccatgtgttccatgtaaagggtagtctccaggaggaatcactgagggataagatacctgaggaggaccggagaaagatgcaggataagtgccgagaagtcctggcctggctagagcataatcaactcgccgagaaagaggagtatgaacaccagaaaagagaattagagcagatctgtcgtccgattttcagtcggctctacggggggccaggagttccaggtgggagttcctgcggtacacaagcccggcagggagatcctagtaccgggccaataattgaggaggtggactag

SEQ ID NO: 190392 - DNA, 2337 bp, Artificial Sequence
  Description of Artificial Sequence: Synthetic coding sequence
atgagcaagcggaagctgatccccaagctgagcatccagagccccgtactgcacacaaatctgaatgtgcagtccacccacccccctctgaaaaaagaggatctccatcgcattagtaaagacagtttggagagcgattctgagagcctcacccaagagattatgtgccattccgagtttgatgaccgcatcaggggcaacgggatggagccagactcattggacgaagaggagtcccctcgctggggctcactccatgaaatggaggaagaggcttccggaaaggcagcgcagatggcgagagaacagaatcaccacacatgggaccagggggcaaacaacagacaacaaccaattgaagataaatactcggacctgcgatacgatccaaactggaagtctaaaaaggaggaaggacagctactgtccgttgaggccttgcctgagagtactgattcatccttggagaaccttccgctggctccactctacccttcacaggaaacaagcatggaactgtccggtggaaagggtgagcagaaggaatccccccaatcagccgcctccctcctggggtccgagttcctcagccctaactacgagcatggcgcccggaggtccaagccatttagtgagttgtctgactccgacctcgaggagaaatctagcagcctgtcgccctatgtgaaatcttcgtcatcccataacgaggttttcctaccgggctctaggggcccccgaagaaggaaatctaagcaacatttcgtcgaaaagaataaactgacactgggcctccccactccaaaaacggactcgtatctgcaactacacaacaaaaagcgaggcgaatcccacccggagcagataagctaccctgtgagagtgacagacaagacatcgattcagaacgctaaagagatggaaaacgctgccatcgatccggaagataaatggcaccagagagcccaacagctgaaaaattatcaggagcactggtcgcagtacgaatcgaccaagagttctaacgtcccaaggggccagccttccgacatggtgaacgaccaccagccttcccgaaggcctgccaaactcaagatcaggaagcagtgtaaacatcaaaatgggcttaagtcctccaccactgaggaggttaccgcctcccagggaaatcaaaacaaccccccgagacagcagcagaatcagaataaacccctcgatacaagcacgaaacctgagtccattgttatcatgcacgcaagcaataacgacgtgcaggcttctcgcgcactgcgcagtcataacctgaaagaaactagtaacaccttcgcaccaccaaagcaggccttcgacaaggtgctcagtaaaaacagcaccgggtgcgacagtggactcaatgtgaacaaagaacgaggacacaaggatcaggaggagaaaaggttctcttatcagcagctccacactctatcagatatggacctcaacaacctgaatgaactgtcgaagaggcacgtgctcctgtcgcagaaaggaagtcaattcgtgtaccacataaacacccatgggtccacgaagaacaagaaacagctgaaacagccttacaccgagacaaaatacaggaacctcgagatgctttggaagtttcactcctcatcagactctcagacagtacgcgctagtcccgactcctggctgacgcagattatggagcagcaccagcaggccttagtccaactgactgatgtccaaccaagcgagggtgctctgtcatccgttaccctaccccccatcttatctagggtggaatctgaaagtcaactctctagtgaaaggtcccagcgcaatcaggtgaaaatctccagaagtaatagcgagggctacttgtttcagctggagaaaggaaaaaagcataaaaaacgtagtagcagcaaaaataccaaactgaagggctatcaaaagagagacgtgaagctggggggactcggtcctgacttcgagtccattagagataaaactcagaaactgatccagcaaaaagagtacgctaaacaggtgaaggagtataacatgaagactctgtctatcctgagtaagccccagactgaaaagacacagaagaagagtgccattccaagacagaaagctcttgagtacgccaaaactattcccaaaccaaaaccttcaaatctcacacaccaggcctctaaggaacagaaaaatcccacttacgcaggtaaagaagagagtctccccgaaatcagccttttggagatattacagaatcggcacgaaagggagaagcaggctgtcgccgcgttcaaggtgcttcatatagtgtag

SEQ ID NO: 190393 - DNA, 1482 bp, Artificial Sequence
  Description of Artificial Sequence: Synthetic coding sequence
atgagcaagggccccgccgtgggcatcgacctgggcaccacctactcctgcgttggcgtttttcaacacggtaaggtggagatcatcgccaatgatcagggtaaccggactactcctagttatgtcgcttttaccgacacagagcgcctgataggagacgcagccaagaaccaggttgccatgaatcccaccaatacagtcttcgacgccaagaggctaataggccggagatttgacgatgcagtggtgcagagtgacatgaagcactggccctttatggtggtaaacgacgccgggcggccaaaagtccaggttgagtataaaggggaaacgaaaagtttctacccagaagaggtctcaagcatggtcttaaccaagatgaaagagatagcagaagcttatcttgggaaaactgtgacaaatgctgtagtgaccgttcccgcatactttaatgattctcagcgtcaggccactaaagacgcaggcaccatcgcaggactgaacgtgctgcgaatcattaacgagccaacagccgccgccatcgcatacggcttggacaagaaagtaggcgcagagcgaaacgtgctcattttcgacctgggcggaggcacatttgacgtatccatcctgaccattgaagacggaatcttcgaggttaaaagcacggcaggagatactcatcttggaggtgaggactttgacaatagaatggttaaccactttattgcagaattcaagcggaaacataagaaggacatttctgaaaataaaagggccgtgcgtcggctgcgcactgcttgcgagcgagctaagcggacactgtcctcatctacccaggcctctatcgagatagacagcctctacgaggggatcgacttctacacatcaatcactcgggccaggttcgaagagttgaacgcagatctttttaggggcactttggatccggtcgagaaggctctgcgcgatgccaaattagacaaatcccagattcacgacattgtactggtgggcggcagcacccgcattccaaaaatccagaagttgctgcaggacttctttaacgggaaagagttgaataagtccataaatcccgacgaggcagtggcttacggagctgctgttcaagctgcaatcctgtcgggcgataaaagtgaaaacgtgcaagatctgctgctactagacgtaactccactgtctttgggcattgagaccgccgggggagtcatgactgtgttgataaagagaaataccacaatcccgacaaaacaaactcaaacgtttaccacatactcggataaccagcccggcgtgctgattcaggtatatgagggagagagagctatgaccaaagacaacaacctactgggcaaatttgaactgaccggtatgccgggaggcatgcccggcggattcccagggggcggggctccccccagcgggggagcatctagcggacctactatcgaggaggtagactag

SEQ ID NO: 190394 - DNA, 1884 bp, Artificial Sequence
  Description of Artificial Sequence: Synthetic coding sequence
atgagcaagggccccgccgtgggcatcgacctgggcaccacctactcctgtgtcggagtcttccagcacggcaaggtggagattatagctaacgaccagggcaatcgcactacgccaagctatgttgcgttcacagacaccgaacgtctgatcggagatgccgctaagaaccaggtagccatgaacccaacaaacacagtgttcgatgccaagaggcttattggccgcaggttcgatgatgcggtggtgcagtccgatatgaagcactggccttttatggtcgtgaacgatgctggacgccccaaggtgcaggtggagtacaaaggcgagactaaatctttttacccggaggaggtctcatcgatggtgctcacaaaaatgaaggaaatcgccgaagcatacttggggaaagccacgaaggatgcaggcactatcgccggactgaatgtcctccggatcattaacgaaccaactgcggctgccatcgcatatggcttggacaagaaggtaggggctgaaaggaacgttttgatttttgatttaggcggggggacctttgatgttagcattttaaccatcgaagatgggatctttgaagttaaatctacggcgggcgacacgcacctgggcggagaggatttcgataacagaatggtgaatcactttatcgccgagtttaaacggaaacacaagaaagacattagtgagaataaacgggctgtccgcaggcttcgcacagcttgtgagcgagcaaagcgcacattaagtagtagcacacaggcatcaattgagatcgactcgttgtatgaaggcatcgatttctacactagcattacacgggcccgattcgaagagcttaacgcagatttgttccgaggcactctggaccccgttgaaaaagctctgagagacgccaagctggacaagtcacagatccacgatatcgtgttagtgggaggttccacccgtatccccaaaattcagaagctcttgcaagacttttttaacgggaaagaactcaataaaagcatcaacccagacgaagctgtagcgtacggggccgcagtccaagccgctattctgagtggcgacaagtctgagaatgttcaggatctactgctgttagacgtgacacccctgtctcttggtattgaaaccgctggcggcgtgatgaccgtcctgatcaagaggaatactactatcccgactaagcaaacccagactttcacgacatattcagacaaccagcctggtgttctgattcaggtgtatgaaggagaacgggccatgacaaaggacaataatttactgggaaagtttgaactgaccgggattcccccagctccccgcggggtgccacagatagaagtgacctttgatattgatgccaacggaatccttaacgtgagcgccgtggacaagtccactgggaaagaaaataagattacaatcactaatgataagggcagactcagtaaagaagacattgagcggatggtgcaggaggcggaaaaatataaggctgaggacgagaagcagagagacaaggtgtcaagcaagaacagcttggagtcgtacgcctttaatatgaaggctaccgtcgaggacgaaaagttgcagggaaaaattaatgacgaagacaagcagaagattctggacaagtgcaatgaaatcataaactggctggacaagaaccagaccgctgagaaggaggagtttgaacatcagcagaaagagctcgagaaggtatgcaaccccataattaccaagctctatcagtccgctggaggaatgcccggaggtatgccaggggggtttccgggaggtggcgcccccccttctgggggcgccagctccggaccaaccatcgaagaagtggattag

SEQ ID NO: 190395 - DNA, 1941 bp, Artificial Sequence
  Description of Artificial Sequence: Synthetic coding sequence
atgagcaagggccccgccgtgggcatcgacctgggcaccacctactcctgtgtgggagtgttccagcatggtaaggtcgagattatcgcaaacgatcagggaaacagaactaccccatcctacgtcgcctttacagacactgagcgactgatcggcgacgctgctaagaatcaagttgccatgaatccaacaaacaccgtgtttgatgctaaaagactaatcggcaggcgcttcgatgatgcggtggtgcaaagtgacatgaagcattggcctttcatggttgtgaatgatgccggaaggcccaaagtgcaggtggagtataaaggcgagaccaaatctttttatcccgaagaggtgtccagcatggtgctgactaagatgaaagagattgcagaggcttacctgggaaagacagtgaccaacgctgtcgtgacagtgccagcatacttcaatgactctcagcgccaggcaaccaaggacgcgggcacaattgctggtcttaacgtgctgagaatcatcaatgaacctaccgcagcggcaatcgcttacggtctggataagaaggtgggtgcagagagaaacgtactaatcttcgatttaggtgggggaacatttgatgtgtccatcctgaccatcgaggatgggatattcgaggtcaagagcacagctggtgacacccatctgggcggagaagactttgacaatcgcatggtaaatcacttcattgctgagtttaagagaaagcataagaaggacatctccgagaacaaaagggctgtcaggcgactgagaacggcatgcgagcgagcgaagaggaccctttcatcatctacccaggcaagcattgagattgattccctgtacgaaggtattgacttctatacttccatcactcgggcccgcttcgaagagcttaacgctgatctctttcgcggaacattggatcccgttgaaaaagcgctgcgcgacgcgaagctggacaagagccagattcacgacattgtccttgtgggcggcagtactcgaatacccaagatccagaagctgctccaggacttcttcaatgggaaggagctcaacaaatccatcaatcccgacgaggccgtcgcttatggcgccgcagtccaggccgccatattaagcggcgataagagcgaaaatgtccaagacctgctgctcttggacgttacacccctctcactaggaatcgagacagctgggggcgtcatgaccgtgcttattaagcgcaatacaaccatccccacaaaacagactcagactttcactacatatagcgacaaccagcctggcgtgctgatccaggtgtatgagggtgagagggcaatgacaaaggacaataatctcctgggaaaatttgaattgactggaattccccccgcacctcgtggggtgccgcagatcgaagtcacctttgacatcgacgccaacggtatcttgaacgtctctgctgttgataaatcaacaggcaaggaaaacaagatcactatcactaatgacaagggtcgattgagcaaagaggacatcgagcgcatggtacaagaggctgagaaatataaagcagaggacgagaaacagcgggataaggtaagtagcaaaaactcacttgagtcttatgccttcaatatgaaggctacagtggaagatgaaaagttacaggggaagataaacgacgaggataagcagaagatccttgataaatgcaacgaaatcataaactggctggataaaaatcagacagcggagaaagaggaattcgagcatcagcagaaggagctggagaaagtctgcaacccaattataactaagctttaccagtcagccgggggtatgcctggagggatgcctggtgggttccccggggggggagcgccaccatcaggtggagcctcatcaggaccaacaattgaggaggtagattag

SEQ ID NO: 190396 - DNA, 1503 bp, Artificial Sequence
  Description of Artificial Sequence: Synthetic coding sequence
atgagcaagggccccgccgtgggcatcgacctgggcaccacctactcctgtgtcggcgtcttccagcacggcaaagtggaaatcattgccaacgatcagggaaaccgcacaactcctagttacgttgcctttacggacaccgaacgtctgatcggagacgctgccaaaaaccaagtcgccatgaaccctacaaatacagtgttcgatgcaaaacgcctgattggacggaggttcgacgatgctgtggtgcaatccgatatgaaacactggccctttatggtggtgaatgacgccggcagaccaaagcataaaaaggacatatcagagaacaaaagagctgttaggaggctgagaaccgcctgtgaaagagcaaagaggaccctttctagctctactcaggcttctatcgaaattgattctctgtacgaaggaattgacttttacacttctattacccgggcacgttttgaagaactgaatgcagatctgttcaggggcaccctggatcccgtcgagaaggctctgcgcgacgccaaattggacaagtcccagatccacgacatcgtcttagtcggcggcagcacaaggataccaaaaattcagaaactgctgcaggatttttttaatggcaaagaattaaacaaaagtatcaatccagatgaggctgtggcatacggcgccgccgtgcaggcagcaattctgagcggcgacaagtctgagaacgtccaggacctgttgttgctcgacgtcacgccactgtccctgggtatcgagactgccgggggtgtgatgaccgtgcttattaaaagaaatactaccattccaactaaacagacccaaactttcacaacctacagcgataaccagcctggagtactgattcaggtgtacgaaggcgaaagagccatgactaaggacaacaacctgctgggcaaatttgaactaactggcatcccaccagctcctaggggtgtccctcagatcgaagtcactttcgatatcgatgccaacggcattctgaatgtgagcgctgtcgataaaagcacagggaaggagaataagatcactataacaaatgataagggacgcctctccaaagaggacatagagcgtatggttcaggaggcagaaaaatataaggctgaggacgagaagcaaagggataaagtgtcgagcaagaattccctggaatcctacgccttcaacatgaaagctactgtggaggacgagaaattgcaggggaagatcaacgacgaggacaaacagaaaatcctcgataaatgtaacgagataattaactggctggacaagaatcagactgctgaaaaagaagagtttgaacaccagcagaaggagctggagaaagtctgcaatccgattatcacaaaactctaccagagcgccggcggaatgcccggaggaatgcccggggggttcccggggggaggagcccccccaagcggaggagctagctcaggacccaccatcgaagaagtggactag

SEQ ID NO: 190397 - DNA, 1233 bp, Artificial Sequence
  Description of Artificial Sequence: Synthetic coding sequence
atggtgaaccacttcatcgccgagttcaagcggaagcacaagaaggacatcagcgaaaataaaagggcggtcagacgattgagaactgcgtgtgagcgtgctaaaaggaccctttccagcagcacacaagccagcattgaaattgatagcctgtatgagggaattgacttttacacctccatcacgagagctcggttcgaggaactgaacgccgatctctttcgaggaacgctggaccctgttgagaaagctctgcgggacgccaaactcgataaaagccagattcacgatattgttcttgtggggggatccacgcggatccccaagatacagaagctgttacaggacttctttaacggtaaagagctgaataaaagcataaaccccgatgaagctgtggcctacggtgccgcagtgcaagcagctatcttatccggtgataaatctgagaatgtgcaagatctcttattactggatgtaacgcctttaagtctaggcatcgagaccgctggaggagtcatgacagttcttattaaacgtaatacaactattcctacaaaacaaacccaaacgtttactacatatagcgacaatcagcctggggtactcattcaggtgtatgaaggagagagagccatgaccaaggacaataaccttctggggaagttcgaacttacgggcataccccccgccccacggggggtgccccagatagaagtgaccttcgatatcgatgctaacggaattctgaatgtcagcgctgtggataagagcactggcaaggagaataagatcaccattacgaatgataagggaaggttaagtaaagaagacattgaacgcatggtccaagaagcagaaaagtacaaggccgaagatgaaaagcagcgtgacaaagtgtcttccaagaattctttagagtcgtacgcattcaatatgaaagcgaccgtcgaagacgagaagctgcaggggaagatcaacgacgaggataagcagaaaatcctggataaatgcaatgagatcatcaactggttagataaaaatcagaccgcggagaaggaagaatttgagcatcaacaaaaagagctggaaaaggtgtgtaacccaattatcaccaagctctatcagagtgccggcgggatgccgggaggcatgcctggagggttccccggaggcggagctccgccatcagggggggcttcttccggccctaccattgaagaggtggactag

SEQ ID NO: 190398 - DNA, 1941 bp, Artificial Sequence
  Description of Artificial Sequence: Synthetic coding sequence
atgagcaagggccccgccgtgggcatcgacctgggcaccacctactcatgtgtaggcgtgtttcaacacggtaaggttgaaatcatagccaatgaccaaggcaaccgtaccaccccttcctatgtggcctttactgatactgagagactgattggggatgccgccaagaatcaggttgctatgaaccctacaaataccgtctttgatgctaagcgcctgatagggagacgattcgatgacgctgtggtccaatcagacatgaaacactggcccttcatggtagtaaacgatgccggccggcctaaagtccaggtcgagtataaaggcgagacaaagagtttttatcccgaagaggtcagcagcatggttctgacaaaaatgaaggaaatagctgaggcctacctgggaaaaaccgttacgaacgccgtcgtgactgttccggcctatttcaacgactcccagcggcaggccactaaggacgccgggacaatagctgggctgaatgtgctccgcatcatcaacgagcctaccgcggccgctatcgcctacggcctggataaaaaggtaggggccgaacgcaatgtgctcatcttcgacttaggcggagggaccttcgacgtgtcaattctgaccatagaggatgggatctttgaggtcaagagtacagctggagacactcatcttgggggcgaagactttgataacagaatggtgaatcactttatcgccgagtttaagaggaaacataagaaagacattagtgagaataagagagcggtgagaaggttgagaaccgcctgtgagcgggcaaagcgtactctttcatctagcacccaggcctctatagaaatcgatagtctctatgagggaatcgacttttatacttctattactagagcaagatttgaggagcttaacgcggacctgttccgcggtaccctcgaccccgtagaaaaggcattgagggatgcaaaactcgataagtcccaaattcacgacattgttctggttggcggatccacccgtattcccaagatccagaagctgctccaggacttttttaatggcaaagagctgaataaatcaatcaacccagatgaagctgtggcctatggcgccgccgtgcaggccgcaatcctatccggtgataaatccgaaaacgtacaggaccttcttttacttgatgtgacaccactatctttagggatcgagactgcaggaggggtcatgaccgtgctgatcaagcggaatacaacaatcccaaccaagcagacacagacgtttacaacttattccgacaaccaacccggggttctaatccaagtatacgagggtgaaagagcgatgacaaaggataataatctcctagggaagtttgaactgactggcatccccccagcaccccgaggggtgccacaaattgaagtcacattcgacattgatgctaatggtatactaaacgtgtcggcggttgacaagtctaccggaaaagagaacaagattactatcacaaacgataaaggaagactgagcaaggaagatatcgagcggatggtgcaagaagctgaaaagtacaaggcagaggatgagaagcagcgggataaggtgtccagcaagaattcactggaaagttacgcatttaatatgaaagctactgtggaggatgaaaaactccaggggaaaattaacgatgaggataagcagaagattcttgataagtgcaacgagattattaattggctggacaagaaccagaccgccgagaaggaggagtttgaacatcagcagaaagaactggagaaggtctgtaaccctatcatcacaaaactgtatcagtcagccgggggcatgcctggcggcatgcccggcggcttcccgggagggggagctcctccatctgggggtgcatcctccggtcctactattgaagaagtggactag

SEQ ID NO: 190399 - DNA, 2040 bp, Artificial Sequence
  Description of Artificial Sequence: Synthetic coding sequence
atgatcagcgccagccgggccgccgccgcccggctggtgggcgccgcagcctcccgaggccctacagcagcgaggcatcaagatagttggaacggtttatctcacgaggcctttaggctggtctctagaagggattacgccagcgaggccatcaagggcgccgtggtgggaatcgacctgggtactacaaacagctgcgtcgcagtcatggaaggcaaacaggccaaggtgctcgagaacgccgagggcgcacgaactacaccctccgtggtcgcttttacggcagatggagagcggttagtgggaatgccagctaaacgacaggcagtgacaaatcctaataacaccttttatgcgacaaaaaggctgatagggaggcgctatgatgaccctgaggtgcagaaagatattaagaatgtgcctttcaagattgtgcgagcttctaatggcgatgcttgggtcgaggcacacgggaagctttactcgccttcacagatcggagcatttgtgctaatgaaaatgaaagagacagcagagaattatctgggccacacagctaaaaatgctgtaataactgtccctgcctacttcaatgattcgcaaaggcaagccactaaggacgcgggccagatcagcggactaaatgtactgcgcgttatcaatgagcccactgccgccgctctcgcttacggactagacaaaagcgaggacaaagtgatcgctgtttacgacctaggcggtgggacattcgatatcagtatcctggaaattcaaaagggcgtcttcgaggtcaaatcaactaacggggacaccttccttgggggagaagactttgaccaggcgttgcttcgccatatagtaaaagaattcaagcgtgagaccggagttgaccttaccaaggacaatatggctctacagcgcgtccgcgaagcagccgagaaggccaaatgcgaactctccagctcagtgcaaaccgatattaatctgccctaccttaccatggactcctccgggcccaagcacctgaacatgaaactgacccgagcccagtttgaagggattgtcaccgatctgataagacgcactatcgctccttgtcagaaggccatgcaggacgccgaggtgtcgaagagtgacatcggtgaagtcatcttagtgggaggaatgaccaggatgccaaaagtacaacaaaccgtgcaagacctcttcggcagagccccaagcaaggcggtcaaccctgatgaggccgtcgccatcggagcagccattcaaggaggggtcctcgccggcgatgtcacagatgtcctattgctggacgtgacgccactgtcactgggaatcgaaaccttaggaggggtgtttactaagcttattaatagaaatacaaccattccgactaagaagtcacaggttttcagcaccgccgccgatggacaaactcaggtggaaattaaagtgtgccaaggagaacgagagatggcaggcgataacaagcttctcggtcaattcactcttatcggcattccgccagcccctagaggggtgccacagattgaggttactttcgacattgacgccaatgggatcgtgcatgtgagtgcaaaagataagggaacaggacgggaacagcagatcgttatacagtcttctggcgggctttcgaaggacgacatagagaacatggttaagaacgctgaaaagtacgccgaagaagaccggagaaagaaggagagagtggaggccgtcaacatggcggaaggaatcatacacgatacggagacaaagatggaggagtttaaagaccaacttcccgcggacgagtgcaacaaattgaaagaagaaatttccaaaatgagggaactactcgccaggaaggatagcgagacgggggagaatatccggcaggccgcctccagcctgcaacaggcatcactgaagctgttcgaaatggcctacaagaagatggctagcgagagagaagggtccggaagcagcggtacaggcgaacagaaagaagatcaaaaagaggaaaagcaatag

SEQ ID NO: 190400 - DNA, 1998 bp, Artificial Sequence
  Description of Artificial Sequence: Synthetic coding sequence
atgatcagcgccagccgggccgccgccgcccggcaccaggacagctggaacgggctctctcacgaggccttcagactcgtctcgaggcgcgattatgcctccgaagccataaaaggcgctgtcgtgggcatagacttgggtacaactaatagctgtgtggccgtaatggagggcaaacaggcaaaagtgctggaaaacgccgagggtgcacgaacaacacctagcgtggtcgcctttactgctgatggcgaaagattggttgggatgccagcaaaacgacaagcagttactaaccccaataacacattctatgctacaaaaaggctgatcggcaggcgctatgacgaccctgaggtgcagaaagatattaagaacgtaccattcaaaattgtccgcgcgtccaatggtgatgcctgggtagaggcacacgggaagctatactcgcccagccagataggtgctttcgtactcatgaagatgaaagagaccgcagagaactacctgggacacacagcaaaaaacgctgttatcacagtgccagcctatttcaatgacagccaacgacaggccacgaaggacgccgggcagatatcaggcttgaatgtactgcgggtgatcaatgaaccaacagctgcagcactcgcctacggactggacaaatcagaggataaggtcattgcggtgtacgacctgggtggtgggaccttcgatatttcaattctggaaatccagaaaggcgttttcgaggtaaaatccaccaatggcgatacattcttgggtggagaggattttgatcaggcactgctccgccacatagtgaaggaattcaagagagagacaggagttgatcttacaaaggacaatatggccctccaacgcgttagagaagccgctgagaaggcgaagtgcgaattatcctcatcagtgcagacagatattaaccttccctatctaaccatggacagcagtggccccaagcatctaaacatgaagctaacacgtgcccagttcgagggcatcgttacagatctgatccggagaacaattgcaccttgccaaaaggctatgcaggatgctgaggtgtccaaatccgatattggggaagttattctggtcggaggaatgacaagaatgcctaaggtccaacagacagtacaggacctgtttgggcgagccccgtccaaggccgtgaatccagacgaggcggtcgcaatcggggcagcgattcagggcggagtgcttgctggagacgttaccgacgtcctactgcttgacgttacccctttatctctcggcattgaaacactagggggagtctttactaaactgattaatcggaatactacaatccctaccaagaagtcccaggttttcagtacggctgctgatggccagacccaggttgagattaaagtttgtcagggagaacgggagatggccggcgataataagctcctgggacaattcactctgatcgggattccacccgcccctaggggagtacctcagatcgaggtgactttcgacattgatgcaaatggcattgtacacgtgtcagcgaaagacaaaggaaccggtcgagaacagcaaatcgtgatccaatcatccggcggcctgtccaaagacgacattgagaatatggtgaagaatgctgagaaatacgctgaggaagatagacggaagaaggagagagtggaagcagtgaatatggcggagggcataatacacgacaccgaaaccaagatggaggaattcaaagaccaactgcctgctgacgagtgcaacaaacttaaagaggagatttccaagatgagggagttactcgcaagaaaggacagtgagaccggtgagaatatccgacaagcggcaagtagcctgcagcaggcgagcctgaagctgtttgaaatggcctataagaagatggcttctgagcgggaaggctcaggctcgtcagggacaggcgagcagaaagaggaccagaaagaggagaagcagtag

SEQ ID NO: 190401 - DNA, 1899 bp, Artificial Sequence
  Description of Artificial Sequence: Synthetic coding sequence
atggccctggtgatgcggctgctggacctgttccagggcggcatcatgcaccagaaacaaagtcgggagcagcttctcgtcttaatctgggtgcttcccacccctgcctggcagctgtggaaggtcaacaagcaacggtgttggcgcatgcctaaagtcccagagccccccctgcagctttggcccttacagcagatggtatcagaccttctcgagtgcagacccagcgatcgcttgtcccccacccaaaccattcattttatgttaccatcggtctcccttgccggagatatgatgatcctgaaatacaggaaaactctgaagatgttccctttaaagctcagcgtgccgcccatggtgatgcccgtgctgatgaagatgaaagagacagccgaaaactacttagggcatacagccaaaaacgcggtgatcactgtgcctgcctatttcaacgattcccaacgacaagccaccaaggatgcgggccagattagcgggcttaacgttctcagggtgataaacgagccgacagcagctgctttggcctatgggttggacaagtccgaagataaggtgattgccgtgtacgacctcgggggaggaacttttgatatttcaatcctcgagatccagaaaggagttttcgaggtcaaatccactaatggagacacgtttttgggcggggaggactttgatcaagctctgctcaggcacatcgtgaaggagtttaagcgcgaaacaggcgtggaccttacaaaggacaatatggcactccagagggtccgggaagcagcagagaaggccaaatgtgaactctcatcatcagtccagacggacattaacctgccctatctgactatggatagttcggggccgaaacacctcaatatgaagttaacacgtgctcagttcgagggtatcgtgactgacttgatacggcgcaccattgcgccatgccaaaaggccatgcaggatgcggaggtgtccaaatccgacatcggagaggtcatcctggttggaggaatgacaaggatgccaaaagttcagcagaccgttcaggacctcttcgggagggctcccagcaaagcggttaaccccgacgaagcggtggccattggcgccgcaatccaaggcggggtgcttgctggcgacgttactgacgttcttttgttagatgtcacaccccttagcctaggaatcgagaccctaggcggcgtattcaccaagcttatcaacagaaacacgactatacccaccaagaagagtcaggtttttagcaccgccgcggatggccagactcaggtggagatcaaggtctgccagggcgagcgcgaaatggcaggggataataagctgctaggacagttcacactgataggtataccccccgctccccgtggcgtgccccagatagaggtgactttcgacatcgacgcaaacggcatcgtccatgtctccgcaaaagataaggggaccggccgggagcaacagatcgtgatccaatccagcggcggcttgtctaaggacgatatcgaaaatatggtcaagaacgcagagaagtacgccgaggaagatagacgtaagaaggaacgtgttgaggcggtgaatatggccgagggcattattcacgacacagagaccaagatggaggaatttaaggatcagcttcccgccgacgaatgtaacaagcttaaagaagagatctctaagatgagagagctgttagcacgaaaagactccgaaaccggagaaaatatccggcaagccgctagctctctgcagcaagcttctcttaagctgttcgaaatggcatataaaaagatggctagcgagcgggagggctccggcagcagcggtaccggtgagcagaaagaagatcagaaggaggagaaacagtag

SEQ ID NO: 190402 - DNA, 2175 bp, Artificial Sequence
  Description of Artificial Sequence: Synthetic coding sequence
atgcccgaggaggtgcaccacggcgaggaggaggtggagaccttcgcctttcaggccgagatcgctcagcttatgagcctcattatcaatactttttatagcaacaaggaaatcttcctgcgggaactgattagtaacgcctctgacgccctcgacaaaatccggtatgagagtctaactgatccatccaaattggattctggtaaggaacttaagatcgacattatcccaaatccccaggagcgcacattaacattggtggacacaggcatagggatgactaaagcagacctgattaataatctaggaacgatcgccaaaagcggaaccaaggcgttcatggaagccctacaggccggagccgatatcagtatgattggtcaatttggagttggcttctactcagcatatcttgtggctgaaaaagtggtggtgattacgaaacacaatgacgacgaacagtatgcctgggagagctctgctggtgggagctttaccgtacgagcagaccatggcgagcctatcgggaggggaacaaaagttatcctgcacctgaaggaggaccaaactgaatacctagaggagcgcagagtcaaggaggtagtgaaaaaacatagccaattcattggataccccatcacactgtatcttgaaaaggagagggagaaggaaatttcggacgacgaggccgaagaagagaagggggagaaagaggaggaagataaagatgatgaggagaagcccaagatcgaggatgtcggcagcgacgaagaagatgattccggaaaggacaagaaaaagaagaccaagaagattaaagagaaatacatagaccaagaagagctgaataagactaaaccaatttggacacgtaatcctgatgacatcacccaggaagaatatggggagttctataagtctttgacgaacgactgggaggaccacctggccgtcaagcatttctcagtggagggtcagcttgaatttagagctctgctgtttataccgcggcgggctcccttcgatctcttcgagaataagaaaaagaaaaacaacataaaactgtacgtccggagggtgttcattatggactcttgtgatgagctgattccagagtatcttaacttcatacgcggggtggtcgactctgaggatctcccgctgaacatctcacgagaaatgctacagcagtccaagatcctgaaggtgattcggaagaacattgtgaaaaagtgccttgagctattttctgagctagcagaagacaaggaaaattataagaagttctacgaggccttctccaaaaacttgaagttaggcattcatgaggattctacaaatcgacggcggctatccgagttgttgcgctaccatacgagccagtcaggcgacgaaatgacttccctgagcgaatatgtttctcgcatgaaggaaacccaaaaatctatatattacatcaccggggagtctaaagaacaagtagctaacagcgctttcgtggaacgggtaagaaagcggggatttgaggtggtgtacatgacagagcctatcgatgaatactgcgttcagcaactgaaagagtttgacgggaagagcctggttagtgtgacaaaggaggggcttgagctgcccgaggacgaagaggaaaaaaaaaagatggaagaatcaaaggctaaattcgagaacctttgtaagttaatgaaggaaatcctggacaagaaggtagaaaaagtcaccatctctaacaggctcgtgtcctcaccgtgctgtatcgtcacgagcacctacgggtggactgctaatatggagcgcataatgaaggcgcaggccttacgagacaatagtacaatggggtacatgatggccaagaaacatcttgaaattaatccggatcacccaatagtggaaacattacgacaaaaggctgaggcagacaaaaacgacaaggcagttaaagatttggtcgtactgctgtttgaaacagcccttctctcatccgggttttctctggaagatcctcagacacattctaaccgtatataccgtatgataaagctcggattaggcattgacgaggatgaggtggctgccgaagaacccaatgctgctgttccagatgagatcccaccccttgagggggacgaggacgcttctcggatggaggaggtcgactag

SEQ ID NO: 190403 - DNA, 2175 bp, Artificial Sequence
  Description of Artificial Sequence: Synthetic coding sequence
atgcccgaggaggtgcaccacggcgaggaggaggtggagaccttcgcattccaagcagagatagcccagctgatgtccctgattattaacacattttactcgaacaaagagatttttctcagagaactcatatcaaacgcctcagatgcccttgacaaaattcggtacgagagtctcaccgatcccagcaaattggatagcgggaaggagcttaaaatagatataatcccaaaccctcaggagcgcacactcacactggtcgacacagggatcgggatgacaaaagcagacctcattaataatctgggaacaatcgctaagtccggaactaaagcatttatggaggccctgcaggccggcgccgatatcagcatgattggacagttcggggtgggattttattctgcgtaccttgttgcggagaaggtggtggtcattactaagcacaatgatgacgaacaatacgcttgggagtcgagcgcaggtggtagcttcactgtgcgtgctgaccacggcgagccaataggaagaggaaccaaggttatcttacacctcaaggaggaccagacggagtatttggaggagagacgtgttaaagaggttgtaaaaaagcacagccagtttatcggttatccaataaccttgtatctcgagaaagagagagagaaggaaatcagcgacgatgaggctgaggaggaaaaaggggagaaggaagaggaggataaagatgacgaggaaaagccgaagatcgaggatgttggatctgatgaagaggacgattcaggtaaggataaaaaaaaaaaaacgaaaaaaatcaaggagaagtatatcgaccaggaggagttgaataaaaccaagcctatctggacacgaaacccagacgatattacccaggaagaatacggcgagttctataaaagtctgacgaatgactgggaggaccacttagccgtcaagcatttctcggttgagggccagcttgagttcagggcattactgttcattcccagaagagccccattcgatctgttcgagaacaagaaaaaaaaaaataacatcaagctgtacgtgcgccgtgttttcatcatggatagctgtgacgagttgatccccgagtatctcaacttcattcgcggagtcgttgattctgaagacttgcccctgaacatctctagggaaatgctgcagcagagcaagatcctgaaggtgatccgaaagaacattgtgaagaagtgcctggagctcttcagcgaactggccgaggacaaagagaactataagaaattctacgaggctttttcaaaaaacctgaaactcgggatacacgaggatagcactaatcggcggcggttgtccgagctgctccgataccacacctcccagtcaggcgacgaaatgacatcccttagcgaatatgtttctcgtatgaaggagacccagaaaagcatttattatatcaccggggaatctaaggagcaggtggcaaatagcgcctttgttgagagagttcgtaagcggggttttgaagtggtatatatgacggaacccatcgacgaatactgtgtgcaacagttgaaggagtttgatggtaaaagtctcgtgtccgtgaccaaggaggggctagagctgcctgaggatgaagaagaaaaaaagaagatggaggaaagtaaggccaaatttgaaaacctgtgtaagctgatgaaagagatccttgacaagaaagttgaaaaggttacaatttccaaccgtctggtttcttcgccttgttgtattgtgactagtacctatggatggaccgcaaatatggaacgaatcatgaaggcccaggcgttgcgagataattcaacgatgggatatatgatggccaaaaagcacctggaaattaatcccgaccatccaattgtagaaaccctgagacagaaagccgaagcagataaaaatgataaagccgtgaaggatctcgtagtcctgctctttgagacagctctgctgtcgagcggcttttccctcgaagatccccagacgcattccaacaggatttatcggatgattaagttgggactgggcatcgacgaagacgaggttgccgcagaggaaccaaatgctgcagtccccgatgaaattccaccactcgaaggggacgaggatgcctcccgaatggaggaagtggactag

SEQ ID NO: 190404 - DNA, 465 bp, Artificial Sequence
  Description of Artificial Sequence: Synthetic coding sequence
atggacagctgcgacgagctgatccccgagtacctgaacttcatcagaggcgttgttgattctgaggaccttccactgaatatcagtcgcgagatgctgcagcagtccaagatactgaaggtgattcggaaaaacattgtgaaaaaatgcctggagctcttctctgagctcgcggaagataaagagaattataaaaagttctacgaagccttcagtaagaacctgaagctggggattcacgaggatagtacaaacagacggaggctgtccgaactccttcgctaccatacaagccagagcggcgatgaaatgacgtcgttgagcgaatatgtaagccgcatgaaggaaacccagaaatccatctattacatcaccggggaatctaaggaacaggtgtgtccttgcccaacgtggctcccgttgttggtgagctccgtcttcttcccgttgctctccctgtgttag

SEQ ID NO: 190405 - DNA, 489 bp, Artificial Sequence
  Description of Artificial Sequence: Synthetic coding sequence
atggacagctgcgacgagctgatccccgagtacctgaacttcatccgaggcgtcgttgattctgaggatctcccacttaacatcagtcgagagatgctccagcagtccaaaatcttgaaagtgatacggaaaaacattgtaaagaagtgccttgaactcttcagcgagctggccgaggacaaggaaaattacaagaagttctacgaagccttctccaaaaacctgaagctggggattcacgaggattcgacaaatcgtcggcggctgagcgagctcctgcgttatcacacctcacagagcggggatgaaatgacctccctgtctgaatatgtaagtagaatgaaagaaacgcagaagagtatctattatatcacgggtgagtcaaaggagcaggtggcaaactccgcttttgtggagcgctgtccttgtcccacttggttacctctgttggtctcctccgttttctttccactcttgtctctgtgttag

SEQ ID NO: 190406 - DNA, 552 bp, Artificial Sequence
  Description of Artificial Sequence: Synthetic coding sequence
atggacagctgcgacgagctgatccccgagtacctgaacttcatccgcggcgtggtggactctgaagaccttccacttaatataagtcgcgaaatgttgcagcagtcaaagatcttgaaagtgatcaggaagaacattgttaagaagtgcctcgagcttttcagcgagctggctgaggacaaagagaactacaagaaattctacgaagccttcagcaagaatctaaaactgggcatacacgaggattctacgaaccgaagacggctgagcgagcttctgaggtaccacacttcccagagcggagacgagatgaccagcctaagcgaatacgtgagcagaatgaaagaaacgcagaaatctatttactacatcacaggatccccgtgctggtgtttagttttcttctctttgagttgcccctgtgtggaaggatctaaactgagagtgagttctccgataccgagtctcttgttaactgctggcctggatgtggtgtactgtggactcttctacttcctgcacttcgttctaaaactcaagtacgctaaatag

SEQ ID NO: 190407 - DNA, 2175 bp, Artificial Sequence
  Description of Artificial Sequence: Synthetic coding sequence
atgcccgaggaggtgcaccacggcgaggaggaggtggagaccttcgcgtttcaggctgagattgcacagttgatgtctctgataatcaacaccttttactcaaataaagagatcttcctgagggagttgattagtaatgcctctgacgccttagataaaatccgctacgagagtctgaccgaccctagcaagctggactctgggaaggaactcaagatcgacatcattccgaaccctcaggagagaacactgacccttgtcgatacaggaattggaatgaccaaggccgatctgatcaacaatctgggaacaatcgccaagtccggcacaaaagcctttatggaggctctgcaggccggagccgacatttccatgatcggccagtttggcgtcggcttctatagcgcatatctcgtcgccgagaaagttgtggtgattaccaagcacaacgacgatgagcagtacgcctgggagagctccgctggcgggagctttacggtgcgggccgatcacggggagcccatcggaagaggcaccaaggttatcctccacttaaaggaggaccagaccgaatacctggaggagcggagagttaaggaagtggtgaagaaacacagccaattcatcggctacccaatcaccctgtatctggaaaaagagcgggaaaaagaaatcagtgatgacgaggctgaggaggagaaaggcgaaaaggaggaagaggataaggatgatgaagagaaacccaaaatcgaagacgtgggctccgacgaggaagacgatagcggcaaggataaaaaaaagaagacaaaaaagatcaaggaaaagtatatcgaccaggaggagctgaataaaactaaacccatttggacacgaaatcccgacgacatcacgcaggaggagtacggggagttttataagagcttgaccaatgactgggaagaccacctggccgtgaagcacttttccgtcgaagggcagttagagttccgcgccctcttattcatcccacgccgtgcccccttcgacttgtttgagaacaaaaaaaagaagaataatataaagctctatgtgcggcgcgttttcataatggattcatgcgacgagctcattcctgaatatctgaattttattaggggtgtcgtcgattctgaggatcttccgctgaatatttcccgagagatgttacagcagagcaagattctgaaggtaattcgcaagaacattgtcaagaagtgtctcgagctcttctcagagctagcagaggataaggaaaactacaaaaaattttatgaagcctttagtaaaaatctgaagctggggattcacgaggattcgacaaataggaggcgactttcagagctgcttcgataccatacatcacaaagcggcgacgaaatgactagtctgtcagagtatgtttctcgaatgaaggagacacagaagtctatctactacatcactggcgaaagcaaagagcaggttgcaaactcagcgttcgttgagagggttcgaaagaggggctttgaggtggtttatatgaccgagcccatcgatgaatattgcgtacaacagctcaaggagtttgacggcaaatctctggtgagcgttaccaaggaaggcttggagttgccagaggacgaggaggaaaaaaaaaagatggaggagtcaaaggccaagttcgaaaacctctgcaaattgatgaaagagattctggataaaaaggtggaaaaggtaaccatcagcaaccggttggtgtcgagcccctgctgcattgttacctccacctacgggtggactgcgaacatggaacgaattatgaaggcccaggcccttagggacaattctaccatgggctacatgatggccaaaaaacacttagaaattaatcccgatcaccctattgtcgaaactctgcgacaaaaggccgaagcggacaagaatgacaaggctgtaaaggacctcgtcgtgttactctttgagactgcacttctctcctccggcttctccctggaagatccacagactcactccaatagaatctacagaatgatcaagctggggctcggtatcgacgaggacgaagtggccgccgaggaaccaaacgctgccgtacctgatgagatcccccccctggaaggtgatgaggacgcctcacgaatggaagaggtggactag

SEQ ID NO: 190408 - DNA, 429 bp, Artificial Sequence
  Description of Artificial Sequence: Synthetic coding sequence
tgattcatccggggcgtggtggacagcgaggacctgcccctgaacatttcaagagagatgcttcaacagtctaagatactgaaagtgatcagaaagaatattgtgaagaagtgcttggaactttttagtgagttagcggaagacaaagaaaactacaagaagttctatgaagcattctctaaaaatcttaagctgggcatccacgaagactccacaaatagacggcggttgagtgaattgttgcggtaccatactagccagtccggcgacgagatgacttcactgagcgagtatgttagcagaatgaaagaaacccagaagtctatctattacatcactggcgagagtaaggaacaggtgtgcccatgccccacatggcttccactgcttgttagcagcgtatttttcccgctgctgtccttatgttag

SEQ ID NO: 190409 - DNA, 453 bp, Artificial Sequence
  Description of Artificial Sequence: Synthetic coding sequence
tgattcatccggggcgtggtggacagcgaggacctgcccctgaacatctctagggaaatgcttcagcagtctaaaatacttaaggtgattagaaaaaatattgtgaaaaaatgtttggagctgtttagcgaattggctgaagataaggagaattacaagaagttctacgaggcctttagcaagaaccttaaactcggcatccacgaggatagcactaaccgcaggaggttatcagagttactcagataccatacaagccagtctggcgacgagatgacatcactgtctgagtacgtgtccagaatgaaagaaacccaaaagtcaatctattatataacaggggaaagcaaggagcaggtggctaactcagcatttgtcgaacgatgcccctgcccaacttggctgccactcctggtgagcagtgtgttctttccgctgctgtccctatgctag

SEQ ID NO: 190410 - DNA, 516 bp, Artificial Sequence
  Description of Artificial Sequence: Synthetic coding sequence
tgattcatccggggcgtggtggacagcgaggacctgcccctgaacatctcccgggagatgctccagcaatccaagatactgaaggttatacgaaaaaacattgttaagaagtgcttggaactgtttagcgagctggcagaggataaagaaaactacaaaaagttctacgaggcttttagcaagaacctcaaactgggcattcacgaggactcgacgaataggcgtcgcctgtccgaactgctgaggtaccatacaagtcagagcggagacgagatgacgagtctcagtgaatacgtgtcccgtatgaaagagacacagaagtctatctattacataacaggcagtccctgttggtgccttgtctttttctccttaagttgcccctgtgtggagggttctaagctgcgtgtgagttcacctatcccctcactgctgctgactgcaggactggacgttgtgtactgcggtttgttttattttcttcacttcgttctgaagttgaaatacgcaaaatag

SEQ ID NO: 190411 - DNA, 507 bp, Artificial Sequence
  Description of Artificial Sequence: Synthetic coding sequence
atgcccgaggaggtgcaccacggcgaggaggaggtggagaccttcgcattccaggccgagattgctcagctgatgagccttataattaataccttctatagcaataaggagatattcctgcgggagctgattagtaatgcttcggacgctttggacaagatcagatacgagtctttgactgatcctagtaagttggattctggaaaggaattaaagatagacatttctatgatcggacaattcggggtgggattttattccgcatatctcgttgcggagaaagtggtggtcataacaaagcacaacgatgacgagcagtacgcttgggaatcctccgctggggggtcgtttaccgtgagagcagatcacggcgagccaatcggcagggggaccaaggttatcttacacctcaaggaagatcagacagaatacttagaggagcgccgggtcaaagaggttgttaagaagcactcgcaattcattggttatccaatcactctctactag

SEQ ID NO: 190412 - DNA, 483 bp, Artificial Sequence
  Description of Artificial Sequence: Synthetic coding sequence
atggagatccccgtgcccgtgcagcccagctggctgcggcgggccagtgctcctctcccaggactgtcagcaccggggcgactcttcgaccagaggttcggcgaggggctcttggaagccgaattggcggcactctgcccaacaaccctcgcaccctactatttacgagctccaagcgtcgctttgccagtagcccaagttccgactgatccaggccacttctctgtgctgctggacgtaaagcatttctcccctgaggaaatagccgttaaagtggtgggtgagcacgtggaggtgcacgcacggcacgaggagaggccagatgagcacggcttcgtcgcccgagagttccacaggcggtatagactgccacctggggtggatcctgcagcggtgacgagcgccctgtctcctgaaggcgtcctctctatccaggcggccccagcctcggctcaggcccccccacccgcggccgctaagtag

SEQ ID NO: 190413 - DNA, 483 bp, Artificial Sequence
  Description of Artificial Sequence: Synthetic coding sequence
atggagatccccgtgcccgtgcagcccagctggctgcggcgggcctcagctccgcttcccggcctatctgcccccgggagactctttgaccagaggttcggagaaggcctgctggaagcagagcttgccgccttatgtccaactaccttagctccatattatcttcgagctccgagtgtagccctcccagtggctcaggtgcccactgatcctggccacttttcagttctcctagacgtgaaacacttttcgcctgaagaaatcgctgtcaaagtcgtcggcgaacacgtggaagttcacgcaaggcacgaggagcgccctgatgagcacgggtttgtagcccgagaatttcaccgacggtacaggctgccccctggcgtggatcctgctgcggtcaccagtgctctgtcacccgagggcgtactttctatccaggcagcccctgcaagcgcccaggctcctcccccagcagccgccaagtag

SEQ ID NO: 190414 - DNA, 591 bp, Artificial Sequence
  Description of Artificial Sequence: Synthetic coding sequence
atggagatccccgtgcccgtgcagcccagctggctgcggcgggcctccgctccactgcccggactttcagcgcctgggaggttattcgaccagcgcttcggcgaggggctactggaggcggagcttgctgctctgtgtcccactaccctcgccccatactatctgcgtgctccgtctgtcgcactgcctgtggcccaggtgcccaccgaccccggacactttagtgttctgttggacgtaaaacattttagcccggaagaaattgccgtcaaagtggtcggggaacatgtggaagtgcatgcacggcatgaagaaagaccggacgagcacggtttcgtggcacgcgagtttcatcgcagatacaggttgccacctggagtggatccggccgctgtgacatccgcattgagtccagagggggtgttgtctatccaggcggcgcccgcaccccgagaacctcctcaggcccctagtattaaggcggacttaacacccccttctcaaatgagtagggtccgccaaggtctttcaagtcatcccttactcgactccgcgttgacctccattctggacacagcactgatcacatag

SEQ ID NO: 190415 - DNA, 1590 bp, Artificial Sequence
  Description of Artificial Sequence: Synthetic coding sequence
atggacctgcccgtgggccccggcgccgccggccccagcaacgtgcctgcatttctgactaagctgtggactctggtctcagaccccgacaccgatgccctaatctgttggagcccatcaggcaatagttttcacgtgttcgatcaggggcagtttgcaaaagaggtcttgcccaagtatttcaagcataataacatggctagcttcgttcgccagctgaatatgtacggctttcggaaggtggtgcatatcgagcagggtggactggtcaaaccagaacgggacgacacagaatttcagcatccctgttttcttcgggggcaggagcagctgctcgaaaatatcaaaagaaaggtgacttcggtgtccaccctcaaatcagaagacattaaaatccggcaggactccgtgactaagctcctaaccgatgtgcagttaatgaagggcaaacaggaatgtatggattcaaagcttctagccatgaagcacgaaaatgaagcattatggcgtgaagtcgcatcgctgagacagaaacacgcccagcagcagaaagtcgttaacaaactgattcagttcctcatctccctagtacagtccaatcggatcctaggcgtgaagcgaaagattccactcatgttaaacgactccggcagtgcccatagtatgcctaaatattcgcgtcagttcagcctcgagcacgtacacggctcggggccgtattcagccccttccccagcatattcgagttccagcttgtacgctcccgatgccgtggcttccagcggaccaattatctccgacatcaccgagctcgcccccgctagtccgatggccagcccaggtggttccattgacgagagacccttatcttcttctccgctagttagagtaaaagaagaacctccttccccaccgcagagtcccagggtggaggaggcatcccccggcagaccatcgtcagtcgatactctcctatcccctacagccttaatcgactctatcttacgtgagagtgagccagctccggccagcgttacggcactgacagacgctcgcggtcatacagacacggaggggcggcctccgagcccaccgcctacttctactccggaaaagtgtttatccgtagcctgtcttgataagaacgaactgtctgaccacctggacgctatggatagcaatctcgacaacctccagaccatgttgagtagccacggattttctgtggatacatccgcactgctcgacttatttagcccttctgtgaccgtgccagatatgagcctgcctgacttggatagcagccttgcatctatacaagagctgctctcaccacaggagcccccacgcccgccagaagccgagaactcctctcctgattcggggaagcagctggtccattacacagcgcagccccttttcctgctggatccaggctccgttgacactgggagcaacgacctgccagtgttgtttgaattgggggaagggtcttacttctcagagggcgacggttttgcggaggatcccaccatctctcttttaaccggttccgagcctccgaaagcaaaagatcccaccgtaagctag

SEQ ID NO: 190416 - DNA, 1611 bp, Artificial Sequence
  Description of Artificial Sequence: Synthetic coding sequence
atgaagcagagcagcaacgtgcccgccttcctgagcaagctgtggacgcttgttgaggaaacccacacgaacgaatttatcacttggtcccaaaacgggcaatccttcttagtactggatgagcaacgcttcgccaaggagatcctgccaaaatacttcaaacacaacaatatggcttcttttgtccgtcagttaaatatgtacgggttcagaaaggtcgtgcacattgacagcggcattgtgaaacaggagcgggatgggcctgtggagttccagcacccttactttaagcaggggcaggacgacctcctggaaaacatcaaaaggaaggtttcgtctagtaagccagaggaaaacaaaattaggcaagaggacttaactaaaattatttcttccgctcaaaaggtccagatcaagcaagagacaattgaatccaggttgagcgaactgaaaagcgaaaacgagagtctgtggaaggaagtgtctgaactgagagcaaaacacgctcagcaacagcaggtcatccgaaagatagtccagttcatagtgactcttgtccaaaataaccagcttgtgagtctgaagcgtaagcgccctttgttactgaacaccaatggggcccaaaagaaaaatctgttccagcacattgtcaaggaacccaccgataaccatcatcacaaagtaccacacagccgcacggaagggctgaaaccgcgggaaagaatctcagatgatattataatctatgacgtgaccgacgacaacgctgacgaggaaaatattcctgtgatccctgaaactaacgaggatgtgatctctgaccccagtaattgcagtcagtatcctgacattgtcatcgtggaagatgacaatgaggacgaatacgccccggttatccagagcggcgagcaaaacgaaccggcgagggagagcctttcctctggcagcgatggctcatcaccactgatgtcatccgcagtccagctgaacggcagttcgtccctgactagcgaggaccccgttacaatgatggactccattctgaacgataacattaacctgctgggcaaagttgagctactcgattaccttgacagcatagactgcagcttggaggactttcaggctatgctcagtgggagacaattcagcatcgaccctgacctactcgtggacctctttacaagttcagtgcagatgaatcccacagattacatcaacaataccaagtccgagaataagggtttggaaactaccaaaaataatgtggtacagcctgtctcagaggaaggcaggaagagcaagtctaaacccgataagcagctgatacagtacacagcattccctcttctggccttcctcgatggaaaccccgcatcgagcgttgagcaggcatccaccacagcgtcaagcgaagtgctctcctctgttgacaagcctattgaagtggatgaactgctggatagttccctggatccagagcccacccagagtaagctggtaaggcttgagccactgaccgaggctgaggcatccgaagcaacacttttctacctgtgtgaactagcccctgcacccctggactctgatatgccactgctcgacagctag

SEQ ID NO: 190417 - DNA, 1557 bp, Artificial Sequence
  Description of Artificial Sequence: Synthetic coding sequence
atgaagcagagcagcaacgtgcccgccttcctgagcaagctgtggacactggtcgaggagacccacacaaatgaattcatcacttggtcgcagaacgggcagtcatttttggtgcttgacgaacagaggtttgcaaaggaaattttgcccaagtactttaagcacaataacatggcctctttcgtcagacagctgaacatgtacgggtttaggaaagtagtgcacattgattcaggcattgtgaagcaggaacgggacggacctgttgaatttcagcatccatacttcaagcagggccaggacgatctgctggagaacattaaacgtaaggtctcctcatccaagcccgaggaaaacaagatccggcaagaagatctgaccaagattatctcaagtgctcaaaaggtgcagattaaacaggagacaatcgagagtagactgtcggaattgaaaagcgagaacgaatctctgtggaaggaggtgtctgaattacgcgccaaacatgcccaacagcaacaggtgattaggaagatagtgcagttcattgttaccctggtgcagaacaaccagcttgtgtcactgaagcggaaacgccctcttctgctaaataccaacggcgcccagaagaagaacctgttccagcacattgttaaggaaccaaccgacaatcaccaccataaggtgccccatagcagaaccgaaggactcaaacctcgggagcgaatctccgatgacattattatttacgatgtgactgatgacaacgccgacgaggagaatatcccagtgattccggaaaccaatgaagacgtgatctcggacccttcaaattgttctcaatatccagatatcgtgatagtagaagacgacaatgaagacgaatacgctcccgtgatacagtctggtgagcaaaacgaacccgcccgcgaatcactcagttctggcagcgatggttcttcccctctcatgagttccgcagtacagctgaacggctcttctagcctgacctcagaggaccccgttaccatgatggattccattttaaatgacaacattaatttgctgggcaaagttgagctcttagattatctcgatagcattgattgctcgcttgaggatttccaggccatgttgtctgggaggcagttctcgatcgatccagatcttcttgtggacagtgaaaataagggactagagaccactaagaataatgtcgtgcagcccgtctcagaggaaggccggaagtctaagtcaaagccagataagcagcttattcaatacacggcttttcctctgttagcattcctggatggcaatccagcctctagcgttgagcaggcctctacaaccgctagcagcgaagtcctgtcttctgtggataaacccatagaggtcgatgagctgcttgactcctctcttgatcccgagccaacacaatcaaaattagtgagactcgaacctctgacggaggcggaggcttccgaggctacactgttttatctctgtgaactcgcccctgccccactggattcagatatgcccctcctagatagttag

SEQ ID NO: 190418 - DNA, 1005 bp, Artificial Sequence
  Description of Artificial Sequence: Synthetic coding sequence
atgggcgaggccggcgccgccgaggaggcctgccggcacatgggcaccaaggaggaatttgtcaaggtccgcaagaaagatctggagagactcacaacggaagtaatgcagatccgcgattttctgccgcgcatcctcaatggggaggttctagaaagttttcagaagctgaagattgttgagaagaacctggagaggaaggaacaagagttagagcagcttaagatggactgtgaacacttcaaagccaggttagagaccgtacaagctgacaacattcgggaaaagaaagagaagctggccttacgacagcagctgaatgaggctaaacaacaattactccagcaggccgagtactgcactgagatgggggctgctgcctgtacgctgttgtggggcgtttcatcatccgaagaagtggtgaaggctattctcggcggagacaaagcgctcaagttcttttcaattactggacagacgatggagtccttcgttaaaagcctagatggggatgtccaggagcttgatagtgacgagtcccagtttgtgttcgcactggcgggcatcgtgacaaatgtcgcagccatcgcctgcggcagggagttcctggtcaattcatcccgcgttctgctggatacaatacttcagctgctgggggacctgaaacctgggcagtgcactaagttgaaggttctgatgctgatgagcctgtacaatgtgtctattaatctcaaaggactcaagtatatctccgagagccccggatttattccgctcctatggtggctgctcagcgatccggatgctgaggtttgcctgcacgtgctgcgcctggtccagtccgtggtgctggagcctgaagtattcagtaagagcgcgtcagagttccggtctagtctgcctttgcagaggattctggccatgtcaaagtcacgaaatccgcgcctgcaaacggctgctcaggagttgctggaggacctgcgcacattagagcacaacgtttag

SEQ ID NO: 190419 - DNA, 780 bp, Artificial Sequence
  Description of Artificial Sequence: Synthetic coding sequence
atggactgcgagcacttcaaggcccggctggagaccgtgcaggccgataacattcgggagaaaaaagaaaagttggcacttcgtcagcagcttaatgaagccaagcagcagcttttgcagcaggccgaatactgcaccgagatgggggctgccgcatgcacgctactgtggggagtttcttcctccgaggaagttgtcaaggccatattgggaggagacaaagcgctgaagttcttttcaattactggccagaccatggagtccttcgtgaaaagcctggatggtgatgtgcaagagctggatagtgatgaaagccagttcgtgtttgctctggctggcatcgtgactaacgtggctgcaatcgcatgcgggcgggagtttctcgtcaacagctccagagtgctgctcgatacgattttgcagctcctaggtgaccttaagcctggacagtgcacaaagctgaaagttctgatgctgatgagcctgtataacgtttccattaatcttaaaggtctaaaatacatttcagagtcacccggctttatcccgttactttggtggctccttagtgatcccgatgccgaagtttgtctacacgtgctccggcttgtccagtctgtagtcctggagcccgaagtgttcagtaagagtgcatccgaatttaggtccagtttgcccctgcagcggatactggcgatgagtaaatcaagaaaccccagactgcagacagccgcccaggaactgctggaggatctccgcactcttgaacacaacgtgtag

SEQ ID NO: 190420 - DNA, 1479 bp, Artificial Sequence
  Description of Artificial Sequence: Synthetic coding sequence
atgcaggaggcccccgccgccctgcccaccgagcccggccccagcccagtccctgcttttctcgggaaactctgggccctggtgggggacccaggcacagaccacctcatccgctggtcaccgagcggcacatctttcctggtgagcgaccagtcccgctttgctaaggaggttctcccacaatacttcaagcacagcaatatggccagctttgtgcggcaactgaacatgtacggatttcggaaggttgtctctatcgagcaaggagggctgctcagacccgagcgggaccatgtggaattccagcatcccagttttgtccgaggtagagaacaactcttggagcgtgttagaagaaaagtgccagccctgcgcggcgatgatgggaggtggagaccagaggatctgggaagactcctcggtgaggtgcaagctctgagaggcgtgcaggaatctactgaggcccgcctcagggaacttaggcaacagaacgaaatcctgtggagggaagtggtaacattgcgccagtcccacggacagcaacatcgggtgattggcaaactgatccagtgcttgttcggacccctgcaagcgggcccttcaaatgctgggggcaaacggaagctttctttgatgttggacgaaggcagctcctgccccacaccagctaaattcaacacatgccctctccccggcgccctgcttcaggatccttattttattcaaagtcccctcccagagactaaccttggtcttagcccacaccgggcacgtggccccattatttccgacattcccgaggatagtccatctcccgaaggcaccagactgtctccgagctcggacggacggcgcgagaagggcctcgcgctgcttaaggaggagcccgccagccccggtggcgacggtgaggccggccttgcactcgccccaaatgaatgtgacttctgtgtgacagcccctccgccgctacctgtggccgtggtgcaagctattctggaagggaaaggatcattcagcccggaagggccccgcaacgcgcagcaaccagagcccggagacccaagagagatccccgaccgcggccctctgggtctagaatctggcgaccgtagtccggagtcactcctccctccaatgctcttgcaacccccacaggagtcagtcgagccagcggggccgttagacgtccttggaccgtccctgcagggcagagagtggaccttaatggacttggatatggagctttccctcatgcagcctctggtcccagagcgtggagagccggaattggccgtcaaagggctgaacagcccttccccgggaaaggaccctacactgggggccccgctgctgttggacgtccaggccgccttgggaggcccggctttaggtctgccaggggccttaactatttactcaacccccgaaagcaggacagcatcctatttggggccagaggcaagccccagcccatag

SEQ ID NO: 190421 - DNA, 1389 bp, Artificial Sequence
  Description of Artificial Sequence: Synthetic coding sequence
atgcaggaggcccccgccgccctgcccaccgagcccggccccagccccgtgcccgcctttctcgggaagctttgggcactggtcggggatcccgggactgaccatttgatacgctggtcacctagcgggacaagcttcctggtctctgaccagtctcggttcgctaaggaggttcttccacagtacttcaagcacagcaatatggcttcattcgttcggcagctgaacatgtacgggttcaggaaggtggtgtctatcgagcaggggggccttcttcgccctgaacgagatcacgtggagtttcagcacccgagtttcgtgagaggacgggaacagttgttggagcgggtccggcggaaggtgcccgctcttcgaggagacgacggaaggtggcggccggaggacctgggtaggctgctgggagaggttcaggcattacgcggggtccaggagagcaccgaggccaggctgcgcgaactgagacagcagaacgagattctctggcgagaagtggtcacgcttagacaaagccacgggcagcagcatcgggtcataggaaaactgattcagtgtcttttcggtcccctgcaagctggccccagcaatgccgggggcaagaggaaactctcactgatgctggacgagggttcatcctgtccgacgcccgcgaaattcaatacttgtccgcttcctggcgccttgctgcaggacccctacttcatacagtctcccagcacatatagcttatcgcaacgccagatctgggccttggcacttacgggacccggtgccccgtcctctttgacatcccagaaaaccctacaccctctacggggtccagggttcttaccacctgtcatggccggagctcccccaccccttcccgttgcagtcgtccaggctatcttagagggcaagggaagtttttcacctgaggggcctcggaacgcccagcagcccgaacctggagatccacgagaaattccagatcggggtccattaggcctagagagcggggacagatcccctgaatcattgctcccccctatgctgctccaaccgccacaggagtccgtagaacccgccggtcccctcgatgttctgggtccctctctgcagggaagggagtggaccctgatggatttggacatggagctttctttgatgcaacccttagttcccgagcgaggcgaaccggagttagccgtcaagggcttgaacagcccctctcccggaaaagaccctacattgggtgcccctttactgctggacgtgcaagcagctctgggcggcccggcactgggcctgcccggcgccctgaccatatattcaactcctgaatctcgtaccgcttcctacttagggccagaggcttcgccttcaccttag

SEQ ID NO: 190422 - DNA, 1251 bp, Artificial Sequence
  Description of Artificial Sequence: Synthetic coding sequence
atgcaggaggcccccgccgccctgcccaccgagcccggccccagcccagttccagcattcttaggaaagctctgggccctggtgggcgaccctggaacggatcatctgatccgatggagcccttccgggacttctttccttgtgagtgatcagtcccgattcgctaaggaggttctgcctcagtacttcaagcattctaatatggcctcattcgtgcgacagctgaatatgtacggctttcgtaaggtggtgagcattgaacagggcggacttctgaggcccgaacgggatcatgtggagtttcagcacccaagcttcgtgcgtgggagggaacagttactggaacgcgttcgccgtaaggtgcccgccttgcggggggacgatggccggtggaggcccgaagatctgggccgcctgctgggagaggttcaggccctgcggggcgtccaggaatcaacagaagcacgactcagagagctccggcagcagaatgagatcctgtggcgagaagttgtcactctccgccaaagccacggccagcagcacagagtgatagggaaattgatccaatgtctatttggccctctccaagctgggcctagcaacgccggaggaaaaagaaaattatcattgatgttggacgaaggatccagctgccccacccccgctaagtttaacacttgtcctcttcccggggccctgcttcaagatccatatttcatacagtcccctcttcccgaaaccaacctgggactgtccccccaccgggcccgagggcctatcatttctgatataccagaggactcccccagtccggaaggaactcgcctgtccccatcatccgatggcagacgcggaccacttggattggagtcgggggacaggtccccggagagcttgctgcctccaatgctgctgcagccaccacaagagtcagtggagccggcaggacctctggacgtgctggggcctagtctccagggaagggaatggacattgatggacttggatatggagttgtccctgatgcagccattggtcccagaaaggggcgagcccgaactggccgtgaaaggactaaatagtccaagccccggcaaagaccctacgctcggagcccctctgctcctggatgtgcaggcagcgttgggaggcccggccctgggtttgcccggcgctctcacaatttactccactccagagagtcgcacagccagctacctgggaccagaggccagcccatctccatag

SEQ ID NO: 190423 - DNA, 1479 bp, Artificial Sequence
  Description of Artificial Sequence: Synthetic coding sequence
atgcaggaggcccccgccgccctgcccaccgagcccggccccagcccagtcccagccttcttagggaaactgtgggcacttgtcggcgatccaggcactgaccacctcattagatggagcccctctggcacgagcttccttgtctcagaccagtcacgattcgccaaagaagttcttccacaatattttaaacactccaatatggcatcgtttgtaagacagctgaacatgtatggattcagaaaagtcgtgagcatagaacaggggggactcctcagacccgaaagggaccacgtggagtttcaacaccccagtttcgtgcgggggagggaacagctgttggagcgtgttagacgcaaggttcccgcgctgcgcggtgacgacggtcgctggagacctgaagatctgggacgcctgctgggtgaagtgcaggcactacgtggcgtgcaagaatctacggaggccaggctgagggagttaaggcagcaaaatgagatactctggcgagaagttgtcaccctccgacaaagccacggccagcagcaccgtgtgataggtaagctcattcaatgtctgtttggcccactccaggctggtccatccaacgcaggcgggaagaggaaactgagcctgatgctcgatgagggtagttcatgcccaacccctgccaagttcaacacctgtccactccccggcgcccttcttcaggatccatattttattcagtcacccctccccgaaacaaatctggggcttagccctcaccgcgcccgggggcctatcattagcgacatccccgaggacagccctagcccagagggtacacgactctccccaagttccgatggacgccgggaaaaggggctggcacttctaaaggaagaacctgcttctcctggtggtgatggcgaggccgggctcgctctggcacccaacgagtgtgacttctgcgttaccgcccctcccccgctgcccgttgcagtggtacaggcaattctcgaaggtaaagggagcttcagtcccgaggggcctcgaaacgctcagcaacccgagccaggtgacccacgggagatcccagatagaggtcctctggggcttgaatccggcgaccggtcccctgagtccctccttcccccgatgcttttgcagccgcctcaggagtcagtcgagccagctggccctcttgacgtcctgggcccaagccttcagggaagggagtggacactgatggatttggacatggaactgtcacttatgcagcctctggttcccgaacgcggcgagcccgagctggccgtaaaggggcttaatagcccttcacctggaaaagatccaacactaggggctccactgcttttggatgttcaggcagctctaggggggccggcgcttggattgcccggcgctctcacaatctatagcacacccgagtccaggacagcttcttatcttggccctgaagcctcccccagcccctag

SEQ ID NO: 190424 - DNA, 9 bp, Artificial Sequence
  Description of Artificial Sequence: Synthetic coding sequence
atgcagtag

SEQ ID NO: 190425 - DNA, 414 bp, Artificial Sequence
  Description of Artificial Sequence: Synthetic coding sequence
atgagcagcctgatccggcgggtgatcagcaccgccaaggcccccggggcaataggtccctattcccaggcagttctagtggaccgcactatttacatcagcggccagattggcatggatccaagtagtgggcagcttgtctcgggaggtgttgccgaggaagccaaacaggctctgaagaatatgggcgaaatcctcaaagcagcgggatgtgatttcaccaacgtcgtgaaaactacagtgttgctagctgacattaatgatttcaacacagtgaatgaaatatataagcagtatttcaagtccaatttcccggcccgggctgcttatcaggtggccgccctccccaagggcagtcgaatcgagatcgaagccgtggctattcaaggacccctgacaacagccagcttgtag

SEQ ID NO: 190426 - DNA, 14505 bp, Artificial Sequence
  Description of Artificial Sequence: Synthetic coding sequence
atgcccagcgagagcttctgcctggccgcccaggcccggctggactcaaaatggttaaaaactgacattcaactggcttttactcgagacggcttatgcgggctctggaatgagatggttaaggacggtgagatagtttatactggtacggaaagcactcagaacggagaacttccacccaggaaggatgacagtgtggaaccctcagggactaagaaggaggatctgaacgataaagagaagaaggacgaggaggaaacccctgctcctatttatcgcgctaagtcaatacttgattcctgggtctgggggaaacagccggacgtaaacgagctgaaggaatgtctctctgttctggtgaaggagcaacaggccctagctgtccagagtgcaactaccacactctcagcgctgcggttgaaacaacgcttggtcatcctggagcgctactttattgcactcaatagaacagtgttccaggagaatgtcaaagtgaagtggaaatcttcaggcataagtctcccaccagtcgacaagaaatcctcaaggcctgcgggaaagggtgtggagggtctggcaagagtggggtctcgcgcagccctttcttttgcttttgcattcctcagacgcgcatggcgctccggcgaagatgccgatctgtgcagcgagctgctccaggagtccctagatgcattgcgagcactgcctgaggctagcctgtttgatgaatctacagtgtctagcgtgtggctcgaggtggtcgagcgcgccaccaggtttttgcgttctgtggtgacaggagatgtccatggtacacctgcgacaaaaggcccaggcagtattccattacaggatcagcatctcgcgctagccattctgcttgagctggctgtacagcggggcacgttgtcccagatgcttagcgcaatcctgttgctgctccagctttgggactctggagctcaggaaacagataacgagagaagcgctcaaggcacctcagcccccctgctcccactgctccagcgcttccagtccatcatttgtaggaaagatgcgccgcatagcgagggagatatgcatctgctgtccggtccactgtcacccaacgaaagcttcctcagatatctaacactgccccaagataacgaactggccattgacctcaggcagacagctgtggtcgtgatggctcacctcgatcggctggcaacaccctgcatgcctcccctctgctcttcccctacaagtcacaaaggcagcctccaggaggtgattggctggggactgattggatggaaatattatgctaatgtcattggaccgatacaatgtgaggggctcgcaaatcttggcgtaacccagattgcctgtgccgagaagagattcctgattctgagcaggaacggaagagtgtacactcaggcatataattctgacacccttgcaccccagttggtgcagggcctcgctagtaggaacattgtgaaaatcgcagcacacagtgatggccatcattatctcgccctggcagctaccggagaggtgtacagttgggggtgcggagatggtggtcgtctcggccacggagatacagtaccccttgaggagcctaaagttatctctgcattcagcggcaagcaggcagggaagcacgttgtacacatagcttgcggctccacctattccgccgcaataaccgcggagggagagctgtacacctggggcaggggcaactacggcagacttggccatggttcatccgaggacgaagccataccaatgctggtagccggcctgaaaggtctgaaggtgatcgatgtggcttgcgggtcaggcgatgcccagacactggcagtcaccgaaaatggacaagtgtggagctggggggacggtgattatggtaaacttggtcgaggcggctctgacgggtgtaaaacaccgaaattgatcgagaaacttcaggatctggacgttgtcaaagtccgatgcgggtcccagttttccatcgcactgaccaaggatggacaggtgtacagctgggggaaaggggacaaccagcggctcggccacgggacggaggagcacgtacggtaccctaagctactggaggggctccaggggaaaaaggtcattgacgtggccgccggttcaacacattgcctagccctgaccgaggacagtgaagttcattcgtggggctcgaacgaccagtgtcaacacttcgatactctgcgggttaccaaaccggaacctgctgccctgcccggactcgacaccaaacacatagttggtatagcatgtggcccagcccaatccttcgcttggagcagctgctctgaatggtccataggcctacgagttcctttcgtggtggacatctgctccatgacttttgaacagttggatctgctgctcagacaggtcagtgagggcatggacgggagcgctgactggcctcctcctcaagagaaggagtgcgtggcagttgcaactctgaacttgctccggttgcagttgcacgcagcgatcagccatcaggttgatcctgagttcctcgggctcggtctggggagcattctgctgaactcactgaagcagactgtcgtcacactggcaagttcagccggtgtactttctactgtgcagtccgccgcccaggccgtcctacagtccggctggtccgtccttctccccacagcagaagaaagggccagagccctgtccgccctcctgccttgtgccgtatcgggtaacgaagtgaatataagcccaggacgtcgattcatgattgacctgcttgtgggtagtctgatggccgacggtggcctcgaatctgccttgcatgctgctattaccgcagaaattcaggatattgaggcaaaaaaagaagcgcagaaagaaaaggagattgatgagcaggaggcaaatgcaagtacgtttcaccgcagccgcaccccgctggacaaagatctaatcaatactggtatttgtgaaagcagcgggaagcagtgcctgccactcgtacaactgattcagcagctgcttaggaacatagccagccaaaccgttgccagactgaaagatgttgctaggagaatttccagctgccttgacttcgagcagcacagcagagaacggagcgccagtctagatctgctcctgagattccagagactgctgatctctaaactgtaccccggcgagtccataggtcagacctctgacattagttcaccggagctgatgggggtaggaagtctcctgaagaagtacacggcgttactgtgcacacacattggagacattttacctgtcgcagcttccatcgcttcaaccagctggcgacactttgctgaagtcgcttacatcgtcgaaggggacttcaccggcgttctgcttcccgaactggtcgtgagtatcgtgttgttgctgtccaagaatgctgggctcatgcaagaagctggggcagtgcccctgctggggggccttctggagcacttggaccgctttaaccacctcgctcctggaaaggaacgcgacgatcatgaagaactggcatggcctgggataatggagagtttctttacgggacagaactgcagaaataacgaggaggtgactttgattaggaaagctgatttagaaaaccacaataaagacggaggtttctggacagtcatcgacgggaaggtgtatgacattaaggacttccagacccagagcctaaccggtaatagtatcctcgcccagtttgctggcgaggacccagtggttgccctagaagctgcactacaattcgaggacactcgggaaagcatgcacgcattctgcgttggacaatatctagagccagaccaagaaatcgtgaccatacctgatctgggctcactgagctcacctctgatagacacagaaagaaatttgggacttctgttggggttgcacgcctcatacctcgctatgagtacacccttgtccccagtggagattgagtgcgcaaagtggctgcagtcttccatttttagcggcggccttcagaccagtcaaatccactactcgtacaatgaagaaaaagatgaagatcattgcagcagtcccggaggcacacccgctagcaagagccgactctgtagtcataggagggccctcggcgatcactcacaggcatttctccaggcaattgccgacaacaatattcaggaccacaacgtgaaagacttcctttgccagatcgaaagatactgtagacagtgccacctgacaacaccaattatgtttcctcctgaacatcctgttgaagaggtgggtagactgctgttgtgctgcttgcttaagcacgaggatctcggccatgtggctctttcactggttcacgcaggggctctcgggatcgaacaggttaaacacaggacgctacccaaatcggtggtagacgtatgcagagtggtctatcaggccaagtgctctttgatcaagacccaccaggaacagggacggtcttataaagaggtgtgcgcgcctgtgatcgaacgccttcggttccttttcaacgagctgagaccagctgtttgtaatgatctgtccattatgtctaagttcaagttgctgagcagcctacctagatggaggagaatagcccagaagataatacgggagaggaggaaaaagagggtcccaaaaaaaccagagagcacagacgatgaggagaaaattgggaacgaggaatcagatctggaagaagcgtgcattctgccccactccccgatcaacgtcgataagagacctattgcgattaagtcccctaaagacaagtggcagcctcttctgtccacggtgaccggggtgcataaatataaatggctgaaacaaaatgtgcagggcctttatccgcagagccccctgctgtctacaatcgccgagttcgccctgaaggaggagcctgtggacgtcgagaaaatgcgaaaatgcttgctgaagcaactggagagggccgaagtgagactggagggtatcgacacaatactgaagctagcaagcaagaattttctgctcccctcagtgcagtatgccatgttttgtgggtggcagcggctgatccctgaaggaatcgatattggagagccccttactgattgtttaaaagacgtagacctcattcccccattcaaccggatgctgctggaggtcacatttgggaagctttacgcatgggcagtgcagaatatccggaatgtgcttatggacgctagcgcaaaattcaaggagctgggcattcagccggtgccgttgcagaccatcacaaatgagaacccatccgggcctagtctcggcaccattccacaggcaaggttcttgctcgtgatgctgtctatgctcaccttgcagcacggcgcaaacaatttggatctgctgctaaatagcggaatgcttgccttgacacagactgccctgcgcctcatcggcccgagctgtgacaacgtggaagaggatatgaacgctagcgctcaaggggcctccgccaccgttttggaagagacacggaaagagacagccccagtacagctccccgtttctggcccagagctcgccgctatgatgaaaatcggcacaagagtcatgaggggagtggattggaagtggggcgaccaggacggaccccccccaggcctcggacgcgtaatcggagagcttggagaagatggctggatccgggttcagtgggatactggatctaccaacagctatcgcatgggcaaggaaggcaaatacgaccttaaacttgccgaactgccagccgcggcacagccgagcgcggaggactcagacactgaagatgacagcgaagcagaacagaccgagagaaacatccatcctacggctatgatgtttacctctacaattaacttgctgcagaccctgtgcttgagcgctggcgtccacgctgagatcatgcagtccgaagccactaagactctatgcggattgctgagaatgctggtggagtccggtaccactgacaaaacctcatccccaaatcggcttgtctaccgagagcaacaccgatcatggtgtaccttaggtttcgttcggtcgatcgctctgacgcctcaagtctgtggcgctctgagtagtccccagtggatcacactgctgatgaaggtggtagaaggacatgctccatttaccgcgacctccctgcagcgccagatcctggctgtccacttacttcaggccgtattaccgagctgggataagacagaaagagcccgggacatgaagtgtttagtggagaaactcttcgacttcctgggctccctgttgaccacctgttcttcagatgtgccattgctccgtgaatccactctgcgacgccgaagggtgcgaccccaggcctccctgacagccacacacagtagcactttggcagaggaggtggtagctctgctgcggaccctgcattccctaacccagtggaatgggttgatcaacaagtatatcaactcccagcttcggtctattacgcatagctttgtcggccgaccctccgagggtgcacaactggaggactacttcccggattcagagaaccccgaagttgggggcttgatggcagtcttagctgttatcggggggatcgacggaagacttcgccttggggggcaggtcatgcatgatgagttcggggagggcacagtgacccggattacaccgaaaggcaaaattaccgtgcagttcagtgacatgcgcacctgccgtgtgtgtcctctcaatcagctgaaacccctgccagcggtggcctttaacgtcaacaacttgccctttactgaacccatgttgagcgtgtgggctcagcttgtaaaccttgccggctctaaacttgagaagcataaaatcaagaagtcaaccaaacaggcattcgccggtcaggtggatctcgatctcctcaggtgtcagcagctgaaactttacatcttgaaagcaggaagagcgcttctgtcgcaccaggataaactgcgtcagatattgtcccagccagcagtgcaggaaacgggaactgtgcacacagatgacggcgcggtcgtatccccggacctgggcgatatgtcccccgaaggtcctcagccccctatgatcttacttcagcaactacttgcctccgctacccagccatctcctgtgaaagctatatttgataagcaagaacttgaagccgccgctctagctgtgtgtcagtgtctggccgtcgagtcaactcatccttccagcccaggcttcgaggattgctcgtcctcagaggccactacacccgtggctgtgcagcacatccggccggctcgggtaaaaaggagaaaacagagtcctgttcctgcattgcccatcgtggtgcagctgatggagatgggctttagcaggcgtaatattgaatttgcgctgaaaagcctaactggagcatccggaaatgccagcagcctaccaggcgtcgaggcccttgtgggctggttattagaccatagtgatatccaagtcaccgaactgtctgacgccgacactgtcagcgacgagtactctgatgaagaggtagtggaggacgtagacgatgctgcatacagcatgagcacaggagccgttgtcacggagtctcaaacttacaagaagcgggccgatttcctttcaaatgatgattacgccgtctatgtacgagagaatatccaggtgggaatgatggtcaggtgttgtagagcatacgaagaggtttgcgaaggggacgtgggcaaggttataaagctagacagggatggactgcacgatctgaacgtccagtgcgattggcagcaaaaggggggtacatactgggtaagatacatacacgtggaattaattggatacccccctccaagctcctcaagccatatcaaaatcggggacaaggtgcgggtgaaggcgagcgtgacaacccctaagtacaagtgggggtctgtcactcatcagtccgtgggagtggttaaagcgttttcggccaacggaaaggatatcatcgtcgattttcctcagcaatcacattggaccggccttttgtctgagatggagctcgtgccgagtatacaccctggagttacttgcgacgggtgtcagatgttcccgataaatggctcccggttcaagtgcagaaattgtgatgatttcgacttctgcgaaacatgtttcaaaacaaaaaagcacaacactcgccatactttcggaaggatcaatgaaccagggcaatccgctgtgttctgtggacgctctgggaagcagcttaagcggtgtcacagctcacaacctgggatgctgttggacagttggtctcgaatggttaagtcgctgaatgtcagctcgagcgtgaaccaagcctcaaggttgatcgacggcagtgaaccgtgctggcagtcttctgggagccaggggaagcactggatccgcttggagatttttcctgacgtcttagttcacaggcttaaaatgattgtagatccagccgattcctcatatatgccatctctggtggtcgtatccggaggcaactccctcaataaccttattgagttaaagactatcaacatcaatccgtccgatacaacggtgccgctactaaatgattgtacagagtatcatcgttatatcgagatcgccattaaacagtgtcggtcttccgggatagactgtaagattcacggactgatcttgctgggtcgtatccgcgcagaagaagaagatctcgctgcggtcccttttctcgcttctgacaatgaggaggaggaagatgaaaaagggaattccggctcgctgattcggaaaaaagccgcaggactcgagtcagctgctaccatacggaccaaggtctttgtgtggggacttaacgacaaagatcaattgggcggcttgaaggggagcaaaattaaagtcccctctttctccgaaactctttcagcactcaatgtggttcaagtcgccggcggttccaaaagtttgttcgccgttaccgtagagggaaaggtgtatgcatgcggagaggctacgaacggcagactcggattgggaatcagctccggcaccgtcccaattccaagacagatcaccgcactctcaagctatgtggtgaaaaaagtggccgtacattccggcgggagacacgcgactgctctaacagttgacggcaaagtctttagttggggcgagggagacgacggaaagctcggtcactttagcagaatgaattgcgataagcccaggctcatcgaggcccttaagacaaaaagaatccgcgacatagcatgtggctcaagccattccgctgcccttacctcaagtggcgagctgtatacttgggggttgggagaatatggtcggctcgggcatggcgacaataccacacagctgaagcccaagatggtaaaggtccttctcggtcatcgagtgattcaggttgcttgtggcagccgtgatgcgcagactcttgccctcacggatgaggggctggtcttctcatggggcgacggagacttcggtaagttggggagggggggatctgaggggtgtaacataccccagaacattgagagattgaacggacagggtgtttgtcagatcgaatgcggggcacagttttctcttgcacttaccaaaagtggggtggtctggacctggggaaaaggggactatttccgcttgggacatggcagcgatgtacacgtccgaaaacctcaggttgtggaaggtcttaggggcaaaaaaatcgtccacgttgctgtgggggcactccattgccttgcagtcacagatagcggacaagtttatgcctggggggacaatgatcatgggcagcaagggaatggcaccactaccgtaaataggaagccaaccctggtccaagggctggagggccagaagatcacccgagtggcctgtggatcatcccactccgtcgcctggaccactgttgacgtcgcaacgccatccgtgcacgaaccagtcctgttccaaacagctcgggatccactgggggcctcctatttgggcgtaccttctgacgctgactccagtgctgcttccaacaaaatctcaggagcaagcaactctaagcctaatagacccagcctcgctaagatcctgttatcactggatgggaacctcgcaaaacagcaggcactgtctcacattttgaccgccctgcagatcatgtatgcccgtgacgccgtggtcggcgccctgatgccggccgcgatgatcgcacctgtcgagtgccccagtttctctagtgctgccccgtctgatgcgagtgcaatggcgagcccaatgaatggtgaggaatgtatgctggctgtcgatatagaggaccgactgtccccaaacccctggcaggagaaacgggagatcgtgagtagtgaagatgcggtgacccctagcgccgttacgcccagcgctccatctgcttctgcacgccccttcataccagttaccgacgatttgggagctgcctccatcattgcagagacgatgactaagaccaaggaggacgtcgaaagccagaacaaggcagctggccccgaaccacaagctctggacgagttcacctctttattaatcgcagatgacacgcgggtggtcgtggacttactgaaactgagcgtgtgtagcagagccggggatcgaggacgggacgtactgtctgcagtcctctctggcatgggcacagcctatccacaagtcgccgacatgctgctagaattatgcgtgacagaactcgaggacgttgcaacagattcacagagtggacggttaagcagccagccggtcgtcgtggaatcaagccacccgtacacagacgatactagcaccagcggcactgtaaagattcccggggccgagggcttgagggttgaatttgacagacagtgcagtactgagcggcgtcacgacccccttacagtgatggacggagtcaatcggatcgtctccgtgaggtcagggagggagtggtcagactggtcaagcgagctcagaatccctggtgacgaattaaagtggaagttcatctctgatggcagcgtgaacggctggggttggagattcacagtgtacccaataatgccagctgccggtccaaaggagctcctcagcgatcgatgcgtgctgtcttgcccatctatggatctggttacctgccttctcgattttaggctcaacctggcctctaaccgcagcattgttccccgcctcgcagcctccttggcggcatgtgctcagcttagtgcccttgccgctagtcatagaatgtgggctttacagagactcagaaagctgctgactactgagtttggacaaagcattaacatcaatcgccttttgggcgaaaacgatggggagacccgggctctgtctttcaccggatcagctctagccgcgctagtgaagggcctgcctgaggctctccaaaggcaattcgagtacgaggaccccattgtgcgaggtgggaagcagctgctccactctcccttcttcaaagtcctggttgctcttgcctgcgacctggagcttgacactctgccctgctgcgcagaaactcacaaatgggcctggttcaggaggtactgtatggcctcccgcgtggcagtcgctctggacaaaaggacacctctgcctcgcctgttcctcgacgaagtggccaaaaagatcagggaactcatggctgatagcgaaaacatggatgtgcttcacgaatctcacgatatcttcaagagggagcaagacgaacaactcgtgcagtggatgaacagaaggccagatgattggacactatccgcgggaggctctggaacaatctacgggtggggtcataatcatcgaggtcagctgggcggaattgagggggctaaggtgaaggtgcccactccatgcgaagccctggctaccctgcgacccgtgcagctcatcggcggcgagcagacgcttttcgccgtgacagccgatggaaagctgtacgctacaggatatggcgccggagggaggctgggcattgggggaactgagtccgtttcgactccgaccttgctagagtcgatccagcacgtctttatcaaaaaagtcgcagttaattccggaggcaagcattgtctcgcccttagctctgagggtgaggtctactcttggggggaggcagaagacggaaaactcggtcatggtaatagaagcccctgcgaccgtccgcgagttattgagagtctccgtggcatcgaggtcgtggacgtagctgctggtggcgcgcacagtgcttgtgtaaccgctgccggagatctatatacttggggcaagggccggtatggccgcctaggacacagtgattcagaggaccagttgaaaccaaaactcgtcgaggccctgcagggccaccgcgtggttgacattgcctgcgggtcgggggacgcacaaaccttatgcttaaccgacgatgacaccgtatggtcttggggggatggcgattacggcaaactgggtcggggaggcagcgacggctgcaaggtcccgatgaaaatagatagccttacaggcctgggagtcgtgaaggtggaatgcggctctcaatttagtgtcgcgctgaccaagtcgggcgccgtttacacctggggtaagggtgattatcacaggttgggccacggatccgacgatcatgtcaggcgcccgcgccaagtgcagggcctccaaggaaagaaggtgatcgcaattgctacagggtccctccactgcgtgtgttgcaccgaggatggggaggtgtacacatggggtgataacgatgaaggtcagttgggcgatgggacgactaacgcgatacaacggccgaggttagtggctgctctgcaggggaagaaggtgaaccgcgtggcctgcggctcagcacatacactcgcttggtcaacctcaaaacctgctagcgccggcaagctgccggcacaggtgcctatggagtacaatcacttgcaagagatacccatcatcgcgctgcggaacaggctgctcctgcttcatcaccttagcgagctgttctgtccgtgtattcccatgtttgacctggaaggcagtctggacgaaaccggcctcggacctagcgttgggtttgacacgttgagaggcattctgatcagccagggcaaagaggcggcattcaggaaggttgtccaggctacaatggtaagggataggcagcacggccccgtggtggagctgaataggatccaggtgaaacgcagtaggtctaaaggaggtctggcgggacctgatggcacaaagagcgtgtttggccagatgtgtgcaaaaatgtcctcttttggccccgacagtctccttctgccacacagggtgtggaaggtgaaatttgtaggcgagtcggtcgatgattgtggcggggggtattcagaaagcatcgccgaaatttgcgaggaactgcaaaatggattaactccgctgctcatagttacccccaacggtagggatgaatcaggagcgaatagagattgttacctgttatcgcctgcagctagagcgccagtacactctagcatgtttcgcttcttgggcgtgctgctcgggatagcaatccggacaggctcaccattgagtttgaacctagccgaacccgtgtggaaacaactcgcaggaatgtcccttaccatcgccgacctctccgaggtggacaaggactttatccctggcctgatgtatatcagggacaacgaagccaccagtgaggaatttgaagccatgtccctgcctttcaccgtgccaagcgccagtggtcaggacattcaactgagctccaagcacacccatattacactggacaatcgagcagagtacgtccgactggcgataaactatcggctgcacgagttcgatgagcaggtggcagccgtgagagaagggatggcacgcgtcgtccccgtccctctgctcagcctgttcactggctatgagctcgagacaatggtgtgcggcagcccagacattcctctgcatcttctgaaaagcgtggcgacgtacaaggggatcgagcccagtgcttctttgatccagtggttttgggaagtcatggaaagtttctctaacactgagaggtccctcttcctgagattcgtttggggaagaacgcgattgcccaggaccattgccgactttcgaggcagagatttcgtcatacaagtactggataagtataatcctccggaccactttctgcccgaaagttatacttgtttctttctactgaagctgcccagatactcctgtaaacaggttctggaagaaaaacttaagtatgccatacatttttgcaaatcaatcgacactgatgattatgctaggatcgctctcaccggcgagcctgcagctgacgactccagcgacgacagtgataatgaggatgttgatagttttgcatccgactctacacaagattacttgaccgggcattag

SEQ ID NO: 190427 - DNA, 3075 bp, Artificial Sequence
  Description of Artificial Sequence: Synthetic coding sequence
atggagcggcggagccggcggaagagccggcggaacggccggagcacagctggtaaagcagccgccacacagcccgccaagtcgcctggagctcagttatggctgttccccagtgcggccggtctacacagggcattgctgcggagggtagaagtaacgcgtcagctatgctgcagccctggacgtctagccgtcctcgaaagaggaggcgccggcgtccaggtgcatcagttgcttgcaggaagcgggggcgcccgcacccccaaatgcataaagcttggaaagaatatgaaaatacattccgttgaccagggcgccgagcacatgctgatcctgtcatccgacggcaaaccctttgagtatgataactacagtatgaagcatttgcggtttgagtcgattctgcaggagaagaaaatcatacagatcacttgcggtgactatcactcgctcgccttaagtaagggcggcgaactgttcgcatgggggcaaaatttacatgggcagctcggcgttggacgaaaatttccatccaccaccactccacagatcgtggaacacttggccggcgtgccactggcacagatcagcgccggcgaggctcactccatggccctgtcaatgtctggcaacatatacagctgggggaagaacgagtgcggtcaactcggactgggtcacaccgagagcaaggacgacccatccctgatcgaggggcttgacaatcagaaggtggagttcgtggcatgcggtggatcccacagcgcacttctgactcaggatggccttctctttacttttggcgctggcaaacatggccagctgggtcataactctacccagaacgagctgcgaccctgcctcgtggccgaactggtgggttatagggttacccagatcgcctgtggccgctggcatactttggcatatgtgagcgatctggggaaggtgttcagcttcggaagtggaaaggatggccagctgggaaatgggggcacacgtgatcagctgatgcctttgccagtcaaggtctcctcttccgaagagctgaaactggaatcgcacacctctgaaaaagaattgatcatgatagcagggggcaatcagtctatactcttgtggattaagaaggagaactcatatgtaaatctgaaacggaccattccaaccctaaacgaaggaacggtcaagagatggattgctgatgtcgagaccaaacgctggcagtcaaccaagcgcgagatccaagagatcttctcttctcctgcctgcctaacggggtcttttctgcggaagaggagaaccactgagatgatgcctgtgtacctggatctcaataaggctcggaatatctttaaggagctgacccagaaggactggattaccaatatgatcaccacatgtttgaaagataatctgctaaagcggctgccattccattcgccaccacaggaggctcttgaaatattttttctattgcccgaatgccccatgatgcatatatcgaataattgggagtccctggtagtgccctttgctaaagtagtctgcaagatgtcagatcagtcctcgctggttcttgaggagtactgggctactttgcaggaatcaaccttttctaagttggtccagatgttcaaaacagcagtaatctgccagctagactactgggacgaaagtgcagaagaaaatgggaatgtgcaggccctccttgagatgttgaagaagcttcaccgcgttaatcaggtgaagtgccagttgcccgaatccatattccaggtggacgagttacttcaccgcctcaactttttcgtggaggtctgccgccgctacctctggaaaatgaccgttgacgccagcgaaaacgtgcagtgttgtgtgattttttctcacttccctttcatttttaataatttgtctaagatcaagttattacacacagacaccctgctgaagatcgagtccaagaagcataaggcctatcttcgctcagcagctatcgaggaggagcgcgagagtgaattcgctctccgcccaacatttgacctgacagtcaggaggaaccaccttatagaggacgtgttaaaccagctgagtcagttcgagaacgaagatctcagaaaagagttatgggtgagcttctctggtgagatcgggtatgatctgggaggggtgaagaaggagtttttctactgtctgttcgctgagatgatccagcctgaatatggcatgtttatgtacccagaaggtgctagctgtatgtggtttccggtcaagccaaaatttgaaaaaaaacggtatttcttctttggcgtgctgtgcggactgagcctcttcaactgcaacgtcgccaacctcccgttcccccttgcactctttaaaaagttgttagatcaaatgcctagcttggaggacttgaaggaactatctccagacctggggaagaacttgcagacattgctggatgacgaaggtgataatttcgaagaagttttttacatccacttcaatgtgcactgggacagaaacgacaccaatttgatcccgaatgggtcttccattacagtgaatcagactaacaaacgtgactatgtgagcaagtatatcaactatatattcaacgactccgtgaaagccgtgtatgaagagttcaggcgtggtttctataagatgtgtgacgaggatattataaaactttttcatccagaggagctgaaggatgtgatcgtcggcaataccgattatgactggaaaaccttcgaaaagaacgcacgatatgaacctggctacaatagttctcacccgacaatcgttatgttctggaaggcattccacaaactgactctggaagagaaaaaaaagttcttggtgttcctgacaggtacagaccgactgcagatgaaagatcttaataacatgaagatcacattctgttgtcctgagtcctggaacgagagagacccaatccgggctctgacatgcttctccgtgctgttccttccaaaatacagcaccatggaaactgtcgaggaggccttgcaggaggctattaacaataataggggtttcggatag

SEQ ID NO: 190428 - DNA, 1854 bp, Artificial Sequence
  Description of Artificial Sequence: Synthetic coding sequence
atgggccccaccctggccgtgcccaccccctacggctgcatcggctgcaaactgcctcagcccgagtatcctcccgccctaattatcttcatgttctgcgccatggtgattaccatagttgtcgatctgataggcaatagcatggtcatactagcagtcaccaagaataagaagctcagaaactccggtaatatctttgtggtcagtctgagcgtcgccgatatgcttgtggcaatttacccatatccattgatgctgcatgccatgagcatcggcggatgggatctgtcccagctgcagtgccagatggttggctttatcacaggactctcggtggtgggcagcatctttaatattgtagcaatcgctattaaccgctactgctatatttgccattcattacagtacgagcggatcttttctgtgcggaacacttgcatttacctcgtcatcacttggattatgaccgtgctcgcggtgttgccgaatatgtacatcggtactattgagtacgacccccggacttatacttgtatcttcaactatctgaacaatcccgtgtttaccgtcacgattgtctgcattcatttcgtcctgcccttactgattgtgggattttgttatgtgcgaatctggacaaaggtgctggctgctcgcgaccccgcgggtcaaaatcctgacaaccagctggccgaggtgcgcaacttcctaacaatgttcgtgatctttctcctgtttgccgtctgttggtgtcctataaacgttctgacggttctcgtggcggtttcccccaaagaaatggcaggcaaaatccccaattggctgtatctagctgcctatttcatcgcctattttaactcttgcctgaatgccgtgatttatggcctgctgaacgaaaactttagacgggaatattggactattttccacgccatgcgtcacccaatcatttttttttccggattgatttccgacatcagagaaatgcaggaggctcggaccctggcacgggcccgtgctcacgcacgtgatcaggctcgggaacaggatcgggcacacgcctgtcctgccgttgaggagaccccaatgaatgtccgaaacgtccctctgccaggtgacgcagcagcaggacaccccgatagggctagcggccatcctaagccgcactcaaggtccagctcggcttaccgaaagagcgcttcaactcaccacaaatccgtattctctcattcaaaagctgcaagcggccacctgaagccagtatccggacactcgaaacccgccagtggacatccaaagtcagcgactgtttaccctaaaccggcatccgtccatttcaaggcggacagcgtacacttcaagggagattctgtgcactttaaacccgatagcgttcacttcaagccagcatctagtaatcctaaacctatcaccggccatcacgtaagcgccggctctcatagtaaatctgcattcagtgccgcaacctcacaccccaagccaactaccggccacatcaaacccgctacctcacatgccgagcccacaacagcggactaccccaagccggccactactagccaccccaaacctaccgcagccgataatcctgagctttctgccagtcactgccccgagatccctgcaattgcccatcccgttagcgacgattcagatttgcccgagtctgccagcagccccgcagctggacccaccaaacccgcagcatctcaacttgaaagcgacacaatcgcagaccttcctgaccccacagtggtgacgacaagcaccaacgattatcatgacgtcgtggtgatcgatgtggaggacgatcccgatgagatggccgtatag

SEQ ID NO: 190429 - DNA, 13125 bp, Artificial Sequence
  Description of Artificial Sequence: Synthetic coding sequence
atgaaggtggaccggaccaagctgaagaagacccccaccgaggccccagccgactgccgcgcacttatcgataaactcaaggtatgtaacgatgaacagctgctgctcgaattacagcagatcaagacctggaacattgggaagtgcgagctgtaccactgggttgacctcctagatcgcttcgatggcatcctggctgacgctggacagactgtggagaacatgagctggatgctggtgtgtgatagacccgaaagagaacaactgaaaatgctgctgctcgccgttctgaattttaccgctctgctaatcgaatacagttttagccgccacctgtactcatctatcgagcatctgactacactgctggcctcttcagacatgcaggtggtacttgcagtgctgaacctcctttacgtcttttcgaagcggtcgaattacattacccgcctgggatctgataagaggactcccctcctgacccgtctacagcatctggccgaatcttggggcggtaaggagaatggcttcggactcgcagaatgctgccgggatctgcatatgatgaagtatcccccttcggcgaccactttgcacttcgaattctatgctgacccaggagcagaggttaaaattgaaaagagaacaactagcaataccctgcattatattcatatcgagcagctggacaaaatcagcgagtccccgagcgagataatggagagtctgacaaaaatgtacagcatccccaaggacaaacagatgctgttgtttacacacattaggctggcccacgggtttagtaatcaccgcaaaaggctccaggcagtccaagcacgattgcatgcaatctctattctcgtctactccaatgctctccaggaatctgccaacagcattctgtacaacggcttgattgaggaactggtcgatgtgctgcagatcaccgacaagcagctgatggagattaaggctgcatctttaaggacattaacctccatcgtccacttggagcggacgcctaaactgtcctctattattgattgcaccggtacagcgtcatatcatggcttcctgccagtactggtgagaaattgtattcaggccatgattgacccctctatggacccttatccccatcaattcgcaacggcgttatttagcttcttgtaccatctggcctcgtacgatgcaggaggagaggccctcgttagctgcgggatgatggaggcactccttaaggtaataaagttcttgggtgacgagcaggaccagattacgtttgtcacccgggcagtgagggtcgtagacctgatcacaaacctggacatggccgcttttcaatcacattctggcctgagtatcttcatctacagactggagcacgaagtggacctgtgtagaaaagagtgcccttttgtgatcaaacctaaaattcagcggcctaatacgacgcaggagggcgaagaaatggaaaccgacatggacggcgtccagtgcataccacagagagccgcactcctaaaatccatgcttaacttcctgaaaaaggctatacaggatcccgctttctcggacggcattcggcacgtcatggacgggtctctgcctactagtcttaagcacattatcagcaacgccgaatattatgggccaagtctgttcctcttagcaacagaggtcgtgaccgtgtttgtttttcaggaacccagccttctatcctcactgcaggacaacggactaactgatgtgatgttacatgcgctgctgataaaagacgtcccggccaccagggaagtgctggggagtcttcccaacgtattttctgcactgtgtttgaacgctagagggcttcaatcgttcgtccagtgtcaaccgtttgagcgtttgttcaaggtgctgctctcacccgactaccttcctgcgatgcgtcgccgacgctcctcagatccactgggagatacggcgagcaacctgggaagcgctgtggatgagctcatgcgccatcagccaaccctaaagacagatgctaccaccgctatcattaagcttctcgaggagatctgcaatctcgggcgagaccctaaatacatttgccagaagccaagcattcagaaggccgacggcactgcaacggctcctccgcctcgcagcaaccacgcagcggaggaagcatcatctgaggacgaagaggaagaggaagttcaggccatgcagtcttttaattcaacccagcagaacgaaactgagccgaaccaacaggtcgtaggtaccgaggagcgcattcccattcccctgatggactacatcttgaacgtgatgaagtttgtggagtctattctgtccaataatacgaccgatgaccattgtcaagagttcgtgaaccagaaggggcttttgcccctggtgacaatccttgggctcccaaacctaccgatcgacttccccaccagcgccgcttgtcaggcagttgcgggcgtgtgcaagagcattctaacattgagccacgagccaaaggtgctccaagaggggctactccagctggactcgattcttagtagtttggaacctcttcacaggcccatcgaaagcccaggcggatctgtgctgttacgcgagctcgcctgtgcaggcaacgtcgctgacgcaactttgagtgcccaggcgacacccttgctgcacgctttgaccgctgctcacgcttacattatgatgtttgttcatacatgccgggtcgggcagtcagagatccgctctatttctgtaaatcaatggggaagccagttaggccttagtgtactgtccaaactgtcacaactttactgctcactggtatgggaaagcacagttttgctgtccttgtgcactcctaattctctccccagcggatgcgaattcggtcaggccgacatgcaaaagctagtccccaaagacgagaaggcaggaacgacccaaggagggaaacgtagcgacggcgagcaggatggggcagccggaagtatggatgcatcaacacagggcctgctggaaggcataggactggatggcgatactctcgcccccatggagactgacgaaccaaccgcgagcgactccaagggaaaatcaaagatcacccccgccatggccgcaagaatcaagcagatcaagcctctgctgagtgcgagtagtcgcctaggacgggctctggccgaactgttcgggttactggtgaagctatgcgttggaagtcccgtccgccagcgcaggagccaccatgctgcctctaccaccacagcgccaacaccagcggctagatcgacagccagcgctctcacaaagctgctgacgaagggcctaagttggcagccccccccctacacccccacccctagattcagacttactttctttatctgctcagtgggttttacatctccaatgctgttcgacgaaaggaagtatccctaccacctgatgctgcaaaaattcctgtgtagcggcgggcacaacgcattattcgagacctttaactgggccctgagcatgggcggtaaagttcccgtgtccgagggtctcgaacattctgatctgcccgacgggaccggcgagtttttagacgcctggctcatgctcgtagaaaagatggtcaatcctacaactgttctcgagagccctcattctttacctgccaaactcccgggaggcgtgcaaaattttcctcagttctctgctctccgcttcctggtggtaacacagaaagccgcattcacatgtatcaaaaacttatggaatagaaaacctcttaaagtctacggcgggagaatggccgaatcaatgctggccatcttatgccacatcctacggggtgaacctgtcatcagggagagactttccaaagagaaggaaggcagtcggggcgaggaagacacggggcaggaggaaggcgggagcaggcgggaaccacaagtgaatcaacaacagttacagcagctgatggacatggggtttactcgggaacacgccatggaagcgctcctgaacacatcaactatggaacaggcgaccgagtatctccttacccacccaccaccaataatgggcggcgtggtgagagacctgagtatgtctgaagaggatcagatgatgcgcgctatcgccatgtctctcggacaggatataccgatggaccagagggccgaatcaccagaagaggtggcttgccgtaaggaggaagaggaaagaaaggcgcgcgaaaaacaggaggaggaagaagccaagtgcctcgagaaatttcaggacgcggaccccctggaacaggacgagcttcatacatttactgatactatgctcccaggatgcttccacctgctggacgagcttccagacactgtataccgggtatgcgacctgataatgaccgcgatcaaacgaaacggcgctgactacagggacatgattctgaagcaggttgtgaatcaagtgtgggaggccgccgatgtgctaataaaagctgcactccctctgacaacctcagacaccaaaaccgttagcgaatggatttcacagatggccactctgccccaggcttccaatctcgcgaccagaatactcttgctgacgctcctgttcgaggagcttaagctgccttgtgcatgggtagtggaatcgagcggcattctaaatgtgctgattaagctgttagaagtcgtgcagccatgtctgcaggctgccaaagagcagaaggaagtgcagaccccaaagtggatcactccagttttattgctcatagatttctacgagaaaacggcaatcagcagcaaacgcagggcacagatgaccaagtacttacagagcaacagtaacaattggagatggtttgatgacagatccggtcggtggtgcagttattccgcatcgaacaattctacaatagacagcgcctggaaatccggtgagacgtccgtgcgatttactgctggaagacggcggtataccgttcagttcacaacaatggtgcaggttaatgaagagacgggtaatagacggccagtcatgcttacacttttgagagtcccacgcttaaacaagaatagtaagaactctaatggccaggagctcgaaaaaactctggaggagagcaaggagatggacataaagaggaaagaaaataaggggaacgatacgcctctcgcgctggagagcacgaacaccgaaaaagaaacctctttggaggaaaccaaaatcggtgaaatactcatccaaggtcttacagaagatatggtaactgtgctgattagagcttgcgttagcatgctgggtgtgcccgtcgacccagacaccctccacgccacactcaggttgtgcctccgcttaacccgggaccataagtatgccatgatgttcgctgagctgaagagcacacgcatgatcctaaatttaacacagtcttccggattcaatggattcacccccttggtgaccctgttgctcaggcacattatcgaggatccatgtaccctgagacacacgatggagaaggtggtgagaagcgcagccacaagtggcgctgggtccactaccagcggtgtggtgagtggatctctgggcagtcgcgaaatcaactatatactgagagtgctgggccctgccgcatgccgcaacccggatatcttcactgaagtcgcgaactgttgcattagaattgccctgcccgccccccgcggatcgggcacagccagcgatgacgagttcgaaaatctgaggattaagggaccaaatgccgtccaactggtgaagaccacccctctgaagccatctcctctacccgtgatacctgacactatcaaagaggtgatatacgatatgttgaacgcactggctgcctaccatgctcccgaagaagcggacaagagtgacccaaaaccgggcgttatgacccaggaggtcgggcaactgttacaggacatgggagatgatgtctaccagcagtaccgatctctcacaagacaaagctcggactttgatacccagagcggatttagcattaacagtcaggtgttcgctgctgacggggcctctacagagacgtccgcctccggaaccagtcaaggtgaagcctcaacacctgaggagagtagggatgggaagaaagacaaggaaggcgaccgagcctctgaagaggggaaacaaaagggtaaggggtctaagccccttatgcccacctcaacaattctacgcctcctggcagagctagttaggtcttacgtggggattgctacactcatagcaaattactcctacaccgttggacaatccgaactgattaaagaggattgctccgtgttggcgttcgtgctcgaccacctgctgccccatactcagaatgctgaagacaaagatacccccgcccttgcacggctgtttctggcaagcctggcagctgctggcagcggcaccgatgcccaagtcgcactcgtgaacgaagtgaaggctgcccttggcagagctttagccatggctgagtccacagagaagcacgcacgcctgcaggctgtcatgtgcattatttcgaccataatggaatcctgtccatcaacttcctctttctattcttctgcgaccgctaagacgcagcacaatggtatgaataacatcatccgcctatttctgaaaaagggactcgtgaacgatctagctagggtgcctcattctctggatctctcttctcccaacatggccaatacagtgaacgctgcattgaaacctctcgaaactctttctaggattgtgaatcagccatcaagcctgttcggctcaaaatccgcgagcagcaagaataagtcagagcaagacgcccagggcgctagccaggactctagcagcaatcaacaggatccgggggagcccggcgaagctgaagtccaggaggaggaccacgacgtcacccagacagaagttgcggacggcgacattatggatggagaggccgagaccgacagcgtggtcattgccggccagcccgaggtcctgagttcacaggagatgcaggttgaaaatgagctcgaggatctgattgatgagctgctggagcgtgatgggggttctgggaactcgacgataattgtgtcacgcagcggggaggatgagtcacaagaggacgtcctgatggacgaggcccccagtaacttgagccaggcttcaaccctacaggcaaatcgcgaggacagtatgaatattcttgatccagaagatgaggaggaacatacccaggaggaggatagttcagggagtaatgaagacgaagacgactctcaggatgaagaggaggaagaagaggaagatgaggaagacgaccaggaagacgatgagggggaggagggagacgaagacgacgacgatgacggatctgaaatggagctcgacgaggattatcctgacatgaacgcatcccctctggtacggttcgagagattcgaccgagaggacgaccttatcatagagttcgacaacatgtttagtagcgccaccgatatcccaccttcacctggcaacattccaaccacacatccccttatggttagacacgcagaccatagctcactgaccctggggtccggctccagcactacccgccttactcaggggataggaaggtctcaaaggactctaaggcagctcactgctaacaccggtcataccattcacgttcactatccaggcaatagacagcctaacccaccgctcatcctgcaaaggctattaggacctagcgctgccgccgatatcctgcaactctcgtctagtctccctcttcaatcccgcggccgcgccaggctcctggtggggaatgatgatgtccatattattgcccgctctgatgatgagctgctagatgactttttccatgaccagtccaccgctacctcacaggcggggacactatcttccatcccaaccgctcttacccggtggacagaagaatgcaaagtcctcgacgcagaatcaatgcatgattgtgtttctgtggtgaaggtgtccatcgttaaccatctcgaattcctgcgcgacgaagagctggaagagagacgggaaaagaggcgtaagcagcttgccgaggaggagaccaaaatcactgataaaggaaaggaggataaggagaacagagaccaatcagcgcagtgtacagcaagcaagtcgaacgattctactgaacagaacctgagtgacggcacacctatgcccgattcgtacccaacaaccccctcatccacagacgctgccaccagcgagtcaaaagaaacactggggaccctccaaagcagccaacaacagcctacactcccaactccgcctgccctgggcgaggtgccacaggagctccagtctccagccggagaaggtggcagtagcacccagctcttgatgcctgtggagcctgaagaacttgggccaacccgccctagcggcgaagctgagacaacccagatggagctgtcacctgcgcccactatcacttctttgtccccggagagggccgaagatagcgacgcactgacggcagtgagcagtcagctggaggggagccccatggacacaagctctctggcaagttgtactttggaagaggcagtgggtgatacttctgcggcgggatccagtgagcagcctagagctggttcttccacccccggcgacgcccccccggccgttgccgaggttcagggtcgtagcgacggatctggtgagtccgcacaaccccctgaggactccagccctcctgcaagttcagagtcatcgagcacgagagactctgctgtcgctatcagcggcgcagacagccgaggcatactggaagaacccctcccttcaacgtcgtctgaggaagaagatccactggccgggatatcacttccagagggcgtggatccatcttttctggctgctctgcctgacgacatcaggcgtgaggtcctgcagaaccaactgggcattaggccccccacacgaaccgcacccagcacgaattccagcgctcccgcagtggtggggaatcccggggtcaccgaagtgagccccgagtttctggccgcgttaccccccgcgatacaggaagaggtgctcgcccaacaacgcgcggaacagcaaagacgagagctcgcccaaaacgcgtctagcgatactcctatggatcctgtgacatttattcagacattgccgtctgacctgcggaggtccgtgctggaggacatggaggactcagtactagcagtgatgcctccagatattgccgccgaggcgcaggccttaagaagggagcaggaggctagacagcgccagttgatgcatgagaggctgtttggccatagttccaccagcgcgctgtcagccatcctcaggtcccctgccttcacctccagacttagcgggaacagaggtgtccagtatacacggttggccgtccagaggggcggtacgttccagatgggggggagctcctctcataatagaccctccggctctaatgtcgataccctcttgcgtcttagaggtcgtctgttactggaccacgaggccctgagctgtctgctcgtcttgctgttcgtggatgagccaaagcttaacacctccaggctgcacagagtcctgcgtaacctgtgctaccacgcccagactaggcactgggtgatcaggagtctgttaagcatcctgcaaaggtcatcagagtctgagctgtgcatcgagaccccgaagctgactacatcggaagagaaggggaaaaaaagcagcaagtcttgtggtagtagctcccatgagaaccgacccttggacctgctgcacaaaatggaaagtaaaagctctaaccagctgagctggctgtcggttagcatggacgccgctcttggatgtcggactaacatctttcaaatacaacgcagcggcggtcgcaaacacactgaaaagcatgcatctggaggctcaacagtgcacatccatccccaggcggccccggtggtctgcagacacgttctggataccctgatccaacttgctaaagtctttccatcccacttcacccagcaacgaacgaaagaaacgaactgcgaatctgaccgcgaacggggcaacaaggcttgctcaccttgtagcagccagagctccagttcgggaatttgcaccgatttttgggatttgctggtgaaactggataatatgaatgtgtcgcggaaaggaaagaatagcgttaagtccgtgcctgtgtccgctgggggtgagggcgaaactagcccctacagcctggaagcttcaccattggggcagctgatgaacatgctttctcaccccgtaattcgccgtagtagtctcctcacggaaaagctgttaagactacttagtctaataagtatcgcgcttcctgagaacaaggtatctgaggctcaagctaattccggatcaggggcctcatccacaactactgctacgtcaaccacatccaccaccacgactaccgcggccagcacgacgccaacccctcccaccgccccaaccccggtaactagtgcacctgcactggtcgcagctactgctatttccactatagttgtggctgccagcaccaccgtcaccacaccaaccaccgcaacaacaaccgttagcattagccccactacaaaaggttccaagagcccagccaaggtttctgatggcggatcctcctcgacagactttaagatggtgtccagcggcctcacagaaaaccagctgcagctctcagtggaagtgctcaccagccacagctgcagcgaagaagggctggaagacgctgctaatgtgctcctgcaactctcccgaggcgactccggaactcgagatactgtgctgaagctgctattaaacggggcacgacacttaggatataccctttgtaaacagataggaactctactggccgagctccgagaatacaatttggaacagcagagaagggcccagtgcgagactttgtccccggacggattgccagaggagcaaccccagacaacaaagcttaaaggcaagatgcagtcacgcttcgacatggccgagaacgtggtcatcgttgcaagtcagaagcgaccgctgggcggccgcgaactgcagcttccgtcaatgtctatgctaacttcaaagaccagcacccagaaattctttttgcgagttctccaggtcataatccaattacgcgacgacacccgcagagctaataagaaagctaaacagaccgggagactcggcagctcagggctgggatctgcttcttcgatccaagcagcagtgagacagctggaggccgaggcagatgccataattcagatggtcagggagggccaaagggcacgcaggcagcagcaggccgccaccagcgagagctcccagtctgaggctagcgtccgcagagaagaatcaccgatggacgtagatcagccctctccctccgctcaagacactcaatccattgcatcagacggtacgcctcagggagagaaggaaaaagaagaacggccccctgagttacccctactctccgagcagttgtcattggatgagctgtgggacatgttgggagaatgtctgaaggaattggaagagtcgcacgatcaacatgccgtgctagtcctccagccagccgtggaggcatttttcttagtgcacgccactgagcgggaatcaaaaccaccagtgagagataccagagagtcacaactggcacatattaaagatgagccccccccgttgagcccggcacctttgaccccagcaactcccagttccctcgaccctttcttctctagggaaccttcaagcatgcatatcagctcttccctgccaccagacacacagaagttcttgcgctttgcagaaactcaccgtaccgttcttaatcagatattaaggcaaagtaccactcatctggccgacggcccctttgccgtcttggtcgattacataagagtcctcgactttgacgtaaagcggaaatacttccgccaggaactcgaaaggctggacgaaggattgaggaaggaagatatggcggttcacgtgcgaagggaccacgtgtttgaggatagttacagggagctccaccgaaaaagccccgaggagatgaaaaatcgcctatacatagtgtttgagggggaggagggccaagatgccggtggactgcttagagagtggtacatgataatctcaagggagatgttcaatcctatgtacgccctctttaggacctctccgggtgaccgggtgacctataccattaatccttcttcacattgtaaccccaaccacctgagctacttcaaattcgtaggccgtattgtcgccaaggctgtgtatgacaatcgcctccttgaatgctatttcaccaggtccttttacaaacacatattggggaaatccgtgcggtatacagacatggagagcgaggactaccacttttaccagggtctggtttacctgcttgaaaatgacgtgtcaaccctcggttatgatctgaccttttccactgaggtccaggaatttggagtttgcgaagtgcgggacctaaagcctaatggagcgaatattctcgtaaccgaagagaacaagaaggagtacgtgcatctcgtgtgccaaatgcgaatgacgggtgccattcggaaacagctggctgctttcctggaggggttttacgagataatacctaagagactgatctctatctttaccgagcaggagttagaattacttatctccggactccctaccatcgacattgatgatttgaaaagcaatactgaatatcacaagtaccaatctaatagtatccagatacagtggttttggcgcgcactacgctcattcgaccaggccgaccgggctaagttcttacagtttgtgacaggcacatcaaaagtgccattgcaggggttcgccgccctggaggggatgaatggcatacaaaaattccagatccatcgagatgataggtccactgatcgactacctagcgctcacacctgcttcaaccagttggatcttcccgcctacgaatctttcgagaaactgaggcacatgcttctactggccatacaggaatgttccgaagggttcggtctcgcatag

SEQ ID NO: 190430 - DNA, 13125 bp, Artificial Sequence
  Description of Artificial Sequence: Synthetic coding sequence
atgaaggtggaccggaccaagctgaagaagacccccaccgaggccccggctgactgtcgtgctctgatagacaaattaaaggtctgtaatgatgagcagctcctcctggaactccagcagattaaaacttggaatatcggaaagtgcgagttataccattgggtagacctattagaccgcttcgatgggattctggcagatgccggccaaaccgtggagaatatgagctggatgctcgtctgcgataggcctgaaagggagcagctaaagatgctgctgcttgcagttctaaactttaccgccctgctaatagaatattcattcagcagacatctatattcatccattgagcatctgaccactttgctggcttcttccgacatgcaggtagtcctcgcagtgcttaatctgctctacgtgttttccaaacgtagtaattatatcaccagactcggctccgataagaggacacctctgctgacacggctgcagcacctggcagaatcctggggaggaaaagaaaatggcttcggcctggcagaatgctgcagagatctccacatgatgaaataccccccctccgcaacgactcttcacttcgaattctacgccgacccgggcgcagaggttaaaatagagaagcgcaccacctctaacaccctccactatattcacattgaacagttggacaaaatctccgagagccccagtgagattatggagtcacttacaaagatgtattccatcccaaaggacaaacaaatgctccttttcactcacattaggctggcacacggcttttccaaccaccgcaaacgactgcaggcagtacaggcccggctgcacgctatctccatcctggtttatagtaacgctctgcaagaatccgcaaactccatcctttacaacggactgattgaggaactcgtggacgttttacagatcaccgacaagcaacttatggaaatcaaggctgctagcctgcgcacactaacgtctatcgtgcacctcgagcgtacgcccaagctgtcgtctatcattgactgcaccggcaccgcctcctaccatggctttctccctgtactcgtgcgcaattgcatacaggccatgatagaccccagcatggatccctatccacatcagttcgcaaccgcgctattttctttcttatatcatctggcctcttatgacgctggtggagaggctctggtctcatgcggcatgatggaggcactcctaaaagttatcaaattccttggcgacgagcaggatcagatcacctttgtgacgagagctgtgcgagtggtcgacctaattactaacctggacatggccgccttccagagtcactcaggattgtctatatttatatacaggttggagcacgaggtggacttgtgtaggaaagagtgcccatttgttatcaaacctaaaattcagcgccccaataccacccaggagggcgaggaaatggagacagacatggacggagtgcagtgtattccgcagcgcgcagcacttctcaagtcgatgttaaactttttgaaaaaagccatccaagaccccgccttctctgatggcatccgacacgtcatggacgggagcctcccaacctccctgaagcatatcatttcaaatgccgaatattacggaccaagcctgtttctcttggctaccgaagtggtgacagtcttcgttttccaggaacccagcttactttcaagtctgcaagataacggactcaccgacgtcatgctccacgccctccttatcaaggatgtacctgctaccagagaagttttgggcagcctgcccaacgtctttagtgcgctgtgcctgaacgccagaggcctacaaagttttgtgcaatgtcagccctttgagcggctgttcaaagtcctgctgtcccccgactacctccccgcaatgcgtcgaaggagatcgagtgaccctcttggagatactgcatccaacctgggtagcgccgtagacgagctcatgcggcatcaacccacactaaaaacggatgccactaccgcaattattaaactgctcgaggaaatctgcaatctcggaagagatcccaaatacatctgccagaagccatccatacagaaggccgacgggaccgctacagctcccccaccgaggtccaatcacgcggccgaggaggcatcatcggaagatgaagaagaggaggaggttcaggctatgcagagttttaatagtacccagcagaacgagacggaacctaaccaacaagtggttggaaccgaagaacggatccctatccctctgatggattacatcctgaacgtgatgaagttcgtggaatccatccttagtaataatactaccgacgaccactgccaagaatttgtcaatcagaaggggttgctgcctcttgtcaccatacttggcttgcctaatcttccaattgactttcctacaagcgctgcctgtcaggctgttgcaggagtctgcaaaagcattctgaccttaagtcatgagcctaaggttctccaggagggtcttttacaactggactccatcttgagttcactcgaacctctgcatcggcctatcgaatcccccggggggtcagtgttgctgcgcgaactggcctgcgctggaaatgttgctgacgccaccctatccgcacaggctaccccattactccacgcactcactgctgctcacgcctatattatgatgttcgtccatacctgcagagttggacagtcagaaatacgcagcatatcagtcaaccaatggggctcccagctgggcctctcagtactctcaaagctgagtcaactttactgcagcctggtgtgggaatccacagtgctgttgagtctctgcacccctaattcgctcccgtcgggatgtgagttcgggcaagcggacatgcagaagctcgtcccgaaggacgaaaaagccggaaccacccagggcgggaagagatccgatggagagcaggacggtgcagccggtagcatggacgccagcactcaaggattgttagaggggatagggctagatggcgacacactggcacccatggaaactgacgaacccacggcatccgacagtaaggggaaatctaaaataactcccgccatggcagcccgcatcaagcagataaagcctctgctctcagctagctccaggctgggccgagccctggccgagttatttggactcttggtcaaattgtgcgtcgggtctcctgtacgtcagcgcaggtctcaccatgccgcgtctaccacgacagctcctacacccgccgcgaggagcacggcctccgctctaacgaagctactgacgaaaggtttgagttggcagccacctccttatactcctactccgcgcttccgtttaaccttctttatatgctctgtgggtttcacatcccccatgttattcgatgagcgcaagtatccgtaccatctgatgcttcagaagtttctgtgtagtgggggtcataatgcgctctttgaaactttcaattgggcactgtcaatgggaggcaaagttcctgtctccgagggattagaacactccgatctgccggatgggacaggtgaatttctggacgcgtggcttatgctcgtggagaaaatggtaaatccaactacggtgctcgagtctccccactccttgccggcaaagctcccaggcggggttcaaaactttccgcagtttagcgccttgcggtttctggtggtgacccagaaggccgcctttacatgcatcaaaaatctctggaacagaaagcctctcaaagtgtatggaggaaggatggcagagtcaatgcttgccatcttgtgccacattcttcggggggaacctgtgatcagagaacgcttaagtaaagagaaggagggtagtcggggagaggaagataccggccaagaagagggagggtcccgacgggaaccacaggttaatcagcagcaattgcagcagcttatggatatgggcttcactagagagcacgccatggaagccctcctaaacacttccacgatggagcaggcgaccgaataccttctgacccatccaccccctatcatgggaggtgtggtccgggatctctccatgagtgaggaggatcagatgatgagggccatagctatgtctctggggcaagatatcccgatggaccaaagggccgaatctcccgaagaggtggcatgccgcaaagaggaggaggagaggaaggccagagagaagcaggaagaggaggaggctaagtgcctggagaaattccaagacgccgacccactggaacaagatgagttgcataccttcacagataccatgcttcctggctgtttccatttgctagacgagctgcccgatactgtatatcgggtatgcgatctcatcatgaccgctatcaaaagaaacggagccgactaccgcgatatgatcctgaaacaggttgtcaatcaagtctgggaggccgcagatgtactgataaaagccgctctcccactgacaacaagtgacacaaagacggtctctgaatggatctctcagatggccaccctgccacaggcttcgaacctggcaactagaattctcctactcacactgctatttgaggaactcaagctgccctgcgcatgggttgtagagtcaagcggtattttgaacgtgttgataaaactactggaagtagtacagccgtgtctgcaagcggcgaaggaacagaaagaggtgcagacccccaagtggattacccccgttttactgctgatagatttttacgaaaaaacagccataagttccaagaggcgtgcgcaaatgactaagtatttgcagtccaatagcaacaactggcgctggtttgatgatcggagcggtcgctggtgttcttactcggcaagtaacaattcaaccatcgacagcgcttggaaatctggagagacctctgtccgtttcaccgctggacgcagaaggtacactgtacagttcaccactatggtacaggtaaacgaggagactggcaaccgtcggccggtaatgctaacactcttgcgcgtgccgcgcctgaacaaaaacagtaagaactcaaatgggcaggagctagaaaaaacacttgaggagagcaaagagatggacatcaagaggaaagagaacaaaggcaacgacacccccctggcgttggagagcaccaacacggaaaaagaaactagcctagaagagacaaagattggtgaaatcttgatacaaggtctgacagaggatatggtgaccgttctgatccgagcctgtgtgtccatgctgggcgtcccagtagatccagataccctgcacgccaccctgcggttatgtttgagactcacccgggatcataagtacgcaatgatgtttgccgagctgaagagtacccggatgatcttgaacctgacacagagtagtgggttcaacggcttcacaccactggtgacactgcttctgagacatataattgaggacccttgcacgctaagacacaccatggaaaaggtcgtgcgttccgcggcgacaagcggagctgggagcaccacttcaggggtggtgtctggaagcctgggcagccgcgaaatcaactacatccttcgggtgttgggccccgccgcctgcagaaatcctgatatattcacagaggtggcaaactgttgtatcaggatcgcattgccggcgcctagaggcagcgggacagcttctgatgacgagttcgagaatctgagaattaaaggacctaacgcagtgcagctggtcaaaacaacgcccctcaaaccgtcccctctgccggtgatccccgataccatcaaggaggtgatttatgatatgctgaacgcattggcagcgtaccacgcccccgaagaggccgataagagcgaccctaagcctggcgtgatgacacaggaagtggggcagctcctacaggacatgggcgatgacgtgtatcagcagtatcggtcactgacccgccagtcgtccgacttcgacacccaatctggtttctccatcaactcacaggtctttgccgcagatggtgcttcaaccgaaacgagtgcatccggcacatctcaaggagaggccagcactccagaggagtcacgggatgggaaaaaagataaggagggggatcgtgcgagcgaggaggggaaacagaaagggaagggcagcaagcccctcatgcccacctccaccatactcagactacttgccgagttggtacgctcatacgttggaatcgccacgttgatagctaactactcgtacacagttggccagtctgagctgataaaggaagattgtagtgtcttggcgttcgtgctcgaccatctccttcctcacactcagaacgcagaggacaaggacaccccagcgctggcacgcctgttcctcgctagtctcgccgccgccggcagcggaaccgatgctcaggtggccctggtaaatgaggttaaggccgctttaggacgagcattggctatggccgagagtaccgaaaagcacgcccgcctgcaagcagtgatgtgcattatatcgaccatcatggagagctgcccctccacatcatctttttattctagtgcaaccgctaaaactcagcataatgggatgaacaacatcatcagactcttcctgaagaaaggcttagttaacgacctggccagagtacctcattctttagacctgtcttcgccaaatatggcgaacacggtgaacgctgcccttaagcccttggaaacactcagtagaattgtaaatcaacctagttccctgtttggaagcaaaagcgcctcatcaaagaacaagtccgaacaggatgcacagggggcgtctcaggattctagcagtaaccagcaggaccctggcgagcctggtgaggctgaagtgcaggaggaggaccatgatgtaacacagaccgaagtggccgatggtgacatcatggatggcgaggcagaaacagatagtgtggtcatcgccgggcaacccgaggtgctgtcgagccaggaaatgcaagtggagaacgaactggaggatctgatcgatgagctgctcgagagggatggcggttctgggaatagcacaattattgtctccaggagcggcgaagacgagagccaggaggatgtcctgatggacgaggccccatcaaacttgtcacaggctagtaccctgcaggccaatcgtgaagattccatgaacattctcgacccggaggatgaagaagagcatacgcaggaggaggacagcagtgggtccaacgaagacgaggatgactctcaagatgaggaggaggaggaggaggaagacgaggaggatgatcaggaagacgacgagggggaggagggcgacgaggacgatgatgacgacgggtctgaaatggagttggacgaagattatcctgatatgaatgctagccccctcgtccgttttgagagatttgacagagaggatgacctgatcatagaatttgataacatgttttcctcagcaaccgacatccctccttcacctgggaacatcccaactacccacccccttatggtgcggcatgcggaccacagctctctgaccctcggctcaggatcctccacaacaagactgacgcaaggcatcggtcgtagccaacgcactttaagacaacttactgccaatacgggccacactattcacgtgcactatcccgggaacaggcagccgaacccccctctgattctccagcgtctcctcgggccctccgccgctgctgatattttacagctgtccagttctctccccctccaaagtagagggcgggcacggctactggtcgggaatgatgacgtacacattattgcccgaagtgacgacgagttactcgatgatttctttcacgatcagtcgacagccactagtcaggcaggcactctgagcagcataccgactgcattaacccgatggacagaggagtgtaaagtgctggatgcagaatcgatgcatgactgtgtctccgtcgtaaaggtgtctatcgtgaatcatctggagtttctgcgcgatgaagaactggaagagcgccgtgagaaacgcagaaaacagctggcggaagaggaaaccaagattactgacaaggggaaggaagacaaagaaaaccgggatcagagcgcgcagtgcaccgcttctaagtctaatgattccacagagcagaacctgtccgacggcaccccaatgcccgattcctatccaactacaccatcctcaactgacgccgccacctctgagtcaaaggagaccctgggaacactgcagagcagtcagcagcagccgacgctgccaactcctcccgccctgggcgaagtgccacaggaactgcagagtcccgcgggcgagggtggctcttccactcagctgctcatgcccgtggagccggaggagttggggcccactcggccatcaggtgaggccgaaaccactcaaatggagctatctcctgcccctactattacctctttgtctcccgaacgggctgaggatagtgatgccctcacagccgtctcatcacaattggagggttctccaatggatacatcatccctcgcttcatgcacactcgaagaagccgtgggagacacttccgccgctggctcttccgagcagcctcgggcaggatcctctaccccaggcgacgcccctcctgcagttgccgaagtgcaggggcgcagtgatggctctggcgagtctgctcagccgccggaggactcctccccccctgctagtagcgagagtagtagtactagagattccgccgtcgctatcagcggagcagactcaaggggcattctggaggagcctcttccgtcgacctccagcgaggaagaagatccactggcaggcatctctctgcccgaaggcgtggatccctcttttctcgcggccctgcccgatgatattagaagagaggtcctgcagaatcagcttggaatacgaccccctacacgcactgcaccttccacaaattccagtgcgccagctgtagtgggcaaccctggtgtaaccgaggtctcccctgagtttctggcagcattacccccggctattcaagaggaagtgctggcgcagcagagagctgagcagcagagacgagagctggcacaaaatgccagtagtgacactcccatggaccctgtgacattcattcagactctaccttcagacttacggcgctccgtcctcgaagacatggaagattccgtcctggctgtcatgccccccgacattgcagccgaagctcaagctctgaggagggaacaggaagcgcgccagcggcaactcatgcacgagagactctttgggcatagttctacctcagcgctgtccgccatactgaggtccccggctttcacctccagattgtccgggaaccgtggagtccagtacacccgcctggccgtccagcgcggcgggacttttcagatgggaggctcctccagtcacaacagacccagcggaagtaacgtggatacacttctgcggttgagggggcgtctccttttggatcacgaggctctcagctgtctgctggtcctgttgttcgtggatgagccaaaactaaacaccagtcgcctgcaccgcgtccttcgaaatctctgctaccatgctcagacccggcattgggtgattagatccctgctctccatcctgcagcgctctagcgaaagtgaactgtgtattgagacgccgaagcttaccacatctgaagaaaagggcaagaaatctagcaagtcctgtggatcaagcagccacgagaatcgtcctctggatctattacacaagatggagagtaagtccagcaatcagctatcctggctgtccgtgtccatggacgctgcactcggctgccgcacgaatatcttccagatccagcggtctggcggtaggaaacataccgagaaacacgcctccggaggcagtaccgtgcacatccacccacaggccgctccagtggtatgtcgacacgtcctcgataccttgatccagttggctaaagtcttcccatcccattttacccagcagcgtacaaaagaaaccaactgcgagagtgaccgcgaaagggggaataaggcgtgttctccgtgctccagtcagtcatcttctagtggaatttgcacagacttttgggatctgctggtcaaactggacaacatgaatgtgagccgcaagggaaaaaatagtgttaagagcgtgcccgtcagtgccgggggcgaaggcgagacaagcccgtattcgctcgaagcatcccctttaggccagctgatgaatatgctgtcccaccctgtgatacgaaggtccagtctgctcactgaaaagctgttgcggctgctctctctgatttcgatcgcacttcctgagaataaggtatctgaggcacaggcaaatagcggctccggagctagttccacgaccacagctacttcgacaacaagcacaacaaccacaacagcagcatcgacaacgcctaccccgccaactgctccaactccagtgacaagtgcccccgccttagtcgcggccactgccatttctaccatcgtggtagccgctagtactacggtgaccactcccactactgctactacaacagtgtccattagccccaccacaaaaggatcgaagtcaccagccaaagtgtccgacggaggcagctctagtacagatttcaaaatggtgagctccggactgacggagaaccagctccagctgagcgtggaggtgctgacgtctcattcctgcagcgaggagggcttggaggatgcagccaacgtactcctgcagctttccagaggcgactctggcacccgcgacacggtgttaaagcttttgctcaatggagcaaggcatctgggctatacactgtgtaaacagattgggacgctgctcgcggagttgcgtgagtataatcttgaacagcagcggcgggcccagtgtgagactctatccccagacggactgcctgaggaacagccccagactacaaagctcaaaggtaaaatgcagtcacggttcgacatggctgagaatgtagtgattgtagccagccaaaagcgaccattaggaggaagagaactgcaactgccctctatgagtatgctgacgtccaaaacctctacccagaaattcttcctccgggtgttgcaagtcattatccagctgcgcgatgatacgcgccgcgcgaataagaaagctaagcagaccgggcgtttgggaagctctggcctgggtagcgcctcgtccatccaggccgcagtccggcaactggaagccgaggcggatgccattattcaaatggttcgggagggacagagggcgagacggcagcagcaggccgcaacttcagaatcatcacaatctgaggcgagcgtacggagagaagaaagtccaatggatgttgaccagccgtcgccaagcgctcaggatacgcagtccatagcctctgacgggactccccagggtgagaaagaaaaggaagagaggcccccggagttgccactcttgtcagagcagttaagcttggacgaactgtgggatatgctaggggaatgtctcaaagagctagaagagtcccatgatcagcacgccgtattggtcctgcagccagctgtcgaggcattcttcctcgtgcacgccaccgagagagaatcaaagccaccggtgagagacacccgtgagtcccagctcgctcatataaaggacgagccgccaccactgtcacccgcaccactgacgcctgcaacacctagctcgctcgaccctttcttttcaagggagccctcgtcgatgcacatctcgtcatccctgccccctgatacgcagaaattccttcgtttcgccgaaacccataggacggttttaaaccaaatattacggcagtcaaccactcatctagcagatggcccttttgccgtgctggtcgattatattagggtgctggactttgatgtgaagcgcaaatacttcaggcaggaactggaacgtctcgatgaaggcctacggaaggaggacatggccgtacatgtgcggcgtgatcacgttttcgaagactcataccgggaattgcatcgaaaaagtccagaggagatgaaaaacagactttacatagtgttcgagggagaagagggccaagacgcaggtggcctcttaagggaatggtatatgatcattagcagagaaatgtttaatcccatgtacgcactgttcaggacatcacctggggacagggtgacctacactattaatccttcctcacattgtaaccccaatcacctgtcctatttcaaattcgtgggaagaattgtggctaaggccgtgtatgacaatagactgctggaatgttatttcactaggtctttctataagcatatcctcggcaaatccgtacgctataccgatatggagagcgaagactaccatttttatcaggggctggtgtacctgttggagaacgatgtgagcaccctcgggtacgacctgacgttctccacagaagttcaggagttcggagtgtgcgaggtgcgcgaccttaagcccaacggagctaacatcctcgtgacggaagaaaacaaaaaggagtacgtgcatctggtctgtcagatgcgcatgaccggcgcaattagaaagcagctggcggccttcctggagggattttatgagataattccaaagcgcttgataagtatttttaccgagcaggagctggaactgctgattagtgggctgcccacaattgatatagatgacctgaagagtaatactgagtaccataagtatcagagcaattctatccagattcagtggttctggcgggcccttcggtcttttgatcaggctgatagagccaagttccttcagtttgtgacaggtacttctaaggtccccctgcaaggcttcgcagccctcgagggcatgaatggcattcagaagttccagatccatcgcgacgacagaagcaccgacagacttccatcagcccatacttgtttcaaccagttagatctgccagcctacgaatcttttgagaagctgcggcacatgctactcctggccatccaagagtgctcagaaggctttgggttggcgtag

SEQ ID NO: 190431 - DNA, 771 bp, Artificial Sequence
  Description of Artificial Sequence: Synthetic coding sequence
atggacccctacccccaccagttcgccaccgccctgttcagcttcttgtatcatctggcctcttacgacgctgggggggaggcccttgtgagctgcggaatgatggaagctctgctcaaggttattaaatttctcggcgacgagcaggatcagattacttttgtgacccgagccgttcgggtggttgatctgattacaaatctggacatggctgcttttcaaagccactccggactcagcatttttatctatagacttgagcacgaagtggatttgtgtcgaaaagagtgtccttttgtgattaagcctaagattcagcgccctaataccacccaggaaggcgaggagatggagacagacatggacgtggccgatgtagccatggagtccagccctggcagttcaattagcatggaacatcgacttgatgtggagctgagggcaagtggctcaagtagttctacaaacatctcatctgggccatctcctggtccctctccaggcaccgggcccggcccaggacccggaccaggccccgggcctggtcctggcccaggccccggacccggaccaggccctggtcccggtccaggacccgggcctagaccgggagttcaatgcatcccgcagcgggcggcactgctgaagagcatgttgaacttcctcaaaaaggccatccaggaccccgcttttagtgacggcatccgtcatgttatggatggcagtctacccactagccttaagcacatcatcagtaatgctgagtactag

SEQ ID NO: 190432 - DNA, 687 bp, Artificial Sequence
  Description of Artificial Sequence: Synthetic coding sequence
tgagtgagctgcggcatgatggaggccctgctgaaggtgatcaagttcctgggagacgagcaggatcagattacgttcgtgacacgcgccgtaagagtcgtggacctgatcaccaacttggatatggctgcttttcagagccactccgggctatctattttcatttaccgcctggagcatgaggtcgacctgtgccgcaaggagtgcccatttgtcatcaagcccaagatacagcgacctaacaccacgcaggagggtgaagaaatggagactgacatggacgtagccgacgtggctatggagagctcccccggatcatccataagcatggagcaccgactggacgtcgagcttcgggcaagtggctcatcatcttcgacgaacatatctagcggcccgagtcctggaccaagcccaggcacaggacctggacctggccccggacccgggcccggcccggggcctggaccaggacctggccccgggccaggaccaggtcctgggccaggcccaggacccaggccaggcgttcagtgcatccctcaaagggcagccctgcttaaaagcatgctgaattttctgaagaaggctatccaagatcccgccttctcagacgggataagacatgtgatggatgggtccctcccaacctccctcaagcatatcatttcaaacgcagagtactag

SEQ ID NO: 190433 - DNA, 3594 bp, Artificial Sequence
  Description of Artificial Sequence: Synthetic coding sequence
tgacccagcggcagcaacgtggacaccctgctgcggctgcggggccgcctcctacttgaccatgaagcccttagttgcttgcttgtcctcctgtttgtcgatgaaccgaagttgaacacctcaaggctccaccgcgtactgaggaatctttgctaccatgctcagaccaggcattgggttatccggtctctcctctcgatacttcagcggagtagtgagagcgagctgtgtatcgagactcccaagctaacgactagtgaagaaaagggaaagaaatcgtcaaaaagttgtggctcatcaagtcacgaaaatcggccactggacctgctgcacaagatggagtccaagtcctcgaaccagttgagctggttgtccgtgtcaatggacgccgcgctgggttgtcgaaccaacatctttcagattcagcgtagcggaggccgaaagcacacagagaaacacgcctcagggggaagcacggtccacatacaccctcaagccgctccggtggtctgccgccatgtcctggacactctcatacagctcgccaaagtttttccatcgcactttactcaacagagaaccaaggagaccaactgtgagagtgatagagaacggggcaacaaggcctgtagcccctgctcttctcagtcatcctcatcaggaatttgcaccgacttctgggacctcctcgtgaagctcgataatatgaacgtttcccggaaagggaaaaacagcgttaaatcagtgcctgtttcagccggcggcgaaggtgaaactagcccatattccctggaggcatcacccctgggccagttgatgaacatgctttcgcacccagtgatccggagatcctctctgctaactgaaaagttacttagactgcttagtctcatcagtattgcgttgcccgagaacaaggtgtccgaggcccaagccaactctggcagcggggccagttccaccacaacggcaacttcgactacatcgactacgactactacagctgctagcactacccccacacctcccaccgcccccactccggtaacctccgccccagccctggtcgccgcaaccgcaatctctactatcgtggtagctgcttccaccaccgtgactactccaacaaccgcaacaaccaccgtgagcatatcccctactactaagggctccaaatcacccgcaaaggttagcgatggcggatcttcaagtacagacttcaagatggtgtcctctggcctgactgagaaccagcttcagctgtcggtggaagtgttgaccagccacagctgctccgaagaggggctggaagatgcagctaacgtcctgctgcagttatccagaggagatagcggcactcgggacaccgtgctgaagctgctgctcaatggcgcgcgccatctcgggtatacactatgtaaacaaataggcacattgctggctgagctgagggaatacaacctagagcagcaaagaagagcccagtgcgagactctgtctccagacgggttgccagaggaacagccccagacaactaaactcaaaggaaagatgcaatcccgctttgatatggccgagaacgtcgtgattgtcgccagccagaaacgccctctcggtggtagagagctccagctgccaagcatgtccatgctgacttccaaaacctctacccagaagttcttcctacgtgttcttcaggttattatacagctgcgagacgacacaagacgtgccaacaagaaggcaaagcagaccggtcgcctagggtcctccggcctgggatcagcctccagtatccaagcagccgtacgtcagctggaagcagaagccgacgcgatcatacagatgtctgaatcctctcagtctgaggcatctgtcaggagggaagaaagccctatggacgtggatcaacccagtcctagcgcacaggacacccagtctatcgcctcagatggtactccccagggcgaaaaggagaaggaggaacgccccccagaactccctctcctgtctgaacagctgtccttggacgagctgtgggatatgctaggtgagtgtctaaaggaattagaggaatcccacgatcaacacgccgtgctggttttgcagccggctgtggaagccttctttctggttcacgccaccgaacgcgaatccaagccacctgttagggacacccgagagtcccagctggcccacatcaaagatgagccccctcccttgagtcccgcacccctaacaccagcaaccccctcaagccttgatccctttttttcgagagagcccagctccatgcatatcagttcttctttgccccctgacacccagaagttcctgagatttgccgaaactcatcgcaccgttctcaatcagattctccggcagtctacaacacacctcgccgacgggcccttcgccgtgcttgtggactacataagggttttagatttcgatgttaaaagaaaatatttccgccaggaacttgaaaggctggacgaaggcctgaggaaagaggatatggccgtccatgtgcggcgcgatcacgttttcgaagacagttaccgcgagctccacaggaaatcccctgaagaaatgaagaaccgtctatatatcgtttttgagggtgaggagggacaggatgcggggggcttgttgagggagtggtatatgattattagtagggaaatgttcaaccccatgtacgctctctttcgaacaagccccggtgatcgggtaacctataccatcaatccgtcgagccactgtaatcctaatcacctctcctattttaaattcgtcggccgcatcgtggccaaagccgtgtatgacaacaggctgctggaatgctattttacccgctcgttctacaagcacattctgggcaagtctgtcaggtacaccgacatggaatcagaggactatcatttctaccaggggctggtgtatcttctagagaacgacgtcagcacattgggttatgatcttacttttagtactgaagttcaagagttcggggtgtgcgaagtccgtgacctgaaacccaacggagcaaatatcttggtaactgaggagaacaaaaaagagtacgtgcacctagtgtgccagatgagaatgactggcgcaattaggaagcagctggctgcttttctcgagggcttttacgagataatacccaaaagattaatctctatctttacagagcaggagctggagctgctgatctctgggctgcctacaatcgacatcgatgaccttaaatcgaacaccgagtaccacaaataccaaagcaacagcatacagattcagtggttttggagggctctgcgatcctttgatcaagccgaccgagctaagttcctgcagtttgtcaccggcaccagcaaagtcccgcttcagggttttgccgctttggaagggatgaatggaatccagaaattccaaattcatagggatgatcgcagcacggaccggctgccctccgcacatacctgcttcaaccaattggatttaccagcttatgagtcctttgagaaactcagacatatgttgcttcttgccatccaagaatgtagcgaggggttcggactggcttag

SEQ ID NO: 190434 - DNA, 10227 bp, Artificial Sequence
  Description of Artificial Sequence: Synthetic coding sequence
tgaagcctgcccagcggctgcgagttcggccaggccgacatgcagaagcttgtgcctaaagatgaaaaagctgatggagaacaagacggcgccgcaggatctatggatgcaagcacccaggggcttctcgagggaattggcctggatggggacacactggcacccatggaaactgacgaacccaccgcaagtgatagtaagggcaagagcaaaattacacccgcgatggcagcacgaatcaaacagataaagcccctactctcggcaagcagcagactcggtcgggcgcttgcagagctcttcggcctcttggtaaagctgtgcgttggaagtccagtccgtcagcgcagaagccatcacgccgcctctaccacgacggccccaactccagccgctcgctctaccgccagcgcactcacaaagctactcaccaaagggctgagttggcaaccccctccttatacacctactccacggtttcgcctgacatttttcatttgtagcgtgggcttcacatctcccatgctcttcgacgagaggaaatacccataccacctcatgcttcaaaaattcctgtgctctgggggccataatgcactgttcgagaccttcaattgggctctgtctatgggaggcaaggtacccgtctcagagggccttgaacactctgacctccccgatggaacaggcgaattcctcgatgcctggctcatgttagttgagaagatggtcaatcctaccactgtgctcgagtccccccatagccttcccgccaagcttcccggaggagtacagaatttcccgcaattttctgccctgagatttctagtggtgacccagaaagccgcttttacatgtattaaaaatttatggaatcgcaagccacttaaggtgtatggcggccgaatggcagaatcaatgttggccattctgtgtcacatcttgaggggtgagcccgttataagggagaggctctccaaagagaaggaagggtctcgaggagaagaagacacaggacaggaggaaggaggctctcgccgcgagccccaggtgaatcagcagcagttacagcaattgatggacatgggtttcaccagagaacatgcgatggaggccttgctgaatacctcaactatggagcaggcaacggaataccttctcactcacccacctcccatcatgggcggtgttgtccgtgatttgtcgatgagtgaagaggaccagatgatgcgggctatagcaatgtcattggggcaggacattcccatggaccagcgggctgagtcaccagaggaggtcgcttgtcggaaggaggaagaagagagaaaggctcgggaaaaacaggaggaagaggaagccaaatgtcttgaaaaattccaagacgccgaccctctggagcaggatgagctgcacaccttcacggatactatgttacccgggtgttttcatctcctggacgagctccccgataccgtgtacagagtgtgcgatttgataatgaccgcaatcaaaagaaatggcgctgattaccgggacatgattctgaaacaggtagtgaaccaggtttgggaggcggcagatgtgttaatcaaggccgcactccctctcaccactagtgataccaaaacagttagtgagtggatctcccagatggccaccttgccacaggccagcaacctggcaacgaggatcctcctattaaccctgctgttcgaggagctgaagctgccctgcgcttgggtggtagaatcaagcggtatcctgaacgtcttaattaagttgttagaagtcgtgcagccttgtttacaagccgccaaggagcagaaggaggtccaaacacccaagtggataacgcccgtgctgctgctgattgatttttacgagaagacagcaatctcctccaagcgacgggctcaaatgaccaagtacctgcaatccaatagcaacaattggagatggttcgacgacaggtccgggaggtggtgctcatacagtgcttctaacaactctaccatagacagcgcttggaaaagcggcgagacaagtgtgaggttcactgctggtaggcggagatatactgttcaatttacaacaatggtgcaggtcaacgaagagaccggcaatcgcagacccgtgatgctcactctcctgcgggtacctaggcttaacaagaactccaaaaattcaaacggtcaggagcttgaaaagacacttgaagagtcaaaagaaatggatattaagagaaaggaaaataaagggaacgataccccattggcgttagaaagcacaaatacggagaaagagacctcacttgaagagacgaagattggagaaatcctgatacaggggcttacggaggatatggtcaccgtcctgatccgggcgtgtgtgtctatgctcggcgtgcctgtggaccccgacaccttgcacgccacattgcgcctgtgtctgaggttaactcgagatcacaaatacgccatgatgttcgccgaattgaagtcaacaaggatgattttgaacttgacacagagctccggttttaatggtttcacgcccctcgtcaccctcctgctgcgccacatcattgaggatccttgcaccctgagacacacaatggagaaagtggtgcgaagcgctgccacatctggcgccggcagcacaaccagcggagtggtgagtgggagcttgggcagtcgggaaatcaattacattctgcgagtgctgggccctgccgcttgtcgcaaccctgacatattcaccgaagtggcgaactgttgtattagaatcgctcttcctgccccgagggggtccgggaccgccagcgacgatgagtttgagaacttacggatcaaaggacccaatgccgtccaactcgtcaaaacaacccctctaaaacccagtcccctgcccgtcatacctgacaccattaaggaggtgatctatgatatgctgaacgctctggccgcgtatcacgccccagaggaggcagataagtcagatcccaagcctggggttatgactcaagaggtcgggcaacttctccaggacatgggagacgatgtctaccagcagtatagaagcctgacccggcaatcatcagacttcgatacccagtctgggttctctattaattcccaagtttttgccgcagacggggcctcgacagagacatctgcatctggcaccagccagggcgaagcaagcactcctgaagaatcgcgggacgggaaaaaagataaggagggcgacagagcctcagaggaagggaaacaaaagggaaaaggcagcaaacccctgatgccaacatcaacaatccttaggctactggcggagctggtgcgaagttacgttggaatcgctaccctgattgcaaattatagctacacagtaggacagtccgaactcattaaggaagactgctccgtgctggcctttgtgctggaccacctgttgccccacacacagaacgctgaggataaagacacgcccgcactggccaggctgtttctcgcaagcttggccgcggccggaagcggcactgacgcccaggtggcacttgtaaatgaagtgaaggctgcactgggccgagctctcgcaatggctgaatccaccgaaaagcacgctcgcctgcaagctgttatgtgcattatatcgacaatcatggagtcatgtcctagtacctcgtctttctattctagtgccactgcgaagactcaacataatggtatgaataacatcatcagactgttcctcaagaagggccttgtgaatgaccttgcccgcgtgccccactcacttgatttgagcagtccgaacatggccaacaccgtgaatgccgcattgaaaccgctggaaacactgagtcgtatcgtcaatcaaccctcatctctgtttggctcaaaatccgcatcatccaaaaacaagagtgagcaggacgctcaaggggccagccaggacagtagtagtaatcagcaggatcctggcgaaccaggggaagccgaggtgcaggaagaggaccacgatgttacacaaaccgaagtcgcagatggtgacattatggacggcgaagcagaaacagatagcgtcgttattgctggtcaacctgaggtgttatctagccaagagatgcaggtggagaacgaacttgaggatcttatcgacgaactcttggaaagagatggaggtagtggaaattccacaatcattgtgtctcgctcaggtgaggatgagtcccaggaggatgtgctgatggacgaggccccctctaatctgagccaagcctccaccttgcaggcaaaccgcgaagactccatgaatatactcgaccccgaggacgaggaggaacacacacaggaggaagacagcagcggatcaaacgaggacgaggacgattctcaggatgaggaggaagaggaagaagaagacgaagaggacgaccaagaggacgatgaaggggaggaaggcgatgaagatgatgacgatgatggctcggagatggagttagatgaagattatcccgacatgaacgcaagccctctcgttcgcttcgagagatttgaccgagaggacgacctgatcatcgaatttgacaatatgttttcttctgccaccgatattcctcccagtcctggcaacatcccaaccactcatccactgatggtccggcatgccgatcacagctctctgacactgggcagcgggtcctccacaactcggctgacccagggtattggccggagtcagaggacgttgaggcaactgacggccaacacagggcacactattcatgtgcactatccagggaatcgacagcccaacccgcccctgatcctccagaggctcctgggcccatcagcagccgctgacatactgcagctgtcaagctccctcccactgcagtcaagaggaagagcccgcctgctggtcggtaatgatgatgtgcacattattgcacgatccgacgatgaactcctcgatgatttcttccatgaccaatctaccgctacatcccaggccggaacattgtctagtattcccacagcactgactcgttggaccgaagaatgcaaagtgctggatgccgagagcatgcatgactgcgtgagtgtggtcaaagtctcaattgtgaaccatctggagtttctgagggatgaggagttggaggagagaagggagaagcgcagaaaacagctagcggaggaagagacgaagatcacggataagggaaaggaagataaagaaaatcgcgatcagtcagcccagtgtaccgcctccaagtccaatgatagtaccgagcagaacctgagcgatggcacacccatgcccgattcctatcccaccacccctagtagtaccgatgcagcaacaagcgagtcaaaggagactcttggcactctccagagtagccagcagcagcccactctcccaaccccccccgcgctgggagaagtaccacaagagctacagtcgccagcgggcgaaggtgggagcagtacccagctcctgatgcctgtcgagccagaggaactcggaccgaccaggccaagcggagaggctgagacaacccaaatggagctgagtcccgcacccacgatcaccagcctgtctcccgaacgagctgaggactcagatgctttgacagctgtgagttcccagctcgaggggagcccaatggacacatcttctcttgccagctgtaccctggaggaggctgtgggtgacacatcagccgccgggtcatctgaacagccccgagccggatcttccacccccggcgacgcccctcctgccgttgctgaggttcagggaagatctgatggctcaggagaatcagctcagcctccagaggactcgagcccaccggcaagttccgagagctcaagcacccgggattctgctgtggccatttccggtgccgattcaaggggaattcttgaggagccactcccaagtacatccagcgaggaagaggatcccttagccggaatttcactgccagagggcgttgacccatccttcctggcagctctgcccgacgatatccggagggaagttctgcagaatcaactggggattaggcctcctactagaaccgcgccatccacaaattcctccgcacccgccgtggttggaaatccaggggtcacagaggtcagcccagaatttctcgccgctctgccacccgcaatccaagaggaggtgctcgcccagcaaagggcagaacaacaacggagggaactggcacagaatgcaagtagcgacacacccatggatccagtcaccttcattcagaccctgccgagcgaccttcgccgaagcgtgctcgaggatatggaggatagcgtcttagcagtgatgcctcccgatatcgccgccgaagcccaggcactgaggagggagcaagaggcgcggcagaggcagttaatgcacgagaggctcttcgggcattcatctactagtgccttgtctgccatacttagatccccggcgtttaccagcaggttgtcaggcaacagaggggtgcaatatacccggctcgccgtacagcggggaggcactttccaaatgggcggatcaagcagccacaaccgacccagcgggtctaatgtcgacacattgctgcgactccggggcagactcctacttgaccacgaagcattatcttgccttcttgtgctgctattcgttgacgagcccaagctaaatacaagccgattacaccgagtcctgcggaatctatgctaccatgctcagactaggcactgggtgatacggagcctactgtcaatcctgcagcgttcgagcgagtctgagctgtgtatcgagacccccaaactgaccactagtgaggagaagggaaagaagtcaagcaagtcttgcgggtctagctctcatgaaaatagaccgctcgacttgctgcataagatggaaagcaaatcctctaaccagttgagctggttatccgtgagtatggatgctgccctgggttgtcgcacaaatatatttcagatccagcggtccgggggaaggaaacacactgaaaagcacgcatcagggggatcaacagttcacattcatccgcaggcagctcctgtggtctgcaggcacgttctagatacattgatccagcttgccaaagtgtttccaagccattttacccagcagcggacaaaagaaactaactgcgagtccgacagggaaagggggaataaagcctgtagcccatgctcttctcagtcaagctcatcagggatttgtacagatttctgggacctcctggtcaaactggataatatgaacgtgagcaggaagggaaagaatagcgtgaagagtgtgcccgttagcgcggggggtgagggggaaacatcgccgtacagcctcgaggcctcacctctgggacagttaatgaatatgttgagtcacccagtgattcgacgctccagcctgctgactgagaagttgttgagactactgagcctgatttctatcgcattacccgaaaataaagtctctgaggcccaggcaaactcaggatctggcgcatcgagtaccaccaccgccacctcgacaactagtactacaaccactactgcagcatcaactacaccaaccccgccaacagcccctactccagtgacatccgcccctgctttggtggcggctacagcaatcagtactatcgttgtggccgcatcaaccacggtgactacccccactaccgcaacgacaacggtgtctatctcccctactacgaagggttccaaatctcccgctaaggtgtccgacggaggttcctcatctactgactttaagatggttagctccggtctgaccgagaatcagctgcagctcagcgtcgaggtcctgacgagccactcatgttccgaggaaggcctcgaggacgcggccaacgtactcctgcagcttagcaggggagacagcggcacccgagatacagtccttaagctgctactgaatggcgctagacatctggggtacacgctttgcaagcaaatcggcacactgcttgccgagctgagagaatacaatctcgagcagcagaggcgtgcacaatgtgagacactcagtcctgatggcctgccagaggagcagcctcagacgacaaagctgaagggaaagatgcagtcaagatttgatatggcagagaacgtggtgattgttgccagccaaaagagacccctcggtggacgggagctgcagctgccttccatgtccatgttgacatcaaaaaccagcacacagaagttcttcctcagagttctgcaggtgattatacagctgagggacgatacccgaagggccaacaagaaggccaaacaaaccggacgcctcggctctagcgggctcggcagtgccagctccatccaggccgccgtgcggcagctggaagcagaggccgacgccattatccagatggtgcgtgaaggccaaagagctcggcgacaacagcaggcagctaccagcgagtcttctcagtccgaggccagcgtcagaagggaagagtctccgatggatgtggatcagcctagcccgagtgcccaagacactcagtccatcgccagcgacgggactccccagggtgagaaggagaaagaggagcgccctcctgaactacccctcttgtctgagcagctgtcactagacgaattatgggacatgttgggagagtgtctcaaagagctggaagagtcacacgaccaacatgctgtgctggtccttcagcctgcagtggaagcgttttttctcgtccacgccaccgaacgggagtctaaaccacctgtgcgggacaccagagaatcccagttggcgcatattaaagacgagccacccccactcagccctgccccactcacccctgcaactccttcgagcctcgatccgttctttagcagggaaccaagctcaatgcacattagctccagtctcccacccgacacccagaaatttctgcgattcgcagagacacataggaccgtgttaaaccagattcttcgccaatctacaactcatcttgcagatggcccttttgccgttctggtcgattacatcagggtgctggatttcgacgtgaagagaaagtactttagacaggaactggagaggctcgatgagggcttacggaaagaggacatggctgtacacgtgagacgggaccatgtattcgaagactcatatagagagctgcacagaaaatcccccgaagagatgaagaaccgcctgtacatagtgtttgaaggggaggaggggcaggacgccggggggctgctcagggagtggtacatgatcatctcccgagagatgtttaaccctatgtacgcgctctttcggacctcccccggcgatcgtgtaacttataccatcaaccccagtagccactgtaatcctaaccatctgtcctacttcaagtttgttggtcgcattgtagccaaagcggtttatgataatagattgctggaatgctactttacccggtcattctacaaacacattctaggaaagtccgtccgctatactgatatggaatccgaagactaccatttttaccagggcctggtgtacctactagagaatgatgtcagcaccctcggctacgacttgacatttagcaccgaggtgcaggaatttggagtttgtgaggtccgtgaccttaagccaaatggagccaatattctcgtgacagaggagaacaagaaagagtatgtgcatttagtgtgtcagatgcgcatgaccggggcgatccgcaaacaactggccgcgttcttggaagggttttacgagattattcccaagcgactgattagcatcttcacagagcaggagttagaacttttgatctctggtttgcccaccatcgatatcgacgatcttaagtcaaataccgagtatcacaaataccagtcaaatagcattcagatccaatggttctggagagcccttaggagtttcgaccaggcagatcgggctaagttccttcagttcgtcacaggaacctccaaagtgcctttacaaggtttcgctgcgttagaaggaatgaacggtatacagaagttccagatccatcgagacgatcgctccactgatcggttaccaagcgcacatacatgttttaatcagcttgatctgccggcatatgaatctttcgaaaagttacgtcatatgttgctgctcgccattcaagaatgcagcgaggggttcgggctggcctag

SEQ ID NO: 190435 - DNA, 651 bp, Artificial Sequence
  Description of Artificial Sequence: Synthetic coding sequence
atgaaggtggaccggaccaagctgaagaagacccccaccgaggcccctgctgattgtcgggccctgattgataaactgaaagtgtgcaacgatgagcaacttcttctagaattgcagcagatcaagacctggaacattggaaagtgtgagctctaccactgggtggatctgctggacagatttgatgggattctggccgacgccgggcagaccgttgaaaatatgagctggatgctcgtttgcgaccgacccgagcgcgagcagctgaaaatgctcctgctcgctgtcctgaacttcaccgccctgctcattgaatactcattttctcgacatttatacagcagcatcgaacacctaaccaccctccttgcctcctcagacatgcaagtggtgcttgccgtactgaacttgctgtatgtgttctccaagagatctaattatattacccgtctgggctcagacaagcgaaccccactgctgacccgtctccagcacctggccgaatcgtggggaggaaaggagaacggtttcggcctcgctgagtgctgccgcgacctccatatgatgaaatacccccctagcgccacaacactgcattttgaattttatgcagatcctggggcagaggtgaagattgagaagagaaagtag

SEQ ID NO: 190436 - DNA, 282 bp, Artificial Sequence
  Description of Artificial Sequence: Synthetic coding sequence
atgaaggtggaccggaccaagctgaagaagacccccaccgaggcccctgcagactgccgcgctctgattgataaacttaaagtctgtaacgatgagcagctgctcttagaactgcagcagatcaagacatggaatatcggcaagtgcgaactgtatcattgggtagacctgctggaccggtttgatggtattctggcagatgctgggcagaccgtggagaatatgagctggatgctcgtgtgtgaccgacccgagcgggaacagctgaagatgcttctctag

SEQ ID NO: 190437 - DNA, 1482 bp, Artificial Sequence
  Description of Artificial Sequence: Synthetic coding sequence
atgctgccccggtgggagctggccctgtacctgctggccagcctgggttttcacttctacagtttctacgaagtttataaagtcagcagggagcatgaggaagagctggaccaggagttcgaattggaaacagatactctgtttggagggctaaagaaggatgctactgactttgaatggtctttctggatggagtggggcaagcagtggctcgtttggctgctgctaggccacatggtggtgtcccagatggccacacttttggctcgaaagcatcgtccatggatactgatgctgtatgggatgtgggcatgctggtgtgtgctcggcacacccggcgtagcaatggttcttcttcacacaacaatttccttctgtgtggctcagttcaggagccagctgctgacttggctgtgttcacttctgctgctgagcaccctgcgcctccagggagttgaggaagtcaaaaggcgctggtacaagaccgaaaacgaatattacttactgcagtttacccttacagtgaggtgcctgtattacacctccttctccctcgaactttgttggcagcagcttcctgcagccagcacgtcttactcttttccgtggatgcttgcatatgtcttctactatcccgtgcttcacaacggaccaattctgagcttctctgagttcatcaagcaaatgcagcagcaggaacacgactctctgaaagccagtctgtgcgtccttgccctcgggctcggtcgcctgctttgctggtggtggttggccgagctcatggctcatttaatgtatatgcacgccatctacagttctatacctctcctcgagacagtttcttgctggactctggggggcttggccctcgcccaagtgctattcttctatgttaagtatctggtactgttcggagttccagcactcctcatgcgcttggatggcctgacccccccggctttgcctcgctgcgtctcgacaatgttttcattcacaggaatgtggcgatacttcgacgtaggcttacacaacttcttgattagatacgtctacattcctgtgggagggtcccagcacggcctcctgggtaccctgttcagtacggctatgactttcgcattcgtgagctactggcatggcggatatgactatctctggtgttgggccgccttgaattggctaggtgtaacggtggagaacggagtgcgtcgcctggtagagaccccgtgtatccaagacagtttggcccgttacttctcaccgcaagcccgcagaagattccacgctgctcttgcatcttgcagcacgtccatgttgattctcagcaatttggtgtttctgggcggaaacgaggttggaaagacctattggaacagaatattcattcaagggtggccatgggtaaccctgagcgttctggggtttctttactgttacagtcatgtggggattgcttgggcccagacgtacgctaccgactag

SEQ ID NO: 190438 - DNA, 1347 bp, Artificial Sequence
  Description of Artificial Sequence: Synthetic coding sequence
atgaagttcaccaagagccccgaggacgccaccgacttcgagtggtccttttggatggagtggggaaagcagtggttagtctggttgctgctgggacacatggtggtgtcccaaatggccacactgctggctagaaaacatcgaccgtggatcctcatgctttatggaatgtgggcctgctggtgtgtcctgggaaccccaggggtggccatggtcctgctgcacactaccatctccttctgcgtagctcaatttagatctcagcttctcacttggctgtgttccctgctgttgctgagtaccctgcgattacagggcgtcgaggaggtcaaacgacgatggtacaaaactgagaatgagtattatttactacagttcacactgactgtgagatgtctttattataccagcttcagcctcgagttatgctggcagcagctacctgccgcctctacgtcctacagctttccctggatgctcgcatatgttttttactacccagtgctgcataacggacctattctgagtttctcagagtttattaaacagatgcaacaacaggagcatgactccctgaaggcctctctatgcgtgctggccttgggtctgggaaggctgctgtgctggtggtggctggccgaactcatggcacacttaatgtatatgcacgccatctacagttccattccccttctggagacagtgtcttgctggactttgggcgggctcgctttagctcaggtgctgttcttctatgtcaagtatctcgtcctctttggcgtgcctgccttactgatgaggctcgacggcctgacacccccggccctgccccggtgcgttagcacaatgttttctttcacaggaatgtggcggtacttcgacgtaggcctacacaacttcctgattcgttatgtgtacatacctgtcggaggaagccagcatggactgctcggaacactgtttagcaccgcgatgacattcgcatttgtatcttactggcacggtggttacgattacctctggtgctgggctgcccttaactggttgggtgtgaccgtcgagaatggagtgcgaaggctggtagagacaccatgcatccaagatagtttggctcggtactttagtccccaagctcgcagacgctttcatgctgcactcgcgagttgcagtacatcgatgctgattttgtcgaatctggtcttcctgggaggtaatgaggtcggcaagacttactggaatcggattttcatccagggctggccatgggtgactttgagcgtgctggggtttctgtattgttactcacacgttggcattgcttgggcacagacatacgctactgactag

SEQ ID NO: 190439 - DNA, 552 bp, Artificial Sequence
  Description of Artificial Sequence: Synthetic coding sequence
atgcggctggacggcctgaccccccccgccctgccccggtgcgtgtccacaatgttcagttttaccggcatgtggcggtatttcgacgtcgggttgcacaattttcttatacggtacgtgtatataccagttggcggcagtcaacacggccttttgggaactctcttctccacagcaatgacgttcgcgttcgtcagctactggcacggcggctacgactacctgtggtgctgggcagccctgaattggttaggagttacggtggagaacggtgtgaggcgccttgtcgaaacaccgtgtattcaggacagcctggcaaggtacttctcacctcaagcacggcgccggttccatgcggcgcttgccagctgcagcacttctatgttgattctgtctaaccttgtctttctggggggtaatgaggtcgggaagacatactggaatcgcatctttattcagggctggccctgggtgactctgagcgtcctcgggttcctgtactgctactctcatgtggggatcgcctgggcgcagacctatgcgaccgactag

SEQ ID NO: 190440 - DNA, 1482 bp, Artificial Sequence
  Description of Artificial Sequence: Synthetic coding sequence
atgctgccccggtgggagctggccctgtacctgctggccagcctgggtttccatttctattccttctacgaggtttataaggtgtcccgtgagcacgaggaggaactggatcaggaattcgaactggagacagataccctgtttggtggacttaaaaaagacgcaaccgacttcgaatggtctttctggatggaatgggggaagcagtggctagtctggctcctgctcgggcatatggtggtctcacagatggctacactgctcgcccgcaagcaccgaccctggatcctgatgttgtatggcatgtgggcctgttggtgcgttctgggaactcctggagtcgccatggttttgttacacaccacgatctcgttctgcgtggcccaatttcgatcacaactcttgacatggctctgcagcctgctgctgctctctaccctccggctgcaaggggttgaggaagttaaacggagatggtacaagactgagaacgagtattacctgctgcagttcactcttactgttcgctgtctctactatacatctttttcattggaactgtgttggcaacagcttcctgcggcctcaacttcatatagtttcccctggatgttggcttatgtgttctactacccggtgctacacaatggccccattctgtcgttctcagaattcattaagcagatgcaacagcaggagcacgattcccttaaagcttccctgtgcgtgctggctttgggactggggagacttctgtgctggtggtggctcgctgagctgatggcccacctgatgtacatgcatgccatctactcttccattccactgttggagaccgtgagctgctggacccttggtggcctcgccctggcccaggtgctgttcttttatgtgaagtaccttgtactttttggcgtgccagctctccttatgaggctggacggactgacgcctccggcattgccacggtgtgtgtcgaccatgttttccttcacaggaatgtggcgatacttcgatgttgggttgcacaacttcctcattagatacgtgtacatccccgttgggggctcgcagcacggcctcctcgggacactgttttccaccgccatgacttttgcgtttgtttcttattggcacggcggatacgattatctgtggtgttgggccgccttgaattggctgggagtaaccgtggagaacggagtgcggagacttgtggagacgccttgtatccaagactcactcgcccgctacttcagtcctcaagcgcgcaggcggttccacgccgcacttgcttcctgtagcacttccatgctaatacttagtaaccttgttttcctgggggggaatgaagtgggaaaaacctattggaaccggattttcatccaaggatggccgtgggttaccctgagtgtccttggattcctgtactgctactcccacgtcggcattgcctgggctcagacctatgctaccgattag

SEQ ID NO: 190441 - DNA, 1557 bp, Artificial Sequence
  Description of Artificial Sequence: Synthetic coding sequence
atgctgccccggtgggagctggccctgtacctgctggccagcctgggcttccatttttattctttctacgaggtgtacaaagtgtcacgagagcacgaggaggagttagatcaggagttcgaactggaaacagatactctgttcggcggcctgaagaaagacgccactgacttcgagtggtcattttggatggagtggggtaaacagtggcttgtctggctgctccttggtcacatggttgtttcccagatggccactctgctggctaggaaacacaggccctggatcctgatgttgtatggaatgtgggcctgttggtgcgtgctgggcacacctggtgtggccatggtgctactgcataccacaatttccttttgcgtggcccagtttagaagtcagctcctcacctggctatgctctctgctcctgttgagcacgctgcgactgcagggagttgaagaggtgaagcgcaggtggtacaagacggagaatgagtactacctgctacagtttaccctgactgtcaggtgcctgtactatacaagcttcagtctagaactgtgctggcagcaactcccggccgcatccacctcttattctttcccttggatgttagcatacgttttctattaccccgtgctgcacaatggccccattcttagcttctctgaatttattaagcagatgcagcagcaggaacatgatagccttaaggccagtttatgcgtcttggcactggggctcggtcgccttctttgctggtggtggctcgctgagctgatggcgcatctgatgtacatgcatgcaatatattcttcgataccactcctcgagacagtgagttgctggaccctcggggggttggccttggcacaggttttatttttctacgtgaaatacctggtgctcttcggagtgcccgcccttctgatgcgtctcgacggcctgactccccccgccttgccacgatgcgttagcactatgttctcgtttaccggcatgtggaggtactttgacgtgggactccacaactttttgattcgttatgtgtacatccccgtgggcggatcccagcacgggctgctggggactttgtttagcacagctatgacgtttgctttcgtgagctattggcacggcggctatgactatctatggtgttgggccgcattgaactggctcggcgtcaccgtggagaacggcgtgcgcagattggtcgaaacaccctgcatccaggactccctcgcccgctactttagtcctcaggcaagacggcgtttccatgccgccttagccagttgctctacaagcatgctgatcttaagcaatttggtattcctgggtggcaacgaggtggggaagacttactggaatcggatattcatccagggggggttgttcctgttcttcctcctgaacccctgctgggaaacagctttccaggggttccccgtgttccttcacttcctgcagacagaggtgcttgccaccttcgtccccaactatttctcttggaatatttgtattgaaaacaccagcgagttaagttcttactag

SEQ ID NO: 190442 - DNA, 1482 bp, Artificial Sequence
  Description of Artificial Sequence: Synthetic coding sequence
atgctgccccggtgggagctggccctgtacctgctggccagcctgggctttcacttctactccttttacgaggtatacaaagtgtccagagaacatgaagaggagcttgaccaggagttcgagctggaaactgacacactgtttggtgggttaaagaaagacgcaactgactttgagtggagtttctggatggaatggggaaagcagtggctagtttggcttcttttggggcatatggttgtgagccagatggctacccttctggctcgcaagcatcgcccatggattctcatgctatacggtatgtgggcgtgctggtgtgtgctcggcacaccaggtgtcgcaatggtgctcctgcacacaacgatctccttctgcgtcgcacaattccgttctcagttgctcacatggctgtgttccctgctactcctctccactttacgccttcagggagtggaagaagtcaaaagaagatggtacaaaacagagaatgagtattacctcctccagttcaccttgactgtgagatgcctctattacacttcattttcactggagctgtgttggcagcaactccccgccgcaagcacatcatactcctttccttggatgcttgcctacgtcttttattaccctgtactgcacaacgggcctatcctgtccttctctgaattcatcaagcaaatgcaacaacaggaacacgattctctgaaagcctctttatgcgtgctggcccttggtttgggcagacttctctgttggtggtggttagctgagctgatggcccatctgatgtatatgcatgccatctactcctctattcctctgctggagaccgtcagctgttggacgctcggaggactggctttggcacaggtgctgttcttttacgtgaagtatctcgtgctgtttggggttccagctttgctcatgagattggacggtctgaccccaccagccctgccaaggtgtgtgagcacaatgtttagtttcaccggtatgtggagatattttgatgtgggactgcataattttcttataaggtacgtgtatatcccagtcggtggaagccagcatggcctgcttggcaccttatttagtacagctatgacttttgcatttgtgtcgtattggcacggaggctatgattacctctggtgctgggctgccctcaactggctcggggtgacagtggagaacggtgtgaggaggctcgttgaaacaccctgcattcaagacagcctcgcgaggtatttctctccacaggcccgccgaagattccatgccgctctcgcatcatgcagcactagtatgttgatcctatccaacctggtatttttgggtgggaacgaggtgggcaagacttactggaatcgtattttcattcaggggtggccctgggtgaccctttctgtcttggggtttctctactgttactcccatgtcggcatcgcatgggcacagacgtacgcaacggattag

SEQ ID NO: 190443 - DNA, 624 bp, Artificial Sequence
  Description of Artificial Sequence: Synthetic coding sequence
atggagtggggcaagcagtggctggtgtggctgctgctgggccacatggtggtgtcgcagatggctactttattggctcggaagagaaggtggtacaagaccgagaacgaatactacttgctccagttcacactcacagttagatgtctgtactatacttcctttagtctggagttgtgctggcagcaactgcccgccgcatccacctcctatagtttcccctggatgcttgcatacgtgttctactaccccgtcttgcacaacggcccaatcttgtctttttccgagttcattaaacaaatgcaacagcaggagcatgattcactgaaggcaagtctgtgcgtgttggcgttggggttgggccgtctactttgttggtggtggctggccgagttaatggcccatcttatgtacatgcacgccatctattccagcatcccactgctggaaactgtgagctgttggactttgggcggtctggcgctcgcccaggtattgttcttctacgtgaaatatttggtgctcttcggcgtccccgcactcctgatgcgcctggatggattgacgcctcccgctttacccagatgcgtgtccaccatgttttccttcactggtatgtggtag

SEQ ID NO: 190444 - DNA, 1287 bp, Artificial Sequence
  Description of Artificial Sequence: Synthetic coding sequence
atgctgccccggtgggagctggccctgtacctgctggccagcctgggctttcatttctacagcttttatgaagtttacaaagtgtctcgcgagcatgaggaagagttggaccaggaatttgagcttgagacggacactctgttcggcggtctcaagaaggatgccaccgacttcgagtggtccttctggatggagtggggcaagcagtggctcgtatggctgctgcttggccacatggtggtgagccaaatggcaactctgctagcaaggaaacgtcgctggtataagactgagaacgagtactacttactccagttcactctgaccgtaaggtgcttgtattacacctcattcagtcttgaactttgctggcaacagctgccagccgcttctacgtcctatagcttcccctggatgcttgcttatgtattctactatccggtcctccacaacggtcctatcctcagtttttctgagtttataaagcagatgcagcagcaggagcacgatagtctcaaagcatccttgtgcgtgttagcgctgggtctggggcgccttctgtgttggtggtggttagccgagctgatggcacacttgatgtatatgcatgccatatacagttccataccactactcgaaacagtcagctgctggaccctcggcggactggccctggctcaagtcctgtttttttatgtgaagtaccttgtgctgtttggggtgcctgcattactgatgagactggatggcctcactcccccagctctgcctagatgcgtatccacgatgttcagttttacaggcatgtggcggtactttgatgttggactgcacaacttccttattcggtacgtatacatccctgtcggtggcagtcagcatggactccttggcaccttgttcagcactgccatgactttcgcgtttgtgtcatactggcacggaggatatgattacttgtggtgctgggcggccctgaactggcttggtgtgaccgtggaaaatggagtgcgcaggttggtggagacaccctgtattcaggactctctagcaaggtactttagcccccaagctagaaggcgcttccacgccgctctggcaagctgctcaacctccatgctcattctgtctaaccttgtcttcttgggcggtaacgaggttggtaagacatactggaataggattttcatccaaggctggccgtgggttaccctgagcgtattaggatttttatattgttactcacacgtgggaattgcttgggcacagacttatgctactgactag

SEQ ID NO: 190445 - DNA, 1071 bp, Artificial Sequence
  Description of Artificial Sequence: Synthetic coding sequence
atgctgccccggtgggagctggccctgtacctgctggccagcctgggcttccatttctattccttctacgaggtgtataaagttagcagagagcatgaggaagagttagatcaggaattcgagctggagaccgacacactgtttggaggtctcaaaaaggatgctactgattttgagtggagcttttggatggaatgggggaagcaatggctggtctggcttcttcttggccacatggtggttagccagatggccacattgttggcaagaaagatgcaacagcaagagcacgacagccttaaagcatctttgtgcgtgttggcacttggcttgggaagactgttgtgttggtggtggctcgctgaactgatggcgcatctgatgtatatgcacgctatttacagctccatccctctgctcgagactgtctcgtgctggacgctaggaggactggctttagcgcaagtcctgtttttctatgtgaaataccttgttctatttggggtccctgcccttctgatgcggcttgacggcctaactcctcctgccctgccccgctgtgtgagcacaatgttctcctttacaggcatgtggcgatacttcgatgtgggcttgcacaatttcctcattcgctacgtctacatcccggtcggaggttctcagcacggactgttgggaaccctgttctcaacagcaatgaccttcgcatttgtatcttactggcacgggggttacgactacttgtggtgctgggctgctctcaattggctgggggttaccgtcgagaacggagtgcgaaggctggtagaaacaccctgtatccaagactctttggctaggtacttttccccccaggccagaagacgcttccatgctgctctcgcatcctgttccacatccatgttaattctgagtaatctggtctttttggggggtaacgaagtgggtaaaacatactggaaccggatctttatccaaggctggccttgggtcacactgtcggtgctagggttcttgtattgctactcccatgtcgggatcgcctgggctcagacctatgccacggattag

SEQ ID NO: 190446 - DNA, 1485 bp, Artificial Sequence
  Description of Artificial Sequence: Synthetic coding sequence
atgagcctgggcctgggcagcgccgagcggggcgtgctgggcacccggggggccagagagcgctgcaggagacgccgaccgggccagcccggcgaacacgaagaggaattggatcaggagtttgaactggaaactgataccttattcgggggcctgaagaaggatgcgactgatttcgagtggagcttttggatggaatggggcaaacaatggctagtatggttgctactcggacatatggtagtcagtcaaatggcgaccttattagcccgaaagcaccggccatggattctcatgttgtacggtatgtgggcttgctggtgcgttctcggaacgccaggggtcgcgatggtgctgttgcacaccacaattagtttctgcgtagcccagttcagatcccagctgttaacttggctctgcagcctcctcctgctgtcgacgttaagacttcagggggtggaggaggttaagcggcgctggtataagactgagaacgagtactacctgctacagttcaccctgactgttcgctgtctctattacacctctttctccctggaactatgctggcaacagttgcccgcagctagcacgtcatacagcttcccctggatgttggcttatgttttctattatcctgtgttgcataacggcccgatcctttccttttctgagttcatcaagcagatgcagcagcaggagcacgattccttaaaagcctctctgtgtgtactcgcccttggattgggacgtctcctgtgttggtggtggctagccgaattgatggcacacctgatgtacatgcatgccatctattcttcaatccctctgttggagaccgtctcgtgttggacactgggcggtctcgcattggcccaagtgctcttcttttacgtaaagtatctggttctcttcggcgtgcccgctctccttatgaggcttgacggcttaacaccaccagcccttccgaggtgtgtgagtacaatgtttagttttaccggtatgtggagatacttcgatgtgggcttgcacaacttcctcataagatacgtgtacatccctgtcggcggttctcagcacgggctgctgggtactctgttcagcaccgccatgacattcgccttcgtatcttactggcacggcggctatgactacttgtggtgttgggcggcactgaactggctgggagtgacggtcgaaaacggagtaaggaggttagtggagacaccgtgtatacaagactctctggcccggtacttttctccccaagctcgccgaagattccacgctgccctcgccagctgttccacctcaatgctgattttatccaatctagtgtttctcggcggtaacgaggtgggcaagacctattggaatcgcatcttcatccaaggttggccctgggtaactctgagcgtactcggatttctctactgctactcccacgtgggaatcgcctgggcccagacgtacgctacggactag

SEQ ID NO: 190447 - DNA, 1293 bp, Artificial Sequence
  Description of Artificial Sequence: Synthetic coding sequence
atggagtggggcaagcagtggctggtgtggctgctgctgggccacatggtcgtgtctcagatggctacactgttggcaagaaagcaccgcccgtggatattgatgctgtatgggatgtgggcatgttggtgcgtgctgggaacccctggcgttgccatggtgctcctccacacaacaatctctttttgcgttgctcaatttcgatcccagctcctgacctggctctgctccttgctacttctgagtacgctcagacttcagggggtggaggaggtgaaacgacgctggtataagactgagaacgaatattatctgctacagttcactctcacggttcgctgtctatattatacctcgttttctttagagctttgttggcagcagttgcccgccgcctccactagctacagttttccctggatgctagcttacgtcttctattaccctgtactgcacaacggtccaatcctgagcttctcagagtttatcaaacagatgcagcaacaggagcatgattctcttaaagcttcattgtgtgtcttggccctggggttgggccgcctcctgtgttggtggtggctcgccgagttaatggcccatctgatgtatatgcatgctatatactcaagtattccccttttagagaccgttagctgctggacccttggcggtctggccctggcacaggttctgttcttttacgtgaaatacctggtgctatttggcgtccccgcactgcttatgaggttagacggcttgacgcccccagccctgcctaggtgtgtcagcacaatgttctccttcacaggaatgtggcggtactttgatgtgggcttgcacaactttctcatcaggtatgtatacattcctgtgggcggtagccagcacggcctcctggggaccctattcagcacagccatgacgttcgcttttgtgagctattggcacggaggctatgactacttatggtgctgggcagcattgaattggctcggggtgaccgttgaaaatggggttaggcgtctcgtggagaccccttgtatccaggactcccttgcgcggtacttctccccccaggcccgtcggagattccacgccgcgttagcaagctgctcaacctccatgctcatactatccaatctcgtgttcctgggaggcaacgaggttggcaagacctactggaacaggatcttcattcagggatggccgtgggtgaccttatcggtactcggattcctatattgctactcgcacgtgggcatcgcctgggcccagacatacgcaacagattag

SEQ ID NO: 190448 - DNA, 2103 bp, Artificial Sequence
  Description of Artificial Sequence: Synthetic coding sequence
atgctgaagatgctgagcttcaagctgctgctgctggccgtggccctgggctttttcgaaggagatgctaagtttggtgaacggaacgaaggctctggcgcaaggcgcaggcggtgtctgaacggtaaccctcctaagaggctcaaacggcgggataggcgaatgatgtcacaattggagctcctgtcaggcggagagatgctttgtggcgggttttacccaagacttagctgctgccttagatctgactctccaggtctcggtcggctggagaacaagatcttcagtgtcacgaataacacagagtgtggcaagctgcttgaggaaatcaagtgcgccttatgttccccccactcccagtctctatttcactcccccgaacgggaagtgctggagagggacctggtgctgcccctactgtgtaaagactactgtaaagaatttttctacacgtgcagaggtcacatcccaggttttctccaaactactgctgacgaattctgtttctactacgctcgcaaagacggtggactatgttttcctgacttcccacggaagcaggtgcgtggtccggcctccaattacctcgatcagatggaggaatacgataaggtggaagagatcagtcgcaaacacaaacataattgcttctgcattcaggaggtggtgtccggactccggcagccagtgggagccctgcacagcggcgatggtagtcagcggctgttcatcctggagaaggaaggctacgtaaaaattcttacccctgaaggagagatttttaaagagccttatctagatatacacaagctggtgcagtccgggatcaaggggggcgatgaaaggggcctgttgagcctcgcatttcatcccaactataagaaaaatggaaagctgtacgtatcctataccaccaatcaggaacgctgggcgatcggtccccatgaccacatccttagagtggtagagtacactgtgtcaagaaagaatcctcatcaggtagacctcaggactgcccgcgttttcctagaagtggccgagttacaccggaaacacctcggagggcagctgctgttcggccccgatggttttctgtacattatcctgggcgacggaatgatcacactagacgacatggaggagatggatggtctctctgactttacaggtagtgtcctgagactggacgtggataccgacatgtgcaacgttccttatagtattccccggagcaacccccacttcaattccacgaaccagcctccagaggtgtttgctcacggtttacatgatcctggccgctgcgcagttgatcgtcaccctacggatataaatattaaccttacaatactctgttctgactccaatggcaaaaatcgctcctccgctcgaatccttcaaataatcaaggggaaagactacgagtctgagccaagcctgttggagtttaagccgtttagcaatggccctttggtgggtggcttcgtctaccgggggtgtcagagtgagcgcctctatgggtcctatgtcttcggcgatcgtaacggaaactttctgacactgcagcagagcccagtcacaaagcagtggcaggaaaaacctctttgtcttgggacgtccgggtcctgtagaggctacttctcgggccatattttagggtttggtgaggacgaactgggtgaggtatacatactgagctcttcgaagtctatgactcagactcataacggtaaactgtacaaaattgtcgaccccaaacggccgctgatgcccgaggagtgtcgcgctacagtgcagcccgcacagacacttacttcggagtgctcccgtctgtgccggaacgggtattgcacccccaccggaaagtgttgttgcagcccggggtgggagggggacttctgcagaacagctaagtgcgagcctgcgtgtagacacgggggcgtctgtgttaggcccaataaatgcttgtgtaaaaagggctacctggggccacagtgcgaacaggttgataggaacatccgacgggttacccgagcaggcattctggatcagatcattgacatgacctcctacctgctggatttgacttcatatatcgtgtag

SEQ ID NO: 190449 - DNA, 963 bp, Artificial Sequence
  Description of Artificial Sequence: Synthetic coding sequence
atgctgaagatgctgagcttcaagctgctgctgctggccgtggccctcggattttttgaaggcgatgctaagttcggagaacggaatgagggctctggggctcggcgccggaggtgcttaaatggcaatccaccaaagcggttaaagcggcgcgacaggcggatgatgagccagctggagcttctgtctgggggagagatgctgtgcggcggcttttacccgcgcctgagttgctgtctgcgatcagatagcccagggctgggcagactggaaaacaagatattctccgtcacaaacaacaccgagtgcggaaagctgcttgaagaaatcaagtgtgctctgtgctcccctcactctcagagtctgtttcacagccccgaacgcgaggtattggagagggacttggtgctgccgctactgtgcaaagattattgcaaagagtttttttacacctgtcgaggtcacatccccggcttccttcaaactaccgccgatgagttttgtttttactatgctaggaaagacggaggcctgtgcttccctgatttcccccgtaagcaagtgcgaggacccgccagcaactatctggatcaaatggaggaatacgataaggtggaggagataagcagaaagcacaagcacaactgcttttgtatccaggaggtcgtatcgggtctcagacagccggtcggcgcactgcattccggggatggctctcaaagactattcattttagaaaaggagggttatgtgaagattctcacacccgaaggggagatattcaaggagccttacttggacatccacaagctggtccaaagcggaatcaaggttggctttctgaactttatttatttctgcgctggctatgttaattttatacttgtattgccctcaagcttgaaagtgttcctgtgtaacaaaaggaaaaatctagccggcgaaaataagggagccacctag

SEQ ID NO: 190450 - DNA, 4146 bp, Artificial Sequence
  Description of Artificial Sequence: Synthetic coding sequence
atggccagcccccgggccagccggtggcccccccccctgctgctgttactcctcccattgcttctgcttcctcctgccgcccccggtacccgcgacccccccccttcgcccgcacgccgtgctctttctctcgcgccgctggccggcgcagggctcgaactgcaactcgagcggagacccgaacgagaacctccaccgactccacctcgggaaagacgtgggcctgcaactcctggcccttcctacagggctccagaacctggggccgcaacacaacgcggcccatcaggaagggcaccgcgcggaggctccgccgatgcagcatggaaacactggccggaatcaaataccgaagcacatgtagagaatatcacattttatcagaatcaggaagatttctccaccgtgagtagtaaagagggcgtgatggtacagacttctggcaagagtcatgccgcatccgacgctcccgaaaaccttaccctgctggccgagaccgcggacgcgaggggcagatccgggtcctcctctaggacaaactttaccatcctccccgtaggatacagtttggaaattgctactgctttgacttctcaaagcggaaacttagctagtgagagcctgcacctgcccagtagtagttccgaattcgatgagcgaattgcagcctttcagacgaagtccgggacagcctcagaaatgggcacagagagggctatgggcttgtccgaggaatggaccgtacactcccaggaggccactacaagtgcctggtccccaagcttcctgcctgccctagagatgggagaactgaccaccccatcgagaaagcgaaactcttctggacctgacctgagctggctgcacttctatagaactgccgccagcagtccattactggatctttcttccagctccgaatctacagagaaactgaacaatagcacaggtctgcagagcagcagcgtcagccagacaaaaaccatgcatgtggctaccgtcttcactgatggcgggccccgaaccctgaggtctctgacagtgagtcttgggcccgtgtccaaaaccgaagggttccctaaagactccagaattgccaccacatcctcatctgtgctcttgagccccagcgcggtggagtcgcggagaaactcccgcgtgacgggcaatccaggggatgaggagtttatcgagcccagcacagaaaatgagttcggccttaccagcttgagatggcaaaacgactcccccacttttggcgagcaccagctcgcatcctctagcgaggtgcaaaatggttctcccatgagccagactgaaaccgtctcccggagtgttgcccccatgcgtgggggagagatcacagcacactggcttctgactaattccaccacttccgccgatgtgactggctcctctgctagctatcctgaaggagtcaacgcttcagtactcacgcagttcagcgattccaccgtgcagtctggcggttcccatacggctcttggggataggagctactctgagtcttcctcaacatcaagctccgagagtctgaattcctccgccccccggggcgagcggtcgattgccggtatttcgtatgggcaggttcgaggcaccgccatagagcaaaggaccagcagtgaccacacagaccacacctacctgagcagtacgtttaccaaaggcgagagggctttgctatctatcaccgataattccagcagcagcgacatcgttgaatcctcgacgagttacattaagatttctaatagctcgcactctgagtactcttcgtttttccacgcacaaaccgaacgatccaacatatcctcttacgacggggaatatgcccagcccagcacggaatcacccgtcctgcacacgtccaatttgccctcatatacacccaccattaatatgcctaacacttccgtcgtcctagatacagatgcagaatttgtgtctgactcatccagttccagctccagttcaagcagcagcagttccagtggaccacccctgccacttccttctgtgtcccagagccatcatcttttctcaagtatcctaccatctactcgggcttcggtgcatctgctaaagtcaacatccgacgcatcgacgccttggtccagcagcccttctcctctgcccgttagcctcactactagtaccagcgctccactttctgtatcacagacaactctgccccagtcaagtagcacccctgttctcccacgggcaagggagactcctgtgacctctttccagacgagcacaatgacatctttcatgactatgcttcacagctcccagactgctgatctgaagtcccaaagtactcctcaccaggagaaggtgattactgagtcaaaaagtcctagtcttgtgtcgctccccaccgagagcaccaaagcagttaccactaatagcccattacccccaagccttacggagtcctctacggagcagaccctgcccgcaactagcactaatcttgcgcagatgagtcccacattcaccactactatcctaaaaacatctcagccattaatgacaaccccgggcactctgtctagtacagcaagtctggtcaccgggcctattgctgtccaaacaacggcgggcaagcagttaagcctcacgcacccagaaattttagtcccacaaatatccactgagggaggtatttcgacggagagaaatagagtcatcgtggatgccacaactggtcttatacccctgactagcgttcccacaagtgctaaagagatgacgactaaactcggagtcaccgcagagtattcgcccgcgagccgctctctgggcacgtcacctagtccacaaaccacggttgtgagtacggccgaagacctggcccccaagagcgccacttttgccgttcagtccagtacccagtcgcccacaacagtgtcgagcagcgcttccgtgaattcctgcgctgtaaacccttgtttgcacaacggtgaatgcgtagccgacaacaccagcagaggctatcattgtaggtgcccaccatcctggcagggcgatgactgttctgtggatgtcaatgagtgtttatccaacccctgtccctcgactgccatgtgtaataatacccagggctccttcatttgcaagtgcccagtcggataccaactggagaaggggatctgtaatctggttagaacgttcgtgaccgagttcaagctcaaaaggacctttctcaacaccaccgtggaaaagcacagcgacttgcaggaagtggaaaacgaaattaccaagacactcaacatgtgcttttccgcactcccctcttatatacgctccaccgtgcacgcttcaagggaaagcaatgccgttgtgataagtctgcaaactacgttcagcctcgcctctaatgtcaccctgttcgatcttgctgatcgaatgcagaaatgcgtgaattcttgcaaatcaagcgctgaagtgtgtcagctcctgggctctcagcgcaggatcttccgcgcaggatctttgtgtaaacgaaagtcacctgaatgtgacaaggacacctctatctgtacagaccttgatggtgtggccttatgtcaatgtaagtcgggttactttcagtttaataaaatggaccactcttgtagagcttgtgaagatgggtaccgactggaaaacgaaacttgtatgtcttgccctttcggtcttggcggcctcaattgtggcaatccctaccagctcattaccgtggtgattgcagccgcaggggggggcctgctccttatcctgggcattgctctgatagtgacatgttgtaggaagaacaagaatgacatctctaaactcatcttcaaatccggcgatttccaaatgtctccatacgctgagtatcccaagaacccaagaagccaggagtgggggagggaggcgatcgagatgcacgagaacggttccacaaaaaatcttcttcagatgactgatgtgtactacagcccaacttctgttcgtaaccctgagctggaacggaatggactgtatccagcctacactggattgcctggatcacgccattcttgcatcttccctggacagtataatcctagtttcattagcgatgagtctaggcgacgagactatttctag

SEQ ID NO: 190451 - DNA, 5829 bp, Artificial Sequence
  Description of Artificial Sequence: Synthetic coding sequence
atggaggaccggcgggccgagaagagctgcgagcaggcctgcgagagtcttaaacggcaggattatgagatggccttaaaacactgtacggaggccctgctctctctcggccaatacagcatggcagatttcaccggaccgtgtcctctggagatcgagagaatcaagattgagtcgctgttatatcgcatcgcatcctttcttcagctgaagaattacgtccaggccgacgaagattgtcggcatgtacttggcgaggggctcgctaaaggagaggacgcatttcgggctgtgctgtgctgcatgcagctgaaaggaaagctgcagccggtgagtaccatcttagctaagtcgctaaccggcgagtctcttaacggcatggtcacgaaagacctgacccgcctgaaaaccctgctctccgaaactgaaaccgctacctccaacgcactgtctggctatcacgtagaagatcttgacgagggtagttgcaatggctggcacttccggcctccaccaagaggcataacatcaagtgaggagtacactctctgtaaaagatttctggagcagggaatatgtcgttacggcgcgcagtgtacatcagctcatagccaggaggaactcgcagagtggcagaaaaggtacgcctcaagactgatcaagctcaagcaacaaaacgagaacaagcagctctccggttcgtatatggagaccctgatagaaaagtggatgaattcactttctcccgagaaggtcctgagcgaatgtatcgaaggggtgaaggtggaacacaaccccgatctctccgtgacggtttccaccaagaagagccatcagacgtggacttttgctctgacatgcaagccagccagaatgttgtacagggtggctcttctgtacgatgctcaccgcccccacttcagtattatcgccatctcagccggagatagtactacacaagtctcacaggaggttcctgaaaactgccaggagtggattgggggcaaaatggcccaaaacggcctagatcactatgtgtacaaagtgggtatcgcatttaacaccgaaatcttcggtacgtttcgccagaccattgtgtttgacttcggccttgaacccgtgctgatgcagagggtcatgattgacgcagctagcaccgaggatctggaatatctcatgcatgcaaaacagcaactcgtcaccacggcaaagcgatgggatagttcatcaaaaacaattatcgactttgaacctaacgagaccactgatctggaaaaatccctcttgatccggtatcagattcccctgtcggcggaccagctctttactcaatctgtgttagacaagagcctgactaaatcaaattatcaaagtaggctccatgatttgctgtatattgaggaaatcgcacaatataaggagatatccaagttcaatctgaaggtgcagcttcagattctggcctctttcatgctgacaggcgtctccggcggcgcgaaatacgcccaaaacggccaactattcggaagatttaaactgaccgagaccttgagtgaggatacgcttgcaggccgcctagtgatgacgaaagtgaacgcggtttacctccttcctgtgcccaagcagaagctcgttcagacccagggcaccaaagaaaaggtgtatgaggctaccatcgaggagaagactaaagagtacatctttctccgtctctctagggagtgctgcgaggaactcaatcttagaccagattgcgatacgcaagttgagctacaattccagctgaaccggctacctttgtgtgaaatgcactacgcactcgaccggatcaaagataatggggtcctgtttccggatattagcatgactcccaccatcccttggtcccccaaccgacaatgggatgagcagctggaccctcggctaaacgccaagcagaaagaagccgtcctggcaattacaacgcctcttgcaatccagctgccgcccgttctcattatcggaccttacggaaccggcaagacctttaccctggctcaggccgtaaaacacatcctgcagcaacaggaaacacgtatactaatctgtactcatagtaactcagctgcagatctttatattaaggactacctgcacccatacgtagaggccgggaacccacaggctagacctttgagagtctatttccgaaatcggtgggtaaagacagttcaccccgtggtgcatcagtattgtctcatcagtagcgcacacagtacgttccagatgccacagaaggaggacatcctgaagcatagagtggtggtagtgactcttaacacttcccagtatctgtgtcaactggatttggaacctggctttttcacacacatcctgctggatgaggcagcccaagcgatggagtgtgaaacgattatgccactggcattagccacgcagaatactcgcatcgttctggctggagatcatatgcagctctcaccctttgtgtacagcgagttcgccagagaacgcaaccttcacgttagcctgttggacagactgtacgaacactatccagccgagttcccctgcaggatcctgctgtgtgagaattacaggtcacacgaagcaattattaattacacatccgagctcttctacgagggcaagctgatggcttcaggtaaacagcctgcccacaaagatttttacccacttacctttttcactgcccggggagaggatgtgcaggagaagaactccacagcattttacaacaacgcagaagtgttcgaagtggttgaacgcgtggaagagctcaggcgcaaatggcctgttgcttggggcaaactggatgatggaagtataggggtggttacgccttacgctgatcaggtcttccgcatccgtgccgagctccggaaaaagcgcctgtctgatgtgaacgtcgaaagggtgttgaatgtgcaaggaaagcagttcagggtgctcttcctgtccactgttaggacccgacatacgtgcaagcataagcagacccccatcaaaaaaaaggagcaactgctggaggattccactgaagacctagattatggcttcctttccaactataaattgcttaacaccgccataactcgcgcccagagcctagtagctgtagtcggggatcctatcgctttgtgtagtataggccggtgccggaaattctgggaacgctttatcgcattatgccatgaaaattctagtctgcatgggatcactttcgagcagattaaggcccagctggaagcgctggagctgaaaaaaacttatgttctgaatccactggcacccgagttcatcccgagagcacttaggctgcagcactcagggtcaaccaataaacagcaacagtcacctcccaagggtaaaagtcttcaccacacacagaatgaccattttcaaaatgatggtatcgtccaacccaatccatccgttctcatcggaaatcctatccgggcatatacccccccgccaccactgggtcctcatcccaacctgggcaagtccccttccccagtgcagaggattgacccccatacagggaccagcatactgtatgtaccggccgtttacggcgggaatgttgtaatgtctgtacccttacctgtcccttggaccggctatcaaggccggttcgccgtcgaccccaggattattacacatcaggcggcaatggcctacaatatgaaccttctacagacacacggcaggggctctcccatcccttacggtctggggcaccatcctccggtgacaattggacagcctcagaaccagcaccaagagaaggaccagcacgagcaaaataggaacggcaagtctgatacaaacaattccggacccgaaattaataagatccgcacaccagaaaagaagccgaccgagcctaagcaagtggacttagagagtaatcctcaaaacaggagccccgaatctaggccgtcggtggtgtacccctctacaaagtttccccgcaaagacaacctgaaccctcgccacattaatctgcctttgcccgccccccacgcacaatatgccataccaaatcgccatttccacccactgccccaacttccaagacctcccttcccgattccccagcagcacaccttgctcaatcagcagcagaacaatctgcctgagcagcccaatcagatccctccccaaccgaaccaagtagtgcaacagcagtcccagcttaaccagcagcctcagcagcctcctccccaattgtcgcctgcctatcaggccgggccaaataatgcttttttcaacagcgctgtggctcatagacctcaaagcccgcccgctgaagcggtgattcccgaacaacagccaccccctatgttgcaggaagggcactccccactccgcgctatagcccaaccgggccctatcctcccttcgcacctcaactccttcatcgacgagaacccgtccggcttaccaatcggcgaagctctggatcgaatccacgggtcggtagccctggaaacactaaggcagcagcaggcaagatttcagcagtggtccgaacaccacgctttcctctcccagggcagtgcaccataccctcatcaccaccatcctcatctccagcacctcccacaaccgcctcttgggcttcatcagcctccagtgcgcgccgactggaagctcacttcgagtgcagaggacgaggtggagaccacctactctcgatttcaagatttgattcgcgaattaagtcatcgcgatcagtcagagactagagagcttgctgagatgccacccccacagtcccggctcctgcaatacagacaggtccaatcccgctcaccgccagcggtgccatccccaccctcctctacagatcattcgagccatttttcaaacttcaacgataacagtagggacatcgaggtggcaagcaaccctgccttcccccagcggttgcccccccagatattcaattccccattcagcctcccctccgagcacttggcgcctccacctctgaagtacctggctcctgatggggcctggacgttcgctaatttgcagcaaaatcacttaatgggcccaggcttcccatatggccttcctcccctgcctcaccgccctccacagaaccccttcgtgcagatccagaaccatcagcacgcaatcggccaggagccattccatcccctgagcagtcgaacggtgagttctagctcactgccaagcttggaggagtacgagcccaggggacctggtaggccgttataccagcgcaggatatcgtcgagcagcgtccagccttgctcggaagaagtgtccacaccccaagactcattagcccaatgtaaagaactgcaagatcatagcaaccagtcctcctttaacttcagtagccccgagtcctgggtcaataccacatcgtccacaccgtatcagaacattccttgcaatgggagtagcaggactgctcaaccacgcgagctcatcgcacctcctaagactgtgaagccaccggaggatcagctgaaatcggagaatctggaggtcagttccagcttcaattattctgtactgcagcaccttggccagttcccacctctgatgccaaataagcagattgccgaatccgccaattcctcctctcctcagtcttccgcaggaggaaagccagccatgagctacgcctccgccttgcgagcacctcccaagccaaggcccccccctgagcaagcaaaaaaatcaagtgatcctctgagtctgtttcaggaactctctctggggtccagctcagggtccaatggcttttattcttattttaagtag

SEQ ID NO: 190452 - DNA, 1365 bp, Artificial Sequence
  Description of Artificial Sequence: Synthetic coding sequence
atggaggaccggcgggccgagaagagctgcgagcaggcctgcgagtccttaaagcgtcaggactacgagatggcactcaagcactgcactgaggcattactgtcactgggccagtactccatggccgacttcaccgggccatgccctctggagattgagcgcatcaaaattgaaagcttgctctatcgcatagcgagcttcttgcagttaaaaaactatgtgcaggccgatgaggattgtcggcacgtcctgggcgagggcctggcgaagggagaagacgcattccgggccgtcctgtgctgcatgcaattgaaaggaaagctgcagcccgtttctacaatattagccaaatcactcaccggcgaatcacttaacggaatggtgaccaaagatctgacacggcttaaaactctgctctctgaaacagaaactgcgacatctaacgctctttctggttatcacgtggaggatttggacgaggggtcttgtaatggatggcacttcagacctcctccacgagggatcacttccagcgaggaatacactctatgtaagaggtttctggagcaaggaatctgtcgatatggtgcccagtgtacatctgcacactcacaggaagaactcgccgagtggcagaaaagatatgcctccaggttgattaagctcaagcaacagaacgagaataagcagttatctggttcctatatggaaactctcattgagaagtggatgaatagcttgtcccccgagaaagtgctctcagagtgtatagagggcgttaaggtggagcacaaccccgacctgtcagtgactgtatcaaccaagaagtcccaccagacatggactttcgccctcacatgcaaaccagcccggatgttatacagagtggcacttctgtatgacgcacataggccccacttttccattatcgcaatttccgccggggattctacgactcaggtgagccaagaagtgcccgaaaattgtcaggaatggattggcggtaagatggcccagaacggactggatcactatgtttacaaagtcgggattgcatttaacacagagatttttggtacttttagacaaaccatcgtctttgacttcggcctggagcccgtgcttatgcaacgcgttatgattgacgctgccagcaccgaagacctggaatacttgatgcatgccaagcagcagctggtgaccaccgcaaagcggtgggattcctccagtaaaactatcatcgattttgagcctaatgaaactacggatcttgagaagagcctgctcattcgatatcagatccctcttagcgaaaagaaaaaaaaaaaaaaaaaaaaaaagaagaaaaaaaaaaaaaagaaatag

SEQ ID NO: 190453 - DNA, 294 bp, Artificial Sequence
  Description of Artificial Sequence: Synthetic coding sequence
atgcccgccgagcggcccgccggcagcggcggcagcgaggcccccgcaatggtggaacagctggacacagctgtgatcacgccggccatgctggaagaggaggaacagctcgaggcggcaggcctggaaagggaaagaaagatgctggaaaaagcacggatgagttgggatcgtgaatcaaccgagatacgatacaggcggctgcagcatttgctggaaaaatcaaacatatactcaaagtttctgttgaccaaaatggaacagcagcagcttgagacagtaatgaagatatag

SEQ ID NO: 190454 - DNA, 2517 bp, Artificial Sequence
  Description of Artificial Sequence: Synthetic coding sequence
atgcccgccgagcggcccgccggcagcggcggcagcgaggcccccgctatggttgaacagctcgataccgccgtcatcaccccagcaatgctcgaggaagaggaacagctggaagccgctggactggaaagggagaggaagatgctggagaaggcacggatgagctgggatcgggagagcacagagattcgttatcggcggttgcagcacctgctcgagaagagcaacatttatagcaagttccttctaaccaagatggagcagcagcagttggaggagcagaagaagaaggagaagttagagagaaagaaggagagtctcaaagtgaagaaaggcaagaattctatcgacgcctcagaggaaaagccagtgatgagaaagaaacgtgggcgcgaagatgagagctataacatctctgaagtgatgtctaaggaggagattctaagcgtggcaaagaagaacaagaaggaaaacgaagatgagaactcttcctctacgaacctatgtgtagaggacctccagaagaataaggattcgaactccatcatcaaggatagactctccgagaccgtgcgccaaaatacgaagttttttttcgaccctgtgaggaaatgcaatgggcagccagtcccatttcagcaacccaagcacttcaccgggggcgtgatgagatggtatcaagtggaggggatggagtggctgaggatgctatgggaaaacggcatcaatggcattctggcagacgaaatgggtctcggcaagaccgtgcaatgcatcgccactatagccctcatgattcagaggggggtgccgggtccatttttagtgtgtggacccctttctactctccccaactggatggcggagttcaagagattcaccccagacatcccaacaatgttgtatcatggtactcaggaggaaagacaaaaactggtgcggaacatatacaaaagaaagggaacgctccaaattcaccccgtcgtgatcacaagcttcgagattgctatgagagacagaaatgcactccaacattgttactggaagtaccttattgttgacgagggacacagaatcaaaaatatgaagtgtcggctgattagggagctcaagcgcttcaatgccgataataagctactgctgacgggaacgcctttacaaaacaaccttagcgaactctggtctttgttaaattttttgcttcccgatgtcttcgacgatctcaagagctttgaaagctggttcgatatcacatctctgagcgaaaccgccgaagatatcattgccaaggagcgggagcagaatgttttgcatatgctccatcagattctcaccccttttctcctgaggagactgaagagcgacgtggcattagaagtcccacctaaacgggaggtggtggtgtatgcacccctgagtaagaagcaggaaattttctacacagccattgtcaacaggaccatcgctaacatgttcggctctagcgagaaggaaaccatcgagttgagtcccaccgggcgacctaagcgccgtactcgtaagtcgataaactattccaaaatcgacgactttcccaatgagctcgaaaaactgatatctcaaatccagccagaagtggatcgcgagcgtgccgttgtcgaggttaacatacctgtcgaaagtgaggtcaatctcaagctgcagaatatcatgatgcttttacgcaaatgctgcaatcacccttatctgattgagtacccgatcgacccagttacgcaggagttcaaaattgatgaagaattggtaacaaatagcggaaagttcttgatactcgatcgcatgctccctgaactcaagaaaagggggcacaaagttctgctgttttctcagatgactagcatgctagatatcctaatggactattgccacttgagggacttcaacttctctcgccttgatggctccatgagttacagtgagcgggaaaaaaatatgcatagttttaatactgaccctgaagtattcatcttcctggtgtctaccagagccgggggattgggaataaacctgactgctgctgacacagtgataatctacgattcagattggaacccccagtctgacttgcaggcccaggaccgctgtcatcgaattgggcagacaaaacctgtggtggtctaccggctagtgacagctaacactatagaccagaaaatcgtagagagggccgccgcaaagcggaagctcgaaaagctgattatccataagaaccactttaagggcggccaatctgggttaaacctctccaagaattttctcgatcccaaagaactgatggaactgcttaaatcccgggactacgagcgcgagataaaaggttctagagagaaggtcattagtgacaaagaccttgagcttcttctggaccgttccgatttaatcgatcagatgaatgcctcaggacccataaaagaaaaaatgggaatttttaaaatcttggaaaacagcgaagattccagtcctgaatgtctgttctag

SEQ ID NO: 190455 - DNA, 2655 bp, Artificial Sequence
  Description of Artificial Sequence: Synthetic coding sequence
atgcccgccgagcggcccgccggcagcggcggcagcgaggcccccgccatggtagaacagctcgacaccgccgttattactccggctatgttggaggaggaagagcaactcgaggccgctggtcttgaacgagaacgaaagatgcttgaaaaagcaaggatgtcctgggacagagagtctactgaaatccgctatcggcggctgcaacacctcttggaaaaatcgaatatttattcaaagttcctgctcaccaaaatggagcagcagcaactggaagagcaaaaaaaaaaggagaaactggaacgcaaaaaagaaagtctgaaagtgaagaaagggaagaactcaattgatgccagcgaggagaagcccgttatgcgcaagaaaaggggcagagaggatgaaagttataacatttcggaggtcatgtccaaagaagagatattgtctgtggccaaaaagaacaagaaagaaaacgaagacgagaatagcagttccaccaatctctgcgtcgaagacctccaaaaaaacaaggacagtaactcaatcattaaggataggctgtctgaaactgtgagacaaaacaccaagtttttctttgatcctgtgaggaaatgcaatggccagcccgtgccattccagcaacctaagcactttaccgggggcgtcatgagatggtaccaggtagagggcatggagtggctcaggatgctgtgggagaacggtattaatgggattttagcagatgagatgggattggggaaaacagtgcaatgcatcgctaccattgcactcatgatccagcgcggagtgccgggcccattcctggtgtgtggcccactgtctaccctccctaattggatggccgagttcaagcgattcacgcctgacatccctacaatgctgtaccacggaacacaggaggagcggcaaaaacttgtacgaaatatttataagaggaaaggtaccctgcagattcatccagttgtgatcacctctttcgagattgcaatgagggatagaaatgcattgcagcactgttattggaagtacttaatcgtggacgaaggccaccgcataaaaaacatgaaatgccggcttatccgtgagctcaagcggtttaacgccgacaataaacttctgcttaccgggacccccttgcagaataatttgtcagagctttggtctctgcttaattttctgctgccagatgtatttgatgacctgaagtcttttgaatcttggtttgatatcacctcactgtccgagactgcagaagatattatagccaaggagcgggaacagaacgtgctgcacatgttacatcaggagcgaatccctagaatgtacgtgtcggaatttacagatgaaggtttcttcgagggcaaactgccatccaggaaagacctgtatgacattaggccgtacgagaacacctatctgctgaagcttcacacaaatttcgagatccttacaccctttctgcttcgaaggctgaagagtgacgtggctctcgaggtccccccaaaacgcgaggtggttgtttatgctcccctctcaaaaaagcaggagattttctacacagctattgtaaacaggaccatcgcaaacatgttcggttcaagcgagaaagaaacaatcgagctgtcccccactggcaggccgaaacgacggacccggaagtccatcaactattcaaaaatcgatgacttccctaacgagctggagaagctaatctcacaaatccaacccgaagtagatcgcgagagagctgtcgtcgaggtcaatatacctgtcgagtctgaggttaatcttaaactccagaatattatgatgctgttgaggaaatgttgcaaccatccctacttgatcgaatatcccatcgaccctgtaacacaggaattcaaaattgatgaggagctcgtgacaaattctggtaaatttctgatcttagataggatgctcccagagcttaaaaagaggggtcataaagtacttctgttctctcagatgactagcatgctcgatattttgatggactactgtcacctccgggatttcaatttcagcaggctggatgggtcaatgtcttacagtgagcgcgagaagaatatgcatagtttcaatactgaccccgaggtttttattttccttgtgtcaacacgggccggcggcttgggcattaatctcacagccgctgacacagtgatcatctacgactcagactggaaccctcagtctgacctgcaggcgcaggataggtgtcatcgcattggccagaccaagcctgtggtggtgtacaggctcgtgacggcaaacaccattgaccagaagattgtcgaacgtgccgcagccaagcggaagctggaaaagctgattattcataaaaatcatttcaaaggcggccagtctggacttaatctgtctaagaatttcttagatccaaaagaacttatggagctacttaaaagcagggattacgagcgcgagatcaaaggctctcgcgagaaggttatcagtgacaaggacctggaactgctgttagaccgttccgatctgattgaccagatgaatgcttctggaccaattaaggagaagatgggtatattcaaaattctcgaaaactccgaagacagcagcccggaatgcttattctag

SEQ ID NO: 190456 - DNA, 390 bp, Artificial Sequence
  Description of Artificial Sequence: Synthetic coding sequence
atgcccgccgagcggcccgccggcagcggcggcagcgaggcccccgccatggttgagcagcttgataccgcggtcatcacaccagcgatgctcgaggaagaggaacaactggaagctgcaggcctcgagcgggagagaaagatgcttgagaaggctcggatgagttgggacagggagtcaaccgaaattaggtatagaaggctgcagcacttgctggagaaatcaaacatctactcaaagtttctgctgacaaagatggagcagcaacagcttgaggaacagaaaaagaaggaaaagctagagagaaagaaggaaagcctgaaagtgaagaaaggcaaaaactcgatcgatgccagcgaagagaagcccggaaattttgtttgcgggtag

SEQ ID NO: 190457 - DNA, 948 bp, Artificial Sequence
  Description of Artificial Sequence: Synthetic coding sequence
atgcccgccgagcggcccgccggcagcggcggcagcgaggcccccgctatggtggagcagctcgacaccgctgtcatcacacctgcaatgctggaagaggaggaacagctggaggctgcaggattggaaagggaaaggaaaatgctggaaaaagcacggatgagctgggacagagagagcaccgagattcgatatcgaaggttgcaacacctgcttgagaaatctaacatctattctaagtttttgctgacgaaaatggagcagcagcaattggaggagcagaaaaaaaaagagaaactcgagcgtaagaaggaaagcctgaaagtgaaaaagggtaaaaactccatcgacgcgtcagaagaaaaaccagtcatgagaaagaagagaggccgcgaggacgagtcttataatatctctgaggtgatgtcaaaggaagaaatcctgtccgtcgccaagaaaaacaagaaggaaaacgaggatgagaacagctccagcacgaatctctgtgttgaggaccttcagaagaataaagacagcaattccataatcaaggataggctgtctgaaactgttcgccagaatacaaaattcttctttgacccggttcgtaagtgtaacggacagcctgtaccatttcaacagcctaaacacttcaccggtggggtgatgcggtggtaccaggtcgagggcatggagtggttacggatgctctgggaaaacggaattaatggtatcctggcagatgaaatgggcctagggaagacggtccagtgtatagccactatcgccctcatgatccaaagaggagttccagggccctttttagtttgcgggccgctgagtacactcccaaactggatggctgagttcaagagatttacaccggacattcccacaatgttgtaccatggtacgcaggaggagcgccagaaactgatttacctctag

SEQ ID NO: 190458 - DNA, 2223 bp, Artificial Sequence
  Description of Artificial Sequence: Synthetic coding sequence
atgcccgccgagcggcccgccggcagcggcggcagcgaggcccccgctatggtagaacagctggacaccgcagtgattacacctgcaatgctggaggaagaagaacagctggaggcagcaggcctcgaaagggagcgaaaaatgctcgagaaggcccggatgtcctgggatcgggagagcaccgaaatccggtaccgtcgccttcaacacctgctggaaaaaagcaatatttactctaaattccttctcactaaaatggaacagcagcaactcgaggaacagaagaaaaaggaaaagctcgaaaggaagaaggagtcactcaaagtgaaaaaagggaagaacagcatcgacgcctccgaggagaaacccgtgatgcggaaaaaaagaggtcgggaagatgaatcctataatatatccgaggttatgtcgaaggaggaaattctgagcgtagctaaaaagaataagaaggagaatgaagacgagaattcatctagtaccaacctctgcgtggaagacctgcaaaagaacaaggatagtaacagtataataaaggatagactgagcgaaacagtcagacaaaatacaaaattcttcttcgaccctgtgcgcaagtgtaatgggcagcctgtcccctttcagcagccaaagcacttcacaggtggcgtgatgcggtggtaccaggtcgaggggatggagtggctcagaatgctgtgggagaacggcataaacgggattctcgcggatgaaatgggactgggcaagacggtgcagtgtattgcaacgatcgccttgatgatccagcgaggagtgcccggaccttttttggtttgcgggcctttatctactttgcccaactggatggctgaatttaagcgatttacgcccgatattccaaccatgttatatcacggtacccaagaagagaggcagaaactggttcgcaatatatataagaggaaggggacattgcagatccaccctgtcgtgatcacctctttcgaaatcgccatgagagacaggaatgcacttcagattctgacacccttcctgctgagaagactgaaaagcgacgtggcacttgaagtcccaccaaagagagaagtggtggtgtacgcgcccctgtcaaagaaacaggaaattttttacaccgccatcgtaaatagaaccatcgcaaacatgtttgggagtagcgagaaagagactattgaattgagccccacgggacgaccaaaacggagaacaaggaaaagcatcaattactccaaaattgatgactttcccaatgagcttgaaaagttgatcagccagattcagccggaagtggacagagagagggctgttgtcgaggtcaatatcccggtggaatcagaagtcaacctaaagctgcaaaatatcatgatgctcctcaggaaatgttgcaatcatccatacctgatcgaatatcccattgatcctgtcacacaggagttcaaaatcgacgaggaacttgtgactaactctgggaagttcctgatcttggataggatgttgccagagctgaaaaagaggggccacaaagttctgcttttcagccagatgacttctatgctggacattcttatggattattgtcacctgagggactttaactttagtcgcctggatgggtcaatgtcctactctgagagggaaaagaatatgcactcctttaacacagaccctgaagttttcatcttcctcgtgagcacccgggcaggggggctcgggattaacctcacggccgctgacacagtcatcatatacgacagcgattggaacccccagtcagatttgcaggcccaagacaggtgtcatcggattggccagacaaagcctgtggtagtttacagactcgtcacagcaaacacaatcgatcagaaaatcgtggagcgagccgctgccaagcggaagctggagaagcttatcattcataagaatcatttcaaagggggccagagcggtctcaacttgtcaaaaaactttctggatccaaaggagctcatggaactcttgaagtcccgcgactatgaaagggaaatcaaaggctccagggagaaggtcatcagtgataaggacctggaactgctgctcgaccgcagcgatctgattgaccagatgaatgccagcggcccaatcaaagaaaaaatgggtatttttaaaatcttagagaacagcgaggacagtagtcccgaatgcctcttttag

SEQ ID NO: 190459 - DNA, 579 bp, Artificial Sequence
  Description of Artificial Sequence: Synthetic coding sequence
atggtggagcagctggacaccgccgtgatcacccccgccatgctggaggaggaggagcagttggaggccgcgggtctagaacgcgagcgtaagatgttggagaaggcgaggatgtcttgggacagagaatcgacggaaattcgttatcgccggctgcaacatctgctggaaaaaagcaatatctactctaagtttctgctgacaaagatggaacagcagcagctggaggagcagaaaaaaaaggagaagctagagaggaagaaggagagcctgaaggtgaagaagggtaaaaacagcatcgatgcttcggaagagaagcccgtgatgcggaagaaaaggggccgtgaagacgagtcttataatattagtgaggtgatgagcaaagaggagattctgtcagttgcaaagaagaataagaaggagaatgaggacgagaacagtagttctacaaatttatgcgtcgaggatcttcaaaaaaacaaggacagtaactccatcatcaaggatagactctccgaaacagttaggcaaaataccaagttcttcttcgatccagtccgaaagtgcaacggacaatag

SEQ ID NO: 190460 - DNA, 1461 bp, Artificial Sequence
  Description of Artificial Sequence: Synthetic coding sequence
atgtggaagagcgtggtgggccacgacgtgagcgtgagcgtggagacgcagggagacgattgggacacagacccggactttgttaacgacatcagtgaaaaggagcagaggtggggcgccaagaccatcgaagggagcggaagaaccgaacatattaatatccatcagctccgaaacaaggtctccgaagaacacgatgtgctgaggaaaaaagaaatggaatcgggtccaaaagctagccatgggtatggaggacgcttcggcgtggaaagagaccggatggacaagagcgccgtcggtcatgaatatgttgcggaggtggagaagcacagttctcaaacagacgcagctaagggctttggaggaaagtacggtgtggaacgcgatcgtgccgataagtccgctgtgggctttgattacaaaggcgaggtcgagaaacacaccagtcagaaggattattccaggggcttcggcggacgctacggcgtagaaaaggacaaatgggataaagctgctctgggctatgactataagggagagaccgaaaaacatgagagccagcgggactatgctaaagggtttgggggccagtacgggatccagaaagaccgcgtcgacaaaagcgccgtcggtttcaacgagatggaggcccccactacagcttacaaaaagaccactccaattgaggccgcttcgtccggaacgaggggtctcaaggccaaatttgagagcatggccgaagagaaaagaaaacgcgaggaagaggaaaaagctcagcaggtcgcaaggcgccagcaagagcgaaaagccgtgactaaaagatctcccgaggctcctcagccggtgattgccatggaggagcctgccgtacctgccccgctgcctaagaagattagcagtgaagcctggcctcccgtcggaacccctccatccagtgagtccgagcccgtcagaacttccagagaacacccggtgcctctactccccatccggcaaacactgcctgaggacaatgaggaaccaccggccttgccccccaggaccctggaagggctgcaggtggaagaagagcctgtatacgaggctgaacccgaaccagaacccgaaccagagcctgaaccagaaaacgattatgaggacgtcgaggagatggatcggcacgaacaggaagatgaacccgagggcgattacgaggaagtgcttgaacctgaggattcatctttcagtagcgcccttgcaggaagcagcggatgtcccgccggggcgggcgccggcgcagtggccctgggcattagtgctgtggctgtgtatgattaccagggggaaggctcagatgaactcagttttgatcctgacgacgtaataactgatattgaaatggttgatgagggctggtggcgcgggagatgtcacggccatttcggcctgttcccagctaattacgttaagctgctcgagtag

SEQ ID NO: 190461 - DNA, 600 bp, Artificial Sequence
  Description of Artificial Sequence: Synthetic coding sequence
atgcccaactacaagctgacctacttcaacatgcggggccgggccgaaataatcaggtatatctttgcgtacctggacatacagtacgaggaccacagaatcgagcaggcggactggcccgagatcaaatctactctaccattcggcaaaatacccatacttgaggtcgatggtctcacattgcaccagagtctggcaattgcccgatacctcaccaaaaacacagacctggccggtaataccgagatggagcagtgtcatgttgacgccatcgtggatactcttgatgacttcatgagttgcttcccctgggccgagaagaagcaagacgttaaggagcaaatgttcaacgagctactgacttacaacgccccacatctgatgcaagatctcgatacttatctgggtggccgagagtggttgattggtaattctgtgacctgggcggatttttactgggagatctgttcaactaccctcctggtgttcaaacccgacctgcttgataaccatcctcgcctggttacattgcgtaagaaagtccaggcgatccctgctgtagctaattggatcaagcgccgccctcaaacgaagctatag

SEQ ID NO: 190462 - DNA, 813 bp, Artificial Sequence
  Description of Artificial Sequence: Synthetic coding sequence
atgcagtacccccaccccggccccgccgccggcgccgtgggcgtgcccttatacgcacctactccccttctacagccagcccatcctacccccttctacattgaggatatcctcggacggggccctgctgcccctacccccgctcccacgctccccagccccaactcctcgttcacatctctggtaagtccatatagaactcctgtgtatgagccaacgccaatccaccctgcattctcacatcattccgccgcggcattagccgctgcatatggtcccggcggattcggtgggccactgtaccctttcccaaggaccgttaatgattatactcatgcactactgaggcatgaccctcttggtaagccgctcctgtggtccccatttctacagcggccactccataaacggaagggcggacaggtccgattctccaacgatcaaacgatagagctggagaagaagttcgaaacacagaaatatctttcaccccctgagaggaagagacttgctaagatgctgcagctctccgagcgtcaagtgaaaacttggtttcaaaatagacgagccaaatggcgcagactgaaacaggaaaatccccagagtaataaaaaagaagagctagaatctctcgattcatcctgcgatcagcgccaggatcttccctcggaacaaaataagggcgcttctctggactcatctcagtgtagccccagccccgctagccaggaagatctcgaaagcgagattagtgaggactctgaccaggaggtcgacatcgaaggtgataaaagctactttaatgcagggtag

SEQ ID NO: 190463 - DNA, 570 bp, Artificial Sequence
  Description of Artificial Sequence: Synthetic coding sequence
atgctgggcatgatcaagaacagcctgttcggcagcgtggagacctggccctggcaggtgttgtctaagggggacaaggaggaggtggcctatgaggaaagagcgtgcgagggaggtaagtttgctacagtggaggtcaccgacaagcctgtcgacgaagccctcagggaagccatgcccaaagtcgctaagtacgctgggggcacgaatgataagggaatcgggatgggaatgactgtacctatcagctttgccgttttccctaatgaggacgggtccctgcaaaagaagctgaaagtctggtttagaatccccaaccagtttcaaagtgatcctcctgcaccttcggataaaagtgtgaagattgaggaacgagaaggaattaccgtgtactctatgcagttcgggggttacgctaaggaagcagattacgtggcacaggcaacccggttacgggcggctctggagggcaccgctacataccggggcgacatctatttctgcactggctacgatccaccaatgaagccctatggacgcaggaatgagatctggctgctcaaaacttag

SEQ ID NO: 190464 - DNA, 4059 bp, Artificial Sequence
  Description of Artificial Sequence: Synthetic coding sequence
atgagcaaggtgaccgcccccggcagcggcccccccgccgccgcctccggaaaggaaaagcggagtttttccaaaagactctttagatctggacgcgccgggggtgggggggctggaggacccggcgcctccggtccagcagctccgagctcacctagcagccccagctccgcacgcagtgtaggctctttcatgagccgcgttttgaagaccttgtcaaccctgagccatctctcctctgagggagcggctccagacagaggtgggctaaggagttgcttccctcctggcccagccgccgctcctacaccacctccatgccctccgccgccagctagcccagctcccccagcgtgcgctgctgaaccagtcccgggcgtggcaggattgaggaatcatggcaacacatgtttcatgaatgctacattacagtgcctcagtaataccgaattgttcgccgagtacctcgctctgggacagtatagggcggggcgtcccgaaccctcccccgatcccgagcagcctgccgggagaggagcccagggccaaggagaagtaaccgaacaactggcccacctggtgcgggctctgtggaccttagaatacacgccccagcacagccgcgacttcaagaccatcgtgagcaaaaacgccctgcagtacaggggcaattctcaacatgatgcacaggaattcctgctatggctgttggaccgtgtgcacgaggacctaaaccacagtgttaaacagagtgggcagcctcccctcaaaccaccctccgaaactgacatgatgcccgaggggccaagcttcccagtgtgttctaccttcgtgcaggaactgttccaagcccagtaccgcagctcacttacttgtccccattgccaaaagcagtctaatacatttgatcctttcctctgcatatcccttccaatccctctgcctcacacacgccctctttacgtcacggtggtgtaccagggtaaatgttcccattgcatgcggatcggcgtggccgtgcctctgagcgggaccgtcgctagattacgcgaggctgtgtccatggagacaaagataccgactgatcagattgtgctgacagaaatgtattatgacggctttcaccgctcgttttgtgacaccgatgacctggagacagtacatgaatctgactgcatcttcgcttttgagacccccgagatttttcgacctgagggaattttatctcaacggggaatccacctgaataataacctgaaccatcttaagttcggcctggactaccatcgcttgagttctccaacacagactgctgccaaacaagggaagatggattcaccgacaagcagggcaggctctgataaaattgtgcttttggtgtgtaaccgggcttgcaccggccagcagggcaagaggttcggcctgccattcgtcttgcacctcgaaaagacgatcgcttgggatctgctccagaaggagatcctcgagaagatgaaatattttctccggccgactgtgtgcattcaggtgtgcccgttctctctgcgcgtagtctcagttgtcgggattacctacctgttgccacaggaggagcagcctttgtgtcatccaatagttgaaagagccctcaagtcttgcggccctggggggacggcacacgtgaaactggtggtggagtgggacaaggagacacgtgatttcctttttgtgaatacagaggacgaatatattccagatgcagagtccgtccgtctccagcgcgaacgccaccaccagccacaaacttgcacattgagtcagtgtttccagctgtacacgaaggaagagcgactggcacctgacgacgcctggagatgcccccactgcaaacaattgcagcagggttctatcaccttgtctctgtggaccctcccagacgtgctgatcattcacctgaaacgttttcgtcaagagggggataggcgcatgaaactgcagaatatggtcaaattccccctgactggcctagacatgacaccccacgtggtaaagcgatcacagagcagctggtcccttccctcccattggagcccctggaggagaccctatggattggggagggaccccgaagactacatatacgatttatacgccgtgtgcaatcatcacggaaccatgcagggtggtcactacacggcctactgtaaaaacagtgttgacggactatggtattgtttcgatgacagtgacgtgcaacagctgagcgaggacgaggtgtgtactcagactgcatacattctcttttaccagagaagaactgccattccttcctggagcgctaactctagcgtggctgggagtacctcctcctctctctgtgagcattgggtctcaagactgcccggttccaaaccagcatccgtgactagtgctgcttctagccggcgcacatcattggccagtctctcagaatctgtagagatgaccggggagagatccgaggatgatggaggcttcagcaccagacccttcgtacggtctgtccagcgacagtcactgtccagccgctcctctgtgacttccccactggccgtgaatgagaattgcatgagaccatcctggtcattatccgcgaaactgcaaatgcgatcaaacagtcccagcagatttagcggggacagtccgattcacagctccgcctctacacttgaaaaaatcggagaagctgctgatgacaaggtgtcgatctcttgcttcggctccctgagaaatttgtcatctagctaccaggagccttctgattctcactctcgaagagagcataaagctgtgggtcgggctccactcgcagtaatggagggcgtgttcaaggatgagagcgacactcggaggctgaacagctccgtagtagacactcagtcaaaacattccgcccaaggtgatagactgcctcctctgtcggggccatttgataacaataaccaaatagcctatgtcgatcagagcgatagcgtcgacagttcccccgtgaaggaggttaaagctccctcccatcctggcagcttggctaaaaagcccgagtcaaccacaaagcgctcacccagctcaaaggggactagcgagcctgagaagtccctgaggaaaggtcgtccagctctcgccagccaggaatccagccttagttctacatctccctcctctcctttgcctgtgaaagtgagcctgaagccaagcaggtcccggtccaaggcagatagttcctccagaggctcaggcaggcacagctcgccagcacctgcccagcccaagaaggagtccagtccgaagtcccaggactccgtcagctctccctctccccaaaaacaaaaatccgctagtgccttgacctacacagcaagtagcacgagtgccaaaaaggcatcgggacctgctacacgcagcccatttcctcccggcaaatctaggaccagcgaccactccctgagccgagagggctctagacagagcctgggctctgacagagcttccgctacatccactagcaagcctaacagccccagagtgtcacaggctagggccggagagggcagaggcgccggaaaacatgtcagaagctctagtatggctagcctgagaagtccttcgaccagcataaagtccggactgaaaagagatagtaaatcggaagacaaaggcctgtccttttttaaatccgcacttaggcagaaggaaacccggagatctaccgatctcggaaagacagcacttctctccaaaaaagcaggtggatcctctgtcaaatccgtctgcaaaaatacaggagatgacgaagccgaaagaggccaccaacccccagcaagccagcagccaaatgccaacacaacaggtaaagagcaactagtaaccaaagaccctgctagcgccaaacactccctcctgtccgccagaaagtcgaaaagttcccagctagacagtggtgtgccctcttctcctggaggacgacagtcagccgagaagagctccaagaagctctcctcgagtatgcagaccagcgccagaccatcccaaaagccacagtag

SEQ ID NO: 190465 - DNA, 951 bp, Artificial Sequence
  Description of Artificial Sequence: Synthetic coding sequence
atgagcgccgaggtggagaccagcgagggcgtggacgagagcgagaagaaaaacagtggagcgcttgagaaggagaaccagatgaggatggctgacttgagtgagctcctaaaggagggaaccaaagaggcacacgacagagccgagaacacacaattcgtgaaggactttttaaaagggaatataaaaaaagaacttttcaagttggccactactgcactgtacttcacgtattcagccctggaggaagagatggagcgcaataaagatcacccagcatttgctccattgtattttccaatggaattacatcggaaagaggctcttaccaaagatatggagtacttcttcggcgaaaattgggaggagcaagtgcagtgtcccaaagctgcccaaaaatacgttgaaaggatacactatattggacagaatgagcctgagctgctagtggctcacgcttacacaaggtatatgggtgatttgtctggtggacaggtgctcaagaaagtcgcacagagagctttaaagttgcccagtaccggcgaagggacacagttctacctgtttgaaaacgtagataatgcacaacagtttaagcagctctatcgtgctaggatgaatgccttggacttgaacatgaagactaaggagcggatagtggaggaggctaacaaggcctttgagtacaatatgcagatttttaacgaactcgaccaggccggttcaacgttggctagggaaaccctggaagatggctttcctgtacacgatggtaagggggacatgaggaaatgccctttttacgctgctgaacaggacaagggtgcgttggaaggcagtagttgtccttttagaacagctatggcagtcctgcgcaagccctcattgcaattcatcttagcagctggcgtagcgctagctgcgggcctcctagcgtggtactacatgtag

SEQ ID NO: 190466 - DNA, 951 bp, Artificial Sequence
  Description of Artificial Sequence: Synthetic coding sequence
atgagcgccgaggtggagaccagcgagggcgtggacgagagcgagaagaagaatagcggtgccctggagaaagaaaatcagatgcgcatggcagacctcagcgaacttctcaaagaaggcaccaaggaggcccacgaccgggcagagaatacacaattcgttaaggacttcctgaagggcaatattaagaaggaactcttcaagctcgcgacaaccgccctgtactttacatacagtgccctggaagaggaaatggagcggaacaaggaccatcctgcatttgcaccactttacttccctatggagctccataggaaagaggcgctcaccaaggatatggaatactttttcggtgagaattgggaagagcaggtccagtgccccaaggccgcacagaaatacgttgagcgcattcattatattggacagaatgagcccgaactactggtggcccatgcctacactcggtatatgggagacctctccggcggccaagtgctgaaaaaggtcgcccagagggcactaaagctcccttcgaccggggaaggcacacagttttacttgttcgagaatgttgataatgcgcaacagttcaagcaattataccgcgccaggatgaatgccctcgacctgaacatgaagactaaagaaagaatcgtggaagaagcaaataaagctttcgaatataatatgcagatcttcaacgagctggatcaggccgggtccacactggccagagaaaccctggaggatggatttcccgttcacgacgggaagggcgacatgaggaagtgccccttttacgctgccgagcaagataaaggggcactagaaggctcttcatgcccatttcgtacagcaatggcagtgttgcgcaagccatcactgcagttcattctggcagcgggtgtggcccttgccgctggcctgcttgcctggtattacatgtag

SEQ ID NO: 190467 - DNA, 951 bp, Artificial Sequence
  Description of Artificial Sequence: Synthetic coding sequence
atgagcgccgaggtggagaccagcgagggcgtggacgagagcgagaaaaaaaacagtggcgctctcgagaaggagaaccagatgcgaatggccgatctaagcgagctgctgaaagaggggacaaaggaagcccatgatcgtgctgaaaatacacaatttgttaaggacttcctgaaaggcaacattaaaaaggaactgtttaagctcgccaccaccgctctgtactttacctattccgcactggaagaggagatggaaagaaataaagaccaccccgcatttgccccgctttatttccctatggagctgcataggaaggaggctctcaccaaagacatggaatatttcttcggcgagaactgggaggaacaagtccagtgccccaaggccgcccagaagtacgtggaaaggatccactatatcggtcagaatgaacctgaactactggtcgcccacgcctacacaagatacatgggagacctttcgggggggcaggtgctgaaaaaagtcgcacaaagagcccttaagctgccctctaccggggaaggtactcaattttatctcttcgagaacgtcgataacgcccagcaattcaagcagctgtaccgagcgcgaatgaacgccctcgacctgaacatgaaaacaaaagaacggattgtggaggaagccaataaagccttcgaatacaacatgcagatattcaatgaacttgatcaggcaggctccaccctggctagggagacactcgaggacggattcccagtgcatgatggaaagggcgacatgcgtaagtgtcccttctacgccgccgagcaggacaaaggcgccctggagggctcatcttgtccttttcgcacagcaatggccgtccttagaaaaccctctctccagttcattctggccgccggcgtggctcttgccgctggtctgttggcttggtattatatgtag

SEQ ID NO: 190468 - DNA, 951 bp, Artificial Sequence
  Description of Artificial Sequence: Synthetic coding sequence
atgagcgccgaggtggagaccagcgagggcgtggacgagagcgagaagaagaactcaggcgcccttgagaaggaaaaccagatgaggatggccgatctctctgaattgctgaaggagggtaccaaggaggcccacgaccgcgccgagaacacacagtttgtgaaagattttcttaagggcaacatcaaaaaagagctattcaaactagccacaaccgccctctactttacgtacagtgctctcgaggaggaaatggagaggaacaaggaccaccccgcttttgcgccattatacttccctatggaactgcatagaaaggaagcccttacaaaagacatggagtattttttcggggagaattgggaagaacaagtacagtgccccaaagctgctcaaaagtacgttgagcgaatccactatatcggccaaaacgaaccagaattgcttgtggcccacgcatacacccgatatatgggagatctgtccggaggacaggtcctgaagaaggtcgctcagcgggccctgaagcttccctcgactggagaagggactcagttctacctgtttgaaaatgtggacaacgctcagcaatttaagcagctctacagagctcgtatgaacgctttggatctcaatatgaaaactaaggagaggattgtggaggaagccaacaaggcttttgaatacaatatgcagatctttaatgagcttgatcaggcagggtcgacactagcccgggaaaccttggaggatggattccctgtgcacgacggcaaaggagatatgagaaaatgccccttttacgcagcagagcaggacaaaggagctctggagggctctagctgcccattccgcacagccatggctgtgttgcgcaagcccagtctccaatttattcttgccgccggggtggccctagccgccgggttgttggcttggtattacatgtag

SEQ ID NO: 190469 - DNA, 951 bp, Artificial Sequence
  Description of Artificial Sequence: Synthetic coding sequence
atgagcgccgaggtggagaccagcgagggcgtggacgagagcgagaagaagaattctggggcccttgaaaaagagaatcagatgcggatggcagacttaagtgaactgttgaaagaaggaacaaaagaagcccatgatcgcgccgaaaatacccagtttgtcaaagacttcctcaagggcaacattaaaaaggagctgttcaagctggctacaacggcactttactttacgtatagtgccttggaagaggagatggagcgcaacaaggaccatccagcttttgccccgctgtactttccaatggaattacaccggaaagaagccttgaccaaggatatggagtacttctttggggagaattgggaggaacaggtccagtgcccgaaggcagcccaaaagtacgttgagagaattcactacattggacaaaacgagccggagctgctcgtagcacacgcatatacaaggtacatgggcgacctttcaggcgggcaagtcctcaaaaaggtcgcccagcgggcacttaaactccctagcactggagaaggtacccagttctatctgttcgagaatgtagacaatgcacagcagttcaagcagttatatagagcgcggatgaacgcactcgacctgaacatgaagactaaggagcggatagtggaagaagctaataaggcatttgaatacaatatgcagatctttaacgagcttgaccaggctggaagcacattggcaagagaaaccctagaggatggcttccccgtgcatgatgggaagggggatatgcggaagtgccctttctatgccgccgagcaagacaagggtgctctggaaggctctagctgccccttccgcaccgccatggccgtactacggaagccgtcgcttcagttcatacttgccgccggggtggcactggctgccgggctcttagcctggtattacatgtag

SEQ ID NO: 190470 - DNA, 16908 bp, Artificial Sequence
  Description of Artificial Sequence: Synthetic coding sequence
atgatcagctgggaggtggtgcacaccgtgttcctgttcgccctgctgtactctagcctggctcaggatgctagccctcagtctgaaattagagccgaagaaatacccgaaggcgcctctacgctcgccttcgtcttcgatgtgacaggatccatgtatgacgatcttgttcaggtgattgagggtgcctctaagattcttgagacttcactcaaacgtccaaaacgccctttattcaacttcgcgctggtcccctttcatgacccagagatcggcccagtaaccatcactaccgatcctaagaaatttcagtatgaactgagggaactgtacgtccagggtgggggggattgtccagaaatgtcgattggcgccatcaagatagcccttgaaatctcactccccgggagttttatctatgttttcacggatgcccgatccaaggattatcgcctgactcacgaggtgctgcagctgatacaacagaagcaaagccaggtggtcttcgtgttgactggcgactgcgacgataggacccatattggctataaggtttacgaggaaatcgcaagtacctcttcgggacaggtgttccacctggataaaaaacaggtcaatgaagtcctgaaatgggtggaagaagctgtacaggcctctaaggtgcacctattgagcaccgaccacttggaacaggccgtgaacacctggagaataccttttgatcctagcctaaaagaggtgaccgtgagcctctctggtcccagtcccatgatagagatcagaaatccactgggcaagctaataaagaagggctttggcctgcacgagctgcttaacattcacaatagcgcaaaggtcgtgaatgtgaaggagcccgaggccggaatgtggacagttaagaccagctccagtgggagacactccgttcgcatcaccggactgtcaaccatcgatttccgtgcgggattctcacgcaagcctacactagacttcaagaaaacagtaagcagacctgtgcaagggattccaacttatgtgctcctgaacacttctgggatttccacacctgcacggattgacctccttgagctgctatctatttccggctcgagcctgaagacaataccagttaaatattacccccatcgaaagccatacggtatttggaatatcagcgactttgtgccacctaacgaggcattcttcttgaaggtgaccggctatgacaaagacgattatttatttcagcgggtgagctccgtcagcttttcctctatagtgcccgatgcccccaaggttaccatgccggaaaaaactcctggctattacctgcagccaggccagatcccctgtagtgtggattcattgttgccctttacactgagcttcgtgcgcaacggcgtcacgctcggagtggaccagtacttgaaggagtccgctagtgtgaacttggatatcgctaaggtgacactttcggatgaggggttctatgagtgcattgctgtgagcagtgcaggaaccggacgcgctcagactttttttgatgtaagcgagccccctccagtgattcaggtgcccaacaatgtgaccgttacacccggtgaaagagccgtgctcacctgtctcataatttccgctgtcgactataacctcacatggcagcgaaatgaccgggacgtgcggcttgcggaaccggccagaatccgtaccctcgccaacctctccctagagttgaaatcggtgaagttcaatgatgccggcgaataccactgcatggtgagtagcgagggtggcagcagcgcagcaagtgtgtttctgacagtgcaggaacctcctaaggtgactgtgatgccaaaaaatcaatcatttacagggggttctgaggtaagcatcatgtgcagcgccaccggctatcccaagcccaaaatcgcatggactgtgaacgatatgtttatcgtgggctcccaccgctacagaatgacaagcgatggcaccctgtttatcaaaaacgcagcccctaaggacgctgggatatacggctgtctcgccagtaattcagccggcactgataaacaaaacagtacactgcgttatattgaggcgcccaagttaatggtggttcagtctgaactcttggtggctctgggtgatattacagtgatggaatgcaagacctcgggcatccctcccccacaggtaaaatggttcaagggggatctggagctgaggcctagcacctttctcattatcgacccactccttgggctgttgaagattcaagagacccaagatctagacgccggcgattacacatgcgtcgccatcaacgaagccggcagggccaccgggaagatcaccctggacgtgggaagcccccccgtctttatccaagagcctgccgacgtgtcaatggaaattgggagtaatgtgacccttccatgttacgtgcagggatatccagagcccacgataaagtggcgccgacttgataatatgcctatcttctccaggccatttagcgtctcctctatctctcagctgagaacaggtgctctttttatcctaaacctctgggccagtgacaagggaacctacatctgcgaggccgaaaaccagttcggcaaaatccagagcgaaacaaccgtgaccgtcaccgggctcgtggcacccctgatcggcattagccccagtgttgcaaacgttattgaaggacagcaactgaccttgccctgtacacttctggcaggcaaccctattcctgaacgaagatggatcaagaactcggccatgctgctgcaaaatccttacattacagtgaggtctgatggctctttacacatagagagagttcagctacaggacggaggtgaatatacatgtgtagccagcaatgtcgctggcacgaataataaaaccacgagtgtggtagtacacgttctcccaacgatccagcacggacagcaaatcctcagtaccatcgagggtataccagttactctcccgtgtaaggccagcgggaacccaaaaccctccgttatttggagtaaaaagggcgagctgatcagtacctctagcgccaaatttagtgctggtgcagacggtagcctgtatgtcgtgtctcctggtggagaggaaagcggcgagtacgtgtgtaccgcaacaaataccgccggatatgccaagagaaaagtccagctgactgtgtacgtcagacctagagtcttcggagaccagcggggactttctcaggacaagccagtagagatctccgtcctggccggcgaggaggtcaccctgccctgcgaggtcaagtccctgcctccacctattattacctgggccaaggagactcagctgatatcccccttcagccccaggcatacttttttaccgagtggcagcatgaagattacagagactcggacgagcgattctggcatgtatttgtgcgttgcgacaaacattgcaggcaatgtcacacaggcggttaagttgaacgtacatgtgcctccgaaaattcagcgcggtcccaagcatctcaaagtgcaggttggacagcgtgtggatattccctgcaacgcgcaaggaacccctcttcccgtgataacctggagcaaaggagggtccaccatgcttgtggatggggagcatcacgtgtctaacccagatggaaccctctctatcgaccaggctaccccatctgatgctggcatttatacatgtgtagccacgaacattgccggcactgatgagactgagatcacacttcacgtgcaggagcccccgacagtggaagacttggagccaccgtacaacactacgtttcaagagcgtgttgccaatcaacgcatcgaattcccatgtcctgccaagggaactccaaaaccgacgataaagtggctccataacggacgtgaactgaccggtagagagcctgggatctccatacttgaggacggcaccttactggttatagctagcgtgactccatacgacaacggcgaatacatctgcgtagccgttaacgaagcaggaaccaccgagcggaaatacaacctgaaggtgcacgtgccacctgttatcaaagacaaagagcaggtaaccaatgtgtctgtactgctgaatcaactgacaaatcttttttgtgaagtcgaggggacccccagtccaattattatgtggtataaagacaatgtgcaggtcacagagtcctccacgatccagaccgttaacaatggaaaaattctcaagctgtttagagcgactcccgaggatgctgggagatacagttgcaaggccatcaatatcgcgggaacctcccagaagtacttcaacattgacgtgttggttccaccaactatcattggcacgaattttccaaacgaagtctccgtggtcctgaacagggatgtggcactggaatgccaagttaagggcaccccgttcccagatatccactggtttaaggatggtaaacccctattcttgggggatccaaacgtggaacttctggatcgtgggcaggtattacatctgaagaacgcacgaagaaacgataagggacgctaccaatgcaccgtgtctaatgccgccgggaaacaggctaaggacattaagttaacgatttacatcccaccatcgataaaagggggcaatgtgactaccgatatcagcgtattaatcaactccctgataaagcttgaatgtgaaactagggggctgccgatgcctgccatcacttggtacaaggatggacagccaataatgagtagttctcaggccctttacatagacaaaggccaatatctacatattcctcgcgcacaggtctcagacagtgctacgtacacttgccatgtggccaacgtcgccggcacagccgaaaaatctttccatgtcgacgtatatgtcccaccgatgatcgaaggaaaccttgcgacaccattgaataaacaggtggtgatcgcccactcacttactctcgagtgtaaggctgccggaaatccttcaccaatattgacctggttgaaagatggagtaccggttaaagccaacgacaatatacggatcgaagccggcggaaagaaactggagattatgtccgcccaggagattgaccggggtcagtacatttgcgtggccaccagcgtggccggggaaaaggaaattaaatacgaggtggatgtcctcgtgccaccggccattgaagggggcgacgaaacatcctactttattgttatggtgaacaacctacttgaactggattgtcacgtcacaggtagccctcctccaactatcatgtggttgaaggacggccagttaatcgatgagagagacgggtttaagatactccttaacggacgcaagctcgtgatagctcaggctcaagtgagtaacacaggcctttataggtgtatggcggccaacaccgccggcgatcataagaaagaatttgaggtgacagtgcacgtgccccctacaattaaaagttctgggcttagcgaacgtgtggttgtgaaatataaacctgtcgcacttcagtgcatcgccaacggtatcccaaatccttccataacctggctgaaagacgaccagcccgtcaacaccgcacagggcaatctgaaaattcaatcaagtggtagggtgctgcaaatcgctaaaacactgttggaggacgcgggccgatatacttgtgttgcaaccaacgccgccggagagactcagcaacacattcaactgcacgtgcacgagccacccagtctcgaagacgcagggaaaatgttgaatgagacagtacttgtgagtaacccggttcaactggaatgtaaggcagcaggcaatcccgtcccagtgatcacctggtataaggacaaccgactgctcagcggatctaccagcatgacttttcttaataggggccagataatcgatattgaaagcgcacagatttccgatgctggaatatacaagtgtgtcgccattaatagcgccggtgctaccgaactcttctactcactgcaggtgcatgtcgcgcctagcatttcaggctcaaacaacatggtcgcagtggttgtcaacaaccctgtgagacttgaatgtgaggcccggggcatacccgcgcctagtctaacctggttaaaagacggttctccggtcagtagcttttccaatggactccaggtactaagcggaggacggattctggctctcactagtgctcagatttccgataccggcagatatacttgcgtcgccgttaacgctgccggtgaaaagcagagggatatcgacctgcgggtttatgttcctcccaacatcatgggagaggagcaaaacgtaagcgtgctaatcagccaagccgtcgagctgctatgtcagtcagacgctatacccccaccaactctgacatggctgaaggacggccacccacttctgaagaagcctggcttgagcatatctgagaatcgaagtgtcttgaaaattgaagacgcacaggtccaagacacaggtaggtacacgtgtgaagcaaccaacgtcgctgggaagacggagaagaattataatgtcaacatttgggtgcctcctaatattggaggcagcgacgagttaactcagctcactgtcattgaggggaacttgatctccctactttgcgaatcctcaggaattcctcccccaaatcttatctggaagaagaagggaagtcccgtactgactgattccatgggaagagtgaggatcctctctgggggccgccagctgcagataagcatcgcagagaagtcggatgctgccctgtattcgtgtgtggctagcaatgttgctggaacagctaaaaaagagtacaacctgcaggtgtacatccgccccacaatcaccaattcaggcagtcaccccacagagattatcgtgacgcgggggaagagcattagtcttgagtgtgaagtgcagggtatccctccaccaactgtgacatggatgaaagatggccatcctttgataaaggccaaaggcgtggagattctcgatgaggggcacatcttgcagttgaaaaatatccatgtgagtgatactggtcgttatgtgtgcgtagctgtgaacgtcgccgggatgacggataaaaagtacgacctgagtgtccacgccccgccaagtattattggcaatcacagaagtcctgaaaatatttcagtggtggagaaaaactcagtctctctgacatgcgaggcatctgggatccccttacccagtatcacatggttcaaagatgggtggcctgtgagcttatccaatagcgtgagaattctgtctggagggaggatgctccgcctcatgcagactaccatggaagacgcagggcagtatacctgcgtcgtgcggaacgcggccggcgaagagcgcaagatttttgggctctctgtattggtcccaccgcacattgtgggtgagaacacccttgaggacgtgaaggtcaaggagaagcagtctgtaaccctaacttgcgaagtaaccgggaaccccgtccctgagatcacctggcacaaggatggccagcccttgcaggaggacgaggcccaccacatcatctctgggggcagattcctccagattactaacgtccaggtacctcatactggtagatacacatgcttagcctcttcccccgcaggacataagagcaggagctttagtctgaacgttttcgtgtctccaaccattgccggggtagggagtgacggtaaccccgaagacgtcaccgtgattctgaatagcccgacctcacttgtttgcgaggcgtattcttacccccccgctacgattacctggttcaaagatggaacccccctggaatccaataggaatatcaggatcctcccaggtggccggacactgcaaattctcaatgctcaggaggacaatgctggccgctactcctgtgtcgcaaccaatgaggcgggggagatgatcaaacactatgaggtgaaggtgtacatccctcccatcatcaataagggggatttgtggggacccggattaagccccaaagaggttaaaataaaggtgaataatacactgactctagagtgcgaagcctacgctattccctctgcaagcctgtcctggtacaaggacgggcagcccttaaaaagcgacgaccacgtcaacatcgccgctaatggtcataccttgcagatcaaagaagcccagatcagcgacacagggaggtacacctgtgtcgcctccaatatcgccggagaagacgaactcgatttcgatgtgaacatccaggtgcctcccagctttcagaagctttgggaaattggcaacatgctcgataccgggagaaatggtgaagcaaaagatgtcatcatcaacaatcctatttccctgtactgcgagaccaacgcagcccctcccccaactcttacctggtacaaagacggacaccctcttacctcttctgataaagtcctgatcctgcccggggggcgcgtcctgcagatcccacgcgctaaagtcgaagacgcggggagatatacatgcgtggctgtaaatgaagccggcgaggattctctgcagtatgacgtcagggtgttggtgccacctatcataaagggcgccaattccgatctgcccgaggaagtgaccgtcctcgtgaacaaatccgctcttatcgaatgtttgagcagcggctcacctgctccaagaaatagctggcaaaaggacggacagccactgttagaggacgatcaccataagttcctctcgaatggacgcattctacagattctcaatacccagattaccgatattggccggtatgtgtgtgttgcagagaacaccgccggctccgctaaaaaatatttcaatttaaacgtccacgttcccccatcagtgattgggcccaagagcgagaatctgaccgtggtggtaaacaactttatctcccttacatgcgaggtgagtggtttcccccctccggacctgagctggctgaaaaatgagcagcctattaagctgaatacgaacactctaattgtgccgggcggtcgaacactgcagatcatccgcgctaaggtatccgatgggggggaatacacttgcatagcaattaatcaggcgggggaaagtaagaaaaaatttagtctaaccgtctatgtaccaccatctatcaaggaccatgactctgaaagtctaagcgtcgtaaacgtgcgggaggggaccagcgtcagtttggaatgcgaatctaacgcagtgcccccaccagtaattacctggtataaaaatggaaggatgatcacagagtccacacacgtggaaatcctagctgacggtcaaatgcttcacatcaagaaagctgaggtgagcgataccgggcagtacgtttgtagggccatcaacgtggctggcagggacgataagaattttcacctaaatgtgtacgtgccgccatctatcgaagggcccgagcgggaagtgatcgtggaaacaatatccaacccggtgactctgacatgcgacgcgaccggtattccacccccgactattgcctggctcaagaaccataagcggatagaaaattcagacagcctggaagtgagaatcttatctgggggcagtaaactgcagattgcacgtagccagcatagcgacagtggcaattatacatgtatagctagtaacatggaaggaaaggctcaaaagtactattttctctcgatccaggtgccacctagcgtcgctggcgcagaaatcccgtccgatgtgagcgtgctgctgggggaaaatgtcgaactggtctgcaatgctaacgggatcccaactcccctcatccaatggctgaaagacggtaagccgattgctagcggcgaaacggaaagaattcgtgtctcagccaacggctccaccctgaacatctatggagccctgactagcgacacagggaaatatacgtgtgttgctacaaatcccgcaggagaggaggaccgtattttcaatctgaacgtatacgttactcccactatccgggggaacaaggatgaggcggaaaagctaatgaccttggtagacacaagcatcaacattgagtgcagggcaacaggaacgccccctccgcagattaactggctgaagaatggcctgccgctccctctgtcctcccatatccgattactggcggccgggcaagtgattcggatcgtacgagcacaggtgtcagacgttgctgtttatacgtgtgttgcatctaaccgggccggtgtggacaataagcattacaatctacaggtgtttgctcccccgaacatggataactccatgggcacagaagaaatcaccgtgctgaaaggaagctctactagcatggcgtgcattaccgacggcactcccgcaccatctatggcctggctccgagatggacaacctctgggacttgatgcccacctgacggtgtcaacccacgggatggttctacaactgttgaaggccgagaccgaggactcagggaaatacacctgtatagccagcaatgaggctggggaagtgtccaagcatttcatattgaaggttctcgagccaccgcatataaatggtagcgaagaacacgaagagattagtgtcattgtgaacaaccccctggagttgacctgtattgcctcagggatccccgcgcctaaaatgacgtggatgaaggacggacgccccctcccccagaccgaccaggtgcagactcttggagggggtgaggtgttacgcatatcaactgctcaggtggaggacactggaaggtacacatgcctggcttcatcacccgccggcgatgacgacaaagaatatctcgtccgtgtacatgtgccccctaatattgctggtactgacgagcccagagacatcacagtgcttaggaacagacaggtaaccctcgagtgtaagagcgatgcggtgcccccccccgtgataacttggcttagaaatggcgagagactacaggcaaccccgagagtgaggattctttcaggtgggcgatatctgcagataaacaatgccgacctgggagataccgccaactatacctgcgttgcttcgaatatcgccgggaaaacaacgagggagtttatcttgacagtgaatgttccccccaatatcaaaggcgggcctcagtctttggttattttgctgaacaaatcaaccgtcctcgaatgcattgcagaaggggtcccaacacctaggattacttggaggaaagatggcgccgttctggccggaaaccacgcgcggtatagtatcttggaaaacgggttccttcacatccagtcagcccacgttacagacacaggccgatacctctgcatggcaacgaatgctgctgggactgatcgtaggcggattgatctgcaagttcacgtgccaccctcaatcgccccgggccccacaaacatgaccgtgatcgtgaatgtgcaaacaacactcgcctgcgaagctacaggcattcccaagccctccatcaattggaggaagaacggacaccttctgaacgtggaccagaaccaaaatagctatagactcctgagttcagggtcacttgtgatcatttcccccagtgttgacgacaccgctacctacgaatgtacagtgaccaatggcgccggggacgacaaacggaccgtcgaccttaccgttcaagttccacctagtattgccgacgagcctaccgattttctggtgacaaagcacgcacccgccgtgatcacctgcactgctagcggagtgccctttcctagcatccattggacaaagaatggcatacgcttgctgccccgcggcgatggatacaggatcctttcaagcggggctattgagattcttgccacacagttgaatcacgctggaaggtatacgtgcgtggctcgtaatgcagccgggagcgcccaccgacacgttacgcttcatgtccatgagcccccggtcattcagccacaaccctcagaactgcatgtcatcttgaataaccctattctcctcccttgtgaggccactgggaccccatccccattcatcacttggcaaaaggaaggaatcaatgtcaacaccagcggacgaaaccatgccgtgttgccctctggtggcctgcagatctcccgggcagtgagggaagatgctggcacgtatatgtgtgttgcccaaaatccggcgggaaccgccctgggtaaaatcaaactgaacgtccaggtaccaccagtcatctccccacatctcaaggaatatgtgatagctgtggataaacccatcacgctcagttgtgaggctgatggccttcctccacctgacatcacttggcacaaggatggtcgggccattgtggaatccattaggcagcgagtcctgagctctggaagccttcaaatcgcgttcgtgcagcccggcgacgcaggacactacacatgtatggctgccaatgtcgccggatcatccagcacaagcactaaactcactgttcatgtcccacccagaatcaggagcacagagggccattatacggtgaacgagaacagtcaggcaattctgccctgtgttgccgacgggatacctacaccagcaataaactggaaaaaggacaacgtactgctggccaatctactaggtaagtatactgctgagccatacggagagctcattctggagaacgtagtgctggaagactccggcttctatacctgtgtggcaaataatgcagctggtgaggacacacacacagtgagtttgactgtgcatgtcttaccaacattcaccgagctgcccggcgatgtttccttgaataaaggcgaacagctgaggttgtcatgtaaggctaccggcattcccctacccaaactgacttggacattcaacaataatattataccagctcacttcgacagcgttaatggccatagcgaacttgtgattgaacgggttagcaaggaagattcaggaacctacgtgtgtacggcagagaacagcgtgggttttgttaaagcaataggcttcgtgtacgtaaaggagccccctgtcttcaagggcgattacccgagtaactggattgaaccactgggaggtaacgccatattgaactgcgaagtgaagggtgacccaaccccgactattcagtggaatagaaaaggggtggacatagagattagccataggataaggcagctgggtaatggctctctggcaatatacggtacggttaacgaggacgctggcgactacacttgcgtcgccactaatgaggcaggagtggttgagcgtagcatgtctctcacacttcagtcacctccaattataacgttggagcccgttgaaactgtgatcaacgctggcggaaagataattcttaattgccaggccactggtgagccacaaccaacgatcacctggtccaggcaagggcactcaatttcttgggacgacagggtgaatgtcttgagtaacaatagtctctacattgccgacgcccagaaagaggacacttctgagtttgagtgcgtagctcggaacctgatggggtctgtcctggtcagggtcccggttattgtgcaggtgcacggcgggttcagccagtggagtgcttggcgcgcctgcagcgtcacctgtggcaagggaatacaaaaacggtccaggctgtgcaaccagcctttgccagcgaatggcgggaaaccttgtcagggctctgacctagagatgagaaattgccaaaacaagccatgcccagtcgatggctcatggtctgagtggtccctctgggaggaatgcactagatcctgcggcagaggaaaccagacacggacgagaacctgcaataacccctccgtgcagcatggaggtcggccatgtgaagggaacgctgtcgagataatcatgtgtaacatacgtccgtgcccagtgcacggcgcctggtcggcttggcagccatggggcacctgcagtgaatcctgtgggaagggtacgcagacaagggcccgattatgtaataaccccccgccggctttcggcgggtcctattgcgatggggccgagactcaaatgcaagtatgcaatgaaagaaactgtcccatccatggcaagtgggcaacatgggcgtcctggtcggcctgtagcgtctcatgcgggggaggcgctcgtcagcggacgaggggttgtagcgatcccgttcctcagtatggaggccgcaagtgcgaaggctcagacgtccagtccgacttctgtaattctgatccctgtccaacccacggcaattggtctccttggtcaggctggggaacctgtagcagaacatgcaatggcggacaaatgaggcgatacaggacttgtgataatcctcccccttcaaacggtggaagggcctgcgggggacccgacagtcagattcagcgatgcaacaccgacatgtgccctgttgacggaagctggggcagctggcatagctggtcacagtgcagcgcctcctgtggcggtggtgagaaaacgaggaagcggctctgcgatcaccctgtccctgtaaagggcgggaggccatgccctggggacacaacacaggtcactcgatgtaacgtccaggcgtgccccggagggccccagcgtgcacgcggttctgtgataggaaatatcaatgatgtggagttcggcatcgccttccttaacgccactatcaccgattctcctaattccgatacccgtatcattcgggcaaaaattaccaatgtacccagaagcctggggagtgccatgcgaaaaattgtgagcatcctcaatcccatatactggaccacagctaaggaaattggagaggctgtgaatgggttcacactaaccaacgcggtgttcaaaagggaaacacaggtcgaattcgccaccggtgagattctgcagatgagtcatattgctcgaggcttagactccgatgggtcccttctactcgacattgtggtttcagggtacgtcctccaactgcaatctcccgcagaagtgacagtgaaggattatacagaggactacatccagactggccctggccagctctacgcgtattctaccaggctgttcaccattgacggtattagcattccctacacttggaaccacaccgttttctacgaccaggcacaaggcagaatgcctttcttggtggaaaccctccacgcctcaagcgtggagtctgattacaaccagatcgaggagaccttgggattcaagattcacgcttccatatcaaagggggaccgatccaatcagtgcccttccggatttactttggacagcgtgggccccttttgtgccgatgaggatgaatgcgcggctggcaacccgtgctctcattcctgccacaatgccatgggaacttactactgctcatgtccaaagggcctgacaatagccgctgatggccgcacttgtcaggacatcgacgaatgtgccctcggacgccatacatgtcacgctggacaggactgcgataacacaataggcagctacaggtgcgtcgttagatgcggaagcggttttagacgaacttctgatggcctttcttgtcaggatatcaatgagtgccaggagtccagcccatgtcaccaacgctgttttaacgctatcgggtcttttcactgtgggtgcgagccgggctaccagttgaagggccgaaaatgcatggatgtgaatgaatgtcgacagaatgtttgtcggcccgaccagcactgtaagaatacaagggggggatataaatgcatagacctttgccctaacggcatgacaaaggctgagaacggcacatgcatcgacattgatgaatgtaaggatggcacccaccagtgcagatataaccagatttgtgaaaacaccagaggctcttatcggtgcgtctgtccaagaggctacaggtctcagggcgtgggccggccctgtatggatattaatgagtgtgagcaggttccgaagccttgcgcgcatcagtgttctaacacgccgggaagcttcaagtgtatttgcccacccggccagcatttgcttggagatggcaaatcatgtgccggtttggaaagattgccgaactatggaacacagtattcttcatataatctagcacgattttcaccggtgagaaacaactatcagcctcagcagcattaccggcagtacagccacctgtatagtagctactctgaatatcgcaacagtcggactagcctgtcccgaactcgccgcacaatccgtaaaacctgccccgaagggtcagaggcctctcacgacacctgcgtggatatcgatgaatgcgagaatacagacgcctgtcagcatgagtgcaagaatacattcgggagctaccagtgtatatgcccccctggatatcagctgacccacaatggtaagacctgtcaggatattgacgagtgcctggaacaaaatgttcactgcgggcccaaccggatgtgttttaacatgcgcggtagctaccagtgcatcgacactccctgtccacccaattaccagcgagatcctgtctctggcttttgtttaaaaaactgtccacctaacgacttagaatgtgcactgagtccctacgctctcgaatataaacttgttagcctcccttttggaatagccacaaatcaggaccttatcagacttgtggcctacacccaggatggtgtcatgcaccccaggacaacttttttgatggttgacgaggaacagacagttccttttgctctgcgcgatgagaacctcaagggcgtggtctatacaactcggcctttgcgcgaggctgagacataccgaatgagggtgagggcttcgtcctattctgccaatggtactatcgaatatcaaaccacgttcatcgtgtacatcgctgtttccgcctacccatattag

SEQ ID NO: 190471 - DNA, 16557 bp, Artificial Sequence
  Description of Artificial Sequence: Synthetic coding sequence
atgatcagctgggaggtggtgcacaccgtgttcctgttcgccctgctctactcctctcttgcccaggatgcttcccctcagagtgaaatccgggctgaggaaattcctgaaggggccagtaccttggcttttgtgttcgatgttaccggcagcatgtacgatgacttagttcaggtcatcgagggagctagcaaaatcctcgagacctcactgaagcggccaaagcgaccactgtttaacttcgctctggtgcccttccacgaccccgaaatcggacccgtaaccattacgacggatcccaaaaagtttcaatacgagctgcgcgaactttacgtgcagggaggaggcgactgcccggagatgtccattggagccattaagatcgctcttgaaatctccctgcctgggtctttcatttacgttttcacggatgctcgctcgaaagactacaggctaacccacgaagtgcttcagctcatccaacagaagcagtcacaggtcgtatttgttctgacaggagactgcgacgaccggacacacattgggtacaaagtatatgaggagatcgcctcgacatcctcaggtcaggtgttccacttggacaagaagcaggttaatgaggtcctgaagtgggtggaggaggctgtgcaggccagcaaagtgcacctcctgtctactgatcacttggaacaggccgtaaacacctggcggataccttttgatccctcccttaaggaagtgacagtgagcctatctggcccttctcccatgatagagatccgcaatccactgggcaagctcataaagaaaggtttcgggctgcacgaactactgaatatccacaatagcgcaaaagtcgtgaacgtcaaggagccagaggctggtatgtggacagtcaaaaccagctcttctggacgccattccgtccgaattacaggcttaagcacgatcgacttccgcgctggcttcagtcgcaaacctacacttgatttcaagaaaactgtttctagaccggtccaggggattcccacttatgtcctgcttaatacttctgggatctcaacgcccgctcggatagaccttcttgaactattaagcatatcgggctcctctttgaagaccatacctgtgaagtattatcctcaccgtaagccctacggcatatggaacatatccgactttgtccctccaaacgaagcattttttctgaaggttacaggatacgataaagacgattatctctttcaacgggtatcctctgtcagcttttctagtatagtgccagatgcccctaaagtgactatgcctgagaagactccagggtactatctccagcccggacaaattccctgttctgttgacagtttgctgccctttactctgagcttcgtgagaaatggcgtaactctcggagtggatcagtacctgaaagaatccgcctcggtgaatctggacattgctaaggtgaccctttctgatgaaggcttttatgaatgcatcgctgtgtccagcgcggggactggcagggctcagacttttttcgacgtgagcgagcctcctcccgtaattcaggtgcctaacaacgtgaccgtcacccccggggaaagggctgtactgacttgtctgatcatcagtgcagtggactacaatctgacatggcagagaaacgatcgagatgtccgcttggccgagcccgcccgaattagaactctagcaaacctgtctctggaacttaagagtgttaaatttaatgacgccggagaataccattgtatggtaagttccgagggaggctcttcagccgcatcagtgtttctgaccgtgcaggagcccccaaaggtgaccgttatgcctaaaaaccagagcttcacgggagggagcgaagttagtataatgtgctctgccacaggctaccccaaacctaaaattgcatggacagtgaatgacatgttcatcgtcggcagccataggtacagaatgacaagcgatgggactctattcatcaaaaatgccgcacccaaagacgcaggcatctacggttgcctcgcatcgaattcagcaggtaccgacaagcaaaacagcaccctgcgctacatcgaggcccctaagttgatggttgtacagtcagagctcctggtggccctcggggatatcactgtcatggagtgcaaaacctccgggattccccccccacaagtaaagtggttcaagggcgatctggagctgcgcccctcaacattcttaatcatagaccctctgctgggtcttctgaagatccaggagacacaggacctggacgcgggggactacacctgtgtagctatcaacgaagccggacgcgccacaggcaagatcacattagacgtggggtcaccacccgtctttatccaggaacctgctgatgtctctatggaaatagggtccaatgtcacactaccttgttacgtacagggctatccggagcccaccatcaagtggaggcggcttgacaacatgcctatatttagcaggccttttagtgtgtccagcatctcgcagctgaggacaggtgcgctgtttatcttgaacttatgggctagtgacaaagggacctacatttgtgaggcagaaaaccagtttgggaaaatacagtctgaaacgacagttactgtgaccggcctggtcgctccactgatcggtattagcccatccgtggctaacgtcattgaaggacagcaacttacacttccgtgtacattgctggccgggaaccccatcccagaaagacggtggattaagaatagcgcgatgttgttgcagaatccctatatcacagtcaggtccgatggaagcctgcatatcgaacgggtacaattacaagacggtggggagtacacctgtgtggccagtaatgtggccggcacaaataataagacgaccagcgtggttgtgcacgtgttacccacaatccaacatggccagcaaatcctgtctacgattgaagggataccagttacactcccttgtaaggcttccgggaaccctaaaccctctgtgatatggagcaagaagggtgagctcattagtacttccagtgcaaaatttagtgcaggtgctgacggttctctgtacgtggtgtctccagggggggaggagagcggagaatatgtctgcacggcaaccaacactgctgggtacgctaagcgcaaggtacagctcaccgtctacgtgagacctagagtgtttggcgatcagcgtgggctcagtcaggacaagccagtcgagatcagcgtcttggctggcgaggaggttaccctgccgtgcgaagtgaagtcactgccaccgcccatcattacatgggccaaagaaacccagttaatctcacccttctctccccggcatacctttctgccgtccggctcaatgaagatcacagaaactaggacctcggacagcggcatgtatctgtgcgtcgcgacaaatatagctggcaatgttacacaagcagtgaaactgaacgtgcacgtgccgccaaagattcagcgcggcccgaaacacctgaaagtgcaggttggacaaagggtcgatatcccctgtaacgcccagggcacccccctcccggtgattacctggtcaaaaggcggtagtaccatgttagtcgatggagaacatcatgtgtctaatcccgacggtaccctgtcaattgaccaagccacacccagtgacgccgggatctacacatgtgttgccaccaatattgccggcactgatgaaacagaaattacgctacacgtgcaggagccccccaccgtggaagatttggagcctccttataataccacctttcaggagcgcgtcgctaatcagcgcattgagtttccctgtccagccaaaggtacccctaaacccaccatcaagtggctccataacgggcgcgagcttaccggacgcgagcctggtatctctattcttgaagacggcacattgttagtaattgcgtccgtcaccccttacgataacggcgagtatatttgtgtggcagtaaatgaggccggtacaaccgagcgtaaatataaccttaaagtgcatgttccaccggtgatcaaggataaggagcaggttactaatgtatcagtgttgctaaatcaactgaccaatctgttctgtgaggttgaaggtacgccctcgcccataatcatgtggtacaaggacaatgttcaggtaaccgagagttcaacgatacagaccgtgaacaatggcaaaatccttaaattgttccgcgctactcctgaggatgcggggcgatatagctgcaaggctattaatattgcgggcacctcccaaaaatactttaacatcgatgtccttgtaccgccaacaatcattggcactaactttcccaatgaagtgtctgtggtactcaatagagacgtggctctggaatgccaggtgaaaggcacacccttccctgatattcactggttcaaggatggtaagcctttgttcttgggagaccccaatgtcgagctcctggaccgcgggcaggtgttgcacttgaaaaatgctagacgtaatgacaaagggcgctaccagtgcaccgtcagcaacgcggctggcaaacaagctaaagacattaagttaacaatctatattcctccttctattaagggtggcaacgttaccaccgatatctccgtgctgatcaatagcctgatcaaacttgaatgcgagacacggggcctgccaatgccagcaattacatggtataaggatggccagcccatcatgtccagctctcaagcgctgtatatagacaaaggacagtatctgcatatcccacgcgcccaggtcagtgatagcgcaacatacacttgtcacgtggccaatgttgctggaaccgcagagaagagtttccacgtggacgtgtacgtcccacccatgatcgagggtaatctcgctacgcccttaaataagcaggtggttatcgcccattccctgactctggaatgtaaggccgcgggaaatccgagtcctatcctgacctggttaaaagatggcgtgcccgttaaggctaacgataacatacgcatcgaggcgggcgggaagaaactggaaattatgtcggctcaggaaatcgataggggccagtacatttgtgtggccacttctgtggctggcgagaaagagatcaaatatgaggtggacgttcttgtgcctcctgctattgaaggtggagacgaaacatcttacttcattgtgatggttaacaacttactcgagctggactgtcacgtgactggatcaccccccccaaccatcatgtggctgaaagacggccagctgatcgatgagagggacgggttcaagattctcttgaatggccgtaagctggtgatagcccaggctcaagttagcaataccggattgtataggtgtatggcagctaataccgcaggcgatcacaagaaggaattcgaggtgacagttcacgtgccgccgaccatcaaaagtagtgggttgtccgaacgggtggtcgtgaagtacaagcccgtggctcttcagtgtatagctaatggcattcctaaccccagcataacgtggttgaaagatgaccaaccagtgaataccgcccaggggaatctgaaaattcagtcctcaggtcgggtactccagatcgccaagaccctccttgaggatgccgggcgatacacttgtgtggctaccaacgccgcaggagagacccagcaacacattcagttgcacgttcacgagcctcccagtctggaagatgccggcaagatgctcaatgaaaccgtgttggtgtctaaccccgttcagttggaatgcaaagccgctggaaatcccgtgcccgtgatcacttggtataaagataatcgtttgttatctggctcaacaagcatgacctttctgaaccggggacagataattgacattgaaagcgcccaaataagtgacgccggtatttacaagtgtgttgctatcaatagcgccggcgctaccgagcttttctacagtctgcaggttcatgtggccccatctatatcagggagcaataatatggtcgcagtagtggtgaacaacccagttcggctggagtgtgaagctcggggtatcccggcgcctagccttacctggctgaaagacgggtcccctgtgtcatctttctccaatggactacaggtcctgtctggcggtcgcatactcgcactcacaagcgctcagatcagtgataccggcagatacacctgtgtggccgtgaatgccgccggagaaaagcagagggatatagatttgcgagtgtacgtgccccctaatatcatgggtgaggaacaaaatgtgtctgtgctgatttctcaggcagtcgaactgctgtgccagagcgacgcaattccccctcctacactgacatggctgaaagacggacatcctctcctgaagaagcccggtctttccatttctgagaaccggagtgtcctgaaaattgaggatgcacaggtccaagataccggccgttacacttgcgaagcaaccaacgtggctggaaagaccgaaaagaactataatgtgaatatctgggtgcccccaaacatcggtggatccgacgagttgactcaattgaccgttattgagggaaacctaataagccttctctgcgagagttccggaattccccctccaaatctgatctggaagaagaagggatcacccgttctgaccgattctatgggtcgagtgcgaatcctgtcgggggggagacaattacagatcagtatcgccgagaagtcggatgcagctctgtactcttgcgtcgcctcaaacgtggctggcaccgcaaaaaaggagtacaacctgcaggtgtatatccgccccactataacaaattccggttctcacccgaccgagatcattgtgacacgggggaagtccattagtctggagtgtgaggtgcagggcatcccccccccaaccgtcacttggatgaaggacggtcacccactaatcaaggccaagggcgtggagatcctagatgagggacatatcctgcagcttaagaacattcatgtttctgacactggacgttatgtgtgcgtggccgttaatgtcgcggggatgaccgataagaagtacgatctctcagtacatgcccccccttctattattggaaaccacaggtcgccagaaaatatttcagtagtggagaagaattctgtgagcctcacctgtgaggcctcaggaatccccctgccttcgattacgtggttcaaggatggctggcccgtgagcctgtctaactccgtgcggattcttagcggcggaagaatgctgagacttatgcagacaacgatggaggacgccggtcaatatacctgtgtggtcaggaatgctgccggcgaagagagaaagatcttcgggcttagtgtccttgttccaccgcacatcgtgggcgagaataccctcgaggatgtgaaagtaaaggaaaagcagagcgtgaccctcacttgtgaagttaccggaaatcctgtgcctgaaattacatggcacaaggacggccagcctcttcaggaagacgaggcccaccatatcatatccggcggccgattcttacaaatcactaacgtgcaggtgcctcataccggtagatatacctgtctcgcatccagccccgccggacacaagagtcgctccttttcactgaacgtattcgttagtcctacgatagcaggcgtcgggagtgatggcaatccagaggatgtgacggtgattctgaattcccccactagcctggtgtgtgaagcctattcttatccccctgcaaccatcacatggttcaaggacgggactcctcttgagtccaataggaacattcggatccttccggggggaagaactctccagatcctcaacgcccaagaagataacgctggtcggtactcgtgtgtggccaccaacgaggcgggggagatgataaagcattacgaggtgaaagtgtatattcctcctatcatcaataaaggagatttatgggggcctggtctctctcccaaggaagtgaaaatcaaggtaaacaatacactgactcttgagtgtgaggcctacgctattccctccgcttccctgtcctggtataaggatggacagcctctcaaatctgacgaccacgtgaatatcgccgcgaacggacacacattacagattaaagaggctcagatcagcgataccggcaggtacacctgcgtggcatccaacatagcaggggaggacgagctcgatttcgacgtgaacatccaagtgccacccagcttccaaaaactctgggaaattggcaacatgctcgacacgggccggaacggagaggccaaagacgtgatcattaataatcctatttcactttattgtgagacaaacgcagcccctccacctaccctcacttggtacaaagatggccatccgctaactagcagcgataaggtgctgattctccccgggggtcgagtgctccaaattcctcgagctaaggttgaggacgccgggagatacacatgtgtggccgtgaacgaagccggtgaggattcgctccaatatgatgtcagagtgcttgtacctcccattatcaagggcgctaatagcgatttgcccgaagaggtaaccgtattagtgaataaaagtgccttgatcgaatgtttaagttcggggagccccgcccctagaaattcctggcaaaaggacggtcagccgctgctcgaggatgaccaccacaagtttctgtcaaatggacggatcttacagatcctgaacactcaaatcacggacatcggcaggtacgtctgcgtcgccgagaacaccgctggttctgccaaaaaatacttcaacttgaatgtgcacgtccctcctagtgtgatcggcccaaaaagcgaaaacctgacggtggtcgtcaacaatttcatcagcttgacttgcgaggtgtcaggattcccacctccagacctctcatggctcaagaatgaacagccaattaaactgaatactaatacacttatcgttccaggtggccgcaccttgcagattatccgtgccaaagtttccgatggcggggaatatacttgcatcgctatcaatcaggctggcgaaagcaaaaagaagttcagtttaactgtttacgtccctccctccattaaggaccatgacagtgaatcacttagtgtggtgaacgtgagggagggcactagtgtgtccctcgaatgtgagagcaacgccgtgcccccacccgtgatcacatggtataagaacgggaggatgataacagagagtacacatgtggagatcctcgccgatggccagatgctccatattaagaaagctgaggtgagtgatacaggtcagtatgtctgtcgagctatcaacgtcgcgggacgagacgataaaaacttccacctaaatgtgtatgtgccaccaagcatagagggaccagaacgtgaggtgatcgttgagacaatttccaaccccgttacgctgacctgcgacgccaccggtattccgccccccaccatagcttggcttaagaaccataagaggattgaaaacagtgactctctggaagtgaggatactgtctggtggttctaagctgcagattgcgcgcagccagcattcggactcaggaaattacacgtgtattgcctctaatatggagggaaaagcacagaagtactacttcctgtctatccaggttcctccctccgttgcaggagcagagataccaagcgacgtgagtgtcctgctgggggaaaacgtggagttggtgtgcaacgcaaatggcattcctacgcctcttatccagtggctcaaggacggtaagcccattgcttccggcgagactgaacggattcgcgtgagcgcgaacggatctacactgaacatatatggcgcgctgacctccgacacaggaaaatatacctgcgtggcaacaaaccctgcaggggaggaggacagaatcttcaaccttaatgtttatgttactcctacaattcggggcaataaggacgaagcggagaagttgatgaccttggtggacacgtctatcaatattgagtgtagagcaacgggcacacctcccccgcaaattaactggttaaagaatggcctgccgcttccactgtcctcacacatccggcttttagctgcagggcaagtaatccgtatcgtgcgtgcacaggtttccgatgtggcagtgtacacctgtgtggcctctaacagagccggagtggacaataaacactacaatctccaggtgttcgcgcctcctaatatggataactccatggggacggaagaaattaccgtcttaaagggctcttctacgagcatggcttgtataacagacggcaccccagcgccctctatggcctggctgcgtgacgggcagcctctgggattggacgcacacctcaccgtgagcacccacggaatggtgctgcagttgcttaaagctgaaaccgaggacagtggaaaatacacctgcattgcctcaaacgaagcaggtgaagtgagcaagcacttcatccttaaagttctggagcccccgcatattaacggatctgaagagcacgaagagattagtgtgatcgtgaataatccgttggagttaacgtgcatcgcatctgggattcccgcccctaagatgacctggatgaaagacggtcgccccctgcctcagaccgaccaggtgcaaacgttaggaggtggcgaggtcttacgcatatctaccgcacaggtggaagatacaggtaggtacacctgcctagcctcctctcccgcaggtgatgatgataaggaatatctggtacgggtgcacgttcctcccaatattgccgggactgatgagccgcgagacatcacagtgcttcggaatcggcaagtgacgctcgaatgcaagtccgacgcagttcctccaccagtgatcacctggctcaggaatggcgagaggctgcaagctaccccgagagtgaggatcctatcgggggggcggtatctacagattaacaacgcagatcttggcgacacagcaaactacacttgcgtcgcctccaacatcgccgggaagacaactcgagaattcatcttaacagtaaatgtgccccccaacatcaaaggcggcccccaaagtctggttatactcctaaacaagtcaactgtgctggagtgcatcgccgaaggcgtcccgaccccacggattacttggcgtaaggacggagccgttctggcaggaaaccacgccaggtactcaattttagagaacggcttccttcatatccagagcgcacacgtaacggacaccggtcgatacttgtgcatggccacaaatgcagctgggaccgataggcggagaatagacctccaagtacacgtgcccccaagtatcgcacctggacctacaaatatgacagtcatcgtgaatgtgcaaactaccttggcatgcgaggccacagggataccaaaaccgagtatcaactggcggaagaacggacatctgctcaacgtggaccagaatcagaattcctaccgcctgctgagttcagggagcctagttattataagtccatccgttgacgacacagcgacttacgaatgtactgtcaccaacggcgcgggcgatgacaagcggacggttgatctaacagttcaggtgcctcccagcatcgccgatgaaccaaccgacttcctggtgacaaaacatgcaccagccgttataacgtgtaccgcctcaggggttccatttccgtccatacactggaccaaaaacgggattcgactactcccccgcggtgacggctaccgcatcctgtcatccggcgcaatcgagattctcgccactcagctgaatcacgcgggccggtatacatgcgtcgcacgaaatgctgccggatcggcacaccgccatgtcacacttcacgtgcacgagcccccagtgatccaacctcagcccagtgagctacatgtgattctgaacaacccaatcttgctgccctgtgaggccaccggaacccctagtccgttcatcacctggcagaaggaaggtatcaacgtgaacacaagcggaagaaaccacgccgttctgccttccggagggctgcagatctcccgggcggtgcgtgaggacgctgggacgtatatgtgtgtagctcagaatccagccggcacagccctcggaaagattaagctgaacgtgcaggtcccccccgttatcagcccccatctcaaggagtacgtgattgctgtcgataaacctatcactctgtcctgtgaagctgacgggctgccacccccagacattacttggcacaaggacggtcgtgctatcgtggaaagtattcgccagagggtcctgtcatcgggaagcctgcagatcgcctttgtccagccaggagacgcaggccattacacatgcatggcagctaacgtcgccggcagcagttccactagtaccaagctcaccgtccacgtgcctccacgcatcagatctacagaaggccactacacggtcaacgaaaattcgcaagcaatattgccgtgcgtggctgatggcatccccacacccgcgataaattggaagaaagacaacgttttgctggcaaatctacttggcaaatataccgctgaaccctacggggagctgatactagaaaacgtggtactggaagatagtggcttttacacttgcgtggccaacaacgccgcaggggaggacacgcacactgtatccttgactgtccacgtgttgccaacgtttactgagctgcctggggatgtctccctgaataagggcgagcagctccggcttagctgcaaggccacgggcatacctcttcctaagctgacatggacatttaacaataatattatcccagcacattttgattccgtgaatgggcactccgaactcgtgattgagagggtcagtaaagaggatagtgggacttatgtctgtacagcggaaaattcggtaggctttgttaaggccatcggcttcgtttatgtcaaggaaccacctgtgttcaagggggactacccatctaattggattgagccactgggcggcaacgcaatactgaattgtgaggtcaagggtgaccccacccccacaattcagtggaacaggaaaggagtggatatcgagatctctcatagaatccgccagctgggcaacgggtcattggccatctacggcaccgtgaatgaagacgcaggcgactatacctgtgttgcaaccaacgaagctggcgtggtggagcgctctatgagcctcactttacagtctcctcccatcattaccctggagccagtagagactgtgattaatgcaggaggcaaaattatccttaactgtcaggctacaggggagccccagcccactattacgtggagccgtcaaggacatagcatctcttgggacgaccgggtgaatgtcctctccaataactctctctacatagcagacgcacagaaggaagatacaagtgagttcgaatgtgtggctaggaatctaatgggatccgtgctggtccgcgtgcccgttattgtccaggtacacgggggctttagtcaatggtccgcctggcgggcgtgctctgtgacctgcggcaaagggattcagaagcggtccaggctgtgcaaccagccactgccagcaaacggaggcaagccctgccaaggatcggatctcgaaatgcggaactgccagaataaaccatgtcctgtggacgggtcttggtcggagtggtccctgtgggaggagtgcacccgtagttgcgggcgaggcaatcagactcggaccagaacatgcaacaacccctcagttcagcacggcggtagaccatgtgagggtaacgcagtcgaaataatcatgtgcaatataaggccctgccctgttcacggagcttggtctgcctggcagccttggggaacttgctccgagtcttgcggaaaggggacccagacccgggcaagattgtgcaacaaccccccacccgcctttggcgggtcctattgtgacggcgctgagacgcagatgcaggtttgcaatgaacgaaattgtcccattcacggaaagtgggcgacctgggccagttggtcagcatgtagcgtctcatgcggcggaggggcaagacaacgcactaggggctgcagcgacccagttccacaatatggcggcaggaaatgcgaaggctcggatgtacagagtgacttctgcaacagtgatccttgtcctactcacggtaactggagtccatggtccgggtggggcacctgcagtcggacgtgcaatggagggcagatgagaaggtaccggacttgcgacaatccaccccctagcaatgggggacgtgcatgtggtggaccagatagccaaattcaaaggtgcaacaccgacatgtgtccagtggacggctcgtggggatcatggcactcatggagccagtgctcagcaagctgtggagggggtgagaaaaccaggaagcggctgtgtgaccaccccgtgccagtaaagggaggtaggccatgtcccggcgacaccacacaggtcacccgctgtaacgtacaagcatgccctggcggacctcagcgagctcgtggcagcgtcattggtaatattaacgatgtcgagttcgggatagcttttctaaacgcaactatcacagattcaccaaactctgacaccagaatcataagagctaagatcactaacgttcccagatccctaggaagcgctatgaggaagatagtgtccatcctgaatccgatttactggactactgccaaggagatcggcgaagcagtgaatggattcactctgacgaacgccgttttcaaacgggagacccaagtagaatttgcaactggcgagatcttacagatgtcacatatagcacgagggttggactccgatggttccctgctgttagatatagtggtgagcggatacgtgcttcagctgcagagtccagcggaggtcactgtgaaggactacactgaggactacatccagaccggaccagggcaattgtatgcatatagcacaagattattcactattgacgggattagcatcccttacacctggaatcatacagtgttctatgaccaagctcagggacggatgccgtttctggtggaaacactgcacgccagtagcgttgaatctgactataaccagatcgaagagaccctcggctttaaaattcacgccagcatctctaaaggcgaccggagcaaccagtgtccaagcggcttcactctggattccgtcggccccttttgcgctgatgaagacgaatgtgccgctggtaacccctgtagccactcatgtcataacgctatgggaacctactattgttcctgccccaaaggtctcacaatcgccgcggatggacgaacctgtcaggatatagacgaatgtgcactaggcagacatacatgtcacgctggccaagattgcgacaataccatcggcagttataggtgcgtggtgaggtgcggttcggggtttcgccgcacttcagatgggttgtcttgtcaggatataaacgagtgccaggagagttccccttgtcatcaacgctgctttaatgccatcggatccttccactgcgggtgtgagcctgggtatcagttgaagggacgtaaatgtatggacgttaatgagtgcagacagaatgtgtgtcggcccgaccaacactgtaaaaatacccgcggaggttacaagtgcattgacctgtgccctaatggcatgaccaaagccgagaatgggacatgtattgacatcgatgagtgtaaagacggaactcaccagtgtcgatacaaccaaatatgtgaaaatacgcgaggatcctaccgctgcgtttgtccacggggttaccgttcccagggtgtgggacggccttgtatggacatcgatgagtgcgagaatacagacgcttgtcagcacgaatgcaagaatacatttggttcctaccagtgcatatgcccccctggatatcagctcacccataacggtaagacgtgtcaagatattgacgagtgcctggaacagaacgtacactgcggaccaaacaggatgtgctttaatatgcgaggcagctatcagtgcattgacactccttgtccaccaaactatcaaagagacccagtctcgggcttttgtctgaaaaactgccctccaaacgacttagaatgtgctttgtctccctatgctctagagtataagttagtgagcctccctttcgggatcgccacaaaccaagacctgattaggttggtggcgtacacgcaagatggcgtaatgcacccccgcactacattcctgatggtggatgaggaacagactgtcccgtttgctctgcgggatgagaacctgaaaggggtcgtgtatactacccgccccctgagagaggccgagacttatagaatgcgcgtgcgggcatcgtcctattccgccaatggcaccattgagtatcagacgacctttattgtgtatattgcggtaagtgcttacccgtattag

SEQ ID NO: 190472 - DNA, 723 bp, Artificial Sequence
  Description of Artificial Sequence: Synthetic coding sequence
gccatcggcagcttccactgcggctgcgagcccggctaccagctgaagggacgaaagtgcatggatgtgaacgagtgtcgccagaacgtctgtcggcccgatcagcactgcaagaacaccagaggtgggtataagtgtattgacctctgccccaatggcatgacaaaggccgagaacggcacgtgtattgacatagacgagtgtaaagacgggacacaccagtgtcgttacaaccagatatgcgaaaatacccgggggtcataccgctgcgtgtgccctagggggtatcggagtcagggcgtggggagaccctgtatggatattgatgaatgcgaaaacacagatgcttgccagcatgagtgcaaaaatactttcgggagctaccagtgcatctgtcctccaggataccagctcacgcacaacggaaaaacctgtcaggatatcgacgaatgtctggagcagaacgttcactgcggccccaaccgaatgtgctttaatatgcgcgggagttaccagtgcatcgataccccctgcccacccaactatcaacgggacccagtgagcgggttttgcctgaagaactgtccacctaatgatctggaatgcgcacttagcccttatgccctcgaatataaactggtgtcactccctttcggcatcgccactaatcaggacctcatccgcctggtcgcatatactcaggacggagtgatgcacccatag

SEQ ID NO: 190473 - DNA, 1455 bp, Artificial Sequence
  Description of Artificial Sequence: Synthetic coding sequence
atggacctgggcaaggaccagagccacctgaagcaccaccagacccctgatcctcaccaggaagagaatcactctcctgaggtgatcggtacatggtctctgcgaaaccgtgagctcctgaggaagcgcaaagcagaggtccacgagaaggaaacctctcagtggctcttcggagaacagaagaaacggaaacaacagaggaccggaaaggggaataggagggggcgaaaacgccagcagaataccgaattgaaagtcgagccccaacctcagatcgagaaggagatcgtcgagaaggcattagcccccattgagaaaaagactgagccaccagggagtatcaccaaggtcttcccctccgtagctagtccccagaaagtggtgcctgaggagcatttttcagaaatctgccaggaatcaaacatctaccaggaaaatttctctgaataccaagaaatagcggtccagaaccatagtagcgaaacctgccagcacgtgtccgagccagaggatctgtccccaaaaatgtaccaggaaatttcagtgctacaagacaacagctcaaaaatctgtcaggacatgaaggagcctgaggacaacagtccaaatacctgtcaggtcatctccgtcatccaagaccatcctttcaagatgtaccaggatatggcaaaaagagaagacttggccccgaagatgtgtcaagaggccgccgtccccaaaatcctcccttgcccaacctcagaagatacagctgatttggcaggatgctcacttcaggcttaccctaagcctgacgtccccaaaggctatattctggacacagaccagaatcctgctgaaccagaagagtacaacgaaactgaccagggcattgctgagactgaaggactgtttcctaagattcaggaaatcgccgaacctaaagatctatcaaccaagacccatcaggagagtgcagaacccaagtacttgcctcacaaaacttgcaacgaaatcatcgtccccaaggctccttcccataagaccatccaggagacgccacactcagaagattactcaatcgaaattaaccaagagactccagggagtgaaaagtactctcctgagacgtaccaggagattcctgggctcgaagagtacagccccgaaatctatcaggaaacctcccagctggaagagtactccccagaaatttatcaagaaacccccgggcctgaggacctgagcaccgagacatacaaaaacaaggacgtgccaaaagagtgcttccccgaaccacaccaggaaaccggaggcccacagggacaggaccccaaggcccatcaggaagacgcgaaagacgcctacacattcccacaggagatgaaggagaagcctaaggaggaaccagggatacctgccattcttaacgaatcccaccctgagaatgatgtttatagttacgtgctgttttag

SEQ ID NO: 190474 - DNA, 1455 bp, Artificial Sequence
  Description of Artificial Sequence: Synthetic coding sequence
atggacctgggcaaggaccagagccacctgaagcaccaccagaccccggaccctcaccaggaggagaatcattctccagaggtgatcgggacctggtcccttagaaatcgtgagttgctgcgcaaaagaaaagccgaggttcatgagaaggagacctctcagtggctgtttggggaacagaagaaacgcaagcagcagcgaaccggcaagggaaacaggcgggggcgtaaaaggcagcaaaacacagagctgaaggttgaacctcagccacagattgagaaggagatagtggaaaaggctctggctcccatcgagaaaaaaaccgaacccccaggcagcatcacaaaggttttcccttccgtcgctagtccacaaaaagtggtcccagaggaacacttcagtgaaatctgtcaggagtcaaatatctatcaggagaattttagtgagtaccaggagatagccgtgcagaaccatagttccgagacatgtcagcacgtaagtgaaccagaagacttatcgcctaagatgtatcaggagatctctgtcctgcaggacaactctagcaagatttgccaagatatgaaggagcccgaggataatagtccgaatacctgccaggttattagcgtgattcaggaccacccattcaaaatgtaccaagacatggcaaagcgggaagacttggcacccaagatgtgtcaggaggccgctgtgcccaaaatactgccctgtcccacgagcgaagacacagctgacttagccgggtgctctcttcaggcttacccaaagccagacgttccgaaggggtatattctggacaccgatcagaaccccgcagaacctgaggagtataatgaaactgatcagggcatcgctgagacagagggcctattcccaaaaattcaggaaatagcagagcctaaggatctgtcaaccaagacccatcaggaaagcgccgaaccaaaatacctaccccacaagacttgtaacgagattatcgtcccaaaagcgccatcccacaagacgattcaggaaactcctcacagcgaagactatagcatagagataaatcaggaaacaccaggctccgaaaaatattcccccgagacgtaccaggagatccccggcctcgaagagtacagtccagagatctaccaggagacctcgcagctggaggaatatagcccagaaatttatcaggaaacgccaggccctgaggacttaagcaccgagacttataagaataaggacgtacccaaggagtgctttccagagcctcatcaggagaccgggggcccacagggccaagatcctaaggcacaccaggaggacgcaaaggacgcctatacattcccacaggaaatgaaggagaaacctaaagaagagcccggtatccccgcaatactgaacgaatcgcacccagaaaatgatgtttattcatatgtgttgttctag

SEQ ID NO: 190475 - DNA, 429 bp, Artificial Sequence
  Description of Artificial Sequence: Synthetic coding sequence
atggtgctgagccccgccgacaagaccaacgtgaaggccgcctggggcaaagtgggtgcccacgctggagaatacggggccgaggctttagagcgaatgtttctgtcttttccgacaaccaaaacatactttcctcacttcgatttgagtcacggcagcgcccaggtgaaggggcatgggaagaaagtcgccgatgccctgacaaacgccgtcgcgcatgtggatgacatgcctaatgccctatcagcgttgtcagaccttcacgcgcacaagctgcgtgttgatccagttaactttaagttactgagtcactgtctcttggttacccttgctgcccatctgcctgccgagtttactccagcggtccacgcctcccttgacaagttcctggcttccgtgtcaacagttctgaccagtaaatacagatag

SEQ ID NO: 190476 - DNA, 429 bp, Artificial Sequence
  Description of Artificial Sequence: Synthetic coding sequence
atggtgctgagccccgccgacaagaccaacgtgaaggccgcctggggaaaggtgggggcccacgcgggcgaatacggcgccgaggccctcgagaggatgttcctgagctttcccactactaagacctacttcccccatttcgacctttcccacggcagcgcgcaggttaagggccatgggaaaaaggtagcagatgctctcactaacgctgttgctcacgtagacgacatgccaaacgctctgtcagctctttccgacctgcatgcccataagttacgggtggacccagtgaatttcaaattgctaagtcactgtttgcttgtgactcttgcggcccatctacccgctgagttcacccctgctgtgcacgccagtctcgacaagtttctggcctccgtcagtacggttctgacaagtaagtaccggtag

SEQ ID NO: 190477 - DNA, 333 bp, Artificial Sequence
  Description of Artificial Sequence: Synthetic coding sequence
atgttcctgagcttccccaccaccaagacctacttcccccacttcgacttatctcatggctcagcacaagtgaaaggtcatggcaaaaaggtggctgacgccctaacaaacgccgttgcacacgtggatgacatgcccaacgccttatcagcactgtcggacttacatgcgcacaaacttagggtggacccggtgaactttaaactgctgtctcattgtttactcgtcacactcgcggcgcatcttccagcggagtttacaccagctgtgcatgcgagtctcgacaagttcctggcgtctgtcagtactgttctgaccagtaaatataggtag

SEQ ID NO: 190478 - DNA, 444 bp, Artificial Sequence
  Description of Artificial Sequence: Synthetic coding sequence
atggtgcacctgacccccgaggagaagagcgccgtgaccgccctgtggggaaaagtgaacgtggatgaggtgggcggggaggctctgggccgcctacttgttgtgtatccatggactcaacggttcttcgagtcctttggcgatctaagcacgcccgatgctgtcatgggaaacccgaaagttaaagcccacggaaaaaaggtactgggggctttctccgatgggctggctcatctcgataatttaaaggggacattcgctaccctgtctgagctccactgtgacaaactgcatgtcgacccagagaactttaggcttctgggaaatgtgctagtgtgtgtgctggcccaccacttcggtaaggaatttactccaccggtgcaggctgcttatcagaaagttgtggctggagtagctaacgccttggcacacaagtatcactag

SEQ ID NO: 190479 - DNA, 273 bp, Artificial Sequence
  Description of Artificial Sequence: Synthetic coding sequence
atggtgcacctgacccccgaggagaagagcgccgtgaccgccctgtgggggaaagttaacgtggatgaggtggggggagaggcattgggccgcttgctagtagtgtacccttggacgcagcgattcttcgagtcatttggagatctttccactcctgatgccgtgatgggaaacccaaaggtgaaggcccatgggaagaaggtcttgggcgccttcagcgatgggctggcacaccttgataaccttaaaggcacttttgcaacgcttagttag

SEQ ID NO: 190480 - DNA, 426 bp, Artificial Sequence
  Description of Artificial Sequence: Synthetic coding sequence
atggtgcacctgacccccgaggagaagaccgccgtgaacgccctgtgggggaaggtgaatgttgacgccgtgggcggggaagccctaggaaggctgctggtagtgtacccgtggacccaacggttctttgagtcttttggcgacctgtctagtcctgatgccgtcatgggcaacccaaaggtgaaggcgcatggcaagaaggtgcttggggctttctcggatggccttgcccatctggacaacctaaaggggactttctctcagctgagcgaactgcattgcgacaagctacacgtcgaccccgagaacttccgcgtgtgtaagaaggtcccggaggctttacagatcggctctacatgtctgttctacaaggagtatatgggcaaggaaaaaagcaagggtacagttcagggaataaatgggtag

SEQ ID NO: 190481 - DNA, 444 bp, Artificial Sequence
  Description of Artificial Sequence: Synthetic coding sequence
atggtgcacctgacccccgaggagaagaccgccgtgaacgccctgtgggggaaggtgaacgtggatgccgttggaggtgaggcactcggacggctgcttgtggtctacccgtggacacagcgtttcttcgagagctttggagatttgagttcacccgacgcagtgatgggaaaccccaaagtgaaggctcatggtaaaaaggttctcggagcctttagcgacggactggcgcatctggacaatctgaaggggacattctcccagcttagtgaactgcactgtgacaaattgcacgtagaccctgaaaactttcggctgctgggaaatgtcctggtgtgtgtgttagccaggaattttggaaaagaattcactccccaaatgcaggcagcataccaaaaggtggttgctggcgttgccaatgccctggcgcataagtatcactag

SEQ ID NO: 190482 - DNA, 315 bp, Artificial Sequence
  Description of Artificial Sequence: Synthetic coding sequence
atggtgcacctgacccccgaggagaagaccgccgtgaacgccctgtggggcaaagtgaacgtcgacgctgtgggaggcgaggctttgggcaggctgctggttgtgtacccctggacacagcgtttttttgaatcctttggagacctgagcagccccgatgcagtgatgggcaatcccaaagtgaaagcgcacggtaagaaggtgctcggcgcctttagtgacggactggcacatctcgacaatcttaaaggaaccttttcccagttgtcagaactccattgcgacaagctgcatgtggatcccgagaatttttag

SEQ ID NO: 190483 - DNA, 444 bp, Artificial Sequence
  Description of Artificial Sequence: Synthetic coding sequence
atggtgcacttcaccgccgaggagaaggccgccgtgaccagcctgtggtcaaagatgaatgtagaagaagccggtggagaagcccttggaaggttgttggtggtgtacccatggacccagcgcttcttcgattcctttggaaatctgtcctcccccagcgcaattctcggcaacccaaaagtgaaggcgcacgggaagaaagtacttacttcttttggagacgccataaaaaacatggacaatctaaaaccggcttttgcaaaactctctgaacttcactgcgataaattgcatgtcgaccctgaaaatttcaaactgttgggaaacgtgatggtaattattctagcaacccacttcgggaaagaatttacgccagaggtgcaggccgcctggcagaagttggtcagcgctgtggcaattgccctggcccataaataccactag

SEQ ID NO: 190484 - DNA, 444 bp, Artificial Sequence
  Description of Artificial Sequence: Synthetic coding sequence
atggtgcacttcaccgccgaggagaaggccgccgtgaccagcctgtggtcaaagatgaacgtggaagaggctggcggagaagcgctgggccgcttactggttgtgtatccctggactcagagatttttcgacagtttcggaaatctttctagcccctcagccatcctgggtaaccccaaggttaaagcacacggcaaaaaagtgctcaccagtttcggcgacgctataaaaaacatggataatcttaagcctgcttttgcaaaattgtccgaattgcactgcgacaagttgcacgtagatcctgagaactttaaactgctcggaaacgtgatggtgatcatcctggccacccactttggcaaggagttcacccctgaggtgcaggctgcctggcagaagctcgtctcagctgtagctatagccctcgcacacaaataccactag

SEQ ID NO: 190485 - DNA, 264 bp, Artificial Sequence
  Description of Artificial Sequence: Synthetic coding sequence
atggtgcacttcaccgccgaggagaaggccgccgtgaccagcctgtggagcaagatgaacgtcgaggaggccggtggcgaagccctgggcagactactggtggtgtatccttggacgcagaggttttttgattcttttggaaatttgtcatctcctagcgctatcctgggtaatcccaaggtgaaggcacacggtaagaaagttctgacatcttttggggacgctattaagaacatggataatttgaaaccagccttcgcctag

SEQ ID NO: 190486 - DNA, 444 bp, Artificial Sequence
  Description of Artificial Sequence: Synthetic coding sequence
atgggccacttcaccgaggaggacaaggccaccatcaccagcctgtggggcaaagtgaatgtcgaagacgcaggaggtgagaccttggggcgcttactagtggtgtatccctggactcaaaggttttttgattcattcggaaatctatccagcgcaagcgccatcatgggaaaccccaaggtgaaagcccacggcaaaaaggtgctcacctctctgggagatgcaacgaagcacctggacgatttaaagggaaccttcgcccagctgtcagagttgcattgtgacaagttacatgtcgacccagaaaattttaagctactcgggaacgtgctggtgacagtactggccattcatttcgggaaagagttcacccccgaagtgcaagccagttggcagaaaatggtgactgcagtggcttccgcgcttagttcccggtatcattag

SEQ ID NO: 190487 - DNA, 444 bp, Artificial Sequence
  Description of Artificial Sequence: Synthetic coding sequence
atgggccacttcaccgaggaggacaaggccaccatcaccagcctgtggggcaaggtaaacgttgaggacgcaggtggtgaaactctgggtcgcctgctggttgtctacccatggacccaacgctttttcgactccttcgggaatcttagtagtgcatccgccatcatgggaaaccctaaggtgaaggcacatgggaagaaggtacttacaagtctgggcgatgccatcaaacatctcgacgatctcaaaggaaccttcgcccaactttcggagctgcactgtgataagcttcacgtggatccagaaaactttaaactgctgggtaatgtccttgttactgttctcgcaattcattttggtaaggagtttacaccagaagtgcaggccagttggcaaaaaatggtgaccggggtagctagtgccctttccagtcgatatcattag

SEQ ID NO: 190488 - DNA, 477 bp, Artificial Sequence
  Description of Artificial Sequence: Synthetic coding sequence
atgggccacttcaccgaggaggacaaggccaccatcaccagcctgtggggcaaagtgaatgtggaggatgctgggggggagacactcgggcgcctcctggtggtgtatccctggactcagcgatttttcgattccttcggcaatctctcttccgcaagcgctattatggggaatcctaaggtgaaggctcatggaaaaaaggtgctgaccagccttggcgatgcaatcaagcacctcgacgacctgaagggtacttttgctcagcttagcgagctgcattgcgacaagttacatgtggatcccgagaacttcaaactgcttggcaatgtcctggtgaccgtgctggccatccacttcggcaaagaattcacaccggaggttcaggcatcatggcagaagatggactggagtggtcaatgtccagtacttcagatccctctgtcttcattgcccatgatgcagagctttcaaggatag

SEQ ID NO: 190489 - DNA, 414 bp, Artificial Sequence
  Description of Artificial Sequence: Synthetic coding sequence
atggtggtgctgggcgagatgaagcggaaggtgctgcccctgcactttctgcctttcatgcggctgctggtcgtgtacccatggacccaaaggttttttgactccttcggcaaccttagcagtgcaagtgctatcatgggaaatcccaaagtcaaggctcatgggaaaaaagtcttgacatcgctgggtgatgccattaagcacttggacgatttaaagggaacgttcgcccagctgtccgagctgcactgtgataaattacatgtggatcctgaaaactttaaactgcttggaaacgtattggttaccgttctggcgatccactttggcaaagagtttacccccgaggtccaagctagttggcagaaaatggttaccggggtggcatcagccttatcctccagatatcactag

SEQ ID NO: 190490 - DNA, 444 bp, Artificial Sequence
  Description of Artificial Sequence: Synthetic coding sequence
atgggccacttcaccgaggaggacaaggccaccatcaccagcctgtggggtaaagtcaatgttgaagatgctggcggagagaccctcggacgcctcctggtggtttacccctggacacagaggtttttcgacagttttgggaatcttagttcagcttccgctatcatgggaaatcctaaggtgaaggctcatggtaagaaagtcctgacctctctcggcgatgctattaagcacctcgatgatctgaaaggcacgtttgcgcagctcagtgagctgcactgcgacaagctgcatgtggaccccgaaaatttcaagctgctgggaaacgtcctggttacagtactggccattcacttcggcaaagagttcacccctgaggtgcaagccagctggcagaagatggtaacgggcgtagcctccgctctttcctctcggtatcattag

SEQ ID NO: 190491 - DNA, 426 bp, Artificial Sequence
  Description of Artificial Sequence: Synthetic coding sequence
atgctgagcgcccaggagcgggcccagatcgcccaggtgtgggacctgatcgctgggcatgaagcccagttcggagcggagttgctcctgcggttgttcaccgtttacccatccactaaagtctactttccccacctgagtgcctgtcaggacgcgacccagcttctttctcatggacagcgcatgttggccgcggtaggagccgctgtccagcacgtagataatctgagggctgcactctcccccctggcggacctgcacgcactagtactgcgcgtagacccagccaacttccccctgctaattcaatgttttcacgttgtcctggcatcccatctccaagacgagtttaccgtgcagatgcaagccgcttgggacaaattcctgacgggggtcgctgtggtgttgacagaaaaatatcgatag

SEQ ID NO: 190492 - DNA, 429 bp, Artificial Sequence
  Description of Artificial Sequence: Synthetic coding sequence
atggccctgagcgccgaggaccgggccctggtgcgggccctgtggaagaagttaggtagcaacgtgggggtgtacaccaccgaggccctcgagaggacgttcctcgccttcccggcaactaaaacctattttagccatttagacctaagtccaggaagcagccaggtgcgagcgcatggacagaaagtcgccgatgcactatccctcgccgtggagcggctcgacgacctgcctcatgctctcagcgccctgagccacctacacgcctgccagttaagggttgaccccgcttcattccagctgcttgggcactgtctgctcgtcaccctggctcgccactaccctggagatttctcacccgccctgcaggcttccctggacaagttccttagtcacgttattagtgccctggtctcagagtataggtag

SEQ ID NO: 190493 - DNA, 429 bp, Artificial Sequence
  Description of Artificial Sequence: Synthetic coding sequence
atgagcctgaccaagaccgagcggaccatcatcgtgagcatgtgggccaagatcagtacccaggccgacaccattggcaccgaaactttggagaggctgtttctcagtcacccacagaccaaaacatattttccacattttgacctgcacccagggagtgctcagctgcgggcacacgggtcaaaggtggttgccgccgttggagacgctgttaaatctatcgatgacataggcggagcgctcagcaagctctctgaactccatgcttacatccttcgggtggaccctgtgaactttaaattgctctctcactgtctgctagtgacccttgcagctcgcttcccggccgattttaccgcggaggcacatgcagcttgggacaagtttcttagcgtcgtgagtagcgtgctcacagaaaagtaccggtag

SEQ ID NO: 190494 - DNA, 1389 bp, Artificial Sequence
  Description of Artificial Sequence: Synthetic coding sequence
atggcccgggtgctgggcgcccccgtggccctgggcctgtggagcttgtgctggtccctcgcgatcgcaacaccactgccccctacctcagctcacggaaacgttgcagaaggagagaccaagccggaccccgacgtcacggaaaggtgcagcgacggctggtcattcgatgctaccaccctagacgacaatggcaccatgctcttctttaagggggagttcgtgtggaagtctcacaagtgggaccgcgagcttatctcagaacgttggaagaatttccccagtcctgtggacgctgctttcaggcagggccacaattccgtgttcctcattaagggagacaaagtgtgggtgtatccacctgaaaaaaaggaaaagggctaccctaagcttctccaggatgaattcccaggcataccaagccctctggatgctgccgtagagtgtcatcgcggggaatgtcaagcggaaggggtgctcttctttcagggagatcgcgagtggttttgggacttggccactggcactatgaaggaacgaagttggcctgccgtggggaactgttcttcagctcttcgctggctcggccgctattactgcttccaagggaaccagttcctccgtttcgatcctgtacgcggcgaagtccctccaagatacccacgggacgtgagggattattttatgccttgtccaggcaggggacacggccaccgtaatggcaccggccacgggaacagcactcaccacgggcctgagtacatgagatgcagccctcaccttgtcctgagcgccctgacttccgacaatcacggcgcaacctacgcgttcagcgggactcattattggcgattggacacctctcgcgacggctggcactcctggcccatcgctcaccagtggcctcagggacccagtgccgtcgatgcagcattttcgtgggaagagaaattataccttgtccaaggaacccaggtatacgtgttcctgaccaagggcggctatacactggtatctggttaccccaagaggctggaaaaagaagtcggcactccacatggaataatactcgactcagtcgacgcggcgttcatttgtcccggtagtagccgccttcacatcatggctggacgccgactttggtggctcgatctgaaaagcggcgcacaggccacctggacagagctgccctggccccatgagaaggtagacggcgcgctgtgtatggaaaagagcctcggccccaactcctgcagcgccaatgggcccggactgtacttgattcacggaccgaatctctactgctactcggatgtggagaagcttaatgccgccaaggccctaccgcagccacagaacgtgacaagtttgctgggatgcacccactag

SEQ ID NO: 190495 - DNA, 765 bp, Artificial Sequence
  Description of Artificial Sequence: Synthetic coding sequence
atggcccgggtgctgggcgcccccgtggccctgggcctgtggagcctgtgttggtcactggcgatcgccacgcccctgcctcctaccagcgctcatgggaatgttgctgagggagaaactaagcctgaccctgatgtgaccgagaggtgttctgatggttggtcattcgacgccactacattagatgataacggaaccatgctgttctttaagggcgagtttgtatggaagagccataagtgggacagagagctcatctctgagagatggaagaatttccccagtccagttgatgcagcctttcgtcaagggcacaattccgtcttccttatcaagggagataaggtttgggtgtacccaccagaaaagaaggaaaaaggttatcccaagctgctccaggacgaatttcctgggataccgagccccctcgatgccgctgtggagtgccaccgcggtgagtgtcaggctgagggtgttctcttttttcaaggagacagagaatggttttgggacctggccacaggaaccatgaaagaaaggtcctggcctgctgtggggaactgcagcagcgctctcagatggttggggcgatattactgcttccagggtaatcagttcctgcgctttgatcctgttcggggcgaggtcccgcctcgctacccccgggacgtgcgggattacttcatgccttgccccggccgagggcatggccaccgaaacggcaccggtcatggcaattcaatttgcgcagtcgcccacatttag

SEQ ID NO: 190496 - DNA, 1353 bp, Artificial Sequence
  Description of Artificial Sequence: Synthetic coding sequence
atgtggctgaaggtgttcaccaccttcctgagcttcgccaccggcgcttgcagtggattaaaagttaccgtcccaagccatacagtgcacggggtgcgtgggcaggcactatatctcccagttcattacgggttccacacgccagctagcgatatccagatcatttggctttttgagcggccgcatacaatgccgaagtatttgctgggtagcgtgaacaaatctgtcgtgcctgacctcgaataccagcataaattcaccatgatgccgccaaatgcctcactgctgattaacccattgcagttccccgatgagggcaactacattgttaaagtcaatatccagggcaacggtacactgagcgcctcccagaagatccaggtcacagtggatgatcctgtgacaaagccggtggtccagattcaccccccatctggcgccgtggaatacgtcggcaacatgacactcacatgccatgttgagggtggtacaaggctggcttatcagtggttgaaaaacggacgtccagttcacaccagttccacatacagtttcagtccgcagaataacactctccacattgctccagttaccaaagaggacattggaaactactcatgcctcgtgcgtaatcccgtctcagagatggagtcagatataattatgcccattatttattatggcccatacggtttacaggtaaactctgacaaggggctgaaggtgggagaggtttttaccgtggatcttggggaggccatccttttcgattgcagcgctgacagccacccacccaatacatacagctggattcgtcgaacagacaatactacatacataatcaagcacggcccccgcctcgaggtggcttcagaaaaggtagcccaaaaaactatggactacgtgtgctgcgcctacaacaacatcaccggaagacaggacgaaacgcacttcacagtaattatcacctcagttggcctggagaagctcgctcagaagggtaaatcactatctcccctggctagtatcaccgggatctccctcttcctgattattagcatgtgcctactgtttctttggaaaaagtaccagccttacaaggtgatcaagcagaagttggaggggagaccagaaacagagtacaggaaggcccagacattttccggacacgaggatgccttggatgatttcggtatttacgagtttgtcgcattccccgacgtcagcggcgtgtcacggatccccagcaggtcagttcctgccagcgattgcgtgtctgggcaggaccttcactccactgtgtacgaggtcattcaacacattcccgcccaacagcaggatcatccagagtag

SEQ ID NO: 190497 - DNA, 1389 bp, Artificial Sequence
  Description of Artificial Sequence: Synthetic coding sequence
atgggccaggacgccttcatggagcccttcggcgacaccctgggcgtgttccaatgcaaaatttacctcctgctgttcggggcttgctctgggctgaaggtgactgtgccctcccacactgtgcatggcgtcagaggtcaggcattgtacctgcccgtgcactacggatttcacacacctgcatctgatatacagattatctggctctttgaacgacctcatacaatgccaaagtatctacttggaagcgtgaacaaaagtgtggttcctgatttggaatatcagcacaagtttactatgatgcctcccaatgctagtttgctcattaaccctttacagtttccggacgagggaaactatattgttaaggttaacatacaggggaacgggactctgtccgcttcccagaagatccaggtcacggttgacgaccctgttaccaaaccagttgtacagatccaccctccttctggtgcagtcgagtacgtaggaaacatgactcttacatgccatgtagagggaggaacaagactcgcataccagtggctaaaaaatggtcggcccgtccacacatcatctacgtactcattctctccgcaaaacaatacgctgcatattgcacctgtcacaaaggaagacatcggcaattactcttgtctagtgcgcaaccctgtgtccgaaatggagtccgacatcatcatgcccattatctactacggaccctacggcttacaagtgaacagtgacaagggtctgaaggtgggggaggtttttaccgtcgacctgggtgaggcaatcctttttgactgctctgctgacagccacccacctaacacttactcttggatccgcaggaccgataatacgacctatatcatcaagcatggacctagactcgaagtggcttcggagaaggttgcccaaaagaccatggactatgtgtgctgcgcctacaataatatcactggacgccaggacgaaacacattttactgtgattatcaccagtgtgggactcgagaaactcgcccaaaagggcaaatctctttcacctttagcctcaataactggaatatctctgtttttgattatctcaatgtgtctgctgtttttgtggaaaaagtaccagccttacaaggttattaagcagaaacttgagggtcgtcccgagaccgaatatcgtaaagcccaaactttctctgggcatgaagacgcgttagacgattttggaatttatgagtttgtcgctttccctgatgtctcgggcgtgagtcgcattccaagtcggtccgttcctgcttctgactgtgtttcgggacaggacctccatagtaccgtctacgaagtgattcaacacattccggcccagcagcaggatcaccccgagtag

SEQ ID NO: 190498 - DNA, 1104 bp, Artificial Sequence
  Description of Artificial Sequence: Synthetic coding sequence
atggcctaccgggtgctgggccgggccggccccccccagccccggcgtgctaggcgcttgcttttcgccttcacgctctctttaagttgcacatacctctgctatagctttctatgctgctgcgacgatctgggccgcagcaggctgctaggggcaccccgctgtcttaggggcccctctgcggggggacagaagctgttgcagaagtccagaccctgcgacccatccggacctactccatctgagcctagcgcccccagtgcacccgccgccgctgtgcctgctccccggttatcagggtccaatcactccggatctcctaagctggggactaagcggcttccacaggcactgattgttggggtaaaaaaaggtggcacacgagcagtgctggaatttataagggtacaccccgatgttcgagccttgggaacggagccccatttctttgacagaaactatggccgcggcctcgattggtatcgcagccttatgccacgaacgctcgaaagccagatcacactggaaaaaacccctagctattttgtcactcaagaggctcctagaagaatatttaatatgagcagagacaccaagctgattgtggtggttaggaatccggtaactcgggctataagtgattatactcagacattgtctaaaaagccagatatccctacctttgaggggctttcttttagaaatcgaaccctcgggttggtggacgtatcttggaatgctattcggatcggcatgtacgtcttacatctggaaagctggttacagtacttccctctggcccagattcacttcgtgtcaggggaaaggctgattacagaccccgcaggcgagatgggaagagtgcaggattttttgggcatcaaacgctttataacagacaagcacttttacttcaataagacaaaaggctttccctgcctgaaaaagaccgaatccagtttgcttcctcgctgtctgggcaaatccaaggggaggactcatgtgcagatagatcctgaagttatagatcagctgagggagttttacagaccttacaatatcaaattctatgagacggtgggtcaagatttcaggtgggaatag

SEQ ID NO: 190499 - DNA, 1035 bp, Artificial Sequence
  Description of Artificial Sequence: Synthetic coding sequence
ccccccgcccgggcccacggcgccatggcctaccgggtgctgggcagagccggcccccctcagcctcgtcgggctcggcgcttactgttcgcattcacactgagcctgtcctgtacatatctttgctattcatttctgtgttgctgtgacgatttgggcagatccagacttcttggggcacctagatgtctgaggggcccaagtgccggcggtcaaaagctacttcagaaaagtcgcccctgcgaccccagcgggccaactccttcggagccatcggccccgagcgcccccgcagccgctgttcccgccccccgcctcagcgggtcaaatcactcgggcagtccaaagttgggaaccaaacgcctcccccaggccctgatcgtcggagttaaaaaggggggtacccgggccgtcctagagtttatacgagtgcatcctgatgtgagagcattggggacagaacctcattttttcgaccggaactacggtagagggctggattggtacaggagcctgatgccccgcacactcgaatcccagatcacactggagaagactccttcctacttcgtgacgcaggaggcgcctaggagaatcttcaatatgtcaagagacacgaagctgatcgtcgttgtccggaacccggtcacccgggccatttctgattatacacagactctcagcaaaaaacccgatatcccaactttcgagggcttaagctttcggaacagaaccttaggactggtcgacgtgtcttggaacgccataaggattggaatgtatgttttacatctggaaagctggcttcagtatttccctctggcgcaaattcattttgtgtcaggggaaagactgattactgacccagctggcgagatgggaagagtccaagactttcttggtattaaaagattcatcaccgacaaacatttttactttaacaagaccaaaggtttcccctgcttaaaaaacagaatcgaaccacccgcctccatgctcgggcagattaaacgagagaactcttgcactgactag

SEQ ID NO: 190500 - DNA, 1221 bp, Artificial Sequence
  Description of Artificial Sequence: Synthetic coding sequence
atggccccccccggccccgccagcgccctgagcaccagcgccgagcccctttccaggtctatcttccgaaagttcctgctgatgctgtgcagccttctcacatcactgtacgtcttctattgtctcgccgagaggtgccagacgctgtcaggacccgtggtgggattgtccggcggcggagaggaagccggggcgcctggagggggggtcctggcaggtggcccccgagagttggcagtatggcctgctgctgctcagcgcaagcgcctcttacaactccctcaatggaggcgtcggaggcctccggcacctagggatgacggcgaagaagcagcctgggaggaagagagcccaggtctctcaggcgggcctgggggcagcggtgcgggtagcacagtggcagaagctccgccaggcacactcgccctgctgttggatgaaggcagcaaacaactcccccaggccatcatcatcggcgtgaagaagggggggacccgagcactgttagaatttctgagagtacacccggacgtccgagcagtcggcgctgagccccatttcttcgaccgcagctatgataaaggacttgcctggtacagagacctcatgccaagaactcttgatggtcagattactatggaaaagactccatcctactttgtgaccagagaagcccctgcccgcatttctgccatgtcaaaggatacgaagctcatcgtggtcgtccgagaccccgtcactcgggctatttccgattacacccagacactcagcaaaaggcccgatataccgaccttcgagagcctcaccttcaaaaatcgaacagcgggattgattgacacgtcttggtcagcgattcaaattggcatctacgccaaacacctggagcactggttgaggcactttcctatcaggcaaatgctcttcgtgagcggggagaggctcatcagtgatcccgcaggcgaattgggcagggtccaggattttctaggcctgaagcgcataattacggataagcacttttattttaataagacaaaggggtttccatgtctgaaaaaggccgagggcagttcaaggccacactgtctggggaagactaaggggaggactcacccagagattgaccgggaggttgtgagacgcctccgtgaattctacaggccttttaatctgaagttttatcagatgaccggacatgatttcggctgggatggctag

SEQ ID NO: 190501 - DNA, 1173 bp, Artificial Sequence
  Description of Artificial Sequence: Synthetic coding sequence
atgggccagcggctgagcggcggccggagctgcctggacgtgcccggccggctcctgcctcaaccccccccgccccctccccctgtgaggagaaagctcgctcttttattcgcaatgctgtgcgtttggctttatatgttcctgtacagctgcgctggctcttgcgccgcggctccaggtctcctgctgctggggtcaggctcccgcgcggcccacgatccacccgcgctcgccacagctcctgatggaactcccccacgcctgccatttcgggctccacccgctacccccttggcctccggcaaagaaatggcggagggagccgcgagcccagaggaacagtccccagaggtcccggattcgccctcaccaatttcttccttcttctccggctcggggagcaaacagctcccccaggccatcatcattggggttaagaaaggtggcacccgcgcgttgctggaattccttcgagttcatccggacgtccgcgcagtgggggctgaaccacacttcttcgaccgctcttatgataaaggtcttgcatggtacagagatctcatgccacggacgcttgatggacaaattacaatggagaagaccccttcatattttgtaaccagggaagcccccgctaggattagtgccatgtctaaagacaccaagctcatcgttgtggtgagggatccggttacaagggctatatctgattacacacaaacactttctaagcggccagacatcccaactttcgaatctcttacattcaaaaaccgaactgcaggtctgattgatacatcctggtcagccattcagatcggcatctacgccaagcatctggagcattggcttagacatttccccatacgccagatgctctttgtgagcggggagcgcctgatcagcgacccagctggagagctcggacgagtccaagacttcttaggcttaaaaaggatcatcactgataagcacttctatttcaataagactaagggatttccgtgtttaaagaaagcagaaggaagcagtcgacctcattgtctagggaaaaccaaaggccgtactcacccggagatcgatagggaagtcgtgcgaaggctccgagagttctataggcccttcaatttaaagttctaccaaatgaccgggcacgacttcgggtgggactag

SEQ ID NO: 190502 - DNA, 1173 bp, Artificial Sequence
  Description of Artificial Sequence: Synthetic coding sequence
atgggccagcggctgagcggcggccggagctgcctggacgtgcccggtcgccttctcccacagcctcctccccctccccctcccgtgcgtaggaagcttgccctcctgtttgcaatgctttgcgtctggctctacatgtttctgtactcttgcgccgggagttgcgcagccgcgcccggacttctgctcctcgggtctgggagccgcgcagcacatgatcctccagcccttgccaccgcccctgacggcacaccccccaggctgccgttcagggcccctcccgctacgcctctcgctagcgggaaagagatggctgaaggggccgcctccccagaagaacagtctccagaggttcccgactctccttcaccgatctcctcattttttagtggttcgggctcaaaacaacttccacaggccattataattggcgtgaagaagggcggcactagggctcttttggagttcctcagagtccaccctgacgtgcgggctgtcggcgctgagccccatttcttcgacagatcctacgacaaggggctcgcctggtatcgggatttgatgccacggacacttgacggacagatcacaatggagaaaacacctagctacttcgtaaccagagaggctcctgcccgtatatctgctatgtcaaaggatacaaagctcatagtggtggtccgtgaccccgtgactagggcaatctctgattacacacagaccctctctaagcggcccgacatcccaacctttgagtcactgactttcaaaaatcgaaccgccgggcttattgacacctcctggtcggcgatccaaatagggatttacgctaaacatcttgagcactggctgcgacactttcccatcagacagatgctgttcgtttctggggaacgactgatctcagaccccgctggtgaattagggagagtgcaggattttctgggtctgaaacgaattatcactgacaaacatttctacttcaacaaaaccaaggggttcccctgtctcaagaaggctgaggggtcctcaagacctcattgccttggaaagacgaagggacgcacccatccagaaatcgaccgggaggtagtgcggaggctccgcgagttctataggcccttcaacctcaagttctaccagatgacaggccacgacttcgggtgggactag

SEQ ID NO: 190503 - DNA, 1371 bp, Artificial Sequence
  Description of Artificial Sequence: Synthetic coding sequence
atggcccggtggcccgcccccccccccccccccccccccccccccccattggctgctcctcccccaccaggggcaagcgctaaaggacctcccgcacgtaaactgctctttatgtgtaccctttcccttagcgtgacatacctttgctattcactgctgggaggcagcgggtctttgcagtttccactggcattgcaggagtccccaggcgcagcagccgagcctcctccgtccccaccacccccttcactgctgcccactccggtgagactgggagccccatcacaacctcccgcccctccaccccttgataacgcttcacacggtgagcccccagagccaccagaacagcctgcagctccgggcacagacggttggggtctaccatcagggggaggcggcgcgcaagatgcatggctcaggactccactcgctccgagcgaaatgatcaccgcgcagtccgccttgcccgagcgcgaagcacaggagtcctcaactaccgacgaagacctggctggcaggcgggccgcaaatggatcttccgaacggggaggagcggtgtccacacccgactacggggagaagaaactaccccaggccctgattattggggtgaagaaggggggcacccgtgcgcttttggaagctatccgggtgcacccagacgtgagagccgtcggggttgagccccacttttttgaccgaaattacgaaaaaggactggagtggtacagaaatgtcatgcccaagaccctggatggacagatcactatggagaagaccccatcgtacttcgtgaccaacgaggcgccaaaacgcatccactctatggcgaaagatatcaagctaattgtcgtggtcagaaatcccgtaaccagagccatttcagattatacacagacactgagcaagaagcccgagatacccaccttcgaggtcttggcatttaagaatcggaccctggggctaatagacgcaagttggagtgctattcgaatcggcatctacgctttacatttagaaaactggctacagtatttcccactttctcagatcctgttcgtgtccggagagagattgattgtagaccctgcgggagagatggccaaggtccaggactttcttggtctgaagagagtcgtgaccgagaagcatttttatttcaataagaccaaaggcttcccttgtttgaagaagcccgaagactcatccgctccgcgctgcttaggtaagtccaaaggacggacccaccccaggatcgatccagatgtgatccaccgactccgtaagttttacaagcccttcaatctgatgttttaccagatgaccggccaagacttccagtgggaacaggaggagggcgacaagtag

SEQ ID NO: 190504 - DNA, 1041 bp, Artificial Sequence
  Description of Artificial Sequence: Synthetic coding sequence
atgctgttcaagcagcaggcctggctgcggcagaagctgctggtgctgggatccttagccgttggctcactgctgtacctggtggcccgagtgggttcccttgatcggctacagcccatctgtccaatcgaaggaaggctgggcggtgcacgaacgcaggccgaattccccctccgggctttgcagttcaagcgtggactcctgcatgagttcaggaagggaaatgcatcaaaggagcaggtaaggctccacgacctggtgcagcaacttccaaaggcaatcatcataggagtgcgcaagggcggaacccgagctctcctcgagatgctgaacctccaccctgcagtcgttaaggcctcgcaggagatacacttttttgacaacgatgagaactacggtaaaggcatcgagtggtaccgaaagaagatgccttttagttaccctcagcagattacaattgaaaaaagcccagcttattttatcacggaagaggtgccagagcgaatttataaaatgaattccagcatcaagctgctgatcattgtgagagagcctacgacgcgagctataagtgactatacccaggtgctcgagggtaaagagaggaagaataagacctactacaagtttgagaaactggccattgatccaaacacctgcgaggtgaacaccaaatataaagccgttcgtactagtatttatactaaacacctggaacgctggctgaaatattttcctatcgaacagttccatgtcgtcgacggagaccggctcatcacagagccccttccggagctgcagctggtcgaaaaattcttgaacctaccccccagaatctcccagtataatctgtacttcaacgctacaagagggttttattgcctaagatttaatatcattttcaacaaatgcctggcagggagtaaaggtagaatccatccggaggtggacccgtccgttatcactaagctgcggaaattcttccaccccttcaatcagaaattttatcaaattacggggcgaaccctgaactggccgtag

SEQ ID NO: 190505 - DNA, 1041 bp, Artificial Sequence
  Description of Artificial Sequence: Synthetic coding sequence
atgctgttcaagcagcaggcctggctgcggcagaagctgctggtgttgggcagtttagcagtcggcagtctgctctaccttgtggcacgagtgggatccttagaccgcttacagcccatctgcccaattgagggccgattgggtggcgcccgcacacaggcagaattccccctgcgggccctccagtttaagagaggactgttgcatgagttcaggaaggggaacgcgtcaaaggaacaagtgcggttacatgacctggtccagcagctccccaaagcaattataattggcgttcggaaggggggaactcgcgccctgttagagatgctaaatctacatcccgctgtggtcaaagcatctcaggagattcatttttttgataatgatgaaaattatggcaaaggaatcgagtggtaccgcaagaagatgcctttttcctaccctcagcaaataaccattgagaagagccccgcatacttcattactgaagaagttcccgaacgcatatacaagatgaatagctctatcaagctcctcattatcgtgagggagcccacgacgcgggccatctcagactatacacaggtcctagaagggaaagagcggaaaaacaaaacctactacaagtttgagaaacttgccatcgacccaaacacatgtgaagtaaatacgaagtacaaggccgtgagaacaagtatctacacaaagcacttagaaaggtggcttaaatattttcccatcgagcagttccatgtcgttgacggagataggctgataacagagcccctgccagaactgcagctggtggaaaagttcctgaacctgccccctaggattagccaatacaacctgtactttaacgcaactagggggttctactgtcttcggtttaatattattttcaacaagtgcctggcaggtagcaaggggcgtattcatccggaagtggatcccagcgtaattaccaagctacggaaattctttcacccctttaatcagaagttctatcagattaccgggcgtacattgaactggccttag

SEQ ID NO: 190506 - DNA, 969 bp, Artificial Sequence
  Description of Artificial Sequence: Synthetic coding sequence
atgctgttcatcaagttcatccacctggaggtgttcagcatgcccgaacgcgccatcgctagacatgaagttcgcgaaattgaacagcgccacactatggacgggccgaggcaggacgcaaccctggacgaggaggaggacatggtcataatctacaacagagttcctaagaccgcctctacttcattcacaaatatagcttatgatctatgcgccaaaaacaagtaccatgtgctccatatcaatactaccaagaataaccctgtgatgtctctccaggatcaggtcagattcgtaaagaacataaccagttggaaagagatgaaacctggcttctatcacggacacgtgtcctaccttgatttcgctaagttcggtgttaaaaagaaaccaatctacatcaatgttataagggatccaatcgagagactggtctcatattattattttcttaggttcggcgatgattacaggcctggactgcgtaggcggaagcagggagacaaaaagacctttgacgaatgtgtggcagaaggtggcagcgattgtgccccagaaaaactgtggttacaaataccatttttctgcggacactcttccgagtgttggaacgtcgggagtcgttgggccatggatcaggccaagtacaacttgatcaacgagtactttctggtaggagtcactgaggagctcgaagatttcattatgttgctggaggcagcactgcctcgtttcttccgcggagccactgagctgtacaggactgcacctgatacagccactccatcccatagacacggtcctatctgtgggtccaaatccattagttcactccttgtcaaagtgtctcctgtgtgcaaggacagccattgccactgtagaaggggaacaggaacaccaaaaggcgaaacccttgccacgttggctccttgctcccagagctggagttcagtgacacaccgctggtag

SEQ ID NO: 190507 - DNA, 912 bp, Artificial Sequence
  Description of Artificial Sequence: Synthetic coding sequence
atgctgttcatcaagttcatccacctggaggtgttcagcatgcccgagcgagcaattgccaggcacgaggtcagagaaattgaacagaggcacacgatggatgggcctagacaggatgcaacactggacgaggaggaggacatggtcatcatttataatcgggttcctaagacggcctctacatcattcactaatattgcctatgacttgtgcgctaagaacaaatatcatgtgctgcacatcaacaccaccaagaacaaccctgtcatgtccctgcaggaccaggttcgcttcgtgaagaacataacaagctggaaagagatgaagccgggcttttaccatggccacgtcagttacctggatttcgctaagttcggtgtgaagaaaaagccaatctatatcaatgtcatacgcgatcccatagaacggctggttagctactactactttctgagatttggtgatgactaccggccaggactcagacggcgaaagcagggagataagaaaacattcgatgaatgtgtggcggagggcggctccgattgcgcacccgagaagctgtggctgcagataccttttttctgtggccacagtagcgagtgttggaatgtaggaagtagatgggccatggaccaggctaaatataacctgattaatgaatactttttggtaggtgttactgaggagttggaggacttcatcatgctgctggaggcagcgctccctagattcttccgaggggctacagaactatataggacagcccccgataccgccacaccgtcccaccgtcatggtcccatctgcggctcgaagagtatctccagcctcctagtgaaggtctcccccgtgtgcaaggacagtcattgcctcggaaagtgctcgagaaacggcctgagcgctgtttag

SEQ ID NO: 190508 - DNA, 1071 bp, Artificial Sequence
  Description of Artificial Sequence: Synthetic coding sequence
atgggcctgctgcggatcatgatgccccccaagctgcagctgctggccgtggtggcctttgccgtcgccatgctttttttggagaaccagattcagaaattggaggagtctaggtctaaacttgaaagggctattgcccgccatgaggtacgcgaaatcgaacagagacacacaatggatggccctagacaagatgccacactagacgaggaggaggacatggtgatcatttataatcgcgttccaaagacagcgtctaccagcttcactaatatcgcttacgatctgtgcgcgaaaaacaagtaccacgtgctccacattaacaccactaagaacaaccctgtgatgagcctccaggaccaagttcgctttgtcaagaatatcaccagctggaaagagatgaaacccgggttttatcatggtcatgtgtcctacttagatttcgccaaatttggagtgaaaaaaaagccaatctacatcaacgtaattcgggaccccatagaacgattggtgagctattactacttcctgcggttcggcgacgactaccgacctggcctgaggcggcgtaagcaaggagacaaaaaaacgttcgacgaatgtgttgccgagggcggctccgattgcgctcctgagaaactgtggcttcagatacctttcttttgcggacactccagtgagtgctggaatgtcggctctcgctgggccatggatcaggcaaaatacaacctcattaatgagtacttcctggtcggggtgactgaggagctggaggattttataatgctgttggaggctgccctaccccgcttcttccgcggcgccaccgaactctacaggacgggtaagaaatcacacctgcggaagaccacagaaaagaagctgccaacaaagcagacaattgcaaaactccagcagtccgacatctggaaaatggaaaatgagttttacgagtttgctctcgagcagttccaattcatccgggctcacgctgtacgcgagaaagatggcgacctgtatatcctggcacagaactttttctatgagaaaatatacccaaagtccaactag

SEQ ID NO: 190509 - DNA, 690 bp, Artificial Sequence
  Description of Artificial Sequence: Synthetic coding sequence
atgggcctgctgcggatcatgatgccccccaagctgcagctgctggcagtcgtggccttcgcagtcgcgatgctgttcctcgagaaccaaattcaaaaattggaagagtcccggtcaaaactagaaagggcaattgcacggcatgaggttcgggaaatcgagcaacgccacaccatggatggaccaaggcaagatgcaactttagacgaagaggaggatatggtgatcatctataatcgggttccgaaaaccgcatctacatctttcactaacatcgcctatgacctgtgtgccaaaaataaatatcatgttctgcatattaatacaacaaaaaataatccggtgatgtccctccaggaccaagttagattcgtcaaaaatattactagctggaaggagatgaaaccgggtttttatcatggacatgtcagttacctggactttgccaaattcggggttaagaagaaacccatctacattaatgtcattagagatccgatcgaacggctagtgtcgtattactatttcctgcgtttcggcgatgactaccgccccggccttcgtcggagaaagcagggggataagaaaactttcgacgaatgcgtggcagaaggaggttccgactgcgcacccgaaaagctatggctacagattcccttcttctgcggccatagttcggaatgctggtag

SEQ ID NO: 190510 - DNA, 1236 bp, Artificial Sequence
  Description of Artificial Sequence: Synthetic coding sequence
atgcggcggcggcgggccggcggccggaccatggtggagcgggccagcaaattcgtcctcgtcgtcgccggcagcgtctgcttcatgctcatcctgtaccagtacgctggtccagggctgagcttgggcgccccaggtggtagagccccaccagatgacctggacttgtttccaacccctgatcctcactacgaaaaaaagtactatttccccgtccgggagctggagagatcactgcggttcgacatgaagggggatgatgtaatagttttcttacatatccagaagacaggaggaaccacttttggcagacatctggtacagaacgttcggctggaggttccgtgcgattgtcgacccggtcagaagaaatgtacatgttacagacctaatcgcagagagacctggctgttttcccgattcagtactgggtggtcctgtggcctgcacgctgattggaccgaactcaccaattgcgtgccaggagtgctggatagacgcgacagtgcggccctgagaacaccgcgcaagttttattatatcacactgctgcgcgaccctgtttcaaggtaccttagcgaatggcgacacgttcagagaggagccacctggaagacctccctacatatgtgtgacggcagaacccccactcctgaggagttgcctccctgctatgaaggaaccgactggtctgggtgcaccctgcaggagtttatggactgcccttataatctggccaataatcggcaggtgcggatgctggctgacttgtcattggtgggctgttacaacttgagtttcatcccggaggggaagagggctcaactcctcctggagtcagccaaaaagaacctgcgtgggatggccttttttgggctgaccgaattccagaggaagacacagtacctgttcgagcggaccttcaacttaaagtttatcagacctttcatgcagtacaattcaaccagggctggtggcgttgaggtcgatgaggatactattagaagaattgaagagctcaacgacctggatatgcagctatacgattacgccaaggacctgttccagcaacggtaccagtataagcggcagctagagcgaagggaacaacggctacggtcgagagaggaacgcctgctgcaccgcgccaaggaagccctcccccgggaggatgcagatgagccgggtagggtgcctactgaagattatatgtctcatattatcgagaagtggtag

SEQ ID NO: 190511 - DNA, 831 bp, Artificial Sequence
  Description of Artificial Sequence: Synthetic coding sequence
atgctgttcctgttcgccgtgatcgtgctgcagtacgtgtgccccggcactgaatgccagctactgagactccaagcgttttcttcaccagtccccgatccctaccgctcagaagatgagtcgagcgccagatttgtgccacgctacaacttcactagaggcgaccttctccgcaaggtggattttgacatcaagggtgatgacctgattgtgttcctgcacatccagaagaccgggggtaccacattcggccgacatctggtgaggaatattcagctagagcaaccttgcgaatgtagggtgggccagaagaaatgtacatgccacaggccgggaaaacgggaaacatggctgttttcaagattcagcaccggctggagctgcgggctccatgccgactggactgaactgacaagctgcgttccatcagtggtggatggtaaaagagacgcacggcttcggccctcccgctggcgtattttccagatcctggacgccgcctccaaagacaagcgcggctcacctaataccaacgccggtgcgaattccccaagcagcacgaaaacccggaacacatccaaatccggcaagaacttccactacattactatcctcagagacccggtaagcaggtacctcagtgagtggcgccatgtccagagaggagccacttggaaggcctcgcttcatgtttgtgatggtagaccccccacatccgaggaactgcccagctgctacactggggacgactggtccggttgcccactgaaggaattcatggactgtccatacaacctcgcaaacaatcgatgtgcatgcagccccacatag

SEQ ID NO: 190512 - DNA, 1389 bp, Artificial Sequence
  Description of Artificial Sequence: Synthetic coding sequence
atggacgagaagagcaacaagctgctgctggccctggtgatgctgttcctatttgcggtgatagtactccaatatgtgtgtccagggaccgagtgccagttattgcgcctccaggcattctcctccccggtgcctgatccttatcgctctgaagacgaatcctcggcgaggtttgttcccagatataactttacccgtggggacttactacgtaaggtcgattttgatatcaaaggagacgatctcatcgttttcctccatatccagaagacaggcggaactacctttggccggcacctcgtgcggaacatccaactggagcagccttgcgagtgccgtgttgggcaaaaaaagtgtacatgccataggcccgggaaaagagaaacctggttgttctcacgcttcagtactgggtggagctgtggtctccatgcagattggactgagctcacttcatgtgtcccttcagtcgtcgacggcaagagagacgctcgcctgagaccatccagatggaggatattccagatcttggacgcagcaagtaaagataagcgtggaagccccaacacaaacgccggcgcgaactctcccagctccactaagacaaggaacaccagtaaatccgggaaaaacttccattatatcaccattctccgtgaccctgtcagccgatacctgtcagagtggcggcacgttcagcggggagctacctggaaggccagtctccacgtgtgcgatggtagaccccccacatctgaggagctgccctcatgctacacaggcgatgattggtctggttgccccttaaaggagttcatggactgcccttacaacctggccaacaaccggcaggtccggatgctgtccgatctcactctggtcggttgttataacctgtctgtgatgcctgaaaagcagcggaacaaggtccttctggaaagcgcaaaatccaacctgaagcacatggccttcttcggactgactgagttccagcggaaaacacagtatctctttgagaaaaccttcaacatgaattttatcagccctttcacgcagtacaacacaacaagagcgtcgtccgtcgaaattaatgaagagatccagaagcgtattgaagggctgaattttctcgatatggagctctattcctacgccaaggatttattcttgcaaaggtatcagttcatgcgccagaaagagcaccaagaagcccgacggaaacggcaggagcagaggaaattcttaaagggaaggctcttgcaaacgcattttcagtcacagggccagggtcagtctcagaatcccaatcagaaccagtctaaagaacagaacgataacacgtccaatggcactaatgattacatcggaagcgtggaaaagtggcggtag

SEQ ID NO: 190513 - DNA, 1818 bp, Artificial Sequence
  Description of Artificial Sequence: Synthetic coding sequence
atggccctgcccgcctgcgccgtgcgggagttcgagcccccccggcaaccggaaaggggagccccagtccggaccacctgtcctcgacgacacagtagagtggaggccgaactggcggcttcacgccccgggtcggtcgccgcctctgtccgcgccggcccccccagaggggtctctcatgggttccacacaagaccactccttgataaacctaggaaggcgtccagttctctggccggggctgcatgcgctcccctttttgccttactctccagaggacgccgaagaaggatgcatgtgctccggagacggtgggatcttggaagcctgtgcagggcgctgcttacacgagggctggccgcccttggccatagcttgaaacatgtactcggcgccatctttagcaagatcttcggccctatggcaagcgtggggaatatggacgagaaatccaacaagctccttctggcactcgtgatgttgtttctgtttgcggttattgtcctccaatacgtttgtccagggactgagtgtcagcttctccgactacaagccttttcctcccccgtgccagatccctaccgctctgaagatgaatcatctgcccggtttgtgccgcgctacaactttacccgcggagacctgctgaggaaagtcgactttgacatcaaaggcgacgatctgattgtgtttcttcacatccagaagacaggagggaccacattcggtcgacatctggtccggaacattcagctcgaacaaccttgcgaatgccgagtgggccaaaagaagtgtacatgccaccggccagggaagcgggaaacgtggctgttctcaaggtttagtaccggatggagttgcggactgcacgctgactggaccgagcttacaagctgtgtcccttctgtcgtggatggcaagcgagatgcacgcttaagaccctctagaaacttccactatatcacaatcctgcgggacccggtgtctagatatctatctgagtggcgacacgtgcagagaggggctacatggaaggccagcttacacgtgtgtgacggcagacctcctacctcagaggaacttccatcatgttacaccggagacgattggagtggttgcccgctgaaggagtttatggactgcccttacaacctggccaataacaggcaagttaggatgctgagcgatctcactctcgtgggatgttacaatttgtcagtcatgcccgagaagcagcggaacaaagtcctactcgagagcgccaaatccaacttgaaacatatggctttcttcggactgacggaatttcagaggaagacacagtatctcttcgagaaaacctttaatatgaactttataagccccttcacacaatacaataccacccgcgcctcctctgtggagattaacgaagagatccaaaagcgcatagagggtttgaacttcctggatatggagctttactcttatgccaaggacctgttcctccagaggtaccagttcatgagacaaaaggaacaccaggaagctcgcagaaaacgccaggagcagagaaaatttctgaaaggtcgcctacttcagacccattttcagtcacaggggcagggccagagtcagaaccctaaccagaatcaaagccagaatcctaatcccaacgccaatcagaaccttactcagaacctcatgcagaacctgactcagtctttgtctcagaaggaaaatcgcgagtcccctaagcagaacagcggaaaggagcagaacgataatacatccaatggaactaatgattacattggtagcgtggagaagtggcggtag

SEQ ID NO: 190514 - DNA, 1380 bp, Artificial Sequence
  Description of Artificial Sequence: Synthetic coding sequence
atggacgagaagagcaacaagctgctgctggccctggtgatgctgttcctattcgccgtcatcgtgctccagtatgtttgccccgggacagaatgccagctgctcagattgcaagcgttctcgagcccggtgcctgacccttatagatcggaggacgagtccagtgcgcgcttcgttcctaggtacaacttcaccagaggcgatttgctgcggaaggtggactttgacatcaaaggcgacgacctcatcgtcttcctgcacattcagaaaactggcggtacaactttcggtagacatttggtccgcaatattcaactcgaacaaccttgtgagtgcagagtcggccaaaagaagtgcacttgtcatcgtcccggtaagcgagagacatggctcttctctcgttttagcaccggctggtcttgcgggttacatgcagattggacggaacttaccagctgtgtgccatccgttgtggatggcaagagggacgctcgtcttagaccctcgcgaaacttccactacattaccattttgagggaccctgtgagcaggtacctaagtgagtggaggcacgtccagcggggcgcgacatggaaagccagcctccacgtttgtgacggtcgccctccgacctccgaggaacttccttcttgttacaccggcgacgactggagcgggtgccccctgaaggaattcatggactgcccttacaatctcgccaacaaccgtcaggtcagaatgctaagcgatctgactctcgttggctgctacaatttatcagtgatgccagaaaaacagagaaataaagtcctcctcgaaagcgcaaagtccaacctgaagcatatggccttctttggcctgactgaattccaaaggaaaactcagtatctgtttgaaaagacatttaatatgaattttatctcccccttcactcagtacaatacaacgagagcctcttccgtggagatcaatgaggaaattcagaagcgcattgagggacttaacttcttggatatggagctgtattcctacgccaaggacttgtttctgcagcggtatcagtttatgaggcaaaaggaacatcaggaagctcgcagaaagcgacaggagcaacgtaagttcctgaagggtagactgttgcagacccactttcagtctcaaggtcagggccagtcccagaaccccaaccagaatcagagccagaacccgaacccaaacgccaatcagaacctgacgcaaaacctcatgcagaacttaacccagtccctgagccagaaggagaatcgggagtctcctaaacagaatagcggaaaagaacagaacgataacaccagtaacggcaccaacgattatatagggtcagtggagaaatggaggtag

SEQ ID NO: 190515 - DNA, 996 bp, Artificial Sequence
  Description of Artificial Sequence: Synthetic coding sequence
atgctgctgaagcacaacggcaagctgctgctgttctacctgctgtcttaccaggcccttgcttccgactggttctattgctccttcaacagatggcgaatatttcagattctcgatgcagcccgcaatttccattacatcacaatcctcagagatcccgtgtcgaggtacctgagcgaatggagacacgtgcagcggggagccacatggaaggcgtccctgcacgtctgcgatgggcgcccgccgacttcagaggagcttccctcttgttatacaggcgacgattggtccggatgccccttgaaggagtttatggattgtccctataacctggccaataataggcaggttagaatgctctctgatttaacactggtgggctgctacaacctcagcgtcatgcccgaaaaacagcggaataaagttctgttggagtctgcaaagagcaatcttaagcacatggccttcttcggtcttacggagttccagcgcaagacccaatacctctttgagaagacgttcaacatgaactttatttctccgtttacacagtacaatacaacacgagcttcatcagtggagatcaacgaggagattcagaagcggatagaaggtctgaactttctcgatatggagttgtactcctatgcgaaagacttattcttgcagagataccagtttatgcgtcagaaggagcatcaggaagccagaaggaaacgtcaggaacagcggaaattcctgaagggtcggcttctacagacccactttcaaagtcagggtcaaggccaaagccagaaccccaaccagaatcagtcacagaatcctaaccccaatgccaaccagaacctgacgcaaaacctgatgcaaaacctgactcagagcctctcccaaaaagaaaatagggagagtcccaagcagaacagcggcaaggagcaaaacgacaacacttccaacggtactaatgactacataggctcagtagagaagtggcgttag

SEQ ID NO: 190516 - DNA, 1938 bp, Artificial Sequence
  Description of Artificial Sequence: Synthetic coding sequence
atggccctgcccgcctgcgccgtgcgggagttcgagcccccccggcagccagagcgcggggctcctgtccgcaccacttgcccgagaaggcatagcagggtggaggcggagctagctgcaagccgcccaggctccgtcgcagctagcgttagggcagggcctccccgcggtgtgagccacggctttcacaccagaccgcttctcgacaaaccacgcaaggcctcttcctcattggctggcgccgcctgtgctccgctgtttgcgctactgagccgcgggaggcgtcgcaggatgcacgttttgcgcaggaggtgggatctcgggagtttgtgtagagcactgctgacaagaggtctggcagccctcggtcactctctcaagcacgtgctgggcgcaattttcagtaaaatttttggcccgatggcatccgttggcaacatggatgagaagtccaacaaactgctcctggctctggtgatgctattcttgtttgcggtaattgtgttgcagtatgtctgcccgggaacagagtgtcaactgttacgacttcaggccttcagcagtccggtgcctgacccctacagatccgaagatgagtcgagcgcaaggtttgttccacgttataacttcactcgaggagaccttctgcggaaagtcgacttcgatattaagggggacgacttgatcgttttcctacacattcaaaagactggcggaacaaccttcggcaggcatctggtcagaaacatccagctggagcagccatgcgaatgccgggtggggcaaaagaaatgcacatgccacagacccggcaagagggagacatggctttttagccgcttctctacgggttggagttgtggactccacgccgactggacagagctcaccagctgtgtcccctctgtcgtggacgggaagagagatgctagacttcgtccgtcccgctggcggatatttcagatcctggatgccgcgtctaaagacaagcgcggcagccctaacactaacgccggcgcgaactcacctagcagtacaaagaccaggaacacctccaagagcggcaaaaactttcattatattacaattctacgggatccggtttcgcggtacctgtctgaatggcggcatgttcaaaggggggcaacatggaaggccagccttcacgtgtgcgatggtaggcccccaacatccgaggaactgccaagctgttataccggcgacgactggtcaggctgcccattaaaagaattcatggactgtccttacaacctcgccaacaacaggcaggtgcggatgctgtctgatctgaccctggtgggatgctacaacttatctgttatgcctgagaagcagagaaacaaagttctattggaaagcgccaagagcaatctgaagcacatggcgttcttcggtttgacagaatttcaacggaagacacagtacctgttcgagaagacttttaacatgaacttcatctcacccttcacccaatacaatacaacgagagcatcctccgtggagatcaatgaagagatccaaaaaagaatcgaaggcctaaacttccttgatatggagctgtattcatatgctaaggatctgttcctccagaggtatcagtttatgcggcagaaggagcaccaggaggcgcggagaaagcggcaggagcaaagaaagtttctgaagggccgactgctccagacccactttcagtcacagggccaggggcagtcccagaaccctaatcagaaccagagccagaatccgaaccccaatgcaaaccagaatttaacccagaaccttatgcagaacctcactcaatctctgagtcagaaagagaatcgtgagagccccaagcagaactccggaaaagaacagaatgacaatacatccaacggcactaacgactacatcggaagtgtcgaaaagtggcgttag

SEQ ID NO: 190517 - DNA, 1416 bp, Artificial Sequence
  Description of Artificial Sequence: Synthetic coding sequence
atggacgagcggttcaacaagtggctgctgacccccgtgctgaccctgctgtttgtagtgattatgtaccaatacgtctcaccctcctgcacaagtagttgcacgaatttcggggagcagcccagggccggcgaggctggccctccggctgtacctggccccgctcggagagctcaggctccgccagaggagtgggaaaggagaccacagttgccgccaccgcctcgaggccctcccgagggaccaaggggcgcggccgctccagaggaagaagatgaggaaccgggtgatccccgcgaaggggaggaagaggaggaggaggatgagccggatccggaagctccagagaatgggtctctaccacgcttcgtgcctcgctttaacttcagtcttaaagatcttacacggttcgtcgatttcaacattaagggcagggatgtgatcgtcttcctccacattcaaaaaaccgggggaacaacatttggcagacacctggtgaagaacattaggctcgaacagccatgctcatgcaaagctggccaaaaaaagtgcacatgccatcgccccgggaaaaaagagacttggcttttctctaggttctccacaggatggtcctgcggactccatgccgactggacagaactaaccaactgcgtgcctgccataatggagaagaaagactgcccgagaaatcattctcatacaagaaacttttattacatcaccatgctccgagaccctgtgtcccgctacctctccgagtggaaacacgtgcagagaggcgccacctggaagacaagtcttcatatgtgcgacggacgctccccaactcctgatgagctaccaacttgctaccccggcgacgattggtcgggtgtgtctctcagggagtttatggactgtacatacaatttggcaaataaccggcaggttcggatgctggcggatctgagcctcgtgggttgctacaacctgaccttcatgaacgaaagcgagcgcaacaccatattattacagagcgccaaaaataatttaaaaaacatggcattcttcggcctgacagagtttcagaggaagacccagttcttgtttgagcgcaccttcaatctgaagtttatctctccgtttactcaattcaatatcaccagggcaagcaatgtggagatcaatgagggcgctcgccagaggatcgaagacctgaattttctggatatgcagctatatgagtacgccaaggacctgtttcaacagcgctatcaccatactaagcaacttgagcaccagagggaccgtcaaaagagacgcgaggagcggagactacagcgtgaacaccgggaccatcagtggcccaaggaagatggggctgcagagggaaccgtcaccgaggactacaactcacaggtggtccgctggtag

SEQ ID NO: 190518 - DNA, 543 bp, Artificial Sequence
  Description of Artificial Sequence: Synthetic coding sequence
tgagcccagacccccccccccccccccgccgccgtggccgtggccgtgaccccagtgccccagttcccccgggcttgtactgaggcagagttcgcatgccattcatataatgagtgcgtcgctctggaatatagatgtgaccgcaggcccgactgtagggatatgagcgacgaactgaactgcgaggagccagtgctaggaatatcgcctacttttagcctcctcgtggagaccactagcctgcccccccgtcctgaaacaaccatcatgagacagccccccgtcacacacgctccacagcccctgcttccaggatcggtgcgacctctaccctgcggtccacaggaagcagcatgccggaatggccactgcataccacgcgactatttatgtgatgggcaggaggactgcgaggacggcagcgatgagctcgactgcggaccaccccctccatgcgagcccaatgagttcccctgtggaaacgggcattgcgcactgaaactttggcgctgtgatggtgactttgactgtgaagatcgctag

SEQ ID NO: 190519 - DNA, 285 bp, Artificial Sequence
  Description of Artificial Sequence: Synthetic coding sequence
tgaggccacccccacagccccagcagcggcgccgcctgggccgccgctttcttgggaggacgcccgccaggtacctcttgttgcaccttgagtgttcagccattgagaacacaggctgccactgccgccggtagtccgactcggtgggcccagcccagaccattacccagctgctccagtaaaaatcctgagctgggtccagaactgccgcgggacgtgtacatgccggggccatggactctcggagagggacctggccagtgcccggcaggctatccccgctag

SEQ ID NO: 190520 - DNA, 13176 bp, Artificial Sequence
  Description of Artificial Sequence: Synthetic coding sequence
atgggctggcgggccgccggcgccctgctgctggccctgctgctgcacggccggctgcttgccgtcacacacggtctacgcgcatacgacgggctttcccttccggaagatatcgagactgtgacagcaagtcaaatgcggtggacacactcctacctcagtgatgacgaagacatgttggcagattccataagtggggacgacctgggctcaggagaccttggatctggcgactttcagatggtgtactttagggcgctggtgaactttacgagaagtatcgagtattccccccagcttgaagatgcaggctcgagagagtttagagaggtgtctgaggccgtggttgacaccctcgaaagtgagtacctcaagatccctggcgaccaggtcgtgagcgtggtgtttattaaagaactggacggatgggtttttgtcgagcttgacgtcgggtccgaagggaacgccgatggcgcacagatccaggagatgttattgagagtgatttcaagtggttccgtggcatcttacgtgaccagtccacagggcttccagtttaggcgtctcggcaccgtgccacagttccccagggcctgcacggaggcggagtttgcctgccactcatacaacgagtgcgttgcactcgagtacaggtgcgaccggcgaccagattgcagagacatgtctgacgagctcaattgcgaagagcctgttctgggaatttcacctactttcagcctcctcgttgagaccacttccctgcccccccgccctgaaaccactattatgaggcagccccccgtcactcatgccccgcagccactcttgcctggatccgtgcgacctcttccctgtggtcctcaagaagctgcttgccgaaatggccactgtatccccagggactacctgtgcgatgggcaggaggattgcgaggacgggtcagacgagctcgattgtggtcccccaccaccatgtgaacccaacgagtttccctgcgggaatggtcactgcgcgctgaagctgtggcggtgcgacggtgactttgactgtgaggaccgcactgatgaagctaattgtcctacaaagagacccgaagaagtgtgtgggcccactcagttccgctgcgtctctacgaatatgtgcatccccgctagcttccactgtgatgaggagagcgactgtcccgataggagcgatgaatttgggtgcatgcccccacaggttgtgactccgccaagagagtcaattcaggcctctagaggccagactgtcacttttacctgcgtggctatcggagtgccaactcccattatcaactggagactgaactggggccacatccctagccatccccgagtgacggtcacctcagaaggcggccggggcaccctgatcattagggatgttaaggagtctgaccagggggcatacacgtgtgaagccatgaacgccagggggatggtattcgggattccggacggcgtgctggagctagtgccccaacggggaccctgtcccgatgggcatttctatctggaacacagcgcagcttgcctgccatgtttctgcttcggtatcacaagtgtttgtcagtctactcgacgcttccgcgatcagatccggctgaggtttgaccagcctgatgacttcaagggagtgaacgtgactatgccagctcagcccggaacgccacccctgagcagcacccagctgcagatcgaccccagcttgcacgaatttcagctggtggacctcagcaggcgtttcctggtgcacgactccttttgggcattgcctgagcaatttcttggtaacaaggtcgacagttacggcggatccctcaggtataatgtgcggtacgagctggcaagggggatgcttgaaccagtgcaacgccccgatgtcgtcctgatgggcgccggctatcgtctgctaagcagagggcacactcccacacagccaggcgcgctcaaccagagacaggtgcagttctctgaggaacactgggtgcatgagtcaggccgccctgtccagcgagctgagttattacaggttctccaatctcttgaggccgtcctgattcagaccgtctataacacaaaaatggcaagtgtaggccttagcgacatcgcaatggacaccaccgttacgcacgcaacaagtcacggtcgggcacattccgtggaagagtgccggtgtcccatcggctactcgggcctctcttgtgaatcttgcgatgcacactttacacgcgtacccgggggtccctatctgggcacctgtagcggctgtaattgcaacggacatgcatccagctgcgatcctgtatatggacattgcttgaattgtcagcataacaccgaggggccgcaatgcaacaaatgtaaggcaggctttttcggcgatgccatgaaagctactgcaacatcctgccgcccgtgtccctgtccatacatagacgcgtcgcgtcgcttcagtgatacatgtttcttggacacagacggtcaggctacctgcgatgcctgcgcccccggttacaccggccgcagatgcgagagctgcgctcccggctacgagggaaaccccatccagcccggcggcaagtgccgacctgtgaaccaagaaatcgttcgatgtgacgaaaggggcagcatgggcaccagcggtgaagcatgtagatgcaaaaacaatgtcgtgggcagactttgtaacgaatgcgcggacggttcattccatttgtccacaagaaatcctgacggctgtctgaagtgtttttgtatgggcgtctcccgtcattgcacctccagctcttggtccagggctcagctccatggtgccagcgaagagcccggtcacttcagcctaacgaatgctgcctccacacacaccacaaatgagggcattttctctccaacccccggcgaattagggttttcttcttttcatagactgttgtcaggtccatatttttggagcttgccatctcgcttcttgggtgataaggtgacctcgtacgggggggagctgaggttcactgtgacccagcgctctcagcctggcagtacgcccctacacgggcagcctctggtcgtcctccaggggaataacataatacttgaacaccatgtcgcacaggaacctagccctgggcagccatccacattcattgtcccgtttagggagcaagcctggcagcgtcccgacggacagccagcgactagggaacacctgctaatggcccttgcagggatcgataccctcctgatccgcgcgagttacgcccagcagcctgccgaatccagagtttccggcataagcatggacgtggcagtccccgaagagactggccaggatcctgcactggaggtcgagcaatgctcatgccctcctggataccgaggacccagttgtcaggactgcgacacaggatacacacggacgccatctggcctttatctgggaacttgtgagcgctgttcttgccatggacacagtgaggcatgtgagccagagacaggggcctgtcaaggctgccagcatcatactgagggacctcggtgtgagcagtgtcagccaggctactacggcgatgctcagagaggcactccacaggattgtcagctgtgtccctgttatggcgatcccgcggctggacaggctgcccatacgtgttttctggacaccgatggccacccaacctgcgacgcttgtagcccagggcactcggggcggcattgtgagcggtgcgcccctggctactatggtaacccatcccagggccagccttgccaaagggacagtcaggtgcccggacccatagggtgtaactgtgacccacagggaagtgtctcatcccagtgcgacgcagccggtcagtgccagtgcaaggcccaagtagagggcttgacctgcagccactgcaggccccatcactttcacttgagcgcaagcaatcccgacggctgcctgccttgcttttgtatgggcatcacgcaacagtgcgcaagctccgcatacactcggcatctgattagcacccattttgcgcctggtgacttccaaggctttgccctggttaatccacagcgtaacagcagactgaccggggaattcacagtcgagccggtgccagagggggctcagttatcttttggcaattttgcacagctcggccatgaaagcttctactggcagctgccggaaacataccagggcgataaagtggctgcctacggtgggaaacttagatatacgctatcatacacagctggccctcaaggaagccccctgtccgacccggacgtccagatcaccggcaacaatatcatgctggtggcctctcagccagcgctgcagggcccagagcgtaggagctatgaaatcatgtttagagaggagttctggagaagaccagatggccagcctgcaaccagggagcatcttcttatggctctagctgacctggacgagctactgatacgggccactttttccagcgtccctctggccgcatctatttcggccgtgagcttggaagtggcccagcccggcccgtcaaatagaccaagagcgctagaggttgaagaatgcagatgcccccctggttacatcggattgagttgtcaggactgtgctccggggtacaccaggacaggttccggactttacctaggacactgcgaactgtgtgaatgcaacggccacagcgacctttgccatccagagaccggagcatgcagccaatgtcaacacaatgcagcaggcgagttttgcgagctgtgtgcgccaggttattatggagatgccacggccggcacgccagaggattgtcagccatgtgcatgcccactcaccaatccggaaaacatgttctccaggacttgtgaatcgcttggagcagggggatatagatgtacagcgtgtgaaccaggctacaccggtcaatactgtgaacaatgtggacctggctatgtaggtaacccctcagtgcagggtggccaatgtctgcctgagacaaatcaggcacctctagtggtcgaggtccaccctgcgcgttccattgtcccgcagggcgggagccactcactgaggtgccaggtgtccgggagccccccccattacttctactggtccagagaggatggacgtccggtcccctctggcactcagcaacgacaccagggaagtgagttacactttccctcagttcaaccatcagatgccggagtgtacatctgcacctgtcggaatttgcaccaaagtaacacatcacgggccgagcttcttgtcactgaggctccttccaagcccatcactgtcacggtggaggaacagcgttcccagtcagtccgacccggcgctgacgtgacttttatctgcacggccaagtcaaagagtcctgcctatacactcgtttggacccgtctgcataacggtaagctgccaactcgggcaatggatttcaatggtatcctcactattcgtaatgtccagctgtctgacgccggtacatatgtgtgcacgggcagtaatatgtttgcaatggatcagggaaccgccaccttgcatgtccaggcttctgggaccctgtccgcccccgtagtgtccatccacccaccccagctgactgttcagcccgggcaactggctgagttccgctgcagtgccaccggctctccgacccctaccctggagtggactggaggtccaggcgggcagctgcccgctaaggcacaaatccatggaggaatccttaggttgccagctgtggaaccaaccgatcaagctcagtacctgtgtagagctcatagctcggcaggtcagcaggtggctagggctgttctccatgtccacggcggcggcggaccacgggtgcaagtgagccccgaacgcacccaggtgcatgccggcaggaccgtgaggctctactgtagagccgcgggggtaccatccgctaccatcacttggcgaaaggagggcggttccctcccaccacaggctcgttccgaacgtaccgacattgcaactcttctgataccagccattactacagccgatgccggattttatctgtgcgtggccacatcacccgcaggtacggctcaggcacgaattcaagtggtcgttctgagcgccagcgacgcatcgcccccacctgttaaaatagagtcatcttctcctagcgttacagaaggccagacactggatctgaactgcgttgtcgcgggttcagcacatgcacaggtcacgtggtaccgaagggggggtagcctccctcctcacactcaggtccacggcagccggctgcggctgccgcaggttagccccgctgacagcggggagtatgtgtgccgagtagaaaacggaagcggccccaaggaggcctccattacggtgagtgtgctgcatgggacccactcagggccatcatacaccccagttccgggcagcacacggcccatacggattgaaccaagcagcagtcacgtcgctgaagggcagaccttggacttaaattgtgtggttccaggccaggcccatgcacaggtgacctggcacaaaagaggtggatccctccctgcacgtcaccaaacacacggatccctcctgcggctgcaccaggtaacacccgctgattcaggcgaatacgtttgccacgtggttggcacgtctggacccctggaagcatccgtgctagtgactattgaggcatctgtgattcccggacccattccaccagtaagaattgaaagctcatcttccacagtggctgagggccagaccctggatttgagttgcgtggtagccgggcaagcacacgcccaggtgacatggtacaaaaggggcggatcgctgcccgcccgacaccaggtgagaggaagtagactttacatttttcaggcaagcccagccgacgccggccaatacgtgtgcagggcatccaatggtatggaggcctcaattacagtcacagtgacgggcacacagggtgccaacctggcctaccctgccggcagtacccagcctattagaattgagccaagcagctcccaggttgcggaaggacaaacactagatctgaattgtgtggtcccagggcagagtcatgctcaggttacatggcataaacgtggcggatcacttcctgtccgccatcagacccatggctccctactgcggctataccaagcttcgcccgctgatagcggcgagtacgtgtgccgggtgctgggcagcagcgtgcctctggaggcgtctgttttggtgactatcgagccggcaggctccgtgccggctttaggggtgaccccaactgtgcggatagaaagttcttccagccaggtcgccgagggccagacgctggacctgaattgcctcgtggctgggcaagcccatgctcaggtgacatggcataagcgcggtggcagcctgcccgcccgccaccaggttcatgggtcgcgcctccgcttgttgcaagttacgcccgccgattcaggcgagtacgtttgtcgagtcgtggggtcgtctggcacccaggaggcctctgtgctggttacaattcaacagagactgtccggcagccactcacagggggtggcctatcctgttagaattgagtcttcaagcgcttccttggccaatggacataccctggaccttaactgcctggtagcaagccaagccccccacacgattacctggtacaaacggggtggcagcctgcccagtcgacaccagattgtgggttctaggctcagaattcctcaagtaacccccgctgacagcggtgaatacgtgtgccacgtgagtaatggcgcaggttcccgagaaacctccctcatagtcactatccagggatcaggttcctctcacgtcccttctgttagtcccccaattaggattgaatcttcgagccccaccgttgtggaggggcagacactggatctgaattgcgtggtcgccagacagccacaggccataatcacttggtataaacggggtgggtcactgcccagtcggcaccagacacatggcagccacctcagattgcaccaaatgagcgttgctgacagtggcgaatacgtctgtcgcgcaaataataatatcgatgccctagaggcaagcattgtgatctctgtgtccccttccgctggaagcccctccgcacctggctcctccatgcctatcaggatagagtcatcttcatcccatgtcgctgagggggagactctagacttgaactgcgtggtgcccgggcaggcgcacgctcaggtgacgtggcacaaaagaggcggatcactcccttcccaccatcagacacggggttccagactcagactgcatcatgtcagtcccgctgactcgggtgaatatgtttgccgtgtcatgggctctagcggccccctagaagcatctgtgctcgttacgatcgaggcaagtggtagttccgccgtacacgtgcccgcaccaggtggcgcccccccgatccggattgagccctcatctagtcgggtagctgaagggcaaaccctggatcttaagtgcgtggtaccgggacaggcccacgcccaggttacatggcataaaaggggagggaacctgccagcacgccatcaggtacacggacctctcctgagactgaatcaggttagcccggccgacagcggggaatatagttgtcaggtgactgggagcagcggaactctggaagccagcgtactggttacaatcgaaccgtccagtccagggcccatccccgcacccggactggctcagcccatttatattgaggcctccagtagccatgtgacggagggacagaccctggatctaaactgtgtggtgcctggtcaagctcatgctcaggttacttggtataagaggggtgggagtctgcctgcccggcaccaaacccacggatcacagctccggcttcacctcgtgagccctgctgattctggagagtatgtgtgcagggccgccagtggccccggccctgaacaagaggcatcctttacggtcacggtccccccatctgaaggcagctcctaccgcctgagaagccccgtcatttctattgacccgcctagctctacggttcagcagggccaggacgcatcctttaagtgcttgattcacgacggagcggcccctatttcgctggaatggaaaacacgaaaccaggagcttgaggataacgtccacattagtcctaatgggtcaatcatcaccatcgtcggaacccgtccctcgaaccatggcacctaccgctgcgtcgcaagtaatgcctacggcgtcgcccagtctgtagtgaatctttcagttcacggaccacctacagtttcagttctgcctgaaggccccgtctgggtaaaagttggcaaggccgtgacactggagtgcgttagtgcgggcgagccacgctcatccgcgcgatggactcgaatctcatcaacaccagcaaagcttgagcaacgtacctatggcctaatggacagtcacgccgtcctgcagattagttctgccaagccctccgatgccggcacatacgtctgcttggcccagaatgccctaggcacagcccaaaaacaggtagaggtgatcgtcgacactggcgctatggcccctggcgccccccaggtacaggcagaggaggcagagctgaccgtagaggcagggcacacagctacactgagatgctccgcaactgggagccctgccccaacgatacattggtctaaactgaggtccccactcccctggcagcacaggttggaaggcgacaccctgataattccacgcgttgcccagcaggattctggtcagtatatctgcaacgctacatctcctgccggacacgcagaggccaccatcatacttcacgtcgagtcccctccttacgctaccaccgtgccagagcatgccagtgtgcaggccggtgaaactgtacaactgcagtgtctggcccatgggaccccacccttgacgttccagtggagtagagtgggaagctctcttcccggtagggccaccgcccgaaatgaactgttgcactttgagcgggccgcccctgaagatagcgggcgctatagatgtcgcgtaactaataaggttgggtctgcagaagcatttgcacagctgttggtgcaaggtcctccgggaagccttccagctaccagcatccccgcaggatccaccccaaccgtgcaagtgacacctcagctggaaaccaagtcaattggcgcatcagtggagtttcactgcgcagtgcccagcgatcgggggactcagttacgatggttcaaagaaggaggtcagttgcctcccggccactccgtgcaggacggagtgctccgaattcagaatctggatcagagctgccaagggacctatatctgccaagcccacgggccttggggaaaggcgcaggcgagtgcacagctggtgatccaggccctgccgtcagtgctgattaatattcggactagtgttcaaacagtagtagtgggtcacgctgtagagttcgaatgccttgccttgggcgatcctaaaccacaggtgacgtggagtaaagtgggaggacacctgaggcccggcatagttcagagcggcggcgtagtgcggattgcccacgtcgagctcgccgatgccgggcagtaccgctgcacagctactaatgcggcggggacaactcagagtcacgttttactactcgtacaagcgctcccccagatctccatgccacaggaggtgagagtgccagcgggctcggccgctgtgtttccctgtatagcctcagggtacccaacaccggatatcagctggtctaagttggacggttctcttcctcctgatagcaggctggaaaataatatgctcatgctgccaagcgtgcggcctcaggacgctggaacatatgtgtgtactgccaccaatagacaaggtaaagtgaaagcatttgctcatcttcaggttccggagcgtgtggtcccttacttcacacagacgccatactcatttctgccactccccacaatcaaagacgcctatcgaaaatttgaaatcaaaatcactttcagacctgattctgctgatggcatgctgctttataacggccaaaaacgggtccctgggagtcccaccaatctcgctaacaggcagcctgacttcatctccttcggcctggtagggggcaggcccgagttcagatttgatgcagggtctggaatggctacaattcgtcacccgacccccttggcactgggacatttccatactgtgaccttgttgaggagtctgacccaggggtcccttatcgtcggcgacctggctccagtgaatggaaccagccagggtaaattccaggggctggacttaaatgaagaactctatctgggaggatacccagattatggagctatcccaaaagctggcctatcttccggattcattgggtgcgtccgagaactgagaatccagggcgaagagattgtgttccacgatcttaacctgactgctcacggcatctcccattgtcccacctgtcgagaccggccatgccagaacggtggacaatgtcacgattccgagtcttcctcctatgtgtgtgtctgcccagccggctttacaggcagtcgttgcgaacatagccaggcacttcattgtcacccagaagcctgcggcccagatgctacgtgcgtcaatcggcccgatggtagaggctacacttgtcgttgccatcttggcaggtcaggactccggtgtgaggagggagtgacagtcaccacacctagccttagtggagccggctcatacctggccctacccgccctgactaatacacatcatgagcttaggctcgatgtcgagttcaagcctctggctcccgatggcgtgctcctgtttagtggagggaaaagcggtcctgttgaagattttgtaagtttggcaatggtgggaggacatctggagtttcgctacgagctcggttccggacttgcagttttgcgctctgccgaacctctggcactgggcagatggcatcgggtgtcggcagaaaggctgaataaggacggaagcttacgggttaacgggggccgccccgtgttgcgcagtagccctggcaaaagtcagggccttaatctgcatacccttctatacttaggtggcgtcgaaccatctgtgccattgagccctgcaactaacatgagcgctcattttcggggctgtgtaggagaagtgtccgtgaatgggaagagacttgatctcacttatagttttctgggcagtcagggcattggccagtgctacgattcctctccttgtgaacggcagccatgtcagcatggggcaacatgcatgcctgcaggcgagtacgaatttcagtgcttgtgccgcgacggcttcaaaggggatctgtgtgagcacgaggagaatccatgtcagctgagggaaccttgtctgcatggagggacgtgccaaggtacgcgatgcctctgtctccccggtttctccggcccgcgatgtcagcaggggagtggacacggcatcgcagaatcggattggcacttggagggatcaggaggaaacgacgctcctggccagtatggcgcttattttcacgacgacggcttcctcgccttccctggccatgtattctcccgctccctccctgaggttccagaaacaatagagcttgaagtaaggacctctactgccagtggcctgctgctttggcagggcgtcgaggtgggggaggctggccaaggaaaggattttatcagcctcgggctgcaagacgggcaccttgtttttagatatcagttgggtagtggcgaagcacgactcgtgagcgaggaccccataaacgatggcgaatggcaccgtgtgacagctctgcgcgagggcagacgaggatcaatacaggtcgacggggaagagctcgtatctggcagaagccccggaccgaacgtggcagtgaatgccaagggatctgtctacataggtggggctccggatgtagccaccttgaccggcggcagattcagttccggcattaccgggtgcgtgaaaaacctggtgctgcactcagctagacccggcgcccctcctccacagcccctggacttgcagcatcgcgcccaggcgggggccaatactcgtccatgcccatcatag

SEQ ID NO: 190521 - DNA, 720 bp, Artificial Sequence
  Description of Artificial Sequence: Synthetic coding sequence
gtgacccacggcctgcgggcctacgacggcctgagcctgcccgaggatatcgagacagtgacggcctctcagatgcgctggacccattcctacctatcagacgacgaggacatgttggcagacagtatcagcggggatgatctgggctcaggcgatctggggtccggggacttccagatggggagttggatggccggcttcctgtggtcctggatgtgggcccggaagggcatgagaatgggtctccgctttagacggtgttgctcaggcagcagccctgcagccctctggccgcccacctcgcctctccctagggattcaagcagcgacgcctgggcacagtgcccctcctcccaggaacctgctcgaagaccatccctgccagccacagcaactatgtcagtgtggccttggagcatcgctgttacaggtggcccaactgccggcacgtgcttaatgagtagcatcgtgaggagccagagctgggtgtctgctccgcactctctgtccctgtggcgcaggcatctgtaccgccctggtcagcgacaaccctcatgcgacagccaccagtcgcctaccttactgagcccctgtttccccgtgccgagtggtccatgccctgtcggcccgcgccgtcctcatgcggctatggggaccgcctcccctgaaaccactagcgccaccgacaggcgtactgcccgtaccgctgctatgtcttag

SEQ ID NO: 190522 - DNA, 567 bp, Artificial Sequence
  Description of Artificial Sequence: Synthetic coding sequence
atgaacgccggcgccagcgtgctgaccttcccctgggccgtgtacggcctgcctagagctaggcctgccgtgactgacctgaccggacccctaccaccatcaagccctgccctgccatccgtacttatcaacataaggacttctgtccaaaccgtcgtagtcggccatgccgttgaattcgagtgcctagcactgggcgaccctaaaccacaagtcacatggtcgaaagtgggcggccatctgcgaccaggtatagtgcagtcaggaggagtagtgaggatcgcccacgtggagctggctgatgctggccagtatcgctgcacagctacaaacgccgcaggaactactcagagccacgtacttctgctggtccaggccctgccccagatttcaatgccgcaggaagtccgcgtgcccgccggctcggcagcagtcttcccgtgtattgcatctgggtatcccactcctgacattagctggtccaagctggatggctccttgcctccagatagtcgtttagagaataacatgctcatgttgccttccgttagacctcaggacgcatag

SEQ ID NO: 190523 - DNA, 594 bp, Artificial Sequence
  Description of Artificial Sequence: Synthetic coding sequence
tgaacccccagcggcctgtacctgggcacctgcgagcggtgcagctgtcatgggcactctgaagcttgcgagcccgagacaggcgcttgtcaaggctgccagcaccacacggaagggcccaggtgcgagcagtgccagcccggttattatggcgacgcccaaagaggtactcctcaggattgtcaactttgtccgtgctatggcgatcctgcagctggacaggcggctcatacttgctttcttgatactgatggtcaccccacctgtgatgcatgctcaccaggccattccggccggcattgtgaacgctgtgctccgggctactatgggaacccttctcagggccagccctgccagcgagacagccaggtgcccggacccataggctgcaattgcgacccccagggttcagtctcttcccaatgcgacgctgccggccagtgccaatgtaaagtgtcccccaatccctgcccgtgtggcgcctgttccgctcctctgccgcgcccatgcggagagatcaggcagcacctggtcgaagccgagacctgggcatggggcgccggacacgggggtcaggggagaggatgcccgtag

SEQ ID NO: 190524 - DNA, 492 bp, Artificial Sequence
  Description of Artificial Sequence: Synthetic coding sequence
ccccccgtgaagatcgagagcagcagccccagcgtgaccgagggccagaccctggatctgaactgcgtggtggctgggagcgctcacgcccaggtcacctggtacagacgcgggggatccctgcctccgcacacccaggtgcatgggagtagattacggctcccacaggtgagccctgctgattccggagaatatgtgtgtagagtcgagaatggatctggccccaaagaggcatccatcacggtgagctattgtccccccgcctggtcctggtgcgtgccagggagcacccgccctataaggatcgaaccctcctcgagtcacgtcgcggagggacagaccttggatctcaactgcgtagtaccaggccaggcacatgcacaggtgacctggcacaagcgcggtggttcactgcccgcgaggcatcaaacacacgggagcttgctccgattgcaccaggttaccccagccgacagtggagaatatgtctag

SEQ ID NO: 190525 - DNA, 573 bp, Artificial Sequence
  Description of Artificial Sequence: Synthetic coding sequence
cccgaggacatcgagaccgtgaccgccagccagatgcggtggacccactcttacctgtccgacgatgaagatatgctggcagatagcatctcaggcgatgacctgggaagtggagatctgggatcaggcgatttccaaatggtctacttccgcgcgctggtgaactttactcgctccattgagtactcgccacagttagaggatgctgggtctcgagagttcagggaggtaagcgaggctgttgtggacacgctggagagcgaatacttaaagatcccaggcgaccaggtggtgtctgtggtttttattaaggagctggacggttgggtgttcgtcgagctggacgtcggatcagaaggcaacgcagatggtgcccagattcaagagatgctgttacgggtcataagtagcggaagcgttgctagctacgtaacaagccctcaaggattccaattcaggcgcctcggcaccggtgaacccattctggtctctgggatcgcaagcagcagactcgtgggctcaccctttagcgtgagcgcaatcggttctcagttaggactagctcaccactag

SEQ ID NO: 190526 - DNA, 624 bp, Artificial Sequence
  Description of Artificial Sequence: Synthetic coding sequence
ggcgagagccgggagggccggggctaccggcaggtggcccagcgggtggcagagcgctctcccgttccatccttactgagccattctggctgcgtggtgcatacaagactgagccccgtgccttctgttagccctccaattcgaattgaaagctcctctcccacagtggtcgaggggcagacactcgatctcaattgcgttgtcgcaaggcagccacaagctataataacctggtataagcggggcggatccctcccgtccagacaccagacacacggcagccaccttcggttacaccaaatgtccgtggctgacagcggcgagtacgtgtgccgcgcgaataacaatatcgacgccctcgaagcaagcatcgtcatctccgttagtccatcagctggttcaccctcagcccccggatcctctatgcctatcaggatcgagagttccagcagccatgttgccgaaggcgagaccctcgacctgaactgtgtggtcccaggccaagcccacgcacaggttacatggcataaaagaggtggtagtctacctagtcatcaccagacacgtggttcacgcctgaggctccaccatgtttccccggccgactctggagagtacgtttag

SEQ ID NO: 190527 - DNA, 1104 bp, Artificial Sequence
  Description of Artificial Sequence: Synthetic coding sequence
atgggctggcggcggggccggggcgccccccggttccccgacggcatggctgctggccagaggcgttcctctctgagcaggttgggctctcaggccgagggtctgctcaccagccagaccatggggggccaggcagagacgttactgacgtcgcaaaccggctggctccttggcaggggatgcaacttagggtccccaggcggacaggtctcttgggacaaggtaagaatccctggtgtccttcagagactgggggtaacctatttcgttgtcgccgtgctggagctgcttttcgccaagcctgtgcctgagcactgtgcctcagagcgctcatgtctttccctgagggacatcacctccagctggcctcaatggctactgatcctagtcctggagggattatggctgggactgacttttttgctacctgtcccgggatgtcccactggctatttaggtccagggggcatcggagattttggtaagtatccaaactgcacaggcggcgccgcaggatatatagatcggctgctcctcggcgacgatcacctttatcagcacccaagttctgcagtgttgtatcacacggaagtggcatacgaccccgaggggatcctgggtacaatcaattcgattgttatggcctttctcggagtccaagctggcaagatcctgctttactacaaggcccgcactaaggacattctcattcgcttcactgcttggtgctgcatcctgggactcatatctgttgccttaactaaagtgagcgagaatgagggattcattcctgttaataaaaacctgtggagtctttcttacgtgactactctttcatcttttgcattcttcatccttttggttctttatccggtagtcgacgtgaagggtctgtggactggaacccctttcttctaccccggaatgaacagcatcctggtgtacgttgggcacgaggtatttgagaactacttccccttccaatggaaactcaaagacaaccaatcgcacaaggaacacctgacacagaatattgtggcgactgccttatgggtacttatagcctacatcctgtaccgcaaaaaaatcttctggaaaatttag

SEQ ID NO: 190528 - DNA, 669 bp, Artificial Sequence
  Description of Artificial Sequence: Synthetic coding sequence
atgagcggcgccggccgggccctggccgccctgctgctggccgcctctgtcctgtctgctgctctgctggccccaggaggatcgtccggcagagatgcccaagccgctcctccacgtgatttagacaagaagcggcacgccgagctgaagatggatcaagctctcctgcttatacacaatgaacttctgtggactaacttgacagtctactggaagtcggaatgttgctatcattgcttgttccaggtgctggtgaatgtcccccagagccccaaggctggtaagcccagcgcagccgccgctagtgtgtccacacagcacgggtccatcctgcagcttaacgacaccctcgaagagaaggaggtgtgtcgtcttgagtataggtttggcgaattcggtaattatagccttttagttaagaacatacacaatggcgtgtctgagatagcgtgcgatctggcggtgaatgaagatccagtcgactctaacttgcccgtttctatcgcgtttttgatagggctggctgttatcatcgtgatcagtttcttgcgactgctgcttagggtgctcctatgtcacccggggtggagtgcggtcgcaccatcaaggctcaccccatcaagtgctagtcgggtacacacaatcctacttccccagccccctgagtag

SEQ ID NO: 190529 - DNA, 1908 bp, Artificial Sequence
  Description of Artificial Sequence: Synthetic coding sequence
atgagcggcgccggccgggccctggccgccctgctgctggccgccagcgtcctctctgcagcactgctggctcccggcggtagctcgggccgggacgctcaagcagcccccccgagagacctagataagaagcgccatgccgagctgaagatggaccaggcccttctgctcatccataacgagttgctatggacaaacctcaccgtgtactggaagagtgagtgttgctaccactgtctattccaggtgctagttaacgtgccacagtctcccaaggccggaaaaccaagtgccgctgcagccagcgtgagcacacagcacggctccatcctccagctgaacgataccctggaggagaaggaggtctgccgactagaatataggtttggggaattcggaaattactccctgttagtgaagaatatccataacggtgtgagcgagattgcctgcgacctggccgtcaatgaggacccggtggattccaacctgcctgtgtcgattgcttttctgatcggcctggcggtgataattgtgattagctttctgaggctgctgttgtctttagacgattttaacaattggatttccaaagctatctcctccagagagactgaccgccttatcaatagcgaactcggatcaccgagtcgcaccgaccctcttgatggggacgtccagccagccacatggcggctgtcggccctgcctccccgcctgcgctcagttgatacctttagaggcatcgcgcttatcctgatggttttcgtgaactatggcggtgggaagtattggtacttcaagcacgctagctggaatggcctgacagtcgccgatctggtgttcccctggtttgtctttatcatgggctcttctatcttcctgagcatgacttccatacttcaacggggctgctcaaagtttcggctgctcgggaaaatcgcttggcgtagttttctcttgatttgcataggtatcatcatcgtcaacccaaattactgtcttgggcctctcagttgggacaaggtgcggatccccggcgtgttacagcgcttaggcgtgacctactttgtggtcgctgtgctggaactcctgtttgccaaaccagttccagagcactgtgcaagtgagcgttcctgtctgagccttcgtgatattacttctagttggccccagtggttactcatactggtgcttgaggggctgtggctgggcctgacctttttactgcccgtaccagggtgtccaacagggtatctggggcctggaggaatcggcgatttcggcaagtaccctaattgcaccgggggggccgccggctatatcgacagactgctcctcggggatgaccacctatatcaacacccatctagcgctgtgctttatcatactgaggttgcatacgatcctgaggggatcctcggcactattaacagtatcgtaatggcgtttttgggcgtgcaggcaggcaaaatccttctgtactataaagcacgaacgaaggacatattgatccggttcacagcttggtgttgtatcttaggactgatatccgttgcattaacgaaggttagcgagaacgagggttttatccctgtgaataagaatttatggtccctatcttacgtcaccaccctttcttcctttgcattttttattctgttagtattgtaccccgttgtggacgtgaaggggttgtggaccgggacccctttcttttatcctggaatgaacagtattctggtgtacgtgggacacgaggtcttcgagaattacttccctttccaatggaagctaaaagacaaccagtctcacaaagaacacttgactcagaatattgttgcaacagccctctgggtcctaatagcctacatcctttaccggaagaaaatattttggaagatttag

SEQ ID NO: 190530 - DNA, 1992 bp, Artificial Sequence
  Description of Artificial Sequence: Synthetic coding sequence
atgaccggcgcccgggccagcgccgccgagcagcggcgggccggcagatctggccaagctcgggccgcagagcgcgccgccggcatgtccggcgccggcagggccttagcagcgttactgctggctgccagtgtcctgagtgctgccctcctggctccaggaggctcctccggtcgcgatgcgcaggctgcacctcctagagacctcgataaaaaaagacatgccgaacttaaaatggatcaagcactgctcctgattcataacgaactgctgtggaccaacctgaccgtgtactggaagagtgagtgttgttatcattgtctcttccaggtgctggtgaacgtgccccagtctcccaaggctggaaagccgtccgctgccgctgctagcgtaagcacacaacacggaagcattctacagttaaacgacaccctcgaagagaaggaggtttgccggctcgaatacagatttggagaattcgggaattactctttactggtgaaaaacatccacaacggggtgtccgagatcgcctgcgacctcgccgttaatgaggatccagtggatagcaacctgcccgtgtcgatcgcattcctgattggtctcgccgtaatcattgtgattagcttcttacggctgctgctaagcttggacgacttcaataactggatatctaaagctatttcttcaagggaaaccgaccgtctgattaatagcgagttagggagtccctctcgcactgaccccctagacggtgacgtacagccagccacatggaggctgtctgcactgccgccacggctgagatcagtcgacactttcagaggcatcgcccttatcttgatggtcttcgtcaattatggtggtggcaaatattggtacttcaagcacgcttcttggaatgggcttaccgtcgctgatctggtatttccttggttcgtctttatcatgggaagctcaatcttcctctcaatgacaagcattttacagaggggatgtagcaaattccgccttctgggaaagatagcttggaggtcatttctgcttatatgcatcggcataatcattgtcaatcccaattattgtctgggaccgctgtcatgggataaggttaggatacctggggtgttgcagcgcctgggagtgacctacttcgtggtggccgttctggaactgctgtttgctaagccagtaccggagcactgtgcttcagagagaagttgcctgtctttgagagacataactagctcatggccacaatggctcttgattcttgtattagaagggctctggctgggactaacattcctcttacccgtgcctgggtgtcctacgggttaccttggtcccggcggaatcggagattttggcaaatatccaaactgtactggaggagccgcaggctatattgatcgccttcttcttggcgacgatcacctgtatcagcatcccagcagcgcagtgctctaccatacggaggtggcgtatgatcccgaaggcatcctagggaccattaacagtatcgtgatggcttttttaggggttcaagctggaaagatccttctatattacaaggccagaaccaaagacatcttgatcaggttcaccgcttggtgttgcatactcgggctgatttccgtggccctcacgaaggtctctgaaaacgaaggattcattcctgtgaacaaaaatctctggtcactgagctatgtaactacgctatcttctttcgcttttttcatcttgttggtcctgtaccccgtagtcgatgtgaagggcttatggacaggaactccttttttttaccctggcatgaactctatcctggtgtatgtggggcacgaggtctttgagaactactttccatttcagtggaagcttaaggacaaccagtcgcacaaggagcacttaacccagaatatcgtggctaccgcgctgtgggtgctgatagcatatattctataccgcaagaagatcttctggaagatatag

SEQ ID NO: 190531 - DNA, 1647 bp, Artificial Sequence
  Description of Artificial Sequence: Synthetic coding sequence
atgcgggtgctgtgcgccttccccgaggccatgcccagcagcaactccagacctcccgcttgcctggcccccggagccttatacctcgccttacttctgcacttgagtctctcctctcaggctggagatcgaaggccactcccggtggacagggcagctggcctgaaggagaagacactgatacttctcgatgtctccaccaagaatcccgttcgcaccgtgaatgagaacttcctaagcttacaactggatccatcaattattcatgatggttggcttgacttcttgagttcaaagaggctcgtcacacttgccagggggctttccccagctttcctgaggtttggaggaaaacggacagacttcttacagtttcagaacttgcggaatcctgctaagtctagaggaggccccggccccgattattacttaaagaattatgaagatgatatcgtcagatcggatgtagccctggataaacagaaaggctgcaaaattgcccaacaccctgatgtgatgttggagcttcagagagagaaagctgcacagatgcatctggtattgctgaaggagcagttttcaaacacctactctaacctgatcctgaccgctaggtccctggataagctctataacttcgcggactgttcaggcctgcacctgatattcgcgctgaatgcgctgcgccggaacccaaacaacagttggaactcgagctcagccctcagcctcctgaagtacagtgcttctaaaaaatataacattagttgggagcttgggaacgagcccaacaactataggaccatgcacggccgagccgtaaacggttcgcaactaggcaaggactatattcaacttaaatctctgctacaacctatccggatctattcacgggcctctctctacggaccaaacatcggacggccaagaaaaaacgtcatcgcgctactagatggttttatgaaggtggccggaagtactgtcgacgccgtcacatggcagcactgttacattgacggccgtgttgtgaaggtgatggacttcttgaagacgcggctgctcgacacattatcagatcagattcggaagatccagaaagtggtgaatacttacacgccaggaaaaaaaatttggctggagggcgttgtgaccacaagtgctggcggaacaaacaatttgagcgacagttacgccgcaggcttcttgtggctcaatacgttagggatgctcgcaaaccaggggatagatgtcgtcatcagacacagcttttttgaccatggttataatcacctggtggaccaaaatttcaaccccttacctgattattggttgtcgctcctgtacaagagactgatcggtcccaaggtcctagccgtgcacgtcgccgggctccagcgaaagcccagacccggtagggtcattagggacaagctgcgaatatatgcacactgcacgaaccaccacaatcataattacgttaggggtagcattactctcttcatcattaacctccatcgctcaaggaagaaaatcaagcttgcgggcacgttgcgggataagctggtgcaccagtatctgttacagccttatggccaggagggtctcaagtcaaaaacccaaaggtgccagtattgtggcataatttag

SEQ ID NO: 190532 - DNA, 1605 bp, Artificial Sequence
  Description of Artificial Sequence: Synthetic coding sequence
atgcgggtgctgtgcgccttccccgaggccatgcccagcagcaacagcagaccacccgcttgcctggccccaggcgccctgtatttagcactcttgttgcacctatctttgtccagccaggcaggcgatcggagaccgttgcccgttgaccgcgcagcaggactcaaggaaaaaaccctgatactcctggacgtttccactaagaaccccgtccggaccgtaaacgagaattttcttagtctgcagctagacccgtctatcattcacgatgggtggcttgacttcctctctagcaagcggttggtcacactggcccgcggactgagccctgcctttttaaggtttggcgggaaaaggaccgacttcctgcaatttcagaatttacgcaaccccgccaagagcaggggaggccccggcccagactattacctgaagaactacgaggacgacatagttagatctgacgttgcactggataagcagaagggttgcaaaatcgctcaacatcctgacgtgatgctagagcttcaaagagaaaaagccgcacagatgcatttggtgttgctgaaggagcaatttagcaacacatactcgaatcttatactgacagagccaaacaattacaggacaatgcatggccgcgccgtcaatggatctcagctcggcaaagattacattcagctcaaatccctgctgcaaccaatcagaatctactcccgagcaagcttatatgggcctaatataggcaggccccggaagaacgtaattgccttgctggacggattcatgaaggtagccggtagcacagttgacgctgtcacttggcagcattgctatatagacgggagagtggtgaaggttatggacttcctcaagacacgactgcttgacacattgagtgatcagatccgcaaaatacagaaagtggtgaatacgtatacacctggcaagaagatctggctggagggtgtcgtgactacatccgcaggtggaacaaataacttgtccgatagctatgcagccggattcctgtggttgaacactctgggcatgctggccaatcaaggaattgacgtggtcataaggcatagttttttcgatcacggctacaatcacctggtggatcagaatttcaatcctctgccagattactggctgagcctcctctataagcggctgattggaccaaaggtgttagcagtccatgtagcagggctccagcggaaacctcgccccggccgagttatcagggataaactgaggatttacgcacactgtactaatcatcacaaccacaactacgtacgggggtctattacgcttttcatcatcaaccttcaccgatcgcgaaagaaaattaaactggctgggactcttcgggacaagctcgttcaccaatacctgcttcaaccctacgggcaggaaggcctgaagtctaaatccgtccagttgaacggccaacctctggtcatggtggacgatggaacactgcccgagctaaagccacgtcccctgcgtgccggacgcacgctggtaatcccccccgtgaccatgggattttacgtggtgaaaaacgtgaacgccttagcctgccggtatcgatag

SEQ ID NO: 190533 - DNA, 1779 bp, Artificial Sequence
  Description of Artificial Sequence: Synthetic coding sequence
atgcgggtgctgtgcgccttccccgaggccatgcccagcagcaactcccgtccgcccgcctgcctggcccccggcgccctttatctggccctcttactgcatctgagcctgagctcccaagccggcgaccgcaggcctctccctgtcgacagagccgccggactcaaggagaaaacgctgattctgctggacgtgtccacaaagaacccagttaggactgtgaatgaaaatttcttgagccttcagctggatccaagcatcatccacgacggttggttggatttcttatcgagtaagcgcctagtgaccctcgccagaggactaagcccggcatttcttagatttggcgggaaaaggactgacttcctgcagttccagaatcttaggaaccccgccaagtcccggggaggccctggccccgactactatttgaagaattatgaggatgacatcgtgaggtctgatgttgcgctggataagcagaaggggtgcaaaatcgcccagcaccctgacgttatgctggagctgcaaagggagaaagccgcccagatgcacctggtcctcctcaaagagcagttttcaaacacatactccaacctcattttgaccgctcgcagcctcgacaagctatataatttcgcagactgttccggactacacctgatattcgccctgaacgcgcttcggagaaacccaaacaactcttggaacagcagtagtgccctgtccctgcttaaatactcagctagtaagaagtataatattagttgggaattgggcaacgaacccaacaattatcggactatgcatgggagagccgttaatggtagccaactgggaaaagattacatacagctgaaatctctgctgcagcctatccgcatttactcccgcgcctctctatacggccccaatataggacgcccccggaaaaacgtgattgcattactcgacgggtttatgaaggtagccggatctaccgttgacgcagtgacatggcagcactgttacatagacggaagagtggtgaaggtcatggattttctaaagaccaggctgttggatacgctctccgatcaaattaggaaaatccagaaagtcgtcaatacctacacccctgggaaaaaaatctggctggagggggtcgtgactacaagtgctggtggaaccaataatctgtctgacagttatgctgcgggattcctgtggctgaacactctaggaatgctggccaatcagggtatagacgtggtgattcgccattccttctttgatcatggatataaccacttagtggaccagaactttaatcctctccctgattattggctctctcttctatacaagcggctgattgggcccaaagtgctggcggtacacgttgcgggcctccagcggaagcctcggcctggccgtgtgatccgggacaagctgcgcatatacgcacactgtacaaatcatcataaccataactacgttcgcggtagcatcaccttgttcattataaatctacatcggagtagaaagaaaattaaacttgccggcactctgcgcgataagctggtgcatcagtaccttctgcagccatacggacaggagggactgaagtcaaagtcagttcagcttaacggtcagccacttgtcatggtggatgatgggactctccctgaactgaagcctaggcctttgagagctggacgaacactcgttattcccccagtcaccatgggcttctacgtggtgaagaacgtcaatgcactggcttgtcgctaccgctag

SEQ ID NO: 190534 - DNA, 1443 bp, Artificial Sequence
  Description of Artificial Sequence: Synthetic coding sequence
atgcgggtgctgtgcgccttccccgaggccatgcccagcagcaactctcgccctccagcctgcctcgcacctggggcactgtacttagctctcttgttgcacttatctttgtcctcccaagccggagatcgccggccactgccagttgatcgcgccgctggactgaaggagaagacattaatactgttggatgtgagcaccaagaatcctgtgcgtacagttaacgaaaattttttgagcctccagctcgatccaagtattatccatgacggttggctagatttcctgagcagcaaaagacttgtgaccctagcccgtggactgtctcccgcatttctgagattcgggggcaaaagaacagatttccttcagttccaaaatcttcgcaacccagccaagagccgaggaggtcctgggcccgattattatctgaaaaattatgaagatgagcctaataattacagaaccatgcacggcagggccgttaatggaagccagctcgggaaagattatatacagcttaaatccctgttgcagccaataagaatctactctagagcctcactgtatgggcctaacattggaaggccacggaaaaacgttatcgccctgcttgatggattcatgaaagtcgcgggcagcactgtggacgcagtgacttggcagcattgctacattgatggacgcgtcgtgaaagtgatggactttttaaaaaccagactactcgatacacttagcgaccagatcagaaaaatccagaaggtggttaatacctatactcctggcaagaagatctggcttgaaggcgttgttacaaccagcgccgggggtacgaataatcttagtgactcttatgcagccgggttcctgtggctcaatacattgggcatgctagccaaccagggcatagatgttgtcatacgtcactcctttttcgaccacggctacaaccacctggttgaccagaatttcaaccctctgccagactattggctgtctctcctttataaaaggcttattgggccaaaagtgttggcggtgcacgtggccggtctgcagcgaaaacctagacctggtcgtgtcattcgagacaaacttcgcatatacgcccattgtactaatcaccacaaccacaactacgtgagaggtagtattactctgttcattattaacctgcatcgcagccgcaaaaaaatcaagttagccggtacattgcgtgataagctggtacatcagtatcttctccaaccctatgggcaggagggcctgaagtcaaaatccgtgcaactcaacggacagccgctcgttatggttgatgacggaacactgcccgagctcaaaccaagacctctgcgggctggaagaacactcgtcatcccccccgtgactatgggattctatgtggttaagaacgtcaacgcgctggcttgccggtataggtag

SEQ ID NO: 190535 - DNA, 1251 bp, Artificial Sequence
  Description of Artificial Sequence: Synthetic coding sequence
atgaagcgggagcggggcgccctgagccgggccagccgggccctgcgcctggcgccattcgtttatctgctcctgatccagacagacccactcgagggagtcaacatcacttcccctgttcgtcttattcatggtactgtgggcaagtcagctctgctgtctgtgcagtattcaagcacttctagcgatagacccgttgtaaagtggcagcttaagagggataaaccagtcacagtggtccagtctatcggcactgaggttatagggacgctcaggcctgactaccgagatcgaatccgcctgtttgagaacggtagtctccttttgagtgatctgcagctagccgacgagggcacttatgaggttgagatttcgatcaccgacgatacattcacaggcgagaagaccatcaacttgacagtggatgtgcccatctctcgtccacaggtattagttgcatctacaacagtgctcgagctgtcggaagcgttcacgctgaactgctcccacgaaaatggcactaagcctagctacacctggttaaaagacggcaagcctctcctaaatgacagccggatgttgctgagccctgatcagaaggtgctgaccattaccagagtgctgatggaagacgatgacctttattcctgcatggtggaaaaccctatctcccaggggcgctcattacctgtgaagatcactgtgtaccggcggtccagcctgtacatcattctgagtactggaggcatttttttgctcgtgaccctcgtaacagtctgtgcctgctggaagccatccaaacgcaagcaaaaaaagctggaaaagcagaacagtcttgagtatatggaccagaacgatgacagactgaaacccgaggcagacacactgccaagatctggggagcaggaacgcaaaaatcccatggccctgtacattcttaaggacaaggattcgcccgaaacagaagaaaatcctgctccagagccccggtctgccactgaacctggaccccccgggtatagtgtgagccccgctgtgcctggacgctccccaggactccccatcaggtccgccagacggtatccccggtctcctgcccgatccccggccactgggcggacccattcttctccccctagagctccaagcagccctggtcggagtcggagcgcaagtcgaacactgagaaccgctggggtgcatatcattagagagcaggacgaggctggaccggtggagatctccgcctag

SEQ ID NO: 190536 - DNA, 1104 bp, Artificial Sequence
  Description of Artificial Sequence: Synthetic coding sequence
atgaagcgggagcggggcgccctgagccgggccagccgggccctgaggctcgcaccattcgtctatctgctcctaatccagactgatcccctcgagggggtgaacatcacctcgccagttcgactgattcatgggaccgtcggcaagtcagctctgctttccgtccagtattcttcgacaagctctgacaggccagtagtcaagtggcagttaaaacgagataagcccgttacggtggtccaaagcatcggaacagaggtgatagggaccctgaggcccgactatcgcgatcggatcagattatttgaaaatggctcactcttgctgtcagacttgcagctggccgatgaggggacgtatgaagtggaaatttccatcaccgacgacaccttcaccggtgagaaaaccattaacctgaccgtcgacgtacctatctccaggccccaagtgctggttgcctcaacaaccgtgctagaactttctgaggctttcacgctcaattgctcacacgagaacggcactaagccaagttacacttggctgaaagatgggaagcctttgctcaacgattcaaggatgctgctgtctcctgatcagaaggtcttgactataaccagagttctgatggaggatgacgatctttatagttgcatggtcgagaaccccatctctcaggggcgttcattacctgtcaagattacggtataccgccggtcttctctgtatattatattgtcaaccggtgggatcttcctgcttgtaacgctcgtgaccgtgtgtgcctgttggaaaccatcaaaacgcaaacagaagaagttagaaaagcagaactcgttagagtatatggaccagaacgatgatagactcaagcccgaaggggagcttccagcaacgcagagtcctattccatcgactattcggtccgtgggctgctgggaaaaggctgagcttggcgataaagaaaactcatccgcggggacactaccctcagacctcggggcctctaaaggcaaggagccagaacccgcctccctcgcgtctagtcattctctcccacgacgccatgcaatgccctctacactctccgtgtctgtccacgagtag

SEQ ID NO: 190537 - DNA, 669 bp, Artificial Sequence
  Description of Artificial Sequence: Synthetic coding sequence
atgagccagaccaagatgctgaaggtgcgggtgaccctgttctgcattctggcaggcattgtgctggccatgaccgccgttgtgacagaccattgggccgttctcagtcctcacatggaacaccataacactacttgtgaagcagcacacttcggactatggaggatttgtaccaagcgcataccaatggacgactctaagacttgtggccccatcacattaccaggcgaaaaaaattgcagctattttaggcactttaatcccggcgagtccagtgagatctttgagtttaccacccagaaagagtactctattagtgcagcagctatcgccatattttcactcgggtttattatactcggctctctctgcgttttgctctctctgggcaaaaagagagattaccttctccgtcccgcatctatgttttacgcatttgccggcttgtgcatcctggtatccgttgaagtcatgaggcagagcgtaaagcgcatgatagatagtgaggacacagtgtggattgagtattactactcttggtcctttgcctgcgcatgtgcggcctttatattactgtttttgggtggactggctctgctgttgttctcactgccgaggatgcctcgaaacccctgggaaagctgtatggatgcagagcctgagcattag

SEQ ID NO: 190538 - DNA, 633 bp, Artificial Sequence
  Description of Artificial Sequence: Synthetic coding sequence
atggacctggaggagttcctgagcgagaacggcatcccccccagcccgtctcagcatgatcactctccacatccacctggattacagccagcttccagcgccgcccctagcgtcatggatttaagtagccgcgcatctgcccctctgcaccccgggattccatctccaaattgcatgcagtctccaattcgtcctgggcagttactgcccgcaaacagaaatacgccaagcccaatcgaccctgataccatacaggtgccagtcgggtatgaaccagaccccgcggatctcgccctgtctagcattccaggacaggaaatgtttgatcccagaaaacgtaaattttccgaggaggaactgaaacctcagcctatgattaaaaaagctcgaaaggtctttatccccgatgatctgaaggatgacaagtactgggcacggagaaggaaaaataatatggcggctaaacgaagtcgcgacgccaggcggctaaaagaaaatcagatcgcaatccgagcctcgttcctggaaaaggagaatagcgcgctgcgacaggaagtcgctgacctgcgcaaggagttgggaaaatgtaagaatattttggctaagtacgaggcaagacatgggcccctgtag

SEQ ID NO: 190539 - DNA, 1095 bp, Artificial Sequence
  Description of Artificial Sequence: Synthetic coding sequence
atgcacccccaggtggtgatcctgagcctgatcctgcacctggccgactcagtagcggggagtgttaaggtcggaggtgaggctggcccgtccgttactcttccctgtcactactcaggggctgtgacatccatgtgttggaacagaggctcatgtagcctctttacatgtcagaacggcattgtctggacgaatgggactcatgttacatatcggaaggacacaaggtataagctgctcggcgacctgtccagacgtgatgtcagccttactatcgagaacactgccgtaagcgactcaggggtgtactgttgcagagtcgagcatcggggctggttcaacgatatgaagataaccgtctcattggaaatcgttccacccaaagtcaccaccacccctatcgtcacaaccgtccccaccgttacaacagtgcggacatccaccacagtgcctactaccacaaccgtccctatgactacggtacctacaactaccgtgccaaccacaatgagcatccccacaactactacagtgctgaccactatgactgtgagtaccacaacatcggtaccaactacaacttctattcctaccaccaccagcgtcccagttacaaccacagtatccaccttcgttcccccaatgcctctcccccgccaaaaccatgaacctgtggctaccagccctagttcgcctcagcctgctgaaacgcatcctaccaccctccagggagctattcgtagggagcctacttcctctccactgtactcctacacgaccgatggaaacgataccgtcactgaatcatcagacggactttggaacaacaatcaaacccagctcttcctagagcattccttattaacggccaacaccaccaaaggcatctatgcaggggtgtgcatttcagtgctcgtgctcttagctttattgggagtgatcatcgccaaaaaatacttcttcaagaaggaggtccagcagcttagcgtgtcattcagtagccttcagattaaagccctgcaaaatgcggtggagaaggaggtgcaggccgaagacaacatttatattgaaaattccctgtacgccaccgattag

SEQ ID NO: 190540 - DNA, 1206 bp, Artificial Sequence
  Description of Artificial Sequence: Synthetic coding sequence
atgcacccccaggtggtgatcctgagcctgatcctgcacctggccgattccgtggctgggtcagtgaaagtgggtggagaggctggcccaagcgttacactcccttgccattattctggcgcggtgacttcaatgtgctggaaccggggctcctgctctttgtttacatgtcaaaacggcatcgtgtggaccaacgggactcatgtgacatacaggaaggatacccgctataaactgctcggggacctcagtaggcgcgacgtgtccctgacaatcgaaaatacagcggtgagcgacagcggcgtctattgttgccgggtcgagcaccgcggctggttcaatgatatgaaaattaccgtgagcttagaaatagtgcctccaaaggtaaccactactcctatcgtcaccacagtgccaactgtcaccaccgttagaaccagtacaacagtacccaccacgacgaccgtaccgatgacaacagtgcctacaaccacagtacctaccaccatgtccatccccactaccacaacagtgctgaccaccatgaccgtgtccacaaccacatctgttcctacgacaactagcatccctacgactacatcagttcctgtgacgactaccgtgtccacctttgtcccccccatgccactgcccaggcagaatcatgaaccagtggctacatcaccatcatccccgcagcccgctgagacccacccaacaaccctgcaaggggccattcggagggagccaacctctagtcccctctactcttacactaccgacggaaacgacacagtgaccgagagtagcgacggcctgtggaacaataaccagactcagttattcctggagcattcactattaactgctaatacgacgaaaggaatttacgccggcgtgtgtatctctgtgctcgtactgctcgctctcttgggcgttattattgcaaaaatgttccaccttgcagcgttcaagctcaagctgtgtaaaatgcaactgaagaggaaaagtaaacaaaagaccatctcgaccttgcggattgtatttatgccacggacgaagacgcagtggtgttcacttagagtgtacgcccatgaatgtaggagattgaacaggcaccaacatattcgacgactcctggatccaaagaccattttcttgtttcagttccatctagcctttcagcacgtcagcgacacgggatag

SEQ ID NO: 190541 - DNA, 672 bp, Artificial Sequence
  Description of Artificial Sequence: Synthetic coding sequence
atgcacccccaggtggtgatcctgagcctgatcctgcacctggccgattctgttgccggctccgtcaaggtggggggcgaggccgggcccagtgttacgcttccttgtcactactctggcgctgtcacttctatgtgctggaaccgaggaagctgctcgctcttcacttgccagaacgggatagtgtggaccaacggaactcacgttacctacaggaaggatactcggtataaactcttgggagacctctcccgaagagacgtgtctctgacaattgaaaacacagcagtgtctgactctggcgtttactgttgcagggtggagcaccgcggctggttcaacgacatgaagatcaccgtctccttggagattgttcctcctaaagtgaccaccactcccatcgtcacgacagttcccactgtgactaccgtgcggactagcaccaccgtgccaacaacaacgactgtcccaatgacaaccgtgcccacaaccacagttcctactacaatgagcattcctaccaccacaactgttctgacgacgatgactgtgtcaaccactacgtccgtgccaaccaccactagtatcccaaccaccacatcagtgccagtgactacaactgtgtccaccttcgtgcctcccatgcccctgccaaggcagaatcacgagtag

SEQ ID NO: 190542 - DNA, 1095 bp, Artificial Sequence
  Description of Artificial Sequence: Synthetic coding sequence
atgcacccccaggtggtgatcctgagcctgatcctgcacctggccgacagtgtggccggcagtgtgaaagtcggcggcgaagccggaccttctgtcactctcccatgtcattactcaggggctgttacctccatgtgttggaaccgcggatcctgctccctgttcacctgccagaacggcatcgtctggacaaatggcactcacgtgacctatagaaaggacactagatacaagttactcggcgatctgagccgccgcgacgtgtctctgaccatcgagaataccgctgtctcagactcaggcgtttactgctgtagagtagaacatagaggctggttcaacgacatgaaaattaccgtgtctcttgagattgtgccacctaaggtgacaaccactcccatcgtgactacagtgccaacagtcaccacagtccgcacatccacgaccgtgcccaccaccactaccgtccccatgaccacagtcccaacaactaccgtgccgactactatgtctatcccaactacaacgacagtgctgacaacaatgactgttagtacaactacctcagtgcccactactacaagcattccaaccactacatccgtgcccgtgaccaccacagtttccaccttcgtacccccaatgccattacctaggcagaatcatgaacctgttgctacatctccatctagtccacagcccgccgagacccacccaaccaccttgcagggcgctatccgtcgcgagcccacctcctcaccgctgtattcgtacaccactgatggtaatgacacagtaaccgaatcctccgacggtctatggaataataaccaaactcaactgtttttggaacattccctcctgactgctaacaccaccaagggtatctacgccggagtatgcattagtgtactagtactgctcgctctgttgggggttatcattgccaagaaatacttcttcaaaaaggaggtgcagcagctttcagtgagtttcagtagtctgcagatcaaagccctccagaatgccgtggaaaaagaggtccaagcggaggacaacatttacatcgaaaacagcttgtacgcaacagattag

SEQ ID NO: 190543 - DNA, 1095 bp, Artificial Sequence
  Description of Artificial Sequence: Synthetic coding sequence
atgcacccccaggtggtgatcctgagcctgatcctgcacctggccgatagtgttgctggttctgtcaaggtgggcggtgaagcggggcccagcgtgacactgccctgtcactattctggcgcagtgacttccatgtgttggaaccgtggctcgtgctccctgtttacctgccagaacgggattgtctggactaacggaacccatgttacctacaggaaagatactagatacaaactgctgggcgacttatcccggcgcgatgtgagtttgactatcgaaaatactgccgtttccgattccggagtttactgttgtcgcgtagagcacagaggatggtttaatgatatgaagatcacagtaagcctcgagatcgtgccgcccaaggtaactaccacaccgatcgttacgacagtccccacggtaacgacagtgcgcacgagtaccacggtgcccacaaccaccaccgtccctatgacgacagtcccaaccacgacagttcctacaaccatgtctatacccactactacaactgtgctgacaacgatgaccgtgagtaccacaacaagtgtgccgacaaccacctcgattcccactaccacttccgttcccgtgacaaccacagtttccaccttcgtaccacctatgcccttgccccgccagaatcacgaacccgtcgccacctccccatcaagcccccagccggcggagacccatccaacaactctccaaggagctattcgcagagagccaacttcgtcacccttatatagctacaccacagatggtaacgacaccgtcactgaaagtagtgacggcctgtggaacaacaaccagacccaattatttctcgaacattcgctattaactgctaatacaaccaaaggcatttatgccggagtgtgcatttctgtcctggttttgttggctcttctgggcgtgattattgccaagaagtacttcttcaaaaaggaggtgcagcaactgtcggtgtccttctcttctctgcagattaaagcattacaaaatgcagttgagaaagaggtacaagctgaagacaacatttatatcgagaactccttatacgctactgactag

SEQ ID NO: 190544 - DNA, 522 bp, Artificial Sequence
  Description of Artificial Sequence: Synthetic coding sequence
atggagcccggcgccggccacctggacggccaccgggccggcagcccctctctccgccaggccctgtgtgacgggagtgcggtaatgttctcttctaaagagaggggccggtgtacagtgatcaattttgtgcctctcgaagctcctctaagaagcacaccccgatcacgacaggtaactgaggcctgtggtggagaaggcagggctgtccccctgggctccgaacctgagtggtcagtcggcggcatggaggccaccctggagcagcatttagaggataccatgaaaaaccccagcattgtgggggtgctgtgcacggattctcaagggctcaacctgggatgccgcggcactctgtctgacgaacatgccggcgttatcagcgtgctggcccagcaggccgcaaagcttaccagtgaccccaccgatatcccagtcgtgtgccttgaatcagataacggcaatattatgatccagaagcacgatggcattacagttgcagttcataagatggcctcttag

SEQ ID NO: 190545 - DNA, 267 bp, Artificial Sequence
  Description of Artificial Sequence: Synthetic coding sequence
atgggcaactggggcctgggcatcgccccctgggtggacggcgagtcagaactcgagttccgccgcctaggcatgcaggggcccctggaagccctccggaggagggagtggaatactcaaagggcttcttttagcttttcattcttgatcgctctgagccctcataccgttgattattgccactcatatgagttatttaataggcgttggcacggccacgtcctggctacccagcggcctagcctcttcattctcatgttggtctag

SEQ ID NO: 190546 - DNA, 2334 bp, Artificial Sequence
  Description of Artificial Sequence: Synthetic coding sequence
atgggccggggcagcggcaccttcgagcggctgctggacaaggccacgagccagctgctgctggaaacggattgggagagcatcctgcagatctgcgatctgatcagacaaggggatacccaggccaaatacgcagttaattctattaaaaagaaggtaaatgataagaacccacacgtcgccctatatgcactagaggtgatggagagcgtagtcaagaattgcgggcagaccgtccacgacgaagtagctaataagcagacaatggaggaactcaaggatctgttaaagcgccaagtagaggtcaacgtgcggaataaaattttatatctgattcaggcctgggcccatgctttccggaatgagcccaagtacaaagtggtccaggatacctatcagatcatgaaggtggaagggcacgttttccccgaatttaaggagtcagatgccatgttcgccgcagagagagcgccagattgggttgacgccgaggaatgtcaccggtgcagggtgcagtttggagtgatgacacgtaaacaccactgcagggcctgtggacagatcttctgcggcaaatgttcatccaaatacagcacgatcccaaagttcgggatagaaaaagaggttagagtttgcgaaccatgttacgagcagttaaatcgtaaggccgaaggtaaagccacatccacaacagagctccccccggaataccttacctctcctctcagccagcagtcccagctgccaccaaagagggacgaaaccgccttgcaggaggaagaagagctgcagctggctctagccctctcccagagcgaggctgaagagaaagaacgtctgcgccagaagagcacatatacaagctacccaaaggccgagcctatgccatctgcctctagcgcccccccagcttcatctttgtattcgagcccagtcaactcatctgcaccgctggcggaggatatcgacccagagctggccagatatctgaaccgtaactattgggaaaagaagcaggaggaggcccggaaatcgccaaccccatctgcccctgtgccattgaccgagcccgctgcccaacctggagagggccacgccgcaccaaccaacgtggtagagaacccgctgcccgaaacagacagccagcctattcctccttccggtggaccatttagcgaacctcagtttcacaatggggagagcgaagagagtcacgaacagtttcttaaggcccttcagaacgccgtgacaacatttgtgaataggatgaaaagcaatcacatgcggggtaggtctataactaatgactcagccgtgcttagcttgttccagagcattaacggcatgcatccccagttgctcgaactgttgaatcagctggacgagcgccgcctgtactatgagggcctgcaagacaagctggctcaaattcgcgacgctcggggtgcgctgagtgctctgcgcgaagagcatagggagaagctccgcagagccgcagaggaagccgaaagacagagacagattcagttggcccagaagcttgagattatgcggcagaagaaacaggagtaccttgaagtccaacgacagttggccattcaacgtcttcaggagcaggagaaagaacggcagatgagactcgaacagcaaaagcagacggtgcagatgagggctcagatgcctgcctttcctctgccttatgctcaactgcaggctatgcctgctgctggaggcgtgttatatcagcctagcggacccgcttcattcccttccaccttttcaccggccgggtcggtcgaaggatctccgatgcatggtgtctacatgtcccaacctgcccccgctgccggaccttatccttccatgccttccaccgcagccgatccctcgatggtgagtgcctacatgtaccccgccggggcaacaggagcacaggcagcacctcaggcccaagctggtcctaccgccagtcccgcttatagctcttatcaacccacgcccacagctggataccagaatgtcgcatcacaagctccccagtcactcccggcgatatcgcagcctcctcaatccagcaccatggggtatatggggagccaaagcgtgagtatgggctaccagccttacaatatgcagaaccttatgacaactttaccatcccaagatgcctcccttccaccacagcagccctacattgccggccagcaacctatgtatcagcaaatggccccttctggtggacctccacagcagcagcctcctgtggcccagcagccccaagctcaaggtcccccagctcagggttctgaagctcagctcatttcattcgattag

SEQ ID NO: 190547 - DNA, 2076 bp, Artificial Sequence
  Description of Artificial Sequence: Synthetic coding sequence
atgggccggggcagcggcaccttcgagcggctgctggacaaggccacaagccaactcctgcttgagacggactgggaaagcattcttcagatttgtgatcttatccggcaaggagacactcaagccaaatacgctgtgaatagcattaaaaaaaaggtcaacgacaagaacccccatgtggctctgtacgctctggaagttatggagtcagttgttaaaaactgcggacagacagtccatgacgaggtcgctaataagcaaaccatggaagagctgaaggatctgctgaagagacaggtggaggttaatgtgaggaacaagatattgtatctcatccaagcctgggcgcacgccttccgcaacgaacccaagtacaaagtagtacaggatacataccagattatgaaggttgagggccatgtgtttccagaattcaaggaatcagacgctatgttcgctgccgagagggcaccagattgggtagacgccgaggagtgccacagatgtcgagtccagtttggcgtcatgactagaaaacatcattgtcgggcctgtggccagatcttctgtggtaagtgtagtagcaagtactccaccatccccaagttcgggatcgagaaagaggtgagggtttgtgaaccttgctatgaacaactgaatcggaaggctgaaggcaaagctacctccaccaccgagctgccacctgaatatctcacctccccactttctcagcagagtcagctccctcccaagcgcgatgagactgccttgcaggaagaggaggagctgcaattagccctggcgctttcccagtcggaagctgaggagaaggaaaggctgcgacagaagtctacctatacgtcctaccctaaggccgaacctatgcctagtgcttcgagtgcgcctccagcctcttctctgtatagcagtcccgtgaacagttcagcccctctggcggaggacatcgaccctgaactagctcggtatttgaaccgtaactattgggaaaaaaagcaggaggaggcaaggaaatcacctacaccctctgctcctgtgcctctgaccgaacccgccgctcaacctggagagggtcacgccgcccctacaaacgtggtggagaatcctctcccagaaactgactcccagccaattcctccatctggcggcccattcagcgagccccaattccacaacggggagtccgaagagagtcacgagcagttcttaaaggcactgcagaacgctgtcacaacatttgtgaatcggatgaaatcaaaccatatgcgtggccgaagcatcaccaacgactcagctgtactgtccttgtttcagtccatcaacggcatgcatccccaattgctcgaactccttaatcagctggacgagcgccggctatattacgagggtctgcaggacaaattggcccaaatcagggatgcaagaggagctctgagcgctctgagggaagagcatagggagaagttaagacgggccgctgaagaagcggagagacagcgtcagattcagcttgcgcaaaaactcgagattatgatgcatggggtctatatgtcacagccagcacccgccgccggaccctacccttccatgccctcaactgctgctgatccctcgatggtttctgcatacatgtaccccgctggtgcgacgggagcccaggcagcccctcaggcccaggccgggcccactgccagcccagcttactcgtcatatcagccaaccccgactgccgggtatcaaaacgtggcctctcaagcaccacaatctctcccagcaataagccagccccctcaatcttctaccatggggtatatgggatcgcaatccgtatccatggggtaccaaccctacaacatgcaaaacttgatgactacactcccgtcccaagatgcatcacttccaccgcagcagccttacatcgctggccagcagccgatgtaccagcagatggctccctccggcggcccgccacagcagcagcctcctgtagctcagcagcctcaggcacaaggccccccagcccaagggagtgaggcccagctcattagcttcgactag

SEQ ID NO: 190548 - DNA, 324 bp, Artificial Sequence
  Description of Artificial Sequence: Synthetic coding sequence
atgcggctgagcaagaccctggtggacatggacatggccgactactctgctgcacttgacccagcctacacaacactggaattcgaaaatgtgcaggtgctgacaatgggtaacgacttcgtggccgcggcttcccggcaaatagaggccagtccccctacttctctggagcacatttggagagggggccaatttagcaccggacgccacgtccccattcgcaggcatcagccgcagcgagcacagcagcccgggtgtcagcggccagtgtgccatcttcgaggacccgggcacggccagactttgcgctgtctagagctctag

SEQ ID NO: 190549 - DNA, 1425 bp, Artificial Sequence
  Description of Artificial Sequence: Synthetic coding sequence
atgcggctgagcaagaccctggtggacatggacatggccgactacagtgccgcacttgaccctgcatacaccactctcgaatttgagaacgtccaggtgctgaccatgggtaatgacacgtctcccagcgagggcacaaatctcaatgcacctaattctctgggcgtgagcgctctgtgtgctatatgcggagatagggccaccggtaaacattacggcgcctccagttgtgatggttgtaaggggttcttcagaagaagtgtgcgcaagaatcacatgtacagctgccgattcagccggcagtgcgttgtggacaaggacaaacggaaccaatgtcgctattgtcggctcaaaaaatgttttcgggcaggcatgaaaaaagaggctgtgcagaacgaaagggaccggatctccacaaggcgcagctcatatgaagacagctcactgccatcaatcaacgcattactccaggccgaggtgttgtccaggcagataactagtcctgtttctggaataaacggtgatatccgggccaagaaaattgcttctattgccgatgtgtgtgaaagcatgaaagaacaacttctagttctggttgagtgggcaaagtacattcccgcattttgcgagctcccgctagatgaccaggtagcgttgttacgcgcgcatgcgggggagcacttactgctcggcgctacaaagcgctccatggtgtttaaggatgtgctactgttgggtaacgactacatagtccctcggcattgcccagagctggcagaaatgtcgcgggtcagcattcgcattctggacgagctggtgctcccttttcaggagttacaaattgacgataatgagtacgcctatctgaaggcaataatcttcttcgaccctgatgcaaagggattatccgaccctggtaaaatcaaacgtctacggagccaggtgcaagtgtcgcttgaggattacatcaatgacagacaatatgacagcaggggccggtttggcgaactactactgctgctccccactcttcagagcattacatggcagatgatcgagcaaatccagtttataaagcttttcggcatggctaaaattgacaacttgctgcaggaaatgctcctgggtgggtctccatccgatgcccctcacgctcaccatccactgcacccccaccttatgcaggagcacatgggtaccaatgtcatagtggccaacactatgcctacccatctgtcgaacggccagatgtgtgaatggccccgcccgagagggcaggctgccacacccgaaactccgcagccttctcccccgggaggaagtgggagcgaaccatataaactcctgcctggggcggtagcgacaatcgtcaagccgctcagcgcgatcccacagccaaccataacaaagcaggaagtcatctag

SEQ ID NO: 190550 - DNA, 1359 bp, Artificial Sequence
  Description of Artificial Sequence: Synthetic coding sequence
atggtgagcgtgaacgcccccctgggcgcccccgtggagagcagctacgacacctccccctccgaggggaccaacctgaatgctccgaatagccttggcgtgagtgctctttgtgcaatctgcggagatcgggccacagggaagcattacggcgccagtagctgtgacgggtgcaaaggattctttcggcggagcgtcaggaagaatcacatgtacagctgtaggttttcccgccagtgtgtggtagacaaagacaagagaaatcaatgtaggtattgcagactgaagaaatgtttccgggccgggatgaagaaggaggccgtgcagaacgaacgcgatcgcattagtacaaggaggtcctcttacgaggattcctcattgccttctataaacgctctgttgcaagccgaggtactctcgcgccagatcaccagccctgtcagcggaattaacggagatatacgagctaagaagattgccagcatagccgacgtctgtgagtctatgaaggagcagctgctcgtgctggtggaatgggccaagtatatacccgctttttgcgaattgcccctggacgaccaggttgccctgcttcgggcccatgctggagaacatctgttactgggagcaactaaacgctccatggtcttcaaggacgtgctgctgcttggtaacgactacatcgttccaagacactgtccggagctggccgaaatgtcccgcgtctccatccggatcctagatgaactagttttgccttttcaggagctgcagattgatgacaacgagtatgcctacctgaaagctattatttttttcgatcctgacgctaaaggcctaagtgatcccggtaagatcaaaaggctgaggtctcaggtgcaggtctcactcgaagactacataaatgaccgtcagtacgactctcgaggccgttttggggagctcctgctcctgttacctacgcttcaaagtatcacatggcaaatgattgagcagatccagttcattaagctctttggcatggccaaaatcgacaacttgctgcaggagatgctgttaggtggaagcccaagcgacgcccctcatgcacatcaccctctgcatcctcacctaatgcaggagcatatgggtacaaacgtgatcgtggctaacactatgcccactcacctctcaaatgggcaaatgtgcgagtggccaaggccccgaggacaagccgcaacgccggagaccccccagccatcgccaccgggaggctcggggagcgaaccttacaaattgttgccgggcgcagtcgcgactatcgtcaaacccctttccgctataccccagcctacgattaccaagcaggaggtgatctag

SEQ ID NO: 190551 - DNA, 1515 bp, Artificial Sequence
  Description of Artificial Sequence: Synthetic coding sequence
atgcggctgagcaagaccctggtggacatggacatggccgactactcagcagctctagaccccgcctatacgactctagagtttgagaatgtgcaagttctaaccatgggaaatgttctgctgcccctgcgtctggccagactgagacaccccttgaggcaccattggtcaatctcaggaggggtagacagttcaccccagggcgataccagcccttcagagggtacaaatctgaacgctcccaactcacttggggtgtcggcgctgtgcgccatctgtggcgaccgggccaccggtaaacactacggggccagtagctgcgatggctgcaaggggttcttccgcagatctgtgcgtaaaaaccacatgtactcctgtagattctcccggcaatgtgtggtggacaaggataagaggaaccaatgtcggtattgtagactgaagaagtgtttcagggccggaatgaaaaaagaggctgtgcaaaatgaaagagatcgtatttcaacacgccgaagctcctacgaagatagcagtttgccttccatcaatgccctactgcaggctgaggttctatcacgccagatcaccagccctgtcagtggaataaacggcgacatccgcgctaaaaaaatcgcaagcatagcagatgtctgtgaaagcatgaaagaacagctgttagtcctcgtcgaatgggccaagtatatacccgcgttctgcgaactgcccttggatgatcaggtggcattattgcgggcgcacgccggtgagcatctgttactgggggctaccaaaaggtcaatggtgtttaaggatgtgcttcttctgggtaacgattatatcgtccctcgccactgtcccgagctcgcggaaatgtcccgtgtttccataaggatccttgatgaactggtgctgccttttcaggagctgcagatcgacgataatgaatatgcttacctaaaagctattattttctttgacccagacgccaaaggactgagcgacccgggtaagattaagcggttacgatcccaggtccaggtttctctggaagattacatcaatgatcgccagtatgattcccgtgggcgatttggcgaactgctcttattgcttccgaccttgcagtccatcacgtggcagatgattgagcaaattcagtttattaagctgttcggtatggctaagatagataacctactgcaggagatgctcttgggaggatctcctagtgacgcccctcatgcccaccaccctttgcatccacacctgatgcaagaacatatgggaactaatgttattgtagctaacaccatgccaacccatttgtcgaacggtcagatgtgtgagtggccacggcctcgcgggcaggctgccacgcccgaaactcctcaaccttcaccacccggtggcagcgggagcgaaccatacaagctgttgcccggcgccgtggctactatcgtcaagccactcagcgccatccctcaaccaaccatcaccaagcaggaggtgatctag

SEQ ID NO: 190552 - DNA, 1395 bp, Artificial Sequence
  Description of Artificial Sequence: Synthetic coding sequence
atgcggctgagcaagaccctggtggacatggacatggccgactactcggcagcactggatccagcgtataccacactcgagttcgaaaacgtgcaggtgctcactatgggaaacgatacgtcaccatctgaaggcaccaatttgaacgcccctaactccctgggagtttcagctctttgtgcaatatgtggcgacagagctacagggaagcactacggggccagctcgtgcgacggatgtaagggtttctttcggcggagcgtccgtaagaatcatatgtatagctgcagattctctagacagtgcgttgtagataaagataagcgcaaccagtgtcgctattgccggctgaaaaagtgtttccgcgccggaatgaaaaaagaagccgtgcagaacgaacgagatcggataagtaccaggcggtcaagttacgaagactcctctctgccatcaataaatgctctgctgcaggcagaagttttgtctcgtcagatcacttcccctgtgtcaggtatcaatggagacattagagccaagaagatagcatccatcgcagatgtgtgtgaaagcatgaaggagcagctcctagttctcgtggagtgggctaaatatatccccgctttttgtgaactgccacttgacgaccaggtggcacttctccgcgcacacgccggtgagcatcttctgctcggagccacaaaaagaagtatggtgtttaaagacgtccttttgttaggaaatgattatatagtcccgcggcattgccccgagctggctgaaatgtctcgcgtcagcatccgcattctggatgagcttgtgctgccatttcaggaattacagatcgacgataatgagtacgcctacctcaaggctatcatttttttcgaccccgacgcaaaggggttgtccgatcccggaaaaatcaaacgtctccgctcccaggtccaggtgagccttgaggattacattaatgataggcagtacgactcgagaggccgctttggcgaattactgctccttttgccaacactccagtccattacctggcagatgatcgagcaaattcaattcattaaactctttggcatggctaaaatcgataatctgctccaggaaatgctgctgggggggtctccatccgacgccccacacgcccaccatcctctacacccacacctgatgcaggaacatatggggacaaatgtgatagtagctaatactatgccaacccacttgtccaatgggcagatgtccacaccggagaccccacagccctcacccccaggcggctcagggtcagaaccatacaaactcctgcctggagctgtcgcaacaatagtgaagcctctgtccgctattccacagcccaccataaccaagcaggaagttatttag

SEQ ID NO: 190553 - DNA, 1254 bp, Artificial Sequence
  Description of Artificial Sequence: Synthetic coding sequence
atgcggctgagcaagaccctggtggacatggacatggccgactacagcgccgccctcgatcccgcttacactaccctcgaattcgaaaacgtacaagtgttgacaatggggaacgatacctcccctagcgagggaactaaccttaacgctcccaattccctgggggtctccgcattatgtgcgatatgcggggaccgcgccacgggtaagcactatggcgccagttcttgtgatggatgtaagggattctttaggcgtagcgtacgaaagaatcatatgtatagctgcagattctcgcgacagtgtgtcgtcgacaaagacaaaagaaaccagtgccggtactgtcgccttaagaaatgctttagagccggcatgaagaaggaagcagtacagaacgagagggacaggatcagcaccaggaggtcttcatatgaggacagctccctgccatccataaacgcgctactgcaggcagaggttctgtcgagacagatcacatccccagtatctggcatcaatggcgatattcgtgctaaaaaaatcgcttcaatcgcagatgtgtgtgagtctatgaaggagcagctcctggtgctggttgaatgggccaaatatataccagctttttgtgaacttcccttggacgatcaggtggcactgctccgtgctcatgcaggggaacatctgctcctgggggcgactaaacggtccatggtattcaaggacgtcctgcttctcggaaacgactatatcgtaccacgacactgccctgagctggctgagatgagcagggtgtccatccgcatcctggatgagctggtactgccgttccaagaactccagatagacgacaatgaatacgcctatctaaaggcaataatcttctttgaccccgatgccaaggggttgagtgaccctggaaaaatcaaacggcttagatcacaggtccaggtctctcttgaggactatatcaacgacagacaatacgatagtcggggaagatttggggaactactgctgctgctcccaacactgcaatctattacctggcagatgatagaacagatccagttcattaagctgttcggaatggcaaagattgataacctgcttcaggagatgctgctcggcggtccctgtcaggctcaagagggccggggctggtccggtgactcacctggggataggccccacacagttagctcacccctgtcctctctggcttcccctttgtgtcgctttggacaggttgcctag

SEQ ID NO: 190554 - DNA, 1329 bp, Artificial Sequence
  Description of Artificial Sequence: Synthetic coding sequence
atggtgagcgtgaacgcccccctgggcgcccccgtggagagcagctacgacacctccccctctgagggcaccaatttgaatgcccccaactccctcggtgtcagtgcactatgtgcaatctgtggagatcgtgccaccggcaagcactatggggcgagcagttgcgacggctgcaaagggttcttccgccgaagcgttcgcaagaaccacatgtatagttgtcgtttcagcagacagtgtgtggttgataaagataagcgcaaccagtgccgctactgtagactgaaaaagtgcttccgggccgggatgaagaaagaggctgtgcaaaacgaacgcgatcgcatttctacaagacggtcatcctatgaggatagctccctccccagcattaacgcattgctgcaggcagaggtgctgagcagacagataacctcccctgtgtccggaattaatggtgatatccgggctaaaaaaatcgcaagtatcgctgatgtgtgtgagagcatgaaggagcagttgctggtgttagtggagtgggccaaatatatacctgccttctgcgaattgcccttggacgaccaagtggcccttttgagagcccatgcaggcgaacacctcttactcggagcgaccaagcggagcatggttttcaaggatgtgctgctactaggaaatgattacatcgtaccgagacactgtccagagttggctgagatgtctcgcgtcagcataagaattctggatgaacttgtgctcccctttcaggagctgcaaatcgatgataacgagtacgcatatctgaaggccataatattctttgaccccgatgccaagggactgtcagatccaggcaaaatcaaacgcttgcgctcgcaggtccaggtgtcactggaggactacattaatgaccgccagtacgattcaagaggtagatttggggagctgctgttgctactgcctacactgcagtctatcacatggcagatgatcgaacagatccaattcattaagctgttcggcatggccaaaatagacaacctgctccaagaaatgctattgggtggtagtccctcagacgcaccacacgcgcaccacccactgcacccgcaccttatgcaggaacacatggggaccaatgtcattgttgccaatactatgcccacacatctgagtaacggacagatgtctaccccggagaccccacagcccagccctccgggcggatccgggagcgagccttacaaactcctgcccggggcggttgccactattgtgaagcccctatccgcaattccgcagccaaccattacaaaacaggaggtgatttag

SEQ ID NO: 190555 - DNA, 1227 bp, Artificial Sequence
  Description of Artificial Sequence: Synthetic coding sequence
atgaacaccaccgacaacggcgtgaactgcctgtgcgccatctgcggagacagggcaactgggaagcattatggggcctcctcgtgtgatggatgtaagggctttttcagacggtccattaggaaaagtcacgtctattcctgccggtttagtcgacagtgtgtggtagacaaagacaagcggaaccaatgcaggtattgcaggctccggaagtgctttcgtgccggaatgaagaaagaggccgtccagaatgaacgtgatagaatttccacacgccgctcgactttcgatggctcaaatattcctagcatcaatactctcgcccaggccgaggtgcggagtcgccagatctccgtgagctctccagggagctcaaccgatatcaacgttaagaaaatcgctagcattggtgatgtgtgcgaaagcatgaagcagcagctgctcgtgctcgtggaatgggccaagtatatcccagctttttgtgagcttcctctcgatgaccaggttgccctgctaagggcccatgccggcgagcatctcctcctaggtgcaacaaagcgcagtatgatgtacaaagacatcctactcctgggtaataactatgtgatccatcgtaattcttgtgaggtcgaaatctccagggtggctaacagggttcttgatgaactcgtaaggcctttccaagagatccaaatagacgacaacgaatatgcttgtctgaaagctatagtgttttttgatcccgacgccaaaggcctgagtgaccctgtaaagataaaaaatatgaggttccaagtgcaaatcgggctggaagattatattaacgatagacaatacgatagtagaggaaggtttggagaactgctgctgcttttgcctaccctacaatccattacgtggcaaatgatagagcagatacagttcgtcaagctgttcggaatggtcaaaatcgataacttacttcaggaaatgttgctgggaggcgcttcgaatgacggctcccacttgcatcacccaatgcacccacatctgtcgcaggatcccctaacgggacagacgatactgctgggaccaatgagcactctcgtgcacgcagaccagattagcaccccggagaccccccttccaagtccaccacagggaagtggtcaggagcagtataagatcgcagcaaaccaggcatccgtgatctctcatcagcacctgagtaagcagaagcaactgtag

SEQ ID NO: 190556 - DNA, 1338 bp, Artificial Sequence
  Description of Artificial Sequence: Synthetic coding sequence
atggacatggccaactacagcgaggtgctggaccccacctacaccacactcgaattcgagacgatgcagattctctacaacagcagcgattcctccgcacctgagacctccatgaatacgacagataacggcgtgaactgcctgtgtgctatttgcggggatcgggccactgggaagcattacggagcgagcagttgcgatggctgcaagggattcttccgccgctctatccgcaaatctcatgtctactcctgtcgctttagcagacagtgcgtagtagacaaggataagaggaatcaatgccgctactgccgcctccgcaagtgtttccgagccggaatgaagaaggaagcagtacagaatgagagggatcggatttcaacaaggcggagtaccttcgatgggagtaatatcccgtctataaatacgctagcacaggcagaagtccgcagccgtcagataagcgtgagtagcccaggcagcagtacagatataaatgtgaaaaagatcgccagcatcggggatgtatgcgagtctatgaagcagcagctcctggttctcgttgagtgggccaagtatataccagcattttgcgagctccccttggatgatcaggtggcattgcttagggcacacgccggcgagcatctgttgctgggcgctactaagagaagcatgatgtataaggatatcctgctgctggggaataattatgtgatacatcgtaactcttgtgaagttgaaatctccagagtggcaaatagagtgctggatgagctggtgcgtccatttcaggaaatccaaatcgacgacaacgaatacgcttgtctgaaagctatcgtgtttttcgatccagatgccaagggcttgagcgaccctgttaagataaagaacatgaggttccaggtacagatagggctcgaagactacatcaacgaccgccagtacgatagcagaggtcggttcggagaattactgctgctgctgcctacactccaatccattacctggcagatgatcgagcagatccaattcgtgaagctgtttgggatggttaaaatcgataacctacttcaagagatgctgctgggtggagcctcaaacgacggctcccacttgcaccatcccatgcacccacacctatcacaagatcccttgacagggcaaacaatcctgttggggcctatgtcaacgctagtgcacgcagatcaaatcagtacgcctgagacccctctgccctctcccccgcaggggagcggccaggaacagtacaaaatcgcggcaaaccaggcttccgtgataagccatcagcatctcagcaagcagaagcagttgtag

SEQ ID NO: 190557 - DNA, 723 bp, Artificial Sequence
  Description of Artificial Sequence: Synthetic coding sequence
atgagccggagcaaccggcagaaggagtacaagtgcggcgacctggtattcgccaaaatgaaaggatatccccactggccagctcggattgacgagatgcctgaggctgcagtgaagtcaacagcaaacaagtaccaggtcttcttctttggcactcatgagaccgcttttctgggacctaaggatttgttcccttatgaagaatcaaaggaaaagtttggtaagccaaataaacgcaagggtttcagcgagggcctatgggaaatcgagaacaaccctacggttaaagctagcggttaccaaagttcgcagaagaaatcctgtgtcgaggaacccgagcccgaacccgaggctgccgaaggtgatggcgataagaaaggtaatgccgagggcagctctgacgaggaggggaagcttgtaatcgatgagcctgccaaagagaagaacgagaaaggtgccttaaaacgccgggccggggacctgctggaggactccccaaaacgtcctaaagaagccgaaaaccctgaaggagaagaaaaagaggctgctacccttgaagtcgaacgaccgctcccaatggaggtggagaaaaactctaccccttcagagcccggctctggccgcggacctccccaagaggaggaagaagaagaggacgaggaagaggaggcgacaaaagaggatgctgaggcccctggaatccgcgaccatgagagcttgtag

SEQ ID NO: 190558 - DNA, 771 bp, Artificial Sequence
  Description of Artificial Sequence: Synthetic coding sequence
atgcaccccgagggcggccagttcgtgccccagctgctgggccacctgcttgctactaagctgaaacggttcctgctcagcaagggaggccggcgagcacagattcctgatgtcagcagagccacaccccataccatcgatgagatgcctgaggcagccgtcaagtcaaccgctaacaaataccaggtgtttttctttggtacacatgagacagctttcctgggtcctaaggatctgttcccttatgaggagagtaaggagaagttcggtaagcccaacaagagaaaagggttttcggagggcctctgggagatcgaaaataaccctacggtaaaagcatccggctatcagagttcccagaagaagtcttgcgtagaagaacccgagcccgagccggaggccgccgaaggagacggtgataagaagggcaacgccgagggtagctccgatgaggagggcaagcttgtaattgatgaacctgcaaaagagaagaacgagaagggggccctgaagcgacgagccggggatttgctggaagatagccctaagcggccgaaggaagctgagaaccctgagggtgaggagaaggaagccgccaccctcgaagtcgagcgcccattgccaatggaagtggaaaagaactctacgccaagtgagccggggtctgggaggggcccgcctcaggaagaggaggaagaagaggacgaagaagaagaggccactaaagaagatgcagaagcacccggaatcagagaccacgaatctctgtag

SEQ ID NO: 190559 - DNA, 702 bp, Artificial Sequence
  Description of Artificial Sequence: Synthetic coding sequence
atggagcagcgggccggcggcaaccgggtgcagaccagcaccctgaactgtgcaggtgccgctgtgattgatgaaatgcccgaagccgctgtcaaatccaccgcaaataaataccaggtgtttttctttggaacgcatgaaacagccttcctgggaccaaaggacctgttcccctacgaggagagcaaagagaagttcggaaagcccaataaacgtaaaggtttcagcgaggggctttgggagatcgaaaacaacccaaccgtcaaggccagcgggtatcagagcagtcagaaaaagagctgcgttgaagaaccagagccggaacccgaagcagcagagggcgatggggacaaaaaagggaatgccgagggctccagtgacgaagagggcaagttggtcatcgatgaaccggctaaagaaaagaacgagaagggagccctcaaacgtagggcgggagacctgttggaagactctcctaaacgccccaaggaggctgagaacccggaaggggaggaaaaagaagctgctacactggaggtggaacggcccctacctatggaagtggagaaaaattctacaccctcagaacccggtagcggccgtggtcctcctcaggaggaggaagaagaagaagatgaggaggaagaagcaacaaaagaggacgccgaggcccccggtatccgcgatcacgagagtctgtag

SEQ ID NO: 190560 - DNA, 789 bp, Artificial Sequence
  Description of Artificial Sequence: Synthetic coding sequence
atgagccggagcaaccggcagaaggagtacaagtgcggcgacctggtattcgccaagatgaaggggtacccgcactggcccgctagaatcgatgaaatgccagaagccgcggtcaaatctacggccaacaaataccaagtttttttttccggtcccacccgcagacattcctgggcccccaaaactagctcactgaccagaaacccaagacgctccctcgctagccctaccagaggtaaaggctctgctcggggctgcggacgatcaaggacaacattgttatcacggctgcccgccatcagtcccccgccatcctgcaccgaaccttgcttgcctggtcagtgggtttatccgggcgcgaaccccacggagagctctcagaaaaaaagttgcgtcgaggaacccgaacccgagcccgaagccgcagagggagacggcgataagaaaggcaatgctgaggggtctagtgatgaggagggcaagctagttatcgacgagcctgctaaagaaaaaaacgagaaaggtgccctcaagaggagagctggcgacctgctggaagattcacccaaaaggccaaaggaggcagaaaaccctgagggtgaggagaaggaagctgcgactctggaggtcgaacgaccgctgccaatggaggtggaaaagaattcgaccccctcagagccaggcagcggacgggggcccccccaggaggaagaagaggaagaagatgaagaggaagaggctactaaggaagacgctgaggcgcccggaatccgcgaccacgaaagatag

SEQ ID NO: 190561 - DNA, 627 bp, Artificial Sequence
  Description of Artificial Sequence: Synthetic coding sequence
atgcccgaggccgccgtgaagagcaccgccaacaagtaccaggtgttctttttcgggacacacgagacagcattcttggggccgaaagacctctttccctacgaagagtcaaaagaaaagtttggaaagccgaacaaaagaaagggcttttccgaaggcctttgggaaatcgaaaacaatcccaccgttaaggctagcggttatcaatcttcacaaaagaaatcttgcgtagaggagcctgaaccagagcctgaggccgcggagggagatggcgataagaaggggaacgccgagggcagcagcgatgaggagggcaaactggtaattgatgaaccagcaaaggagaagaacgagaagggtgcacttaaacgccgcgccggagacctgctcgaggattcccccaaacgacctaaggaggccgagaaccccgagggcgaggagaaggaggctgcaaccctggaagtggagaggcccctgcccatggaggtagagaaaaacagcacgccctcagaacccggctcgggaagagggccaccacaggaagaagaggaggaagaggacgaggaggaggaggcgacaaaagaagatgccgaggcacctgggatcagggaccatgagagcctgtag

SEQ ID NO: 190562 - DNA, 723 bp, Artificial Sequence
  Description of Artificial Sequence: Synthetic coding sequence
atgagccggagcaaccggcagaaggagtacaagtgcggcgacctggtgttcgcaaaaatgaagggttacccacattggcccgcccggatcgacgagatgccggaagccgcggtcaagtctactgccaacaagtatcaagtcttttttttcggcacccatgagacagcatttcttgggccaaaggatctgttcccttacgaagaaagtaaggaaaaatttggaaagcccaataaaaggaaggggtttagtgagggcctgtgggaaattgagaacaaccccaccgttaaggccagcggataccagtcctcccaaaaaaagagttgcgtggaggaacctgagccggagcccgaggcagcagaaggcgatggcgacaaaaaaggtaacgccgaggggtcctctgacgaggaaggaaaactagtgattgatgaacccgccaaggagaagaacgagaaaggagcattgaagcgccgcgccggcgatctgctggaagactcacctaaacggcctaaggaggctgagaaccccgaaggagaggagaaagaagcggcaacacttgaggtggaaaggccactgccaatggaagtcgaaaagaacagtaccccatcagagcctggctccggacgtggaccccctcaggaagaagaggaggaggaggatgaggaggaggaggccaccaaagaagacgccgaggctcccggcatcagggaccacgaaagcctatag

SEQ ID NO: 190563 - DNA, 2676 bp, Artificial Sequence
  Description of Artificial Sequence: Synthetic coding sequence
atgcacgccatcaacggcttcgtgttcggcaacctgcccgagctgaacatgtgcgcacagaaacgggtggcttggcatctatttggtatgggtaatgagatcgacgtccacactgcattcttccacggccaaatgctaactactcgtggccatcatacagatgtggccaatatatttcccgcaacttttgttaccgccgaaatggtcccctgggaaccagggacatggcttatctcctgccaagtgaactctcacttcagggacgggatgcaggcactgtacaaggtcaagtcttgctcaatggcccctccagttgacttgctcactggaaaggtccgccagtactttattgaggcgcatgagatccagtgggattatgggcccatgggacacgacgggtcaacagggaaaaacctccgagaacccgggtccatcagcgacaaatttttccagaaatcatctagccgtattggcggcacgtactggaaagttcgatatgaagccttccaggatgagacttttcaggaaaaaatgcatttagaagaagaccgacacctgggaatcctgggacccgtgatccgcgcagaagtgggggacaccatccaggtggtattttataacagagcgagtcaaccattttcaatgcagccacacggggtgttctatgaaaaggactacgaggggaccgtgtataacgatggttcaagctaccccgggttggtggcaaaaccctttgagaaggtgacataccgatggacagtgccccctcacgctggcccaacagctcaggatcccgcatgtttgacttggatgtacttttccgcggcggatccaatccgcgataccaacagtggcttggtaggaccattactcgtctgccgcgctggcgccctgggggcagatggtaagcaaaagggggtggacaaggaatttttcctgctctttacggttttggatgaaaataaatcctggtattcgaacgctaaccaggccgctgccatgctggatttccgcctgctgagcgaggatattgagggttttcaggactctaacagaatgcatgccattaatggttttctgttcagcaatctgccacgcctcgacatgtgtaagggtgacaccgttgcctggcatctgcttggcctgggaactgaaacggatgttcatggtgtgatgtttcaagggaataccgtacaactgcaaggcatgagaaagggagcagccatgttgtttccccatacgtttgtcatggcaataatgcagcctgacaatttagggaccttcgagatctactgtcaggccggctcccaccgcgaggctggcatgcgggccatttataacgtcagccagtgtccgggacatcaagcaactcctcgtcagcggtaccaggccgcccggatctactacataatggcagaggaggtggaatgggactactgtcctgaccggtcatgggaaagggaatggcacaatcagtcagaaaaggacagttatgggtacatattcctatcaaacaaggatgggctgttgggatcgcgctacaaaaaagccgtgttcagagaatatactgatggaacctttcggatcccccgtccgcggaccgggccagaagagcatctcggaatcctggggccactgatcaagggtgaggtgggggacatcctgacagtcgtcttcaagaataacgcctcaagaccatattccgttcatgcccacggtgtcctggagtccacaaccgtgtggcccctggctgctgaaccaggggaggtcgtgacatatcagtggaacatccccgagaggtcaggcccagggccaaatgactccgcctgcgtgtcctggatttactacagcgccgtggacccaataaaggatatgtactcaggcctagtggggcccctggcaatctgtcaaaaaggtatcctggagccccacggaggccgctctgatatggaccgggaattcgccttgctctttcttatcttcgacgaaaataaatcttggtaccttgaagaaaatgtggcgacgcacggatctcaggatccaggttccattaatctgcaagatgagactttcctagagtctaacaagatgcacgcgatcaacgggaagctgtacgccaatctaagaggtctgactatgtaccagggcgagcgcgttgcttggtatatgctggctatggggcaagacgttgacctgcataccatccatttccacgctgagagctttttatacaggaacggcgagaattatagagcagatgtcgttgacctttttcctgggacttttgaggtggtggagatggtcgcttccaatcccggcacctggctgatgcactgtcacgtcactgatcacgtgcacgccggcatggaaaccctcttcaccgttttttcccggaccgagcacctgtctccattgactgtcattaccaaggaaaccgagaaggctgtcccccccagggatattgaggagggcaatgtgaagatgcttggaatgcagataccaatcaagaacgtagaaatgctcgcgtccgtgctggtggctatatccgtaaccctgctgctcgtcgtcttggccctggggggcgttgtctggtatcagcaccgacaacggaaactgaggaggaatagacgttctatcctagacgactctttcaaactgctgtcatttaaacaatag

SEQ ID NO: 190564 - DNA, 3477 bp, Artificial Sequence
  Description of Artificial Sequence: Synthetic coding sequence
atggagagcggccacctgctgtgggccctgctgttcatgcagagcctctggccccaactcactgacggcgcaactagagtgtattacctgggaatccgggatgtccagtggaattacgccccaaaagggaggaatgtgatcacaaaccaaccgttagatagcgacattgtggccagcagctttttaaaatccgacaaaaacagaatcgggggcacatacaagaagacaatctacaaagagtacaaagacgactcctacacagatgaggtggctcagcccgcctggctcgggttcctcggccctgttctccaagccgaggtcggtgatgtgatcctgatccatctgaaaaactttgcaacccgcccatatactattcatccacacggagttttttacgagaaggactcagagggctctttatacccagacgggtccagcggccctcttaaagcagatgactctgtgcctcccggcgggtcacatatctacaactggacgattccagagggccacgcccccacagatgctgatcctgcttgcctgacctggatctaccactcccacgtcgatgcacctagagacattgctaccggactgatcggacctctgatcacctgcaagaggggtgctctagacgggaattctcctccgcagcggcaggatgtggaccatgactttttcttgctgttctcagtcgtggatgagaatctgtcttggcacctgaatgaaaatatcgcaacctattgctccgatcccgctagtgtggacaaggaagacgaaactttccaagagtcaaatcgcatgcatgctataaatggctttgtgtttggcaatctgccagaacttaatatgtgcgcccagaagcgcgtcgcttggcacctgttcggaatgggaaatgagatcgacgttcatacggctttcttccacgggcaaatgctgactacccgtgggcaccataccgatgtggccaacatattcccggcgactttcgtgactgccgagatggtgccctgggagcccggcacttggttaatctcatgtcaggtaaacagccatttccgagatggaatgcaagctctttacaaagtgaaaagctgttccatggccccccctgtcgacctgttgactgggaaagtcaggcagtactttatcgaagcacacgagatccaatgggactatggtcctatggggcatgatggatctacagggaagaatttgcgggaacctggcagcattagtgataagtttttccagaaatccagctccagaatcggaggaacttactggaaagtgaggtacgaagcttttcaggacgagacgttccaggagaaaatgcacctcgaggaggaccgccacctgggaatcttgggtcctgtgatccgggccgaggtaggagacactatacaggtggttttctacaatcgcgcctctcaaccattctccatgcagccccacggagtgttttatgagaaggattacgagggtacagtgtataatgatgggagctcctatcctggtctcgtggccaagccgtttgaaaaagtgacctacaggtggacagtgcccccccacgctggcccaacagcccaggatccagcatgtcttacctggatgtacttttctgcagccgacccgatccgggacacgaacagtggcctggttggccccctcttagtgtgtagggctggagctctgggcgccgacggaaagcagaaaggagtggataaagagtttttcctgctgttcaccgtcctcgatgaaaacaaatcttggtacagcaacgccaaccaggccgctgcaatgttggacttccgcttgctttccgaggatattgaaggattccaggatagcaatcggatgcacgctatcaatggatttctcttctcaaacttgcctcggctagatatgtgcaagggggatacagtggcttggcacttattaggcttaggcaccgagacagacgtccacggtgtgatgtttcagggtaatacagtgcaattacagggcatgcggaaaggcgcagctatgctgtttccgcatacttttgttatggcaattatgcaaccagacaacctggggactttcgaaatttattgtcaggctggctctcatcgggaggccggcatgcgcgccatttacaacgtttcccagtgccctggacaccaggcaacccctcggcagaggtatcaagccgctagaatttactacatcatggctgaggaagtggaatgggactattgtcctgatagatcctgggaaagagagtggcacaaccagtcagaaaaagattcttatggctacatcttcctttccaataaagacgggctattgggctcaaggtacaaaaaggccgtgttccgtgaatatacagacggcacatttagaattcctagacccagaactggaccggaagagcacctgggtattctcggccctctgatcaaaggcgaggtgggggatattctcaccgtagtattcaaaaataatgcctcacgcccttatagtgtgcacgctcacggcgtcctcgagtccacaacagtctggcccctagcagctgagcccggcgaagtggttacgtatcagtggaacatcccagaacggtccggcccaggacctaacgatagcgcttgtgtctcgtggatctactacagtgcagtcgatcccattaaggacatgtacagcggcctagtaggcccccttgctatatgccagaaaggaatcctcgagccccacgggggacgcagtgatatggacagagagttcgccctgctcttcctgatctttgatgaaaacaaatcatggtacctcgaggagaacgtggccacacacggttcgcaggatccaggatctattaacctccaagacgagacctttttagaatccaacaagatgcacgccatcaacggtaagctgtatgctaacttacgaggccttacaatgtaccaaggagagcgggttgcatggtacatgctcgcaatgggacaggacgtggacttacatactattcactttcacgccgaatcctttttatacagaaatggcgagaattaccgggctgacgtcgtcgacctattccctggaacatttgaggtagtggaaatggtcgcttccaatcctggcacgtggctgatgcactgccacgtgaccgaccatgtgcatgccggcatggagaccctctttacagtcttctctcgtacagagcatctgagtcctctcaccgtaatcaccaaagaaaccgaaaaggcggttcctccacgggacatagaggaaggtaatgttaaaatgctgggcatgcaaatccccataaaaaatgtcgaaatgcttgcgtcagtcttggttgctatttcagtgacgttactgctcgtggtcctcgccctgggcggagtggtatggtaccagcaccgacagcggaagcttcgaagaaaccgcaggagcattctggatgacagcttcaaactgctctccttcaaacagtag

SEQ ID NO: 190565 - DNA, 3486 bp, Artificial Sequence
  Description of Artificial Sequence: Synthetic coding sequence
atgtgggccatggagagcggccacctgctgtgggccctgctgttcatgcaaagcctttggccacagcttacagatggtgccacccgcgtgtactacttggggattcgcgacgtccagtggaactatgctcccaagggtagaaatgttattactaatcagccgctggactcggatattgtagctagcagtttcctcaagtctgataaaaaccgcataggcggtacatacaagaaaacaatctataaggagtataaggacgactcatataccgacgaggttgcccagcccgcctggttgggcttcctcggacctgtgctgcaggccgaagtaggagatgtgatccttatccatctcaagaatttcgcaacccgaccatatacaatccacccccatggagtcttttatgagaaggatagcgagggcagcttgtatcccgatggcagttccgggcccctgaaggccgatgactcagtgccaccaggtggcagccacatttacaactggactatccccgaagggcatgctccaacagacgcagatcccgcctgtctcacatggatttatcacagccacgtggacgctccaagggatattgccaccggactgatcggacccctgatcacatgcaagcggggcgcattggacggcaacagcccccctcagcggcaggatgtggatcacgatttcttcctcctattttccgtggtcgatgagaacctgtcctggcatctgaacgaaaatatcgccacatactgctccgaccccgcatccgtggataaggaggacgagacattccaagagtccaatagaatgcacgcaattaacggattcgtgtttggcaacctgccggaattgaacatgtgtgcgcagaagcgagtagcatggcatctgtttggcatggggaacgaaatcgatgtccatactgccttctttcatggacagatgctgacaacccgcggccaccacaccgatgtcgcaaacatattcccagcaaccttcgtgacagcagaaatggtgccatgggaaccagggacgtggttgattagttgccaggtaaattctcatttccgggacggcatgcaggctctttataaggtcaagtcttgtagcatggctcccccagtggatctgcttaccggaaaagtgcgccaatacttcatcgaggcacacgagatccagtgggactacggaccaatgggccatgacgggtccactgggaagaatttaagagaaccgggtagtataagcgacaaattttttcagaaaagcagtagcaggatcggaggaacctattggaaagtgcggtatgaggcctttcaggatgaaacttttcaagaaaagatgcaccttgaggaggacaggcaccttgggattctcggcccagtcatcagggctgaagtcggcgacacaatccaggtggttttttacaacagagcgtcgcagccctttagcatgcagcctcacggggtgttctatgagaaagactatgaaggcactgtgtataatgatggatcctcgtaccccggccttgtggcaaaaccattcgagaaagtgacctaccgttggacagttcctccacatgccggccccaccgcccaggatcctgcttgcctgacatggatgtacttctccgccgctgatcctattcgggacacaaactccgggctggtgggtcccttgctggtctgtcgcgcaggagccctgggtgccgacggcaagcaaaaaggcgttgacaaggagttcttcctgctgttcacagtacttgatgaaaataaatcctggtattcgaacgcaaaccaggctgccgcgatgctagacttccggctgctctctgaagacatcgaggggttccaggattccaatagaatgcacgccatcaatggatttttgttctctaacctgccaaggctggatatgtgcaagggtgacactgtggcttggcacctgctggggctggggaccgaaaccgatgtccacggggtgatgttccaggggaataccgtccaactgcaaggaatgcgaaaaggagccgcgatgctctttccacacacttttgtaatggctatcatgcagccagataaccttggcaccttcgagatttattgccaggccggttctcacagagaagcgggaatgcgcgcaatctacaatgttagccagtgcccagggcatcaggccacccctaggcaaaggtaccaggcagcgcgcatttactatatcatggctgaagaagtggaatgggattactgtcctgataggagctgggaaagggaatggcataaccagagcgagaaagactcctatggatatatttttttgtctaacaaggacggcctgctggggtccagatacaagaaggccgtattcagagagtacacggacggcacctttagaattcctcgaccaaggacaggcccagaggaacatctgggaatccttggacctctgattaaaggcgaggtgggcgacatactcactgtagtgttcaaaaataatgcttctcgtccctattcagtgcacgcccatggggtgctcgagtctacaactgtgtggcccctagccgcagagcctggggaggttgttacttatcagtggaatatcccggaacgcagcggcccagggcctaatgattccgcgtgtgttagttggatttattactctgccgttgatccaatcaaggatatgtattcagggctggtgggtcccttggccatctgccaaaaagggatcctggagccgcacggcggtcggtcagacatggatagagaattcgcacttttattccttatatttgatgagaacaagtcatggtatctggaagaaaatgttgccacccacggttcacaggatcctggctcaataaacttgcaggacgaaacctttctggagagtaataaaatgcacgctatcaatggcaagttatacgccaacctgaggggacttacaatgtaccagggagaaagggtggcatggtacatgctggcgatgggacaggatgtcgacctgcatactatccacttccacgccgagtcctttctgtatcgcaatggcgagaattatagagcggacgtggtcgatcttttcccaggcaccttcgaagtggtggaaatggtggccagcaatcccgggacatggttgatgcattgtcatgtaacagaccatgtgcacgcagggatggaaactctgtttacagttttctcccgaactgaacacctctcccccctcactgtcattaccaaggagactgaaaaagctgtgccaccaagagacattgaggaaggtaacgtcaaaatgctgggcatgcagattccgataaagaatgttgaaatgctggcatcagtccttgtggccatctcagtcacgttactcctggtagtcctcgctctcgggggtgtggtgtggtaccagcacagacagcgtaagcttagaagaaacaggcgttctatcctagatgattccttcaagctattgtccttcaagcagtag

SEQ ID NO: 190566 - DNA, 2910 bp, Artificial Sequence
  Description of Artificial Sequence: Synthetic coding sequence
atgtgggccatggagagcggccacctgctgtgggccctgctgttcatgcagtctctgtggcctcaattgacggacggtgcaaccagagtctactatctggggataagggatgtgcagtggaactatgcaccaaaggggcgcaacgttattactaaccagcccttggattctgatatagtggcctcgtcattcctgaagtctgacaaaaaccgcattggaggaacctacaaaaagacgatttacaaagaatataaagatgactcctataccgacgaagtggcccagcccgcatggctgggtttcttgggccccgtgctacaggcagaggtgggagatgtgattctgattcacctaaagaatttcgcgactagaccgtacacgatccatcctcacggggtattctatgagaaagacagcgagggatccctttacccggatggctctagtgggccacttaaggccgatgactccgtgcctccgggtgggtcacacatttacaattggactataccggaaggtcacgcacctacggatgcggatcccgcttgcctaacctggatttaccacagccacgtagatgcccctcgcgacatcgctacaggcctgatagggccgctcatcacctgcaaacggggagctctcgatggaaactcccccccacaacgtcaggacgtcgatcacgatttctttctgttgttcagcgtggtcgatgaaaatctgtcctggcacttaaacgagaacatcgctacatattgttcggatcctgcgagcgtggacaaggaggacgagacatttcaggaatcaaatcgtatgcacgccatcaatggattcgtcttcgggaatctgccagagttgaacatgtgcgcccaaaaaagggtggcttggcacctttttggcatgggaaatgaaatagatgtccataccgcattttttcatggccagatgctgacaaccaggggtcaccatacggatgtagccaatatttttccggccacctttgtaacggcagaaatggtgccctgggagccggggacatggctgatcagctgccaggtgaattctcattttagggatggcatgcaggccctgtataaagttaagagctgctcaatggcacctcccgtagatctcctgacaggaaaagtgaggcaatatttcatcgaggcacacgagatccagtgggattacggcccaatgggtcacgacggtagcacaggaaagaaccttcgcgaacccggtagtataagcgataaattttttcagaagagctcctcaaggatcggggggacctattggaaggtgagatacgaagccttccaggacgagaccttccaggagaagatgcacctcgaggaagacagacacctgggcattctgggacctgtcattcgggcagaagtgggggacacaatacaagtggtgttttacaatagggcctcgcaaccattcagtatgcagccacacggggtcttctacgaaaaggattatgaagggacagtgtataacgacggcacattcgaaatctactgtcaagccggttcacaccgtgaagcaggaatgcgggccatttataacgtctcccagtgccctgggcatcaggcaaccccccgccagcggtatcaggctgcccgcatttactacataatggccgaggaggtcgagtgggattactgccccgaccgatcatgggaaagggaatggcacaatcagtctgagaaagactcatacgggtatatctttctctccaataaggacggcctcctggggtccagatataagaaagccgtcttcagggaatacacagatggcaccttcaggatcccacgcccccgtacagggccagaggagcacctcggaatcttggggcctttgattaagggggaggttggcgacattctaaccgtagtcttcaagaataatgcctcacggccctatagcgtgcatgcccatggggtgctggagtctacaacagtctggcctctggcggcagagcccggggaggtggtcacatatcagtggaacatccccgaacgctctggacccggacctaacgactctgcctgcgttagttggatttattattcggccgtggacccaattaaggacatgtactcgggcctggtaggcccacttgcgatctgccagaagggtatactggagccccatggcgggaggagcgacatggatcgcgaatttgcactcctgtttttaatatttgatgaaaataagtcctggtacctggaggagaacgtggcaacccatggctcccaagaccccggctccatcaacctgcaagacgaaactttcctagaatcaaataagatgcatgctattaacggaaaactgtacgctaacctgcgcgggctgactatgtatcaaggtgagagggtggcctggtatatgttggcgatgggccaggacgtggatctgcacaccatccatttccatgccgagtcattcctctacaggaatggcgagaactaccgagctgatgttgtggatctgttccctggcacattcgaggtcgttgagatggtggcctccaaccccggtacatggctcatgcattgtcatgttaccgaccatgtgcacgcaggcatggaaacactgttcaccgtgttcagtcgcaccgagcatctgtctccgctaactgtcatcacaaaggagaccgagaaggctgttcctcccagagacattgaggaaggcaacgtaaagatgctcgggatgcagatccctattaagaacgtcgagatgcttgcttctgtgttggtagctatatctgttacactgctgcttgtggttctcgctctcggcggtgttgtctggtatcagcatcgacagcgcaagcttcggaggaaccggcggtccatcctcgacgatagcttcaagctgctgtcctttaagcagtag

SEQ ID NO: 190567 - DNA, 2436 bp, Artificial Sequence
  Description of Artificial Sequence: Synthetic coding sequence
atggagagcggccacctgctgtgggccctgctgttcatgcagagcttgtggcctcagcttactgacggagcgaccagagtgtattaccttggtatccgggatgtgcaatggaattacgcccctaagggtcgtaacgtgattaccaaccaaccattggattccgatatcgtcgcttcttctttcctgaagtcagacaagaataggattggggggacttataaaaagaccatttacaaagagtataaagatgactcctacacagacgaagttgctcagccagcatggctgggatttctgggccctgtgcttcaggccgaggtaggcgacgtcatcctgatccacttaaaaaatttcgctaccagaccatacaccatccatccccatggcgtattttatgagaaggactccgaaggttctctgtaccccgacggtagttccggccctctcaaggccgacgattccgtgccgcccggaggtagccacatttacaactggactattcccgaaggccacgctcctaccgacgccgaccccgcctgtctcacctggatctatcactcacacgtagacgcccctagggatatcgcgaccggcctgatcggtcctctcataacttgtaagaggggagcactcgatggtaattcgccccctcagaggcaggacgtagatcacgactttttcctcctgttttcagtggtcgacgaaaatctgtcttggcatcttaacgagaatatagcaacatattgctcagatcccgcttccgtggataaggaagacgaaactttccaagagtctaaccgcatgcacgccataaacggctttgtgttcgggaacttgcctgagctgaatatgtgtgcccagaagagagtggcatggcacttgttcggcatgggtaatgagatcgatgtccataccgcctttttccatgggcagatgcttacaactcgggggcatcacactgatgttgccaacatcttccctgctaccttcgtcaccgccgaaatggtcccttgggagcctggaacatggttgatttcctgccaagtgaactcccacttcagagacgggatgcaagccctctacaaggtgaaaagttgttccatggctccaccggttgatcttctcacaggtaaagttcgccagtacttcattgaagctcatgagattcaatgggattacggtcccatgggacacgacggctccacaggcaagaatttaagggagccaggcagtattagcgacaaattctttcagaagagctcttcgcgcatcggggggacctactggaaagtaagatacgaggctttccaagatgagactttccaggagaaaatgcatctggaagaagacaggcacctgggtatcctgggacccgtcatccgggcggaggtgggtgatactatacaggttgtcttctataatagggccagccagcccttttcaatgcaacctcatggcgtgttctatgaaaaggattacgaggggactgtctacaatgacgatcccatccgggacactaattccggcctggtgggtcctctcctagtgtgtagggccggagcattgggtgcggatgggaagcagaagggtgtcgacaaggagtttttcctgctctttacagtgctggacgaaaacaaatcttggtatagcaatgctaaccaggccgccgcgatgctggacttccggctcctgtccgaggatatagaaggatttcaagactccaatcggatgcacgcaataaacggttttcttttttcaaatctcccccgccttgatatgtgtaaaggagacaccgtcgcctggcatctcttaggacttggcactgagacagatgttcatggggtcatgtttcaggggaacactgttcagctgcagggcatgcgcaaaggagcggctatgctatttccacatacgttcgtgatggcgatcatgcagccggataatctgggcacatttgagatctattgtcaagctggctcgcaccgcgaagcgggcatgagggccatttacaacgtttctcagtgccccggccaccaggcaaccccccggcagcgctaccaagctgcgaggatctactacataatggccgaagaagtcgaatgggactattgccctgacaggtcatgggaacgtgagtggcataaccagtctgaaaaagacagctatggctacatcttcttgtccaacaaggacggattgttgggcagcaggtacaaaaaagccgtgtttagggagtacaccgatggcaccttccggataccccgcccacgcaccggacccgaggagcatctcgggatactggggccgttaataaaaggagaagttggggacatactgacggtggtctttaaaaacaacgctagtcgcccatacagtgtgcacgctcatggggtgctggaaagtaccacagtttggcccctggctgctgaaccttag

SEQ ID NO: 190568 - DNA, 3483 bp, Artificial Sequence
  Description of Artificial Sequence: Synthetic coding sequence
atgtgggccatggagagcggccacctgctgtgggccctgctgttcatgcagagcctatggccccaactcactgatggcgcaaccagggtgtattatctggggatacgcgatgtccagtggaattacgctccaaaaggtagaaatgttatcactaatcaaccactggattcagacatagtcgcttcgtccttcctcaagtcagacaagaaccggattggcggtacatacaagaaaacaatttacaaagagtacaaagatgactcctacaccgatgaggtggcacagcccgcatggctgggattcctgggtcccgttctccaggcagaggtgggagacgtgattctgattcacctcaagaattttgctacgcgtccatacaccatccatccacacggcgtgttctatgaaaaagattccgaaggcagcttatacccagatggctcatcaggccctctgaaggccgatgattcagttcctccaggaggtagtcatatctacaactggaccattcctgaagggcacgcacccaccgatgctgacccagcatgtctgacctggatctaccactcacacgttgacgcccctcgcgacatcgccactgggctgatcggcccacttataacttgcaaaaggggtgcactggatggcaactccccaccccagcgccaggacgtcgatcacgactttttcctgctctttagcgtggtggatgagaatctgtcatggcacttgaacgaaaatatcgctacctactgttccgaccccgccagtgtggataaggaagacgagacattccaggagagcaaccgcatgcacgccattaatggcttcgtctttggcaatcttcctgaactgaacatgtgcgctcagaaaagggttgcatggcacctgttcggcatgggaaacgaaatagatgtccacacagctttcttccacgggcaaatgctgacaacgcggggtcaccacaccgatgtcgccaatatctttcctgccacgttcgtgacagccgaaatggtaccatgggaacccggtacgtggcttataagctgccaggtgaattcacactttagagatggcatgcaggccttgtataaggtgaagtcctgtagcatggctccccctgttgatcttctcaccggaaaagtgcggcagtactttatcgaagctcatgaaatccagtgggattacgggcccatgggtcacgacgggtccacagggaaaaacctcagagaaccaggaagcatttcggacaagttcttccaaaagtcatcctcacggattggtggtacgtattggaaggtccggtatgaagctttccaagacgagacctttcaagaaaagatgcatctcgaggaggataggcacctaggcatcctgggaccagttatccgagctgaggttggagatacgatccaggttgtcttttacaacagagcaagccagccattcagcatgcagccccacggggtcttttatgagaaggactatgagggcacagtgtataatgatggctcgtcctaccctggtcttgtggcaaagccttttgaaaaggttacataccgttggactgtcccaccacatgctgggcccacagcacaagatccagcatgcctgacgtggatgtacttcagcgctgctgaccctatcagggacaccaacagtggtctggtgggtcctctcctcgtttgccgggcaggagccctcggagccgacgggaaacaaaagggggtcgataaggagttctttttgctgtttactgttctggatgagaataaaagttggtacagcaatgccaatcaagctgcggccatgctggactttagactgctgtccgaggacatcgagggatttcaagactccaacagaatgcacgctattaatggcttcctcttttccaacttaccaagactggatatgtgtaaaggggacaccgtggcctggcatctgctgggcctgggaactgaaacggacgtgcacggagtcatgttccagggcaatactgtacaattgcagggcatgcgtaaaggcgcggctatgctgtttccccacacctttgtgatggccattatgcagcctgataatctcgggaccttcgagatctattgccaggctggatctcatagagaagccggcatgagggcaatctacaatgtgtctcaatgtccgggtcaccaagccaccccacggcagcgatatcaagccgctagaatttactacattatggccgaggaggtggagtgggattactgtccagatcgaagctgggaacgggagtggcataaccagagcgaaaaggacagctacgggtacatctttctgtcaaacaaggacggactgctcggatcacggtataaaaaagctgttttccgagagtacactgacggaacattcaggatacctcgccccagaacggggccagaggaacacttaggcattctaggaccactcatcaaaggggaggttggggacatcctgactgttgtcttcaagaataacgcctcccgcccctactccgtccatgctcacggcgtcctcgagagcacaacagtatggccactcgccgccgaacctggcgaggtagtaacataccaatggaacatccccgaaaggagcggccctggccccaacgactctgcctgtgtatcgtggatttattatagcgccgttgaccctatcaaagatatgtactcaggactggtcggcccgctcgccatctgccagaagggcatcctcgagccacatggtggccgctcagacatggatcgcgagtttgcactgctgttcctgattttcgatgaaaacaagtcctggtacctggaagagaacgtggccacgcatggctcgcaggatccaggctctataaatctgcaggacgagaccttcttggaatccaacaagatgcatgccattaatgggaagctctatgcaaacctgcgcggattaacaatgtaccagggggaaagagtggcatggtacatgctcgccatggggcaggacgtggatctccataccatccacttccacgcagaaagtttcctttacaggaatggcgagaactaccgcgcagacgtggtagacctctttcctggaacatttgaggtggtcgagatggtggcttcaaaccctgggacatggcttatgcactgccacgtaacagaccatgtgcacgcaggcatggaaacgctgttcacggtattctcccggactgagcatctgagtccactgaccgtgattaccaaagagaccgagaaagttcctccacgagatatagaagagggcaacgtcaagatgctgggcatgcaaatcccaatcaaaaacgtcgaaatgcttgctagcgtgcttgtcgcaattagcgtgactctgctattggtggtcctggcccttgggggagtcgtgtggtaccaacatcgtcaaagaaagcttaggcgtaatagacggtctatattagatgattcatttaagttgttgtcatttaaacagtag

SEQ ID NO: 190569 - DNA, 627 bp, Artificial Sequence
  Description of Artificial Sequence: Synthetic coding sequence
atggagagcggccacctgctgtgggccctgctgttcatgcagagcctgtggccacaattgactgacggggcaacacgcgtatattatctgggaatccgggacgtgcaatggaactatgcaccaaagggaagaaatgtgattacgaatcagccactcgattcggacatcgtagcgtcaagttttctgaaatccgacaagaaccggataggaggaacatacaaaaagacaatctacaaggaatataaagacgacagttacactgacgaggtggcccagcccgcgtggctgggcttcttgggccccgtgcttcaggccgaagtgggcgacgtcatcctgatccatctgaagaactttgcaactagaccatatacgatccatccccacggtgtgttttatgagaaagactctgaaggatccttgtatcctgatggaagcagcggaccactgaaagctgatgactctgttccccccggaggcagccatatttacaactggactattcccgaagggcatgccccaacagacgcagacccagcctgcctgacatggatatatcacagccatgtggacgcccccagagatatcgccacagggcttataggtccacttattacgtgcaaacggtag

SEQ ID NO: 190570 - DNA, 3639 bp, Artificial Sequence
  Description of Artificial Sequence: Synthetic coding sequence
atgacccagaccctgccctaccacctgagcctgctgaacgtgctgtttcctggaccttgcagtcgccactttaagtttcgcagggggaagtgcgcacagccagcctggaggaaagtatccgctccctcccaggaccttcttatcacaaaggttatgtgggcgatggagagcgggcaccttttatgggcgctgctgtttatgcagagcctttggccccagctaacagatggggccactcgggtgtattaccttggaatcagagacgttcagtggaactacgcccccaaggggaggaacgtgattacaaaccaacctctggatagtgacatcgtggcgtcaagttttctgaagtccgacaaaaaccggatcggaggcacatacaaaaaaacgatctacaaggaatacaaagatgacagctacacggatgaagtggcccagcccgcgtggctgggattccttggcccagttctgcaggccgaagttggcgatgtcatcctcatccacctaaagaatttcgccactcgcccatatacaatacacccacatggggtcttctacgagaaggacagcgaggggagcctctaccccgacggttccagtggtcccctgaaggccgacgattccgttcctcctggcggctcacacatctacaattggacaattccagaagggcatgctcctactgacgcagaccctgcctgcttgacttggatctaccatagccacgtggacgcgcctcgcgatatagcaaccggactgatagggccgttgatcacatgcaagcgtggagctctcgatggcaacagccctcctcaacgacaagacgtcgaccatgacttcttcctcctcttttcggtggttgatgaaaacctatcctggcatcttaatgaaaatatcgccacgtattgctcagatcctgccagcgtggacaaggaggatgaaaccttccaagaaagcaaccgcatgcacgcaataaatggcttcgtgttcgggaacctgccagaacttaatatgtgcgcccagaagagagtggcctggcatctgtttggaatgggcaatgagattgatgtgcacacagctttcttccatgggcaaatgctgacaacacgcggacatcatactgatgtcgccaacatcttcccggctacattcgtcacagctgaaatggtcccgtgggaacccgggacctggcttatcagttgtcaggtgaatagtcatttccgcgatggcatgcaggctctgtataaggttaagagctgttcgatggcaccgccagtggacctcctgactggaaaagttcggcagtactttattgaagcccatgaaatccagtgggattatggtcctatggggcacgacggcagtactggaaagaacttgcgtgaaccaggtagcatcagcgacaaattttttcagaagagctctagtcgcatcggagggacctactggaaggtacgctatgaagctttccaggacgagacatttcaggagaagatgcacctcgaagaggatcgacacctaggaatcctcggcccagtgatcagagctgaagtgggcgacaccatccaggtggtgttctacaaccgcgccagccaaccattcagcatgcagcctcatggcgtattttatgagaaagactacgaaggcactgtttacaatgacggatcatcatatcccggcctggtcgccaaaccatttgagaaggtgacttaccgctggaccgtgcccccccacgccggccctacagcccaggatcccgcctgcctcacatggatgtatttcagtgcagcagacccaattagggataccaacagcgggctagtcggcccgctcctcgtgtgcagagcaggcgccctgggggctgatggcaagcagaagggggtcgacaaagagttctttcttttattcacggtgttggacgaaaataaaagctggtattccaacgccaaccaagccgctgcaatgctggacttccgcctgctcagcgaggatatcgagggcttccaggatagtaaccgtatgcatgccatcaatggatttttgttttcaaatctgccaagattggatatgtgcaaaggtgacacggtggcctggcatctgctaggactggggactgagacagacgtgcatggggtgatgtttcagggcaacactgtccagctacagggcatgaggaagggagccgccatgctgttcccccacaccttcgtgatggctataatgcagcctgacaatctgggaacctttgaaatttattgtcaagccggttctcacagagaggccggcatgcgcgctatttataacgtgtcccagtgcccaggccaccaagccacaccgcgacaacggtaccaggccgccaggatctactatattatggcggaggaggttgaatgggactactgtcctgaccggagctgggaacgggagtggcataatcaaagcgaaaaggacagctacggctacatctttttaagtaacaaagacggcctgttgggatccaggtacaaaaaggcagtgtttagagaatatacagatgggaccttccgaatccctaggccaagaacggggcccgaggaacatttgggcatcctgggacctctgatcaagggggaggtcggtgatatcctcaccgtcgtgtttaagaataatgctagccgtccgtacagcgtccacgctcatggcgtgctcgagagcactactgtgtggcccctagctgccgagcccggggaagtggtcacataccagtggaatatacctgaaagatccggaccaggccctaatgactccgcgtgcgtctcatggatctactatagcgccgtggatcccatcaaagacatgtactccggactggtgggtcctcttgcaatatgccagaagggtatcctggagcctcatggtgggcgatccgacatggaccgggagtttgccctccttttccttatctttgacgaaaacaaaagctggtacctggaagaaaacgtggcaacacatgggagtcaggatcctggatcaatcaatctgcaggacgagacttttttagaaagcaataaaatgcacgctatcaacggcaaactgtatgcaaacctgcggggcttaactatgtatcagggagagcgcgtagcctggtatatgctagctatgggacaggatgtcgatttgcatacaatccattttcatgctgaaagcttcctctacagaaatggcgagaactatcgggctgacgttgtggacctttttcccgggaccttcgaagtggtggagatggtggcttcgaaccctggcacctggctgatgcactgccatgttactgaccacgttcacgccggaatggagacactgttcaccgtgttctctcgcaccgagcacctgtctccgctcaccgtcattacgaaggagactgagaaagccgtaccaccaagagacatagaagaagggaacgttaagatgctgggcatgcaaatccccatcaagaatgtagagatgctggcctccgtgcttgtggcgataagcgtgactctgctgctggtcgtgctcgctctcggcggcgtggtatggtaccaacaccgccagcgaaaactgcgcagaaatcggagaagtatcctggacgacagtttcaagctcctctcatttaagcaatag

SEQ ID NO: 190571 - DNA, 1254 bp, Artificial Sequence
  Description of Artificial Sequence: Synthetic coding sequence
atggcccagaaggagggcggccggaccgtgccctgctgcagccggcccaaggtggctgctctgactgccggaactctgctgctgttaacagcaatcggcgcagcctcatgggcaattgtcgcagtgctactgagatcagaccaggagcccctctaccccgtacaagtaagttcggctgatgcgagacttatggtgttcgataagacagaaggtacctggaggctgttatgtagttccagatcaaatgcgagagtagccggtctttcttgtgaggagatgggatttctcagagccctcacccactctgaactggacgttcgcactgctggagccaacggaaccagcggatttttctgtgtggacgaaggaaggctgcctcacactcaacgtctgttggaagtgatcagcgtctgcgattgtccccgtggcaggtttttagccgctatttgccaagattgcggtcgtagaaaactgcccgttgacaggatcgtcggcggcagagacactagcctaggaaggtggccttggcaggtgagcctgagatacgacggtgctcacctatgcggcggtagcctgctgtctggcgactgggtgctcacagccgcacactgcttcccagagagaaacagggtgctgtcacgctggagagtctttgcgggcgcagtggcccaagcctctccacatggattgcagctaggtgtgcaggccgtcgtgtatcacggtggttatttgccatttcgggaccccaacagcgaggagaattcaaacgacatagccttggtgcatctttccagccctctgcctctcactgaatacatccagcctgtgtgtttgcccgccgcgggtcaagccctggtggacgggaaaatatgcaccgtaacaggatggggaaacacccagtactatggccagcaagctggagtgctgcaggaagcccgcgtgcctataatatccaacgacgtctgcaacggcgctgacttttatgggaaccagatcaaaccgaagatgttctgtgctggataccctgagggtggaattgatgcctgccagggtgactctggcggcccgttcgtctgtgaagactcgatttccaggactcctaggtggcggctatgcggaattgtctcatggggcaccgggtgtgcgttggcacaaaaaccgggggtttatactaaagtgtcagattttcgagaatggatttttcaggccatcaagacacatagcgaagccagtggtatggtgacacaactgtag

SEQ ID NO: 190572 - DNA, 1254 bp, Artificial Sequence
  Description of Artificial Sequence: Synthetic coding sequence
atggcccagaaggagggcggccggaccgtgccctgctgcagccggcccaaggtggccgcacttaccgccgggacactgctgctcctcacggctataggggcagcttcttgggcaatagtcgccgtgctcctcagatctgaccaggagcccctgtatccagtccaagtaagcagcgcggacgccagactgatggttttcgataaaaccgaagggacttggcggctgctctgctcctccagatcaaacgctcgcgtagccggactgtcgtgcgaggaaatgggatttctcagggcactgacacacagcgaactcgacgtgaggactgccggcgctaatggtaccagtggattcttttgcgtggatgaagggagattgccccatacccagagactcttggaggtgatatccgtgtgtgattgtcctcgcggtcgttttctggccgccatttgtcaggattgtggtcgaagaaaactgcccgttgacaggatagttgggggccgcgataccagtctcggcagatggccttggcaggtctccctgcggtacgacggcgcacacttatgtggtgggtcccttctgagcggcgactgggtgctgactgcagcccattgcttcccagagagaaatagagtgctgtcgcggtggagggtgttcgctggggccgtcgctcaagcctccccccacggccttcaacttggcgtacaagctgtcgtgtatcacggaggctatctaccctttcgtgatccaaattcagaagagaactccaatgatatcgctctggtgcatttatcgagccccttacctttaacagagtatatacagcccgtttgcctcccggcagccggtcaggctttggtggatggcaaaatttgcacagtgaccgggtggggcaatacccaatattacgggcagcaggcgggtgtgctgcaagaagcccgcgttcctataattagtaatgatgtgtgcaatggcgccgacttctacgggaaccagattaaacctaaaatgttctgtgccggctaccccgagggaggcatagacgcctgccagggtgacagtggcggcccgttcgtctgcgaggactctataagcaggacaccgagatggcgcctctgcggcatcgtgagctggggaaccgggtgtgctctggctcagaaacccggcgtgtataccaaggtttccgattttagagagtggatctttcaggccattaagacacattctgaagcctcagggatggtgactcagctgtag

SEQ ID NO: 190573 - DNA, 1182 bp, Artificial Sequence
  Description of Artificial Sequence: Synthetic coding sequence
atgtgcaagatgcggacccgggaggacatgcagctgggcaacgagggtccaggcactgctttacggctgatacatctccaggttagttcagccgatgcccgactcatggtcttcgataaaacagagggcacctggagactgctgtgttcctcacgttcaaatgcccgcgttgcaggcttgtcttgcgaagagatgggattcctgcgcgccttgacccactccgaactggacgtccgaactgcaggcgctaatggcacctccggctttttctgcgttgatgaaggtcgacttccacacacgcaaaggcttctggaggtcattagcgtgtgtgactgtcctcgggggagattcctggctgcgatatgccaggactgcggacgccgcaagctccctgtggataggattgttggcgggcgggacacgtccctcggccgttggccctggcaggtaagcttaaggtatgatggggcccacctttgtgggggaagcctgctttctggagactgggtgctgaccgcagcccactgttttcctgagcggaaccgtgttcttagtcgctggcgcgttttcgcgggtgccgttgcccaggcctcgcctcacggcctccagctgggcgtgcaggctgtggtgtatcatggaggttaccttccatttagggatcccaactccgaagagaacagcaacgacatcgctctggtgcacctatcatcccctctgccacttacagagtatattcaacccgtgtgtctgccagctgctgggcaagccttggtcgatggtaaaatctgtacagtcacgggctggggaaacacacagtactatggccagcaggctggagtgctgcaggaggcaagagtgcctatcatatcgaacgacgtgtgcaacggagctgacttctacggcaatcagattaaaccgaagatgttctgtgctgggtaccccgaaggtgggatcgatgcctgtcaaggtgattctggcggcccgttcgtatgtgaggacagcatatctaggactccgcggtggagactctgtgggatcgtgagttgggggacaggatgcgccctcgctcagaagcccggtgtctataccaaagtttccgatttccgcgaatggatcttccaggctatcaaggttaaagtgggatctcggtgggagcctggatggggtagactgggtgtttag

SEQ ID NO: 190574 - DNA, 2103 bp, Artificial Sequence
  Description of Artificial Sequence: Synthetic coding sequence
atgaagtgcgtgctggtggccaccgagggcgccgaggtgctgttctattggactgaccaggaattcgaagaatccctcagactcaaattcggacagagcgaaaacgaggaggaagaacttcccgcactggaggaccaactaagcacgttattggcgccagtaattatcagcagtatgactatgctagaaaaactgtctgatacgtacacctgtttctccactgagaatggcaacttcctgtatgtgctgcacctgtttggcgaatgtttattcattgccatcaacggggaccacaccgaaagtgaaggagacttgcggcgaaaattgtacgtcctgaagtacctgttcgaagtgcactttggccttgtaaccgtcgatgggcacctgatcagaaaagagctcaggccgcccgacctggcacagagggtacagctctgggaacacttccagagtctcctctggacttacagtcggttacgagagcaggagcagtgtttcgccgtcgaagctctggagcgcctgatccacccgcagttgtgcgagctatgcattgaagcactcgaaagacacgtgatccaggccgtgaatacaagccccgagcgcggcggcgaggaggcgctgcacgcatttctgctagtgcatagtaaactactagctttctactcaagccactccgccagctctctgcgaccagctgatctactggccttgattttgctggtccaggatctgtaccctagcgagagtacggccgaggacgacatccagccctcccctcgacgcgcccggtcttcccaaaatattccagtacagcaagcgtggtcgccccacagcactggacctactggagggtcaagtgcggagaccgaaacagattccttctctctaccagaagagtacttcacaccagccccttcccctggcgatcagtctagtggtagcacaatctggctggagggcgggaccccacccatggatgcattacagattgcagaagacacactccagaccctcgtgccgcattgtcctgttccctcaggcccgcgtaggatcttcctcgatgccaatgtgaaagagagctactgccccctagtgccccacactatgtactgcctcccattgtggcaaggcattaatctggtcctgttgacacgttcaccttctgcgcctctggctctcgttttatcgcagctgatggacggattcagcatgcttgagaagaagctaaaagagggacccgaacctggggcatccctccgatcacagccactcgtgggcgacctccgacaaaggatggacaagttcgtgaagaatcgaggagctcaggagatccagagcacctggttggagttcaaagctaaggcgttttccaaatcggaacctggaagctcttgggagctcttgcaagcatgtggcaaactcaagcgacagctgtgtgcaatctatcgacttaactttttgactacggcccccagccgggggggtcctcacttaccccagcacctgcaggatcaggtgcaacgcctgatgcgggagaaattgacggattggaaagatttcctgctggttaagagccgacgaaatatcacgatggtgtcctacttagaagatttcccaggcctcgtacacttcatctacgtggatcgtacgacagggcagatggtagccccctccctgaactgtagccagaaaaccagttccgagttggggaagggaccattggcagctttcgtgaaaacaaaggtgtggagtcttattcagctggcccgaagatacctgcagaaagggtacacaacactcctatttcaagagggggacttctattgtagttactttttgtggttcgaaaacgatatgggctacaaactgcagatgattgaagttcctgttttgagcgacgactctgtgcccattgggatgttaggaggagactactatcggaagcttctgaggtactactctaagaaccggcccactgaggcggttaggtgctacgagttactggccctacatcttagcgtgatcccaacggacctgttggtgcagcaagccggtcagctggctaggcggctgtgggaggccagccgcatcccactcctatag

SEQ ID NO: 190575 - DNA, 975 bp, Artificial Sequence
  Description of Artificial Sequence: Synthetic coding sequence
atgaagtgcgtgctggtggccaccgagggcgccgaggtgctgttctactggaccgatcaggagttcgaagagagcctgcgcctgaaatttggtcagagcgaaaatgaggaggaagagcttccagcactcgaggatcagctgtccacccttcttgccccagtgatcatcagtagcatgacaatgcttgagaaactgtcagatacatatacttgcttctcaacggagaacggaaactttctgtacgttttgcatttgtttggtgagtgcctgttcattgccattaatggcgaccacaccgagagcgagggcgatttgagaagaaagttatacgtgctgaagtatctgttcgaagtccatttcggcctcgtcactgtggatggtcatctaatcagaaaagaactcagaccccccgacctggctcagcgagtgcagctgtgggagcatttccagagcctcctttggacctattcacggttgagagagcaagaacaatgtttcgccgtggaggccttagaacgcctcatccacccccagctatgtgagctctgtattgaggcactcgagcggcatgtcatccaggctgtgaatacaagtccagagcgcggtggtgaggaggctctgcatgccttcttactcgtccattctaagctgttggccttctactctagtcactctgcaagctccctccgccccgccgacctacttgcactgatactgctagtgcaggatctctatccatccgaatccactgcagaagatgatatccagccgagccctcgtcgggcccggagttcacaaaacatccccgtacagcaggcttggtccccccacagtaccggtcctacagggggctcaagtgcagagactgagactgattcgttcagcctccctgaggaatactttaccccagctccatcccctggcgatcagtcctccggagaggataggaggaaagccggtggtaataactcctag

SEQ ID NO: 190576 - DNA, 981 bp, Artificial Sequence
  Description of Artificial Sequence: Synthetic coding sequence
cggctgatccacccccagctgtgcgagctgtgcatcgaggccctggaacgccacgtgatccaggctgtcaatacatcaccagaaaggggcggagaggaggccctacacgcttttcttctcgtgcattccaaactgctggcattttattcaagccactcagcctccagcttgcgccctgctgatcttctagcactcatccttctcgtgcaagacttatatccaagcgagagcactgccgaagatgacattcaggaaacggatagtttcagtcttcctgaagagtactttacaccggcgcccagccctggcgatcagtcttctgggagcaccatttggcttgagggaggcacgccccccatggacgcgctccagattgctgaggacaccctccagaccctggtgccacactgtcctgtcccttccgggcctcgtagaatcttccttgatgctaacgtgaaagagagttactgcccccttgtgccccacaccatgtactgtctgcctctgtggcagggaattaacttggtgctcctcacaaggtccccaagcgcacccctggccttagtattaagtcagctgatggatggtttttccatgctggaaaaaaagctgaaggaagggcctgagccaggcgcttcgctgcgatcacagccactcgtgggggatctcagacaacggatggacaaatttgtgaagaaccgtggagcccaggagatccaatctacgtggttggaattcaaagccaaagctttctctaagagcgagccaggaagcagctgggagcttctgcaggcatgtggtaagctgaagcggcaactttgtgctatatatcgcctgaactttctgaccaccgccccctcgaggggaggacctcacctccctcaacacctgcaggatcaagttcagcgtttgatgcgcgagaagcttacagactggaaagatttccttctggtaaagagcagacgaaatattacaatgtag

SEQ ID NO: 190577 - DNA, 2103 bp, Artificial Sequence
  Description of Artificial Sequence: Synthetic coding sequence
atgaagtgcgtgctggtggccaccgagggcgccgaggtgctgttctactggaccgaccaagagttcgaagaaagtctacggctgaagtttgggcagtccgagaatgaagaggaagagctacccgcactcgaggaccagttgtcaaccctcctggccccggtgattatatccagcatgacaatgctggagaagttgagcgatacatacacctgctttagtaccgagaatgggaattttctgtacgtcctacacctcttcggggaatgcctgttcatcgccatcaacggggaccacacagagagcgaaggtgaccttaggaggaaactttacgtactcaaatacctgttcgaggtccacttcggcctggtaaccgtggatggccacctgattcgaaaggagctccgaccgccggatctggctcagcgtgttcaactgtgggagcactttcagagcctcctgtggacgtactcccgattaagagagcaggagcaatgttttgcagtggaagctctggaacgactgattcatccccaattgtgcgaactctgtatcgaggccctggagcggcacgtgattcaggcagtgaacacctcaccagaacgcggtggggaggaggcacttcatgcctttctactagtacactccaaacttttagctttctactcaagccatagtgcttcttctctgcggcccgcagatctgctcgctttaattcttctggtccaggatctgtaccctagtgaaagtaccgctgaagatgacatccaaccgtcacctcgcagagcccgctcatctcagaatatacctgtccagcaggcgtggagtcctcattccacgggccctacagggggcagtagcgctgagaccgagaccgactcctttagtctgccagaagagtactttacccctgcgccatcacccggagaccagtcttccgggtcgacaatctggcttgaaggggggacaccacctatggatgccctgcagatcgctgaggataccctgcagaccctggtaccacattgccccgtccctagcggtcctcgcagaatcttcttggatgccaatgtcaaggagagctattgcccactcgtcccccacactatgtactgcttaccgttgtggcagggcatcaacctggtgctgctcaccaggagtcctagtgcccctctggctctggtgctctcccaactgatggacggattcagcatgcttgagaaaaagctgaaagagggccctgaacccggcgccagtctgcgtagccagcccctagttggtgacctgcgccagaggatggataaatttgtaaaaaacagaggcgcccaagaaatccagtccacatggctcgaattcaaagctaaggctttcagtaaatcagaacccggaagttcctgggagctcttgcaagcttgtgggaaactcaagaggcagctgtgtgcaatctatcggctgaacttcctcaccaccgccccctcacggggcggtccccatctgccccagcatctgcaggaccaggttcagaggctgatgcgggaaaagttaaccgactggaaggatttcctcctggtaaaaagccgaaggaacatcacaatggttagttatctagaggacttccccgggcttgtacattttatctacgtcgatcgaacaacgggtcagatggtggccccgtcattgaattgttcccagaaaactagcagcgagttgggtaagggacctttagccgcgttcgtgaagaccaaagtctggtccctcatccagctggctagaagatacctgcagaaaggatacaccaccttgctgttccaggagggcgatttctactgcagttactttctgtggttcgagaatgacatgggatacaagctccagatgattgaagtgcccgtgctgtctgatgactctgtccccattggaatgctggggggcgactactataggaagctactgcggtactattcgaaaaaccgccctaccgaagctgttagatgctacgaactgctggccctgcacctgtccgttatccccacagacttgttggttcaacaggctggccagttagctcgccgtctttgggaagccagcagaatccccctgctttag

SEQ ID NO: 190578 - DNA, 2004 bp, Artificial Sequence
  Description of Artificial Sequence: Synthetic coding sequence
atgaagtgcgtgctggtggccaccgagggcgccgaggtgctgttctactggactgaccaagagttcgaggaaagcttaagacttaagttcgggcagagtgaaaatgaggaagaggaacttcccgccctcgaggatcagctgagcacattactggcacccgttatcatatcttcaatgacgatgctggaaaagttgtctgacacatacacctgcttctccacagagaacggaaatttcctgtatgtcctgcacctcttcggcgagtgtctttttattgcaattaacggtgaccatacggaatctgagggggatttgagacgcaagctctacgttctcaagtacctattcgaggtgcatttcgggctggttacagtggacggccatttgatacgtaaagagctgcggcctccggacctggcccagcgagtacagctctgggaacatttccaatcactcctgtggacttattcccgactcagggagcaggagcagtgcttcgcagtggaggcgctggagcgcctaatacatccccaactctgcgagctgtgtatcgaggcccttgaacgacacgtcattcaggcagtgaacacaagtccagagcggggaggcgaagaggccctacatgcatttctgttagtgcactccaagcttctggcgttttactcatctcactctgcctcctcattgcggcccgccgacctgttagccctgattctgctggtccaggacttatacccctcagaaagcaccgcagaagatgatatccaggagacagattcattctccctgcccgaagagtattttaccccagcgccttcacccggggaccaaagttctgggagtaccatctggctggaaggaggaactccccccatggatgcgctgcagatcgcagaggacactctgcagacactggtacctcactgtcccgtgccctctggacccagaaggatttttctggatgccaatgtgaaggaatcttactgcccactggttcctcacacaatgtattgtctgcccttgtggcagggcattaatctggttctcctaacccggtcgcctagcgcgcctctcgcattggtactgagtcaattgatggatggattctctatgttggaaaagaagttgaaggagggaccagagccgggggcttccctgaggtcgcaaccgctcgtgggggatctgcgacagagaatggacaaatttgtgaagaatcgtggtgcgcaggaaatccagagtacatggctcgaatttaaagctaaggccttcagtaagtctgaaccggggtcctcctgggaactgctccaggcatgtggtaaactgaaacggcagttatgcgcgatatacaggttgaacttcctcactactgctccctctagaggcgggccccaccttcctcaacatctgcaagaccaggttcaacggctcatgcgcgaaaaactaactgactggaaggatttcctgcttgttaaaagccggcggaatatcacgatggtttcctacctggaggatttccccggactagttcactttatctacgtggatcgcactactgggcagatggtagccccttcactaaactgttcccagaaaaccagttcagaattgggaaagggcccacttgctgcttttgttaaaacaaaagtgtggagcctgatacagctcgctagacgttaccttcagaaaggctacaccactcttctttttcaggagggtgacttctattgttcatactttttatggttcgagaatgatatgggctacaaactgcaaatgattgaagtaccggttctgagcgacgattccgtcccgatagggatgctaggtggagattactaccgtaaacttttgaggtattattcgaagaaccggcctaccgaagcagtgaggtgctatgagctgcttgcattgcatctgagtgttatccccacggatctgctggtgcagcaggctgggcagctggccagaaggttatgggaggcttcgcggatccctctcttgtag

SEQ ID NO: 190579 - DNA, 480 bp, Artificial Sequence
  Description of Artificial Sequence: Synthetic coding sequence
tgactgcggccccccgacctggcccagcgggtgcagctgtgggagcacttccagagtctcttgtggacttattcgcgattgcgcgaacaagaacagtgctttgctgtggaggctttagagcgtctgatccatccccagctttgtgagttatgcattgaagctctggagcgacatgtcattcaggcagttaacacttctccggagaggggcggtgaagaggcactgcatgccttcttattggtacattcaaagctgctcgctttctacagttcccactctgcctcatcgctacgaccagcagacctcctcgctctgattttactggtgcaggacctgtatccctcagaaagcacagctgaagatgatatccaggagacggacagcttctccctccccgaagaatactttacacccgccccttccccgggagaccagagctccggggaggataggcggaaagctggtggtaacaattcttag

SEQ ID NO: 190580 - DNA, 3015 bp, Artificial Sequence
  Description of Artificial Sequence: Synthetic coding sequence
atggtgcagctgtacaacctgcaccccttcggcagccagcaggtggttccatgcaaactggaacccgatagattctgcggcgggggacgggacgccctgttcgtcgctgcaggctgcaaggttgaagccttcgccgtcgcgggccaagagctgtgtcagcctaggtgcgcattctctacattaggaagggtcttgcggctggcctacagtgaggccggagactacctggtggctattgaggagaagaataaagcgacctttctgcgagcgtatgtgaattggcgaaataaaagaaccgaaaacagccgggtgtgcattagaatgataggtcataatgtggagggcccatttagtaaggccttccgggaccagatgtacattatcgaaatgccattaagcgaggcccctttgtgtatctcttgctgtccggtaaaaggcgacttgctggtagggtgcacgaacaaattggtcttattctctcttaaatatcagatcatcaacgaggagttctctctgttggattttgagcggagcctaatcatacatattgacaacattaccccagtcgaggtctcgttttgtgtaggttacgtcgctgtgatgtctgatctggaagtgctgatcgtaaaactggaatccggtccaaaaaacggcgagagagtccaccatcacccccacaaaaccaacaatcgaattagacggactgaagaaggcatcagcaacgaaatcagtcagctggaatctgacgactttgttatatgtcagaaaccactggaattgctgggagaaaaaagcgagcagtctgggctgtcagttaccctcgaatccactggcctcgccgacgagaaacgaaagtattcgcacttccaacatctgctttaccggcggttcgccccagatatctcctcttacgtactctctgatgacattaagctgcattcattgcaactcctccccatctaccagacgggtagcttaacaagtgacggtaagaatctcagtcaagagaaggagctgctctctttattttgtttcttcagcctgcctcatgtggggtatttgtacatggtcgtcaagtcagtggaactgatgtctgtctatcagtaccctgaaaagtcgcagcaggccgtcctcacccctcaatttttacacgtaataacaagtaacaatctgcagtgttttacggtgcggtgtagcgccgccgcagcccgggaggaagatccttacatggacactacgctcaaagcatgccctccggtgagcatggacgtctgcgcactgcggattcagttgttcatcgggctcaaggccatctgtcatttcaagaatcacatcattctactgacaaaagctgaacccgaggctattcccgagagaaggcaatctcctaaacgcttgctgtcccggaaggatacgtctgtgaaaatcaagatccccccagtggccgaggccggctggaacctgtacatagttaacacaattagtccggtgcagctttacaaggaaatggtggattatagtaatacatacaagactgtgaagacacagtcatgcattcacctactcagtgaggcgcacctgcttgtgagagctgcactgatggacgcctctcagcttgaaccaggggagaaagcagaactgctagaggccttcaaggaatcttgcggacatctgggcgattgttattcacgcctcgattcacagcactcccacctcacattaccctactataagatgagtggactatccatggccgaggtgctggctaggactgactggaccgtggaagatggcctgcagaaatatgagcgcggattgattttctacatcaaccattctctgtacgagaatctggacgaggagctgaatgaagagctggctgcaaaggtggtgcagatgttctatgttgctgagcctaaacaggttccccacatactgtgttcccctagcatgaagaatataaatccacttactgccatgagctaccttcgaaaactcgacacttcaggcttcagtagtatattggtgacccttacaaaggctgccgtggccctgaagatgggcgacttagatatgcatcgtaacgagatgaagtcccactctgagatgaaactggtttgcggctttatcctcgagcctaggctcctgatccagcagcggaaagggcagatcgttcccactgaactcgccctacatctaaaggagacacagcctggcttgttagtagctagtgtactggggcttcaaaagaacaacaaaattgggatagaagaggccgatagcttctttaaggtcctgtgcgcgaaagatgaagacactattccccaactgctggtggatttttgggaggcacagctggtggcctgccttccagacgtagttttacaagagcttttcttcaagttgacttcccagtatatctggcggctgagcaagcgccagccgccggacactaccccacttagaacttctgaggatctgattaatgcctgttcccactacggtttaatttacccctgggtgcacgtggtgatttccagcgactcattggccgataagaattacacggaagatctgagcaaattgcagtcactcatctgcggaccgtccttcgatatcgcttccattatccctttcctcgaacccctgagtgaagataccattgccgggttaagcgttcacgtgctgtgtaggacgcgccttaaagagtacgagcaatgtatcgatatccttctagagcggtgccccgaagctgttattccatacgcaaaccacgagctcaaggaggagaatcgcaccttatggtggaagaaactgctgcccgaactgtgccagcggatcaaatgcggcggcgagaagtaccagctataccttagtagcctgaaagagaccctgtctattgtggccgttgagttggaattgaaagacttcatgaatgttctacccgaggacggaacggctacatttttcctgccctacctcctgtactgtagtagaaagaaaccactgacatag

SEQ ID NO: 190581 - DNA, 1587 bp, Artificial Sequence
  Description of Artificial Sequence: Synthetic coding sequence
atggccaccagcaccagcaccgaggccaagagcgccagctggtggaactacttctttctatacgacggcagtaaggtgaaggaggagggcgaccctaccagagctggcatctgctacttttatcccagccagacccttttagatcagcaagagctcctgtgcgggcagattgcgggcgtcgtgcggtgtgtgagcgatatctcagattcaccccctacattggttaggctccggaaactcaaattcgctattaaggtcgacggtgattacctgtgggtgttgggttgcgccgttgagctacccgacgttagctgcaagagattccttgatcagctggtagggttttttaatttctacaatggcccagtaagcctggcatacgagaattgctcacaggaggagctgtccaccgagtgggatacctttatcgagcaaatacttaaaaacacttctgatctccacaagatttttaactccctctggaatctggatcagaccaaggtggagcccttgttgttgcttaaggcagccaggatcctacagacttgtcaacggagcccgcacattctcgcagggtgtattctttacaaggggctcatagtgtctacccaactgcctccttccctgactgccaaggtgctgctacaccgcacagctcctcaggaacagcgcctacccaccggtgaagacgccccgcaggagcacggtaagtggatgctgtggtcctttaagaaccgtgtgacccatcaaaatcctaacggcgcagccctcccaccaaatgttcagatcatccctgtgttcgtaacaaaggaggaagcaatttccttacatgagtttcctgtcgaacagatgactagaagccttgcctctccggctggcctccaggatggcagcgcacagcatcacccgaagggaggctccacatcggcactcaaagagaatgctacggggcacgttgaaagcatggcatggactacccccgacccaacgtcccctgatgaggcttgccctgacgggaggaaagagaacggttgcctcagcggacatgatctggagtcaattagacctgcagggctgcataatagcgcacgaggggaagtgctagggctgtcctcctccctcgggaaggaacttgtgttcctgcaggaggaactcgacctctccgagatccacatcccggaggcacaggaggtggaaatggcatctgggcacttcgctttcctgcacgttcctgttcctgacggacgtgccccttactgtaaggcgtccctgtcagcctccagcagtctcgaacctacgccgccagaagatacggcaatctcctctctaagaccgccatcagctcccgagatgctgactcagcatggtgctcaggaacaactggaggatcatccggggcattcttcccaagcacccattccacgagctgatccactcccgaagtcaactgttctgttcagtggagggtgcgtgaaggggagcgatacccagttatgcgttcctggactggtttggtatcttgaaccccagttctactacgtgattgtcaggcatttctttgactccatgcgacaaaccgctgggtag

SEQ ID NO: 190582 - DNA, 2127 bp, Artificial Sequence
  Description of Artificial Sequence: Synthetic coding sequence
atggccaccagcaccagcaccgaggccaagagcgccagctggtggaattacttttttctgtatgatgggtcaaaggtgaaggaggaaggcgacccaactagagccggtatttgttatttctacccatcccagacgctgttagaccagcaggaactgctctgcggccagatcgcaggagtcgtaagatgcgtgtcagatatttccgacagccctccgacattggtccgcctgcgtaaactgaaattcgccatcaaggtggacggcgattacctttgggtgctcggctgcgccgtcgaactccctgacgtctcatgtaagcggttccttgaccagctggtgggcttctttaatttttacaacggaccggtgtccctggcctacgagaactgttcacaagaggagttgtccaccgagtgggataccttcatagagcagattctgaaaaacacctccgacctgcacaaaatatttaacagcttgtggaaccttgatcagacaaaagtagagccattactgttactcaaagcggctaggattctccaaacatgtcaaaggtcaccgcatatcctggctgggtgcatcctatacaaaggacttatcgtgtcaactcagttaccgcctagtctcacagcaaaggttctgttacaccgcaccgccccccaggaacagcgcctaccgacaggcgaagacgcccctcaagaacatggggccgccctcccccctaacgtacagattatccctgtttttgttacaaaggaggaagcgattagcctccacgagtttccagtagagcagatgacacggtccttggccagccctgcaggacttcaggacggaagcgctcagcatcaccctaagggagggagcacaagcgctttgaaagaaaacgctaccggacatgttgagtcgatggcttggactacacccgatcccactagccccgacgaagcatgtcccgatggcagaaaagagaatgggtgcctttctggccacgacctcgagtccatccggcccgccggcctgcataatagcgctaggggtgaggtactgggtctgagtagctctttagggaaggagctcgtattcctccaagaagagctcgacttatcagagatacacatccctgaggctcaggaagtggaaatggccagtggccacttcgccttcctgcatgtgcccgtccccgacggcagagctccttactgcaaggcctcactgtcagcttccagttcactggaacctactccacctgaagacactgcaatctcatctctcaggcccccatcagcacctgaaatgctgacccagcacggggctcaggagcagctggaagatcaccctggacacagcagccaggcccctatccccagagcagaccccctgccccgccggactagacgcccattactgttgccaaggttagaccccggtcagaggggaaataagctccctacgggtgagcaaggtttggacgaagatgtagacggagtttgtgaatcgcacgccgcaccaggactcgagtgtagcagtggctcagccaattgccaaggagcgggaccctcagcggacggtatttcaagtcgcttgacaccagcggaaagttgtatgggtctggtgcggatgaacctatacacccactgcgtcaaagggctcgttctcagccttcttgcagaggagcctctcctgggggacagcgcggcaattgaagaagtctatcactcctcgttagcctctcttaatggattggaagttcatttaaaagagaccctgcctagggacgaggccgctagcactagcagcacctataattttacccactacgatcggattcaatctctgctgatggccaatcttcctcaggtggcaaccccccaggatagacggttcctccaggccgttagcttgatgcactctgaatttgcccagctgcctgcgctttacgagatgactgtaagaaatgcttccactgccgtgtacgcatgctgtaacccgatacaggagacttatttccagcagctggctcctgcagccagatcaagcggctttccaaatccccaggatggcgcatttagcttgtcaggcaaagccaaacagaaacttttgaaacatggggtcaacctgctctag

SEQ ID NO: 190583 - DNA, 2166 bp, Artificial Sequence
  Description of Artificial Sequence: Synthetic coding sequence
atggcccccctgtgcagcctggcccggtggaactacttcttcctgtacgacgggtctaaggtgaaagaagaaggggaccccacacgggcggggatctgttacttttatccttctcagaccctgcttgatcagcaggagctgttatgcggccagatcgcaggagtggtgagatgcgtgtctgacatctcggatagtccaccaactctggtgagactgaggaaactcaagttcgccattaaagttgatggggactatctgtgggtgctcggatgcgccgtcgagctccctgacgtgtcttgcaaacggttccttgaccaactggttggtttctttaacttttacaacggtccagtgagtctagcatatgagaactgttcgcaggaagaactgtcaacggagtgggatacgtttatcgaacagatactgaaaaatacctccgacctgcacaaaatctttaactccttatggaacctggatcagacaaaggtagaacccctcttactccttaaggccgctaggatcctgcagacttgccagaggtcgccacacattctagccggctgtattctgtacaagggcctcatagtgtccacccagctcccgcctagcctgaccgcgaaggttctgctccatcggacggcgccacaggagcagcgacttcctacgggggaagacgcccctcaggagcatggcaaatggatgctctggagctttaaaaaccgggtgacacaccaaaaccccaacggagctgctctgccaccgaacgtgcagatcattccagtcttcgtaacaaaagaggaagcaattagtttacatgagtttcccgtggaacagatgactcggagtttggcctccccagcaggtttacaggacggctctgctcagcaccatccaaaaggaggctccacatccgccctcaaagaaaatgctactggtcacgtcgaatcgatggcttggacaacaccagatcccacgtctcctgacgaagcctgccccgatggccgcaaggagaatgggtgcctcagtgggcacgacctggaaagcatccgcccagctggcttgcacaattctgcacgtggcgaggttctggggcttagttcttcgttggggaaagaattggttttcttgcaggaagaactcgatctctccgaaattcacattccggaggctcaggaagtcgaaatggcctcaggacactttgcgttcctccacgtccccgtgcctgatggaagagcgccttactgcaaagcctcattgagcgcttcatcatctttggaacctactccacctgaagataccgcaatctcatcgctgcgtccgccttctgctcccgagatgctcacacaacacggtgcccaggagcagctggaagatcaccccggtcacagttcccaggcacccattcctcgcgctgatcctttaccgcgaaggacccgccggccactcctgcttccgagactggacccaggccagcgcgggaacaagctgccaacaggtgaacagggacttgatgaggatgtagatggcgtctgtgaaagccacgctgctcccggcttagagtgtagctcaggtagtgctaactgtcagggagcaggcccttccgccgacggtatcagcagcagactcacacctgccgagtcatgcatgggactagttagaatgaacctgtacacgcattgcgtaaagggcctcgttctgtcactgctggcagaggagccactcctgggtgattcagctgcaattgaagaagtataccactcatctcttgcaagcctcaatggcctggaggtacatctgaaagagactctgccacgggatgaagccgcaagtaccagttccacatacaacttcacccattatgatcgaattcagtccctcctgatggccaacctaccccaggtagctaccccacaggatagacggtttcttcaggcggtatcgctaatgcacagcgagttcgcccagctgccagcactctatgaaatgacagttcgaaatgcctctaccgccgtctacgcctgctgtaaccccatacaggaaacttattttcaacagctggcccctgctgcacggtcctccggctttccgaatcctcaggacggggctttttcactgagtggcaaagcaaaacagaaattattaaaacacggcgtgaacctgctgtag

SEQ ID NO: 190584 - DNA, 2127 bp, Artificial Sequence
  Description of Artificial Sequence: Synthetic coding sequence
atggccaccagcaccagcaccgaggccaagagcgccagctggtggaattatttttttttatacgacgggtctaaagtgaaagaagagggtgatcccacgcgcgctgggatctgctatttttacccttctcagaccctgttggaccaacaggagcttctgtgtggacaaatcgctggagtcgtccggtgcgtctccgacatcagtgactccccccccacacttgtaaggttgagaaaactgaaattcgctatcaaggtggacggggattacctctgggtactaggatgtgctgtggagctccctgacgtatcatgtaaacggttcctcgatcaactggtggggtttttcaacttctataacggtcccgtttctctcgcatacgaaaattgctcacaggaggaactgagcaccgagtgggatacattcatagaacagatcctcaagaatacttccgacctccacaagatctttaattctttgtggaatctagaccagactaaagtggaaccactcttactcctaaaggctgctcgaatcctacagacttgccagaggtctcctcatattttggccgggtgtattctctacaagggcctcatcgtctccacccaacttcccccttccctaaccgcaaaggtgttgctccatcgcactgcacctcaagagcaaagattacctacaggagaggacgccccacaggagcacggtgctgccctgccacccaatgtgcaaattatcccagtgtttgtgactaaagaggaggcgatcagtcttcacgagtttcccgtggagcaaatgacaagatctctagccagtccagccggacttcaggacggaagtgcgcaacatcacccaaaaggagggtctacgtcagcattgaaggagaacgcgaccggtcacgtagagtccatggcgtggacaacgccggatcccaccagtcccgatgaggcctgtccggatggaaggaaggaaaatggctgtctgtccgggcacgatcttgagtcaattcgtcccgccggcctgcacaacagtgctcgcggagaagttctgggactgagcagctcgcttggcaaggaactggtgttccttcaggaagagttagatctgtcagaaattcacattccggaagcacaagaagtcgagatggcatccggtcactttgcttttctgcacgtgccggtgcccgacgggagagccccttactgcaaggcctccttgagcgcgagctcaagtcttgagccaactccccccgaggacacagccatctcttccctcaggccgcccagtgccccggagatgctaacacagcatggagctcaggagcagctggaggatcacccaggacactccagccaggcacctatccctcgcgctgatccattgccaaggcgcactcgcagaccccttctcctgcctagactcgatccgggacaaagagggaacaagctccctactggagagcaggggctggatgaagacgttgacggagtgtgtgaatcccatgccgcgcctggtctcgagtgttcatcaggaagcgcaaattgtcagggagcaggaccaagcgccgacggcatatcctcccgcctgacgccagccgagagttgtatgggtctcgttagaatgaatttgtatacccactgcgtcaagggtcttgtgctctctctcctggctgaagagcctctcctcggggattctgccgcaatagaggaagtatatcactctagcttggccagtttgaacgggctagaagttcatctgaaagagactctgccccgggacgaggccgcaagcaccagcagtacctacaacttcacacattacgataggattcaatccctcttgatggctaatcttccacaagtcgccacaccccaggatagaagatttctgcaggctgtatccctgatgcattccgagttcgcccagttgcccgccctatacgaaatgacggttcgcaatgctagcacggcagtgtacgcatgctgcaatcctattcaggaaacctatttccagcagttagctccagcagcacgcagcagtggattccctaacccacaagatggagcatttagtctgagcggaaaagcgaaacagaaactcctgaagcacggagtgaatttgttatag

SEQ ID NO: 190585 - DNA, 2112 bp, Artificial Sequence
  Description of Artificial Sequence: Synthetic coding sequence
atggcccccctgtgcagcctggcccggtggaactacttcttcctgtatgatggctcaaaggtcaaagaagaaggagaccccactagagcggggatctgttatttctatcctagccagacactgctagatcaacaggaactgctctgtgggcaaatcgctggcgtggtgcgttgtgtctccgatattagcgattcacctcccaccttggtgcggctccggaagctaaagtttgcaatcaaggtggacggggactacctgtgggtgcttggatgcgcagtcgagctgccagacgtgagttgtaagaggtttctggatcagctcgttggattttttaacttttacaacgggccggtgtcactggcttatgagaactgctcgcaggaggagctgtccacagaatgggatacgtttatagagcagattctgaaaaacactagcgatctccataagatttttaactccctgtggaaccttgatcaaaccaaagtggagccgctgctgctgctcaaggcagccaggattttgcaaacatgtcagagaagcccgcatattctcgctgggtgcattctctataaggggttaattgtgtcgacccagctaccgccctcattaaccgctaaggtgttgttacaccgaacggcacctcaggaacagcggctgccgacaggagaggacgccccccaggaacacggagctgccctgcccccgaatgtgcagataattccagtgtttgtcacaaaggaggaagccattagcctccatgagtttcctgtcgagcagatgacccgcagtctcgctagccctgctggcttgcaggacgggagcgctcaacaccatccaaaagggggaagcacaagcgctcttaaggagaacgcaacaggccatgtggaatccatggcctggaccactccagatcctacaagccctgacgaggcatgtcctgatggccggaaagaaaacggttgcttgtccggtcacgatttagaatccataaggccggccggactgcataattcagcccgaggcgaggtgcttggattgtcttcatctctgggcaaagagttggtcttcctgcaggaggagctagacctctcagaaatacacattccggaggcccaggaggtggagatggcgtctggtcatttcgcattcttgcatgtgccggtgcctgatggtagggctccttactgtaaagcgtcactgagcgcatcctctagcttagagcctacaccacctgaggatacagcgatctctagcctgagacccccttccgcacctgagatgctgacccagcacggcgcacaagagcagctggaggaccaccccgggcactcatcacaggctccaattccgagggcagatccattaccccgaagaacacggaggccactcttgcttcccagactggatccaggacagaggggtaataagctgcctacaggggaacagggactggatgaggacgtcgatggggtctgtgagtcacacgcagctccaggacttgagtgctcaagtggatccgctaattgccagggagctggcccctctgcggacggtataagctctaggctgacaccggccgaatcttgcatggggctcgtgcgtatgaacttgtatacgcactgcgttaaggggttagtgttaagcctgctggcagaggagccacttctgggagattccgccgcaatagaggaggtgtatcattcttccctcgcctccctaaacggccttgaggttcatttgaaggagacactgccaagagacgaggccgcttcgaccagtagtacctataattttacccactacgaccgcattcaatcacttctgatggcaaatctgccgcaggtcgcaaccccccaggacagacgttttctgcaggccgttagtctgatgcatagtgaatttgcacagctgccagcgctctatgaaatgaccgtcagaaatgccagcacagcagtgtatgcctgctgtaatccaattcaggaaacgtacttccagcagctggctccagctgcccgcagttctggatttcctaaccctcaggatggggctttttcactctcaggtaaggccaaacagaaactcttaaaacatggagtgaatctgctttag

SEQ ID NO: 190586 - DNA, 3390 bp, Artificial Sequence
  Description of Artificial Sequence: Synthetic coding sequence
atggccttcgtgcccgtgatccccgagagctacagccacgtgctggcggagttcgagagcctcgacccactgctttctgcacttcgcctggactcttctaggcttaagtgcacctctattgcagtttcccggaaatggctcgctcttggctcgagcggtggaggcttacacctgattcagaaagaaggctggaaacatagactcttcctctcccacagagagggcgcaatttctcaggttgcgtgttgcttgcatgacgatgactacgtggcagtggccacatctcaaggactggtggtggtgtgggagctcaatcaggagagacggggaaaacccgagcagatgtacgtaagttcagagcataagggacggcgggttacagctctttgctgggatacagcgattctgcgtgtgtttgtgggagatcatgctggtaaagtctcagccatcaaactgaatacaagcaagcaagccaaggccgccgctgcattcgtgatgtttcccgtacagacaatcaccacggttgattcttgcgtcgtacagttagactatctggacgggcgactgctgatttcttcactgacccggtcatttctgtgcgacactgagcgagaaaagttctggaagattgggaataaggagagggacggggagtatggcgcctgcttctttcccggaagatgcagcggaggccagcagcctttgatatattgcgccaggcccggctcccgcatgtgggaggtgaatttcgacggcgaggttatttcaacgcaccagtttaagaaattgttgtccctacctcccttgcctgtgatcaccctgcgctcagagcctcagtacgatcatactgccggctcatctcagtctctgtcgtttccgaagctcctccatctatccgagcactgtgtccttacttggacagagcgcgggatttatatcttcatcccgcagaacgttcaggtgctgctctggagcgaggttaaggatatacaggacgtcgccgtttgtagaaatgaactcttctgtctgcacctcaacggcaaggtgagtcacctgagtcttatctcagttgagcgctgcgtcgaacggctgctccgccgcggcttgtggaatctcgcagcgagaacatgttgcttgtttcaaaactctgttatcgcctccagggctcggaagactctgacagctgacaagctggagcacctcaaaagccagctcgatcatggcacatacaacgatttaatttctcaactcgaggagctaatcctcaagttcgagccgttagacagtgcctgcagcagccgacgatcaagcatcagttcccacgagagcttttcaatactggatagtggtatttatcgaattatttctagccggaggggctcacaaagtgatgaggactcctgctctctgcacagccaaaccctgtctgaagacgagagattcaaagagtttacctcacagcaagaggaagatctccctgatcaatgctgtggaagccatggcaacgaagataatgtctcgcatgctccggtgatgttcgagacagataagaatgaaacattcttgccattcggaataccactcccattccgatccccctcccccctggttagtctgcaagcagtgaaggagagcgtgagctcctttgttcgaaagacaactgagaagattggaacactgcacaccagccctgatctgaaagtgcggcctgagctgagaggagatgaacagtcctgtgaagaagatgtgtcgtccgatacctgtcctaaagaggaggatacagaggaggagaaagaggtaacatcccctccccccgaggaggaccgatttcaggagttgaaggtcgccaccgctgaggccatgacaaagctgcaggatcccctggtactctttgagtccgaaagcttgcggatggtgctgcaggagtggctgtcccacctggagaaaaccttcgccatgaaagacttttcgggagtatcagacactgacaattctagcatgaagctcaaccaggacgtcctactggtcaacgagtcgaagaaaggcatactcgacgaggacaatgagaaagagaagcgcgactccctcggtaacgaagaaagtgtcgataaaactgcctgcgagtgtgtcaggtcaccccgggagagccttgacgatctatttcagatttgttcaccctgcgccatagcatcaggtctgcgtaacgatctggccgaattgaccacgctttgtctggaactaaatgtgctgaactccaaaattaagagcacaagtggccacgtcgaccacaccttgcagcagtacagcccagagattctcgcctgtcagtttttgaaaaaatacttctttctgctgaacctgaagcgagctaaggaatcaataaaacttagctattctaactccccgtctgtctgggatacttttattgagggactcaaagagatggccagcagcaacccagtttacatggagatggagaagggagatctaccaaccagactcaagctcctcgatgacgaagtgccttttgactcacccctgctggtcgtgtacgccacccgcctgtacgaaaagttcggcgagagcgcgctgcgctcactgattaaattttttccgagcatcctgccatcagatattattcagctgtgccaccaccatccggccgaatttcttgcttatcttgacagcttggtgaaaagcagacctgaagaccagagaagttctttcctagagagcttgttgcaaccagaatctttaaggctggattggctgttactggctgttagtcttgatgcacctccttccaccagcactatggacgacgaggggtacccgcgtcctcactctcacctcttgtcctggggttatagtcagcttattctccatctaattaagctgcccgctgatttcattacgaaggaaaaaatgacagacatctgccgctcatgcggcttttggccaggctacttgattctctgtttggagcttgagcgacgcagagaggcattcactaatatcgtttacctcaacgacatgagtctgatggagggagacaatggatggattccagagacagttgaagagtggaagctccttctccatctgatccagagtaagtccactagacctgccccgcaggaatcacttaacggctccctgagtgacggaccctcaccaattaatgtcgaaaacgtcgccctgctactggctaaggctatgggccccgatagagcttggtccctacttcaggaatgtggcctggccctggaactcagcgagaagtttacaaggacctgtgacatcctcagaattgcagaaaaacgccagcgggctctgatccagtcaatgttagagaaatgcgaccggttcctttggtcacaacaagcctag

SEQ ID NO: 190587 - DNA, 3048 bp, Artificial Sequence
  Description of Artificial Sequence: Synthetic coding sequence
atgtacgtgagcagcgagcacaagggccggcgggtgaccgccctgtgctgggacactgctatcctgcgagtgttcgttggcgatcacgccggtaaagtgtcggcaatcaaactcaatacaagcaagcaggccaaggccgcagctgctttcgtcatgttccctgtgcagacgatcacgaccgtggacagctgtgtagtccagctggattacctcgatgggcgactgctgatttccagcctaaccagatccttcctctgtgacaccgaacgagagaaattttggaagatcggcaacaaagagcgagatggcgagtacggcgcatgttttttccccggccgttgcagtgggggccagcaacccttgatctattgcgcccgcccaggcagtcgaatgtgggaagtgaacttcgacggcgaagtgattagtacccaccagttcaaaaagttgctatcacttcccccgttgcctgttattacgctccggtccgaaccacagtacgaccacaccgccggctcgagtcaaagtctttcatttcctaagttgctgcacttgtcagagcactgcgtgctgacatggaccgaacgggggatatacattttcattccacagaatgttcaggtgctgctttggagcgaggtcaaggacatccaggatgtggcggtctgccggaatgagttgttttgcctgcacctgaacggaaaagtcagccatctctccctgatcagcgtagagcggtgcgtcgagcgtctgctccgacggggtctctggaacctggcagcgcgcacttgctgtctgttccagaactccgtaatcgcaagcagagctcgtaaaactttgaccgctgataaactggaacacctgaagtcccagctggaccacggcacctataacgaccttatcagtcaactcgaggagctgattctgaaatttgagcccttagacagtgcatgcagtagcagaagatcgtccatcagctctcacgagagtttttccatcctggattcaggcatctaccgcatcatttcctcaaggcgcggatcacagtcagatgaagattcctgttcactgcacagccagaccttgtccgaagatgaaagattcaaggaattcacctcacagcaagaggaggacctgccggaccagtgttgtgggtctcatggcaacgaagacaatgtatcgcatgcccctgtgatgtttgagaccgacaaaaacgagacattcctgccatttgggattcccctccccttcagatccccttcaccactggtcagtttgcaggccgtaaaggaaagcgtgtcaagcttcgtccgcaaaacgactgagaaaatcggcaccctgcacacatcacccgacctaaaggttaggcctgagcttcgtggagatgaacagtcctgcgaggaagatgtgagctctgacacttgccccaaggaagaagatacagaagaggaaaaggaggtgacctcacctcctcccgaggaggacaggtttcaggaactgaaggtggctaccgcagaagctatgacaaaattacaggatcctttggtgctgttcgaatccgaatctctccggatggtgctccaggaatggctctcacacctcgaaaagacattcgctatgaaagatttttctggtgttagcgacacggataattcctccatgaaacttaatcaggacgtgttgttggttaacgaatccaagaagggtattctggacgaggataacgagaaagaaaagcgcgactcattaggaaatgaagagtccgtggacaaaaccgcttgcgaatgtgtaagaagcccgcgggaatcccttgacgacctctttcagatctgttccccgtgtgccatcgcttccggtctgcgcaacgacctggccgagctgactacactttgcttggagctgaacgtgcttaactcaaagatcaagtcaacatccggccacgtggatcacaccctccagcagtattcaccggaaattcttgcttgccagttcctaaagaagtatttttttctgctgaatctgaaaagggctaaggagagtatcaaactgtcctacagtaactcgccgagcgtttgggacacgtttatagagggactgaaggagatggccagctccaatcccgtgtacatggagatggaaaaaggtgacctgcctacacgcctcaagctcctggacgacgaggttcctttcgactcccctctgttggttgtgtacgccactaggctttatgaaaagttcggcgagtctgcactcagatctttgattaagttcttcccttctatcctgcctagcgatatcattcagctctgccatcatcacccagccgagtttctcgcttaccttgactcgctggttaaaagcaggccagaggaccagcggtcaagcttcctggagtcactgttgcagccagaatctctacggctagattggctgcttctagccgtgtccctggacgccccacctagcacctcaaccatggacgatgagggctatcctagaccccactcccacttgcttagttggggatacagtcagctcatactgcacctaatcaagctgcccgccgactttattaccaaagaaaaaatgaccgacatctgcagatcatgcggcttttggcctggatacctcatcctctgtcttgagctggagagacgccgcgaggcttttaccaatattgtgtatctcaacgatatgtccctgatggaaggagacaatggatggattcctgagaccgttgaggagtggaagctgttactccatctgattcagagcaaatcgaccagaccagcaccccaagaatcactaaatggcagcctgtccgacggcccgagtccaatcaacgtggagaacgtggctctgctgctggccaaggctatggggccagatcgagcttggagtctgcttcaagagtgcggactggctctcgagctgagcgaaaaattcactcgcacatgcgacatccttcgtatcgcagagaagcgacaacgcgccttaattcagagcatgcttgaaaagtgcgatagattcctgtggtctcagcaggcatag

SEQ ID NO: 190588 - DNA, 3048 bp, Artificial Sequence
  Description of Artificial Sequence: Synthetic coding sequence
atgtacgtgagcagcgagcacaagggccggcgggtgaccgccctgtgttgggatacggcgatacttagggtgttcgtcggggaccatgctgggaaagtgtccgccatcaagctcaatacaagcaagcaggccaaggccgctgctgccttcgtaatgtttcctgtgcagacaatcacaaccgtcgattcatgtgtagtccaactggactatctggacgggaggctgctgattagctcactgaccagatctttcctatgcgacactgaaagagaaaaattctggaagattggaaacaaggagcgtgatggagagtacggggcctgctttttcccaggcaggtgtagcggcggccagcaacccctaatctactgcgcccgaccaggctcccggatgtgggaggtcaacttcgacggagaagtgatttcaacacaccagttcaagaaattgctgtctctgccacccctccccgtcattacattgaggagcgaaccacaatatgaccacaccgccggctcctcccaaagcctgtccttccccaagctgctgcatctgtctgagcactgtgtactcacctggacagaaagaggtatttacattttcatcccccagaatgtgcaggtcctattgtggtccgaggtcaaagacatccaggacgtggccgtgtgccgcaatgaactgttttgtctgcatcttaatggcaaggtcagtcacctctccctgatatccgtggaacgatgcgttgaacggttattgagacgaggactatggaacctggccgcccggacctgttgcctgtttcagaatagcgtcattgcctctagagccagaaagactctcacagccgataagctggagcacctgaaatctcagctggatcacggtacctataacgaccttatctcccagctcgaggagctgatcctaaagtttgagcctctggactccgcctgttcctcaagacgctctagcatcagctcgcatgaatccttctctattctcgattccggcatctatcgtattatctcatcacggagaggcagccagagcgatgaggactcatgttctctccatagccagaccctctctgaagacgaacggtttaaagagttcacatcacagcaggaggaggacctccctgatcagtgctgtggatctcacggaaacgaggataatgtgtctcatgctcctgtcatgttcgaaactgataagaacgagacctttctgcccttcgggatcccgttaccttttagatccccttccccgttggtttccctgcaagcagttaaagagtcagtctcctcctttgtgcgaaagactacggaaaaaatcggaacgctgcatacttctccagacctgaaagtccggcctgagctgaggggagacgagcagagctgtgaagaagatgtttcatctgatacctgccctaaagaggaagacactgaggaagagaaggaggtgacaagcccccctccggaggaagacagattccaagaactgaaggtagctactgcagaagctatgacaaaacttcaggatccactggtattgttcgagagcgaatccttacgcatggttctccaggagtggctgagccatcttgagaaaacgttcgccatgaaagacttcagtggcgtatctgataccgacaactcttccatgaaactcaatcaggatgtgttactggtcaacgaaagtaagaagggcatcctcgatgaagataacgagaaggagaagcgggactcccttggtaatgaggaatctgtcgataaaactgcttgcgagtgcgtcagatcccctagggagagtctggatgacttgtttcagatctgcagcccttgtgcaattgctagtggcctgaggaacgaccttgcggaactcacgacattgtgtttggagctgaacgtcctgaatagcaagatcaaaagcacttccggtcatgtggatcacactctccagcaatacagtcctgaaatcctggcctgtcagttcctgaaaaagtacttcttcctcctaaatctaaagcgcgcgaaagagtctattaagttgagttactccaattccccttctgtatgggacacctttattgaaggtttgaaagaaatggctagttcaaatcccgtctatatggaaatggagaagggcgatctgcctacccgactgaagctcctagatgacgaagtgccttttgattcccctctgttagtggtatatgctacccggttgtacgaaaaatttggcgaaagcgcacttcgctccctgataaaattcttccccagtatcctcccctccgatataattcagttatgccatcaccacccggctgagtttttagcgtatcttgactcactggtcaagagtcgccccgaggaccagagatcgagtttcctggaaagtttactgcagcctgaatcactgagactcgactggcttcttcttgcagtgagtctcgatgcgccaccgagtacatccactatggatgatgaaggatacccacgcccacacagtcacttactgagctgggggtacagtcagcttatactgcaccttattaaattacctgcagactttatcacaaaagagaagatgactgatatttgtcgcagctgcggtttctggcctggatacctgatactgtgcctcgagttggagcggcggagggaggcatttaccaatatcgtgtatttgaacgatatgagtcttatggagggagacaatggatggattccagagacagtcgaagagtggaagctgctgctccacctgattcagagcaaatcgaccaggcctgcgccacaggaaagcctaaatgggagcctcagcgatgggcctagtccaatcaacgttgagaatgtggcgcttctccttgccaaggccatgggtccagatagggcatggtctctgttgcaggagtgcggtttggccctcgagctgagtgaaaagttcacacgcacgtgtgatatcctgcggattgccgagaagagacagagagctctgatccaatcaatgttggagaaatgcgataggttcctgtggtcccagcaggcatag

SEQ ID NO: 190589 - DNA, 2328 bp, Artificial Sequence
  Description of Artificial Sequence: Synthetic coding sequence
atgaagcggagcggcaccctgcggctgctgagcgacctgagcgcctttggcggagcagcccgactgcgagaactggtcgctggtgatagtgccgtgcgagttagaggctcaccggatggccggcaccttctcctgttaagacccccaggcgccgttgccccacagctactggttgcctcgagagggccaggggctgagctggagagagcatggcccgctggccagccttcccccctcgacgcgttctttcttccttggcctgccagacccgcactggtgctggtctgggagagcggactagccgaggtgtggggggcgggtgttggtcctggatggcgccctttacagagtacagaattatgtccaggcggcggagcccgggtggtggccgtggcagctctgcgagggcgcctggtttggtgcgaggaaagacaagcccgggccgagggtcccagtgggtccccagctgctgcattctcgcactgcgtgtgcgtccgtacgttagaaccgagcggcgaggcatccacatcgctgggtcgaacacatgtgctgctgcaccactgcccggctttcggtcttctggcctcatgcaggcagctgttcttagtgccgaccgccacaacgtggccgggggtcgcacatgttctgttgatctggtccccaggcaagggcaaggttatggtcgccgctcctaggcttgggctctcttactcaaagtccctgaatcccggaagaggcgacacgtgggattttcggactttgctgagaggactccccggactgttgtccccacgagagccactggccgtgcacacctgggctcccacacctcagggactgttactgctcgacttcggaggtacggtgtcattattgcagagtcacgggggaacacgagccgtcgggactcttcaggaggccccagtagggccatggggctcagctgcgctcggtacctttcaggggacgctagcgtgtgtcctgggtagtactctcgagctcttggatatgggatcaggccagctccttgagaggaaagtgttaagcactgatcgggtacatttactggagccgccagccccaggaatggaagacgaggaggagctggagacaagagggaaccttcggttactgagtgctctggggctattctgcgtcggatgggaggccccccaaggtgtagaactgccctccgccaaagatctcgtctttgaagaagcttgtggatactatcagcggcggtccctccgaggtgcccagcttactcctgaagaactccgccacagctctaccttcagagcaccccaggcattggcatcaatattacaagggcatcttcctcccagcgcacttctgaccatgctgcggacagaactgcgcgactacagaggcctagagcaactgaaagcgcagcttgtggctggggatgatgaagaggctggctggacagagctggccgaacaagaggtggcacggctgttgcggaccgagctcatcggggatcagctcgcccagctgaatactgtgtttcaggccttgccgaccgccgcttggggggcgacattacgggcactgcagctgcaattagacggtaacggaaaactgaggtcccaggctccacctgatgtctggaaaaaggttctaggtggtatcactgctggtaaggagccgcctaatggcatcctgccccctttcgagctgctgtgccagtgtctgtgccagctggagcccagatggcttccccctttcgtggagctggctcagcaacaggggggacccggttggggcgcaggtgggcccggccttcccctctatcggagggctctggccgtgctgggtgaggaaggcacaaggccagaagccctggaactcgagctcctgctgtccagtggccgcccaaaggcggtcctgcaggccgtgggtcagctcgttcaaaaggagcagtgggacagggcgctggatgcgggattagctctggggccatcatcacctttactccggtcagagatctttaagcttctacttgccgaattcgcacagcacaggcggctggatgcacatctgcccctactttgcaggctgtgcccccctgaactcgcacctgcggaacttctcctcctactacgaacttacttgcctgacgaggtcggtccgcctacaccgtttccagaacccggggccgaaccccccctgactgtgggccttctgaaggccttgcttgaacagactggagcccaggggtggctgagcggaccagttctgagcccctatgaggacatcttgtgggatcccagtactccaccgcccacacccccaagggatctttag

SEQ ID NO: 190590 - DNA, 1596 bp, Artificial Sequence
  Description of Artificial Sequence: Synthetic coding sequence
atgctgggcttcctgagccggggccccagcatgaagctgtgcatgggcctcgcctgtgtcctcagcctgtggaatacggtaagtggcataaaaggagaagccaagaaggagaagggcatgacttttctaccgacaacagtttcgggtctgagagaagaggaacgcaaggagaagggagtggcctttttggctacaaccgagctgcccgccaggagcatcgatctgtctgcactgaacctgacagagcttgttaatggtatgttatcccgggccctgaaagactctaaaaagttcttctccttgctgtcggtaacttcttattcgtcgttcgcgttccacaagtttagcgtggcggtgtacaatatcagtaatttgaaaaccgtcgatcctgcgaaatttcccactagatactgctactgcctcaacaaccgaactaacgatctgtccgattttacagctctgctggttgacatcatcggcaactccaccagttacctgacagagattttcaagagtaccagtatccttagtgtgaatcagtcgaatgagagcgattgtatattcatctgcgtgatgacaggcaagtcgggaagaaatctgagtgatttctgggaaatagaggaaaagtacccaattatcaactacacatttacgtccggtctctctggagtgctgggcgctgccactcggggcacagccagaaccagtaagccgacgaccaagagtcaaaagaccctccccagcactagccctggccactggacacaatctacaccttgggctagtgcgctgcgatcctccccctggactgagacagccgctccttccgagacggaggagaccctgaatactggcaggccacctgagctgcccgctcgcgcgaccgcgacctggttctccgcatcgcacacattgccagccttagccacccggcgcgtcgctcgtactcagtggctgactgctgatcgccagacttgggctagcataagctctgtgccatgggcgcaaaccatttcggaaaagaagcctggcggtagtctttgggaaactcgctccagccctcccaccacagcaggcacagaagaagccatgaataccacaagtttgctggccccagccgcagagatcatggccaccccgggttccccctcgcaagcttccccaacacttggcgccttcactcatgggactcagacaccctctccgactaaggctacagcacctcgctatccgcagaccggcgacctgtccgccgagtggcctttcacagcaggtgaggaaccagtgctagtccctcgccctcatcaggtatctcgctgtccacaacctctgttcaaggtgggagccatggctgctgctccccttaccctggcgatacagcggctgaacccttgcctgatggagctatgccagttcttccagcagtgcctttgcatgagccaacgctcgccgcggacggaggatatgcgttactgcctggagtattactcttggtttctgaagaacgccacctatatatgccaacgagtcaaacgagtgtcgcattcacatacgctcaagcagaagtgtttggagaatatttgcaagtcagtgtag

SEQ ID NO: 190591 - DNA, 558 bp, Artificial Sequence
  Description of Artificial Sequence: Synthetic coding sequence
atgagccccagcctgcaggagggcgcccagctgggcgagaacaagccttccacctgctcgtttagcattgaaagaatcctgggtcttgaccagaagaaggattgcgtcccgctgatgaaaccccacaggccctgggccgacacttgtagttcttcaggtaaagacggaaatctctgtttgcacgtccctaacccccccagtggcatttcttttcccagtgtggtcgatcaccccatgcccgaggagcgggccagcaagtacgaaaactacttttccgcgagtgagagactttcccttaagagggagctgtcttggtaccgcggccggcgaccacgaaccgcctttacacaaaaccagattgaagtgcttgaaaatgtgtttagagtaaactgctatccaggcattgacatcagagaggatctagcccagaagctgaatctggaagaggaccgcattcagatttggtttcagaatcgacgggccaagcttaaacggtcccacagggaatcacagtttctaatggccaaaaaaaattttaacactaacctcttggagtag

SEQ ID NO: 190592 - DNA, 324 bp, Artificial Sequence
  Description of Artificial Sequence: Synthetic coding sequence
atgagccccagcctgcaggagggcgcccagctgggcgagaacaagccctctacatgcagcttctccatcgagcggattctcgggctggaccagaaaaaagattgtgtgcccctgatgaaacctcatcgaccctgggcagatacgtgtagctctagcggcaaagatggaaacttgtgtctgcacgtgccaaacccaccttccgggattagtttcccctcagttgtggatcaccccatgcctgaggagcgcgcgagcaagtatgaaaattacttcagtgcttccgagcgcttgagtttgaaaagagagctgtcttggtacaggtag

SEQ ID NO: 190593 - DNA, 1263 bp, Artificial Sequence
  Description of Artificial Sequence: Synthetic coding sequence
atggaggtgcccccccggctgagccacgtgcccccccccctgttccccagcgcgccagcaaccctcgccagtcggagcttgtcccattggaggccgcggcctcctagacagcttgcccctctcctcccttctctggcaccttcctctgcccgccaaggggccagaagggctcagagacatgtgacagctcagcagcccagtcgacttgcgggaggggctgctatcaagggcggaaggcgccgccgcccagaccttttccggaggcatttcaagagttcatcaattcaacggagtgccgccgccgcagcagctacgcgcactgcccgccagcatccacctgccgatagttccgtaacaatggaggacatgaatgaatatagcaacatagaggagtttgccgagggatcaaaaatcaatgcttccaaaaatcagcaggacgatggaaaaatgtttatcgggggactctcgtgggatacctccaagaaggatctcaccgagtacttgtctaggtttggcgaagtcgtcgactgcacaatcaaaactgaccctgtcacaggcagaagtcgcggctttggcttcgtcctgttcaaagacgccgcaagcgtggacaaggttctagagttaaaagagcacaaactggacggcaagctgatagatcccaaaagggccaaagcactgaaaggcaaagaacctccaaaaaaagtgtttgtgggtggcctatcgcccgacacaagtgaggagcagatcaaagagtatttcggcgccttcggcgaaatcgaaaatattgagctgccaatggacacaaagaccaacgaaaggagaggcttttgcttcattacgtacacagacgaggagccggtgaaaaaactgctcgaatctcgataccaccagatcggatctggcaaatgtgaaatcaaagtagctcagcctaaagaagtctaccgccagcagcagcaacaacagaaggggggccgcggcgcggcggctggtgggcgcggcgggaccagaggccgaggcagagggcagggacagaactggaatcagggattcaacaattattacgatcagggttacgggaactataactccgcctacggaggtgatcagaactactctgggtatggaggctatgattatacaggctataattatggcaactatggctatggccagggctacgccgactattcgggacaacagtccacttacggcaaagcatccaggggcggcggtaaccaccagaacaactaccagccatattag

SEQ ID NO: 190594 - DNA, 735 bp, Artificial Sequence
  Description of Artificial Sequence: Synthetic coding sequence
atggaggacatgaacgagtacagcaacatcgaggagttcgccgagggctccaagatcaatgcttccaagaatcagcaagacgatggtaagatgtttatcggcggactgtcctgggacacatccaaaaaagatctaactgaataccttagtcgattcggcgaggtggtagattgcactattaagaccgaccctgtgaccgggcgctccaggggctttgggtttgttcttttcaaggacgcagcatctgtagacaaggttttagagttaaaggaacacaaattggatgggaagctcattgatcccaaacgggcaaaagctctgaaaggcaaggagcctcccaagaaggtctttgtgggaggtctgagtccggacacctctgaagaacaaatcaaggaatactttggcgctttcggcgagattgaaaacatcgaactgccaatggacaccaaaacaaacgaacgcagaggattttgttttataacctataccgacgaagaaccagtgaaaaagcttttagagagtcggtaccaccaaattggttctggcaagtgcgaaattaaggtggcccagcctaaggaggtgtacagacagcagcaacagcaacagaagggcggccgaggcgcggccgctggcgggagagggggtacacgcggccgcggcagggggcagcagagcacctatggaaaggccagccgcggcggggggaaccaccaaaacaactaccagccatattag

SEQ ID NO: 190595 - DNA, 1263 bp, Artificial Sequence
  Description of Artificial Sequence: Synthetic coding sequence
atggaggtgcccccccggctgagccacgtgcccccccccctgttcccaagcgccccagcgactttggcatcgcgaagcctgtctcattggagaccccgacctcctaggcagctggcgccattgctaccctctttggccccttcgagtgccaggcagggtgcccgccgggctcagaggcacgtcacagcacagcagccctccagactcgcggggggagcggccatcaagggtggcagaagacggaggccagacttattccgacggcatttcaagagctcttcgatccagaggtccgcagccgcagccgctgctactcggacagcgaggcaacatccacccgccgactcttctgtgacaatggaagatatgaacgaatactctaacatcgaagaatttgccgagggctctaaaatcaacgcaagtaagaaccagcaggacgacgggaaaatgttcattggagggttgtcctgggatacttccaagaaagatctgactgaatacctctcgcggttcggagaggtggtggactgcacgatcaagaccgatcctgtaactggaaggagcagaggttttgggttcgtgttgttcaaggacgccgcctccgtggataaggttcttgaacttaaggaacataagctggatgggaaactgatcgatcctaagcgtgccaaagcactgaaaggcaaggaaccacccaaaaaggtgtttgtgggcggcctatcccccgacacaagtgaggagcagattaaggaatattttggggcatttggtgaaatcgaaaatatcgaactcccgatggacacaaagacaaatgagcgaagaggattttgcttcatcacctataccgacgaggagcccgtaaagaaactgctggagagcaggtaccaccagattggaagtggtaagtgtgaaatcaaggtggcccagcccaaagaagtgtatagacagcagcagcagcagcagaagggcgggcgcggagcggcggccggcgggcgcggggggacaagaggccgcgggaggggccaagggcagaactggaatcagggtttcaataactactatgaccaggggtatgggaattataattccgcttatgggggggaccagaattatagcggttacgggggttatgactacaccggatacaattatggtaattatgggtatgggcagggatacgccgactattccggccagcagtcgacttatgggaaggcctcacggggaggcggcaaccaccagaacaattaccagccatattag

SEQ ID NO: 190596 - DNA, 1902 bp, Artificial Sequence
  Description of Artificial Sequence: Synthetic coding sequence
atggccaaccaggtgaacggcaacgccgtgcagctgaaggaggaggaagaaccaatggacaccagctccgtaactcacactgaacattacaaaacattgatagaggccggactgccccagaaagtggcagagaggctagatgagatcttccagacagggctggtggcctacgttgacctagatgagagagccatcgacgccctccgtgagtttaatgaggaaggcgccctttccgtccttcaacagtttaaggagtcagatttaagtcacgtgcagaacaaaagtgcttttctgtgcggcgtgatgaaaacctacagacagagagaaaagcaagggagcaaggtgcaagagtctaccaaagggcccgatgaggccaagatcaaggcactcctggaacggacaggctataccctggatgttacgaccgggcagcggaagtacggcggacccccaccagatagcgtgtactccggcgtacagcctggcataggtactgaggtttttgtagggaaaatcccacgtgatctgtacgaagacgagttggtccccctgttcgagaaggccggaccaatatgggacctccggctgatgatggatccacttagcggccagaaccgaggctatgctttcattacattctgtgggaaagaagccgctcaggaggcagtgaagctgtgcgatagttacgaaatcagacccggcaaacatcttggagtgtgcatttcggtagcgaacaaccggctattcgtgggcagcattccaaagaacaaaactaaggagaatatacttgaggagttttccaaggtgactgaggggctggtggatgtcatactttatcaccaaccagatgataagaaaaagaaccgcggcttttgctttttggaatatgaagaccataaaagcgcagcccaggcccgccgccgactgatgtcaggcaaagttaaggtgtgggggaacgtggtcacagtggagtgggccgaccccgtggaagagccagaccctgaggtgatggccaaagtgaaagtcctgttcgtccgaaatcttgcaactaccgttacggaagaaatccttgaaaagagttttagcgaattcggaaagcttgagcgcgtcaagaagcttaaagattacgcatttgtccatttcgaggatcgtggagctgcagtgaaagccatggatgagatgaatggtaaggaaatagagggagaggagattgaaatagtcctagctaaacctcctgataagaagcgcaaggagagacaggccgcccgccaagctagtagatccacagcttacgaagattattattaccacccccccccacggatgccgccgccaattcgtggaagaggacgtggggggggacgaggaggctatggatatccgccggactattatgggtatgaagactactacgatgactattatgggtatgattatcatgactacagaggggggtatgaggacccctactacgggtatgatgatgggtacgctgtccgcgggagggggggcggcagaggagggcgaggcgccccacctccccccagggggcggggcgctccacctccgagaggcagggcaggctactcccagcgaggcgcaccgcttgggcctccccgcggtagtaggggaggaaggggcggacccgcacagcagcagcgggggagaggttccagaggttcccgaggaaaccgcggtggcaacgtcggaggtaagcgcaaagccgatggctataatcagccggatagcaagcgtcgccagactaacaatcaacaaaattgggggtcgcagccaattgcacagcagcctctgcagcagggcggagactacagtgggaactacggctacaacaacgataatcaggagttctaccaggatacgtatgggcagcagtggaagtag

SEQ ID NO: 190597 - DNA, 1902 bp, Artificial Sequence
  Description of Artificial Sequence: Synthetic coding sequence
atggccaaccaggtgaacggcaacgccgtgcagctgaaggaggaggaagaacccatggacactagctctgttactcataccgaacattacaaaaccctgattgaggccgggcttccccagaaagttgccgagcgccttgacgagattttccagacaggcctggttgcgtatgtcgatttggacgaaagagcaattgacgccttgagggaatttaacgaggagggagccctgagtgtacttcagcagtttaaagaatccgatctgtcccacgttcagaataaatcagcatttctatgcggcgtgatgaagacctatcgtcagagagagaagcagggatcgaaagtccaggaatccaccaagggccccgatgaggcaaagatcaaggcgttattggagagaaccggatatacccttgacgtgacaacaggtcaacgtaaatatggcggcccccccccagattccgtgtattccggggttcagcccgggattggcacagaagtgttcgtgggtaagataccgagggacctctacgaggacgagctggtgcctcttttcgaaaaagctggccccatttgggatctgagactgatgatggatccgttgagtggtcaaaaccgcgggtacgccttcatcaccttctgcggaaaagaggctgcgcaggaggctgttaaactttgtgactcctacgagatcagaccaggcaagcatttgggcgtgtgtataagcgtggcaaacaacaggttgttcgtggggtctatccccaagaataagactaaagaaaacattctagaggagttctcaaaggttacggaaggactggtggacgtaattctgtaccaccaacctgatgacaagaaaaagaaccgcggattttgcttcctggaatacgaggaccacaagtcagcagctcaggccaggcgacgtctgatgagtggaaaagtgaaggtctggggcaatgtggtcactgttgagtgggccgatcctgttgaggaacctgatcccgaggtgatggctaaagtcaaagttctgtttgtcaggaatttggccacgactgttaccgaagagattctggaaaaatcattctcggaattcgggaagctggagagagtcaaaaagctcaaggactatgctttcgtccactttgaggaccggggggccgctgtgaaggctatggacgaaatgaacggcaaggaaattgaaggggaggaaatagagatcgtgttagcaaagcctcccgataaaaaacgcaaagagaggcaagctgctagacaagcgagtcggagcacagcttacgaggactactactatcatccaccgccccgaatgccccctcccatacgcggccgtggacgaggaggagggcgaggcggttatggttaccctcccgattactatggctacgaggactactatgacgattattacggatacgactaccatgactaccgcggaggctacgaggacccatactatggctacgacgacggctacgctgtgagaggacgtgggggaggcagagggggccgtggcgcaccaccaccgcccaggggccggggtgcaccccctcccaggggccgggccggttacagccagcggggtgctccactgggaccacctaggggaagtagagggggccgtggcggtccggctcagcagcagaggggcagaggctctcgaggaagccgtggaaatcgaggcggaaacgtgggtggaaagcgaaaagccgatggctacaaccaaccggatagtaaacggaggcagacgaacaaccaacaaaactggggcagtcagcccatcgcccagcagccactgcagcaggggggggattactctgggaactatggctacaataacgacaatcaagagttttaccaggacacctatggtcaacagtggaagtag

SEQ ID NO: 190598 - DNA, 1911 bp, Artificial Sequence
  Description of Artificial Sequence: Synthetic coding sequence
atggccaaccaggtgaacggcaacgccgtgcagctgaaggaggaggaggagccaatggacacatcctccgtgacccacacagagcactataaaactttaattgaagcaggcctgccacagaaagtggctgagcgcctcgatgagatttttcaaaccggccttgtggcatatgtggacctggatgaaagagccattgatgctttgagggaatttaatgaggagggggccctgtccgtcttacagcagttcaaggaaagcgatctttcacatgtgcaaaacaagtcggcgtttttatgtggcgtcatgaagacataccggcagcgagaaaagcagggtagcaaggttcaggaatccactaaaggcccggatgaagccaagataaaagcgctgctcgagagaacgggttacactctggatgtcaccaccggacagcggaaatacggcggaccgccaccagattctgtgtattcaggggtgcagcccgggattggcaccgaggtttttgtgggaaagataccgcgcgacttgtatgaagacgagttggtccccttgtttgaaaaggctggacctatttgggatcttcgactaatgatggaccccttgtcagggcagaacaggggctacgctttcatcactttttgcggcaaggaggcggcccaagaggccgtgaaactatgcgactcctacgaaattcgcccaggaaaacaccttggagtttgcattagcgtcgctaataatcgcctgtttgtcgggtctattcctaagaataaaacaaaagagaatattctggaagaattttcaaaagtgacaggcctgactgaaggacttgtcgatgtcattctctatcaccagccagacgacaaaaaaaagaatcgcgggttctgctttctggaatacgaagatcacaagtccgctgcgcaggcgcggcgacggctgatgtccggaaaggtgaaggtgtggggcaacgtcgtgacagtggagtgggccgatccagtcgaggagccagaccctgaggtgatggcaaaggtaaaggtgctctttgtgcggaatctggcgactactgttacagaagagatcctagagaaatcattctccgagttcggcaagctggagcgggttaaaaagctgaaggactatgcttttgtgcatttcgaggaccggggcgccgcagtgaaagccatggatgagatgaacgggaaagagatagagggggaggaaatcgagatcgtcctggccaagcctccagacaagaagcgcaaagaacgccaggctgctagacaggcttcgcggagcaccgcctacgaagattactattaccatccccctcctcgcatgccaccacctattcggggccgcggaaggggtggtggtcgaggggggtatggctacccccccgactactacggctacgaggactactacgatgactactatggctatgactaccacgactatagagggggctacgaagacccttactacggatacgatgatggctatgccgtgagaggccgtggtggcgggcgcggaggtcgtggggcacctccacccccgcgcgggcggggcgcccctcctcctcgggggagggccggatactcgcagcgcggcgcaccactgggccctccccggggaagccgaggtgggcggggcggaccagcacagcagcagcgagggcgcggatcacgaggatcccgaggcaacagaggcggcaatgtgggcggtaagagaaaggcagatggctataatcagccagatagcaagcgaagacagactaataatcagcaaaactggggtagtcaaccaatcgcccagcagcccctgcaacagggaggcgattattcgggtaactacggctataataacgacaaccaagagttctaccaagatacctatggccagcagtggaaatag

SEQ ID NO: 190599 - DNA, 1422 bp, Artificial Sequence
  Description of Artificial Sequence: Synthetic coding sequence
atgaagacctaccggcagcgggagaagcagggcagcaaggtgcaggaatcaacaaagggaccagacgaagctaagattaaagccttactggagcgtactggctataccctcgacgtgactacaggacagagaaaatatgggggcccaccacccgacagtgtatactccggcgtacagcctgggattggcactgagtgtgactcatatgaaatccggccgggcaagcacttaggtgtgtgcatctccgtagccaataaccgactcttcgtgggaagcatacctaagaataaaactaaggaaaatattttggaggaattctcaaaggtcactgaggggttggtggacgtgatcttataccaccagcccgacgataagaaaaagaatcggggcttttgtttccttgaatacgaagaccacaagtctgccgcacaagctaggagacgattgatgagcgggaaagtgaaggtttggggaaatgtggttactgtcgagtgggctgaccctgtcgaggaacctgacccagaagttatggccaaagttaaggtcctttttgtccgaaaccttgcgacaacagtgacggaagagatcctcgagaagtcattttctgagtttggcaagctggaacgcgtaaaaaagctaaaggattacgccttcgttcatttcgaagaccgtggagccgcagtgaaggcgatggatgagatgaacggtaaagaaattgaaggggaagagatcgagatagtgctggccaagccccccgacaagaagcggaaggaaagacaggcagctcgccaggcgtctaggagcactgcgtacgaggactactactaccacccaccacctagaatgcccccccccattcgcggcagaggacggggagggggccgagggggatacggatatcccccagactattacggctatgaagactactacgatgactactatggctatgactatcatgattatagaggagggtatgaggacccctattacggctacgatgatggttacgccgtacgagggcgaggcggtggaagggggggaagaggcgctccacctccacctagggggcggggcgctccccccccaaggggacgcgcgggttactctcagaggggggcaccgttaggcccccctcggggctcaagaggagggcgcggtggaccagcccagcagcagcgcgggcggggcagtcgcggatccaggggcaaccgtggaggaaatgtaggggggaaacgcaaggccgacggctacaaccagcctgactcaaaacgacgccagaccaataaccagcagaactggggctcccaaccaattgcgcagcagcccctccagcaggggggcgattactccggaaactacgggtacaacaatgacaaccaggagttctatcaagacacctacggccagcagtggaaatag

SEQ ID NO: 190600 - DNA, 1788 bp, Artificial Sequence
  Description of Artificial Sequence: Synthetic coding sequence
atggccaaccaggtgaacggcaacgccgtgcagctgaaggaggaggaagaacctatggatacctcaagcgtgactcacacagagcactacaagacccttatcgaagctggcttaccacagaaagtcgcggaacgtctcgacgaaatcttccaaacaggacttgtcgcatacgtcgacctggatgagcgggcaatcgatgcacttagagaatttaatgaagagggagcactgagcgtactgcagcagtttaaggagagcgacctcagtcatgtccagaacaaatctgctttcctgtgcggcgtcatgaaaacttatcgccagcgggagaaacaaggctccaaggttcaagagtcaacaaaaggtcctgacgaagcgaagattaaggtgttcgtgggcaaaatcccgcgggacttgtatgaagatgagctggtcccgctgtttgagaaggctggccctatttgggatctccgcctgatgatggatccgttaagtggacagaacaggggttacgcatttatcaccttctgtgggaaagaagcagcccaagaagccgttaaactctgcgacagctacgaaatccgacccggtaagcacctgggggtgtgcatctccgttgccaataatcgattgttcgtgggaagcattcccaagaacaagaccaaagaaaatatcctggaggagttttctaaggtaactgaaggactggtcgatgtaatcctgtaccatcaacccgacgataaaaagaaaaatcggggattctgctttctagaatatgaggaccacaaatcagcagcgcaggcccgaaggcggctgatgagcggtaaggttaaggtttggggcaatgtggttacagtcgaatgggctgaccccgttgaagagcccgacccagaggtcatggctaaggtcaaggttttatttgtgcggaacctggctaccaccgtgacagaggagattctggagaaatcatttagtgagtttggcaaacttgaacgggtgaagaaactaaaggactatgccttcgtgcacttcgaggaccgcggagcggctgtgaaagcaatggatgagatgaacggaaaagaaatcgaaggcgaggagatcgagattgttttggcgaaacctccagataagaagagaaaggagcgccaagccgccaggcaggcatccaggtcaaccgcttacgaggactactattaccacccccccccacgaatgcctccaccgatcaggggacggggccgcggcgggggccgaggaggatacggctacccccctgattactacggctacgaggattactacgacgattactacggatacgattaccacgactaccgagggggttacgaggatccctattacggatacgatgatgggtatgccgttagaggcagaggaggtggcagggggggcagaggggcaccgcctcccccacgaggacgaggagcaccccctcccagggggagagcgggatacagccaacgcggagctccactggggccacctcgaggaagcaggggcgggcgaggcggcccagctcagcaacagagaggcaggggaagtcgaggtagcagagggaatagaggcggcaacgttggggggaaacggaaagccgacggatacaaccagcccgatagcaagagacgacagacgaacaaccagcagaattggggctcccagcccatcgcacagcaaccgttacaacagggcggcgactatagcggcaactatgggtacaacaatgataaccaggaattctatcaggatacttacgggcagcaatggaagtag

SEQ ID NO: 190601 - DNA, 2304 bp, Artificial Sequence
  Description of Artificial Sequence: Synthetic coding sequence
atgcggagctgggccttcagctacctggacgccatggacaacatcacacggcagaatcagttttatgacacccaagttattaaacaggagaatgagtcgggttacgagagacggcctctggagatggagcaacagcaggcatataggcccgaaatgaaaacagagatgaaacagggtgcccccacttctttcctgccacctgaagccagtcagctcaagccagacaggcagcagtttcagagccgcaaaaggccgtatgaggagaatagaggaaggggctactttgagcatagagaagaccggcgcggtcgatccccgcaacctcctgcagaggaagacgaagatgattttgacgatacactagtggctatcgatacatacaattgcgacctgcacttcaaggtagcgcgagatagatcctccggttatccactcacaattgagggcttcgcttacctctggagcggcgctagagcctcatacggagtgcggagaggacgagtatgctttgaaatgaaaattaatgaggaaatcagcgtgaaacacttacccagtacagagcctgacccccacgtagtacgtattgggtggagcctggacagctgcagcacacagttgggtgaagagcctttctcttacggctacggaggtaccggtaagaagagcacgaactctcggttcgagaactacggtgataagtttgcggaaaatgatgtcatcgggtgtttcgccgactttgagtgcggtaatgatgtagaattgagtttcacaaaaaacggtaagtggatgggaatcgctttccgtatccaaaaagaagccctgggaggacaagccctgtacccccatgtgctggttaagaactgcgccgtggaattcaattttggacagcgggccgaaccctattgctccgttttacctggtttcacgttcatccaacatctgccgctttctgagaggatacgcggaaccgttgggcccaagagtaaggcagaatgtgagatactaatgatggtggggctgcccgcggccggcaaaacaacatgggctatcaaacacgcggcaagcaatccctccaagaaatataatatactcggaacaaacgccatcatggacaagatgcgggtgatgggcctccggcggcagagaaactacgccggtcggtgggacgtgctcattcagcaggctacccagtgtcttaacagactgatccagatcgcagccagaaagaaaaggaactatatcctggaccagactaacgtgtacgggagcgctcaaaggagaaaaatgagaccatttgagggcttccagcggaaagccatcgtgatctgcccaacggatgaggatcttaaagatcgcaccatcaagcgtacagatgaggaagggaaagacgttcctgatcatgcagtcctcgagatgaaggctaactttacgctgccagatgtgggtgacttcctagacgaggtccttttcatcgagctgcagcgcgaggaagcggataagcttgttcggcagtacaacgaggagggccggaaagccggaccacccccagagaaacgattcgataatcggggaggtggaggcttccggggtagggggggtggtggaggatttcagcgatatgagaatagagggccccctgggggtaaccgaggtggttttcagaatcggggcggcggtagcgggggcggcggcaactatcggggtggctttaaccggtcaggcgggggtgggtatagccagaatcgttggggaaataacaacagggataataataatagtaataaccgaggatcatacaacagggcgccgcagcagcaaccaccgccacagcagccccctccaccccagcctccaccccaacaaccgccgccacctcccagttacagccccgctagaaaccctcctggagcctccacttataataaaaactcgaacatccccggttcctccgctaacacttccacccccaccgtatcgtcctattcccctccccagcccagttacagccagcctccatacaatcagggtggttactcccagggctataccgcgccacctccgcccccccccccccctccagcctacaactacggtagctacgggggctataaccccgcaccctatacgccccctccacctccaaccgcccagacatacccacaaccttcctataaccaatatcagcagtacgctcagcagtggaatcagtactaccaaaatcaggggcaatggcctccttactacgggaattatgactatgggagctattccggcaacacacagggcggtacctcaacacagtag

SEQ ID NO: 190602 - DNA, 369 bp, Artificial Sequence
  Description of Artificial Sequence: Synthetic coding sequence
atggacgtgcggcggctgaaggtgaacgagctgcgggaggagctgcagaggaggggccttgatacgcgaggcctcaaggccgagcttgccgagaggttgcaagctgcgttagaggccgaggagccagacgacgaacgagagctcgacgcagatgatgagccaggcagacctggccacataaacgaagaagcagagctgcagcccgccacactgcagccgggacgcctgcagcccggattgcactcgccgaccgcctctacttccaccaccacctgtctgcagttgtgggagctccggaggctgcagccaggaccgctgtacccaacggccacaccgcattgcaccgatctcccttccgctcagctatag

SEQ ID NO: 190603 - DNA, 2271 bp, Artificial Sequence
  Description of Artificial Sequence: Synthetic coding sequence
atggacaacatcacccggcagaaccagttctacgacacccaggtgattaagcaagaaaatgaatctggatacgagcgccgtccactcgagatggagcaacagcaggcctatcggcccgagatgaaaaccgaaatgaagcagggtgcccccacctcctttttgcccccggaggcctcccagttgaagcctgacagacaacagtttcagagtcgaaaacgcccatatgaggaaaaccgtgggcgaggatatttcgagcacagggaggatcgtaggggaagaagtccccaacctcctgctgaagaggacgaggacgactttgatgatacgctggtcgctatcgatacctacaactgtgacctgcatttcaaggtggctagagacaggtcttcgggctatcctctcacaatcgaggggttcgcatatctctggagcggagcccgtgccagctacggggtgcgcagaggtagggtgtgttttgaaatgaagattaatgaagagattagtgtgaagcacctcccttccaccgaaccggatccccatgttgtcagaattgggtggtcccttgattcctgctcaactcagttaggtgaagagccattttcatacggctacggggggacgggaaagaaatccactaacagtagatttgaaaactacggggataaattcgcggaaaacgacgtgatcggctgctttgcagacttcgagtgcggaaacgacgtcgaactctcattcacaaaaaacggcaagtggatggggatagcctttagaatacagaaggaggcattaggcggccaggctctgtacccccacgtccttgtgaaaaattgtgccgtggaattcaacttcggccagcgcgctgaaccatactgttctgtcttgccagggttcaccttcatccagcacttgccgttgagtgagaggatcagagggacagtcggccccaagtcaaaggccgaatgcgaaatcctgatgatggtgggactgcctgctgccggcaaaacaacatgggccatcaagcacgctgcgtccaacccctctaaaaaatacaacattctgggaaccaacgccataatggataaaatgagggtgatgggcctgaggaggcagcgcaactacgcaggtcgctgggacgtgctaattcaacaagccacccagtgtcttaatcggctgatccaaatcgccgctagaaaaaagagaaactacatcctggatcagacaaacgtgtatggttcggctcagcgccggaaaatgcggccctttgagggctttcagcgaaaagctatagttatttgtcccactgacgaggatctaaaagatcggaccatcaaaaggacagatgaagaggggaaggacgttccggaccacgctgtcttggagatgaaggctaatttcaccctgccagacgtcggggactttctcgatgaggtgttgtttatcgagctgcagagggaggaggcagataagttagtgcgccagtataatgaagagggcaggaaagccggccctccgcctgagaaacgatttgacaatcggggcggaggcggttttagaggacgcggcgggggcggcgggtttcagagatacgagaaccgcggcccacccggcggaaaccgcgggggatttcagaatcgcggtggtggaagcggaggtggcgggaattataggggagggttcaaccggtccggaggagggggatattcacagaaccgatggggtaataataatcgggataacaataactccaataatcgggggtcttataatagagcacctcagcagcagccccctccacagcagccaccccctccacaacctccaccccagcagccgcctcctccccccagttatagtcccgctagaaatccacccggtgcgtcaacttacaacaagaactctaatatacccgggtcttctgcgaacacatcaactccaaccgtttcgagctactcccccccccaacctagttattctcaaccgccctataatcagggcggatacagtcagggctatacagcaccaccacctcctcccccacctccacccgcgtataattacgggagttatggggggtataatcctgctccatatacccctccacctccgcccaccgctcagacctaccctcagccgtcctataaccagtaccagcagtacgcccagcaatggaatcagtattaccagaaccagggacaatggccgccatactatggaaactacgattacgggtcctatagcggaaacacacagggaggaacatccacccagtag

SEQ ID NO: 190604 - DNA, 2259 bp, Artificial Sequence
  Description of Artificial Sequence: Synthetic coding sequence
atggacgtgcggcggctgaaggtgaacgagctgcgggaggagctgcagcggaggggtttggatacacgaggactcaaagctgaactggctgaacggcttcagcctccaccgccaggtctacagcctcacgctgagccaggcggatacagcggacctgacggccactatgcgatggacaatattacacgccagaatcagttttacgacacgcaggtgattaaacaggagaatgaatccggctacgaacggcgcccacttgagatggaacagcaacaagcatatcgaccggaaatgaagaccgaaatgaagcagggcgctccaaccagctttctccctcctgaagccagccaactcaaaccggataggcagcaatttcagagcagaaagagaccctacgaggagaatcggggacgcgggtatttcgaacaccgcgaagatcgccgcgggcgttcacctcagccccccgcagaggaagatgaggatgacttcgatgacaccctcgtcgccattgatacatataactgtgatctgcacttcaaggttgctcgggatagatccagtgggtatccactgacaatcgagggcttcgcttacctctggagcggggccagagcaagttatggcgtccgtcgtggccgggtgtgtttcgagatgaaagacttcgagtgcggtaatgacgtggaactgtccttcacaaagaacgggaagtggatggggattgcatttagaatccagaaagaagctctgggtggtcaggccctgtaccctcacgttcttgtgaaaaattgcgccgttgagtttaactttgggcagcgggcagagccttattgcagtgtcctcccggggtttacctttatccagcacttgcctctcagcgagaggattcggggcacagtggggcccaagtcaaaagccgaatgtgaaatcctgatgatggtcggattacccgcagcgggaaagacgacctgggcaatcaagcacgcggcatccaaccccagcaaaaagtacaatatactgggaacgaacgccattatggacaagatgagagtgatgggcctgaggaggcagagaaattatgccggtcgctgggacgttctgatccaacaggcaacacaatgtttgaatcgactcatccaaatcgctgctcgtaagaaacgcaactatatcctcgatcaaacaaacgtttatggtagtgcacagcgtcgcaagatgcgcccttttgaggggtttcaacgaaaagccatcgtgatctgccctaccgatgaggaccttaaagatcgtaccatcaagcgcaccgacgaggaaggcaaggacgtgccagatcacgctgtgctggaaatgaaggccaacttcaccctgcccgatgtgggcgacttcctggacgaggtgcttttcattgagctgcaacgcgaagaggccgataaattggtgcgacagtacaatgaggagggccggaaagcaggccccccacccgagaagcggtttgacaatcggggaggtgggggatttagaggacggggcggcggtggggggttccagcgctatgaaaacagggggccacctgggggcaatcgcggcggttttcagaaccgtggaggtggttccggcggcggagggaattaccggggtggatttaataggagtggaggaggcggatactctcagaacagatggggcaacaacaatagagataataacaactccaacaatcgcggttcatataaccgggctcctcagcagcagccacctccgcagcagccacctccaccacagcccccacctcagcagcctccacctccaccctcctacagtccagcccgtaacccccctggggccagtacttataataaaaacagcaatatacccggcagctcagcaaacaccagcaccccgactgtgtcctcttattcccctcctcagtcatttggctttttccctagtaccttccagccttcttactcccaaccaccctacaatcagggaggttattcgcagggatataccgcccctcctcctccccctcctcccccccccgcgtataactacggatcttatggaggatataatccggcaccctatacacctcccccaccaccaacggcccagacatacccacagccttcatataaccaataccaacagtacgcccagcagtggaaccagtattaccagaatcagggccaatggccaccatattacggaaactacgactacgggtcgtactccggcaacacccagggaggcacaagcactcagtag

SEQ ID NO: 190605 - DNA, 2571 bp, Artificial Sequence
  Description of Artificial Sequence: Synthetic coding sequence
atggacgtgcggcggctgaaggtgaacgagctgcgggaggagctgcaacgacgtgggctggatacacgcggcttgaaggcagaactggctgagcggcttcaggccgcacttgaagcagaggagccggatgacgagagagagctggacgcggacgatgagcctggcaggcctggacatatcaacgaagaagtcgagaccgagggtggaagcgaacttgagggcacagcacagcccccccctcccgggctgcaaccacacgctgagcctggcggctatagcggccctgatggacactacgccatggataatatcaccagacagaatcagttctacgatacacaagtcattaaacaagagaacgagtctggctatgaaaggcgccccttagagatggaacagcagcaggcttatagacctgaaatgaagaccgagatgaaacagggtgccccaacgtcctttctgccacctgaggcatctcagcttaaacccgacaggcaacagttccagtctcgaaaacgaccctatgaagagaatcgggggcgcggatattttgaacaccgggaagatagaagaggcaggtccccccagccaccagcggaggaggatgaagacgatttcgacgataccctggtggccattgatacctataactgtgacttgcactttaaagttgcccgcgatcgtagtagtggatatcccctgaccattgagggattcgcctacctgtggagcggagcccgggcgtcttatggcgttaggcgaggccgagtttgctttgaaatgaagatcaacgaagaaattagcgtcaagcaccttccttccaccgagcctgatccacacgtggtacggatagggtggtctttggactcctgctcaacccaactcggagaagagccctttagctacgggtatggaggcacaggcaagaagagcaccaacagccgatttgagaactacggtgataagtttgcagaaaatgacgtgattgggtgctttgccgacttcgagtgtggcaatgacgtagagctgtcctttactaagaatggtaaatggatggggattgcattccgtatacagaaggaggccttaggggggcaggctctctacccccacgtgctggtgaagaactgcgccgtcgagttcaacttcggccaaagagccgaaccctactgtagtgttttaccgggattcacattcatccaacacctgccgctttccgaacgcatacgcggtacggtaggccctaaatccaaggccgagtgcgagatcctgatgatggtaggcctcccagctgcagggaaaacaacctgggccatcaaacacgctgcctcgaacccttcaaaaaaatacaatatactgggaactaatgccatcatggataaaatgagggtgatgggactccgacggcaaaggaattatgcaggtcggtgggacgtgttgattcagcaagctacccagtgcctgaatcgattgattcagattgcggcccgaaaaaaacgtaactacatactcgaccaaaccaatgtgtatggaagcgcacagcgtcgcaaaatgaggccattcgaggggttccagagaaaggctattgtcatctgcccgacagatgaagatctcaaagatcggaccatcaaacggactgacgaagagggaaaagacgtccccgaccacgccgttctggagatgaaagcaaattttaccctccccgacgtgggtgacttcctcgacgaagtgttgttcattgagctgcagagggaggaggcagacaaattggtgagacagtataacgaggagggaaggaaagcggggccaccacctgaaaaacggtttgacaaccgcggagggggcgggttccgcggccgtggcggtggaggtggattccagcgctatgagaacaggggcccgcccggaggcaaccggggcggatttcagaatcgcggtggtggttcaggaggcggggggaattacagaggcgggtttaacaggtcaggcgggggagggtacagtcagaacaggtggggcaacaacaatagagacaataacaatagtaataacagaggatcctataatagagccccccagcagcaacctccaccccagcagcccccaccaccacaaccgccacctcagcagcccccgccccccccttcatattcgcccgcccggaatccccctggagccagcacctacaacaagaactcaaatattccgggaagctctgcaaacactagcacccctacagtcagctcctatagtccaccccagcccagttattcacagcccccatacaaccagggcggctatagtcaaggttacacggccccaccccccccaccgcctcccccacctgcttacaactacggtagctatggcgggtacaatccagctccctatactccacccccgcccccaactgcgcagacctacccacagccgtcatataatcagtaccagcagtatgcacaacagtggaaccagtactatcagaatcaaggccagtggccaccctactacgggaactatgactatggtagctattcaggcaatactcagggaggcacatccacccagtag

SEQ ID NO: 190606 - DNA, 2751 bp, Artificial Sequence
  Description of Artificial Sequence: Synthetic coding sequence
atggactgcgagcacagcctgagcctgccctgccggggcgccgaggcttgggaaatcggaatagataagtatctctatgccatgagactttctgatgaaaccctaatagacatcatgacgagatttcgcaaagaaatgaaaaatgggttgagtcgcgatttcaatcctaccgcaacagtcaaaatgcttccaaccttcgtgcgctccataccggacgggagcgagaagggggactttatagcattagatttgggtggttcatcctttcggatcctgcgagtgcaggtgaatcacgaaaagaaccagaatgtccatatggaaagtgaggtgtacgataccccggaaaatatagtgcacgggtcaggctcccagctcttcgaccatgtcgccgagtgtctgggagacttcatggaaaaaaggaaaataaaagacaagaagctgcccgtagggttcaccttttcgtttccctgccagcagtcgaagatagatgaggccatcctcataacatggacaaagcgctttaaagcttcaggcgtcgaaggggcagacgtggtcaagctgctgaataaggccattaagaagagaggcgattatgacgccaacatagttgctgtcgtgaacgacaccgtgggcacaatgatgacgtgtgggtatgatgaccagcattgcgaggtgggactcatcatcgggactggaactaacgcttgctacatggaagagttgcgccatatcgatctcgtggagggagacgagggaagaatgtgcatcaacactgaatggggggcctttggagatgacggatctcttgaggacatccggaccgagttcgatagggagattgaccgtggttccctaaacccaggcaagcagctttttgagaagatggtttcagggatgtacctgggggagctggtgcgtctcatcctcgtgaaaatggccaaagagggtctgctgtttgaaggacgaatcactcctgagctgttgactagggggaagttcaatacaagtgacgtctcggcaattgagaaaaataaggaagggctgcataatgccaaggagattctgactcgcctgggtgtcgaaccatcagatgacgactgtgtctccgtgcagcacgtatgtaccatcgtgtcattcagaagcgcaaatctcgttgcagcaaccctgggggctattctgaacagactgcgggataacaagggtacacctagactgagaaccactgtgggcgtggacggcagcctgtacaagacacacccccagtattcaaggcgcttccacaagacattaaggagactggtccctgactcagatgtgaggttcctgctttccgaatcgggcagtggcaagggcgcagccatggttaccgctgtagcctatcgccttgcagagcagcatcgtcagattgaggagaccctggctcacttccacctcaccaaggatatgttacttgaggtgaagaaacgaatgcgagcagagatggagctcggactccggaagcagacccacaacaatgctgtggtgaagatgctcccatccttcgttagacgcactccagacggaactgagaatggcgactttttagcgctcgatctgggcggcacgaatttcagggtgttactagtgaagatccgtagcggtaaaaagcggaccgtggaaatgcacaacaagatctatgcgatcccaatcgagatcatgcaagggaccggcgaggaattgttcgaccacattgtcagctgtatatctgacttcctggactatatgggtataaagggtccccgtatgcccctgggattcactttcagtttcccatgccagcaaacgtcgctggacgcaggaattctgattacttggacgaaggggtttaaggcaacggactgcgttggacacgacgtggtaaccctgttaagagatgccataaagagacgcgaagaattcgatttagacgttgtcgcagtggtcaatgatacagtggggaccatgatgacatgtgcatatgaagagcccacttgcgaagtagggcttatcgtcgggacaggcagcaacgcgtgctacatggaagagatgaagaacgtggaaatggtcgagggcgatcaaggccagatgtgcataaatatggaatggggagccttcggggacaatggctgtttggatgatattcggactcactatgaccggctggtggatgaatattctctcaacgcgggcaaacagagatatgagaagatgataagcggaatgtatctgggcgaaatcgtaagaaacatactgatcgactttaccaagaagggcttcctgtttagaggccagatttctgaaactcttaagacacgaggtatctttgagaccaaatttctctctcaaatcgaaagcgaccgactggcccttctacaagtgagggccattcttcagcagctcggcttgaattccacttgcgacgacagcattctcgttaagacagtgtgtggtgtggtgagtcgacgggccgctcagctgtgtggggcagggatggcggcagtagttgacaaaattcgggaaaaccgggggttggaccgactgaatgtgacagtaggcgtagatggcactctgtacaaattgcaccctcatttttcccgcattatgcaccagacagtaaaggaactctcacccaagtgcaacgtctcttttctgttgtcagaagatgggtccggcaaaggagccgccttgatcacagcggtcggtgtgagattgcgaaccgaagcgtccagttag

SEQ ID NO: 190607 - DNA, 2754 bp, Artificial Sequence
  Description of Artificial Sequence: Synthetic coding sequence
atgatcgccgcccagctgctggcctactacttcaccgagctgaaggacgatcaggttaagaagattgacaagtatctgtatgctatgcggctctctgacgaaactctcatagacattatgactagatttaggaaggagatgaaaaacggcctgtcacgtgattttaatcccacagcaaccgtcaagatgctgcctacattcgtgcggtccattcctgacggttccgagaagggagactttatagcactggaccttgggggctccagcttcaggattcttagagtgcaggtcaatcacgagaaaaatcagaacgtgcatatggagtccgaggtgtacgatacgccggagaacattgtgcatggaagcgggagccagttgtttgaccatgtagcagaatgcctcggggactttatggaaaagaggaagattaaggacaagaagctgcccgttgggttcaccttttcctttccgtgccagcaatccaagatcgatgaggctatattaatcacgtggactaagaggttcaaagcgagtggagtcgaaggcgctgatgtggttaaactgctgaacaaagcaattaagaagagaggcgactacgatgccaatatagtggctgttgtaaacgacacagttggaacaatgatgacctgcggctatgacgaccaacactgcgaagtgggcctcataatcgggacaggcaccaatgcgtgttacatggaagagttgcgacacatcgatctggttgagggagatgagggccggatgtgtataaacacagaatggggggcttttggggatgacggcagccttgaagacataagaaccgaatttgatagagagattgaccgggggagtctgaatcctgggaaacaactctttgagaagatggttagtggtatgtatttaggcgaactcgtgaggttgatcttggtcaaaatggccaaagaaggcttactcttcgagggacgtatcacccctgaactcctaacgcggggcaagtttaatacttcagacgttagcgctatcgagaaaaataaggagggactgcataacgctaaggaaatcttgactcgactgggagtggagcccagcgacgatgattgtgtgagcgtgcagcatgtctgcacaatcgtcagcttccgctcggcgaacttggtcgctgctacactcggtgccattttaaacaggttgagagacaataaaggcacccctcggttaagaaccaccgtgggtgtagacggcagtctatacaagacacacccccagtattcccggaggttccataaaacactcagacgcttggtcccagatagcgatgtgagattcctcttgagcgagagcgggagtggtaaaggggctgcaatggtgaccgcagtggcttaccgcctggctgagcagcacagacagatagaagaaaccctcgcccacttccaccttacgaaagacatgctgcttgaggtaaaaaagcggatgagagctgaaatggaacttggcctgcgcaaacagacacataataacgccgtagtaaaaatgttgccctcttttgtgaggaggactcccgacggtacggaaaacggtgatttcttggccctcgacttaggaggcacgaacttccgagtcctgctggtgaaaatccggtctgggaagaaaagaactgtagaaatgcacaacaagatttacgctataccgatagaaatcatgcagggcacaggagaagaattattcgatcacatcgtgagttgcatctccgacttcctggactacatgggcataaagggaccccgcatgcccctgggattcacattcagctttccgtgccagcagactagcctcgacgctgggatcttaattacgtggacaaagggattcaaagccacagactgtgtgggacatgacgtcgtaacattactacgcgacgcaattaaacgccgggaggagtttgaccttgatgtcgtggcagtggtcaacgatactgtcggcactatgatgacttgtgcgtacgaagaacctacgtgcgaagtggggctgatagttggtacaggctccaatgcatgttacatggaagaaatgaaaaacgtggaaatggtagagggagaccaaggacaaatgtgtatcaacatggagtggggggcctttggagataacggctgcctcgatgatatccgtacacattacgataggctcgttgacgagtacagcctgaatgccggtaaacagcgatatgaaaaaatgatcagcgggatgtatctgggagaaattgttagaaacatcctgatcgactttactaagaagggattcctgtttcggggccagattagcgaaactctgaagacccggggaatttttgaaaccaagtttttatctcagatagagagcgataggctcgcgctgctgcaggtgcgtgcaattttacagcagctgggcctgaactcaacctgcgacgattcgattctcgtgaagactgtttgtggcgtggtgtccaggagggctgctcagttatgtggcgcaggtatggctgctgtggtggacaaaatccgggaaaacagagggctggataggttaaacgtgaccgtgggcgttgacggaactctgtacaaactgcacccacatttttctcgtatcatgcaccaaactgtgaaagaacttagtccaaagtgtaacgtcagttttctgttgagcgaggacggttccggcaagggtgcggctcttatcactgctgtgggtgtgcgcttacggactgaggctagctcctag

SEQ ID NO: 190608 - DNA, 2718 bp, Artificial Sequence
  Description of Artificial Sequence: Synthetic coding sequence
atggccaagcgggccctgcacgacttcatcgacaagtacctgtacgcaatgcgtctctccgacgaaacactgattgacatcatgacaaggtttcggaaagagatgaaaaacgggctgagccgcgacttcaatcctacggctactgtaaagatgctgcccaccttcgttaggtccattcctgacgggagcgaaaaaggagatttcattgcccttgatctagggggctcctcatttcggatcttgagggtccaggtgaatcacgaaaagaatcagaatgtgcatatggaatctgaagtttacgacaccccggagaatatcgtgcacggatcaggaagtcaattatttgatcacgttgccgaatgcctgggagatttcatggagaagaggaaaattaaagacaaaaagctacctgtcggatttaccttcagttttccatgccagcagtccaaaatcgatgaggccatactgattacatggactaagcgatttaaggcttctggggtagaaggggctgatgttgtaaagctgctgaacaaagcgataaaaaagaggggagactatgatgctaacattgtcgccgtggtaaacgacactgttggcactatgatgacatgtggctacgacgaccagcactgtgaagtgggactgatcataggcacaggaacaaacgcctgttacatggaggaactccgacacatagatcttgttgagggggacgaaggccggatgtgcattaacactgagtggggtgcctttggagacgatggaagccttgaggatattaggactgagttcgacagggagattgacagagggagcctgaaccccggcaaacagttgtttgagaagatggtttcggggatgtatctgggagagctcgttcgcctaatcctggtgaaaatggccaaggaaggcctgcttttcgaaggaaggataactccagagctgctgactaggggcaagtttaacacctccgatgtctcagcgatagagaaaaataaagagggtcttcacaacgctaaggaaatcctcacccgtctgggagtggagccaagcgatgacgattgtgtcagtgtgcaacacgtgtgtaccatcgtgtcatttcgtagcgccaatctggtggctgccacgctcggcgcgatcctgaacagattaagagacaacaaaggcaccccacggctgcggaccaccgtgggagtggatggttcactttataaaacccatcctcagtactccaggcgcttccacaaaacgctgaggaggctggtgcctgatagcgatgtgagattccttctgtccgaatccggttctggtaaaggcgcagctatggtgactgccgtcgcctaccggctggcagaacaacaccgccagatagaggagacgctggcgcactttcacctcaccaaggatatgctgttggaagtcaaaaaacggatgagagctgagatggagttggggcttcgcaagcagacccacaacaatgctgtggtaaaaatgctaccctcgtttgtgcggagaacacccgacggtactgagaatggcgacttcttggccctggaccttggaggcacaaatttccgggttcttttggtgaaaatcaggtctggcaaaaaacggacagttgagatgcataacaagatttatgcgatccccattgagattatgcagggaacaggagaggagctgttcgaccacattgtgagttgtatttcagacttcctggactacatggggattaaaggacctcgcatgcccctgggcttcacttttagcttcccctgtcagcaaacatctctggacgctggcatactgattacgtggaccaagggattcaaggcgactgattgcgtgggacatgacgtcgttaccttgcttcgagatgctattaaaagaagggaagagtttgatctggacgtcgttgctgtggtgaacgacaccgtggggacaatgatgacatgcgcctatgaagagccaacctgtgaggtaggcctaatcgtgggaaccggatcaaacgcttgctatatggaggaaatgaagaatgtggagatggttgagggcgatcagggacagatgtgtattaatatggaatggggagcttttggcgataacgggtgcctggatgacatacggacgcactacgacaggctggtggacgagtatagtctcaacgctggtaaacagcgctatgagaaaatgatcagcggcatgtaccttggggagatcgttcggaatatcctgattgacttcactaaaaaagggtttttgtttcgcggccaaatctctgaaacgctgaaaactcgtggtattttcgaaactaagtttctttcacagatcgagagcgataggctcgccctactgcaggtacgagcgattctccagcaacttggtctcaatagcacctgcgacgattctatactagtcaagacagtctgcggcgtggtctctaggcgggccgctcagctctgtggtgccggcatggccgccgtggttgataaaatccgcgagaaccggggattggacagactcaacgtgacagtgggagtggacggcacattgtataaactccatcctcatttctctcggatcatgcatcagaccgttaaggagttatcacctaagtgcaatgtgagcttcctgttgagcgaggacggttcaggcaagggagccgctctgatcaccgcagtgggtgttcgtttgcgtactgaggcatcatcctag

SEQ ID NO: 190609 - DNA, 2766 bp, Artificial Sequence
  Description of Artificial Sequence: Synthetic coding sequence
atgggccagatctgccagcgggagagcgccaccgccgccgagaagccaaaactgcacctgctggcagaaagcgagattgataaatacctgtacgccatgagactgtcggacgagactctgatagacatcatgacccgcttcaggaaggagatgaagaatgggctctcccgtgactttaaccctacggccaccgtaaagatgctccctacattcgtgcgatccatccctgacggaagtgagaaaggagatttcatcgctttagacttgggcggttccagcttcagaatcctacgcgttcaggtgaaccatgagaagaaccaaaatgttcacatggagtcagaggtgtacgacaccccagagaatatcgtgcatggctctggatctcagctgtttgaccacgtggcggagtgcctgggggatttcatggaaaagagaaagatcaaagacaagaagctgcccgtcggattcacttttagtttcccatgtcagcagtctaagatcgatgaggcaattttgatcacctggaccaaacggtttaaggccagtggggttgagggggccgacgtggttaaactgctgaataaggccatcaaaaaacgcggcgactatgatgcaaatatcgtggcagttgttaatgacacggtgggcactatgatgacttgcgggtatgatgaccagcattgcgaggttggattgatcatcgggaccgggacgaacgcttgctacatggaagagctgaggcacatagatctagttgagggggatgaaggccgcatgtgcataaacacagagtggggtgccttcggagatgatgggtctctagaggatatcaggacagaattcgacagagagattgaccggggatcactcaaccctggcaagcagctctttgaaaagatggtgagcggcatgtatctcggggagctggtaagacttattctggtcaaaatggctaaagaagggctgttatttgaagggaggattacaccagagctcctcactaggggtaagtttaacacctcagacgttagtgccatcgaaaagaacaaggagggtttacataacgccaaagagattcttactcgtcttggagtcgaaccatccgacgacgactgtgtatcagtacagcacgtgtgtaccatcgtttcttttcgcagtgccaacctcgtcgccgccacattgggcgcaatacttaaccgtctcagggacaacaagggaacacctcgactaaggacaacggtgggggtcgatggctctctttacaagactcatccacaatattcaaggagattccacaagacccttcgacgtctggtgccagatagcgacgtgagattcctgctgtctgagtccggcagtggaaagggagccgcaatggtcactgccgtcgcatatcgtctggcagagcagcatcggcaaatcgaggagacacttgcacatttccacctgacgaaggacatgctccttgaagtgaaaaagcgtatgagagccgaaatggagctcggactgaggaaacagacccataataatgcggttgtgaagatgctgccatcattcgtgagaaggacacctgacggcaccgaaaacggggactttctggcactggacctggggggcacaaatttcagggtgctactggtgaagatccgcagtggcaagaagcgcacagtggaaatgcataacaagatctacgctatccctatagaaattatgcagggaacgggggaggaactcttcgaccacatagttagctgtatcagtgattttcttgactatatgggaatcaaaggcccacggatgccccttggctttaccttcagctttccatgtcagcaaactagcctggatgccgggattttaatcacttggacaaagggattcaaagcaaccgactgtgtgggccacgatgttgtcaccctcctacgcgacgctattaagagaagagaggaatttgatctggatgtcgtcgctgtggtgaacgataccgtgggaacaatgatgacttgcgcatacgaggagccgacttgtgaagtcgggctcatcgtgggtacagggtcgaatgcttgctacatggaggagatgaagaacgtagaaatggtggagggggaccagggtcaaatgtgcataaacatggagtggggagccttcggggacaatggttgcctcgatgacatacggacccactatgaccggctggtagatgagtattcacttaatgcaggcaagcagcgttacgaaaaaatgatatctggaatgtatctgggcgaaatcgtccggaacattctcattgatttcaccaaaaagggattcttatttagaggccagataagcgagacactgaagacccgcggcatctttgaaacaaaattcttgagccagatcgagtctgataggctagccttactgcaggtccgcgccatcctccagcagctggggctcaattctacatgtgacgattcaatactcgttaagacagtgtgtggggtggtttctagacgtgccgctcaattatgcggcgccggcatggcggcggtggtcgacaaaataagagagaacaggggcctagatcgcctcaacgttacggtgggtgtggatggcacgctgtacaagctgcatccgcatttctcccggattatgcatcaaactgtgaaagaattatcccccaaatgtaatgtttccttcctgctgtcagaggacggctcgggcaaaggtgccgccctcattaccgcggttggagtgcggctgagaacggaagcctccagctag

SEQ ID NO: 190610 - DNA, 2748 bp, Artificial Sequence
  Description of Artificial Sequence: Synthetic coding sequence
atgatcgccgcccagctgctggcctactacttcaccgagctgaaggacgaccaagtgaaaaagatcgacaagtacttgtacgcaatgcgattgtcagacgaaacccttatagatataatgacgcgtttcaggaaagagatgaaaaacggactgtctcgcgactttaacccaacagctactgtaaaaatgcttcctacattcgtccggtcaatccccgatggctcagaaaagggggatttcatcgccctggatctgggcggatcgtcatttcgtattctgcgcgtgcaggtgaatcatgaaaagaatcagaatgtgcacatggaaagcgaggtttatgatactcccgagaacattgtgcacggtagtggaagccagttattcgatcacgtggccgagtgcttaggcgactttatggaaaagcggaagatcaaagacaagaagctgcctgttggattcaccttcagtttcccttgtcagcagtcaaaaatcgacgaggctatcctgatcacttggactaaaaggttcaaggcctctggggtcgagggcgccgatgtggtcaaactgctcaacaaggctataaaaaaacggggcgactatgatgccaacatagtcgctgtcgtgaatgacaccgttgggaccatgatgacttgcggttatgacgaccagcactgcgaggtgggtttaattattggcaccggcacgaatgcatgttacatggaagaactacgccacatcgaccttgttgaaggggatgagggcaggatgtgtattaatacagagtggggtgcctttggggacgatggaagtcttgaggatattcggacagagttcgatagagaaattgatagggggtcacttaaccccggaaagcagctgtttgagaagatggtatctggaatgtacctaggggagcttgtgagactgattctcgtgaagatggctaaggaaggtctgttattcgagggtcgcataacccctgaactactgacgcgcggtaagttcaatacatctgatgtgtcagcaatcgagaagaataaggaggggctgcataatgctaaagagatcttgaccaggcttggagtagagcccagcgacgacgattgcgtgagcgtccaacacgtgtgcaccattgtttccttccgatcggccaatctggtggcggcaacgctgggcgcaatccttaatcgcttgcgtgataataagggaaccccaagactcaggactaccgtaggcgtggatgggagcctgtataaaacacaccctcagtacagtcgccgttttcacaaaacactgaggagactagtcccggactccgatgtaaggtttctcctgtccgagagtggatctggtaaaggtgctgcaatggttaccgccgttgcttatagattggccgagcaacaccgccagatcgaggaaaccctcgcgcacttccacctgaccaaggacatgctcctggaggtcaagaaaagaatgagggcagaaatggagcttggcctccggaaacagacacataacaatgccgttgtcaaaatgcttccttccttcgtgcggcgtaccccagacggcacagaaaacggagacttcttagcactggatctgggtggcacaaactttcgtgtgttgctggtgaagattagatctggcaaaaagcgtactgtggaaatgcacaacaagatctacgccataccaattgaaatcatgcaagggacaggcgaagaactgttcgatcatattgttagttgcatcagcgatttcctggactatatggggatcaaagggcccagaatgcctcttggcttcacctttagcttcccgtgccagcaaacatcacttgacgcaggcatactcattacctggacaaagggcttcaaggctaccgattgcgtcggacatgatgtcgtgacactgttacgtgatgccataaagaggagggaggaattcgatttggatgtcgtcgcagtcgtcaatgacaccgtaggcaccatgatgacctgcgcctacgaggagcccacgtgcgaagtcggccttatcgtgggaaccggctctaacgcctgttacatggaggagatgaaaaatgtggaaatggtagagggtgaccaaggacagatgtgcatcaatatggaatggggcgctttcggtgacaatgggtgtctggatgacattcgcactcattatgaccgcctagtggacgagtacagtctcaacgctgggaaacagcgatatgaaaagatgatttccggaatgtatctcggtgagatcgtacgcaacatactcatcgactttactaagaaggggtttctctttagaggacagatttccgagactttgaaaactaggggcatttttgagaccaaatttctgtcacagattgagtcggaccggcttgcccttctgcaggtgagggccatcttacagcagctgggtcttaacagtacctgtgacgatagtattctagtgaaaaccgtgtgcggggtggtgtctagacgagcagcacagctgtgtggagcaggaatggcagccgttgtcgataagatcagggagaaccgcggcctggaccgattaaacgtgacagtgggagtcgacggcacactgtacaagctccatccgcacttctcccgcataatgcaccagaccgttaaggaattatctcccaaatgtaatgttagttttcttctcagcgaagacggctccggcaagggagccgcattgatcacagctgtcggggttagattaagaactgaggcttag

SEQ ID NO: 190611 - DNA, 345 bp, Artificial Sequence
  Description of Artificial Sequence: Synthetic coding sequence
atggccaagcgggccctgcacgacttcatcgacaagtacctgtacgccatgaggctgagtgacgagaccttgattgatatcatgacacgtttccgtaaggaaatgaagaacggattgagtagagattttaacccaactgcgaccgtaaagatgcttcctacttttgtcaggagtatccctgacgggagcgaaaagggtgacttcattgctcttgatctcggcggaagctcttttaggatccttagggtccaagtcaatcacgagaaaaatcagaatgtacacatggaatcggaggtatacgacacgcctgagaacatcgtgcacggctcgggctcacaattatag

SEQ ID NO: 190612 - DNA, 876 bp, Artificial Sequence
  Description of Artificial Sequence: Synthetic coding sequence
atggactgcgagcacagcctgagcctgccctgccggggcgccgaggcctgggagattggaattgataaatacctatatgctatgcggctcagtgacgaaacacttatcgatattatgacccggtttcggaaggagatgaagaatggactgagccgagactttaatcctacagctacggtaaaaatgttgcccactttcgtgcgctctatacccgacgggtcagaaaagggggatttcatagccctggacctcggcggatcttcctttcggatcctccgggtacaggttaaccacgagaagaatcagaacgtccacatggaatcagaggtctacgacactccagagaacattgtccatggaagcggctctcaattatttgaccacgtcgcagaatgtctcggcgactttatggagaaaaggaaaattaaggacaaaaagctgcctgtcggcttcacattctcttttccttgccagcaaagcaagatcgatgaagcaattcttataacatggaccaagcggtttaaggcgtcaggcgtcgaaggagccgacgtagtgaaattgctcaataaggcaataaaaaagcgaggtgattatgatgccaatattgtggcggtggtaaatgacacagttggcactatgatgacctgcggctatgatgaccagcattgtgaggtcggcctcatcattgggacaggtacaaatgcatgttacatggaggaattaagacacattgatctggtggaaggggatgagggccgaatgtgcatcaacaccgaatggggcgctttcggagatgatggcagcctggaggacattagaaccgaatttgatagagaaattgaccggggatcattgaaccccggtaaacaactctag

SEQ ID NO: 190613 - DNA, 2859 bp, Artificial Sequence
  Description of Artificial Sequence: Synthetic coding sequence
atgggccagatctgccagcgggagagccggcagggcctggccatgctcccccgcctctttctgaatccgtggagacaggtcattcttctcccgcagccccccaaggtattaggattgcaggccacagcagccgaaaagcccaagctgcacctgctggctgagagcgaaatcgataagtacttatacgccatgcgcctgagcgatgagaccttaatagacatcatgacgcgttttcgcaaggaaatgaagaacggcctgtctagggattttaatcctacagcgacggtgaagatgctccccactttcgtccgttccattccagatggatctgagaagggcgattttattgcgcttgacctgggaggaagttctttccggattctgcgggttcaggttaaccatgaaaaaaatcaaaatgtgcacatggaatctgaagtgtatgacacccctgagaatatcgtacacggctccggaagccaactctttgatcatgttgccgagtgtttgggggacttcatggagaagcgtaagataaaagacaagaagctgccagtgggcttcacattttccttcccttgtcagcagagtaagattgatgaggccatcctaataacctggacaaagcgctttaaagcctcgggcgtggagggagctgacgtggttaaacttctcaataaggccataaagaagagaggcgactatgacgccaatatcgtagcagtggtgaatgataccgtcggcacaatgatgacatgcggatacgatgaccagcactgcgaggtcgggttaatcatcggtactggaacgaatgcgtgctatatggaggagctgaggcacatcgacttagttgaaggggacgaaggccggatgtgtatcaataccgagtggggggcctttggcgacgatggctctttagaagacatccgtacagagtttgatagggagattgataggggctcactcaaccctggtaaacagctgttcgagaagatggtgagcggtatgtatttgggcgaactagtgcggttaatcctggtcaagatggctaaagaagggctgctgtttgagggccggataacaccggagctcctgacacgaggcaagtttaatacctccgatgtttccgctatagagaaaaataaggagggcctccacaacgctaaggagatcttgacacggctcggagtggagccaagtgatgatgactgcgtgtcggtgcagcacgtgtgcacaatcgtgagctttcgcagtgccaaccttgtcgccgctacactcggggctatcctgaatagactgcgggataataagggtactcccaggttacggacaacagtcggtgtggatggttcactgtacaagactcacccacagtatagcaggagattccacaaaaccctgcggcgactcgttccagactcagacgtccgattcctgctttcggagtccgggagtggcaagggagccgccatggtgaccgcggtcgcgtaccggctcgccgagcagcatcgacagattgaagagactctagcccactttcatctgactaaagatatgctccttgaggtcaagaaaagaatgagggctgaaatggaacttgggttgaggaaacagacccataataacgccgtggtgaaaatgcttcctagtttcgtccggaggacgccagacggaacagaaaacggggacttcctggcacttgatctggggggaacgaatttccgggttctgcttgttaagatacgaagtggtaaaaagcgcacagtcgagatgcacaacaaaatctacgctatacctatcgagattatgcagggtacaggagaggaactgtttgaccacatcgtgagctgtatctctgacttccttgattacatgggcattaaaggtccgcgcatgcccttgggcttcaccttttcgtttccctgccagcagacctctcttgacgccggtatactgattacgtggactaagggattcaaagcaactgactgcgtgggacatgatgttgtgactttgctcagggacgcaatcaagcgtcgggaggaatttgatcttgacgtggtggccgtggtcaacgatacagtgggaaccatgatgacctgtgcttatgaagagcctacctgcgaggtcggactgatcgtggggaccgggagtaacgcttgttatatggaggaaatgaaaaacgtagagatggtagagggggatcaaggtcagatgtgcattaacatggaatggggcgcatttggggacaacggttgcttggatgacattcgaacacattacgatagactggtggatgagtacagcctgaacgccggtaaacaacgctatgagaagatgatttctgggatgtatcttggtgaaatcgtacggaacatcctcatagacttcacaaaaaaggggtttctcttccggggccagatttctgaaaccctcaagacacgaggcatttttgaaaccaagtttttgtcccagatcgaatctgacaggctggcgctgttacaggtgcgagctatcctccagcagctgggtctgaactcaacctgcgacgacagcattctggtgaagaccgtatgcggagtggtgtcgagaagagcagcacaactttgtggcgccggtatggctgccgttgtagacaagattcgagagaacagagggctggataggctcaacgtgacggttggcgtagacggcacactgtataaactgcacccgcacttctcccgaatcatgcatcagacggtaaaggagctgtcacccaaatgtaacgtttccttcctgttatcagaagatggatcggggaaaggagcagccctgattacggcagttggagtgaggctgcgcactgaagcgtcctcctag

SEQ ID NO: 190614 - DNA, 420 bp, Artificial Sequence
  Description of Artificial Sequence: Synthetic coding sequence
atgggccagatctgccagcgggagagcgccaccgccgccgagaagcctaaactgcatttgctggcagagtcagagattgacaagtacctatatgccatgcggctatccgacgaaacactcatcgacattatgacccggtttcgaaaagaaatgaagaatggattaagtcgagatttcaaccccacggctaccgtcaagatgctgcctactttcgttagaagtatccctgacggctctgaaaagggcgacttcatcgctttagaccttggtggatcctcatttagaattcttcgtgtacaagtcaaccatgaaaagaaccaaaatgtgcacatggaatcagaggtgtacgatacccccgagaacatcgtgcatggatcaggcagccagctatttgaccatgtcgctgagtgcctgggatag

SEQ ID NO: 190615 - DNA, 2754 bp, Artificial Sequence
  Description of Artificial Sequence: Synthetic coding sequence
atgatcgccagccacctgctggcctacttcttcaccgagctgaaccatgaccaagtgcaaaaagttgatcagtacctgtatcatatgagattatccgatgagacgctgcttgagatttctaagcgtttccgcaaggaaatggagaagggccttggagcgacaacccatcctaccgccgccgtgaaaatgctgccaacttttgtgcggtccacccctgatggcaccgagcatggagagtttctagcattagacctgggaggcacgaattttagggtactgtgggtgaaggtaacggataacggattgcagaaggtcgagatggaaaaccagatctacgccatacctgaggacatcatgcgggggagcggcacccagctttttgaccatatcgccgaatgtctcgctaatttcatggacaaattgcagatcaaggataagaagctgcctctcggatttactttcagcttcccatgtcatcagacgaagctcgacgaaagcttcttggtgagctggaccaaggggttcaaatcgagcggagtggaaggccgagatgtcgtggcgctcatccggaaggcaattcagcgtcgcggagattttgacatcgacattgttgccgttgttaatgacacagtgggaaccatgatgacatgcggctatgatgaccataattgtgagattggactgatagtgggcacaggctccaacgcgtgttatatggaggaaatgcgacacattgacatggttgagggagacgaaggacgaatgtgcataaacatggagtggggggcgtttggtgacgacggcagtctgaatgatatcaggacagagtttgaccaagaaatcgatatggggtctttaaaccccggaaagcagctgttcgaaaagatgatctcaggcatgtacatgggcgagctggtaagattgatcctggtgaagatggccaaggaggaactgcttttcggcggaaaactatcgcccgaattgttgaacaccgggcggtttgaaactaaggatatctctgatattgaaggcgaaaaagatggcatcagaaaagcgcgggaggtgcttatgaggctgggactcgatcctacacaagaagactgcgtggcaacacaccgcatctgccaaatagtttcaaccaggagcgcttccctctgcgccgccactctggctgcagtgttgcagcgaatcaaagagaataaaggggaggagcgactccgttcaactatcggcgtcgacggctccgtgtataagaaacaccctcatttcgccaagagattacacaagaccgtccggagattggtgcctggttgcgatgtgaggttcctcagaagcgaggatggcagtggtaagggtgccgccatggtgaccgccgttgcctatcggctggccgatcaacaccgggccagacagaagacgctggaacacctgcagctgtctcatgaccagttgctggaagtgaagcggaggatgaaagtcgaaatggagcggggcttgtcaaaggaaacacacgctagcgcacctgtgaaaatgctgccaacatatgtatgtgccacacccgacgggacagagaaaggagacttcctggcccttgatctcggagggaccaacttcagggtgcttctcgtccgagtccgtaacggcaagtgggggggagtggagatgcataataaaatctatgccatcccccaggaggtaatgcacggtaccggggacgaactcttcgaccacatcgtgcagtgcatcgctgattttcttgaatacatgggaatgaaaggagtctctctgccgttaggctttacattcagtttcccttgccagcagaatagtctggacgagagtatcctgctgaaatggactaaaggtttcaaagcaagtggatgcgagggtgaggatgtggtgaccttgctcaaagaagctatccatcgccgagaggagttcgacttggacgtcgtagcggtggtgaacgataccgtcggtaccatgatgacttgtggattcgaagatccccactgtgaggttggactgattgtgggaacaggatctaatgcgtgctatatggaggaaatgagaaatgttgaactagttgaaggcgaagaagggcgcatgtgtgttaacatggaatggggcgccttcggcgacaacggatgtctggatgacttccgcaccgaattcgacgtggccgtggatgaactaagcctgaacccagggaaacagaggttcgaaaaaatgatcagcggcatgtatctcggcgaaatcgtgcgtaatatcctcatagacttcacaaaacgcggtttactgttcagaggcaggatatcagagcgcctcaagacacgcggtattttcgaaacgaagtttctgagccagattgagtctgactgcctggcacttttgcaggtacgcgcaatcctgcagcatttgggactggaatccacctgtgacgattctattatcgtgaaggaagtgtgtaccgtagtggccagaagagctgctcagctctgcggcgccgggatggctgcagttgtggatagaattcgcgagaatagaggactggatgccctcaaagtgacagtcggcgtggatggaaccctatataaactccatccacacttcgccaaagtgatgcatgagacagtgaaagacttggcccctaagtgtgatgtaagtttccttcagagcgaggacggttcaggcaagggggcagcactgatcacagccgtagcatgccggattcgggaagcagggcagcgctag

SEQ ID NO: 190616 - DNA, 2670 bp, Artificial Sequence
  Description of Artificial Sequence: Synthetic coding sequence
atgcggctgagcgacgagaccctgctggagatcagcaagcggttcaggaaagaaatggaaaaaggtctcggggccacaactcaccctacagccgcggtgaagatgcttcccacctttgtcagaagcactcccgacggaactgaacacggggagtttttggcgctagatctcgggggcacgaatttccgggtgctgtgggtgaaggtgaccgataacggcctgcagaaggtggagatggagaaccagatctatgcaattcctgaggatatcatgagggggagcgggacccagctctttgatcacattgcagagtgccttgccaatttcatggataaactccagatcaaggataaaaagctccctctgggctttaccttttcttttccgtgccaccagaccaaactcgatgaaagttttctggtgtcatggactaagggattcaaatcttctggtgtggaggggcgggacgtggtggcgctgatccggaaagctatccagaggagaggcgatttcgatatcgacattgttgctgtggtgaatgacactgttggcaccatgatgacttgcggctacgatgaccataattgtgagatcggattgatcgtgggaacgggctccaacgcatgctatatggaggaaatgcgccacattgacatggttgagggcgatgaaggacgaatgtgtattaatatggagtggggcgctttcggagacgacggatcgctgaatgatatccgtactgaatttgaccaggagatcgatatgggctctctgaatcctggcaaacagctctttgagaagatgattagtggaatgtacatgggcgaactcgtgcgactcatcctggtgaagatggccaaagaagagctactgttcgggggcaaactctcaccagagttactcaacaccggtcgcttcgaaaccaaagacatttctgacatagagggagagaaagacgggatcaggaaggctcgagaggtactgatgagacttggcctcgacccaacccaagaagactgtgttgccacacataggatttgtcaaatagtgtccactcgcagtgcctctctatgtgccgccaccctcgctgccgtcctacagagaatcaaggagaataagggcgaagagcgcctccggagcactattggcgtcgacggctctgtgtacaagaaacacccccactttgcaaaacggttgcacaagacggtgaggcgcctggtgccaggttgtgacgtccggtttctgaggagtgaggatgggagcgggaaaggagccgctatggttaccgccgtggcttaccgccttgccgaccaacaccgcgccagacaaaagaccctggagcatttacaattgagtcatgaccagctgctggaggtcaagcgtaggatgaaggtggagatggaacgcggactctcgaaggagacccatgcctcagcccccgtgaaaatgttgccaacatacgtgtgtgccacaccagacggcaccgagaaaggggacttcctggccctagatctgggcggcacaaattttcgggtactgctcgtccgcgtgagaaatggtaagtgggggggtgtagaaatgcacaataagatttacgccattccccaggaggtaatgcacgggaccggtgacgagcttttcgaccacatagtccagtgcatcgccgactttcttgaatacatggggatgaagggggtcagcttgcccctgggcttcaccttctcctttccttgccagcagaatagtctggatgagagtattttgctcaaatggacaaaggggtttaaggcatctggctgcgaaggggaggatgtggtgacactcctgaaggaggccattcacaggagggaggaatttgacctggacgtagtggcggtggtgaacgataccgttggcaccatgatgacctgtgggttcgaggatccccactgtgaggtgggactgattgtgggcaccggttcaaacgcgtgttatatggaggagatgaggaatgtggaattggtggagggcgaagaaggtaggatgtgcgtgaacatggaatggggagctttcggagacaacggctgtctggatgactttcggactgaattcgatgtggctgtcgatgagctctcccttaaccctggcaagcagagattcgaaaagatgattagtgggatgtacctgggcgagatcgtgcgcaacatcttaattgatttcacaaaacggggactgctctttcgaggacggatatctgagcggctgaaaacacgaggaatatttgaaactaaatttctgagccaaatagagtcggattgtctagccctgcttcaagttcgggcaattctgcagcatttaggtctcgagagcacatgcgatgacagtattatcgtcaaggaggtttgcacagtagtggccaggcgtgctgcccagctgtgtggtgctggaatggcggctgtggtggataggattcgggagaacagaggtctggatgccctgaaggtgaccgtaggagtcgacggaacactgtacaagttacaccctcattttgctaaggtcatgcatgagaccgttaaggatctggccccaaaatgtgatgtttccttcctgcaatctgaggatggaagcggcaagggagctgctttgattactgccgtggcttgcagaattcgagaggccgggcagcggtag

SEQ ID NO: 190617 - DNA, 2754 bp, Artificial Sequence
  Description of Artificial Sequence: Synthetic coding sequence
atgatcgccagccacctgctggcctacttcttcaccgagctgaaccatgatcaggtacagaaggtcgatcagtatctgtatcacatgcgcctgagtgacgagactctgctcgaaattagcaaaagatttcggaaggagatggagaaggggctgggcgccacaactcatcctaccgcagcagtgaagatgctgccgacttttgtccgttctacccctgacgggacagagcatggggagttcctcgctttagatctggggggcacaaacttccgcgtcttgtgggtaaaggtaactgataatgggctccagaaagttgaaatggagaatcagatttacgctatccccgaagacataatgcgcggctccggaacccagctgtttgaccacatcgcagaatgtctagccaactttatggataaactgcaaatcaaggacaaaaagcttccattgggatttactttcagcttcccttgtcaccagaccaaactcgacgaatcatttctggtgtcatggacaaagggttttaaaagctctggggttgagggacgtgatgtggtggcgctgatccgcaaagctatccagcggaggggagattttgatattgacatagtagccgtggtcaatgacacagttggcactatgatgacttgcggatatgacgatcacaactgtgaaatcgggcttatcgttgggacaggttccaacgcatgctacatggaggagatgcgacatatcgacatggtagaaggggatgaagggcggatgtgcatcaacatggaatggggggccttcggggacgacggatcactgaatgacatccgcaccgaattcgaccaggagatagatatgggttccctgaatcccggcaagcaactcttcgagaagatgatttctggcatgtatatgggggagttggtgcgcctcatcttggtgaagatggcaaaggaggaactcttatttggaggcaaactaagccccgagctgctgaataccggcagattcgaaactaaagacatctcagacatcgagggggaaaaggacggaatcaggaaggcccgcgaagtgcttatgcgcctaggcctggatcctacccaggaggactgtgtcgccacccaccgtatctgccagatcgtgtctaccagaagcgcctcattatgtgccgctacacttgccgctgttttacaaaggatcaaggaaaataaaggcgaggagagactcagatctactataggcgttgatggctccgtctataaaaagcatccacacttcgcaaagaggctgcataagactgtaaggaggttggttcctgggtgtgacgtcagattcttgcgctcggaggatggcagcgggaagggagccgctatggtaaccgcagtggcctacaggcttgctgaccagcatcgagcccgccagaagactcttgaacacttgcagttgagccatgaccaattgctggaggtcaagcggagaatgaaagtggagatggaaaggggcctctcaaaggagacccacgcctctgcgcccgtgaagatgcttccgacatatgtctgtgccaccccggacgggacagaaaaaggcgactttcttgctctcgatcttggaggtacaaacttcagggtgcttctggtccgggttcggaacgggaaatggggcggggtagagatgcataacaagatatacgctatcccccaagaggtcatgcacggtaccggggatgagttgtttgatcacatcgtccagtgtattgcggactttctggaatatatgggcatgaagggcgtctcactccccctgggattcacgttttcattcccatgccagcagaacagcctcgacgaatcaatacttctcaaatggactaagggtttcaaagcatcagggtgcgagggagaagacgttgtgaccctgctgaaggaagccatacatcgccgtgaggaatttgatctggacgttgtggctgttgtgaatgatacggtcgggactatgatgacctgtggcttcgaagaccctcattgtgaggtgggattgatcgttgggactgggtcgaacgcctgttacatggaggagatgcgtaacgtggaattggttgagggcgaagagggcaggatgtgtgtgaacatggaatggggtgcgtttggtgacaatggctgccttgacgacttccggaccgagttcgatgtcgcagtggatgaattaagtttgaatccgggcaagcagaggtttgaaaaaatgatcagcggcatgtatcttggagagatagtacggaacatcctcattgactttacaaaacgggggctcctgtttcgcggaaggatatcagagagactcaagactaggggcatttttgaaaccaagttcttatcacagatcgagtctgactgtctggcactccttcaagtcagagccatcttacagcatttggggctcgaaagcacatgtgacgactctataatcgtaaaagaagtgtgcacggtggttgcacgccgcgctgcacagctctgcggggctggcatggctgccgtggtggatcgaatacgagagaaccgcggacttgacgctctgaaggtgactgtcggcgtggacggcactctatataagctccaccctcacttcgctaaagtcatgcacgaaactgtaaaagatctagccccaaaatgcgacgtgtccttcctgcagtccgaggacggtagtgggaagggtgcggcgctcatcacagccgtggcatgtagaattagagaggctgggcagcggtag

SEQ ID NO: 190618 - DNA, 2772 bp, Artificial Sequence
  Description of Artificial Sequence: Synthetic coding sequence
atggacagcatcggcagcagcggcctgcggcagggcgaggagaccttgtcctgctctgaggagggcttgcctgggccttctgacagttctgagttagtgcaagaatgcctccaacagttcaaagtgaccagagcgcagttgcaacaaatacaagcctccctcctgggatccatggagcaggccctgagaggtcaggcttctcctgcccctgccgttaggatgcttcccacatatgttggctctactcctcatggtactgagcagggcgactttgtagtcctggagctaggtgcgacaggagccagcttaagagtgctctgggtgaccctgaccggtattgaaggccaccgggtggaaccacgcagccaggaatttgtgattcctcaagaggtgatgcttggcgctggacaacagcttttcgattttgcagcgcattgcctgagcgagtttctggacgctcagccagttaacaaacaggggctgcagctgggtttttcgttcagtttcccctgtcatcaaacaggtcttgatcgttctactctgattagttggacaaagggattccgctgtagcggggtggagggccaagatgtggttcagctgttgcgggacgccatccgtcgtcaaggggcctacaatattgacgtggtggccgttgttaatgacacggtgggaactatgatgggatgtgagccaggcgtcaggccctgtgaagttggactggtcgtagacactgggactaacgcgtgctacatggaggaggcccgccatgtggccgtacttgacgaagacagagggagggtttgtgtttcagtggaatggggctcgttcagcgacgatggagcccttgggccagttcttactacatttgatcacaccctcgaccatgagagtctgaatccaggtgcacaacggtttgagaagatgattgggggtctgtacctgggcgaactggtaagactggtactggcccatctggcccggtgcggggtgctatttggtggatgcacgtcccctgccctgctttcacagggtagtatcctgttggaacatgtggccgagatggaggacccatcaacgggagctgccagagtacatgcgatactccaagacctcggcctgagccctggggcttccgatgtggagttagtccagcacgtgtgtgctgctgtttgtaccagagcagcccagctgtgcgccgctgccctagccgcagttttaagctgcttgcagcattctcgtgagcagcaaactctccaggtcgctgtggcaactggaggcagggtgtgcgagcgacacccgcggttctgcagcgtgctccagggaacagtcatgcttttggcacccgagtgtgacgtctcactgattccatccgtcgatggcggcggccggggtgtggcaatggtgactgcggtggcagctagactcgcagcgcatcgacgcctgctagaggagactctggcaccttttcggcttaaccatgatcagctcgctgccgtgcaggcccagatgcgaaaggcgatggcaaaagggcttaggggcgaggcttcgtcacttaggatgcttccaacgttcgtgcgcgctactcctgatggctccgaaagaggagatttcctcgccctcgacctaggcgggacaaactttagggtactactagtgcgtgtgactacaggcgttcagattacctcggaaatttatagtatacctgagacagtggctcaaggtagcggacaacagctttttgatcacatagtggattgcatcgtagatttccagcagaaacagggtctgagtggccagtctctgcccctgggcttcaccttttcattcccttgtcggcagctgggccttgatcagggaatcctcctgaattggacaaaagggttcaaggctagcgactgtgaagggcaggacgtagtgtcactgctcagagaagccatcacaaggcggcaagccgtggagctgaacgtcgtggccatcgtaaatgacaccgtcggaaccatgatgtcatgcggatacgaagacccgcgctgcgagattggtctcattgttggcacggggacaaatgcctgttacatggaagaactgagaaatgtggcaggggtgcccggcgattctggccggatgtgcatcaatatggaatggggcgcattcggcgatgacggatctctcgccatgctgtccaccagattcgatgcctcagtggaccaggcgtccatcaaccctggtaagcagcgtttcgaaaaaatgatctccgggatgtacctgggcgaaattgtcagacatatcctgcttcacttgacgagcctcggcgtcctttttcgagggcagcagatacagaggctgcaaacccgggatatctttaagacgaagtttctttctgagatcgaatctgattctttagctttgcggcaggtgagagctattttggaagacctgggcctgccactcaccagtgacgatgcccttatggtgctcgaggtctgccaggccgtgtcccagagggccgcacagctgtgtggtgctggcgtcgccgcagttgtggaaaagattagagaaaatagagggctcgaggagctagcagtgtccgtgggggtagatggaactctgtacaagctgcatcctagattctcatccctagttgctgccacagtgcgcgagcttgcaccgcgctgcgtggtgacattcttgcagtcagaggacgggtcaggaaaaggagccgctctggtgaccgcagtcgcctgtcggctcgctcaactaacaagggtgtag

SEQ ID NO: 190619 - DNA, 1590 bp, Artificial Sequence
  Description of Artificial Sequence: Synthetic coding sequence
atgaccagcagccggctgtggttcagcctgctgctggccgccgcctttgccggccgcgctactgccctttggccatggccccaaaactttcagacttccgatcagaggtatgtactgtatcctaataatttccaatttcaatatgacgtttccagcgcggctcagccagggtgctccgtactggacgaggccttccagagatatagagatctgctatttgggtccggatcttggccccgaccatacctcaccggtaagcggcatactctggagaaaaacgttctcgtggtttccgtcgtaaccccaggttgcaaccaacttccaaccctggagagcgttgagaactatacactcacaattaacgatgaccagtgtttgcttctttctgaaaccgtctggggcgccttacgtggactcgagactttttctcaactggtgtggaagagcgccgaaggtacttttttcattaacaaaactgaaatcgaggactttcctaggttccctcatcgcggtttgctcctcgatacaagtcgccattatttacctctgagctctattctggatactctcgacgttatggcatataacaagctgaatgtgttccactggcacctcgtggatgacccctccttcccgtacgagtctttcacattccctgagctgatgagaaagggctcatataatccggtgacccacatctacacagcacaggatgtgaaggaggtgatcgaatatgcaaggttgcgcgggatccgggtcctcgctgaattcgacactcccggccatacattgtcgtggggccctggcataccaggattgttgaccccatgctactctggaagcgagcctagcgggaccttcggcccagttaatcctagcctgaacaacacgtatgaatttatgtcaacatttttcctggaagtgagcagcgtgttcccagatttttatctacacttggggggggacgaagtggatttcacgtgctggaagtcaaatcccgagatccaggatttcatgcgcaagaaaggctttggcgaagacttcaagcaactggagtccttctatattcaaacactgctcgacatagtgagtagctatggcaagggatacgtggtttggcaagaagtgttcgacaacaaggtcaaaattcaacctgacacaatcatccaggtctggagagaagatattcccgtgaactacatgaaggagctggagctagtgacaaaggcgggattcagagctctgctttcagcaccttggtacctaaacaggatcagttacggtcctgactggaaagatttttacatcgtggagccactcgctttcgagggtacacctgaacagaaggcattggtgatcgggggcgaagcctgcatgtggggggaatatgttgacaatactaacttagtaccacggctctggcctcgagcgggagccgtggccgaacgtctctggtcaaataaactaaccagtgatctcacgttcgcatacgaaaggttatctcatttcagatgcgagttgctgagaagaggtgttcaggcacagcctctaaacgtgggtttctgtgaacaggagtttgagcagacctag

SEQ ID NO: 190620 - DNA, 906 bp, Artificial Sequence
  Description of Artificial Sequence: Synthetic coding sequence
atgatgaccagcgtgtacagcagcctgcggctgagcggcgagctgtccgaggatgtgatggcctataataagttgaacgtttttcactggcacctggttgatgacccaagcttcccctacgagtctttcaccttccctgaactaatgagaaagggcagttataatccagtcactcatatctatactgcacaggacgtgaaggaggtcattgaatacgccagattgcgcggaataagagttctggcagagttcgacacaccgggtcatacactgtcctggggccccggaatcccagggctgcttactccgtgttatagcggatctgaaccttccggcacctttggcccagtcaatccaagtttgaacaatacatacgaatttatgagcacctttttcctggaggtttcttcagtgttccctgacttctacctgcatctgggcggagatgaggtcgacttcacatgttggaagtccaatccagaaattcaggacttcatgagaaagaagggattcggcgaagacttcaaacaactggagagtttttatattcagactctgctggatattgtgagttcctatggcaaggggtacgtggtgtggcaggaggtattcgacaacaaggtgaaaatccagcccgacaccatcattcaggtttggcgggaggatattcctgtgaactatatgaaggagctggagctcgttactaaggcaggattccgagcgcttctgtcagcgccctggtatctgaataggatctcttatgggccagactggaaagacttctacatcgtggagcctctggccttcgaagggacaccagaacaaaaggcacttgtgattggaggtgaagcttgcatgtggggcgagtatgttgataatactaacctcgtgcctcgtctttggtag

SEQ ID NO: 190621 - DNA, 507 bp, Artificial Sequence
  Description of Artificial Sequence: Synthetic coding sequence
atggcctacaacaagctgaacgtgttccactggcacctggtggacgaccccagctttccttacgaatcttttacttttcccgagctgatgagaaaaggctcctacaatccagtgacgcacatttatacggcgcaagacgtcaaggaggtaatcgaatatgcacgcctgcgaggcatacgcgtgcttgccgagtttgacactcccgggcacactctgtcatgggggcccggcatcccgggcctcctgacaccatgctatagcgggagcgagccctcggggactttcggccctgtgaacccgtccctgaataatacttacgagtttatgtcgacattcttccttgaggtttctagcgtattccccgatttctatctgcacctcggcggcgatgaggtagactttacgtgctggaaaagcaatcccgaaattcaggactttatgaggaagaagggcttcggcgaagattttaagcaactggaatccttctacatccaaacttacccctag

SEQ ID NO: 190622 - DNA, 1671 bp, Artificial Sequence
  Description of Artificial Sequence: Synthetic coding sequence
atggagctgtgcggcctgggcctgccccggccccccatgctgctggcattactgctggctacactgcttgccgcaatgctcgccctgttgactcaagtcgccctggtggtccaggtcgctgaggctgcgcgtgctccctctgttagcgccaagcctggccccgcgctttggccgctgcctctactcgtgaagatgaccccaaacctcttgcatctggccccggaaaatttttacatcagccactcccccaactctacagctggaccaagttgtaccctgctggaagaggctttcaggaggtatcatgggtacatattcggattttataagtggcatcacgaaccagctgagtttcaggctaaaacccaagtgcaacaactgcttgtatccatcacattacaaagcgagtgcgatgctttccctaacattagttcagacgagtcttatacactccttgtgaaggaacctgttgcagtactgaaagccaaccgggtttggggcgcattgcgcggcctggagacattctctcagcttgtctaccaagacagctacggaacctttaccattaacgagtctacaatcatagactctcctaggtttagccatcgagggattcttattgatacaagcagacactacctgccagtaaaaataattctcaaaacattggatgctatggctttcaacaagtttaatgtactgcactggcatattgtcgacgaccaatccttcccttaccagtctatcaccttccccgagctatctaataaaggctcttattcactcagccacgtctatacccctaatgatgttagaatggtgattgaatacgctcgcctgagaggcatccgcgtactccccgagttcgataccccaggccataccctcagctggggcaaaggccagaaagacttactgactccatgttacagccggcagaacaaactggactcatttggcccaatcaatcccacgcttaacacgacctactcatttctgacaacattctttaaagaaatctctgaagtgtttcccgaccaattcatccacctgggcggggatgaggtcgagttcaagtgttgggagtccaatcccaagattcaggactttatgcggcaaaaagggttcgggacagatttcaaaaagctagaatcattttacatccagaaagtcctcgatatcattgcaactattaataaggggagcatcgtgtggcaagaagtctttgacgacaaggcaaaattagctcctggtaccatcgttgaggtctggaaagactcagcatatcccgaggaacttagccgcgtaacggccagcgggttccccgttattttgagcgctccatggtatctcgacctaatctcttacggtcaggattggagaaagtactacaaggtcgaacctttagatttcggaggcacacaaaaacagaaacagctgttcatcggcggagaggcctgtctctggggggagtatgtggacgctacgaatctgacgcctagactgtggcccagggcgtccgcggtcggcgagcggctatggtcctcgaaggatgttcgagatatggatgacgcttatgaccgactgacccgccataggtgtaggatggtggagcgggggattgctgcgcagccactttatgcaggatactgtaatcacgaaaatatgtag

SEQ ID NO: 190623 - DNA, 996 bp, Artificial Sequence
  Description of Artificial Sequence: Synthetic coding sequence
atggccttcaacaagttcaacgtgctgcactggcacatcgtggacgaccagtctttcccataccagagcattacattccccgagctatcgaacaaggggtcttactccctgtcgcacgtatatacacctaacgatgtcagaatggtcatcgagtatgcacgcttgaggggcatcagagtgctgcctgaattcgatacacctggccatacactgagttggggtaagggacagaaggaccttctgactccttgctactcccgtcagaacaaactagatagttttgggcccatcaatcctacactgaatacaacttacagttttctgaccactttcttcaaagaaatctctgaagtgtttccagatcaatttattcacctcggcggagatgaagtggagtttaagtgctgggagagcaatccaaagattcaggacttcatgaggcagaaaggctttggcacggactttaagaaattggagtcattttacatacagaaggttctcgacatcatcgccacgattaacaagggaagtatcgtctggcaagaggtttttgacgataaggccaaactggcacccgggacaatcgtggaagtgtggaaagacagcgcgtatcccgaggagctctcacgggtcacggcctcaggcttccccgtgatactgtccgcaccgtggtatctcgacctgatatcctacggtcaagactggaggaaatactacaaggtagagccgctggacttcgggggcacacagaaacaaaagcagctgttcatcgggggggaggcttgcctgtggggcgagtacgtagatgcgacaaatttaacaccccggttgtggcctagggcgtctgcagtgggggagaggctctggtcttcaaaggatgtgagggacatggacgacgcgtatgacaggcttaccaggcaccgatgtcggatggtcgaacgaggaatagccgcacagcccctctacgccggatactgtaaccatgaaaacatgtag

SEQ ID NO: 190624 - DNA, 2376 bp, Artificial Sequence
  Description of Artificial Sequence: Synthetic coding sequence
atgtggaacatgctgatcgtggccatgtgcctggccctgctgggctgcctgcaggctcaggagcttcagggacacgtttccattatcctgctgggtgcgaccggtgatcttgcaaaaaaatatctgtggcagggcctcttccaactgtaccttgatgaggcaggaagaggacattcgttttccttccatggtgccgctctgacggctcctaagcagggacaggagttgatggctaaagccctagaatctctgtcctgccccaaggacatggcaccatctcactgcgccgagcacaaagatcagttcctgcagcttagccagtatcgtcagttgaagaccgccgaggactaccaagccctcaacaaagatatcgaagctcaactccaacacgccggcttgcgggaagctggccggattttttatttctccgttcctccatttgcctacgaggatattgctagaaacattaactcctcgtgccgacctggcccaggagcctggctgagagtggtcctggagaagccctttggacacgatcacttctccgcgcagcagctagcgactgagctgggcaccttttttcaggaggaggagatgtaccgcgttgatcattacttggggaaacaagccgtcgctcagattctaccctttcgcgatcagaatcgtaaagccctggatggtctctggaataggcaccatgtagaaagagtggaaatcatcatgaaagaaactgtagatgcggaaggaaggacgtccttttatgaagaatacggagtcatacgcgacgttctgcagaaccaccttactgaggtgctgacgttggtggctatggaactgccgcataacgtgagttccgctgaagctgtgctccgccacaaacttcaggtctttcaggctttgagaggtctgcagcgcggaagcgccgtggtgggacagtatcagtcttactccgaacaagttcgtcgggagctccagaagcctgattccttccactccctcacgccgacatttgcagctgtgttagtccatattgacaacctgcgatgggagggcgtacccttcattctgatgtctggaaaggccctcgacgagcgcgtcggctatgctagaatactttttaaaaaccaggcatgctgcgtacagtccgagaagcattgggcggctgcccagtctcaatgcttaccacgtcaattggtcttccatattgggcacggcgacctgggcagtcctgcggtcctggtttcccgtaatctctttcggccctctctgccttcgtcgtggaaggagatggagggacccccgggcctacgcctatttggctcacccctctctgattattacgcctactcacccgtgagagagcgggacgcgcacagcgtgctgctgtctcatatcttccacggcagaaagaactttttcattactacggagaatctcctggcaagttggaatttctggacacccctactggagagcctggcccataaagcgccgcggctctacccgggaggcgccgagaatggccggctattagactttgagttttcaagtgggcgtctctttttctcccagcagcagcctgagcagctggtgccgggtccgggccccgccccgatgccctccgattttcaggtgttgagagcaaaatatcgagaatcaccattagtgtccgcatggtctgaagagctgatttccaagttggccaacgacattgaagcaacggctgtccgagctgtcaggcggtttgggcaatttcatctcgctctatccggtgggagtagtcccgtggcactctttcaacagctagcaacagcgcactatggattcccgtgggcgcacacccatttgtggctggtcgatgagagatgcgtgcccctgtccgaccccgaaagtaactttcagggactgcaagcccatcttttgcagcatgtgagaattccttattataacatccaccccatgcctgtccacttgcagcagcgtctgtgcgccgaggaggaccagggcgcccagatctacgctcgggaaatttccgccctggttgcgaactcctccttcgatctggttctgcttggaatgggcgcagatggacatacagcctcactttttcctcaaagcccaaccgggctagacggggagcagttggtggtcttgacgacttcgccttcgcagcctcatcgccgaatgtctctctccctacctctaattaacagagcaaaaaaagtcgccgtactagtgatgggtcggatgaaacgggagatcaccaccttagtgagtagagtgggccacgaaccaaagaagtggccaatctccggcgtactgccacattctggccaattggtttggtatatggattatgatgccttcttaggatag

SEQ ID NO: 190625 - DNA, 1968 bp, Artificial Sequence
  Description of Artificial Sequence: Synthetic coding sequence
atgggccggtgggcctgggtgcccagcccctggcccccccccggcctaggccctttcttactattattactattgcttctgcttctgccccggggattccagccccagcctgggggaaatagaacagaaagccccgaacctaacgccacagcaacgcccgccattccaacaatccttgtcacgagcgtgacatcggagactccagccacatccgctcctgaggccgaggggcctcagagtggtggattgcccccccctccgcgagctgtgccaagctcaagctcccctcaggcacaggcactcaccgaagacgggaggccctgccgattccccttccgatacgggggcagaatgctgcatgcttgtacttccgaagggagcgcacaccgcaagtggtgtgccactactcataattacgatagagatcgggcatggggatactgcgtggaagctactccacctcccggtgggccggccgcactggatccctgtgcttccgggccttgtctcaacggcgggagctgcagtaacacgcaggaccctcagtcgtatcactgctcgtgcccgcgagcattcactggtaaggactgcggaaccgagaaatgctttgacgagaccaggtacgagtatctggagggcggcgaccgttgggccagagtcaggcagggacatgtggaacagtgcgaatgtttcggagggcgcacgtggtgcgaaggtaccaggcacacagcctgcctatcttcaccctgcttgaatggcggtacttgtcatctcattgtggccactggcacgacggtctgcgcatgtcctcccggattcgccggcaggctgtgtaacatagaacccgacgaacgttgttttctcgggaacggtacgggctaccggggcgtcgccagcacttcagcctcagggctatcttgcctggcctggaactctgacctgttgtaccaggagctgcatgttgacagcgtaggcgccgctgccttattgggactggggccacacgcatactgtcgcaatccagacaacgacgagcgtccatggtgctatgttgtgaaagacagcgcactttcatgggagtattgtcggctggaagcctgtgagagcctcactcgagtccagttgtccccggatctgctggccacactgccagaaccagccagcccaggccgccaggcctgtggccgtcggcacaaaaagcgtacatttctacgacctaggatcatcggcggctcctcctcattgccaggcagccatccttggctcgcagcaatttacataggggactctttctgcgcaggcagcctggtccacacctgctgggtggtgtcagccgctcattgtttttctcattccccacctcgcgatagtgtatccgtagtccttggacagcattttttcaaccggaccacagatgtaactcaaactttcgggatagagaagtatatcccctatacattatactccgtctttaatcccagcgaccacgacttggttttgatcaggctgaagaagaagggtgataggtgtgcaaccagatctcaatttgtgcagcctatttgtctccctgaacccggcagtaccttccccgccgggcataaatgtcagatagctggatggggccatttagatgagaacgtgtctggatattcttcttccctgagggaggcccttgtcccacttgttgctgaccacaaatgctcgtcccctgaagtgtatggcgccgacatctcccctaacatgctgtgtgcgggatatttcgattgtaaaagtgacgcctgtcagggcgattcgggcggtccattagcgtgtgagaaaaacggcgtggcctacctatatggcatcatcagttggggagatggatgcggacgacttcataagcctggtgtttacacccgggtcgccaactatgtggattggatcaacgatagaattcgacctcctagacgtctggtcgcccccagttag

SEQ ID NO: 190626 - DNA, 3807 bp, Artificial Sequence
  Description of Artificial Sequence: Synthetic coding sequence
atgagcagcgtggccgtgctgacccaggagagcttcgccgagcaccggagtggtctggtgccccaacagataaaggtggccactctgaattctgaggaagagagcgacccccccacatacaaggatgccttccccccactgcctgagaaggcagcctgcttagagtcagcacaggaaccctctggggcttggggaaataaaatccgcccaatcaaggccagcgtgataacacaggtatttcacgtccctctcgaggaaaggaagtacaaagatatgaaccaatttggcgaaggcgaacaggccaaaatttgtctggagattatgcagagaactggcgcccacctggagctctctttggccaaggaccagggcttgagtatcatggtctccgggaaactggacgccgtcatgaaggcccgcaaggatatcgttgctaggctgcagactcaagcctccgccactgtggctatcccaaaggagcatcataggttcgtgatcggaaaaaatggcgagaaactgcaagacttggaactgaaaaccgccacgaaaattcagatcccccggcccgacgaccctagtaaccagatcaagatcactggcaccaaagaaggcatagaaaaagctcggcatgaagtgttactgatctctgccgaacaggacaagcgggccgtggagcgcttggaggtggagaaggcttttcacccgttcatagccggtccttataatagactcgtcggggaaatcatgcaggagaccgggacaagaatcaacattcctcctccctccgtgaaccgcaccgagattgtctttacaggtgagaaggaacaattagcacaagcagtcgccagaataaagaaaatttatgaagaaaagaagaagaagacaaccaccattgcagtagaggtgaaaaagtcacaacacaaatatgtcatcggaccgaaggggaatagcctccaagagattcttgagcgaacgggggtcagcgtcgaaatcccaccgtccgacagtatctccgagacagtgatcctgaggggggagccagagaagcttgggcaggccctgaccgaggtctacgcaaaggccaacagcttcactgtgtcatcagtggccgcacctagttggcttcacaggttcatcatcggcaagaagggtcagaacctggccaaaatcacccagcaaatgcctaaggtgcatatcgaattcacagagggggaggacaaaattactctggaaggtcctacagaggatgtgaacgtggcccaggagcagattgaggggatggtgaaagatctgatcaacaggatggactacgtggagattaacattgaccacaaatttcatcgccatctgataggtaaatctggtgccaacataaaccgcattaaagaccaatacaaggtttccgttaggattcctcctgatagcgaaaagagcaacctgatcaggattgagggagatcctcagggagtccagcaggcaaagcgagagctgttggagctggcctcaagaatggagaatgagcgtactaaggatctcattattgaacagagatttcacagaactattattggccagaagggggagagaattcgtgaaattcgggataaatttcctgaggttataatcaacttccccgatcctgcacagaagtcagatatcgttcaacttcgtgggcctaaaaatgaagtggaaaagtgtactaagtacatgcagaagatggtcgccgacctggtggaaaatagttatagcattagcgtgcccatttttaagcagtttcacaagaacattatcgggaaggggggggcgaatattaaaaaaatccgtgaagaaagcaatacgaaaattgacctgcccgccgaaaacagcaactctgaaaccataatcataacaggaaaacgggctaattgcgaggcagccaggagcaggattctttcaatccagaaagatctggcgaacattgcagaggtcgaggtgtcaatccccgccaaacttcataatagcctaattggaacgaagggtcgattgatccggtccattatggaagagtgtgggggtgtccacatacattttcctgtcgagggatccggaagtgatactgtggttattagggggcctagcagtgatgtcgagaaggctaagaagcagctacttcatttggctgaggaaaaacagaccaaatcttttaccgtcgacatccgggccaagccagaataccacaagttcctgatcggcaaaggcgggggcaagatcaggaaagtccgagacagtacgggcgcacgagtcatcttcccggccgcagaagataaagaccaggatcttatcaccataatcggcaaggaggatgctgtcagagaggcacaaaaagaattagaagccctgatccagaatctggataatgtggtcgaggacagtatgctcgttgacccaaaacatcacagacacttcgtcattcgtaggggccaggtcctgcgtgaaattgccgaagagtatggcggtgttatggttagcttccctaggagtggcacacagagtgataaagtcactttaaagggtgcaaaggattgtgtagaggccgctaagaaaaggattcaagagatcatagaagatctcgaagcacaagtgacgcttgaatgcgccattccccagaaatttcaccgttctgtaatggggcctaaaggatcaagaatccagcagataactagggactttagcgtgcagatcaagtttcctgacagggaggagaacgctgtacattctactgaaccagtcgtccaggaaaacggcgacgaagccggagaaggaagggaggccaaggattgcgacccgggttcccctcggcgctgcgacattatcattatatcaggccgcaaagagaaatgtgaggccgctaaggaggcgctggaggcactagtgcccgttaccattgaagtcgaagtccctttcgacttgcaccgctacgtgattggtcagaagggatccgggatacgcaagatgatggacgaatttgaggtgaacatacacgtgccggccccagaactacaaagcgatataatcgcgatcactggactggctgctaatctggaccgggcaaaggccggtctcttagagcgcgtgaaggagctgcaggcagaacaggaagaccgcgcactgcggtctttcaagctgagtgtgactgtagatcccaagtatcatcccaagatcattggacggaagggggctgtgatcacccaaatacggctcgaacacgacgttaacatccagttcccagacaaagacgatgggaaccaaccccaggatcaaattaccataacaggctacgaaaagaataccgaggctgcgagggatgcaattctccggatcgtgggggagctggaacagatggtgtccgaggacgtccccttggaccacagagtccacgcccgcattatcggagcgcggggtaaggccataagaaagatcatggacgaattcaaggtagacattcggtttccacagagcggtgccccggatcctaattgcgtcaccgtgacgggcctgccagaaaacgttgaagaagccatagaccacatcctgaacctcgaggaggaatacctcgcagatgtggtggattcggaggctctacaggtctacatgaaaccacctgcccacgaagaggcgaaagccccctcccgggggttcgtggttcgtgatgctccttggacagccagttctagcgaaaaagctccagacatgagctcctccgaggagtttccttcgttcggcgcccaagtggcaccaaaaaccctgccgtggggcccgaagcggtag

SEQ ID NO: 190627 - DNA, 3807 bp, Artificial Sequence
  Description of Artificial Sequence: Synthetic coding sequence
atgagcagcgtggccgtgctgacccaggagagcttcgccgagcaccgctccgggttggtgcctcagcagatcaaagtggctaccttgaattcagaagaggagagcgatcccccaacctataaggacgctttcccacctctgccagaaaaggcagcctgcctcgagtcagctcaggaaccatcaggcgcttggggtaataagattcgccctatcaaggcctctgtgataacacaagtgtttcatgtccccctggaagagcgcaaatataaggacatgaatcaattcggtgaaggagaacaagcgaaaatttgcttagagatcatgcagcggaccggagcccaccttgaactgtctctggctaaggaccaggggctgtctatcatggtgtcgggcaagctggatgctgtcatgaaggcccgcaaggatattgtggccaggctgcagacccaggcttctgctactgttgcaatcccaaaggagcatcaccgtttcgtgatcggtaagaatggcgagaaactccaagacctggagctcaagaccgccactaaaatccagatccccaggcctgatgatcccagcaatcagatcaagattactggtacaaaggaaggcatcgagaaggcgagacacgaagtcctcttaatctcggccgagcaggacaaacgcgccgtcgaacgattggaggtggaaaaggcgtttcacccctttatcgccggaccgtataaccgcctcgtgggagaaataatgcaggaaacaggcactcggatcaatattcctccaccatccgttaaccgaacagagattgtgtttaccggagaaaaagaacaactagcacaagccgtcgcgcggataaagaaaatttacgaagaaaaaaagaagaaaacgacaaccatcgccgtcgaagtgaagaaatcacaacataagtacgtaatcgggcccaaaggcaatagtctacaggaaatcttggagagaaccggtgtatccgtagaaattcctcctagcgactctatcagtgaaaccgtgattcttagaggggagccagagaagctggggcaggccctgacagaggtgtatgctaaagccaactcttttacagtcagttctgtggctgcccctagctggttgcacagattcatcatcggaaaaaagggacagaatctggccaaaatcacacagcagatgcccaaggtccacattgagtttacagagggggaggacaagattacgctggaaggccctacagaagatgtcaatgtcgcccaagaacaaattgagggcatggtaaaggatctgatcaataggatggattacgtcgaaattaatatcgatcataaatttcaccggcacttgattggcaaatctggagccaacatcaatcggattaaggatcagtataaagtaagcgtgcgcatccctccagattctgaaaagagtaacctgattcggatagaaggcgacccgcagggggtacagcaagccaagagggagctgctggagctggcttcacgcatggaaaatgagagaacaaaagaccttattattgagcagagattccataggactattattggccagaaaggcgagaggatccgcgagatacgcgataagttccccgaggtgatcatcaatttcccagatcctgcccagaagagcgatattgttcagctccgcgggccaaagaacgaagtggagaaatgcactaagtacatgcaaaagatggtggctgaccttgtggagaatagctatagcatcagtgtccctatcttcaaacagtttcataaaaacataattggtaaaggcggcgctaatattaagaagattcgggaggagagcaacaccaagattgatctgcccgctgaaaactctaactctgaaactattatcataactggcaagcgtgcaaactgtgaggccgcaagatctcgtatcctgtctattcaaaaagacttggctaatatcgcggaagtggaagtgagcatcccagccaagcttcacaacagcctcatcggaaccaagggcagactcatccggagcatcatggaggaatgcggaggggttcatattcatttcccagtggaaggtagtggctctgatacagtcgtgattagagggccatcctccgatgttgagaaggcgaagaaacaattgctgcatctggccgaagagaaacagactaaatctttcacggtggacattcgcgccaagcctgaatatcacaaatttctgatcgggaaaggtggggggaaaattcgcaaggtgagggactctactggtgccagagtgatctttcccgccgccgaagataaagaccaggatcttattacgattatcgggaaggaggatgccgtgcgggaagcgcagaaagaattggaggccctgatccagaatctggataatgttgtagaagatagcatgctcgtggatcctaaacaccatagacactttgtaatccgcagggggcaggttttaagagaaattgcagaagaatacggcggagtcatggtgtcctttccacgtagtggaacacaatccgataaggtgaccctcaagggggcaaaggactgcgtagaggccgctaagaaaaggatccaggagatcatcgaggatttggaggctcaggtgactctggaatgcgctattccccagaagttccatagatctgtcatgggtccaaagggatcgcgaatccaacagatcacccgcgatttttcggtacagatcaaatttcccgacagagaagagaatgccgtgcattcaaccgagcccgtagtgcaagagaatggggacgaagccggcgagggccgtgaagcaaaggactgtgatcctggatctccacgcagatgcgatattattatcatctctgggcgcaaggagaaatgtgaggccgctaaggaagcgctggaagctctcgttccagtcaccatcgaggtagaggtgcccttcgatcttcatcggtatgtgattggccagaagggttctggtatcaggaaaatgatggacgaatttgaagtaaatatccatgtgcctgcccctgaactgcaatccgatatcatcgccattacagggctggcggccaacctggacagagccaaggccggactgttggagagagtaaaggagttgcaggccgaacaagaggatagagccctaaggtcattcaagctctctgtgaccgtggacccaaaatatcatcccaaaattatcggcaggaagggagccgtgataactcagattaggttggagcatgacgtcaacatacaattcccggacaaggacgacggcaatcagcctcaggatcagataacgattacaggatatgaaaagaacacagaagccgcacgcgatgccatcctcaggatagtcggcgagttggaacagatggtctcagaggatgtcccgctcgaccatcgtgttcacgccagaattatcggtgcccgaggcaaagcaatccgcaagataatggacgaatttaaagtggatataagatttcctcagtccggcgctcctgaccctaactgcgtcacggttaccgggctgcctgaaaacgtggaagaagcgatcgaccacattctgaatttagaggaggaatatctggctgacgtggttgattctgaggccctgcaggtatacatgaagcccccagcccatgaagaggcaaaagccccatcaagaggatttgttgtgcgcgatgccccttggacagcatccagctctgagaaggcacccgatatgagcagcagcgaagagtttccctcgttcggcgcccaggtggctccaaaaaccctcccatggggccctaaaaggtag

SEQ ID NO: 190628 - DNA, 3807 bp, Artificial Sequence
  Description of Artificial Sequence: Synthetic coding sequence
atgagcagcgtggccgtgctgacccaggagagcttcgccgagcaccgaagcggactggttccccagcagatcaaggtagccacattgaactccgaggaggaaagtgacccccctacatataaagatgccttccccccattacccgaaaaggctgcctgtctggagtccgctcaggagccgtcaggcgcctggggtaataagatcagacccatcaaagccagtgtcatcacccaagtcttccacgtgccgcttgaggaacgcaagtacaaagatatgaatcagtttggcgagggcgaacaggccaaaatctgcttggagattatgcagaggactggtgcccacctggaactgtctcttgctaaagaccaaggcttatcaattatggtgagcgggaagctggacgcggtgatgaaagcacggaaggatatcgtggcacgactgcagacccaagctagcgctactgtcgcgatcccaaaggagcatcataggttcgtgatagggaagaacggagagaagctgcaggatttagagttaaagaccgcaaccaaaattcagattccccgacctgacgatcccagcaaccagataaaaataacaggcactaaagagggcatcgagaaggcgcgccatgaggtcttgttaattagtgccgagcaggataaaagggctgtggagagactggaggtcgagaaggctttccatcccttcattgcaggtccttacaaccgcctggttggagaaattatgcaggagactggtacccgaataaatatcccacctccctctgtcaataggacagagatagtttttactggagagaaagaacagctggcccaagccgtggctcgaatcaaaaaaatctatgaagaaaagaagaaaaagactactactattgctgtggaagtgaagaagtcccagcacaaatacgtaatcgggccaaagggcaacagtctgcaggagatcctggagagaaccggtgtgtccgtggaaatccccccttccgacagcatcagtgagaccgtgatcctgaggggcgagccagaaaagctgggccaggcccttactgaggtctacgcaaaggcaaactccttcactgtgagtagcgtggctgccccctcctggttgcacagattcatcataggcaagaagggacagaatctggcgaaaataacgcagcagatgcctaaagtccacatagaattcaccgagggtgaggataagattactcttgaaggccctacagaagatgttaacgtggcccaggagcagattgagggcatggtgaaggaccttattaaccgaatggactatgtggagatcaacattgatcacaagtttcaccgtcatttgattgggaagagcggagctaacattaatcgcataaaggatcagtacaaggtgtcagtgcgcataccacccgactctgagaagtcaaatttaatcaggatagagggcgatcctcagggcgtgcagcaagctaagagagagctccttgagctcgctagcaggatggagaatgagagaacaaaagacctcatcatcgagcaaagattccatcgtacaatcattggccagaaaggggagaggataagagagattcgggacaagttccccgaagtcattattaattttcctgacccagctcagaaatccgacattgtccagctgcggggccctaagaacgaggtggaaaagtgcactaaatatatgcagaagatggttgccgacctggttgagaacagctattctataagcgtgccaatcttcaagcaatttcacaaaaacattatcggaaaggggggtgccaatataaagaaaatcagagaagaaagcaacactaagatagacctaccagcagaaaacagcaacagtgaaactattatcattaccggtaagagagcgaactgtgaggctgctaggagtcggattctaagtatccaaaaggaccttgccaatatcgccgaggtggaggtgagcatacccgccaagcttcacaacagtctgatcgggactaaaggccgactgattcggagtatcatggaggaatgcggcggtgtgcacattcattttcccgtggagggaagcggctccgataccgtagtcatcaggggcccaagctcagacgtcgaaaaggctaagaagcaactcctgcatctcgccgaagagaagcagaccaaaagcttcaccgtggatataagagcgaaacccgagtaccacaaatttctgataggaaaaggtgggggcaagatcagaaaagtgagagactccactggggcaagagtgatttttccagccgctgaggataaggatcaggacctgataaccatcattgggaaggaagatgccgtgagagaggcacagaaggagctggaggcgctgatccagaatctggacaacgtcgtagaggactccatgttagttgatcctaagcaccacagacacttcgtgattaggcgtgggcaggtactcagagaaattgctgaggagtacggcggcgtcatggtatcctttccaagatccggtactcagagtgacaaggttaccctgaaaggagccaaagattgcgtagaggccgcaaaaaagcggatccaagagatcatagaggacctggaggcccaagttaccctggagtgcgctattccacagaaatttcaccggtccgtcatgggacccaaaggctctaggatccagcagattactcgcgacttcagcgtgcaaatcaaatttccggatcgagaggagaatgccgttcattcaaccgagcccgtggtgcaagaaaatggcgacgaagccggtgagggacgcgaagccaaggattgcgacccaggctccccccggcgctgtgatatcattatcatcagtggccggaaagaaaaatgcgaggctgccaaagaagccctcgaagcactggtacccgtcacgatcgaggtcgaggtgccatttgatctccacaggtatgtcattggccagaaaggaagtggcattcgcaaaatgatggacgagtttgaggtcaatattcacgtgcctgccccagagctgcagagtgatatcatcgctatcactgggctggctgccaatctggacagggctaaggcgggtttactcgagcgtgtgaaagaattacaggccgagcaggaggatagggctctcaggtccttcaaactcagcgtaacagtggacccaaagtaccatcccaaaatcattggtagaaagggcgcagtgattactcagatccgccttgaacacgacgtgaatatccaattcccagacaaggatgatgggaaccaacctcaagaccagatcactataaccggttacgagaagaataccgaggcggcaagggatgctatccttcggatcgttggggaactggagcagatggttagcgaagacgtccccctcgaccatagggtccatgcacgtataattggtgctagaggaaaagcaatccgcaagataatggatgagtttaaagtggacatccgctttccccagagcggggcccccgatccgaactgcgtgaccgtcaccggactgcccgagaatgtggaagaggctatcgatcatattctcaaccttgaggaagagtacctcgctgacgtggtggacagcgaggccctacaggtgtacatgaagccacctgcacacgaagaagccaaggcgccctccagaggcttcgtcgtgagggacgccccttggaccgcctcgtcctctgagaaggcacctgatatgtcgtcctccgaagagttcccttcttttggggctcaggtggcaccaaagactttgccttggggccctaagagatag

SEQ ID NO: 190629 - DNA, 249 bp, Artificial Sequence
  Description of Artificial Sequence: Synthetic coding sequence
atgagcagcgtggccgtgctgacccaggagagcttcgccgagcaccggtcaggcctagtgccccagcaaataaaagtggccacactgaacagcgaagaagagtccgatccgcctacctacaaggacgcgttcccaccattaccagagaaggccgcatgtttggaatccgcccaggagcctagtggagcttgggggaataagatccgaccaatcaaagcttccgtgatcacccaggtttttcacgtgtag

SEQ ID NO: 190630 - DNA, 45 bp, Artificial Sequence; identical to SEQ ID NO: 84436
  Description of Artificial Sequence: Synthetic coding sequence

SEQ ID NO: 190631 - DNA, 210 bp, Artificial Sequence
  Description of Artificial Sequence: Synthetic coding sequence
atgagcagcgtggccgtgctgacccaggagagcttcgccgagcaccgcagcggcctagtcccccagcaaatcaaggtcgctacactcaattctgaagaggagtctgacccacctacctataaggacgcattcccccctttgccagaaaaagccgcttgtctggagtccgcccaggaacctagtggggcatggggtaacaagattcgttag

SEQ ID NO: 190632 - DNA, 165 bp, Artificial Sequence
  Description of Artificial Sequence: Synthetic coding sequence
atgagcagcgtggccgtgctgacccaggagagcttcgccgagcaccgaagtggcctggttccacagcagatcaaagtggctactcttaacagtgaagaggagtccgaccccccaacatacaaggatgcctttccaccccttccagagaaggcagcttgcctatag

SEQ ID NO: 190633 - DNA, 675 bp, Artificial Sequence
  Description of Artificial Sequence: Synthetic coding sequence
atgagcagcgtggccgtgctgacccaggagagcttcgccgagcacagatccggcctggttccccaacagataaaggtggccacgttaaacagtgaggaagaaagtgacccccctacctacaaggatgcctttccacccttaccagagaaagcggcttgcctggaaagtgcccaggaaccaagcggggcctggggaaacaagattaggcctatcaaagcctcggtgatcacccaggtgttccacgtacctctagaggagcggaagtacaaggacatgaatcaatttggagaaggagagcaggccaagatctgcctggagataatgcaacggacaggcgcacatctagaactgagtttggcaaaagatcagggtctgagtataatggtgagcggcaaactggatgctgtcatgaaggcccgcaaagacatcgtcgcccggttgcagacacaggcgagcgccaccgtcgccatccccaaggaacaccataggtttgtcatcggaaagaatggcgagaagctgcaggacttagaactgaaaacagcaacaaagattcagataccccgcccagacgacccgagcaatcagattaagattacagggactaaggaaggtatagaaaaagctcggcatgaggtcctgctaatatcagcagaacaggataaaagagcagtgtag

SEQ ID NO: 190634 - DNA, 246 bp, Artificial Sequence
  Description of Artificial Sequence: Synthetic coding sequence
atgagcagcgtggccgtgctgacccaggagagcttcgccgagcaccgcagtgggcttgtcccgcaacaaatcaaggtggccactctgaattcagaggaggagagcgacccgcccacatacaaggatgcgttccctccactgcctgagaaggccgcctgcctcgagtccgcccaggagccaagtggggcatgggggaacaaaatacggcccattaaggcgagcgtcattacccaggtctttcactag

SEQ ID NO: 190635 - DNA, 240 bp, Artificial Sequence
  Description of Artificial Sequence: Synthetic coding sequence
atgagcagcgtggccgtgctgacccaggagagcttcgccgagcacagatctggactcgtgcctcagcagatcaaggtggcgaccctaaactcagaggaggaatcagatcccccgacctacaaagacgccttcccgcctctgcctgagaaggcagcctgtctggagtcagctcaggagccctctggcgcatgggggaataagattcgaccgatcaaggcctctgtgatcacgcaggtctag

SEQ ID NO: 190636 - DNA, 291 bp, Artificial Sequence
  Description of Artificial Sequence: Synthetic coding sequence
atgagcagcgtggccgtgctgacccaggagagcttcgccgagcaccgatctggcctggttccccaacagatcaaagttgccactctgaacagcgaagaggagtcggatccccctacctataaggacgcctttccccccctccccgagaaagcggcctgtctggaaagcgcccaggaacctagcggggcatggggtaacaagatccgaccaattaaggcatccgtcatcactcaggtcttccacgttcctcttgaagagcgaaaatacaaggatatgaatcaatttgggtag

SEQ ID NO: 190637 - DNA, 60 bp, Artificial Sequence
  Description of Artificial Sequence: Synthetic coding sequence
atgagcagcgtggccgtgctgacccaggagagcttcgccgagcacagaagtggcctatag

SEQ ID NO: 190638 - DNA, 3708 bp, Artificial Sequence
  Description of Artificial Sequence: Synthetic coding sequence
atgcacctggccgagcgggaccggtggctgttcgtggccaccgtgatgatgcattttgtctctatcaaatccggtttccccggactttgtgtcggcgtccgctcgaccatgagcagcgttgccgtactgactcaagaatcttttgccgagcatagatcgggtctggtccctcagcagatcaaggttgccacattgaattcggaagaggagtctgacccacctacctacaaagatgcgttccccccgctgccagagaaggcagcttgtctagaaagtgcgcaggagccaagcggggcctggggaaataagattagaccaataaaggccagcgttattacacaggtgtttcatgtgcctctcgaggagagaaagtacaaagacatgaaccagtttggcgagggcgagcaggctaagatatgtctcgaaatcatgcagcgcacgggtgcacacctggagctctccttggctaaagaccagggcctgagcattatggtgagcggaaagctggacgccgtcatgaaagccagaaaggatatagtcgctagactgcagacccaggcttccgccacagtcgccatccccaaagagcaccataggttcgttataggtaaaaacggcgaaaagctacaggatctggaactgaaaacggcaactaaaatccagatcccacgacctgacgatccctcaaaccagataaaaatcacagggacaaaggagggaatcgagaaagcacgacacgaagtactgctaatttctgcagaacaggataagcgggccgtagaaaggctggaggtggaaaaagcattccatccctttattgccggcccctataataggttggtgggcgaaatcatgcaggaaaccggcactagaatcaatataccccctccatcggtgaaccgcaccgagatcgtgttcacaggggagaaagaacaattggctcaagctgtcgctcgaattaagaagatctacgaggagaaggccaatagtttcaccgtttcctccgttgccgcaccgtcgtggctgcatcgctttatcattggtaagaaaggacaaaacctagctaagataacacagcaaatgcctaaagtgcatattgagtttaccgagggagaggacaagattacactcgaagggcccacggaggacgtgaacgttgctcaggaacagattgaaggcatggtcaaggacctgattaaccgcatggattatgttgagatcaatattgatcataaattccaccgacaccttatcggcaaaagcggcgcgaacatcaaccgcatcaaagaccagtacaaagtgagcgtgcggatcccaccagactccgagaaatctaacctcatccgcatcgagggagacccccagggggtgcaacaggcaaaaagggaactattggaattggcgtcccgaatggagaatgagaggacaaaggatctgatcattgaacagaggttccaccgaaccatcatcggccaaaaaggtgagcggattagggagatacgcgacaagttccccgaggtgatcatcaactttccagatcccgcacagaagagcgacatcgtgcaattacgaggacctaagaacgaggtagagaagtgcacaaagtacatgcagaagatggtggccgacctcgtggaaaactcatactctatttcagtgccaatattcaagcaattccacaagaacatcatcggcaaaggaggagccaatatcaaaaagatccgcgaggagtccaatactaagattgatttgcctgctgaaaattccaattccgagaccattattattacaggaaaacgggctaattgtgaggccgcccggtcacgtatactgtctattcagaaggatctggcaaatatcgcagaagtcgaagttagcatacctgcaaaactacacaattctttaatcgggaccaagggtcgcctcattcggagtattatggaagagtgtggaggcgtacacatacactttcccgtggaaggatcaggatccgacacagtagtgatccgggggcctagctcggatgtagagaaagcaaaaaaacagctcctccacctggctgaagaaaagcagaccaaatccttcaccgtcgacattagagccaaaccagaataccacaagtttctgattggcaagggcggggggaaaatccgcaaagtgcgggacagtactggcgcaagagtgatattccccgctgccgaggacaaagatcaagacttgatcaccattatcgggaaggaagacgccgtcagggaagcacagaaagaactggaggctctcatccagaacctggacaatgtggtggaggactctatgcttgtggatcccaaacatcacagacacttcgtaataagaaggggacaggtgctgcgcgagatagccgaggagtacggaggcgtaatggtctcgttcccaagatctggcacacagtctgacaaagttaccttgaagggcgcaaaggattgcgtggaggcagcaaagaagaggatccaggaaatcattgaagatctggaggcccaggtcacgcttgaatgcgccatcccccaaaaattccatagatccgtgatgggacctaagggaagcagaattcagcagatcacacgggacttttctgtgcagatcaaatttcccgaccgagaggagaacgccgtgcacagcaccgagccagtggtgcaagaaaacggggatgaggcaggggaggggcgggaggccaaagattgtgaccccggctctcctcggcgctgtgacataataatcatttcaggcaggaaggagaagtgtgaggcagccaaggaggcgctcgaagcgctggtcccagtgacaatcgaggtcgaagtgccattcgatctccatcgttacgttattggtcagaaggggtcaggcatccgaaaaatgatggacgaattcgaagtcaatattcacgtgccagcgcccgagttacaatcagatataatagctattacaggactagccgccaacttagaccgggctaaggcagggttactggaacgggtcaaagagctgcaggctgagcaggaggatcgagcattacggtctttcaagctgtccgttacggtcgaccctaagtaccatccaaaaatcatcggacggaagggcgctgtgatcacacagatcagactggagcacgacgtcaacatacaattcccagacaaagacgatggcaatcagccccaggatcaaataacgatcaccgggtacgagaagaataccgaagccgccagagatgccatcctgcggattgtcggggaattggaacagatggtgtctgaggatgtgcctctagatcaccgtgtgcatgccagaattattggggcacgcggcaaagcgattagaaagataatggatgagttcaaggtcgacatcaggttcccacagagcggagccccagacccgaactgtgtgacggtgacaggtctgcctgaaaacgtggaggaagccatagaccatatacttaacctggaggaggaatacctcgccgacgtcgtcgactccgaagccttgcaagtctacatgaagcctccggcacacgaggaagctaaagcaccctctcggggcttcgtggtccgcgatgccccatggacagcctccagcagcgagaaggcgccggatatgtctagtagtgaggagtttcctagctttggggcacaggtcgcaccaaagactctcccttgggggccaaagcgatag

SEQ ID NO: 190639 - DNA, 666 bp, Artificial Sequence
  Description of Artificial Sequence: Synthetic coding sequence
atgagcagcgtggccgtgctgacccaggagagcttcgccgagcacaggagcggtttggtgccccagcagatcaaggtggccaccctgaattctgaggaggaatccgaccctcctacctacaaggacgcttttccccctctacctgagaaagctgcctgtctggaaagcgcccaggagccctccggagcttggggaaataagatcagaccgatcaaggccagcgttatcacccaagttttccacgtccctctggaagagcgtaaatacaaagacatgaatcaattcggggaaggagagcaggccaagatttgcctggagattatgcaacggacaggtgcgcatctggaactttcccttgcaaaggaccagggcctgtcaattatggtgtccgggaagctcgatgccgtgatgaaagcacgaaaggatattgtggccagactgcagacccaggcctcagccacagttgcgatccctaaagagcatcataggtttgtgattgggaagaacggggagaagttacaggatttggaactcaaaaccgccacaaagattcagattccacggcctgatgacccctccaatcagatcaagattaccggtactaaggagggcattgagaaggcccggcatgaggtgctactgatttctgccgaacaagataaatag

SEQ ID NO: 190640 - DNA, 426 bp, Artificial Sequence
  Description of Artificial Sequence: Synthetic coding sequence
atgagcagcgtggccgtgctgacccaggagagcttcgccgagcaccgatccgggctcgtgccacagcagatcaaagtggcaactctgaatagcgaggaggagtccgacccaccaacttataaggacgctttccctcctctgccagaaaaggccgcatgtctcgagagtgcccaggagccgtccggcgcgtggggaaacaagatcaggccgataaaggcatccgttatcacgcaagtgttccacgtgccgttggaagagcgaaaatataaggacatgaatcagttcggcgagggcgagcaagcaaaaatctgtctggaaatcatgcaacgcacaggtgcccacctcgagctatcgctggcaaaggaccagggcctcagcatcatggtcagcggcaagttggacgctgtgatgaaggcacggaagtag

SEQ ID NO: 190641 - DNA, 381 bp, Artificial Sequence
  Description of Artificial Sequence: Synthetic coding sequence
atgagcagcgtggccgtgctgacccaggagagcttcgccgagcaccggtcgggcttagtcccccagcagataaaagttgctacgctcaactctgaagaggaatccgacccaccaacatataaggatgctttcccaccgctgccggaaaaggccgcctgtctcgaaagcgcacaggagccctctggtgcctggggcaataaaatcagacccattaaagcaagtgtaatcacgcaagtcttccacgtgcctctggaagagaggaaatacaaggatatgaaccagttcggagagggggaacaggctaaaatctgcctggagattatgcagagaactggggcacatctagagctgtccctggctaaagatcagggcctgagctag

SEQ ID NO: 190642 - DNA, 444 bp, Artificial Sequence
  Description of Artificial Sequence: Synthetic coding sequence
atgagcagcgtggccgtgctgacccaggagagcttcgccgagcacagatcagggctggtgccgcaacagatcaaggtggcgaccttgaattcagaggaggagagcgatccaccaacttataaggacgcattccctccactgccggagaaggcagcatgtctagagagtgcccaagaaccttctggagcatgggggaacaagatccgaccaatcaaagccagtgttataacccaggtttttcacgtacccctcgaggaacgcaagtacaaagacatgaaccagtttggggaaggcgagcaagcgaaaatctgtctggagattatgcagcgcaccggagcgcacctcgaactgtcactggcaaaagaccagggtttatctattatggtatcaggaaagctcgatgcggtgatgaaggctagaaaagacatcgtcgcgcgcttgtag

SEQ ID NO: 190643 - DNA, 54 bp, Artificial Sequence
  Description of Artificial Sequence: Synthetic coding sequence
atgagcagcgtggccgtgctgacccaggagagcttcgccgagcaccgtagctag

SEQ ID NO: 190644 - DNA, 495 bp, Artificial Sequence
  Description of Artificial Sequence: Synthetic coding sequence
atgagcagcgtggccgtgctgacccaggagagcttcgccgagcaccggagtggcctggttcctcagcagatcaaggtggctacccttaatagcgaggaggaaagtgaccccccaacctataaagacgcatttccacctctgcctgagaaggccgcttgcctggaaagcgcacaggaaccgagtggagcctggggaaataaaattcgtccaatcaaggcatccgtcatcactcaggtgttccacgttcctctcgaagagagaaaatacaaggatatgaaccagtttggggagggagagcaggccaagatttgtcttgaaataatgcagcgcacgggcgctcacctggagctgtctttggccaaagatcaggggctgtccatcatggtcagcggcaagctggacgcggtgatgaaagcgagaaaggacatagtggctaggctgcagactcaggcatccgcaaccgtggcgatccctaaggaacatcatcgcttttag

SEQ ID NO: 190645 - DNA, 144 bp, Artificial Sequence
  Description of Artificial Sequence: Synthetic coding sequence
atgagcagcgtggccgtgctgacccaggagagcttcgccgagcacaggagcgggctagtgcctcaacagatcaaggtggctacattaaactctgaagaggaatccgatcctccaacgtataaagatgcttttcctcctctgtag

SEQ ID NO: 190646 - DNA, 1044 bp, Artificial Sequence
  Description of Artificial Sequence: Synthetic coding sequence
atggagaacctgatgaccagcagcaccctgccccccctgttcgccgacgaggatggatcaaaagaatctaatgaccttgccactacaggcttaaatcaccccgaggttccttactcatctggcgccacatcatcaaccaacaacccagagtttgtagaagacctcagccagggccagctcctgcagtctgagagttccaacgccgccgaagggaatgagcagcgtcatgaagatgagcagcgctctaagcgcggtgggtggtcaaagggccggaaacgtaagaagcctctacgcgactcaaacgctcccaagtcacctcttactggatacgttcggttcatgaacgagcgacgagagcagctgcgagctaaaaggccggaggtcccctttcctgagattaccaggatgctcgggaacgagtggtcaaagctcccccctgaggaaaaacagaggtatcttgatgaagccgatcgagacaaggaacgatatatgaaagaactcgagcagtatcaaaaaacggaggcatacaaggtcttctcccgaaaaacacaggaccgtcaaaaaggcaagtcacaccgacaggatgccgcccggcaggccacccacgaccacgagaaggagactgaagtgaaggagcggagcgtctttgacatcccgatctttaccgaggagtttcttaatcactcaaaggctcgcgaggctgaattgcggcagctccggaagagcaacatggagttcgaagaacggaatgccgcccttcagaaacatgtggagagcatgcgcacagctgtggagaaactcgaagtggatgtcatccaggaacggtcccggaacaccgtgcttcagcagcaccttgagaccctgcggcaagtcttgacctctagcttcgcctctatgcccctgcctggctcaggggagacccctaccgtggatactatagactcctacatgaataggttgcattcaataattctagctaacccgcaggacaacgaaaacttcattgccaccgtgagggaggtcgtgaacaggctggatcgctag

SEQ ID NO: 190647 - DNA, 1044 bp, Artificial Sequence
  Description of Artificial Sequence: Synthetic coding sequence
atggagaacctgatgaccagcagcaccctgccccccctgttcgccgatgaggatggcagcaaggagtctaacgacctcgcaacaactggactgaaccatcccgaagtgccctattcctctggggcaacatcttctacaaataacccagagtttgtggaagacctaagccagggccagctactgcagagcgagtctagcaacgcggccgagggtaacgagcagagacacgaggacgagcagagatctaagcggggcgggtggtccaaagggcgcaagagaaagaaacctttaagggattcaaacgcgcctaaatcccccctgactgggtatgttaggttcatgaatgagcgaagagaacaattacgagccaagaggcccgaggtcccttttcctgaaatcactcgaatgttggggaatgaatggtctaagctgccccctgaagagaagcaaaggtatctcgatgaggccgacagggataaagagagatatatgaaggagcttgagcagtatcagaagacagaggcctacaaggtgttctctcgaaagacccaggatcggcaaaagggtaaatcacataggcaggacgccgctcgacaggctacccacgatcacgagaaagagaccgaggttaaggagcgttcggtttttgacatccctattttcaccgaggagttcctcaaccacagcaaggcccgggaggctgaactcagacagctgaggaagtccaatatggagttcgaggaaagaaatgccgccctgcagaaacatgtggagtctatgcgtacagctgtagagaaacttgaagtcgacgtcatccaggagcgttcacgcaatacagtgctccagcagcatctggaaacacttaggcaggtattgacttcctccttcgcgtcaatgcctttgccaggcagcggcgagacccctaccgtggacacaattgattcctacatgaatcgcctgcactcaattattctggccaacccacaggacaacgaaaatttcattgcaaccgtgcgagaggtagtgaaccgtttagaccgttag

SEQ ID NO: 190648 - DNA, 471 bp, Artificial Sequence
  Description of Artificial Sequence: Synthetic coding sequence
atggagaacctgatgaccagcagcaccctgccccccctgttcgccgacgaagacgggtcaaaggagtcaaatgacctcgctaccaccggattgaaccaccctgaagtgccctatagcagcggcgccacgtctagcaccaataaccctgagtttgtggaggatcttagtcagggacagttgctgcaatccgaaagtagtaacgcggctgagggcaatgaacaacgccacgaagacgagcagcgttcaaaacggggaggatggagcaagggacgcaaacgcaagaaaccattgcgggactccaatgcgcccaagagtccactgaccgggtacgtgaggtttatgaatgaacgcagagagcaactacgagccaagcgaccagaggtgccatttcccgagattacccgcatgctaggaaatgagtggagcaagctgccgcctgaagaaaagcaaagatacttggacgaggcttag

SEQ ID NO: 190649 - DNA, 303 bp, Artificial Sequence
  Description of Artificial Sequence: Synthetic coding sequence
atggagaacctgatgaccagcagcaccctgccccccctgttcgccgatgaggatggcagtaaagagagcaatgacctggcaaccaccgggctgaaccacccagaagtaccatattcctctggcgccacttccagtactaacaacccggagttcgtggaagatctgtcacagggacagctgctgcagtccgagagctcaaacgctgcagagggcaatgaacagcgccacgaagacgagcagcgatctaaacgcggtggctggtcaaaagggcggaaacggaaaaagcccctcagagactcttag

SEQ ID NO: 190650 - DNA, 489 bp, Artificial Sequence
  Description of Artificial Sequence: Synthetic coding sequence
atggagaacctgatgaccagcagcaccctgccccccctgttcgccgacgaagacggatccaaggagagcaacgatttggcaactaccggactgaatcatcccgaggtgccttattcttccggcgctacgtcttcaactaacaaccccgagttcgttgaagatctctcacagggccaacttctgcaaagcgaatcatccaatgccgctgagggcaatgagcagagacacgaggacgagcaacggtcaaaacgtgggggttggtcaaaggggcggaaaagaaaaaagccactgagagactcaaatgcccctaaaagcccactgactggctacgttcgctttatgaatgaacggcgcgagcaactgagagccaaacgccccgaagttccatttcctgagatcactaggatgctgggcaacgaatggtccaagttaccacctgaggaaaaacagaggtacctggacgaggctgatagggacaaggaaagatag

SEQ ID NO: 190651 - DNA, 954 bp, Artificial Sequence
  Description of Artificial Sequence: Synthetic coding sequence
atgagccacggccccaagcagcccggcgccgccgccgcccccgccggcggcaaagctccagggcagcatggcgggttcgtcgtcaccgtgaagcaggagcgtggcgaaggtccacgcgcaggggagaagggctcccatgaagaggagccggtcaaaaagcgcggatggcccaaggggaaaaagcgcaagaagattttgcccaatggcccaaaggcgccggttactgggtatgtccggttcctcaatgagcgcagggagcagatcaggacccgccacccggacctccccttccctgaaatcactaagatgctgggcgcggaatggtctaagctacagcctaccgaaaaacagcgctatttagatgaagcagagcgggagaagcagcaatatatgaaggagttgagagcctatcaacagagtgaggcctacaagatgtgtactgagaaaattcaagagaagaagatcaaaaaggaagacagtagcagcggcttgatgaacactctacttaacggtcacaaaggcggcgattgcgacgggttttcaacattcgatgtgcccatctttaccgaagagttcctggaccagaacaaagctcgggaggcggagctgagacgtctgaggaaaatgaacgttgccttcgaggaacagaacgcagttctacaacgtcacacgcaatcaatgtcaagcgctcgagaaaggctggagcaggaactcgccctcgaagagaggcggaccctcgctctccaacagcagctgcaagccgtccggcaggccctcacagcctcattcgccagtcttccagtgccaggtactggcgagaccccaaccttaggcactctggacttctatatggctcgcctgcatggagccattgagcgagaccctgcacagcatgaaaagctgatagtgcggattaaagagatactcgcacaggtcgcctcggagcatctctag

SEQ ID NO: 190652 - DNA, 807 bp, Artificial Sequence
  Description of Artificial Sequence: Synthetic coding sequence
atggacacccgggtgggcaccgccatggccagcccccccagcatgttccctagcagcctaaaatcttcctggactaaaaccaagagagtgcggcgttctttcggggccgaggatgagtgcgggctgcggggggctgagcggggcacagccgaggcgcacgccgagcacgagcagagggcccgcgctagcggtgctggcgccggcgcaggcggggcagaagacgcaggggctgccgccgcagcccctggacgcgcccctggagcacacaggcaactgaggttgaccgcgggggcaggccacggacgcaacgcccatgctggacattcaggactactgcatggtccagcaagcaggtctcatcgcgctcgcccccgacccgcccgcgaagcacatcggccacatcagggaaatcccggtcccggtcgacagcgcgcccccgttaggagcgggcgcgcacacgatgcagaagaaaagctttgggcacggccatgtcacactccgccaaggggacgggaagctggaggaccccctggacctggcccgatactacacctgggcgggtcaagtcctcctaagattaagttcttgcaacacccattctccttccagtctccacagcccccagagccagggaaatccaccagagatacacctagacgcactagtcagcccagagtgcccctgctaggcggacagacaagatacacaggttcacccggtcacccccaggacaccggacagacaaaacccacgccttccaccagacaggacccacccaactactctctgcgaggggccgtcccctag

SEQ ID NO: 190653 - DNA, 648 bp, Artificial Sequence
  Description of Artificial Sequence: Synthetic coding sequence
atgagccacggccccaagcagcccggcgccgccgccgcccccgccgggggtaaggctcctggccagcatggggggttcgtcgtcaccgtgaagcaggagaggggggagggccctcgggccggagaaaaaggaagtcatgaagaagagcccgtcaaaaaaaggggttggccaaagggaaagaagcgtaagaagatcctccctaacggaccaaaggctcccgtaaccgggtatgtccgctttctgaacgagaggcgggaacagatccgcacaaggcaccccgacctgccctttccagagataaccaagatgctgggtgctgaatggtcgaaactccagcctaccgagaaacaacgctacttggacgaggccgagcgggagaagcagcagtacatgaaagagctgcgcgcttatcaacagagcgaggcatacaaaatgtgcaccgaaaagatccaagagaagaagattaagaaagaggatagcagttctggcctgatgaacacactccttaatgggcataagggcggtgactgtgacgggttctctacatttgacgtaccaatcttcacagaagagtttcttgatcaaaataaagcccgcgaggctgagctgcgaagattgcggaagatgaacgtagccttcgaagaatag

SEQ ID NO: 190654 - DNA, 429 bp, Artificial Sequence
  Description of Artificial Sequence: Synthetic coding sequence
atgagccacggccccaagcagcccggcgccgccgccgcccccgccggcggtaaggctccgggtcagcacgggggcttcgtcgttaccgtgaagcaggaacggggcgaaggtccccgcgcaggggagaaaggtagccacgaagaagagcccgttaagaagagaggctggccgaaggggaagaagcgcaagaagatactgccaaatggtcccaaagctcccgtgacgggctacgttcgtttcttgaacgaaaggagagaacagatcaggaccaggcatcccgatctgccttttccagagattacaaagatgctgggagcagagtggagtaagttgcagcccacggagaagcagcgctatctggacgaggccgaacgcgagaaacagcagtacatgaaggagctgcgcgcttaccagcaatccgaagcttag

SEQ ID NO: 190655 - DNA, 324 bp, Artificial Sequence
  Description of Artificial Sequence: Synthetic coding sequence
atgagcgagagcagcagcaagagcagccagcccctggccagcaagcaagagaaagacggtacagagaagcggggacgcggacgaccaagaaagcaaccccccgtgtctccaggcaccgcacttgttgggtctcaaaaagagccgtctgaagtgcctacccctaagagacccagaggcagaccaaaaggatccaagaacaagggggccgccaaaactcggaaaaccaccacgacacctggcaggaaacctcgaggaagacccaagaaactcgaaaaggaggaggaagaggggatatctcaggagtcttccgaagaagagcaatag

SEQ ID NO: 190656 - DNA, 291 bp, Artificial Sequence
  Description of Artificial Sequence: Synthetic coding sequence
atgagcgagagcagcagcaagagcagccagcccctggccagcaagcaggaaaaggacggcactgaaaaaagaggaagaggccgaccccggaaacagccacctaaggagcctagtgaggttccaactcctaagagacctagagggcgtcccaagggaagcaaaaacaagggagccgcaaagacacgcaaaactacaacgacaccaggcagaaagcctcggggccggcctaaaaaactggagaaggaggaagaagaaggcatatcgcaggagtcatcagaggaggaacagtag

SEQ ID NO: 190657 - DNA, 291 bp, Artificial Sequence
  Description of Artificial Sequence: Synthetic coding sequence
atgagcgagagcagcagcaagagcagccagcccctggccagcaagcaggaaaaagacggaacagaaaagagaggacggggacgacctaggaaacagcctcccaaggaacctagtgaagtgccaacaccgaaaagaccacggggacgaccaaaaggaagcaagaacaaaggcgcggctaagacccggaagacaaccacaacccctgggcggaaaccacgagggaggccaaagaagctagagaaagaggaagaagagggaatctcacaggagtcatctgaagaggagcaatag

SEQ ID NO: 190658 - DNA, 324 bp, Artificial Sequence
  Description of Artificial Sequence: Synthetic coding sequence
atgagcgagagcagcagcaagagcagccagcccctggccagcaagcaggagaaggacgggaccgagaaaaggggcagggggcggccgcgtaaacaacccccagtttcgcccggaaccgcactggtggggtctcagaaagagccgtcagaggttcctacacccaaacgcccaaggggtcggcctaagggatctaaaaataagggtgctgcgaaaacaagaaaaaccactactaccccgggcagaaagccaaggggtaggcctaagaagttggagaaggaagaggaagagggtattagtcaggaaagttccgaggaggagcagtag

SEQ ID NO: 190659 - DNA, 291 bp, Artificial Sequence
  Description of Artificial Sequence: Synthetic coding sequence
atgagcgagagcagcagcaagagcagccagcccctggccagcaagcaggagaaagacggcaccgaaaaacgcgggcgtggtagaccacggaagcagccaccaaaggaaccatccgaagttcctaccccaaagcgccctcgcggtcggcctaaagggtctaagaataaaggcgcagccaaaacccgaaaaactacaaccacccccggccgaaagccaagaggtagaccgaaaaagctggaaaaagaggaggaggaaggcatcagccaagagagcagcgaagaggagcagtag

SEQ ID NO: 190660 - DNA, 987 bp, Artificial Sequence
  Description of Artificial Sequence: Synthetic coding sequence
atgagcgagagcagcagcaagagcagccagcccctggccagcaagcaggaaaaggatgggacagaaaagagaggccgtggccggccgagaaagcagccccctgtgtctccagggacagccttggtaggctcacagaaggaaccttccgaggtgccaaccccgaagcgcccccgcgggcggcccaaagggtccaaaaacaagggcgagggtggcagaggcgggcacttggccggagtcctcggaggcggcgctgtcacgcatgcctgtagattactcctcacaggcggggccgctagtttttgggattggaccgccttgctccgcagccaccggcctcacccttttccacgaccaaccataaccaccgcgagtggtaggcacccacacctcccccccgtgccatcgcccccccactatacagcccatcagcctctccagggatcacacggactctctggtgagcagttctccccagggttgagctcccagctacctcctcccacacacgcctacacacacgcactactggacaaggctaatatccccttgtcaaggactctccatcttctgaggcctcattctttaggaggaggcgacatcgctctttgggcttttggcctgggcgcccccagcttgttactgcattgtagcctgtggctgccgatcgtgggcccaggacgcgtcccattggctcttaagggcgctcaggcgccgagccaccctgggaccccctatagcacagccctcgccgcagcaggtgtggcgaatgggggtggatgctggcctcccggctttccccagcctaattgcctgtgccatcatgttggcctaacatttcatccttcacccacctctctggtacctgtcttaggatggacagcaccgttcggataccgaaaggccggaggggtttctccccttctgcctcttcactgtgggcacagtcccctggcacttcgtttggggagtgagtacattttatggtag

SEQ ID NO: 190661 - DNA, 291 bp, Artificial Sequence
  Description of Artificial Sequence: Synthetic coding sequence
atgagcgagagcagcagcaagagcagccagcccctggccagcaagcaggaaaaggacggaacagaaaaaagaggacggggcaggcctcggaaacagccaccaaaggaacctagcgaggtgcctactccaaagagacccagaggtcggcctaaaggatcgaagaataaaggggccgccaagactaggaaaaccacaacaactcccggccgaaagcctagaggaaggcccaagaaacttgaaaaggaggaggaagagggcatctctcaggaatcctcagaagaagagcagtag

SEQ ID NO: 190662 - DNA, 324 bp, Artificial Sequence
  Description of Artificial Sequence: Synthetic coding sequence
atgagcgagagcagcagcaagagcagccagcccctggccagcaagcaggaaaaagacgggactgagaagcgaggacggggacggcccaggaaacagcctcccgtgtctccagggacagcgctcgtgggatcccagaaagagcctagcgaggtccccacacccaaacggccaagggggagaccgaaaggaagcaaaaacaagggcgcagcgaaaacgaggaaaaccaccactacgccaggacgaaaaccgcgtgggcgcccgaagaagttggaaaaagaagaggaagagggaattagtcaggaatcatcagaggaggagcaatag

SEQ ID NO: 190663 - DNA, 321 bp, Artificial Sequence
  Description of Artificial Sequence: Synthetic coding sequence
atgagcgcccggggcgagggcgccggccagcccagcaccagcgcccaaggacaacctgccgcaccggcgccccaaaagcgggggaggggacggcctcggaagcaacagcaggagcctaccggcgaacccagccctaaacgcccccgcggcaggcccaagggttccaagaacaagagcccttcaaaggcagcacaaaaaaaggccgaggcgaccggcgagaaacgcccacgcggccgcccacggaagtgggataacttactgcctaggaccagctcgaagaagaaaacctccctcgggaactcaacaaagcgatcacattag

SEQ ID NO: 190664 - DNA, 357 bp, Artificial Sequence
  Description of Artificial Sequence: Synthetic coding sequence
atgagcgcccggggcgagggcgccggccagcccagcaccagcgcccagggacagcccgccgctcctgccccccaaaaaaggggcaggggaaggccgcgtaagcagcaacaggaacccactggagaaccaagcccgaagcgacctcggggacggcctaagggatccaagaacaaatccccttccaaggccgctcagaagaaagccgaagcaaccggagaaaagcggcctcgaggacgacctaggaaatggccgcagcaggtggttcagaaaaaaccggcacaggtaaacgtcgccctgcctgggaaagaccatccgggcaatctcatctatctgcttttcagcaagaacgccacctag

SEQ ID NO: 190665 - DNA, 273 bp, Artificial Sequence
  Description of Artificial Sequence: Synthetic coding sequence
atgagcgcccggggcgagggcgccggccagcccagcaccagcgcccagggacagccagcagcacccgccccccaaaagcgaggccgtggcaggcctaggaaacagcagcaagaaccaaccggtgagccttccccaaagcggccacggggccggcctaaggggtcaaagaataagtccccttcgaaggccgcgcagaagaaggctgaagcaacgggagagaaacggccgcgaggtagaccccgcaagtgggaggaattctatatcgcagcctag

SEQ ID NO: 190666 - DNA, 330 bp, Artificial Sequence
  Description of Artificial Sequence: Synthetic coding sequence
atgagcgcccggggcgagggcgccggccagcccagcaccagcgcccaaggccagccagccgctccagctccacagaaaagaggccgcggacgacctaggaaacaacagcaagaacctacgggcgagccaagcccaaagcgcccccgtgggcggcctaagggatctaaaaataagtcaccctcaaaggcggctcaaaaaaaagctgaagcaaccggcgaaaagcgacctagagggcgaccaagaaaatggcctcagcaggtcgtgcagaagaagccagcacaggaggagacagaagagaccagttctcaggagtcagccgaggaggattag

SEQ ID NO: 190667 - DNA, 279 bp, Artificial Sequence
  Description of Artificial Sequence: Synthetic coding sequence
atgagcgcccggggcgagggcgccggccagcccagcaccagcgcccaggggcagcccgctgctcccgcaccccaaaaaagaggcagagggaggcctcgtaagcaacaacaggaaccaaccggcgagccatctcccaagcgacctcggggtagaccgaaaggcagcaaaaacaagagcccatccaaagccgcacaaaagaaagctgaggctacaggcgaaaaacggcctcggggccggcctcggaagtggtggcttctgatgaagtccccatgctggtag

SEQ ID NO: 190668 - DNA, 312 bp, Artificial Sequence
  Description of Artificial Sequence: Synthetic coding sequence
atgagcgcccggggcgagggcgccggccagcccagcaccagcgcccaaggccagccggcagcccctgctccgcagaagcggggtcgaggtcggccacggaagcagcaacaagaacccaccggagagccctctcctaagaggcccaggggacgacctaagggttcaaagaataagtccccatccaaagctgcccagaagaaggctgaggctactggggagaaacgtcctcgaggccgccccagaaagtggttgcgggcccaggcgttggactctgatggtctcgggagcaacagtggccctagcctctcctag

SEQ ID NO: 190669 - DNA, 261 bp, Artificial Sequence
  Description of Artificial Sequence: Synthetic coding sequence
atgagcgcccggggcgagggcgccggccagcccagcaccagcgcccaaggtcaacccgcagcgcctgccccccagaaaagagggcgcgggcgcccaagaaagcagcaacaagagcccacgggggaaccaagccctaaacggccccgcggtaggccaaaaggctcaaaaaacaagagcccctcaaaagccgctcaaaaaaaagccgaagctaccggggagaaaagaccaaggggtcgaccacgcaaatggctgcagaactag

SEQ ID NO: 190670 - DNA, 300 bp, Artificial Sequence
  Description of Artificial Sequence: Synthetic coding sequence
atgagcgcccggggcgagggcgccggccagcccagcaccagcgcccaaggacagcccgctgctcctgcgccgcaaaagagaggaaggggaaggccgaggaagcaacagcaggaacccacaggtgaaccttcacccaagcgacctcggggccgtcccaaggggtcaaagaacaaatccccttctaaggcggctcagaagaaagccgaggccacaggtgagaagcgacctcgaggacgccctagaaagtggccacagcaagtggtgcagaagaaacctgctcaagttcggcactcccattag

SEQ ID NO: 190671 - DNA, 477 bp, Artificial Sequence
  Description of Artificial Sequence: Synthetic coding sequence
atgggcaagggcgaccccaagaagccccggggcaagatgagcagctatgcattcttcgtacagacctgtcgggaggaacacaagaaaaaacatcctgacgccagcgttaacttcagcgagttttcaaagaaatgttcagaacgctggaagacaatgagcgctaaggagaagggaaagtttgaggatatggccaaagctgacaaagcccgttacgaacgggaaatgaagacctacatccccccaaagggcgagactaaaaaaaagttcaaggatccaaacgcccccaagcggcctccttcagctttctttctcttctgctctgagtataggcctaagattaagggggagcaccctgggttaagcatcggagacgtggctaagaaactgggagagatgtggaataacactgctgccgacgataagcagccctatgaaaagaaagccgccaagctcaaagagaaatacgagaagttctag

SEQ ID NO: 190672 - DNA, 648 bp, Artificial Sequence
  Description of Artificial Sequence: Synthetic coding sequence
atgggcaagggcgaccccaagaagccccggggcaagatgagcagctacgccttctttgtgcaaacctgccgagaagaacacaagaaaaaacatcccgacgcttcagtgaatttctcagagttcagcaagaaatgtagcgaaagatggaaaaccatgtcagcaaaggagaaggggaaatttgaggatatggctaaggccgacaaggccagatacgagcgagaaatgaaaacctacatcccgcctaaaggcgagaccaaaaagaagttcaaggaccctaatgctcccaaacggcccccctctgccttttttctgttctgcagcgagtaccggcccaagattaagggcgagcatcccggtctgtctatcggggatgttgccaaaaagttgggtgagatgtggaacaatacagcagcggacgataagcaaccgtacgaaaagaaggccgcgaagttaaaggaaaagtatgagaaggacatcgccgcgtaccgggccaaaggcaagccggatgcagccaaaaaaggagtggttaaggctgagaagtctaaaaaaaaaaaagaagaggaagaagacgaggaagacgaggaagatgaggaagaagaagaagatgaggaggacgaagatgaggaggaagacgacgatgatgagtag

SEQ ID NO: 190673 - DNA, 648 bp, Artificial Sequence
  Description of Artificial Sequence: Synthetic coding sequence
atgggcaagggcgaccccaagaagccccggggcaagatgagcagctatgctttcttcgtgcaaacatgtcgcgaggagcacaagaagaaacacccagacgccagcgtgaactttagcgaattctccaaaaaatgcagcgagcgctggaagactatgtccgcgaaagaaaagggaaagttcgaagacatggcaaaggcagataaggcacgatacgagcgagagatgaaaacctacatacctccgaagggcgaaaccaaaaaaaagttcaaggacccaaacgctcccaaaaggccccctagcgcttttttcctgttctgctcagagtaccgtcccaagatcaagggggaacaccccggactcagtattggagacgtggctaagaagcttggcgagatgtggaacaacactgcagcagacgataagcagccttacgagaaaaaagccgctaagctcaaagaaaagtatgagaaagatatagctgcgtaccgcgccaaagggaaaccagacgctgccaagaaaggggtggtgaaagctgaaaagagcaaaaaaaagaaggaagaggaggaggatgaggaggacgaagaagacgaggaagaggaggaagatgaggaagatgaagacgaggaagaggacgatgacgacgagtag

SEQ ID NO: 190674 - DNA, 294 bp, Artificial Sequence
  Description of Artificial Sequence: Synthetic coding sequence
atgggcaagggcgaccccaagaagccccggggcaagatgagcagctacgcattcttcgtccaaacctgcagggaagagcacaaaaaaaagcacccagacgcttccgtcaatttttctgagttttcaaaaaaatgcagcgagcggtggaagaccatgagcgccaaggaaaaaggtaaattcgaagacatggcaaaagccgacaaggccagatatgagcgggaaatgaaaacctacatccctccgaaaggagagaccaaaaagaaattcaaagaccccaacgccccaaagcggtag

SEQ ID NO: 190675 - DNA, 477 bp, Artificial Sequence
  Description of Artificial Sequence: Synthetic coding sequence
atgggcaagggcgaccccaagaagccccggggcaagatgagcagctatgccttctttgtgcagacatgtagggaggagcacaaaaagaaacatcccgacgccagcgtcaatttcagcgagttttccaagaaatgcagcgagcgctggaagacaatgtcagcaaaggagaaggggaagtttgaggacatggcaaaagctgataaagcaaggtatgagcgggaaatgaaaacttatatcccgcctaaaggcgaaaccaaaaagaaatttaaggaccctaatgcacctaaaaggcccccatcggccttcttccttttctgtagcgagtatcggccaaagattaagggagagcatcccgggttgagcataggtgacgtggctaagaagttgggtgaaatgtggaacaataccgccgctgacgataaacagccctatgagaaaaaagcagctaagcttaaggagaaatacgagaagttctag

SEQ ID NO: 190676 - DNA, 648 bp, Artificial Sequence
  Description of Artificial Sequence: Synthetic coding sequence
atgggcaagggcgaccccaagaagccccggggcaagatgagcagctatgccttcttcgtgcagacatgcagagaggagcacaagaagaaacaccccgacgccagcgtgaacttctccgagttttccaaaaaatgtagcgagcgttggaagaccatgtcagctaaggagaaggggaagtttgaggatatggccaaggctgataaggcaagatacgagcgcgagatgaaaacttacattccgcctaaaggcgagaccaaaaagaaattcaaagaccccaacgctcccaaacgcccgccatcggctttttttctcttttgctccgagtacagaccaaaaattaagggagagcaccctggcctgtccataggtgacgtggcaaagaagcttggcgaaatgtggaacaataccgctgctgacgacaaacagccttatgaaaagaaggccgcaaaattaaaggagaagtatgaaaaggacatagctgcatatcgcgcgaaagggaagcccgatgccgccaagaagggggttgttaaagctgagaagtcaaagaagaagaaagaagaagaggaagatgaggaggacgaggaggatgaggaagaagaggaggatgaagaggacgaggatgaggaagaagacgatgatgatgagtag

SEQ ID NO: 190677 - DNA, 648 bp, Artificial Sequence
  Description of Artificial Sequence: Synthetic coding sequence
atgggcaagggcgaccccaagaagccccggggcaagatgagcagctatgccttctttgtgcagacatgcagggaggaacacaagaagaaacaccctgatgcaagtgttaatttttctgagttctccaagaaatgttctgaaagatggaagaccatgtccgcaaaagaaaaagggaagtttgaggacatggctaaggccgataaggctagatacgagcgagagatgaaaacttacatacccccaaaaggtgaaaccaaaaaaaaatttaaagatccaaacgcgcctaaacggcccccatccgcctttttcctgttttgtagcgagtacaggcctaagattaagggtgaacaccctggtctatccatcggggatgtcgcgaaaaagcttggcgagatgtggaataacacagccgccgatgataagcagccatatgagaagaaggcggcaaaactaaaggaaaagtatgagaaagatattgccgcctatcgggctaagggtaagccagatgcagcaaaaaagggcgttgtcaaagctgagaaatccaaaaaaaagaaggaggaggaagaagacgaggaagacgaggaagacgaagaggaggaggaggatgaggaggacgaggatgaagaggaggatgacgacgacgaatag

SEQ ID NO: 190678 - DNA, 489 bp, Artificial Sequence
  Description of Artificial Sequence: Synthetic coding sequence
atgggcaagggcgaccccaagaagccccggggcaagatgagcagctacgcatttttcgttcagacctgccgcgaagaacacaagaaaaagcaccctgatgctagcgtgaacttttccgaattctcaaaaaagtgctccgaacgatggaagacaatgtccgccaaagaaaaagggaagtttgaggacatggccaaggccgacaaggctcggtatgagcgggaaatgaagacttacataccaccaaaaggtgaaactaagaagaaatttaaagaccctaatgcccccaaaagaccaccttccgcattttttctcttttgttccgagtatcggcctaaaatcaagggcgaacaccccgggttgtcaataggtgacgtcgctaagaagcttggtgaaatgtggaacaacacagcagctgacgacaagcaaccatacgaaaagatcctcctgcacatagagctgaaagaatcattaatgcagcagaagcggtag

SEQ ID NO: 190679 - DNA, 630 bp, Artificial Sequence
  Description of Artificial Sequence: Synthetic coding sequence
atgggcaagggcgaccccaacaagccccggggcaagatgagcagctacgcattttttgtccagacctgtagagaagaacacaaaaagaagcaccccgacagtagcgtaaattttgcggaatttagcaaaaagtgttcggaacgatggaaaaccatgtcggccaaagaaaagtctaagttcgaagatatggccaaatccgacaaagcccgttatgatagggaaatgaagaactatgtacctcctaaaggagataaaaagggcaagaagaaagatcctaacgcccctaaacggccacctagcgcgttcttcctgttctgttcagaacaccgtccgaagatcaaaagtgaacatcctgggctttctatcggagatactgccaaaaagttgggggagatgtggtcagaacagtcagcaaaagataagcaaccatacgaacagaaagcggccaaactcaaagagaagtacgagaaagatatcgcggcctatagagcaaagggtaagagtgaagctggcaagaaaggccccggccggcccactgggtctaagaaaaaaaacgaacctgaggacgaggaggaagaggaagaagaagaggatgaagacgaggaggaggaagacgaggacgaggagtag

SEQ ID NO: 190680 - DNA, 630 bp, Artificial Sequence
  Description of Artificial Sequence: Synthetic coding sequence
atgggcaagggcgaccccaacaagccccggggcaagatgagcagctacgcattttttgtacaaacttgccgtgaggagcacaaaaaaaagcatccagactcatcagtgaactttgcggagttctctaagaaatgttctgagcggtggaagaccatgagcgcaaaggagaaatccaaattcgaagacatggctaaatcagataaggcaaggtatgatcgtgaaatgaagaattacgtgccccctaagggcgacaaaaagggaaagaaaaaagatccaaacgcacccaaacgccctccatccgcatttttcctgttttgtagcgaacatcgccccaaaatcaaatcagaacaccctggactgtccatcggggataccgctaagaagctgggagaaatgtggtcagagcagagtgccaaagacaagcaaccgtatgagcaaaaggcggctaagctgaaagaaaagtatgaaaaagatatcgcagcctaccgagcaaaggggaagagcgaggcaggcaagaagggtcctggaagaccaacaggcagtaagaagaaaaacgagccagaggatgaggaggaggaggaggaggaggaggacgaggacgaggaggaagaggacgaagatgaggagtag

SEQ ID NO: 190681 - DNA, 630 bp, Artificial Sequence
  Description of Artificial Sequence: Synthetic coding sequence
atgggcaagggcgaccccaacaagccccggggcaagatgagcagctatgcttttttcgtccaaacctgtcgcgaggagcataaaaagaaacatccagattcatccgttaatttcgctgaattctcaaaaaagtgcagtgaaaggtggaagacaatgtccgctaaggagaagtctaaattcgaggatatggccaaaagcgacaaggcccgctatgaccgagagatgaaaaactacgtgccaccaaagggagataagaaaggcaagaaaaaggacccgaacgctccgaagaggccaccaagcgcttttttccttttctgctctgagcataggccgaaaattaaatccgagcaccctgggttgagcataggcgacacagctaaaaaacttggtgagatgtggtccgaacaatcagccaaagacaagcagccatatgaacaaaaggctgcaaagttgaaagagaagtacgagaaagacatcgccgcctaccgcgctaagggcaaatctgaggctggaaaaaaaggacccgggcggcccacaggatccaagaaaaagaatgagccggaggatgaagaggaggaagaggaagaagaggatgaggatgaagaagaggaggacgaagatgaagagtag

SEQ ID NO: 190682 - DNA, 405 bp, Artificial Sequence
  Description of Artificial Sequence: Synthetic coding sequence
atgggcaagggcgaccccaacaagccccggggcaagatgagcagctacgcatttttcgtacaaacgtgccgagaagaacacaaaaaaaagcaccctgactcttccgttaattttgcagagttctcgaaaaaatgctccgagagatggaagaccatgtcggccaaggagaagagcaaatttgaagacatggccaaaagcgataaggcaagatacgacagggaaatgaagaattacgttcccccgaaaggcgacaagaagggaaagaaaaaggatcctaacgccccaaagagaccgccaagcgctttctttctgttttgcagcgaacacaggcccaaaatcaagagcgagcacccggggctcagcatcggggacacggctaagaaactgggtgagatgtggtcgtag

SEQ ID NO: 190683 - DNA, 603 bp, Artificial Sequence
  Description of Artificial Sequence: Synthetic coding sequence
atggccaagggcgaccccaagaagcccaagggcaagatgagcgcctacgccttcttcgtgcagacctgcagagaggagcataagaagaaaaaccctgaagtccccgtaaatttcgccgaattttctaagaagtgttccgagcggtggaagactatgagcggtaaggagaagtcaaaattcgatgaaatggctaaggcagataaggtgcgttacgaccgagaaatgaaggattatgggccagccaaaggtggcaagaagaagaaggacccaaacgccccaaagcgtccccctagtgggtttttcctgttctgctcagaatttcgcccaaagattaagtccacaaatcctggcatcagtattggggacgtggcaaagaaactcggagagatgtggaacaacctcaacgatagtgagaagcaaccgtatatcacaaaggctgctaagctgaaggagaaatatgaaaaggatgtcgctgactataagtcaaagggcaagtttgatggcgcgaaaggacccgccaaagtggcccggaagaaggtcgaggaagaggacgaagaagaagaagaagaagaggaagaagaggaggaggaagaggacgagtag

SEQ ID NO: 190684 - DNA, 567 bp, Artificial Sequence
  Description of Artificial Sequence: Synthetic coding sequence
atggccaagggcgaccccaagaagcccaagggcaagatgagcgcctacgccttctttgtccagacatgtagggaggagcacaagaagaagaatccggaggttcctgttaattttgcagagttcagcaaaaagtgttccgagcgctggaagaccatgtctgggaaagagaagtcaaaattcgatgaaatggcgaaggccgacaaggtacgatatgaccgagaaatgaaggactatggcccagctaaggggggcaagaaaaaaaaggatccaaacgctcctaagcggcctccctcaggctttttcctcttttgctcagaatttcgaccaaaaatcaaaagcactaaccctggaattagcatcggggacgtggccaaaaagttgggcgagatgtggaataacctgaacgatagtgagaagcagccatacattacaaaagccgctaagctgaaagaaaaatacgaaaaggacgtcgcagattacaagtccaaaggcaagttcgacggggcaaaaggcccagccaaagtagcacgcaagaaagtggaagaggaggatgaagaggaagaatag

SEQ ID NO: 190685 - DNA, 462 bp, Artificial Sequence
  Description of Artificial Sequence: Synthetic coding sequence
atggccaagggcgaccccaagaagcccaagggcaagatgagcgcctatgctttcttcgtccaaacttgccgggaagagcacaagaaaaagaatcccgaagtccccgtgaatttcgcagagttctccaaaaaatgttcagaaaggtggaaaaccatgagtgggaaggaaaaatctaaatttgatgagatggcgaaagcagataaagtacggtacgatagggagatgaaagattatgggcccgcaaaagggggcaaaaagaagaaagacccaaatgccccgaagaggcccccctccgggttttttctgttttgttcagaatttaggcccaagataaaatccacaaatcccggcatcagtatcggtgacgtggcaaagaaattgggagaaatgtggaacaacctgaatgactctgaaaagcagccatacatcaccaaggccgccaagctcaaagaaaagtattag

SEQ ID NO: 190686 - DNA, 603 bp, Artificial Sequence
  Description of Artificial Sequence: Synthetic coding sequence
atggccaagggcgaccccaagaagcccaagggcaagatgagcgcctatgcctttttcgtacaaacgtgtcgcgaggagcataaaaagaagaaccccgaggtgcctgttaattttgcagaatttagtaagaaatgttccgagaggtggaagacaatgtctgggaaggaaaaatccaaattcgacgagatggccaaggccgataaggtccgatacgaccgcgaaatgaaggattatggtcccgccaagggggggaaaaaaaaaaaggaccctaacgctcccaagagacctcccagcggcttcttcctcttttgtagcgaattccggcccaagattaagtctacaaatcccggaatcagcataggggacgtggctaaaaaactgggtgagatgtggaataacctgaacgattctgagaagcagccctacatcacaaaggcagcaaaactaaaagagaaatacgaaaaggatgtggctgactacaaaagcaaagggaaattcgacggcgctaaaggtccagcgaaagtcgcccggaaaaaggtcgaagaagaggacgaggaagaggaggaggaagaggaggaggaggaggaggaggaagatgagtag

SEQ ID NO: 190687 - DNA, 582 bp, Artificial Sequence
  Description of Artificial Sequence: Synthetic coding sequence
atggccaagggcgaccccaagaagcccaagggcaagatgagcgcctacgccttttttgtacagacgtgtcgcgaggagcataaaaaaaagaatcccgaggtaccagtgaacttcgcagagttctccaaaaaatgcagcgaacggtggaagaccatgagtggaaaggagaaaagtaagtttgacgagatggcgaaagccgataaggtaaggtacgatcgtgaaatgaaggactacggccctgccaaaggaggtaagaagaagaaggaccctaatgctcccaagcggccacccagcgggttctttctcttctgcagtgagtttaggcccaagattaaatccaccaatcctggcatcagtattggcgacgtagccaaaaaactcggagaaatgtggaacaatctgaatgattctgaaaaacagccctatatcactaaagctgccaagcttaaagagaagtatgagaaagacgtcgccgactacaaaagcaaggggaagtttgacggagcaaaagggcctgcaaaagttgctagaaaaaaggtcgaagaagaggatgaggaggaggaagaggaggaggaggagtag

SEQ ID NO: 190688 - DNA, 273 bp, Artificial Sequence
  Description of Artificial Sequence: Synthetic coding sequence
atgcccaagcggaaggccgagggcgacgccaagggcgacaaggccaaggtgaaagacgaaccacagcgcaggtctgcccgcttgtcggcgaaaccggcacccccgaagcctgagcccaagcctaaaaaggctccggccaaaaagggcgagaaagtcccaaagggaaagaaaggaaaagccgacgccggaaaggagggcaataatcctgctgagaacggggacgcaaaaacagatcaggcccaaaaagccgaaggtgctggcgacgctaaatag

SEQ ID NO: 190689 - DNA, 234 bp, Artificial Sequence
  Description of Artificial Sequence: Synthetic coding sequence
atgcccaagcggaagagccccgagaacaccgagggcaaggacggcagcaaagttacgaagcaagagccaacccggagaagcgcccgcttaagcgccaagcctgccccccccaaaccagaacccaagccgaggaagacctctgctaagaaggagcctggcgccaaaatcagtaggggcgcaaaggggaagaaagaagagaagcaggaggcaggtaaggagggtacagaaaattag

SEQ ID NO: 190690 - DNA, 300 bp, Artificial Sequence
  Description of Artificial Sequence: Synthetic coding sequence
atgcccaagcggaagagccccgagaacaccgagggcaaggacggctccaaggtaactaagcaagagcctacaagacgttccgcacgcctaagcgcaaaaccagcccctcctaaacccgagcctaagccgcgaaagacatccgcgaagaaggaacccggagccaagataagtcgcggcgcaaagggaaagaaggaggagaaacaggaagccggaaaggaggggacagccccttctgaaaatggcgaaaccaaagccgaggaggcacagaagactgagagcgttgataatgaaggcgagtag

SEQ ID NO: 190691 - DNA, 507 bp, Artificial Sequence
  Description of Artificial Sequence: Synthetic coding sequence
atggtgctgttcttccggatcaacctgcagaccaagaagtgcaagcagaaagggaagggtgagcagagagaaaatcgcccaaagtggctgaccaaaaaacttaaaaagacttatctcaggaaaaccggaaaaaggaggctacgcagggtgcagccattgatgaagcaagagcgtaaaaagccgtcccttatcaacaaccacataccctgcctgatcagtggaccttgcctgccaagttgcaccattcaacgcaatatttttatcaactatttcgtaaatgcgtcattcctggtggcgctcgaaacattccttaggcgtagggagtctcacctaattccatttttcaagtgcaagtgtttctttctgaggggagaaataatctgttggctattcatattttggtacaaccagaaaattgtgtgggatatcgaactctgggaggctttgacagtttctggggtttctttgacatttcatagatggggagtgagcttctatattctgtag

SEQ ID NO: 190692 - DNA, 303 bp, Artificial Sequence
  Description of Artificial Sequence: Synthetic coding sequence
atgcccaagcggaaggtgagcagcgccgagggcgccgccaaggaggagcccaaaaggcgtagtgctagactgagcgctaagccacctgcaaaagtggaggccaagccaaagaaggcagctgccaaggacaaatcttcagataagaaagtgcaaactaaggggaaaaggggagccaaaggaaagcaggcggaggttgcgaaccaagagaccaaggaggacctgccggccgagaacggggagaccaaaaccgaagagtctcctgcaagtgatgaggccggcgaaaaggaggctaagtccgactag

SEQ ID NO: 190693 - DNA, 582 bp, Artificial Sequence
  Description of Artificial Sequence: Synthetic coding sequence
atgggcaagcagaacagcaagctgcggcccgagatgctgcaggacctgagagagaacaccgaattctctgagctagagctccaggaatggtataagggatttttaaaggattgccccaccgggattctgaacgttgacgagtttaagaagatctacgctaattttttcccctatggagacgcaagcaaatttgcagagcatgtgttcagaactttcgatactaatagcgatgggactatcgattttcgcgagttcattatcgccttgtccgtcacatcccggggacgcttggaacagaaacttatgtgggcattcagcatgtacgacctcgacggcaatggatacattagcagggaagaaatgctcgaaatagtccaggccatttacaaaatggtgagttctgttatgaaaatgcctgaggacgagtctacacctgagaaacggactgaaaagatttttcgccagatggatacgaacaacgacggaaaattaagcctggaggaattcatccggggggctaaatcagatccatctattgtcaggctcctccaatgcgatccttctagcgctagccagttctag

SEQ ID NO: 190694 - DNA, 582 bp, Artificial Sequence
  Description of Artificial Sequence: Synthetic coding sequence
atgggcaagcagaacagcaagctgcggcccgaggtgctgcaggacctccgggagaatacagagttcaccgatcacgaactccaggaatggtacaaaggtttcttaaaggactgtcccaccgggcatctgactgtggacgagtttaaaaaaatatacgcaaatttctttccatatggtgatgcgtctaaattcgccgagcacgtatttaggacttttgacaccaacggagatggaacaatcgactttcgtgagttcattatcgctctcagcgtcacctcccggggcaaattagagcagaagttaaagtgggctttttctatgtatgacttggacggaaatggttacatctctagatctgagatgctggagatcgtgcaagctatctacaagatggtaagtagtgtgatgaagatgcccgaggatgagagtactccagaaaagcgtactgacaagatattccggcagatggataccaataatgacggaaagctctcactcgaagaattcatcagaggcgcgaaatccgaccctagcattgttcgtttgctacaatgcgatccatcctctgcctcacaattttag

SEQ ID NO: 190695 - DNA, 582 bp, Artificial Sequence
  Description of Artificial Sequence: Synthetic coding sequence
atgggcaagcagaacagcaagctgcggcccgaggtgctgcaggacctccgtgaaaacactgaatttactgatcacgaactgcaggagtggtacaaagggtttcttaaagactgtccaacagggcacctgactgtggacgagtttaaaaagatctacgctaactttttcccttacggcgacgcaagcaagttcgccgagcatgtgttcagaacttttgatactaatggagacggtaccattgacttcagggaatttatcatagcactgagcgtgacttctaggggtaagctagaacagaaattgaaatgggctttctccatgtatgacctggacggcaacggatatatttcgcgttcagagatgcttgagattgttcaggctatttataaaatggtctcctccgtgatgaagatgcccgaagatgagtccacgcctgagaagaggaccgacaagatttttagacagatggatactaataatgacggtaagttatccctggaagagttcataagaggggccaaaagcgatccatccatcgtaaggctgctccagtgcgatccttcatctgccagccagttttag

SEQ ID NO: 190696 - DNA, 93 bp, Artificial Sequence
  Description of Artificial Sequence: Synthetic coding sequence
atgggcaagcagaacagcaagctgcggcccgaggtgctgcaggacctcagggagaataccgaattcacggatcacgaactgcaggagtggtag

SEQ ID NO: 190697 - DNA, 3054 bp, Artificial Sequence
  Description of Artificial Sequence: Synthetic coding sequence
atgaagctgctgaagcccacctgggtgaaccacaacggcaagcccatattttcagtagacatccacccagacgggaccaaattcgctacagggggccaggggcaggatagtggcaaggtggtgatttggaacatgagcccagtcctccaggaagacgacgagaaagatgaaaacattcctaaaatgctctgtcagatggacaaccacctagcgtgtgttaactgtgtaagatggagtaatagtggtatgtacttggcttctggcggggatgacaagctgataatggtgtggaaaagggcaacttatattgggcctagcacggtctttggcagctccggaaaattagctaacgtggaacagtggcgatgtgtcagcattctgaggaatcattcgggggacgtgatggacgttgcttggtctccccatgatgcttggctggctagctgtagtgtggataataccgtagttatttggaacgcagtgaagtttcctgagatactagccacactcagagggcattctggtctggtcaagggcctaacctgggaccctgtggggaaatacatagcttcgcaagcagacgacagatctctgaaagtctggcggaccctggactggcagctggagaccagcattacaaagccttttgatgagtgcggcggcacaacgcacgtgctgcggctctcttggtctcctgacggacactacttggtgtcagcccacgccatgaacaactcaggtcccacggcccagattatcgaacgcgagggctggaaaaccaacatggacttcgtaggccacaggaaagctgtcacagtggttaagttcaatccaaagatcttcaagaagaagcagaaaaatgggtcaagtgcaaagccgtcttgtccatactgttgttgcgctgtgggcagcaaggaccgaagtttgtccgtgtggctgacgtgcctaaaacggcctctggtagtgatccacgaactgtttgacaaatcgatcatggacatctcctggaccctgaatggacttgggatcctcgtgtgttcaatggatgggtctgtcgcgtttctcgacttctcccaggatgagttgggtgatcccctgtctgaagaggagaaatccagaatccaccagtccacctacggtaaatctcttgccataatgacagaagcccaactaagcacagctgtcatcgagaatcccgaaatgttaaaataccagaggaggcagcagcagcagcagctggaccagaagtcagccgccacaagggagatggggtcagccacgtctgtagcaggtgtggtgaatggcgaatccctggaggatatcagaaagaatctgttgaaaaagcaggtggagactcgaaccgcagacggcagacgtagaattacaccgctgtgtattgctcaactcgacacaggggatttttcaactgccttttttaacagcatccccctttcaggttcgttggccggcacaatgctcagttctcacagcagcccacaacttctccccttggactccagcactcccaatagcttcggcgcttccaaaccatgtacagagccggtggttgcagcatccgcccgaccggcgggcgatagtgtcaataaggatagtatgaacgctacctccacgcccgccgcattgtcgccatctgtactcactaccccctctaagattgaacctatgaaggcatttgactcgaggttcactgaacgaagtaaagccacccccggcgccccggcgttaacatccatgactcctacagccgtggagcggctaaaggaacagaatctggtgaaggaactccggcccagagatctgctggagagctcttctgacagcgacgaaaaagtgcccttagccaaagctagctccctatctaagcgcaaacttgagctggaggtggagaccgttgagaaaaagaagaaagggcgcccaaggaaggattcgaggctgatgccggtgagtctgtctgtgcagtctccggccgcactgaccgcagaaaaggaagccatgtgcctgagtgcccctgcactggcactgaaattacctataccatcaccacagagggcattcaccctgcaagtgagctctgaccctagcatgtacatcgaggtggagaacgaggttaccgtggtcggtggagtgaagctgagcaggctgaagtgtaaccgggaggggaaagagtgggagacagtgctaacaagcaggatactgaccgcagcgggatcgtgcgatgttgtgtgtgtagcctgcgaaaagcggatgctttccgtgttcagcacttgcgggcgaagattgctctccccgatactcctcccctcccccataagtaccctccattgtactggttcgtatgtcatggccctcacggccgctgcaaccctaagcgtctgggatgtgcatagacaagtcgtggttgttaaagaggaaagccttcatagtatacttgccgggagcgatatgactgtttcccagatcttactgactcagcatggaatccctgtgatgaacctgtcagatggaaaagcttactgtttcaatccgtctctgtcaacatggaacctggtgtcagacaagcaggattcgcttgcacagtgtgctgatttccggtcatccctccccagccaggatgccatgctctgtagcggacctctggcaattatccagggtcgcaccagtaactcaggaagacaggcagcccggctgttttcagttccccacgtggtgcaacaggagactaccttagcctatttggagaatcaagtggccgccgcccttaccctgcagagttcccacgaatatagacactggctcctggtgtatgcccgctatctggtgaatgaaggcttcgagtatagactcagagaaatctgcaaggacctcctcggccctgttcactactcaactggaagtcagtgggaaagcactgtggtgggcctgaggaagcgggaattgttgaaggagctgctacctgttattggtcagaacttacgatttcaaagactctttaccgaatgtcaggagcagttggacattctgagagacaaatag

SEQ ID NO: 190698 - DNA, 2433 bp, Artificial Sequence
  Description of Artificial Sequence: Synthetic coding sequence
atgaagctgctgaagcccacctgggtgaaccacaacggcaagcccatcttctcagtagatattcaccccgacggcacgaagtttgcgaccggcgggcagggccaggacagcggtaaggtggtcatttggaacatgtcgcccgtcctccaggaggacgatgagaaggacgaaaacattccaaaaatgctgtgccagatggacaaccacctcgcatgtgtcaactgcgtccggtggagcaattcaggcatgtatctcgcttcaggaggagacgataagttgataatggtatggaaaagggccacttatatcgggccctccactgtctttggcagcagcgggaaattagccaatgtggaacagtggcgatgcgtgagtatcctgcggaaccacagcggcgatgtcatggatgttgcatggagcccacacgatgcctggctggcctcttgttcagttgacaatactgttgtgatctggaacgctgttaagttcccagagatacttgccaccctgcggggacactcaggactagttaagggactgacgtgggaccctgtcggcaaatacattgcaagtcaggcagatgatagaagtctgaaagtctggaggacattagactggcagcttgaaacatcaattactaagcccttcgacgagtgcggaggcactactcacgtcttgagactctcctggtcaccagatggccattatctggtatcagcacacgccatgaataattctggccccaccgctcagattatcgagcgagagggatggaaaaccaatatggattttgtgggtcaccgcaaagctgtcaccgtcgtaaagttcaatccaaaaatctttaaaaaaaaacagaaaaacggcagttccgccaagccatcatgtccttactgttgctgtgccgtaggatcgaaagacagaagcctgagtgtctggttgacttgtctgaagcggccccttgtcgtaattcacgagctgtttgacaagtcaatcatggatatttcttggaccttaaatggtcttggtatcttggtgtgctccatggatggatccgtggccttcctcgacttctcccaggatgagctgggggatcctctttcagaagaggaaaaatcgagaatccaccaatccacctacgggaagtccctcgccatcatgacggaggctcagctgagcaccgccgtcatcgagaacccggaaatgctgaagtaccaaaggaggcagcagcagcagcaactcgaccaaaagtccgcggcaactagggagatgggcagtgcgacatctgtggccggcgtggtcaatggggaaagtcttgaggatatcagaaaaaacctgttaaagaaacaggtcgagacgcggactgccgatgggcgcaggagaatcacgccactatgcatcgcgcagttggatacgggagatttcagcaccgctttctttaattcaatcccgctgtctggcagccttgccggcacaatgctgtcatcgcacagcagcccacagctgctgccgcttgattcttctacccccaattcctttggcgcaagcaagccgtgcacagagcccgtggtggctgccagcgcgaggccagcaggggacagtgtgaacaaggatagcatgaacgcaacatctacgcccgcagccctttcgcccagcgtcctgactacacccagcaagatagagcctatgaaagccttcgactcacgcttcaccgaacgctcgaaggctactcctggagctcctgcccttaccagtatgacaccaacggccgtcgaaagagatgtccatcggcaggtggtggtggtcaaagaggaatctctgcactcgattcttgctgggtccgatatgacagtatcgcagattctactgactcaacacggtatccctgtgatgaatctgtccgacggtaaagcatattgtttcaacccatctctgagcacttggaacctggtaagcgacaagcaggactcactggcccagtgcgcagacttcagaagctccctcccttcacaggacgcaatgctgtgtagcggccccctggcaatcatacaaggcagaacttcgaattccggaaggcaggccgccagactttttagcgtgcctcacgtcgtccagcaggagactaccctcgcttacctcgaaaatcaggttgccgcagctcttacactgcagtcgtcccatgaataccgccattggctgcttgtgtatgccagatatctggtgaatgagggctttgagtaccgtctcagggaaatttgcaaggatctactaggccctgtgcattacagcacaggatcccaatgggagtccactgtcgtgggcctccgcaaacgggaactgcttaaagaactactgcctgtcatcggccagaatctcaggttccaaaggttattcacagaatgccaggaacagttagatatcctgagagataagtag

SEQ ID NO: 190699 - DNA, 1815 bp, Artificial Sequence
  Description of Artificial Sequence: Synthetic coding sequence
atgctgagcagccacagcagcccccagctgctgcccctggacagcagcaccccaaacagcttcggagcttccaagccatgtaccgagcctgttgtcgctgctagcgcccgcccagccggggacagcgtcaataaagattccatgaacgcaaccagcactcccgctgcgctgagtccctctgtactcaccaccccatctaagattgaacccatgaaagctttcgacagcagattcacggagaggtccaaagccacacccggcgcacccgctctgactagcatgaccccaacagccgtagaaaggctgaaggagcagaatctagtgaaggagttgcgtccgcgtgatctgctggagtcctcatcggattctgatgaaaaggttcctctggctaaagcctcatctctgtctaagcgaaaactagagcttgaggtggagacagtggagaagaagaagaagggccgacccaggaaggattcgagattgatgccagtctcactgagcgtgcaatcccctgccgctctcaccgccgagaaggaggcgatgtgcttgtctgcacccgcactagccctcaagctgccaatcccttcaccccagcgggcttttaccctccaggtcagcagcgaccctagcatgtacatagaggtcgaaaacgaggttaccgtggttggcggagtgaagctctcccgactgaaatgcaaccgtgagggcaaggagtgggagactgtcctgactagccgcatcttgactgctgcgggctcctgtgatgttgtctgtgtcgcttgcgaaaaacgcatgttatcggttttctccacctgcggccgccggctgctgtctccgatacttttgcccagcccaatttcaaccctacattgtacaggaagttacgtgatggcccttacggcggctgcaaccctaagtgtgtgggacgtccatcggcaggtggtggtcgtgaaagaggagagtctccacagcattctggctggctctgacatgacggtaagccagatcttgctcacacaacacggcattcctgtcatgaacctctcggacggtaaggcatactgtttcaatccaagcctttccacatggaatctggtgagcgataaacaggacagtctcgcccaatgcgccgattttcgcagtagtttgccctcccaggacgccatgctgtgttcaggacccctggcgataatccaggggagaactagtaacagcggtcgtcaagctgcccgccttttctctgtaccccacgtggtgcagcaggagacgaccctggcatacctagaaaaccaggtcgcggcagccctgacactccaatcaagccacgagtatcgacattggctgctggtgtacgctcgttacctcgtcaacgaggggtcagccgaggagggggcagccgaaggggcggccacctctcatcgggccgagccaccgattcccgcccctttgcacagggtcagcggcaccgctaggcaccccgaagggcaggtcgcctgcccgagcttgccctggctgcaacaaggtcaggggcacacactcgcggccgacgatatgcaggaccgcctctccccagaccaggcagtggggggaggcgatacagggagaaggtgtgctgtgctacaccagagacagccttcgtcactcggaagatgtgcgttatgccctgggtctgatatcgctagcggagggggttcttctagtcttcctccctcccctcgctgcggcgcccgcgccggagcactacctcggtgccccggggcctcaaaggcagtgccagggctgcccagtcctgctcgccctcaaggcggacactag

SEQ ID NO: 190700 - DNA, 2922 bp, Artificial Sequence
  Description of Artificial Sequence: Synthetic coding sequence
atgagccccgtgctgcaggaggacgacgagaaggacgagaacatccccaagatgctgtgccaaatggataatcatctagcctgtgtgaactgcgtccgatggagcaatagcgggatgtacctggctagtggaggagacgataagttaattatggtttggaagcgagcgacctacatcggcccatctactgttttcggaagttcaggtaaacttgcaaatgtcgagcagtggagatgcgtgtccattctgagaaatcacagcggggacgtgatggacgtggcctggtctcctcacgacgcgtggttggccagctgctcggtggataataccgtggttatatggaacgctgttaaatttcctgagatcctagctactctcaggggccattcaggtctggtgaaaggtctaacctgggatcccgtgggcaaatatatcgcctcccaggcagacgaccgcagcctgaaggtatggcggactctggactggcagttagaaacctccattacaaaaccgtttgacgagtgcgggggaactacccacgtcttgcgcctgagctggtcccccgacggacattacttagtgtccgctcacgcaatgaacaactctggccccactgcacagatcatagagcgcgagggctggaaaactaatatggactttgtgggacaccgcaaggccgtgacagtcgtcaaattcaaccccaagattttcaagaaaaagcaaaagaatggttcatccgctaaacctagttgcccctactgctgttgcgcggttggcagcaaggacaggagcctgagcgtatggcttacgtgtctgaaaaggcctctggtggtgatccacgagttgttcgataagtcaattatggacatttcttggaccctaaacggcctagggatccttgtatgcagtatggacggttcggtggcatttctggatttctcccaggatgagctaggtgatcctctgagcgaagaggagaagagccgcatccaccagtccacttatgggaaatcattggctattatgaccgaggcccaattgagcactgcagttatagaaaacccagaaatgctgaagtatcagagacgtcagcaacaacagcaacttgatcagaagagtgctgccacccgagagatgggaagcgcaacatccgtggccggcgtcgtaaacggggaatctctcgaggatatccggaagaacttgctgaagaagcaagtggagacacgaaccgccgacggcagaagacgcataactccgctgtgcattgcccagctcgatacaggagacttctctaccgctttttttaatagcatccccctgagcggctccctcgcggggactatgttgagctctcactcatccccccaacttttacccctggactcctcgacacccaattccttcggcgcttcaaagccatgcacagaacccgtcgtcgccgcatcagccaggccagcaggcgactcagtgaataaagattccatgaacgccacaagcactccagccgcactctcaccgagtgtcctgaccactccttccaaaatcgaaccaatgaaggcctttgacagccgatttaccgagcgttctaaagccacaccaggcgcaccagctctgacatcaatgactcccaccgctgtggagcggctgaaagaacagaacctggtaaaggaactccgccctcgagaccttctcgagtccagctctgactccgacgaaaaagtgcctcttgccaaagccagctccctgtccaaacgcaagctcgaattagaagtggaaacggtagagaagaaaaaaaagggacgccctaggaaggattcacggctcatgcctgtaagcctgtctgtacagagccctgcagccctgacagccgaaaaggaggccatgtgtctgtcagccccagcgctagcacttaaactgcccattccaagccctcagagagcttttacgttgcaagtgagctccgatccaagtatgtacattgaggtggaaaacgaagtgacagtggtaggcggggtgaagcttagcaggctgaagtgtaatagggagggaaaagagtgggagactgtactcacaagccgaatcttgaccgcagccggttcttgtgatgtggtgtgtgtggcctgcgaaaaaagaatgttgtccgttttttctacctgcggccgccgtctgcttagcccaatactcctgccctcacccatatccaccttgcattgtaccgggtcgtatgtaatggccttaacggcggcagctacgctgtccgtgtgggatgttcacaggcaggtggtggtggttaaagaggagtctttgcatagtatcctcgcaggttcggacatgaccgtttcacagattctgcttacgcaacatggaatcccagtgatgaacctcagcgatgggaaggcctactgttttaacccctccctgagcacatggaacctggtgagcgataagcaagactcacttgcccagtgtgctgatttcagatcctctctgccatcacaggatgcgatgttgtgcagtgggccattggccatcatccagggccgcacatctaatagtggccggcaggctgccagactgtttagtgtgcctcatgtagtgcaacaggagactaccctggcctacctggagaaccaagtcgctgccgccctgaccctccaatcatcccacgaatatcgtcattggctactggtgtatgcgaggtatctggtgaacgaggggttcgagtacagactaagagagatatgtaaagatttattgggccctgtgcactacagtacaggctctcagtgggagtccaccgtggtgggtctgagaaaaagagagctgcttaaagaactgttacccgtgatagggcaaaacttgcgattccagcgactcttcacagagtgccaggagcagctagatatactgagagacaagtag

SEQ ID NO: 190701 - DNA, 2421 bp, Artificial Sequence
  Description of Artificial Sequence: Synthetic coding sequence
atgagccccgtgctgcaggaggacgacgagaaggacgagaacatcccaaagatgctctgtcagatggataaccacctcgcgtgtgtgaattgtgttaggtggtccaattcaggcatgtacctggcatccggcggtgatgataaactgatcatggtgtggaagagggccacctatatcggacctagtaccgtctttggctcatccggtaaactggctaacgttgagcagtggagatgtgtaagcattttgcgcaatcactctggcgatgtcatggacgttgcctggagcccgcatgatgcgtggttggccagttgctctgtcgataacaccgtcgttatctggaacgccgtgaaattcccagagatcttggcaacgctgcgcggtcactccggtctcgtcaaggggttgacatgggatccagtcggaaagtatatcgcatcacaggcagatgaccgctcacttaaagtttggcggaccctggactggcagttggaaacaagtattactaagcccttcgacgagtgcggggggacaactcatgtcctgcgcctatcctggtcccctgacggacattatttagttagcgcccatgctatgaataacagtggcccaacagcgcagataatcgaacgggagggctggaaaaccaacatggactttgtcgggcatagaaaagcggtgaccgtggttaaattcaatcctaagatcttcaagaaaaagcagaaaaatggttcttcagctaaaccaagttgcccctactgttgttgcgccgtgggaagcaaagacaggtcccttagtgtctggttaacatgcttgaaacggcccctagtggtcatccacgagctgtttgataaatccataatggatatttcttggacactcaacggactgggcattctcgtttgcagcatggacggcagtgttgcgtttctcgatttctctcaggatgagcttggtgacccactctcggaagaagaaaaaagcagaatacaccagtctacctatgggaaatccctagccataatgacagaggcgcagctgagcacagccgttatagaaaaccccgaaatgctgaaataccaaaggcgccagcagcagcagcagttagatcagaaaagcgcggccaccagagaaatggggagtgcaacgtctgtcgccggagttgtgaacggcgagtctcttgaggatataaggaagaacctcctgaagaaacaggtggagacaaggaccgccgacggtaggcgtagaatcaccccgctgtgtatcgcccagcttgacaccggcgacttcagcaccgcatttttcaactccataccattgtccggcagtctcgctggcacaatgcttagctcccatagttctccgcagttattgccactggattcgtccactcccaacagctttggggcgagcaagccctgcacggagcctgtggtagcagcctctgcgcgccccgccggggattccgtgaataaggacagcatgaatgccacaagcaccccggccgctctatcccccagcgttctgacaaccccttccaaaattgaacctatgaaagcttttgactcacgcttcaccgaaagatcaaaggctacccctggagctccagctctcactagtatgacacctactgcagtcgagcgtctcaaagaacaaaatctcgtgaaggaactgaggccccgcgaccttcttgaatccagcagcgattcagacgagaaagtgcccctcgcaaaagccagctcactgtccaaacggaagctggagcttgaagttgagaccgtcgaaaagaagaaaaagggacgaccacggaaagatagcagactgatgcctgtgtccttatcagtccaatctccagctgcactgaccgccgaaaaggaggcaatgtgtctgagcgcaccggccctcgcgttgaagctccctatcccctctccacagagggccttcacacttcaggtgtccagcgatccctccatgtacattgaggtcgaaaatgaggtcacggtggtcggcggcgtgaagctcagcaggctgaagtgtaatcgggaaggcaaggaatgggaaacagtgctcactagtcgcattctcactgctgccggctcttgcgacgtggtatgcgttgcctgcgaaaagcggatgttatcagtgttcagcacttgtgggcggcgattgcttagtcccattctgctgccctccccgatctccacattgcactgcacagggtcttacgtgatggcccttaccgcagctgctacactgagcgtgtgggacgtgcatagacaggtggtggttgtcaaagaagagagtcttcactctatactcgccgggacttggtttctaaccagtcgaacgcattggctgtccgtccagacactgggagccgcatgtcacccgagaactccttgttgcgcccaagatcgctag

SEQ ID NO: 190702 - DNA, 156 bp, Artificial Sequence
  Description of Artificial Sequence: Synthetic coding sequence
atggccagcagcatgcggagcctgttcagcgaccacggcaagtacgtggagtcattcaggcgcttccttaaccattcaacagaacaccagtgtatgcaggaattcatggacaaaaagctacccggtatcattggcagataccagaactgctgctag

SEQ ID NO: 190703 - DNA, 879 bp, Artificial Sequence
  Description of Artificial Sequence: Synthetic coding sequence
atggccagcagcatgcggagcctgttcagcgaccacggcaagtacgtggaatctttccgcaggttcctgaatcactcgactgagcatcagtgtatgcaggagtttatggacaagaagttgcccggtatcattggcagaattggcgataccaagtcagaaattaagattctcagcatcggtggcggcgctggcgaaatcgatctacaaatcctcagcaaggtgcaggctcagtaccctggggtgtgtatcaacaacgaagtggttgagcctagcgctgaacagatcgccaaatataaagaactggttgccaagaccagcaacctagagaatgtgaagtttgcctggcataaggaaaccagctctgagtatcaatcccgcatgcttgaaaagaaggagcttcagaaatgggactttatccacatgatccagatgctttactacgtgaaagacatacccgcaactctgaagttctttcatagcctcctcggcaccaacgcaaaaatgctgattattgtggtaagtggtagctcggggtgggataagctgtggaaaaagtacggctccagatttccacaggacgacctctgccaatacattacctccgatgacctgacccagatgctggacaacctgggcctgaagtatgaatgttacgatctgctgtcaactatggatatctctgattgtttcatcgatggaaacgagaatggggatcttctgtgggactttctgacagaaacctgtaacttcaacgccacagcaccaccagacctgcgggctgagctgggcaaagatttgcaggaacctgagttctccgcgaaaaaggagggcaaagtactgtttaacaacacgctttcatttatcgtcatcgaagcgtag

SEQ ID NO: 190704 - DNA, 381 bp, Artificial Sequence
  Description of Artificial Sequence: Synthetic coding sequence
atggccagcagcatgcggagcctgttcagcgaccacggcaagtacgtcgaaagcttcaggagattcctgaatcacagcaccgaacatcaatgcatgcaagagtttatggataagaagctccccgggatcattgggcgtatcggcgatacaaaatccgagatcaagatactttcaattggaggaggtgcagactgtctgatacgcggaagctcccgcgtgctgaaacggaattcatgcttcatactttgttccactcgtcaaaaggataaaccaggaatgaggatccacgacgagcgcagttcggaactgcccttcggtgctgcgaggcttgaatctaagtcggcgtttccttcatttttggtgtctttcattctcttctag

SEQ ID NO: 190705 - DNA, 879 bp, Artificial Sequence
  Description of Artificial Sequence: Synthetic coding sequence
atggccagcagcatgcggagcctgttcagcgaccacggcaagtacgtcgagagcttccgccggttcttgaaccattccacagaacatcagtgcatgcaggagttcatggataagaaattgccagggatcattggccgcatcggcgatactaagagcgaaatcaaaattctgtctattggaggaggagcgggagagatcgacctgcagatcctgagcaaggtacaggcacagtaccccggtgtgtgcatcaacaacgaggtcgtggagccttctgctgaacagattgctaagtataaggaacttgtagctaagaccagcaatctggaaaatgtgaagtttgcatggcacaaggagaccagcagcgagtaccagagccgtatgctggagaagaaagagctgcagaagtgggattttatccacatgattcagatgctttattacgtcaaggatatcccggctacactgaagttctttcactcgttgttaggaacgaatgccaaaatgcttattatcgttgtctccggttctagcgggtgggacaaactttggaaaaaatacggatcacgatttccccaagatgacctgtgtcagtacatcacaagcgatgacttgacccagatgctagacaatctcggactcaagtatgaatgctatgatctgctctccacaatggacatctccgactgttttattgatggtaatgagaatggggacctcctgtgggactttttgactgagacatgtaactttaatgctacagccccccctgatcttagagccgagcttggaaaagacctgcaagagccggaattctccgccaagaaagaaggcaaggtcctctttaataacactctctctttcatagtcatcgaggcctag

SEQ ID NO: 190706 - DNA, 1464 bp, Artificial Sequence
  Description of Artificial Sequence: Synthetic coding sequence
atgagcctgcccaacagcagctgcctgctggaggacaagatgtgcgagggcaataagactaccatggcttccccgcagctcatgcccctggtggtcgtcctgagcacaatctgtcttgtcaccgtggggctcaatctccttgtgctgtacgccgtgcggagcgaacgcaagcttcacactgtgggaaatctttacatagtgtctttatccgtggcagatctcattgtcggtgccgtagtaatgccaatgaacatcctgtacctactgatgagtaagtggtcccttggtcggccattgtgcctgttctggctgtctatggattacgtcgcttctacagcatccattttctccgtgttcattttatgtattgaccgatatcgaagtgtgcagcagccattgaggtatctgaagtacaggacaaagacccgggcctccgcgactatactgggggcttggtttttgtcgtttttgtgggttatcccaatccttggatggaatcattttatgcagcaaaccagcgtccgaagagaggataagtgtgaaacagacttttacgatgtcacttggttcaaggtcatgaccgctatcatcaatttctatctgccgacactcttaatgctttggttctacgccaagatctacaaagcagtgcgacagcactgccagcatagggagctcatcaataggagtctccccagcttttccgaaataaaacttcggcccgagaatccaaagggcgacgcgaaaaagccaggcaaagagtcgccgtgggaagtcctgaagcgcaagcctaaggatgccggaggggggagtgtgctaaagtcaccatcccaaacgcccaaggaaatgaaaagtcctgtcgtgttcagccaggaggacgaccgcgaggtagacaaactctattgtttccctttggatatagtgcacatgcaggccgcagctgaaggaagtagtcgcgattacgtagccgtgaatcgatcgcatggacaactgaagacggatgagcagggtctcaatacccacggtgcctccgaaattagtgaggaccagatgctgggagatagccagtctttctctcgcaccgattccgacaccaccaccgaaacggcccccggaaaaggcaagctgagaagcggttccaatacagggctcgactatatcaagtttacatggaagcggctgcggtcacacagccggcagtacgtgtctggactacacatgaatagggagcgaaaggccgcaaagcagctgggctttatcatggccgcatttatactgtgctggataccgtactttatattttttatggtgattgccttttgcaagaactgttgcaacgagcatctgcacatgttcaccatctggctgggctacattaactcgaccctgaacccactaatctatcccctctgtaatgagaactttaagaagacctttaagcgaatcctgcacataagatcttag

SEQ ID NO: 190707 - DNA, 39 bp, Artificial Sequence; identical to SEQ ID NO: 84513
  Description of Artificial Sequence: Synthetic coding sequence

SEQ ID NO: 190708 - DNA, 1464 bp, Artificial Sequence
  Description of Artificial Sequence: Synthetic coding sequence
atgagcctgcccaacagcagctgcctgctggaggacaagatgtgcgaagggaataaaacaactatggctagcccgcagttaatgcccctcgtggtggtcctgagcaccatctgtctcgttactgttgggctgaatttgctggtgctgtacgctgtaaggtctgaacggaaactgcacaccgtcgggaacctgtacatagtctcacttagcgtggcagacctgatagttggcgctgttgtgatgccaatgaacattctgtatctgttgatgagcaagtggtcactcggtcgtcctctctgcttgttttggctgtcaatggattatgtggctagcaccgcttcaatattctcagtgttcatcttatgtatcgacagataccgctctgtgcagcagccgctccgttacctcaagtacagaaccaagacacgtgcgtcagcaactattcttggtgcatggttcctgtccttcctgtgggtgatcccaattctcggctggaaccacttcatgcagcagacgagcgtaagaagagaagacaagtgtgagaccgatttttacgacgtgacatggttcaaggtaatgactgccattatcaatttctacctgcccacattgctcatgctttggttctatgctaagatttataaggctgtgcgtcagcattgccagcacagggaactaatcaacagatctctgccctcattttcggagattaagctgcggccggaaaatcccaagggagatgctaaaaagcctggtaaagaaagcccttgggaagttctcaagagaaagccaaaagacgccggtggagggtccgttctgaaaagtccttcccaaaccccgaaggagatgaaaagtcctgtagtctttagtcaggaggacgatcgggaggttgacaagttatattgctttccccttgatatcgttcatatgcaagcagccgccgaaggatcatcacgtgactatgttgccgttaataggagtcacggtcagctgaaaactgacgaacagggactgaatacccacggagcttctgaaatttctgaggaccagatgctcggcgacagccagagtttttctcggacagacagcgacaccacaactgagactgctccggggaaaggtaaactccgctccgggagcaataccgggttagattatattaaatttacctggaagcggttgcgcagccacagccgccaatacgtgagtggactacacatgaaccgcgaacgcaaggccgcaaagcagcttggctttatcatggccgcgttcatcctgtgctggattccctactttatattctttatggttatagctttctgcaagaactgctgcaatgaacacttgcacatgtttaccatctggctgggctatataaatagcacactcaatcccctcatctatcccctctgtaatgaaaatttcaagaagacctttaagcgcatcctgcatatcagaagctag

SEQ ID NO: 190709 - DNA, 1464 bp, Artificial Sequence
  Description of Artificial Sequence: Synthetic coding sequence
atgagcctgcccaacagcagctgcctgctggaggacaagatgtgcgaaggcaacaaaaccaccatggcctccccgcagctcatgccccttgttgttgtgttatccacaatctgtcttgtgactgttgggcttaatttgctcgtgttgtacgccgtgagatcagaaagaaagctgcatacagtgggtaacctgtatattgtgagcctttctgtagccgatctaatagtcggcgccgtcgtgatgccgatgaatattctctatttactgatgtccaaatggtctctcggtcgccccctttgcttgttctggctgagtatggattacgtggcgagtacagcaagtattttctccgtgttcatcttatgcattgatcgctacaggagtgtgcagcaaccacttaggtacttgaagtaccgaacaaaaactcgggcgagcgccaccatcctgggggcatggttcctgtcattcctgtgggtgataccaatccttggctggaatcatttcatgcagcagaccagtgtgagaagagaagacaagtgcgaaaccgatttctatgacgttacctggtttaaggtcatgactgccatcataaatttttaccttccaacacttctgatgttatggttttatgctaaaatttataaggccgtcagacagcattgtcagcaccgcgaactcattaacagatcgctgccatccttctcagagatcaagctcaggccggaaaatcccaagggcgatgccaaaaagcctgggaaggagagcccctgggaggtgttaaagaggaagccaaaggacgcaggcggcggttcggttttaaagtctccttcgcagactccaaaggagatgaaaagccccgtggtgttcagccaagaagatgatcgtgaagtagataagttatattgctttccgctggatatcgtgcatatgcaagctgcagcagaggggagtagtcgtgactatgtcgctgtcaaccgctcacacgggcagctcaagactgatgagcagggcttgaacacacatggggcaagcgaaatttccgaggaccagatgctgggagacagtcagtcgttttctagaaccgacagtgacaccactacagaaacggcccccggtaagggtaaactgagaagcggatcaaatactgggctcgactatatcaagttcacctggaaacggttacgatcccacagccggcagtatgtatctgggctgcacatgaaccgcgagagaaaagccgcaaaacaattgggattcatcatggccgctttcattctgtgttggattccctacttcatcttctttatggtgatcgcattctgtaaaaactgctgcaacgaacaccttcatatgtttacaatatggctcggatacattaacagcaccttgaatccactaatataccccctttgcaatgagaacttcaagaaaacctttaagcgcattcttcacattcgcagttag

SEQ ID NO: 190710 - DNA, 816 bp, Artificial Sequence
  Description of Artificial Sequence: Synthetic coding sequence
atggccgccccccaggacgtgcacgtgcggatctgcaaccaggagatcgtcaaattcgatctcgaggtcaaggctttgattcaggacattcgagactgtagtggccctctgagtgccctgaccgaactcaacaccaaggtgaaggagaaatttcagcagctccggcacaggattcagcctgtgctttaccagcgcgcgttcatctggacagcttccacattttttttcaaacttacgtattctctgacagacttttctagtactcaacatgacttcaatagcccaaccacaccagttactttctctgatctggagcaactagcaaaagaacaggacaaggagtctgaaaaacaattgctgctccaggaagttgaaaaccacaaaaagcagatgcttagcaatcaggcttcttggagaaaggccaacctgacctgcaaaatagctattgacaacttggaaaaggccgagctgctgcaaggaggggacttactaagacagcggaaaactaccaaggaaagtctcgctcagacctcttctacgataactgagtccctcatgggaatcagtagaatgatggcgcagcaggtacagcagtctgaggaagcaatgcagtcactggtcacatcctcccggactatcctagacgctaatgaggagtttaagagcatgtcaggaaccattcagctcggcagaaagctgataaccaaatacaatagacgtgagttaactgataagcttctgattttcctggcactggctctcttccttgccactgtgttgtatatcgtaaaaaagaggttgttcccatttctctag

SEQ ID NO: 190711 - DNA, 1194 bp, Artificial Sequence
  Description of Artificial Sequence: Synthetic coding sequence
atggcccccaacggcaccgccagcagcttctgcctggacagcaccgcttgtaagataaccatcaccgtggtgctggctgtcctgatccttatcacagtggcaggcaacgtggtggtttgtctggcagtgggcctgaatcgcagattgcggaacctaaccaactgcttcatcgtatcactggccatcactgacctcctgctggggctgctggtgcttccttttagcgccatctatcagctcagttgcaaatggtctttcggcaaagtgttctgtaacatttacaccagtttggatgtgatgctttgtaccgcgtccattctcaacctgtttatgatttccctggatagatactgtgctgtcatggatcctttgcgataccccgtactagtgacccctgtgcgcgtggccatatcccttgtgctcatctgggtaattagcatcaccctgtcctttttgtctattcatttgggctggaacagcaggaacgagacaagtaaaggcaatcataccacttccaaatgcaaagtgcaagtgaatgaggtttatggcctggtggatggtctggttactttttatttacccctgttgatcatgtgcatcacatactacaggatcttcaaagtcgctcgtgaccaagccaagcggatcaatcacatctccagctggaaagctgcaacaatcagggaacataaggccacggtcactttagccgctgtgatgggcgccttcatcatctgttggtttccgtatttcaccgcgttcgtgtatcgcgggctccgcggggatgacgccataaatgaggtgctggaagcaattgtgctgtggctggggtatgccaattccgcactgaacccaattctctatgccgccctcaatcgcgactttaggaccggctatcaacaacttttctgttgtcggttagccaacaggaattctcataagacttctctaaggtctaatgcatcacagctctccagaactcagagccgcgagccccgacagcaggaagaaaagccacttaaacttcaggtatggtcaggtacagaggtcacagcaccacagggcgcgactgaccggccatggctgtgtttaccagaatgctggtccgtagagctcacgcactcctttatccacctttttattcattccttcgctaacatacaccccatcccaacaacctgtcaggagctgtag

SEQ ID NO: 190712 - DNA, 1173 bp, Artificial Sequence
  Description of Artificial Sequence: Synthetic coding sequence
atgcccgacaccaacagcaccatcaacctgagcctgagcacccgggtgaccttggcatttttcatgagcttagtggcttttgcgattatgctcggaaacgcacttgtcatccttgcctttgtggtggataagaacctcagacatcgatcaagctatttcttccttaacttggctatttcggactttttcgtcggtgttatctccatcccactctacataccgcacacactgtttgaatgggatttcgggaaagagatctgtgtgttctggctgacaacggattatctcctctgcacagcaagcgtctacaatatcgtgctgattagttatgatagatacctgtcagtaagcaacgctgtgtcttatcgaacgcaacacacgggagtactgaagatcgtgacactaatggtggctgtgtgggtcttagctttcttagtgaacggccctatgatcttagtaagcgagtcgtggaaagacgaagggtctgagtgtgaacctggcttctttagcgagtggtatattctggccatcacctctttcctagaatttgtgatccccgtgatcctggttgcatatttcaatatgaacatttattggtcactttggaagagggatcacctgagtcgctgtcagagccatcccggtctgacagctgtaagcagcaatatttgtggtcattccttcaggggacggctcagtagtcggcgaagcctgagtgccagcactgaggtgcctgcatctttccacagtgagcgccagagacggaagagctctctcatgttctcctcgcggactaaaatgaattctaacacaatcgccagtaagatgggctcctttagccagtcagatagcgttgcactgcaccagcgggagcacgtcgaactattgcgtgctcggaggctggccaagagcctggccattttgcttggagtcttcgccgtctgttgggccccctactctctgtttaccattgtacttagcttctattcatcggccaccggccccaagagcgtgtggtatcgtatagcgttctggctccagtggttcaatagctttgttaaccccctgctgtaccctctttgccacaaaagatttcagaaggctttcctcaagatcttctgtattaaaaagcagcctctcccttcccagcactcccggtcggtgtcctcttag

SEQ ID NO: 190713 - DNA, 909 bp, Artificial Sequence
  Description of Artificial Sequence: Synthetic coding sequence
atgcccgacaccaacagcaccatcaacctgagcctgagcacccgggtcactctcgcctttttcatgagcctggtcgcatttgctattatgctggggaacgccctcgtgatcctggcctttgtagtggacaaaaatctcagacatagatcctcgtatttttttctgaacttggctatctcagactttttcgtcgtgtctgagtcttggaaagacgaggggtctgaatgcgagcccggcttttttagcgaatggtacattctggccatcacatctttcctggagtttgtgatccccgtgatcctcgtggcttactttaatatgaatatctattggagtttatggaaacgggatcacttgtcaaggtgccagtcgcaccccgggctgacggcggtgagctctaacatttgcggacattcttttcggggcaggctctctagccggcggtccctgagcgcttctactgaggtgcctgctagtttccacagcgaaagacagaggagaaagtcgtccctgatgttctcatcaaggacaaagatgaacagtaataccatcgcatccaagatggggtccttcagccaatctgactccgtggccctgcaccagagggaacatgtggagctgttgcgcgcacggcggctggcgaaaagtttggcgattttactcggcgtatttgccgtatgctgggcaccctacagcctgttcaccatcgttctgtcattctactccagcgccaccgggccaaaatccgtgtggtaccgaatagcattttggctgcagtggtttaatagttttgttaatcctttactgtatcccctgtgtcataagcggtttcagaaagcctttctgaagatcttttgtatcaagaagcagcctcttccatctcagcacagccgttccgtgtcaagctag

SEQ ID NO: 190714 - DNA, 174 bp, Artificial Sequence
  Description of Artificial Sequence: Synthetic coding sequence
atgaagttcttcgtgttcgccctggtgctggccctgatgatcagcatgattagtgcagatagccatgagaaaagacaccacgggtatcgccggaagtttcacgagaagcatcacagccatcgagagtttcctttttacggcgactatgggtcgaactacctctatgataactag

SEQ ID NO: 190715 - DNA, 174 bp, Artificial Sequence
  Description of Artificial Sequence: Synthetic coding sequence
atgaagttcttcgtgttcgccctggtgctggccctgatgatcagcatgatctcagccgacagccatgagaaacggcatcacggttaccgccgcaagtttcacgaaaaacaccactcccatagggaatttcctttctatggagactatggctcaaactatctgtatgataattag

SEQ ID NO: 190716 - DNA, 156 bp, Artificial Sequence
  Description of Artificial Sequence: Synthetic coding sequence
atgaagttcttcgtgttcgccctgatcctggccctgatgctgagcatgactggagccgatagtcacgcaaagcgtcaccacggatacaaacgcaagttccatgagaagcaccactcccatcgtggctaccggagtaattatctgtatgataactag

SEQ ID NO: 190717 - DNA, 156 bp, Artificial Sequence
  Description of Artificial Sequence: Synthetic coding sequence
atgaagttcttcgtgttcgccctgatcctggccctgatgctgagcatgacaggagccgatagccacgctaagaggcaccatggctataaaaggaaattccacgagaaacaccatagtcacagaggctatcgcagcaattacctgtacgacaactag

SEQ ID NO: 190718 - DNA, 1989 bp, Artificial Sequence
  Description of Artificial Sequence: Synthetic coding sequence
atgatggagcccgaggagtaccgggagcggggccgggagatggtggactacatctgtcaatatttgtctaccgtgagagagcggcgagtgacccccgacgtgcagcctggatacctcagagcacagctacctgaatctgcgcccgaggatccagacagttgggacagtatcttcggtgatatcgaaaggattatcatgcccggcgtggttcactggcaaagccctcacatgcacgcttattaccccgccctgacgtcatggcctagcttgctgggagacatgctggcagatgccattaactgcctcggatttacctgggcaagttcacctgcctgcaccgagctggaaatgaatgtgatggactggctcgcaaaaatgctcggactcccggagcactttctccaccatcacccaagtagccagggtggaggagtgctacagagcactgtttctgaatcgactcttatcgcactgctcgccgctcgaaagaacaaaattctagaaatgaagacatcagagcctgatgcagatgaaagctgtttaaatgcccggctggttgcctatgcttctgatcaagctcacagcagcgtggagaaagcgggtttgatcagcctggtcaagatgaagtttttgccagtagacgacaacttttccctgaggggcgaggccttgcaaaaagccatcgaagaagacaaacagagggggctggtcccggtcttcgtctgtgctactctagggactacgggtgtctgcgcgtttgattgcctttccgagctcgggcccatatgcgcacgtgaggggctctggctgcacatcgatgctgcgtacgcaggcactgcatttctctgtcctgagttccgggggttccttaaaggcatagagtacgccgatagtttcacatttaatcccagcaagtggatgatggtacacttcgactgcaccggcttctgggtgaaagataagtacaaactccagcaaaccttttccgtgaatcccatttatctgcgacatgccaactcaggagtggctaccgacttcatgcattggcagatcccacttagtagacggtttaggtccgtgaagctctggttcgtgattcgctcctttggtgtaaagaatctgcaggctcacgtgagacatgggaccgaaatggctaaatatttcgagtcacttgtaagaaatgatccctctttcgagattcctgctaagcgccacttgggcttagttgtttttcggctgaagggacctaattgtctgacagagaacgtgctgaaagagatcgccaaagctggtcggctgttccttatccctgccaccattcaagacaaactgatcatccgctttacagtgacttctcagtttaccacgcgggatgacatactgcgtgattggaatctgattagagatgctgccaccttgatcctaagtcagcactgcacgagccaaccgtcaccgcgtgtcgggaatctgatttcccagatacgaggcgcacgggcttgggcttgtggaacctcgcttcagagcgtgagcggggctggcgacgatcccgtacaagctcggaagatcatcaagcagccccagagggtcggagctggaccgatgaagagggagaatgggctgcatctggagaccctgctggatcccgtggatgactgcttctccgaggaagcacctgacgctaccaagcacaaactgtctagctttctctttagctaccttagtgtccagaccaaaaagaagacagtaagaagcctgtcatgtaattcagttccagtctctgctcagaaaccactgcccactgaggcgtcagtgaagaatggaggctcttcacgagtccgaatctttagccgattccctgaagatatgatgatgctgaagaagtctgctttcaaaaagctgattaagttctactctgtgccgtccttccctgaatgctccagccaatgcggacttcagctgccttgctgtcccttgcaggccatggtttag

SEQ ID NO: 190719 - DNA, 2100 bp, Artificial Sequence
  Description of Artificial Sequence: Synthetic coding sequence
atgggccaccaccggccctggctgcacgccagcgtgctgtgggccggggtggcgagcctgctgctaccccctgctatgacccaacaactacgaggcgatggactgggcttccggaaccggaacaattccaccggcgtggccggcctctcggaggaagcctccgccgagcttcgacaccatctgcactcgcctcgggaccaccccgacgagaacaaagacgtctccactgagaacgggcaccatttttggtcccaccccgaccgggaaaaagaagatgaggatgtgtctaaagaatacgggcacctgcttccagggcacaggagtcaggatcataaggtaggtgatgagggcgtttctggtgaggaagtgttcgccgagcacggtggccaagcccgaggacatcggggccacggtagtgaagacaccgaggactccgcagagcatcgccaccatttgccgtctcacagaagccactcccatcaggatgaggatgaggatgaggtggtcagctctgagcatcaccaccacatcctgaggcacggccacaggggtcacgacggcgaggacgatgaaggcgaggaggaggaggaggaggaagaggaggaggaggaggcctcaacagagtacggtcatcaggcacatagacaccgcggtcacggcagcgaggaagatgaggatgtgtcagacggacatcaccaccacggacctagccaccggcaccagggccacgaagaagacgacgacgatgacgacgatgacgacgacgatgacgatgatgacgacgtctccatcgaatacaggcaccaggcacaccgccatcagggccacggtatcgaagaagacgaggacgtcagtgacggccaccaccatagagatccctctcatcgccatagatctcacgaggaagatgacaatgatgacgacgacgtgtcaaccgagtatggccaccaagcacaccggcatcaggaccaccggaaggaggaagttgaggcagtgtcgggggaacaccatcatcacgtcccagaccaccgacaccaaggtcatcgagacgaagaggaagacgaggacgtctcaaccgaacggtggcaccaggggccccagcatgtccatcacggactggtggacgaggaagaggaagaagaagagattaccgtgcagtttggacactacgtcgcatcccatcagccacgaggacacaagtctgacgaagaagattttcaggatgagtataagacagaggtgccgcaccaccaccaccaccgagtccctagagaagaagacgaggaagtgtccgctgagctggggcatcaagctccctcccatcggcagagccatcaagacgaggagactgggcacgggcagcgcggctctattaaagagatgtcccaccaccctccaggccacactgtggtcaaggacagaagtcatttgcgcaaggacgactctgaggaagaaaaagagaaagaagaggaccccggcagccatgaagaggacgatgagagctcagagcagggggagaagggtacccatcacggatcccgggatcaagaggatgaagaggacgaggaagaaggccatggattgagcttgaaccaggaagaggaggaagaggaagataaagaagaggaggaggaagaggaggacgaggaacgacgggaagagagagccgaagtgggggcccctctgtctccagaccattccgaggaggaggaagaagaagaggaaggcttggaggaagacgaaccccggttcacaattatccccaacccactcgatagacgggaagaagccgggggcgcatcgagtgaggaggagagcggtgaagatactggaccccaggacgcccaggagtatgggaactatcaacccggctccctctgtgggtattgttcattctgcaacaggtgtaccgagtgtgagagttgccattgcgacgaagagaacatgggcgaacactgcgatcagtgccagcattgccagttttgctacctgtgtcctctcgtttgcgagactgtgtgcgcccccgggagctacgttgattactttagcagcagcctgtaccaagccctggctgacatgctcgagacacctgagccatag

SEQ ID NO: 190720 - DNA, 1170 bp, Artificial Sequence
  Description of Artificial Sequence: Synthetic coding sequence
gaggacgacaacgacgacgacgacgtgagcaccgagtacggccaccaagcccacagacatcaagaccatagaaaagaggaggtggaagcagtgagcggggagcaccaccaccacgtcccagaccatcggcatcagggccaccgcgatgaggaggaggacgaggacgtgtccactgagcggtggcatcagggtcctcagcatgtgcatcacgggctggttgacgaagaagaggaggaggaagagattacagttcagttcggccactacgtcgcttcccaccaaccacgcgggcataagagtgatgaggaagactttcaggatgagtataaaactgaggtccctcaccatcaccatcacagggtgccacgcgaggaggatgaggaagtctcagctgaactcggacaccaggctcccagccatcggcagtctcaccaggacgaggagaccggccacggtcagcggggttcaattaaagagatgtcccaccaccctcctggccacacagtggtgaaggatagatctcatctgcgaaaggacgactccgaggaggagaaagagaaagaagaggatccggggtcgcacgaagaagacgatgaaagtagcgaacaaggggaaaaaggaactcatcatggatctcgcgaccaggaggatgaagaggacgaggaagaaggccacggacttagtctgaatcaggaggaggaagaggaggaggatgaggaaagaagagaggaaagggcagaggtgggagcgccccttagccctgatcacagcgaggaagaagaggaggaagaagaaggcctagaagaggacgagccaaggtttactatcatcccgaacccactggaccgaagggaagaagccggtggtgccagcagtgaggaagaatcaggcgaggacaccgggcctcaggatgctcaggaatatggcaattaccagcccggatctctctgcgggtactgctcgttctgcaaccgttgcactgaatgtgaatcgtgccattgcgatgaggagaatatgggtgaacactgtgaccaatgtcaacattgccagttctgctatctctgccccttggtgtgtgaaaccgtctgtgcccccgggagttacgtcgattacttcagcagctcactttaccaggcgctcgcggatatgcttgaaactcctgaaccatag

SEQ ID NO: 190721 - DNA, 1365 bp, Artificial Sequence
  Description of Artificial Sequence: Synthetic coding sequence
atgggccaccaccggccctggctgcacgccagcgtgctgtgggccggagtggccagcctgctgctgcctcctgcgatgactcagcagctgcggggtgacgggttgggttttagaaaccgcaacaaggatgtgtccacggaaaacgggcaccacttctggtcccatccggaccgtgaaaaggaggacgaggacgtgtccaaggaatatggccatcttctgccaggccatcgttcccaggaccataaggtgggagacgagggggttagtggggaagaggttttcgccgagcacgggggccaagcgagggggcaccgggggcacggtagcgaggatacagaagactctgctgagcacaggcatcatctgccatcccaccgctcacactcccaccaggatgaagacgaggacgaagtagtgtcgagtgaacaccaccatcatattctgcggcatggtcatcggggacatgatggcgaggatgacgagggcgaggaggaggaagaggaggaagaagaggaagaagaagcttccaccgaatacgggcaccaggcgcatcgtcaccgcggccacgggtccgaggaggatgaggatgtttccgacgggcaccaccaccacgggccaagccatcgccatcaagggcatgaggaggacgatgacgacgacgacgatgatgatgatgacgacgatgacgacgacgtcagcatcgagtaccgccaccaggcccatagacaccagggccacggaattgaggaggacgaagatgtgtccgacggacaccatcaccgggatccttcccaccgtcaccgatctcacgaagaggacgacaacgatgatgatgatgtgtctacagaatatgggcatcaggcccaccggcatcaggaccacaggaaggaggaggttgaagctgtgtccggcgagcaccatcatcatgtgccagatcaccgccatcagggacatcgggacgaggaagaggatgaggatgttagtaccgagaggtggcatcaggggccccagcacgtacatcatggcctcgtggatgaggaggaggaggaggaggagattacagtgcaattcggtcattatgtcgccagtcaccagcctaggggacacaaatccgatgaagaagattttcaggacgaatacaagaccgaggtgcctcaccatcatcaccaccgcgtcccaagagaagaggatgaagaggtgagcgcagaacttgggcatcaggctccctcgcacaggcagagtcaccaggatgaggagacgggccacggacagcgcggcagcatcaaggaaatgagtcatcatccccctggccataccgtggttaaggacagatcacatctgaggaaagatgatagtgaagaatag

SEQ ID NO: 190722 - DNA, 381 bp, Artificial Sequence
  Description of Artificial Sequence: Synthetic coding sequence
atggccgacgagatcgccaaggcccaggtggcccggcccggcggcgacaccattttcggcaaaatcattcggaaggagatcccagcaaaaataatcttcgaggatgataggtgtctggctttccacgatatttctccacaagcccccacccattttcttgtcatccccaagaagcacatctctcagatttccgtcgcagaagacgacgatgagtccctactgggacatctaatgatagtcggaaagaaatgcgctgcagatctgggcttgaataagggttataggatggttgtgaatgaaggcagcgatgggggccagagcgtttatcatgtgcaccttcacgtgttgggagggaggcaaatgcactggcctccgggctag

SEQ ID NO: 190723 - DNA, 492 bp, Artificial Sequence
  Description of Artificial Sequence: Synthetic coding sequence
atggccgccgccgtggtgctggccgccggcctgcgggccgcccggagggccgtggccgcaaccggtgttcggggaggtcaggtgaggggcgccgcaggagtcacagatggcaacgaagtagcaaaggcccaacaggccactcctggaggagctgcacctactattttcagtcgcatactggataagtcacttcctgccgatatcctctatgaagatcaacaatgtctggttttccgggacgtggctcctcaggctcccgtccactttttagtcatccccaaaaagcccatcccacgtatttcccaagcagaggaggaggatcagcagctcctcggccacctgttacttgtggccaagcaaacggccaaggccgaaggtctgggggacggataccgcctggtaatcaacgacgggaagctgggggcccaatctgtataccacctgcatatacatgtattaggcggcagacagctgcagtggccccccggttag

SEQ ID NO: 190724 - DNA, 615 bp, Artificial Sequence
  Description of Artificial Sequence: Synthetic coding sequence
atggccaaggtgcaggtgaacaacgtggtggtgctggacaacccctcacccttctacaaccctttccagttcgaaatcaccttcgaatgtatcgaggacctctctgaagacctggagtggaagataatatatgtcggctctgccgagagcgaggagtatgatcaggtgctcgacagtgtcctggtgggccccgtgcctgccggaagacatatgttcgtatttcaagctgatgcacccaaccccggcttgatcccagacgccgacgctgtgggggtcactgtcgttttaatcacttgtacctaccgcggccaggagtttattagagtcggctattacgtgaacaatgagtatacagagaccgagctgagagagaaccccccagtgaagcccgactttagcaagcttcagagaaacattctggccagcaacccccgcgtgacacgttttcacataaattgggaggacaacaccgaaaaattagaggacgccgagagcagtaaccccaacctccaatcactgctctccacagacgcactgccttctgcctctaagggctggtccacttccgagaactccctgaatgtgatgcttgagtcccacatggattgcatgtag

SEQ ID NO: 190725 - DNA, 1329 bp, Artificial Sequence
  Description of Artificial Sequence: Synthetic coding sequence
atggccggcgagggcgaccagcaggacgccgcccacaacatgggcaaccaccttccactgttgccagccgagtcagaagaggaggacgaaatggaagtggaggatcaggactctaaagaggcgaagaagcctaacatcatcaatttcgacaccagtttgcccacctcacatacatatctcggggccgacatggaggagttccacgggaggactttgcacgacgacgatagctgtcaggtgatcccggttttaccacaggttatgatgatcctgatacccgggcagacactcccattgcaacttttccaccctcaagaagtttctatggtgcgcaacttaatccaaaaggatcgcaccttcgccgtgttggcctactccaatgtacaggaaagagaagctcaattcggcacaaccgcagagatttatgcttacagagaggagcaagacttcggtattgaaatcgtaaaggtcaaggccatcggacgtcagcggttcaaagtgctcgaactgcgcacacagtcagacgggatccagcaggctaaagttcagatcttgcctgagtgtgtcctcccgagcacgatgtcagccgttcagctcgagtcgctgaacaaatgccagattttcccaagcaaaccagtgagcagagaggaccagtgcagctataagtggtggcagaagtaccagaagaggaagttccactgcgccaatctgacatcatggcctcgatggctgtatagcctttatgatgcagagactctcatggatcggatcaaaaaacaattacgagagtgggatgagaatttgaaggacgactcactgcccagtaatcccatcgacttctcctatcgcgttgccgcctgcctgccgatagacgatgtgctcaggattcaactcctcaagatcggatctgccattcagcgactgcggtgcgagctagacatcatgaacaaatgtactagcttgtgctgtaaacaatgtcaagagacagagattactactaagaacgagatcttttccttgagcctgtgcggacccatggcagcgtatgtaaaccctcacggttatgtacatgaaacgctgactgtttataaggcatgcaacctcaatctcatcggtagacccagtacagagcatagctggttccctggttacgcctggacggttgctcagtgtaagatctgcgcctcacacattgggtggaagtttacagctactaagaaagatatgtctccgcagaaattttggggactcactaggtccgccctactgcccactatcccggacaccgaggatgaaattagccccgacaaggtgatcctgtgcctgtag

SEQ ID NO: 190726 - DNA, 1308 bp, Artificial Sequence
  Description of Artificial Sequence: Synthetic coding sequence
atggccgagcgggccgccctggaggagctggtgaagctgcagggcgagcgcgttcgcgggctcaaacagcagaaggcctccgccgagctgatcgaggaagaggtggcaaagctgctcaagctgaaggcccagctcggacccgacgagtcaaaacaaaagtttgtattgaagactcctaagggaactagagactatagtcctaggcagatggccgttcgagagaaagtgttcgacgtgatcatcaggtgttttaagcgccatggcgctgaggtgattgacactcccgtttttgagttaaaggacttcgatattgccgggaactttgatcctatgattcccgacgcggagtgcctaaagatcatgtgcgagatactgtcgagcttgcagatcggcgactttctggtgaaagtgaatgatagaaggatcctcgatggcatgttcgcgatctgcggcgtctccgatagcaagttcagaaccatttgctcctctgtagataagcttgataaagtgtcctgggaagaagttaagaacgaaatggtcggagaaaaggggttagccccagaagtcgccgacagaatcggagattatgttcagcagcacggcggcgttagcctcgtggaacagttgctgcaggaccctaaattgtcccagaacaagcaggccttggaaggattgggagatttgaagctcttgttcgaatacctgacccttttcggaattgatgacaaaatttcttttgacttatccctggctcgcgggctggactattacacaggagttatctatgaagctgtgctcttgcagactcccgcgcaggcaggagaagaacccctcggcgtcggatctgtggccgccggaggacgctatgacgggctcgttggtatgtttgatcccaaaggtcgaaaagtgccctgcgtgggcctgagcatcggagtggaacgtatctttagcattgtggagcagcgcttggaagctttggaagagaagatccggaccactgaaacccaggttctggtcgcttctgcccagaaaaagcttcttgaagagaggctgaaattggtgagcgagttgtgggacgcgggtataaaggcagagctgctatacaaaaaaaacccaaagttgctgaaccagctgcaatactgcgaagaagctggaattcccctcgttgcaatcattggggagcaggagctgaaagatggcgtaattaaactcagatctgtgacttcccgagaagaggtggatgtcagacgcgaagacctcgttgaagaaatcaagcggagaaccggacagcctctatgtatctgttag

SEQ ID NO: 190727 - DNA, 1188 bp, Artificial Sequence
  Description of Artificial Sequence: Synthetic coding sequence
atggccgagcgggccgccctggaggagctggtgaagctgcagggcgagcgtgtccgagggctcaagcagcagaaggcttcggccgagctaattgaagaagaagtggcaaaactactgaaactgaaagcccagctgggcccggacgagagtaagcagaagttcgtgctgaaaactccaaaagattttgacatcgcgggaaactttgatcccatgattcctgacgccgaatgtctgaagattatgtgcgaaatcttgtccagcctccagatcggggacttcctggtgaaagtaaatgaccgtaggatcctagacggcatgttcgccatttgtggagtgagtgactcaaaatttcgcaccatctgtagttctgtggacaagctcgataaggtgtcctgggaagaagtgaagaatgagatggtcggggagaagggactggctccagaagtggcagacagaataggcgactatgtgcaacaacacggcggagtcagcctggtggagcagctgttgcaggacccgaagttgtcgcagaacaagcaggccctcgaggggctgggcgatctgaaattgctcttcgaatatttaacgctgtttggcattgacgacaagatctcatttgatctgtccctggcaagaggactggactattatactggtgtgatttacgaagcagttctgctccagacaccggcccaagctggcgaagagcctctcggagtaggatcagtagctgctgggggtcgatacgacgggctggtgggcatgttcgacccaaaaggacgtaaggtgccgtgtgtggggcttagcatcggcgtggagcgaattttctcgatcgtggaacagcgactggaagccctcgaagagaaaataaggacaaccgaaactcaagttctggtggcctctgcccagaagaagctccttgaagaacgcctgaaactggtgagcgaactttgggacgccggcatcaaagcggagctcctgtataaaaaaaatcctaaattactcaaccagctgcagtattgtgaggaagccggtatccccctggtggccatcatcggagaacaggagttgaaagacggcgtgattaaactgcggagcgtcacctcccgggaagaagtagatgtccgacgggaagatctcgtggaggagataaagcggaggactgggcagccactttgtatttgctag

SEQ ID NO: 190728 - DNA, 1410 bp, Artificial Sequence
  Description of Artificial Sequence: Synthetic coding sequence
atggccgagcgggccgccctggaggagctggtgaagctgcagggcgaacgggtgcgtggtctcaaacagcagaaggcctcagccgagctgatcgaagaagaggtggctaaacttttaaagctgaaagcccaattgggccctgatgaatctaagcaaaagttcgtgttaaagacccctaaggaaaccctgatgggaaaatatggagaagactctaagctcatatatgatctgaaagatcaggggggagaactcctgtccttaagatacgacctgacagtgccatttgcacggtaccttgccatgaataagctcacaaatatcaaacggtaccatatcgctaaggtctatcgcagagataacccagctatgacaaggggcagatatcgcgaattctatcagtgcgacttcgacatcgcagggaacttcgacccaatgatcccggacgctgagtgtctgaagataatgtgcgagattctgtcctctctacaaatcggagactttctggtaaaggttaatgacaggcgaatactggatgggatgttcgccatctgcggggtctccgattctaagttcaggacaatttgcagctccgtggataagttagataaggtgagctgggaagaagttaagaatgaaatggtgggcgagaaggggctcgcccccgaggtagctgacaggattggtgattacgttcagcaacatggcggggtttctttagtggaacagttactgcaagaccctaagctttctcagaacaagcaagctctcgagggtttgggagacctgaagctgctcttcgagtacctgacactctttggcatcgacgacaaaataagcttcgatctgagtctagctcgtggcctggattactacaccggcgtcatctacgaggccgtgcttttacagacccccgctcaggccggcgaagagccactcggcgtggggtccgtggcagccgggggtagatacgacggcctggtcggtatgtttgatccaaaagggcgaaaagtcccttgtgtgggattatcgattggagtcgaacgaattttttctatcgtagagcagcgactggaagccctagaagaaaaaatcaggactaccgaaactcaggttcttgttgcctctgcccagaaaaagctcctcgaagaaagactgaagttggtgtcggagctctgggacgccgggataaaagcggagcttttatataagaagaatcccaaacttctaaaccagctgcagtactgtgaggaggcaggaatccccctcgtggcaatcatcggtgaacaggagctgaaagatggcgtgatcaagctgagatcagtgacgtccagagaggaagtggacgttcggcgggaggacctcgttgaagaaattaagaggaggaccggtcagcccttgtgtatttgctag

SEQ ID NO: 190729 - DNA, 945 bp, Artificial Sequence
  Description of Artificial Sequence: Synthetic coding sequence
atgacccggggccggtaccgggagttctaccagtgcgacttcgacatagcaggcaactttgatcccatgattccggatgctgagtgccttaagatcatgtgcgagatcctgtcatctctgcaaatcggggatttcctggtcaaggtttcatgggaagaggtcaaaaacgagatggtgggtgagaaaggcctggctccagaagtagcggatagaattggcgattatgtgcagcaacatggcggggtaagcctagtcgaacaactgttgcaggaccctaagctatcccaaaacaaacaggcgttagaggggctgggggacctgaaacttctcttcgagtacctgaccctgttcggcatcgatgacaaaatttcattcgatttgagtctcgcacgcggtctcgattactacactggtgtgatctatgaagccgtgctgctacaaacccccgcccaggccggcgaggagccccttggcgtaggctccgtggcagccgggggtaggtatgatgggctggtggggatgtttgaccccaagggaagaaaagttccctgtgtgggactatctatcggtgttgagaggatattcagcattgttgagcagcggctagaagccctagaagagaagatccgcacaaccgagacacaagtcctcgtggcctcggcccagaaaaagctgctggaagaacggttgaaacttgtttcagagctttgggacgccggcatcaaagcggagctgctgtataaaaagaaccctaagctgctgaaccagttacagtactgcgaagaggctggaattcctctggtcgcaataattggagagcaggaactaaaggacggagtgattaagctgcggtcagtgacaagtagggaagaggtagatgttcgtcgcgaagatctcgtagaggagattaaaagacgaacaggccagcctttgtgcatatgttag

SEQ ID NO: 190730 - DNA, 1530 bp, Artificial Sequence
  Description of Artificial Sequence: Synthetic coding sequence
atggccgagcgggccgccctggaggagctggtgaagctgcagggcgaacgcgtaagggggctgaagcaacagaaggcgagcgcagaattgattgaggaagaggtcgccaaactgttgaaactgaaggcccaactgggccccgatgaaagtaaacagaaatttgtgctgaaaacgccgaagggcacccgggattactccccgagacagatggcagttcgggaaaaggtgttcgacgtcattataaggtgtttcaaacggcacggcgccgaggtgattgatactccagtttttgagctcaaggaaacacttatgggcaagtatggcgaggacagtaagttaatctatgacctcaaggaccaagggggcgagctgctctcccttcggtatgacctaaccgtaccgttcgcaaggtaccttgccatgaacaaattgaccaacatcaagcggtaccacatcgcaaaggtctacaggagggacaaccccgccatgacgagaggtcgatacagagagttctaccagtgcgattttgatatagcagggaacttcgaccccatgattccggatgcggaatgcctgaaaatcatgtgtgagattctaagtagcctgcagatcggcgacttcctcgtgaaggtgaacgaccgccgcatcttggatggtatgtttgctatatgtggcgtgagcgattcaaagtttaggaccatttgttcgtctgtagacaagctggataaagtgtcatgggaagaagttaaaaatgagatggtcggcgagaaaggactcgcacccgaagtggcagaccgtattggcgattacgtccaacagcatggcggcgttagtctggtagagcaacttctgcaagaccccaagctaagccagaacaaacaagcgctggagggtctgggcgacctgaagcttctcttcgaatacctgaccttatttggaatcgacgacaaaatttccttcgatctgagtctcgccaggggcctagattactacacaggggtcatttatgaggctgtgctgctccaaacgccggcccaagcaggagaagagcccctcggagtggggtcagtggcagctggtggccgatacgatggcctggtgggtatgtttgaccccaaaggtcgcaaagttccctgcgtcggactgtccattggagtggaacgtatcttctctattgttgagcagcgtctggaggctctcgaggagaagatcaggacaaccgagacccaagtccttgttgctagcgcccagaaaaaactgctggaagaacgacttaagctcgtcagtgagctatgggatgccggcatcaaggcagagctgctgtataaaaaaaacccaaaactactaaatcagttacagtactgtgaggaagcggggataccattggtggccattatcggggagcaggagctgaaggacggagtcatcaaattgaggtctgttacctctcgtgaggaagttgacgtgcgaagggaagatctcgttgaggagattaaacggcgaacgggccaacctttgtgcatatgttag

SEQ ID NO: 190731 - DNA, 1323 bp, Artificial Sequence
  Description of Artificial Sequence: Synthetic coding sequence
atggccgtgcgggagaaggtgttcgacgtgatcatccggtgcttcaagagacacggcgccgaagtgattgacaccccagtattcgagttaaaggaaaccttgatgggtaagtacggagaagacagcaaactcatatacgacctcaaggatcaagggggtgaactgctgtctcttcgatatgacctgaccgtgccttttgcacggtacctggccatgaacaagctgacaaacattaagcgatatcacatcgcgaaagtataccgccgggacaaccccgctatgacaagaggtagataccgagaattttaccagtgtgacttcgatatcgcaggaaactttgatcccatgattcccgatgccgaatgcttaaagatcatgtgtgaaatcctatcttcccttcagatcggggactttttggtgaaggtcaatgacaggcggatcttggatggaatgtttgcaatatgcggcgtgtccgatagcaagtttagaacaatctgcagttctgtcgacaaattagataaggtgagctgggaggaggtgaaaaatgaaatggtcggggaaaaaggccttgcaccggaggtggccgatcggattggggattatgtgcaacaacacggcggagtgtctcttgtggagcagctcctgcaagaccctaaactctcacagaacaagcaggcactggagggcctaggagacctgaagctgctgtttgagtacctgaccctctttggaatcgatgataaaatctcattcgatctgtcgctcgcaagggggctggactactatactggcgttatttacgaagcagtactgctgcagacgcccgcgcaggcaggggaggagccgctgggcgtaggatccgtggccgctggtggaagatacgacggcctagttggcatgttcgatcccaagggtaggaaggtgccgtgcgtcgggcttagcatcggcgtagagcgtatcttttcaatcgttgagcagaggctcgaagcgctcgaagaaaaaattaggacgaccgagacacaagtcctggttgcttcggcacagaagaaactcctggaagaaagactgaagttagtgagtgaactctgggacgccggaatcaaggccgaactgttgtacaaaaaaaatcccaaattgctaaaccaactgcagtattgcgaggaggcagggatccccctggttgcaatcataggtgagcaggagctgaaagacggggtgatcaaactcagaagcgtgacttctagggaggaagtcgacgttagacgggaagatctagtcgaagaaattaaacgcagaactgggcagcctctgtgtatttgttag

SEQ ID NO: 190732 - DNA, 867 bp, Artificial Sequence
  Description of Artificial Sequence: Synthetic coding sequence
atggccgagcgggccgccctggaggagctggtgaagctgcagggcgagagggtcaggggcctgaagcagcagaaggcttcagcagagttgatcgaagaagaagtggcaaagctgttaaagcttaaggcgcaactggggcccgacgagtctaaacagaagtttgttctgaagacccccaaaggtactcgtgattactctccccgccagatggccgtccgggagaaagtcttcgacgtgattatccgctgttttaagcgccacggcgccgaagtaatcgacaccccagtcttcgagttgaaagtgaatgatcggcggatcctcgacggaatgttcgctatctgtggagtctccgattctaagtttcggacgatatgttccagtgtcgacaagctcgataaggtttcttgggaggaagttaaaaacgaaatggtgggggaaaaggggctggcaccagaagtggccgaccgcatcggcgactatgttcaacagcacgggggtgtgagcctggtggagcaactcctgcaggatcccaagctctctcaaaataagcaggctctggagggtctgggcgacctgaagctgctgtttgagtatttgaccctctttggcattgacgataagatctctttcgacctttctctagctagggggctcgactattatactggcgtaatctacgaggccgtcttgctgcagacccctgcccaggccggggaagagcccctcggcgtgggcagcgtggcagcaggcggcaggtatgacgggctcgtcggaatgttcgaccctaaaggccgaaaagtgccctgtgtggggcttagcatcggggtagagaggattttctccatcgtcgagcagcgattggagtag

SEQ ID NO: 190733 - DNA, 1350 bp, Artificial Sequence
  Description of Artificial Sequence: Synthetic coding sequence
atggccgagcgggccgccctggaggagctggtgaagctgcagggcgaacgcgtgcgcggactcaaacaacagaaagcttcagccgagttaatcgaggaagaggtggccaaactcttaaaactgaaggcccaattgggacctgatgaaagcaagcagaaatttgtcctgaagacaccaaaagagaccctgatgggcaagtatggggaggatagcaaactcatttatgatttaaaagatcaaggaggggagctgctttcccttcgatatgatctgactgtgccctttgctaggtatctggccatgaacaagctgactaacattaaaaggtaccatatagcgaaggattttgacatcgccgggaatttcgatcccatgattcctgacgcagaatgcctgaagattatgtgtgaaatcctctctagtctccaaatcggggactttcttgtgaaagtgaacgatagacgtatcttggatgggatgttcgctatttgtggagtatcggacagtaagtttaggaccatctgcagcagcgtggataagctggataaggtgtcctgggaggaggtaaaaaatgagatggttggggagaaaggactcgcccccgaagtggctgacagaattggtgactacgtccaacagcacggaggagtgagcctggtagaacagcttctgcaggatccaaaactctcacaaaataagcaggctctagaaggtctaggagatcttaagctgctctttgaatatctgaccctgttcgggattgacgacaagataagcttcgaccttagcttagcgcgcggactggattactacacaggagtgatttatgaggccgttttgcttcagacacccgcccaggccggcgaggagcctctgggcgtcggcagcgtggccgctggggggcgctacgacggcctggttggaatgttcgatcctaaagggaggaaagtcccctgcgtggggctgagcattggtgtggaaagaatttttagtatcgtcgagcagagactggaagccttggaggagaagattcgcacaactgaaacacaagtcctcgtggcgagcgcccaaaagaaactgttggaggagcgcctaaaactggtgtctgaactttgggatgccggtattaaagcagagttgttgtacaaaaaaaaccctaagcttctgaatcagctccagtactgcgaagaggcggggatccctctggtggccatcatcggcgaacaagaacttaaagacggggttatcaagctgaggagtgtgaccagccgcgaggaggtggatgtccgtcgggaggacctggttgaggagataaagaggcgcacaggacaaccactgtgcatctgctag

SEQ ID NO: 190734 - DNA, 1470 bp, Artificial Sequence
  Description of Artificial Sequence: Synthetic coding sequence
atggccgagcgggccgccctggaggagctggtgaagctgcagggcgaaagggtgcggggactgaagcaacaaaaagctagtgccgagctgatcgaggaggaggtggccaaacttctcaaactgaaggcccagctcggtcccgatgagtccaaacagaaatttgtgcttaagacacctaaggggacccgggattattcacctcgacagatggctgtgagagaaaaggtgttcgacgtgatcatccggtgctttaagaggcatggggcagaggttattgatacccctgttttcgagctgaaggagacacttatgggcaagtacggggaggacagtaaactgatatacgacctgaaggatcagggtggagaactgttgtcactccggtacgacctgactgtgccgtttgcacgctacctcgccatgaataagctaaccaatatcaaacgttatcacatcgccaaggatttcgacatcgctggcaattttgaccccatgatacctgatgctgaatgtctgaagattatgtgtgagatcctgtccagccttcagatcggtgactttctagtgaaagttaatgacagacggatcctagacgggatgttcgcaatttgcggtgtctccgactcaaaatttagaaccatttgctcgtcagtggacaagctagacaaagtgtcctgggaggaggtgaagaatgagatggtgggagagaaagggctggcccctgaggtggctgaccggatcggcgactatgtgcagcagcacggtggtgtgtccctggtcgagcagctcctccaagatcccaaattgtcacagaacaaacaggccctggagggactgggggacctgaagctgctgttcgaatatctcaccttattcggaatagacgataagatctcttttgacctgagcctggcgagggggctggattactacacaggagtcatctatgaggcagttcttctgcagactccggcccaggccggggaagaacccctgggcgtaggatcagtggcggcaggtggtcgctatgacggcctagtgggtatgttcgaccccaaggggcgtaaggtgccatgtgtgggcctttctatcggcgttgaacgtattttttccattgttgagcagagactggaggctctggaagagaagatacgcaccacagagactcaggtgctggtcgcttccgcccagaaaaaactactggaagaaaggctcaaattggtgtcagaactttgggatgcgggcattaaggcagaattgttgtacaaaaaaaacccgaaattgctgaaccagctgcaatattgcgaggaggcaggtataccgcttgttgccataataggggagcaggagttaaaggatggagtgatcaaactcaggtctgtgacctccagagaagaagtggacgttcgtagggaagaccttgttgaggaaattaagcgccgaaccggccagccactgtgcatctgttag

SEQ ID NO: 190735 - DNA, 1017 bp, Artificial Sequence
  Description of Artificial Sequence: Synthetic coding sequence
atgatggccatgaacagcaagcagcccttcggcatgcaccccgtgctgcaagagcccaagttctcatccctccattctggcagcgaggctatgcggagagtctgtttgcctgcaccacagttgcagggcaatatattcggatctttcgatgagtcattgttggctcgggccgaggcccttgctgccgtggatatcgtttcacatgggaaaaaccatccttttaagcccgacgccacctaccatactatgtctagcgtgccctgcacatccaccagctccacagtgcctattagtcaccccgccgcactgacctcccatccccaccacgcagtgcaccagggactggagggcgacctcctggaacacatctcacctactctttctgtatctggtctcggagcgccggagcactcagtcatgcccgcacagatccacccgcaccaccttggggctatgggacatctgcaccaggctatgggcatgtcccacccacacaccgtggctccccattctgccatgcccgcctgcctctccgacgtcgaaagtgacccacgtgagctggaggctttcgccgagcgcttcaagcaacggaggataaagctgggggtgacacaagcagatgtgggagcagctctggccaatctgaagattccaggtgtgggctctctgagccaatccactatttgtaggttcgaaagccttacgctttcgcacaacaatatgattgccttgaaaccagttttacaagcatggctcgaagaggcggaagccgcctatagggagaaaaattcgaagccagaattgttcaatggtagcgaacgtaaacgaaagaggactagcattgcggcccccgaaaagcgcagcctcgaggcctactttgccattcagcctagacccagctcagagaaaatagctgccattgccgagaaactggacctcaagaagaacgtcgtccgtgtatggttctgcaatcagcgacagaaacaaaagcgcatgaagtactccgcagtgcactag

SEQ ID NO: 190736 - DNA, 1038 bp, Artificial Sequence
  Description of Artificial Sequence: Synthetic coding sequence
atgaccctgctggaggtgcccttcgcccggtacctggccatgaacaaagtgaaaaagatgaaacggtaccatgttgggaaggtttggcgcagagagagcccaaccattgtgcaaggccgttatagagaattttgtcaatgcgacttcgacatcgccggtcaatttgatccgatgatccctgatgctgaatgcctgaagatcatgtgcgaaatcctttccggcctgcagctcggggacttcctgataaagatggcatggaaggacgtgcggcatgagatggtggtgaagaagggcctggcaccagaggtggcggacaggatcggggattatgtgcagtgtcacgggggagtctcactggttgagcagatgtttcaggatccacgcttgagtcagaacaaacaggcattggagggtctcggcgacctcaaactgctcttcgagtacctaactctcttcggaatagcggataagattagctttgacctaagtctggccagagggttggattattacacaggcgtgatctacgaagctgttctgctgcaaacccctacacaagccggcgaggagccacttaatgtcggctcagtcgctgctgggggcaggtacgatggcctggtcggaatgttcgatcctaagggacataaggttccttgcgtcggcctcagcattggtgttgaacgaatcttttatatcgtggagcagcggatgaaaacaaaaggagagaaggttcgaaccacagagacacaagtatttgttgcaacacctcagaaaaattttctacaagagcggctgaaactcatagccgaattgtgggacagcggtatcaaagcagaaatgttatacaagaataaccctaaacttctgactcaactccactactgtgagtctacaggtattcccttggtggtcattatcggagagcaggaactgaaagaaggagtcataaaaatacgaagcgttgcaagcagggaagaggtcgctatcaagcgagaaaacttcgtcgccgagatccagaagcggctgagtgagagttag

SEQ ID NO: 190737 - DNA, 1179 bp, Artificial Sequence
  Description of Artificial Sequence: Synthetic coding sequence
atgcccctgctgggcctgctgccccggcgggcctgggccagcctgctctcacagctgctgagacctccttgcgcgtcttgcaccggagctgttaggtgtcagtcccaggtagccgaagccgtgcttacaagccaactcaaagctcaccaggagaaacccaactttatcatcaaaacccccaaggactttgatattgcgggacagttcgatcccatgatcccggatgccgaatgtctgaagatcatgtgcgaaatcctttctgggctgcagcttggggatttcctgatcaaggttaacgacaggagaatcgtcgatggcatgtttgctgtgtgtggagtaccagagagcaaattccgggctatctgttccagcatagataagcttgataagatggcctggaaagatgtgcgacatgaaatggtggtcaagaagggactcgctccagaggttgcagacaggattggagactatgtgcagtgccacggtggcgtgtcacttgtcgaacagatgttccaggacccccggcttagtcagaacaagcaggcgctggagggtcttggcgatttgaagttgctgttcgaatacctgacactctttggaattgcagataaaatctcttttgacctgtcactcgcaagaggactagactattacactggagtcatatatgaggctgtgctgctccagaccccaacccaagcaggtgaggagccactaaatgtgggctccgtggccgcggggggccggtacgatggactggtaggcatgtttgaccctaaaggccacaaggttccttgtgtcgggttgtcaatcggcgttgagcgcatattttacattgttgaacagagaatgaagaccaagggggaaaaggttcgaacaacagagacccaggtttttgttgccactccccagaaaaactttctgcaagaaaggctgaagttgatcgcggagttgtgggatagcggaatcaaagcggagatgctgtataaaaacaacccaaaactactaacacaactccactattgtgagagcaccgggataccgctcgtggtcattatcggggaacaggagcttaaggagggggtcatcaaaatcagatccgtggccagtagggaggaagtagctatcaagagggagaattttgtagcggagatccagaagcgcttatcggaatcgtag

SEQ ID NO: 190738 - DNA, 1401 bp, Artificial Sequence
  Description of Artificial Sequence: Synthetic coding sequence
atgcccctgctgggcctgctgccccggcgggcctgggccagcctgctgtcccagttgctccgaccaccatgtgccagctgcaccggggctgtgcggtgccagtcacaggtggctgaggctgtgctgacgagccagctgaaggcgcatcaggagaaacctaacttcataattaaaactccaaaagaaacactgacagaaaaatacggcgaggactctggattgatgtacgacctcaaggatcaaggtggcgagttactaagtctgaggtatgatctgaccgtcccatttgcacgttatctggccatgaacaaagtcaagaaaatgaaacgctaccacgtgggtaaagtctggagaagagagtcaccgacaattgtgcaggggagatacagagaattttgtcagtgtgacttcgatatagctggtcaatttgatccaatgatacccgatgccgaatgcctgaaaataatgtgtgagatcctgagtggcctgcagttgggcgattttttgataaaagtaaatgaccggagaattgtcgacggaatgtttgccgtctgtggggtgcctgaaagcaaattcagggcaatttgctcttccatcgataaattggataaaatggcctggaaggacgtccggcatgaaatggtagtgaaaaagggactggcacccgaagtggctgaccggataggcgattatgtgcaatgccatgggggcgtatcattagtagagcaaatgttccaggacccgcgcttgagccaaaataagcaagctcttgaaggccttggggacctgaaactccttttcgaatacctgacgttatttggcattgccgacaagatctccttcgacctgtcactggcaagaggtctggattactatacaggcgtaatttacgaggctgtacttctgcagacccctacacaggccggggaagaacccctaaacgttggcagcgtggcagccggcggcagatacgacggcctggtaggaatgtttgatccaaagggtcataaagttccgtgtgtgggcctaagcattggcgtcgagcgcatcttctacatcgtggagcagcggatgaagacgaagggggagaaggtgaggacaactgagacacaggtgttcgtcgctacgccacagaagaactttctgcaagagcgcctcaaactgatagcagagttgtgggattccggaataaaggccgagatgttgtacaagaacaaccctaagctgctcactcagcttcactattgtgaatcaactggcattcccttggtggtgataataggagagcaggagcttaaggagggagtaataaagattagatctgtggcctccagagaggaggtggctattaagagggagaattttgtcgccgaaattcagaaacgcctctctgaatcgtag

SEQ ID NO: 190739 - DNA, 1005 bp, Artificial Sequence
  Description of Artificial Sequence: Synthetic coding sequence
atgcccctgctgggcctgctgccccggcgggcctgggccagcctgctgtctcagctgcttaggcctccctgcgcctcctgtactggggcagtgcgctgccagagtcaagatttcgatatagcgggccagtttgatccgatgatacccgatgctgaatgtctgaaaatcatgtgcgagattttgagtggtcttcagctgggagattttctgatcaagatggcatggaaagacgtgcgccacgagatggttgttaagaaaggtttagcccccgaggttgctgacagaattggcgactatgtacaatgtcatggcggcgtgagcttggtggaacagatgttccaggaccctagactatcacagaataagcaggcactcgagggtctgggcgacctgaaactactgtttgagtacctcaccttgtttgggatagcagacaaaatcagttttgatctttcactggcccgggggttggactattacactggtgtgatttacgaggcggtgttgctgcagacacctacacaggctggagaggaacctctgaacgtcggatcagtagcggcaggtggacgatacgacggcctagtgggcatgttcgaccccaaggggcataaggtcccctgcgtcggactgtctatcggcgtggagcgcattttttacatcgtcgagcagcggatgaaaacaaagggcgagaaggtgagaacaacagaaactcaggtgtttgttgccacaccacaaaagaattttctccaggagcgcctgaagctcatcgcagagctttgggattctggcattaaggcggaaatgctctataaaaataatccaaagctgctcactcagttacactattgtgagtcaacaggaattcccctagtagttattattggcgaacaggagctgaaagaaggcgtgattaagatccgtagcgtggcttcccgcgaggaggttgccatcaaaagggagaattttgttgcagaaatccagaagcggctgtctgaaagttag

SEQ ID NO: 190740 - DNA, 1446 bp, Artificial Sequence
  Description of Artificial Sequence: Synthetic coding sequence
atgcccctgctgggcctgctgccccggcgggcctgggccagcctgctgtctcagttactccgccccccatgtgcctcttgcacaggagccgtgcgctgtcagtcccaagggacgcgcgacctctcgccccagcacatggtggtgcgcgagaaaatactcgacctggtgatctcctgttttaagcgtcacggtgccaagggtatggacacacccgccttcgagctgaaagagactctcacagaaaaatatggcgaagactcagggctgatgtacgacctcaaagatcaggggggtgagctcttgtctctgcggtacgacctaaccgtgccatttgctaggtacttggccatgaacaaggtcaagaaaatgaagagatatcacgtgggtaaagtttggcgccgggagtctcctaccattgtacagggtaggtatcgggaattttgccagtgtgatttcgatatagctggacagttcgatcccatgatccccgacgctgaatgtctgaaaattatgtgcgaaattctatcgggattgcagctgggagacttcctgataaaggtcaatgaccgtcgcattgtcgatggcatgttcgcagtgtgcggagttcctgaatccaaatttagggctatttgtagttcaatcgacaaacttgacaagatggcttggaaggatgtgcgccatgaaatggtggtgaaaaaaggacttgctccggaagtagcagacaggatcggagactacgtgcagtgtcatggcggtgtttctctcgtcgagcaaatgtttcaagaccctaggctgagtcagaataagcaggctctcgaaggtctgggcgacctcaaactcctgtttgaatacctgaccctgtttggcatcgccgacaaaatctcatttgatctttctcttgctagaggcttggactactacacaggggtaatctacgaggctgtgctcttacagactccaacacaagctggcgaagaaccgttgaatgttggaagcgttgcagctggaggcaggtacgacgggctggttggcatgttcgaccctaaggggcataaagtcccctgcgttggattatctataggtgtggagcggatcttctacatcgtagaacaaaggatgaaaaccaagggagagaaagttagaaccaccgagacccaggtgttcgtggcaaccccccagaagaactttctgcaggagaggcttaaactgatcgccgagctgtgggactctggcatcaaagcagagatgctgtataagaacaaccctaaactattaacacagcttcattactgtgagagtaccgggatccctctggttgtcatcatcggcgagcaggagcttaaagaaggcgtgattaagatcaggtccgtggccagccgcgaagaggtggccatcaaaagagaaaacttcgtggccgagatccagaagaggctttccgaatcttag

SEQ ID NO: 190741 - DNA, 1185 bp, Artificial Sequence
  Description of Artificial Sequence: Synthetic coding sequence
atggacagcgccctgagcgacccccacaacggcagcgccgaggccgggggccccaccaattctacgacacgtccaccctctactccggagggaattgccctggcttatggtagccttctcttgatggccctgcttcccattttttttggcgcattaaggagtgtccgctgtgctagggggaagaatgcttccgacatgcccgaaactatcacctcccgggatgccgctaggtttccaataatcgcaagctgcaccctgctgggactatatcttttctttaaaattttctctcaagaatatatcaatctgctcttgagcatgtacttcttcgtgcttggaatccttgcgctgagtcacacaatctctccctttatgaataaattttttccggcctctttcccgaacaggcagtaccaactgctgttcacacagggcagcggtgaaaacaaagaagagataatcaactatgagttcgacacgaaagaccttgtgtgtctggggctctcatctattgttggggtctggtaccttcttcgcaaacattggatcgccaataacctgttcggcctcgctttttcgttgaatggggtggaactactgcatctgaacaacgtctctaccggctgtatcctcttgggtggcctgttcatctatgatgtgttttgggtcttcggaactaacgtcatggtgaccgtcgccaagtcttttgaagcgcccattaaattggtattccctcaggacctgctggagaaaggcttagaggctaacaattttgccatgctcgggcttggagatgtagtgatccccgggatattcattgctcttcttcttagatttgatatctccctcaagaaaaacactcatacctacttttacacttcttttgccgcctacatttttgggcttgggttgaccattttcattatgcacatctttaagcacgcacagcccgcgctgttgtatctagtgccggcgtgtattggttttccggtgctggtggcgctggcaaaaggggaggttacagaaatgttcagctatgagtcaagtgcagagatccttcctcatacacctcgccttacacacttccctactgtcagtggctcgcccgccagcctcgccgacagtatgcagcagaagctagcagggccaaggcgccggcgtcctcagaatccctccgcaatgtag

SEQ ID NO: 190742 - DNA, 1134 bp, Artificial Sequence
  Description of Artificial Sequence: Synthetic coding sequence
atggacagcgccctgagcgacccccacaacggcagcgccgaggccgggggtccaacaaattcaacaacccggccaccaagtacaccggagggaattgctctggcctatggcagtcttctcttgatggccctgctgcccatctttttcggcgctctcaggagcgtgcggtgcgctcggggtaaaaatgccagcgacatgcctgaaactatcacctccagggacgccgctcggtttccaattatcgcgtcttgtaccttgttaggcttatacctgttcttcaagatattctctcaggagtacataaatctcctcctgtccatgtatttttttgtcctcggaattttggcgctgagccacacgatcagcccattcatgaataagttctttcctgcctctttccccaatagacagtaccaattattgttcactcaaggcagtggcgagaataaagaggaaattatcaactacgagttcgacaccaaggacctggtttgcctaggcctttcgtccatcgtgggtgtttggtacctcctcagaaagcactggatcgccaacaacttattcggcttggcttttagtttgaacggtgtcgaactgctgcacctgaacaacgtgagcacagggtgtattctgctgggcgggctgtttatctacgacgtcttttgggtatttggcacaaacgtcatggtcaccgtagcgaaatcctttgaagctcccattaagctggtgtttcctcaggatctgttggaaaaaggcttggaagctaacaactttgccatgctcgggctcggggatgtagtgatccctggcatcttcatagccctgctactgcgctttgacatcagtttgaagaagaatacacatacatatttttatacgtcatttgcggcatatattttcggcctgggactgactatctttatcatgcacattttcaaacacgcacagccggctttgctttatctggtgcctgcttgtatcgggttccctgtactcgtggccctcgctaaaggcgaggtgaccgaaatgtttagctatgaggagtccaatcccaaggatcctgctgcagtcacagaatccaaagaggggactgaggccagcgccagtaaaggcctggagaagaaagaaaagtag

SEQ ID NO: 190743 - DNA, 1008 bp, Artificial Sequence
  Description of Artificial Sequence: Synthetic coding sequence
atggacagcgccctgagcgacccccacaacggcagcgccgaggccggtgggcccaccaattctacgacaagacctccctctacacctgagggaatagcccttgcatacgggtctcttctcttgatggccttgctacctattttcttcggagctctgaggagcgtgaggtgtgcccgcggcaagaatgcatctgatatgcctgagacaatcacttctagggatgccgccagatttcccatcatcgcatcatgtacactgctcggcctgtatctgtttttcaagatcttctctcaagaatacatcaacttactactgagcatgtattttttcgtgctgggaatccttgccctcagccatactatctccccctttatgaacaaatttttccctgcaagttttccaaatcgtcagtaccagctgctgttcacacaaggcagcggagaaaacaaggaagagattatcaactatgagttcgatactaaagatttggtctgccttggcctgtcgagtattgtaggcgtgtggtatttgctccgcaaggtgtttggcacaaacgtcatggtcactgttgccaaatcttttgaagccccaatcaaattggtgttcccccaggatctgttggaaaaggggctggaggctaataattttgccatgctgggtctgggcgatgtagttataccggggatttttatcgccctcctcttgcgttttgatatttccctgaagaagaacacccatacatacttttacacaagcttcgctgcttacatcttcgggctgggtctcacaatatttatcatgcatatcttcaagcacgcacagccagcactgttatacctggtcccggcatgcatagggttccccgtcctcgtggcccttgccaagggcgaggtcaccgaaatgttctcatacgaagagagcaaccccaaggacccagctgctgtcacggagagtaaagaaggcaccgaagccagcgccagcaagggcctggagaagaaagaaaaatag

SEQ ID NO: 190744 - DNA, 1281 bp, Artificial Sequence
  Description of Artificial Sequence: Synthetic coding sequence
atggacagcgccctgagcgacccccacaacggcagcgccgaggccgggggaccgaccaacagtaccacccgcccccccagcacgcccgagggtatcgcactcgcatacggctctcttctgctgatggctctgttacctatattttttggcgccttacgttctgtgcggtgtgcgcgggggaagaacgcctcagacatgcctgaaacaataacatctcgggacgcggccagatttccaattatagcatcctgcacattgctgggactctacctgtttttcaagatttttagccaggagtacataaacctgctgctatcgatgtacttcttcgtgcttggcattttggctctgtcacataccatatctccatttatgaataaatttttccccgccagtttccctaatagacaataccagctcctgtttacgcagggaagcggagaaaacaaagaagaaattattaactatgagtttgacaccaaagacttggtgtgtttaggattgtctagcatcgtgggtgtgtggtacctcttgcggaagcattggatcgctaataatttgttcgggctggcgttttctctgaacggggttgagctgctgcatttgaacaacgtttcaactggctgcatactgttaggggggcttttcatatacgacgttttctgggtgttcggcaccaatgtgatggtcacagtcgctaagtcctttgaggcaccaatcaagctagtctttccgcaagacctgctggagaaaggccttgaggctaacaactttgcgatgctgggtctgggcgatgtggtcattccgggcatcttcatcgcactgttgctgcggttcgacatctccttaaaaaagaatactcacacctatttctacaccagcttcgcagcctacattttcggactggggctcaccatcttcatcatgcacatttttaagcacgctcaaccagccctgctgtacctcgtgcccgcttgtatcggttttccagtgctcgttgccctcgctaagggggaggttacagagatgttttcctatgagtcgtcagccgaaatcctgcctcacacacctagattaacacactttccaactgtctcagggtctcctgctagcctcgcggattccatgcagcagaagctggcggggccccggagacgaaggccacagaacccatccgctatctacgaagaaagcaaccccaaggatccagctgccgtaaccgaatcaaaggagggtaccgaagctagcgcctctaagggcttggagaagaaggagaaatag

SEQ ID NO: 190745 - DNA, 3411 bp, Artificial Sequence
  Description of Artificial Sequence: Synthetic coding sequence
atgttcagccggaagaagcgggagctgatgaagacccccagcatctccaagaagaaccgggctggaagtccctctcctcagcctagcggtgagcttccacggaaggatggagcggatgccgtattcccaggcccctctctggagccgccagcaggcagcagcggagtgaaggcaaccgggaccctgaaacgaccaacaagtttgtctcgacacgccagtgccgctggttttcctctgagcggcgcagcgagttggacactcggccgaagccaccgatctcctctcaccgcagcaagccctggcgaacttccaacggagggagcggggcctgatgtggtggaggatatttcccatctcctggcagatgttgctagatttgcagagggtctggagaaacttaaggaatgcgtgctgcgggacgatctgctcgaggctagacgcccgcgcgctcacgagtgtctgggtgaggccctgcgtgtcatgcatcagattattagtaaatacccgcttcttaacacagtggagacacttaccgctgctggcaccctcatagccaaagtcaaagctttccactacgaatccaataacgatttggagaaacaggagttcgagaaagctctggaaaccatagcggttgctttctcctccacagtgtcagagttcctcatgggagaagttgatagtagcacccttctggccgtgccaccaggagactctagccagagcatggaatctctatacggcccaggctctgagggtacccctccttctcttgaagactgcgacgccggatgcctccccgccgaggaagttgatgtcctgttacaaaggtgtgaggggggcgttgatgctgccctgctttacgcgaagaacatggccaagtatatgaaggaccttatcagctaccttgagaagcgcaccaccctggagatggagtttgccaagggtctgcagaagatcgctcataattgtcgccagtcagtcatgcaagaacctcacatgccgctgctctctatctactcactggcccttgaacaagacttagagttcggccacagtatggtgcaagccgtcggcacgctgcagacgcaaacttttatgcagcctctgaccctgaggcgtctggagcatgagaagcggcgcaaggagatcaaggaggcttggcacagggcccaacggaaattgcaagaggctgagagcaatctgcgaaaagcaaagcaagggtatgtccagagatgcgaagatcatgacaaggccagattcttagtggcaaaggccgaagaggaacaggctgggagcgctcctggggccggaagcactgcaacaaaaaccctagataagagacggcgcctggaggaggaggcaaaaaacaaagccgaagaggcaatggcaacttaccggacttgcgtagccgatgctaagacacagaagcaggagctggaggatactaaggtgactgccttgagacagatccaggaggttatccggcagtccgatcagaccatcaagtccgcgaccatctcctattaccagatgatgcacatgcaaacagctcccctgcccgtgcacttccaaatgctgtgcgaaagctccaagctgtatgacccaggacagcagtatgcatcacacgttagacagttacagagagatcaagagcccgatgtgcactacgactttgagccccacgtatctgctaacgcttggtcccccgtgatgcgggctaggaagtcgagcttcaatgtgtctgacgttgcacggcccgaagcagccggatcaccccccgaggaaggcgggtgtacggaaggcactccagctaaagaccacagggccggccgaggtcaccaggttcacaagtcttggcccctcagcatatcggactccgactcaggccttgatcccggcccaggtgcgggcgattttaaaaaattcgaaagaacttcatcaagcggcaccatgtcaagcacagaggagttggtcgaccccgatggcggggcgggtgcttctgccttcgagcaggctgacctcaatgggatgacacccgagctgccagttgctgtgccctcaggccccttccggcacgaggggctcagtaaagcggcccggacgcacaggcttcgaaagttgaggactccggcaaaatgccgcgagtgcaatagctatgtctacttccaaggagctgagtgtgaggagtgctgtcttgcctgccataaaaagtgcttagaaacactcgccattcaatgcgggcacaaaaaattgcagggtcggctgcagttattcgggcaggacttctcgcatgcggctcgctccgcacccgacggcgtgccgtttattgtgaagaagtgtgtgtgcgaaatagagcggcgagccttacgaacaaagggcatttatagagtgaacggagtgaagaccagggtggagaagctgtgtcaggccttcgaaaacggcaaggagctggttgagttaagccaggcttccccccacgacatctcgaatgtgctgaaactatacctcaggcagctgcccgagccgcttatttccttcagactgtaccacgagctggttgggctggccaaggactctctgaaagccgaggccgaagccaaagccgcgagtcgcggtaggcaggatggctcagaatcagaggccgtcgctgtagccctggccgggagactgcgagagctgctcagggacttgccaccagagaaccgtgcaagtctgcagtatttgctccgacaccttcgaaggattgtggaggtggagcaagacaataaaatgactcctggtaatctaggaattgtgtttggcccaacacttctgcgaccaaggcccaccgaggccacagttagcctgtcctcgctggttgattatccgcatcaggcgcgcgtaattgaaacgcttattgtacactacggactggttttcgaggaggagcccgaagaaacccccgggggtcaggacgaatccagcaaccagcgagctgaggtggtcgttcaggtcccctacctcgaggcaggagaagctgtggtctatccgttacaggaagcagcagcagacggatgccgagaatctagggtcgtttctaacgattcagacagcgacctcgaagaggcctccgaactgctctcatcaagcgaagcgtctgccctgggccatctgtccttcctcgagcagcagcagagcgaagctagcctcgaggtcgccagcggatcccatagtggctccgaggaacagctggaggctacagcaagagaagatggtgacggagacgaggatggcccagcgcagcaactgagcggattcaataccaatcaaagtaacaacgtcctgcaggcacccttaccacctatgcgtctgaggggtggcagaatgactctggggtcgtgtcgggagaggcagccagaattcgtatag

SEQ ID NO: 190746 - DNA, 3393 bp, Artificial Sequence
  Description of Artificial Sequence: Synthetic coding sequence
agctacagcccctaccgggccggccggcagggcccccagcagcggggacgggacccgggcatccagctcacagagttgccaagaaaggacggcgctgatgctgtctttcccggaccctccctggaacctcccgcagggtcctctggggtgaaggctaccggcaccctcaagcgtcccaccagtctcagtcggcacgcttccgccgccgggttcccgctcagcggggcagcgtcttggacgctgggacgatcccatagatcccctttgactgccgccagtcccggggaactgcccactgagggagctgggcccgacgtggtagaagatatcagccacttgctggccgacgtagcaagattcgcagaaggtctagagaagttgaaggagtgcgtcctcagagatgacctgcttgaagcccgcaggcctcgggcccacgaatgtctcggggaggctttgcgcgtgatgcaccagattatatcgaagtatcctctactaaatactgtggagacactgacagctgcgggtacacttattgcgaaggtgaaagcattccactacgaatctaataacgaccttgaaaagcaggagtttgagaaggctctagaaacgatcgccgtggccttcagctctactgtctccgagtttcttatgggggaagtcgactctagtactcttctcgcagtaccgcccggggattcgtctcagtctatggagtcgctgtacggacctgggtcagagggcaccccaccttcgctggaggactgcgacgcaggttgcttgccagcagaagaagtcgacgttctcctgcagcggtgcgaaggcggagtggacgccgcactcttgtatgcaaagaacatggcaaagtatatgaaggatctgatctcatatctcgaaaaaagaactaccttggagatggaatttgccaaggggctccaaaagatcgcacataactgtaggcagtccgtgatgcaggagccccacatgcctctcctctccatttatagccttgctcttgagcaggacttggagtttggacactccatggttcaggctgttgggactctgcagacacagacattcatgcaacccctgaccttaaggcggttggagcacgagaagagacgcaaggaaataaaagaagcctggcatcgggctcaacgtaaactgcaggaggccgagagtaacctgagaaaagctaagcagggatacgtgcagaggtgtgaggatcatgacaaggccaggttcctggtggcaaaggcagaagaggagcaggccggctcggcccccggcgccggcagtaccgctacaaaaactctggataagagacggcggttagaggaggaggctaaaaacaaagccgaggaggcaatggccacttatcggacgtgcgtggcagatgctaagacccagaagcaagagctcgaggatacaaaagtcacagctttgaggcagatacaggaagtcattcgacagtccgatcaaacaattaagtctgctaccatctcatactatcagatgatgcatatgcagactgcccctttacccgtgcacttccagatgctctgcgaaagctccaagctctacgatccaggtcagcagtacgcttctcacgtaagacagcttcagagggatcaggagcccgacgtgcactatgatttcgagccccacgtcagtgccaacgcctggagccccgttatgcgggcaaggaaaagcagctttaatgtgtccgacgtcgctaggcctgaggcagcaggctccccccccgaggaaggtgggtgcacggaggggacaccggccaaggatcatcgggcgggacgcggccaccaggtccacaagtcatggcccctctcaatttccgactccgattcgggcttggaccctggacctggggccggagattttaagaaattcgagcgcacctcatcttccgggaccatgagtagtaccgaggagctcgtcgatccagacggaggggctggcgctagtgccttcgagcaggcagacttgaacggcatgacgcctgagctgcccgtcgccgtaccttcaggcccattccgccacgaagggctgtctaaggctgctaggacgcacaggctgcggaagctgaggacccccgctaagtgcagggagtgcaacagctatgtctatttccagggggccgaatgcgaagagtgttgtctggcctgccataaaaaatgccttgagacactcgctatacaatgcggtcataagaaactccaggggcgccttcagctgttcggtcaggacttctctcatgccgccaggtccgctccagacggggtcccattcatcgtcaagaaatgtgtctgtgaaattgaaaggcgggcactgaggactaagggaatatatcgcgtgaacggtgtaaagacccgagtggagaagctgtgccaggcctttgaaaacggtaaggagctagtggagctcagccaggcctcaccacatgatatatccaatgttctgaagctgtacctgaggcaactaccagagccactgatttctttccggctctaccatgagctggtgggcctagcaaaggacagcttgaaagctgaagccgaagccaaggccgctagccgaggcagacaggatgggagcgagtcggaagcagtcgcggtcgcactggcaggtcgactgcgagaactgcttagggacctgccaccggaaaaccgcgcctctctgcagtatctgctgcggcatctacggaggattgtagaggtggagcaggacaacaaaatgactccaggaaatctcgggattgtgttcggaccaacactgctgaggccccgtcctacggaggcgactgtctcattgtcatctctggtcgactacccacaccaggcaagagtaatcgagactctgatcgtccattacggactcgtcttcgaggaggaaccggaagagacaccagggggtcaggatgaaagctcaaatcagcgcgccgaggtcgtagtccaggtgccgtatttggaagccggcgaggctgtggtctatccactgcaggaggcagccgccgacggatgtagggagagtcgagtggtatcaaatgactctgactccgacctggaggaggcatcagagctgctctcctcttctgaagcctcagcccttgggcatctgtctttcctggagcagcagcagagcgaggcctccctggaagtggccagcggctcccacagcgggtcggaggagcagctggaagctacggcgagggaagatggcgacggggacgaggacggacctgctcagcagctgtctggctttaacaccaatcagtccaacaacgtcctccaggcacccctcccccctatgagactcagggggggccgcatgacactcgggtcatgcagagagaggcagcccgaatttgtgtag

SEQ ID NO: 190747 - DNA, 3015 bp, Artificial Sequence
  Description of Artificial Sequence: Synthetic coding sequence
atgcaccagatcatcagcaagtaccccctgctgaacaccgtggagaccctcacagctgccggtacactcatcgcaaaagtcaaggccttccattatgagtcaaacaacgacctggaaaagcaagagtttgagaaggctctcgaaactatcgccgtagctttctcctcgaccgtaagcgaatttttgatgggagaggtggactcttctaccctattagccgttccccccggtgactcatcacaatctatggagagtctgtatggacctggcagtgagggcacgcctccttctctcgaggattgtgatgctgggtgcctccccgccgaggaggtggacgtcctgcttcagagatgcgagggtggggtcgatgctgcgctgctttacgctaagaatatggccaagtacatgaaggacctaatcagctatctggaaaaacgcaccaccctagaaatggaatttgcaaaaggcctgcaaaaaattgcccataactgccggcagtcggtgatgcaggagccccacatgccccttctgagcatctactctctggccctagagcaggacctggagttcggtcactctatggtgcaggcagtcggaacactgcagacccagaccttcatgcaacctttgacactccggcggctcgagcacgagaaacggcgaaaggagattaaggaagcttggcacagagcacagcgtaagttgcaagaggccgagagtaacctgagaaaagctaaacagggctacgtccagcggtgtgaggatcatgataaggcccgcttcttggttgctaaggccgaggaagaacaggccggatcagccccaggggctggaagcaccgcaaccaaaacgttagacaagagaaggagactggaggaggaggctaaaaacaaggccgaagaggccatggcaacttacagaacatgcgtggctgacgctaagactcagaagcaggaactcgaggacaccaaagttacggccctcaggcagatccaagaagttatccgccagtccgaccagaccataaagtcggccacaatctcgtattatcagatgatgcacatgcagaccgcaccgctgcccgtccacttccagatgctgtgcgaaagtagtaagctctatgatccaggccagcaatacgccagtcacgttcgtcaactccagagagaccaggagcctgatgttcattacgacttcgaacctcatgtctccgccaatgcttggtcacctgtcatgcgagctcggaaatcctcattcaatgtgagcgacgtggctcgtcctgaggccgcagggagtcctcctgaggaaggaggttgcacggagggcacgccagcaaaggaccacagaggtgagtgtccagctggtccccgtggcggtagatggctaccagcaacacatcccggaccatctcccgaaacacccctgagtccagccgggcgcggccaccaggtacataaatcatggcccctgtcgatctccgactctgacagcgggttagacccgggaccaggcgccggcgatttcaagaagtttgagcgaactagcagtagtgggaccatgtcttctaccgaagagttagttgaccctgatgggggggctggcgcctccgctttcgagcaagcagatttgaacgggatgacccccgagctgcccgtggcagtgccttcaggtcccttcaggcacgagggtctgagcaaggctgccagaacccataggctcagaaaactgcggacaccagctaagtgcagggagtgcaactcctatgtctactttcagggtgccgagtgcgaggagtgctgcctggcttgtcacaagaaatgcctagagacgctggcgatccagtgtgggcacaaaaagctccaaggccgcttgcagttgttcggacaggatttttcacatgctgcacggagtgctccagatggggtgccctttatagttaaaaaatgtgtttgtgagatcgaacggcgcgccctgcgtactaaaggaatttatcgcgtgaacggagttaagaccagagttgagaagctatgccaggccttcgaaaatggtaaggagctagtggagctgagccaggctagcccccacgatatatcaaatgttctaaaactgtacctgcggcaactgccggaacctctgatctccttcaggttatatcacgagctggtgggactggccaaggatagcctgaaggcggaagccgaggcaaaagccgcctcacgcgggaggcaagatggcagcgaatcagaagcagtggctgttgcacttgccggccggttaagagaactcctccgagatttgcccccggagaacagagcgtcgctgcagtacttgcttcgtcacctaaggcggatcgtggaagtcgagcaggacaataaaatgacgcccggcaatctcgggatcgtatttggccccacactattgcggccccgtcctaccgaggctaccgtgtctctcagctctctcgtcgattatccccatcaggctcgcgtgatcgagaccctgatcgtccattatgggctagtcttcgaggaagaacctgaagagacaccaggcggccaggacgagagctctaaccaaagggccgaagttgtggtgcaggtaccctacctggaggcaggagaggcagtggtgtatcccctccaggaagccgctgctgatggatgcagggagagcagagtcgtctccaacgactctgattccgacctagaagaggctagcgagttgctaagctccagcgaggctagcgcactaggtcacctttcctttctcgaacagcagcagagcgaagcaagcttggaggtggcttcaggatcccactcagggtctgaggagcaacttgaggccactgcgcgtgaagatggggacggtgacgaagatggcccagcccagcagttgagtggtttcaacacaaaccagagtaataacgtgctccaagctccgctgcctcccatgcgacttaggggaggacgtatgactctggggagctgtcgcgagcggcagcctgagtttgtgtag

SEQ ID NO: 190748 - DNA, 3459 bp, Artificial Sequence
  Description of Artificial Sequence: Synthetic coding sequence
atgagccggggccagcgggtgctgaagggcctgctgggctgggtgtgcacatggacctgggcctggagggcacggctgggagcaagaggttgcgggctgcatgttctctgcccaagagatttgccgctgccgccggaagaactgcctagaaaggatggagcagacgctgtgtttcccggcccttctctagagccacccgccggctccagcggagtgaaagcgacagggaccctaaaacggcccacctcattgagcaggcatgcgagcgctgccgggtttccgctcagtggcgcagctagttggacactggggcggtcccatcgatccccattaacagctgccagcccaggcgagttgcccaccgaaggcgctggtccggatgtcgtggaagacatttcgcatctactagccgacgtagcaagattcgccgaaggattggagaagcttaaggagtgtgtacttagggacgatctgctcgaagcacgaaggccgcgagctcatgaatgtttgggtgaggccttacgggtgatgcaccagatcatatctaaataccctctactcaacacagttgaaaccctcactgccgcaggaacattgatcgccaaagtgaaggccttccactacgaatcaaataacgacctggaaaagcaggaatttgagaaggctcttgagacaatagcggtggcctttagctccacagtttcagagtttctgatgggcgaagtcgattctagtacacttctggccgtgccacctggcgacagctcacaaagcatggagtccctctacgggccaggtagtgaggggacacctccgagcttggaagattgtgatgccgggtgcctcccagccgaagaagtggacgttctgctccagcgttgtgaggggggcgttgacgccgccctgctgtacgccaaaaatatggccaagtatatgaaagatcttatttcatatcttgagaagagaaccacgctcgaaatggagttcgcgaaaggacttcaaaaaattgcccacaattgccggcaatccgttatgcaggaacctcacatgcccctccttagcatctactccttagctctggaacaggatctggagttcgggcactccatggtgcaggccgtaggcaccctccagacacagacctttatgcagccactgaccttgaggcggcttgagcacgagaagcgccgaaaagagatcaaggaggcctggcatagggcccagcgcaagcttcaggaggccgaatccaaccttaggaaggccaaacagggctatgtccaaaggtgtgaagaccacgataaggccagattcctcgtggcaaaggctgaggaagagcaggccgggtctgcccccggagcaggatcaacagccactaagacgttagacaagcgccgacggctcgaggaagaagccaagaataaagccgaggaagcaatggccacctacagaacatgcgtggcggacgcaaaaacccaaaagcaggagctggaagatacaaaggtcaccgccttaaggcaaatccaggaagtcatcaggcagtccgaccagaccatcaaatccgctacaataagttattaccagatgatgcacatgcagacggcaccccttccggttcactttcagatgctctgtgagagtagcaagttgtatgacccaggtcagcagtatgccagccatgtgagacaactccagagggatcaagagcccgacgtccactatgacttcgagcctcatgtttccgctaatgcctggagtcccgtgatgcgggcccggaagtccagcttcaatgtctccgacgtggctcgacctgaggccgcaggaagtccacctgaggagggtggctgcaccgagggtacaccagctaaagatcatagagccggtcgcgggcaccaggtgcataaatcttggcccttgtcaatcagtgactccgatagcggcctggatcccgggccaggggccggcgattttaaaaagtttgagcgtacatcttcaagcggcactatgtcttcaactgaggagttagtggatccagatgggggggctggtgcttccgccttcgaacaggccgacttaaacggtatgacaccggaactgccagtggccgtcccaagcgggccatttaggcacgaaggcttgtcgaaagcagctcggacacatcggcttcgtaagctgaggactccagccaaatgcagagagtgcaactcatatgtttacttccagggagcagagtgcgaagagtgctgtttagcatgccacaagaagtgcctggagacgcttgcaattcagtgcggtcacaagaaactccaaggacgcctgcagcttttcggccaggattttagtcatgctgccagaagcgctccagatggggttccctttatcgtaaaaaaatgcgtgtgcgagatcgagaggcgcgcgctgcgaacaaagggcatctacagggttaatggcgtcaaaactcgcgttgagaagctttgccaggccttcgagaacgggaaggagctggtcgaactcagccaggcatctccacatgacatatcaaatgtgctgaaactctacctacgacagctccctgaaccactcatcagcttccgcctttaccacgagttagtgggtctggcgaaagactcattaaaggccgaggccgaagctaaagcagcctcaagaggaagacaagatgggtctgaatctgaagccgtggccgtggccctcgctggcagactgcgcgagctgcttagagatcttcctcccgagaatagggcttcattgcagtacctgttacgtcacctgcgaaggattgtggaggtcgagcaggataataaaatgaccccaggcaacctgggaatcgtgttcggccctacgctgctaaggcctcgaccaactgaggccaccgtgagcctgagtagcctcgtcgattatccacatcaagcaagagtgatagaaaccctgatagttcattacggtctggtgttcgaggaagagccagaggagacacctgggggacaggacgagtcctccaatcaacgcgcagaggtggtcgtgcaggtgccataccttgaagcaggcgaggccgtcgtttatccccttcaggaggcggccgctgacggatgtcgggaaagcagagtcgtgtcaaacgactcggatagcgaccttgaggaagcatcagagctgctgtccagcagcgaagcatctgcccttggccacctgagtttccttgaacagcagcaatccgaggcttctctggaggttgcatccgggtcgcacagcgggtcggaggaacagttagaagctacagctcgtgaggacggggacggagatgaggatggacccgctcagcagttatcaggtttcaataccaaccagtccaataatgtccttcaggcacctttaccccccatgcgtctgcgggggggcaggatgactctcggctcttgcagagaaagacaacccgaatttgtgtag

SEQ ID NO: 190749 - DNA, 3060 bp, Artificial Sequence
  Description of Artificial Sequence: Synthetic coding sequence
atgtgcatctgcggcaccgcccaccccgtgctggacgagggccccgtgaggtgtagggccggcccaagagacctacttgaggcccggcggccccgagctcacgagtgtcttggagaagcactgcgcgtaatgcaccagatcatctcgaagtaccccctcctgaatactgtggagactttgaccgctgccggaacactgattgcgaaagtgaaggcctttcactacgagtctaataatgatctagaaaaacaggagttcgaaaaggctttagagacaatcgccgtggccttctcctccaccgtgagcgagttcctgatgggagaggtcgacagctctaccctcctggccgtgccaccgggcgacagcagtcaatccatggaaagcctgtatgggcccgggagtgaaggcacccctccttcactcgaggattgcgatgccgggtgcctgccagctgaagaggtagatgtgctgctgcaacggtgtgaaggaggggtggacgccgctctgctgtatgctaagaacatggcaaagtatatgaaggatctcatctcatacctggagaaacgtacaaccttagaaatggagtttgctaaaggcctgcaaaaaatagcacacaattgtagacagtccgttatgcaggagccgcatatgcccctactgtctatatacagcctagctctggagcaggacctggagttcgggcacagcatggtgcaggcagtgggaaccctccagacacagacattcatgcagccattgaccctgagaaggttggaacacgaaaagcggaggaaagagataaaggaagcttggcacagggcgcaaaggaaactgcaagaggccgaatctaacctgcggaaggcaaagcagggatacgttcaacggtgcgaagaccacgataaggcacgcttcctagtagccaaagccgaggaagaacaggcagggtccgcccctggtgccggatccacagctacaaaaacgctcgataagcgacgaaggctggaggaggaggctaagaacaaagccgaagaagctatggccacatacagaacctgtgtggctgacgcgaaaacccaaaagcaggaactcgaagatactaaagtgaccgctctgcggcagatccaggaagtaatccggcagagtgaccagaccatcaagtcagcgacgatcagttactaccagatgatgcatatgcagactgcccctttgcctgttcatttccagatgctgtgcgaaagcagcaaactgtacgaccctggtcagcagtacgcttctcacgtccggcagctgcagagagaccaggagcctgacgtgcactacgacttcgaacctcacgtcagtgccaacgcttggtcccctgtgatgcgggcccggaaatctagctttaacgtgagcgacgtggcacgcccagaggctgcaggttcaccaccggaagaagggggttgcacagagggcactcctgctaaggatcaccgagccggccgtggtcaccaggtgcacaaaagctggccactcagcatcagcgactccgattccggcctggacccaggccccggagctggcgactttaagaagtttgagcgaacatccagcagcggcaccatgtctagcacggaagaactggtagatcccgacggcggagcaggagcaagcgctttcgagcaagccgacctgaacggaatgacaccagaactgccagtcgccgtgccaagcggtcctttccgacatgaagggctgagcaaagccgctaggacacaccgactgcgcaaactgaggaccccagccaaatgcagggagtgtaactcatacgtgtactttcagggtgccgagtgcgaagaatgctgtttggcttgccacaaaaagtgcctagaaacactggccattcagtgtggacacaagaagttgcaagggcgcctacagttgttcgggcaagatttcagccacgccgcccggagcgcacccgatggcgtacccttcattgtgaagaaatgcgtgtgtgagatcgaacgtagagccctgcggacgaagggaatctaccgagtgaacggagtgaaaacacgagttgagaaactatgtcaggcttttgagaacggtaaggagctcgtcgagctttcacaggcttctccacacgatatctccaatgttctgaagttgtacctgagacagctaccagagcctctcatcagtttcaggctgtaccacgaactggtgggcttagccaaggactcactgaaagctgaggccgaggcaaaagcagcttctaggggtcgtcaggacgggtctgagtctgaggccgtcgccgtggcattggccggacggctgagggaattgctgcgcgacttgccgccagaaaatcgggcatctctgcaatatcttctccgccacctgcgacggatcgttgaggtggagcaggataataaaatgacaccaggaaacttggggattgtgttcgggccaaccctgctgcgtccgcgtccaactgaggccactgtctctctgagttctctagtggactacccccatcaggcccgggtgatcgagaccctgatagtgcattacggtctggtgtttgaagaagagcctgaggagacacccggcggccaagatgaaagcagcaaccagcgggctgaggtcgttgtgcaggtaccttacctggaagccggagaggctgtggtgtaccccctccaggaggcagctgccgatgggtgccgcgaatcccgagtggtttcaaacgactcagacagtgatctggaggaggcctccgaactgttatcttcttctgaagcctcagcccttggacatctctcgttcctcgagcagcagcagtcagaggctagcttggaggtggccagcggctcacacagtggctctgaggagcagcttgaggcaaccgcaagggaagacggcgatggcgacgaggatgggccggctcagcagctgtcaggttttaataccaaccagagcaataacgtgctccaggctccgcttcctccaatgcgactgcggggtggtcgaatgacactgggcagttgtcgagagcggcagcccgaatttgtttag

SEQ ID NO: 190750 - DNA, 2847 bp, Artificial Sequence
  Description of Artificial Sequence: Synthetic coding sequence
atgttcagccggaagaagcgggagctgatgaagacccccagcatctccaagaagaaccgagccggaagcccctcacctcagccaagtggggagttgcctaggaaagacggggccgacgctgtctttcccggtccgagcctggaacccccagccggatcctcaggcgtgaaggctacagggacgttgaaaaggccaacctctctgtctagacatgcttctgccgctgggttcccactgtctggggccgcttcttggacgctgggcaggagtcataggagccctcttacagcggcgtctcccggagaactgcccactgaaggagcaggacccgacgttgtcgaagacatctcccacctgctggccgatgtcgctagatttgctgagggcctcgagaagctaaaggagtgcgttctaagagacgacctgctggaggcgcgtcgccctcgcgcccacgagtgtttaggagaggctctgcgcgtcatgcaccagatcatctcgaaatatcccttgctgaacacagtggaaactctgaccgcagcaggaacgcttattgctaaagtgaaggctttccactacgagagcaacaatgaccttgaaaaacaggaatttgagaaggctctggagaccattgccgtggccttttcgtcgactgtgagtgagtttttaatgggagaggttgattctagcactctgcttgcggttccaccgggagacagctcccagagtatggagtctctgtatggccctgggagcgagggcacccctccatctctcgaggactgcgacgcagggtgcctgccagctgaggaggtggatgtgctactgcaaagatgcgagggcggagtggatgcagctctcctgtatgctaaaaatatggccaaatacatgaaggacctgatcagctatctggagaagagaacaaccttggagatggagttcgccaagggcctgcagaagatcgctcacaattgtcgacaatctgtgatgcaggaaccccatatgcctcttctttctatctatagcctggccctggaacaggacctggaattcggccactccatggtgcaggctgtgggtacgttacagacccagacattcatgcagccgcttactctgagacggcttgaacacgagaaaagaagaaaggaaattaaggaggcttggcacagagcgcagcgcaaactgcaagaggccgagtccaacctgcggaaagccaagcagggttacgtgcaaaggtgcgaggatcatgacaaagcaaggttcctcgtagccaaggccgaggaagagcaagcaggctccgctcctggggccggctccactgccaccaaaaccctagataaacgccggagactggaggaggaagcgaagaataaggccgaagaggccatggcaacgtatagaacctgcgtggccgacgcaaaaacacagaaacaggaactggaggacacgaaggtgacagctctacgtcagattcaagaagttatccgccagagtgatcagactatcaaatctgctaccatctcatactatcagatgatgcacatgcagaccgcaccattaccagttcactttcagatgttgtgcgagtcctccaagttatatgatcccggacagcaatatgcttcgcatgtgcggcagctgcagagggatcaagagcctgatgtccactacgactttgaaccacatgtgagtgccaatgcatggtcccccgtgatgagggcccgcaaatcaagctttaacgtgagcgacgtggcccgtccagaggccgcaggctcgcccccggaggagggcgggtgtaccgaggggactcctgcgaaagaccacagagctggtcggggacatcaggtgcacaaatcatggcccttgagtatcagcgattctgatagcgggctggacccaggtcccggcgctggcgatttcaagaagttcgagaggacttcctcttcgggcactatgagctctactgaagaactagtggatcctgacggaggagcgggggcgtctgcctttgagcaggcagaccttaacgggatgactccggagctgccagtagccgtgccaagcggcccctttcggcacgagggattgtctaaagctgcacgcacccatcgactgcgtaagctcaggacgcccgcaaaatgtcgcgaatgtaactcatacgtttatttccagggtgcagagtgcgaagagtgctgcctggcttgtcataaaaagtgtttggagacactggcaatacagtgcggccacaagaaactccagggcaggctgcagttgtttggtcaagacttcagtcacgctgccaggagtgcgcctgacggcgtgcccttcattgtcaaaaaatgtgtgtgtgagatcgagaggcgcgctctccggacaaagggcatctaccgggtgaacggggttaagactcgggtggagaagctttgtcaggcttttgaaaatggaaaggagctggtcgagctgtctcaggccagcccgcacgacatttcaaacgttctcaagttatacttaagacagcttccagagcccctgataagctttagactgtatcacgaactggtagggctcgcgaaagactctctgaaggccgaagccgaagctaaagcagcttctagaggccggcaggatggttccgagagcgaggcagtcgctgtcgcactggccggccgcttgagagagctgctgcgtgatctcccccccgagaaccgggcctcccttcagtatctcctccgccacctgcggagaatagtagaagtcgaacaggataataaaatgacccccatgaggctcagggggggcagaatgacgctgggctcttgtcgcgagaggcagcctgaattcgtatag

SEQ ID NO: 190751 - DNA, 3492 bp, Artificial Sequence
  Description of Artificial Sequence: Synthetic coding sequence
atgttcagccggaagaagcgggagctgatgaagacccccagcatctcgaagaaaaacagagctggtagtccaagtccgcagccctcaggaccacattttatctctggagagacggaggcagtctcccgtcctgaaaatcctttcaacgagctccccagcgacctccccaaggaacttccacggaaagacggagctgacgctgtcttccccggtccaagcctagagcctccagcgggatcttctggggtgaaggctacagggactctcaagaggccaacctctctttctagacatgcctccgcggctggattccctttaagcggagccgcttcatggaccctgggccgcagccaccgctcccctctcacggccgcctcacccggtgaactacctaccgagggcgctggccctgacgtggttgaggatatcagccacctgctggctgacgtcgctaggttcgccgagggactggagaaattgaaagagtgtgtgctccgcgacgacctgcttgaggctcgaagacccagggcccatgagtgtctcggcgaagcgctacgcgtgatgcaccaaattatctcaaaatacccactcctgaatacagtggaaactttaactgccgcaggaacactgattgctaaggtcaaagccttccactacgaaagtaataatgatttggagaagcaggagttcgagaaggcgctcgagactatagccgtcgcgttctcttcaactgtctccgaattcttaatgggcgaggtcgactccagtaccctgctggctgtcccgcccggcgacagctcccagagtatggagtccctctatggtcccgggagtgaaggaacaccaccttccttagaagattgtgatgctgggtgccttccggccgaggaggtagacgtcttgctccaaagatgtgagggaggagtggacgccgcgctgttgtacgctaagaatatggccaaatacatgaaagatctgattagctacttggaaaagcgcacgactttggaaatggaattcgccaaaggcctgcagaagatcgcccacaactgccggcagtcggtaatgcaagaaccgcacatgccgctcttgagtatttacagcctggccttagaacaagacctggaatttggccactccatggtgcaggcagtcggcacactgcagacacaaacgtttatgcagccactgaccctgagacggcttgagcacgagaaacgtcgcaaggagatcaaagaggcatggcaccgggcccagaggaagctacaggaggctgaatccaatttacgcaaggcgaaacaaggctacgtacaacggtgcgaagaccacgacaaggcgcgcttcctcgtggcaaaggccgaagaggaacaggcggggtcggccccgggagcgggctcaactgccacaaagaccctcgataagagacgtcggctggaagaggaagctaagaacaaagccgaagaggccatggcgacctaccgtacttgcgtggcagatgccaagacacaaaagcaggagctggaagacactaaagtgactgctctgcgccagattcaggaggtgattagacagtcggaccagacgattaaatccgccacaatctcatattaccagatgatgcacatgcagacagccccgttacctgtgcattttcaaatgttatgcgaaagtagcaaattgtacgacccaggacagcagtatgctagtcacgtccgccaattgcaaagagaccaagagcccgacgttcactacgacttcgaaccccacgtgtcggccaatgcttggtcaccagtgatgcgcgccagaaagtccagctttaacgtttccgatgtggcgcgccctgaggccgctggcagccccccggaggaagggggctgtacagagggaactcctgccaaggaccacagagctggcaggggacatcaagtgcataagagctggcccctctcgatctcagatagcgactctggactagacccaggcccgggcgccggggacttcaaaaagtttgaacggacaagctcttctggaacaatgagtagcaccgaagaattggtcgatcccgatgggggagctggagcctcagccttcgagcaggccgatctgaacgggatgacgcctgagttgccggtagccgtgccgtcagggccctttaggcatgagggactgtccaaagcagccaggacacaccgccttcgcaaattgcggacaccagctaagtgtagggagtgtaacagctacgtgtatttccagggcgctgaatgcgaagaatgttgtttagcatgccataaaaagtgtctcgaaacactggcgattcaatgtgggcacaaaaagttacagggacgattacagcttttcggacaggacttctcgcacgctgccaggtctgccccagacggtgtaccattcattgtgaaaaaatgcgtctgcgaaatcgaacgcagagccttgcggactaagggcatctaccgggtgaacggagtcaagactagagtcgaaaagctgtgtcaggcctttgaaaatggcaaggaactggtggaactttcacaagctagccctcacgacataagcaacgtgcttaagctttatctccggcagctgcccgaaccactgatttcctttcggctgtaccatgagctggttgggctagccaaagactccctgaaagccgaagccgaggctaaggcggcaagccgcggtaggcaagacggcagcgaaagcgaagctgtggctgtagctctggctggccgcttgcgtgaattgctcagggacctgcccccggagaatcgagcatccttacaatacctcttaagacaccttaggcgtattgtggaggtagaacaagacaataagatgacgcctgggaatctgggcatcgtgttcgggcccacactcctgaggccgcggccaacggaagccactgtgagtctatcatctcttgtggactatccccaccaagcacgggtgatcgaaacgttgatagtgcattatgggcttgtcttcgaagaggaaccagaggagacaccggggggccaggacgaaagcagcaatcagcgggccgaggtggtggtgcaggttccttacttggaggcaggggaggctgttgtgtaccccttacaggaggcggccgctgacggttgtcgtgaatcccgtgtggtcagtaatgattccgactctgacttagaagaggcctcagagcttctatcttcttctgaagcaagcgcgctgggacatctttctttcttggaacagcagcagtccgaggcgtctttagaagtcgcctctggctcgcacagcggctctgaggagcagttggaagccactgcacgcgaggacggggatggggatgaggatggacctgctcaacagctgtcaggttttaatacaaatcagtctaacaatgtcttgcaggccccactaccacccatgaggctgcggggcggacggatgactttagggtcctgcagagagagacagcctgagttcgtgtag

SEQ ID NO: 190752 - DNA, 420 bp, Artificial Sequence
  Description of Artificial Sequence: Synthetic coding sequence
atgagcatcagcagcgccctggccatggtgttcatgggcgccaaggggaacacagcagcacagatgagtcaagcgctctgttttagtaaaatcggcggcgaagacggcgatattcatcggggattccaatccctactggttgctattaatcgaacagataccgaatacgtgctgcggactgcaaatgggctctttggcgaaaaatcatatgatttcctaaccggtttcactgactcttgtggcaaattttaccaggccactatcaaacagctcgacttcgtaaatgataccgaaaaatcaacaacaagagtgaatagttgggtggcggataagacaaagggagagaacattttacttttctactttgacaatattctgaattccttcatcgtatcgagtctccaaaactgtcaaatatag

SEQ ID NO: 190753 - DNA, 162 bp, Artificial Sequence
  Description of Artificial Sequence: Synthetic coding sequence
atggagatcttcatcgaggtgttcagccacttcctgctgcagctgacagagctaaccttgaacatgtgcttagaattgcctactggatctctggagaagtccctcatgatctccagtcaagtactccaaatacccgtcgcaaactcaaccaagcaacgctag

SEQ ID NO: 190754 - DNA, 648 bp, Artificial Sequence
  Description of Artificial Sequence: Synthetic coding sequence
atgagcgagaccgtgccccccgcccccgccgccagcgccgcccccgagaagcccctggcagggaagaaagccaaaaaacctgcaaaggccgccgccgccagtaagaaaaagccggccggtccatcagtcagtgaactgatcgtgcaagctgcctcctccagtaaagaaaggggtggtgtgtctcttgccgcccttaaaaaggccctggccgctgccggttacgacgtcgaaaagaacaattcccgaataaaactcggcattaaatccttggtgtcaaaggggacactggttcagacgaaagggaccggagcatccggttcctttaaactgaacaaaaaagctagttccgtagagaccaagcctggagcgtccaaagttgctaccaaaaccaaggctaccggagcgagtaagaaactgaaaaaagccactggtgcctctaaaaagtctgtaaaaacccctaagaaagctaaaaaacccgctgcgactcgaaagagctcaaagaatccgaagaagccaaagaccgttaaacccaagaaggtggcaaaatccccagccaaagccaaagctgtcaagccgaaggcggcaaaagctagagtaactaaaccgaaaactgccaaacctaagaaagctgcgcccaagaaaaagtag

SEQ ID NO: 190755 - DNA, 681 bp, Artificial Sequence
  Description of Artificial Sequence: Synthetic coding sequence
atgagcgagaccgcccccgccgagaccgccacccccgcccccgtggagaagagtcctgccaagaagaaggccacaaagaaagccgctggcgccggagctgcaaagcggaaagctaccggcccccctgtgagtgagttaatcaccaaagctgtcgccgcatctaaagaaaggaatggcttgtctctggcggctctaaagaaagctctcgctgcaggaggctatgacgtggagaagaacaactccagaattaaactgggtctgaaatctctggtgtcgaaaggtactttagtccagactaagggcacaggagcttcaggtagttttaaattaaacaagaaagcggcttcaggggaggccaaaccgaaagccaagaaagcgggggccgcaaaagctaaaaaaccagccggcgccacaccaaaaaaggccaagaaggctgcgggtgccaagaaagctgtgaagaaaacacccaaaaaagccaaaaagcctgccgccgcaggagtcaagaaggtagccaagagccccaagaaggctaaggcggccgccaaacccaagaaggcaaccaaaagccccgctaagcccaaagcagtcaagccaaaagcggccaaacctaaagccgcgaagccgaaggcagccaagcccaaagctgccaaggccaagaaggctgcagccaagaagaaatag

SEQ ID NO: 190756 - DNA, 642 bp, Artificial Sequence
  Description of Artificial Sequence: Synthetic coding sequence
atgagcgagaccgcccccgccgcccccgccgccgccccccccgccgagaaagcgcccgtcaagaaaaaggccgctaaaaaagccgggggaacaccccgcaaggccagcggccccccagtgagcgagctcatcacaaaggccgtggccgccagcaaggagaggagcggggtatctctggcagccctcaagaaagcattggccgctgccggctatgatgtggagaaaaacaattcgcggattaagctggggctgaaatccttggtctcaaaaggtacactggttcagactaagggcaccggggcttccggctccttcaagttgaataaaaaggctgcgtcaggcgaagctaagccaaaggtcaagaaagcaggtggcactaagcctaagaaaccagtgggtgccgcaaaaaaacccaagaaagccgcaggaggagctacacctaagaaatcagccaagaagactcccaagaaagccaaaaagccagcagccgctacagtcactaaaaaggtggcgaagtcaccaaagaaagcgaaggttgcaaagcccaagaaggctgcaaagagcgccgccaaagccgtgaaacctaaggcagcaaaaccaaaagtcgtcaagcccaaaaaagccgctccaaaaaagaagtag

SEQ ID NO: 190757 - DNA, 666 bp, Artificial Sequence
  Description of Artificial Sequence: Synthetic coding sequence
atgagcgagaccgcccccctggcccccaccatccccgcccccgccgagaagacaccagtcaaaaaaaaagcaaaaaaggcgggagcaaccgccggaaagagaaaagccagtgggcccccggtgtccgagctcatcactaaagcagtcgccgcctcaaaggagcggagcggcgtttccctggcagcactgaaaaaggccttggccgccgccggttacgatgtggagaaaaacaactccaggataaaacttggactaaaaagcctggtgagcaagggtactctcgtccagactaaagggactggggcttccgggtcttttaaacttaataaaaaagccgctagcggtgaggggaaaccgaaggccaagaaggcgggcgccgctaaaccgcgcaaacccgcaggcgctgcgaagaaacctaagaaggtggcaggcgcagcaacacccaagaagagtattaagaaaactccgaagaaggttaagaagcctgcgactgccgccggtactaagaaggttgccaaatccgccaagaaagtaaaaaccccccaacctaagaaagctgcgaagagccccgccaaggcaaaggcacctaagcctaaggcagctaagcctaagtctggtaaaccaaaggtgaccaaggccaagaaggctgctcccaagaagaagtag

SEQ ID NO: 190758 - DNA, 660 bp, Artificial Sequence
  Description of Artificial Sequence: Synthetic coding sequence
atgagcgagaccgcccccgccgcccccgccgcccccgcccccgccgagaaaacaccggtgaagaagaaggcccggaaatcagctggtgccgccaagcggaaggcaagcggcccccctgtgtccgaactgatcactaaagcagtcgcggcttctaaggaacgaagcggcgtttccctggccgctcttaaaaaggctttggccgctgcaggctacgacgtcgagaaaaacaactctcggatcaagctgggcctgaagagcctagtgagcaagggcacattggtgcagactaagggaacaggggcgtcaggttcctttaaattaaacaagaaggcggccagcggcgaagctaaacccaaagctaaaaaggcaggagctgccaaggccaagaaacctgctggagcggccaagaaacccaaaaaagctaccggggcagctaccccgaagaagagcgccaaaaaaacacccaagaaagccaaaaagcccgccgctgcagctggggccaagaaagcgaagtcccctaaaaaagcgaaggctgctaagccaaaaaaagcccccaagagccctgcgaaggcaaaggctgtcaagccaaaggcagctaaacccaagacagcaaaaccaaaggccgcaaagcctaagaaggctgccgcaaagaagaaatag

SEQ ID NO: 190759 - DNA, 624 bp, Artificial Sequence
  Description of Artificial Sequence: Synthetic coding sequence
atgagcgagaccgtgcccgccgccagcgccagcgccggcgtggccgccatggaaaagctgcctaccaaaaaaaggggccgaaaacctgccggcttgattagcgcctctcgaaaggtgcccaaccttagtgtgagcaagctgatcacagaggccttatccgtatcccaagaacgggtcggcatgtccttagtcgctttgaagaaggcactcgcagctgccggttatgacgtggagaaaaacaactcaaggatcaaactctcccttaagagcctagtaaataagggcatcttggtgcagactagggggacaggagcgagtggttctttcaagctcagcaagaaggtgattcccaaatcaacacgatccaaagcaaagaaaagcgtgtccgctaagacaaagaagctggtgcttagccgtgactccaaatccccaaaaacggccaagactaataaacgcgctaaaaaaccaagggctacgacgcccaagactgtgcgcagcggtcggaaggcaaagggggccaagggcaagcagcagcagaagagtccagtcaaagcccgagcctccaagtctaaacttacacagcaccatgaagtgaatgtgcgcaaggcaacctccaaaaaatag

SEQ ID NO: 190760 - DNA, 393 bp, Artificial Sequence
  Description of Artificial Sequence: Synthetic coding sequence
atgagcggccggggcaagcagggcggcaaggcccgggccaaggccaagacaagatcatcaagagccggattgcagtttccagtggggagggtgcacagactacttaggaagggaaactatagcgagcgggtaggagccggagctcccgtatatttggcggccgtcttggagtacctgaccgcagaaattctcgaactggccgggaatgccgcaagagataataaaaaaactcgcatcataccgagacatttgcaactagccatcaggaacgatgaagagctgaataagcttctgggtcgcgtgaccattgctcaaggaggcgttctccctaatatacaagcggttctactgcctaagaagaccgaatcccaccacaaagcaaaaggtaagtag

SEQ ID NO: 190761 - DNA, 393 bp, Artificial Sequence
  Description of Artificial Sequence: Synthetic coding sequence
atgagcggccggggcaagcagggcggcaaggcccgggccaaggccaagtccagaagttcccgagctggcctgcagtttccggttgggcgagtgcacaggctcctgcggaaagggaactacgccgagcgtgtcggtgcgggtgcccccgtgtatctggccgctgtgttagaatatctgacagcagagatattggagttggctggcaacgcagcccgggacaataagaaaacaagaatcatcccacgtcaccttcagctagcaataagaaatgatgaagagctaaacaagcttctgggtcgcgtcacaatcgcccagggtggagtgctgccaaacatccaggccgtactgctccccaaaaaaacagagtctcatcataaggcaaagggaaaatag

SEQ ID NO: 190762 - DNA, 393 bp, Artificial Sequence
  Description of Artificial Sequence: Synthetic coding sequence
atgagcggccggggcaagcagggcggcaaggcccgggccaaggccaagagtcgctcgtcacgcgctgggctacagttccctgtcggtagagtgcatagattattgagaaaagggaattatgctgagcgagtgggggccggagcacctgtgtatttggcagccgtgctggagtacctgacagcagagatcttagagctcgctggtaacgcggctagagataacaagaaaacaaggatcatccccaggcacctccaactcgcaatccgaaacgatgaagagctgaataagttgttagggcgcgtgaccattgcccagggtggcgtcctaccaaacattcaggccgttctgcttcctaagaaaactgagtctcaccataaggccaagggcaagtag

SEQ ID NO: 190763 - DNA, 393 bp, Artificial Sequence
  Description of Artificial Sequence: Synthetic coding sequence
atgagcggccggggcaagcagggcggcaaggcccgggccaaggccaagacgcgatcatccagagccggcctccagttccccgttggaagggtacatcgcctgttgcgtaaagggaattacagcgaaagggtcggcgcaggcgcgcccgtctacttagccgccgtgctggagtacttgacagccgagatcctcgaactcgctggcaatgccgctcgcgacaataagaagacccgcatcatcccccgtcacctgcagttagcaatcaggaacgatgaagagctgaataagctgctaggcaaggtaaccatagctcagggcggtgtgcttccaaacatacaagccgtcctgttgcctaagaaaaccgaaagtcaccacaaggctaaggggaaatag

SEQ ID NO: 190764 - DNA, 393 bp, Artificial Sequence
  Description of Artificial Sequence: Synthetic coding sequence
atgagcggccggggcaagcagggcggcaaggcccgggccaaggccaagaccaggagctctcgtgctggactacagttccccgtgggtagggtgcaccgtttactccgaaagggaaactattctgaaagggtgggggccggagcgccagtgtatctcgccgcagtcctggagtacctgacagcggagattctcgaattggcaggaaatgcggcaagagacaacaaaaaaactaggattattccccgacatctgcaactcgccattcggaacgacgaggagctgaacaagctgctggggagagtgactattgctcaaggcggcgtgttgcccaatatacaggctgtgctcttacccaaaaagacggagtcacaccacaaagccaaggggaaatag

SEQ ID NO: 190765 - DNA, 393 bp, Artificial Sequence
  Description of Artificial Sequence: Synthetic coding sequence
atgagcggccggggcaagcagggcggcaaggcccgggccaaggccaagacaagatcatctagggccggactgcagttcccagtgggacgggtccaccggctgttaagaaagggcaattatgccgagagagtcggtgccggcgccccagtgtacttagcagccgtattggaatatttaactgctgagattctggaactcgcgggcaatgccgcacgggataataagaagacgaggatcatacccaggcacctgcagttggccatacggaacgacgaggaactaaataagctcctcggaaaagtgactatcgcccagggaggggtgcttcctaatatccaagcagtactgctcccgaagaagactgaaagtcatcacaaggcgaagggcaagtag

SEQ ID NO: 190766 - DNA, 387 bp, Artificial Sequence
  Description of Artificial Sequence: Synthetic coding sequence
atgagcggccggggcaagcagggcggcaaggcccgggccaaggccaaaacccgatcctcacgggcaggcctgcagtttcctgtggggcgcgtgcatcggctcctcaggaaggggaactacgccgagagggtgggagccggggccccagtgtacttggctgcagtgctcgaatacctgactgccgagatcctggaacttgccggcaacgcggcacgagataacaaaaagactaggataatcccccgccatctgcagctggccatacggaatgacgaggagttaaacaagctgttgggcaaagtgacgatcgcccagggtggcgtgcttccgaacatacaggccgtgctactccctaagaagactgagtcacaccacaaaactaagtag

SEQ ID NO: 190767 - DNA, 393 bp, Artificial Sequence
  Description of Artificial Sequence: Synthetic coding sequence
atgagcggccggggcaagcagggcggcaaggcccgggccaaggccaaaacgcggtcctcccgcgcgggtttgcagtttcccgtgggacgcgttcacagattattacgaaaaggtaactacgccgagcgggttggggcaggcgctccagtgtacctggccgcagtcctggagtatctaaccgccgaaattttagagctggccggcaacgccgcacgggataacaagaagaccaggatcattccaaggcaccttcaacttgcgatccggaacgacgaggaattaaataagctactcggcaaggtgactattgctcaaggcggcgtccttccaaatatccaggcagtgctcttgcctaaaaaaaccgaaagtcaccataaggctaaggggaagtag

SEQ ID NO: 190768 - DNA, 393 bp, Artificial Sequence
  Description of Artificial Sequence: Synthetic coding sequence
atgagcggccggggcaagcagggcggcaaggcccgggccaaggccaagacaagatctagccgggccgggctgcaattccctgtgggaagagtccaccgcctgctgagaaaaggcaactacgccgaacgcgtgggcgccggagccccggtgtacctggccgccgtgctggaatacctgaccgcagagatcctggaattagctggaaatgccgccagggataataaaaaaacccgcattatccctcgccacttgcagctggccatcaggaatgatgaggagctgaataaattgctcggaaaggtaaccatagcccagggtggggtgttaccaaacattcaggctgttctgctcccaaagaaaacagaatcccaccataaggctaagggaaagtag

SEQ ID NO: 190769 - DNA, 393 bp, Artificial Sequence
  Description of Artificial Sequence: Synthetic coding sequence
atgagcggccggggcaagcagggcggcaaggcccgggccaaggccaagacccgcagtagtcgtgctgggctgcagttccccgttggacgggtgcacagattgctgcgaaaagggaattacgcagagagagtgggagccggcgcgccggtatatctcgcagcggtccttgaatacctaacggctgaaatactggagctggctgggaatgccgccagggacaacaagaaaactcgcatcatacctagacacctgcagctcgctatcagaaatgacgaagaattaaacaaacttctgggaaaggttacaattgcccaaggaggggtgcttccaaacatccaagctgtcttgctacccaagaagaccgaaagccatcacaaagccaagggcaaatag

SEQ ID NO: 190770 - DNA, 384 bp, Artificial Sequence
  Description of Artificial Sequence: Synthetic coding sequence
atgcccgaggtgagcagcaagggcgccaccatcagcaagaagggctttaagaaggcagttgtgaaaacacaaaagaaagagggaaaaaaaagaaagagaacccgcaaggaatcctattctatctacatctataaggtgttgaaacaggtccaccccgataccggtattagctccaaagccatgtccataatgaatagtttcgttacagacatattcgagagaatcgcgagcgaagccagccgactcgcccactactccaagcgcagtaccatatcctcacgagaaatccaaacagccgtgcgacttctgctgcctggagaactagccaagcacgctgtctccgaggggacaaaggctgttacaaaatacacatccagtaagtag

SEQ ID NO: 190771 - DNA, 381 bp, Artificial Sequence
  Description of Artificial Sequence: Synthetic coding sequence
atgcccgagcccagcaagagcgcccccgcccccaagaagggcagcaagaaggcgattaccaaggctcagaagaaggatgggaagaagcgcaagagatctagaaaagagtcatattctatttacgtatacaaggtcctaaaacaggtgcacccagatacaggaatcagtagtaaggccatgggcattatgaacagcttcgtgaatgacatcttcgaaagaatcgccggagaagcttctagactcgcccactacaacaaacgcagcactatcacctcacgagaaatacagacagccgtccggctgctgctccccggggaattggccaagcacgccgtgagcgaaggcacaaaagctgttacaaagtatacgtccagtaagtag

SEQ ID NO: 190772 - DNA, 381 bp, Artificial Sequence
  Description of Artificial Sequence: Synthetic coding sequence
atgcccgagcccgccaagagcgcccccgcccccaagaagggcagcaaaaaggcggttactaaagcccagaagaaggacggcaagaagaggaaacgctcccgcaaagagagttattccgtatatgtgtacaaggtgctgaaacaggttcatcccgacaccggcatcagttccaaggctatgggtattatgaattcctttgtgaatgacatcttcgagagaatcgcgggagaagcttctcggttagcacattataacaaaaggtcaaccatcacctctagagagattcagaccgctgtcaggctgctgctgcccggagagcttgccaaacatgctgtatccgaaggcaccaaggccgttacaaaatatactagctccaagtag

SEQ ID NO: 190773 - DNA, 381 bp, Artificial Sequence
  Description of Artificial Sequence: Synthetic coding sequence
atgcccgagcccgccaagagcgcccccgcccccaagaagggcagcaaaaaagcagtgaccaaggctcagaaaaaggacggcaagaagcgtaagaggagccggaaggagtcgtactctgtgtatgtgtacaaagtactgaagcaggtccatcccgacaccgggatcagcagcaaagcgatgggcataatgaacagttttgttaacgatattttcgaacggatcgctggtgaggctagccgattggctcattacaacaaacgctctactatcacctcgcgcgaaatacagacagcagtccgcctcttactaccaggagagctcgctaagcatgctgtttccgaaggcactaaggccgttactaagtacacatccagcaagtag

SEQ ID NO: 190774 - DNA, 381 bp, Artificial Sequence
  Description of Artificial Sequence: Synthetic coding sequence
atgcccgagcccaccaagagcgcccccgcccccaagaagggcagcaaaaaagctgtaactaaggctcaaaagaaggacggaaagaagcggaaacgcagccgtaaggaatcttatagtgtatatgtttacaaagtgttgaaacaagtgcatcctgatacagggatcagctccaaagctatgggaatcatgaactcttttgtgaatgatatatttgaacgtattgcaggcgaggccagccggctggcgcactacaataagcgcagtacgattaccagtcgcgagatacagaccgccgttcgcctcttactccccggcgagctggccaagcatgctgtgagcgaaggcacaaaggctgtcactaagtacaccagctctaaatag

SEQ ID NO: 190775 - DNA, 381 bp, Artificial Sequence
  Description of Artificial Sequence: Synthetic coding sequence
atgcccgagcccaccaagagcgcccccgcccccaagaagggcagcaagaaggctgtcaccaaggctcagaagaaagacggtaaaaagcggaagcgttcccggaaggagtcttacagcgtctatgtatacaaggtcttaaaacaagtgcaccccgacacggggatatcaagcaaagcaatgggaattatgaatagcttcgtgaatgatatattcgaaaggattgccggtgaagcgagcagactagcccactacaacaagagatctaccatcacttcaagagagatccaaacagcagtgaggctgctgctgccgggcgagctcgctaaacatgccgtgtccgagggtacaaaggccgtgacaaaatacacctccagtaagtag

SEQ ID NO: 190776 - DNA, 381 bp, Artificial Sequence
  Description of Artificial Sequence: Synthetic coding sequence
atgcccgagcccgccaagagcgcccccgcccccaagaagggcagcaagaaggccgtgactaaggcccaaaagaaggatgggaaaaaacgaaaacggagccgcaaagagagttatagtgtgtacgtgtacaaggtgctgaaacaagtgcacccagacactggcatttcttccaaggcaatgggcattatgaattctttcgtgaacgacatatttgagagaattgccggtgaggctagccgcctcgcccattacaacaagagaagcactataacgtcccgggaaattcagaccgccgtcaggctcttactccccggagagctcgccaaacacgcagtaagcgagggcactaaggccgtgacaaagtacacatcgagcaagtag

SEQ ID NO: 190777 - DNA, 381 bp, Artificial Sequence
  Description of Artificial Sequence: Synthetic coding sequence
atgcccgagcccgccaagagcgcccccgcccccaagaagggcagcaaaaaggctgttacgaaagctcagaaaaaagacggtaagaagcgtaaaaggtctcgcaaggagtcctatagcgtgtacgtgtacaaagttctgaaacaggttcatcccgataccggcatcagctccaaggcgatggggattatgaattctttcgtgaacgatatattcgaacgcattgccggtgaggcttccaggctcgctcactacaacaagagatccacaattacctcaagggagattcagacagccgtcaggctcctgcttcccggggaactagccaaacacgctgtgtctgagggcacaaaggctgttacaaagtataccagcagtaaatag

SEQ ID NO: 190778 - DNA, 381 bp, Artificial Sequence
  Description of Artificial Sequence: Synthetic coding sequence
atgcccgagcccgccaagagcgcccccgcccccaagaagggcagcaaaaaagctgttacaaaagctcagaagaaagatggaaagaaaaggaaacggtctcgcaaggaaagttactctgtgtatgtgtacaaggtattgaagcaggtgcatccagatacaggcatcagctcaaaagcgatgggcattatgaattcctttgtcaatgacatcttcgaaagaatagccggggaggcatctcgcttagctcactataataaacggtcaacaataaccagtagagagatacagaccgcagtgaggctcctgttaccaggggaactggctaagcacgcagtctcggagggcaccaaggctgttacaaagtacactagcagcaagtag

SEQ ID NO: 190779 - DNA, 381 bp, Artificial Sequence
  Description of Artificial Sequence: Synthetic coding sequence
atgcccgaccccgccaagagcgcccccgcccccaagaagggcagcaagaaagccgttaccaaagctcaaaaaaaggatggaaagaagcgaaagaggtcccgaaaagagagctacagcgtgtacgtttacaaagtcctaaaacaggttcaccccgacacaggcatctcttctaaagcaatgggaattatgaattcttttgttaacgacatattcgaacgcatcgctggtgaggcgtccagattagcgcactacaacaagaggagtacgatcacaagccgggaaattcagaccgccgtccggttactgctccctggtgagttggctaagcacgcagtgagtgagggcacaaaggcagtcacaaaatatacatcgagtaagtag

SEQ ID NO: 190780 - DNA, 381 bp, Artificial Sequence
  Description of Artificial Sequence: Synthetic coding sequence
atgcccgagcccgccaagagcgcccccgcccccaagaagggcagcaaaaaagcagtcacaaaggcccagaagaaggacggtaaaaagcggaagcgttcacgaaaggagtcgtatagcgtttacgtgtataaggtacttaagcaagtccatcctgatactgggatcagcagcaaggctatggggattatgaactcttttgtaaacgatatattcgaaagaattgccggggaggcctctcgtcttgctcattacaataaacgatccaccatcactagccgcgaaatccagactgcagtcaggctgctactgccaggcgagctggcgaagcacgccgtgtctgaaggaaccaaagcagtgacaaaatacacatcttccaagtag

SEQ ID NO: 190781 - DNA, 381 bp, Artificial Sequence
  Description of Artificial Sequence: Synthetic coding sequence
atgcccgagctggccaagagcgcccccgcccccaagaagggcagcaaaaaagctgtgactaaggctcaaaaaaaggatggaaagaaaaggaagcgttcaaggaaagaatcctactctgtctatgtttacaaagtcctgaaacaggtgcatccagacacagggatcagcagcaaggccatgggcattatgaacagctttgtaaacgacattttcgaacggattgcatcagaagcatcaaggctagcccactacaacaagaggtcaacaattacaagccgagaaatccagacagcagttcgactccttctgccaggggagctggccaaacacgccgtgagcgaaggaaccaaagccgtcactaaatacacatccagcaaatag

SEQ ID NO: 190782 - DNA, 381 bp, Artificial Sequence
  Description of Artificial Sequence: Synthetic coding sequence
atgcccgagcccgtgaagagcgcccccgtgcccaagaagggcagcaaaaaagctataaataaggcacagaagaaggatggaaagaaacggaagcggagcagaaaagaatcctacagcgtctacgtatataaggtgcttaagcaggtccatccggacactggtatatcctccaaggccatgggaataatgaactcttttgtaaacgacatcttcgagcgcattgcgggcgaagcaagccggcttgcacattacaacaagagaagtaccatcacatctcgagagattcagactgccgtacggctcttgctacccggtgaactggctaagcacgctgtgtcagagggcacaaaagccgtaacaaagtacaccagctctaagtag

SEQ ID NO: 190783 - DNA, 381 bp, Artificial Sequence
  Description of Artificial Sequence: Synthetic coding sequence
atgcccgagcccagcaagagcgcccccgcccccaagaagggcagcaaaaaagctgtaacaaaagctcagaagaaggacggtaaaaaaaggaagcggtctcgcaaagagtcctatagcgtctatgtctataaagttctcaagcaggtacatccagacacaggtatcagcagtaaggccatgggtattatgaacagtttcgtgaacgacatattcgaacgcattgccggagaagcttctaggctggcacattataataagcgctccacgatcaccagtagggagatccaaactgctgttagattactgctgcccggagagctggctaaacacgccgtgtcagagggtactaaggcagtaaccaagtacacctcctctaagtag

SEQ ID NO: 190784 - DNA, 381 bp, Artificial Sequence
  Description of Artificial Sequence: Synthetic coding sequence
atgcccgagcccagcaagagcgcccccgcccccaagaagggcagcaagaaggccgttactaaggctcaaaagaaggacggcaaaaagaggaaaagatcacggaaggaatcgtactccgtttatgtgtacaaggtattaaaacaggtgcacccagataccggtatcagctccaaggccatggggattatgaattcatttgtcaacgatattttcgagcggatagctggtgaagcatctagactcgcacattataacaagcgatccacaataacgtctagagagatccagactgccgttaggctcttacttccgggcgaactcgcgaaacacgctgtgtctgaaggcaccaaggccgtcacgaagtatacatcaagcaagtag

SEQ ID NO: 190785 - DNA, 381 bp, Artificial Sequence
  Description of Artificial Sequence: Synthetic coding sequence
atgcccgaccccgccaagagcgcccccgcccccaagaagggcagcaaaaaagctgtcacgaaggcacagaaaaaggacggcaaaaaacgtaagcggagccgcaaggaatcctatagcatttatgtgtataaggtgcttaagcaggtgcatccagacaccggcatcagttctaaagccatgggaatcatgaatagcttcgttaatgatatttttgaacgcattgccggggaggcctcacgactcgcccattacaataaaagatcaactataacatctcgggagatccaaaccgccgtgagattactgctgcccggggagttggcaaaacatgccgttagtgagggtacaaaggcagttaccaaatacaccagttccaagtag

SEQ ID NO: 190786 - DNA, 411 bp, Artificial Sequence
  Description of Artificial Sequence: Synthetic coding sequence
atggcccggaccaagcagaccgcccggaagagcaccggcggcaaggcacccaggaaacagctggctaccaaggctgctagaaagtcagcccccgccaccggcggagtgaaaaagccacacagatataggcccggaaccgttgccctgagggaaattcgtcgttaccagaaatctacagagcttctgatccgcaagctgccgtttcagagactggtgagagagatagctcaggacttcaagactgatttaagattccagagttccgctgtcatggcactgcaggaggcctgcgaggcctatttggtgggtttatttgaggacaccaatctttgtgcgatacatgccaagcgcgtgaccatcatgcccaaggacattcaacttgcccgcaggatcaggggggaacgcgcttag

SEQ ID NO: 190787 - DNA, 411 bp, Artificial Sequence
  Description of Artificial Sequence: Synthetic coding sequence
atggcccggaccaagcagaccgcccggaagagcaccggcggcaaggctcctcggaagcagcttgctaccaaagccgctcggaaatccgcccctgctacaggcggcgttaagaagccccatagatacagacccggcaccgtcgctctccgggagattcgccggtaccagaagagcacagaattgctgatcagaaaacttccctttcagcgcctagttagggaaatcgcccaagacttcaagactgacctcaggttccagagttctgccgttatggctctacaagaggcttgcgaagcctatctagtggggctgttcgaggataccaacctgtgtgccatacatgctaagcgggtcactatcatgccaaaagacatccagttagctcggagaattaggggagagagggcttag

SEQ ID NO: 190788 - DNA, 411 bp, Artificial Sequence
  Description of Artificial Sequence: Synthetic coding sequence
atggcccggaccaagcagaccgcccggaagagcaccggcggcaaggctcctcgtaagcagttagctactaaagccgctaggaagtctgcccccgccacaggcggcgtgaaaaaaccccatcgctatagacctggaacagtcgcgctccgcgaaattagaaggtaccagaagtccactgaactgcttattaggaagttaccatttcagcgacttgtgcgcgaaatcgcacaagactttaaaacggacctgcgctttcaatcatctgccgtcatggccctgcaggaggcatgcgaggcatacctcgtgggcctcttcgaagacaccaacctgtgtgctatccacgccaagcgggtcaccattatgcctaaggacattcagcttgcccggcggattaggggtgagcgggcctag

SEQ ID NO: 190789 - DNA, 411 bp, Artificial Sequence
  Description of Artificial Sequence: Synthetic coding sequence
atggcccggaccaagcagaccgcccggaagagcaccggcggcaaggcccccaggaaacagcttgcaaccaaggctgctcgtaaatcggcccccgccaccggcggggtcaagaagccccaccgctaccgtcctggcactgtagcacttcgtgaaatccggcgctaccagaaaagcacagagttgctgattcgcaaactgccattccagcggctggtgcgcgagatagctcaagacttcaaaactgaccttcggtttcagtcctcggcagttatggcgctgcaggaggcctgcgaggcttaccttgtgggcctgttcgaggataccaatctctgcgcaatacacgcaaaaagggtcacaatcatgccaaaggatattcagcttgccagaagaattcggggcgagcgcgcttag

SEQ ID NO: 190790 - DNA, 411 bp, Artificial Sequence
  Description of Artificial Sequence: Synthetic coding sequence
atggcccggaccaagcagaccgcccggaagagcaccggcggcaaggcacctcggaagcagctggcaacaaaagcagccagaaaatccgcacccgcgaccggtggagttaagaagcctcataggtatcgccccgggactgtcgcgctgcgcgaaattagacggtatcaaaaaagcaccgagctcctgattagaaaactgcccttccagcgccttgtgagagagatcgcccaggattttaaaactgacctcaggtttcagagtagtgctgtgatggccctgcaggaagcatgcgaggcttacctcgtcggcctctttgaggacaccaacctgtgtgctattcatgctaaaagggttacgatcatgccaaaagacatccagctggctagacgtataaggggagaacgggcctag

SEQ ID NO: 190791 - DNA, 411 bp, Artificial Sequence
  Description of Artificial Sequence: Synthetic coding sequence
atggcccggaccaagcagaccgcccggaagagcaccggcggcaaggctcccaggaagcagcttgcaaccaaggctgcccgaaagagtgcccctgccacgggaggggtaaagaagccccaccgctaccgcccaggaacagtggctctccgagagatcaggaggtaccagaagagcacagagctactcatcaggaaactacccttccagcgcctggtgagggagattgcccaggacttcaagacagatctgcgtttccagtcctccgccgtcatggccttacaggaagcttgcgaggcatacttggttgggctgttcgaagacaccaatttatgtgctatccatgcgaagcgggtaaccattatgcctaaagacattcagcttgcgagaaggattagaggcgagagagcatag

SEQ ID NO: 190792 - DNA, 411 bp, Artificial Sequence
  Description of Artificial Sequence: Synthetic coding sequence
atggcccggaccaagcagaccgcccggaagagcaccggcggcaaggcaccaaggaaacagttggctacgaaggctgctaggaagtcagccccagcgacgggaggcgttaaaaagccccaccgctacagaccaggcaccgtggcactgcgggaaatcaggcgttaccagaagagtaccgagttgctcatcagaaaacttccttttcagaggttggtgagagaaatagcacaggactttaaaactgacctcaggttccagtcctctgccgtgatggccctccaggaggcatgcgaggcatatctcgttggactgtttgaggataccaatctatgtgccattcacgccaaacgggttaccattatgcctaaggatatccagcttgcacggaggatacggggggagagggcctag

SEQ ID NO: 190793 - DNA, 411 bp, Artificial Sequence
  Description of Artificial Sequence: Synthetic coding sequence
atggcccggaccaagcagaccgcccggaagagcaccggcggcaaggctccacgcaagcaactcgcaaccaaagctgccagaaaaagcgcccctgctactggcggggttaaaaagccccatcgttacagacctggaaccgtggcccttcgcgagatcagaagataccagaagagtacagagcttctgatccgcaagctgcctttccagaggctcgtgagagaaattgcacaggatttcaagactgacctcaggttccagagctccgccgtgatggcactccaagaagcctgtgaggcgtatctggtaggcttattcgaggataccaatctttgtgcaatccatgctaagcgtgtgaccatcatgcccaaagacattcagctcgctcggcgcattcgcggtgaaagggcatag

SEQ ID NO: 190794 - DNA, 411 bp, Artificial Sequence
  Description of Artificial Sequence: Synthetic coding sequence
atggcccggaccaagcagaccgcccggaagagcaccggcggcaaggcgcctcggaagcaactcgccaccaaagccgccaggaagagtgccccagcaacaggtggcgtcaagaaaccacaccgctatcgaccaggcacggtcgctctgagggaaatcagaagataccagaagtctaccgaattgttaattcgaaagctgcccttccaacgattagtaagagaaatcgcacaggattttaaaacggatttgaggtttcagtccagtgctgtgatggctctacaagaagcgtgcgaagcatacctagtgggccttttcgaggacaccaacctttgcgccattcacgccaaacgcgtaactatcatgccaaaagatatccagctagcccgccggatacggggggaacgtgcctag

SEQ ID NO: 190795 - DNA, 411 bp, Artificial Sequence
  Description of Artificial Sequence: Synthetic coding sequence
atggcccggaccaagcagaccgcccggaagagcaccggcggcaaggcaccccgcaagcagctcgctacaaaggctgcgcggaagtctgcgcctgcgacggggggcgttaaaaaaccacataggtatcggcctggaaccgtagcactcagagagatccggagataccaaaagtccactgaactcctgatcaggaagctcccatttcagcgcctggtcagagagattgcgcaggactttaagaccgatctacggttccagtcaagcgccgtcatggcactgcaggaggcctgcgaagcctacctggtgggcctgtttgaggacacaaacctgtgcgccatacacgcgaagcgagtgaccataatgccaaaggatatacaacttgctagacggatcagaggtgagagggcctag

SEQ ID NO: 190796 - DNA, 411 bp, Artificial Sequence
  Description of Artificial Sequence: Synthetic coding sequence
atggcccggaccaagcagaccgcccggaagagcaccggcggcaaggcgcctcgcaaacagctcgcaactaaggcagcacgaaagtccgcccccgccaccggtggggtaaaaaagccacacaggtatagaccagggactgtcgccttgcgcgaaattaggcgctaccagaagtccaccgagttactgattcgtaagctgccgtttcagaggctcgtccgcgagatcgcacaggatttcaaaaccgacttgcgatttcagagcagcgcggtgatggccctgcaggaggcctgcgaagcttacctggtgggcttatttgaagatactaacctctgtgctatacatgccaaacgtgtgaccataatgcccaaagacatccaactggctaggcgaattcgtggagagcgggcgtag

SEQ ID NO: 190797 - DNA, 339 bp, Artificial Sequence
  Description of Artificial Sequence: Synthetic coding sequence
atgagcggccggggcaagggcggcaagggcctggccaaggccaagacatgttcatcccttccaggcttacagtttcctgggagggtcaggcatcttttccggaagggaaattactttgaacctgtgggggctggagcccctgtgtatctacagtatctcgcggctgagatcctggagttggtcggctccgccatccgtgataagacaaggtccattattccacgacatctgcagcttgccatacggaatgacgaggaggtgaacaagcagctcggtaatgtaactatcgcccaaggtggggtcctctccaacattcaggccgtccttcttcccaaatag

SEQ ID NO: 190798 - DNA, 312 bp, Artificial Sequence
  Description of Artificial Sequence: Synthetic coding sequence
atgagcggccggggcaagggcggcaagggcctgggcaagggcggcgcgaagcggcacagaaaagtcctgcgcgataacatccaggggattaccaaacccgctataagacgactcgcccgaagaggtggagtgaaacggattagcggcttgatatatgaagagacaaggggcgtgctgaaggtctttctagaaaacgtgatacgggatgccgtgacttataccgaacacgcaaagaggaaaaccgttactgcaatggacgtagtgtatgctctgaagcgtcagggccgcaccctttacggctttggggggtag

SEQ ID NO: 190799 - DNA, 312 bp, Artificial Sequence
  Description of Artificial Sequence: Synthetic coding sequence
atgagcggccggggcaagggcggcaagggcctgggcaagggcggcgcaaagcggcatcgtaaagtcctgcgagataacattcaggggatcacaaagcctgcgatcagacgcctggcacggaggggtggcgtgaaacgcatttcaggactgatctatgaagagacccgcggtgtgctcaaggtgttcctcgaaaatgtaattcgcgatgcagtcacctacactgagcacgctaaaagaaagactgttacagcaatggacgttgtctatgcattaaaacggcagggcaggaccctgtatggcttcggagggtag

SEQ ID NO: 190800 - DNA, 312 bp, Artificial Sequence
  Description of Artificial Sequence: Synthetic coding sequence
atgagcggccggggcaagggcggcaagggcctgggcaagggcggcgcgaaaaggcacagaaaggttctacgagacaatattcagggaataactaaaccagccatccggcgactggctcggaggggcggggtgaagagaatttccggcctgatctacgaagagaccaggggtgtgttaaaagtctttcttgagaacgtaattcgggacgctgtgacttacaccgagcacgccaaacgcaagacagtcactgccatggacgtggtgtatgcccttaagaggcagggaagaactctctatggcttcgggggctag

SEQ ID NO: 190801 - DNA, 312 bp, Artificial Sequence
  Description of Artificial Sequence: Synthetic coding sequence
atgagcggccggggcaagggcggcaagggcctgggcaagggcggcgccaagcgccacaggaaggtcctcagggacaatatacagggtattacaaagccagccatccgcaggctggctcgacgaggaggagttaagagaattagtgggctgatctatgaagagaccaggggagtattgaaagtgtttcttgagaatgttattcgcgatgcagtcacgtacacagagcacgccaaaaggaagacagtgactgccatggacgtcgtgtacgctctgaaacgccaaggcagaaccctctacggctttggcggatag

SEQ ID NO: 190802 - DNA, 312 bp, Artificial Sequence
  Description of Artificial Sequence: Synthetic coding sequence
atgagcggccggggcaagggcggcaagggcctgggcaagggcggcgccaaacgtcaccgtaaggtactgcgggataacatccagggaataaccaaaccagctatccgtcggctcgccagacgagggggcgttaagaggattagtggcttgatttatgaggagacccgcggcgtcctgaaggttttcctggagaatgtaatccgggatgcagttacctataccgagcacgccaaaaggaagacagtgactgcgatggacgttgtgtacgccttgaagcgccaggggaggacactctacgggtttggcgggtag

SEQ ID NO: 190803 - DNA, 312 bp, Artificial Sequence
  Description of Artificial Sequence: Synthetic coding sequence
atgagcggccggggcaagggcggcaagggcctgggcaagggcggcgccaagaggcaccggaaggtgttgagggacaacatccaggggatcacaaagcctgcaatccgtagacttgcccgacggggcggagtcaaaagaatatcgggtctgatctatgaagagacccgtggtgtgctgaaggtgtttctggagaatgtaattcgcgacgctgtgacttacaccgagcacgccaagcgtaagacagtgaccgcaatggacgtggtttacgcactaaaaagacaggggcggactctttacggcttcggcggctag

SEQ ID NO: 190804 - DNA, 297 bp, Artificial Sequence
  Description of Artificial Sequence: Synthetic coding sequence
atgagcgtgcggggcaaggccggcaagggcctgggcaagggcggcgctaaatgtcatcgcaaggttctctccgacaatatacaggggataaccaagtgcactattcgccggttggcccgccacggaggtgtaaagaggattttggggcttatttatgaagaaactaggagggtctttaaggtgtttctagagaatgtcatatggtatgcggtcactaatactgaacacgccaagcgcaagaccgtaaccgccatggccgttgtatacgtgctgaagcgtcaagggaggacgctttag

SEQ ID NO: 190805 - DNA, 312 bp, Artificial Sequence
  Description of Artificial Sequence: Synthetic coding sequence
atgagcggccggggcaagggcggcaagggcctgggcaagggcggcgctaagcgacaccgaaaagttctcagggacaatatccaaggtatcactaaaccagcaatccgacggctggcccgacgcggcggagtcaaacgaatatcaggccttatctatgaggagaccaggggagtgctgaaggtgttcctcgaaaatgtcatcagggacgcagtaacatacacagagcatgctaaacggaagacagtgaccgcaatggatgtagtatacgcacttaagcggcaaggccgaactttgtacgggtttggtgggtag

SEQ ID NO: 190806 - DNA, 312 bp, Artificial Sequence
  Description of Artificial Sequence: Synthetic coding sequence
atgagcggccggggcaagggcggcaagggcctgggcaagggcggcgctaagcggcacagaaaagtactacgggacaatatccagggaataaccaaaccagctatcagaaggttggcacgacgtggcggggtgaaacgtatctccggcctgatttacgaggagacacggggtgtgttgaaagtctttctggaaaatgtgattcgggacgctgtgacgtacactgaacacgctaaacggaagaccgtgacggcgatggatgtcgtttatgccctgaaacgccagggcaggacgctctacggcttcgggggctag

SEQ ID NO: 190807 - DNA, 312 bp, Artificial Sequence
  Description of Artificial Sequence: Synthetic coding sequence
atgagcggccggggcaagggcggcaagggcctgggcaagggcggcgcgaagcgtcaccggaaagtgctgcgggataacattcaaggtatcaccaaacccgcaatcagaagactggcgagaaggggtggcgtgaaacggataagtggtctgatctacgaggagacacgcggtgtgctcaaagtgttcttagaaaatgtcattcgcgacgcagtgacctacacagaacacgcgaagcggaaaactgtgactgcaatggatgtggtgtatgcgcttaagcgccaggggcgaaccctgtatgggtttgggggatag

SEQ ID NO: 190808 - DNA, 312 bp, Artificial Sequence
  Description of Artificial Sequence: Synthetic coding sequence
atgagcggccggggcaagggcggcaagggcctgggcaagggcggcgctaagcgtcatagaaaggtgctgcgggataatatccagggaatcaccaaacctgccatcagacggctagcaagacgaggtggggttaaacgcatcagcggactgatttacgaggagactcggggcgtgctgaaagtcttcctggagaacgtgataagggatgcagtgacatacactgagcatgcaaaaaggaaaaccgtgaccgcaatggacgtggtttatgccctcaagcgacaggggaggaccctttatggtttcgggggctag

SEQ ID NO: 190809 - DNA, 312 bp, Artificial Sequence
  Description of Artificial Sequence: Synthetic coding sequence
atgagcggccggggcaagggcggcaagggcctgggcaagggcggcgcgaagcgccacaggaaggtgctgagggataacatacagggcatcactaaaccagcaattagaagactcgcccggcggggaggagtgaaacgcatttccggtttaatctatgaggagacgcgcggtgtgctgaaggtcttccttgagaacgtgatccgagacgccgttacgtacaccgagcacgcaaaaaggaaaacagtaacagccatggacgttgtctatgcgctgaagcggcagggaaggaccctctatggatttggcggttag

SEQ ID NO: 190810 - DNA, 312 bp, Artificial Sequence
  Description of Artificial Sequence: Synthetic coding sequence
atgagcggccggggcaagggcggcaagggcctgggcaagggcggcgcaaaacgccaccgaaaagtactgcgagataacatccagggtatcaccaagccagccattaggcgactggcccgaaggggaggggttaagcgcatcagcggtctgatctatgaggagactagaggtgtccttaaggtgttcctggagaatgtcatacgcgacgccgttacgtacactgaacacgccaaacggaaaacagtcactgcgatggacgtggtgtatgctctgaagcggcagggcaggactttatacgggttcgggggttag

SEQ ID NO: 190811 - DNA, 390 bp, Artificial Sequence
  Description of Artificial Sequence: Synthetic coding sequence
atgagcggccggggcaagcagggcggcaaggcccgggccaaggccaagtcccgtagttccagggccggcctgcaattcccggttgggcgagtgcatagattgctgaggaaggggaactacgctgagcgggtgggcgccggcgctccagtgtatatggccgcagtgttggaatatcttacggccgagatactggagctggccggcaatgcagcccgagacaacaagaaaacacgcataattccccggcacctgcaactggccatccgtaatgatgaagaacttaacaagctgctgggaaaagtcacgatcgctcagggtggagttctgccaaacatccaggccgtcttgttgcccaaaaagaccgaaagccataaagctaagtctaagtag

SEQ ID NO: 190812 - DNA, 381 bp, Artificial Sequence
  Description of Artificial Sequence: Synthetic coding sequence
atgcccgagcccgccaagagcgcccccgcccccaagaagggcagcaagaaggccgtaactaaggctcaaaagaaggacggcaagaagaggaaaagaagcagaaaagagtcatacagtatctacgtgtacaaggtattgaaacaagtgcatccagacactgggataagcagcaaggccatggggatcatgaatagttttgtcaacgacatcttcgaacggatcgccggcgaggcaagcaggcttgctcattataacaagcgcagcacgatcacaagtagagagattcagactgccgtgagactgctgctgcccggcgagcttgcaaagcatgccgttagcgagggtaccaaggcagttactaagtacacttcgagtaagtag

SEQ ID NO: 190813 - DNA, 411 bp, Artificial Sequence
  Description of Artificial Sequence: Synthetic coding sequence
atggcccggaccaagcagaccgcccggaagagcaccggcggcaaggccccgcgaaaacagttagcaacaaaggcggctcgtaagtccgcaccggctacaggaggcgtgaagaagccgcatcgctatcggcctggtaccgtggccctgagggaaatccgtagataccaaaagagcacagagctgctgattagaaaactccctttccagcgactggtgcgtgaaattgcgcaggactttaagacagatctgagattccagagttccgccgtcatggcccttcaagaagcctcagaagcttacctcgtcgggttattcgaagacaccaacctgtgtgccatacacgccaaacgcgtgaccatcatgccaaaagacatccagttggccagacgcattcgcggcgagagggcgtag

SEQ ID NO: 190814 - DNA, 411 bp, Artificial Sequence
  Description of Artificial Sequence: Synthetic coding sequence
atggcccggaccaagcagaccgcccggaagagcaccggcggcaaggcaccaaggaaacagctggcgacaaaagtggcacggaagagcgctcccgccaccgggggtgttaagaagccccaccgctaccgaccaggcaccgtggctctcagagaaatcaggcgctatcaaaagagcactgagcttttgatccgcaaacttcctttccaacgacttatgcgcgaaatcgcccaggacttcaagactgatcttcgctttcaaagttccgctgttatggcccttcaggaggcctgcgagagctacttagttggcctgtttgaagatacaaacttatgcgtgatccatgccaagcgtgtgaccatcatgcccaaagatattcagctggcgaggcgcatacgcggcgaaagagcttag

SEQ ID NO: 190815 - DNA, 684 bp, Artificial Sequence
  Description of Artificial Sequence: Synthetic coding sequence
atggagggccagagcggccggtgcaagatcgtggtggtgggcgacgccgagtgcggaaagacggctctcttacaggtgttcgctaaagatgcctatcccggcagctatgtgcccaccgtgtttgagaactacacagccagctttgagatcgataagcgtaggatcgaactgaatatgtgggataccagtggtagttcttactatgacaacgtccgtccgctggcataccccgattccgacgcagtgctaatctgtttcgatatcagtcggcccgaaaccttggacagcgtattgaaaaaatggcagggggagacgcaggaattttgcccaaacgctaaagttgtgttggtaggctgtaagctggatatgaggaccgatctcgcgactctgagagagttatccaaacagcgcttgatccctgtaactcacgaacagggaacagtacttgctaaacaagttggtgccgtttcttatgtggaatgctcttcgagaagctccgagcgatcggtccgcgacgtcttccacgttgcaacagttgcctccctgggaagggggcatcgccaactgcggaggacagacagccgccgcgggatgcaaaggagtgctcagctctcaggtaggcccgatcgaggcaatgagggagaaatccacaaggatcgggcaaagtcctgtaacttgatgtag

SEQ ID NO: 190816 - DNA, 3114 bp, Artificial Sequence
  Description of Artificial Sequence: Synthetic coding sequence
atgaacagccccaacgagagcgacggcatgagcggccgggagcccagtctggagatccttcctaggacctcactgcattcaatccctgtgactgtcgaggtcaagcccgtcctgccacgggccatgccaagtagtatgggcgggggggggggtggttcaccatcccccgtggaactgcggggggctctggtgggctccgtggacccaaccctgagagaacagcagcttcaacaggagctgctcgccctgaagcagcagcagcaacttcaaaagcagctgctttttgctgaatttcagaaacagcacgatcacctcacgcggcagcatgaggtgcagctgcaaaaacacttgaagcagcagcaggagatgctcgcggcaaaacagcagcaggagatgctcgccgccaaaagacaacaggagctggagcagcaacgacaacgggagcagcagagacaggaggagttagaaaaacagaggcttgagcaacagttacttatcttgagaaacaaagagaaatcgaaagaatcagccatcgcatctacagaggtgaagctcagactgcaggagttccttctgtccaagtctaaagagccaacccccggcggcctcaaccactctcttccccagcatcctaagtgttggggcgcccaccacgcatccttagatcagagctcgcccccccagtctggcccacctggaacgcctccatcctacaagctgcctctccctgggccatatgattcccgagacgacttccctttgaggaaaacagcctctgaacccaatctgaaggttcgctccagactgaaacagaaggtggcagaacggcgcagctcccccctgctgaggcggaaggacggaacagtgattagcacgtttaagaaaagggccgtcgagattacaggagccggcccgggagcctcatctgtctgcaacagcgcacctgggtcaggcccctcctcacctaacagctcacattctaccattgccgagaatggcttcacaggttctgtcccgaatatacccactgaaatgctgccgcaacaccgtgcccttcccttggacagtagccccaatcaattcagtctgtacacttctccctccctccctaacatctcactgggtctccaggcgacagtaaccgtcacaaactcccacttgaccgcgtcgcctaaactttctacccagcaggaggccgaaagacaggctctccagagtcttcggcagggaggaaccttgacaggcaaatttatgtctacctcatcaatccccggctgtttgctcggtgtggctctggagggtgacggatccccccacggtcacgcaagcctgttgcaacatgtactgctgctggagcaggcccggcaacaatccactctgattgcggtgccgctccacggtcaatcacctcttgtgaccggagagagggttgcgacgtccatgcgcactgttggcaagctgcctagacatcgtccactgagtaggacacaatcatcaccactgccccaatctccccaagcactgcagcagctagtgatgcagcagcagcaccagcagttcttagagaagcagaagcagcagcagcttcagctggggaaaatcttgactaaaacaggcgagctccctcgacagcctactacccacccagaggagacagaggaggaactgaccgaacaacaggaggtattgctcggagaaggcgccctcaccatgccccgcgaagggtctactgaaagcgaatcgacccaagaggacctggaggaagaagacgaagaagacgacggagaagaagaggaagactgcattcaggtgaaggacgaggagggtgaatccggagcggaggagggtccggacctagaagagcctggcgccgggtacaaaaagctcttttccgacgcccagccactgcagccgctccaggtgtatcaggcccctctatccctggcaactgtgccacaccaagccctaggccgaacccagagtagccctgccgcgccgggtggcatgaagtcccctccggatcagcctgtgaaacacctgtttacgactgggcctatttctcagaagatgtatgccgtcctgccctgcggaggtattggtgtcgattctgatacagtgtggaacgagatgcattccagcagtgctgtgaggatggctgtgggttgtctgctagaacttgcctttaaagttgctgccggcgagctcaaaaacggctttgccattatcagacctccagggcatcacgcggaagaaagtaccgcaatgggcttttgtttctttaattccgtcgctataacggccaagctgctgcagcagaagctgaatgtggggaaagtgcttatcgtggattgggatatacatcatggtaacgggactcaacaagccttctataacgatccatccgttctgtacatttccctgcaccgctacgacaatgggaatttcttccctgggtctggggctcccgaagaggtgggcggcggccctggcgtgggctacaacgtgaacgtggcatggacaggcggggtggaccccccaattggcgatgtggaatatctaacagccttcagaaccgttgtgatgccaatcgcacatgaattctctccagacgtcgttctcgtttccgcaggattcgacgccgtggaaggacatttatcacctctggggggctactcagtgaccgcccgctgttttggacatctaaccaggcagctgatgacactcgctggggggcgagtagtgttagctctggaagggggccacgatctgactgctatatgcgatgccagcgaagcgtgtgtatccgcgctcctgagtgttgagctacagcctctggatgaagctgtgttgcaacaaaaaccgaatatcaatgcggtggcaaccctggaaaaagtgattgaaatccaaagtaaacattggagttgcgtacagaagttcgctgccgggctgggccggtctctgagggaagctcaagctggggaaacagaggaagctgagactgtctcagccatggcactcttgtccgtaggcgctgaacaagcccaggccgccgcagccagagaacattccccccggccagccgaagaaccaatggagcaagaacctgcactgtag

SEQ ID NO: 190817 - DNA, 3369 bp, Artificial Sequence
  Description of Artificial Sequence: Synthetic coding sequence
atgaacagccccaacgagagcgacggcatgagcggccgggagccctcattggagattctgcctaggacatctctgcactccattccagtcactgtggaggtgaaacccgtcctgcctcgagctatgccaagcagtatgggcggcggtggaggcggcagccctagccccgtcgagctgagaggagccttggtaggcagcgtagatcccacccttagggaacagcaactgcagcaagagctgctcgctctgaaacaacaacagcaactgcagaaacagcttctttttgccgagtttcagaagcaacatgatcatctgaccagacaacacgaagtacagcttcagaagcacctgaaacagcagcaagagatgctggccgccaagcagcagcaagagatgcttgctgctaagcggcagcaggaattagaacaacagcgccagagagagcagcagcgccaggaagaactggagaagcagaggctggaacaacagctgctcattttgcgcaataaggaaaaaagcaaggagtcagcaattgcctcaacagaagtgaaactccgcctgcaggaattcctactttcaaagtctaaggagcctacccccggtggactaaaccactcactgccacagcaccccaaatgctggggcgcacatcacgccagcctggaccagtcgtcacccccacagagtggcccaccaggcacccccccctcctacaaactacctttacccggcccctacgactcacgtgatgatttcccccttcgaaagactgctagcgagcctaacctcaaagtgcgttcaagactgaaacagaaagtcgcggaaagacggagctcccctttactgaggcggaaagacggaactgtgatttcaacctttaagaagagagcagttgagattactggcgcaggcccgggcgcctcttccgtctgcaacagtgccccaggcagcggaccttcatcccctaatagttctcattcaacaatcgcagagaacggcttcaccggtagcgtccccaatatcccaaccgagatgctcccacagcatagggccctccctctggactcatcacccaaccaattctctctttatacctccccatcgttgccaaatatttctctgggtttgcaggccacagtaacagtgactaattcacacctcacagctagccctaaactcagcacccagcaagaggccgaaaggcaggccttgcagtctctccggcagggcggcactttaactggaaaattcatgtccacctctagcatccccgggtgcttgcttggcgtcgccctggaaggcgatgggagtccccatggtcacgctagtctgctccagcacgtactattgctggagcaggctaggcaacagagcacactcatcgccgtaccacttcacggacagagcccactcgttactggggagcgtgtcgctacaagcatgcggaccgttggcaaattacctcggcataggcctctgagccgtactcaatcgtccccgcttccacagagtccacaggctttgcaacagctggtgatgcaacagcagcaccagcaattcctggaaaagcaaaagcaacaacagctccagctgggcaagattttgaccaaaaccggggaacttccccggcagccaacaacgcacccagaggaaaccgaagaagagcttaccgagcaacaagaagtgttgctaggagaaggagcgctcaccatgcctagagagggatcgacggagagcgagagcactcaagaggacctggaggaagaggacgaggaggacgatggcgaggaggaggaggactgcatccaggtgaaagatgaggagggcgaatcaggcgctgaggagggcccagacttagaagagcccggggcaggttataaaaagctttttagcgatgcccagcctctgcagcctctacaagtgtaccaagctccattgtcactggcgacagtgccccaccaagcactaggacggacacagtccagccctgccgctcctggtggcatgaaatctccacctgaccagcccgtaaagcatctttttaccaccggtgtcgtatatgacaccttcatgctgaagcatcagtgcatgtgcggtaacacccacgtgcacccggagcatgcaggccgcatccagagcatctggagtagactacaggaaacaggtttgctttctaagtgcgagcgaatacgcgggaggaaggcaacgctagacgagatccaaacggtgcactccgaataccacacccttctttatggcacgtccccgcttaataggcagaaactggattccaagaaattactcggtcccatttcacagaaaatgtatgcggtgctgccctgcggagggatcggcgttgatagcgacacagtctggaatgaaatgcattcctccagcgctgtgcgaatggctgttgggtgcttgctagaacttgcttttaaggtggccgcaggtgaactgaagaatgggtttgccattatacggccccctgggcatcacgccgaagagagtacagctatgggattttgttttttcaattcagtagcgattacagcaaaattgttacagcaaaagctgaatgtgggcaaggtattgattgtggactgggatatccaccacggcaatggcactcaacaagccttctacaacgaccccagcgtgctctacataagcctgcatcggtacgacaatggtaatttcttccctgggtccggggcgccggaagaagtcggaggggggcctggagtgggctataacgttaacgtcgcttggacaggaggtgtggatccgcccattggcgacgtcgagtatctcaccgccttcaggaccgtcgtcatgccaattgcccacgaattttcccctgacgtcgtgctggtctcggccggattcgatgctgtggagggacacctgtcacccctaggcggctacagcgtcaccgctcggtgttttgggcatctgacgcggcaactgatgactctcgccgggggacgtgttgtgctcgctctggagggcggacatgacctgacagcaatctgtgacgcctcagaagcatgcgtcagcgccctgctgagcgtagaactacagcctctggacgaggctgtcctgcagcaaaagcctaacatcaacgccgtagccacattagagaaggtgatagagatacagagtaagcactggtcatgtgtgcagaaattcgccgctgggcttggccgaagccttagagaagcccaggctggggagaccgaggaggcagaaaccgtgtccgctatggctctgctaagcgttggcgccgagcaggcccaggcggcggcagccagagaacatagtccaagacctgccgaggagccaatggagcaagagccggctttatag

SEQ ID NO: 190818 - DNA, 1776 bp, Artificial Sequence
  Description of Artificial Sequence: Synthetic coding sequence
atgatgagcagccccgcccagagccggagccccgacctgatgtggaacctcgtgccctgggttctgttttgcggctgctgtaggatcttccccgacggggtggccggaagagaacagctgctggctcagcagagaatgcactccatgatctcaagcgtggacgtgaagagtgaggtcccagtcggacttgagccgatctctccactggatcttcggacagatctgcgcatgatgatgccggtggtggatccagtggtgcgggaaaagcaattgcagcaagaacttctgttaattcagcaacagcaacaaattcagaagcagctgctaatcgccgaattccagaagcagcatgagaacctgactagacaacaccaggcccaattacaggagcacatcaaagaattgctcgccattaaacaacagcaggaactgcttgagaaggaacagaagcttgaacagcaacggcaggaacaagaagttgagcgccatagacgtgagcagcaacttccgcccctcagaggtaaggacaggggccgtgagcgtgcagtcgctagcactgaagttaagcagaagctccaagagtttctgttgagcaagtcagccacgaaagacacgccaacgaatggaaaaaaccactccgtgagccgccaccccaagttatggtatacagctgcccaccacacctctctcgatcagagctccccacccttgagtggtacatccccgagctacaagtacaccctgccaggggcccaagatgccaaggacgatttcccactcagaaaaacagagtcgagtgtatcctccagttcccccgggtccggcccttcatcgcccaacaatggcccaacaggtagtgtcacagagaatgaaaccagtgtactgcctccaaccccacatgcagaacagatggtctcccagcagagaattctgattcacgaggacagtatgaacttgctgtccctgtacaccagcccttccctgccgaatataactctcggcctgcctgccgtcccttcccaactgaatgcctctaattcgcttaaggaaaaacagaagtgcgaaacacagacccttcggcagggggtgcctctcccggggcaatacggcggcagcattcccgcatcatcgtcccacccccacgtgactctggaggggaagcctcctaatagttctcaccaggccctgctgcagcacctgctgttaaaggagcaaatgcggcagcagaagttactggtcgctggtggggtgcctctccatccccagtcccctctggcgacaaaggaacgcatctctccaggcataagaggcacccacaaattgccgcgccaccggccactcaatagaacacagtccgcgccacttccccagagcaccctcgcccaactggtgattcagcagcagcatcagcagtttctcgagaaacagaaacagtatcaacaacaaatccacatgaacaagctgctgtctaagtccattgaacagctgaagcagccaggttctcatctggaagaagccgaggaggaactccagggcgatcaggcaatgcaggaagatagggctcccagtagcggcaactctactcggtcagactcatccgcatgcgtcgacgatactctcggccaagttggggcagttaaagtcaaagaagagcccgtagattcggacgaagatgcccagatacaagagatggagagcggagaacaggcagcatttatgcagcaggtgattggcaaagacttggcgcccggctttgtgatcaaggtgatcatttag

SEQ ID NO: 190819 - DNA, 2772 bp, Artificial Sequence
  Description of Artificial Sequence: Synthetic coding sequence
ctgcacaagctgagcagcctggtggacgtgaagagcgaggtgcccgtgggcttggaacctatttctcccctggacctgagaacggatctaagaatgatgatgccagtggtggatcctgtcgtccgagagaaacagctgcagcaagaacttctgctgatccaacagcagcagcagattcaaaaacaattactcatagctgaattccagaagcagcatgagaacctaacaagacagcatcaggcccagctccaggagcatatcaaagaacttctcgcgatcaagcagcagcaagagctgcttgagaaggagcagaaactagaacagcagcgtcaagaacaggaggtcgaaagacacaggagagagcaacagctccctccattacgaggcaaagatcgcggaagggaacgggcggtggcgtccactgaagttaaacagaagctacaggagtttctcctcagcaaaagcgctactaaagatacgcccactaacggtaaaaaccactctgtgtcaaggcaccccaagctgtggtatacagcggcacaccacacctctctggatcaatctagcccgccactctccggaacatccccgagttacaagtacacactgccgggggcccaggacgccaaggatgactttcccctcagaaagaccgcctctgaaccaaatttgaaggttcggtcacgccttaaacagaaggtcgccgagaggagatccagcccactcctgagaaggaaagatggcaacgtggtaacttcattcaaaaagagaatgtttgaggtaacggagtcatcagtctctagctctagtcccggcagtggcccatctagccccaacaatggtcccacagggtcagtgactgagaatgagacctccgtcctgccccccacccctcacgccgaacagatggttagccaacagcgcatcttaatccatgaagacagtatgaatttgcttagtctctacacttctccgagcctccctaacattaccctcgggttacccgcagtgccctctcagttgaacgcatctaacagcctgaaggaaaagcaaaaatgtgagacacagactctgaggcagggagtgcctctccctggccagtatgggggctccattccagcctctagctcccacccacatgtcacactcgaagggaagccccctaacagtagccaccaggccttgctgcagcacctgctgctgaaggaacaaatgagacagcagaagttgctggttgcaggaggagtgcccttgcacccacagagccccctggccacaaaagagcgcatctctcctggaatccgtggcacacacaagctgccacggcaccgtcccctcaaccgcactcagtccgctccactcccccaatcaactctcgcccaactcgttattcagcagcagcaccagcaattcctggaaaagcagaagcagtatcagcagcagattcatatgaacaagccctttctagagcctacgcacacaagagccctctctgtgagacaggcccctctagccgccgtcggcatggatggcttggaaaagcataggcttgtgtccaggacccactcaagtcccgctgcttccgttcttccccacccagctatggatcggcccctgcagcctggcagcgctacaggaatcgcctacgatccactgatgctgaagcatcaatgtgtatgcggaaatagtacaacacatcctgaacacgccggacgtatacaatctatttggagccggctgcaagaaacaggactccttaataaatgtgaacggatccagggccgaaaggcttccctggaggaaatccaactcgttcacagcgaacaccactccctactctatggaacaaaccctttggatggccagaagctagaccctcggatccttctcggagatgattctcagaagtttttttctagcctaccttgtgggggattgggggtggattccgatacaatctggaacgagctgcattccagcggggctgcgcggatggctgttggatgtgtgatagaactggctagtaaagtcgcaagcggtgaactgaagaacggattcgccgtggtgagaccccccgggcaccacgctgaagagagcaccgcaatgggtttctgcttctttaatagtgtggcaatcaccgccaaatacctgagggatcagcttaacatctccaaaattctgatagtggacctcgatgtgcaccacggtaacgggacccagcaggctttttatgcggatccatccatcctctacatcagcctccacagatacgacgagggcaactttttccctgggtcaggcgccccaaacgaggtaggtaccggcctaggagaggggtataacatcaatatcgcttggaccggaggcctggacccacccatgggtgatgtcgaatatctggaggcctttcgcactattgtgaagcccgtggcaaaggaattcgacccagacatggtgctcgtcagtgctgggttcgatgctctcgagggccataccccccctcttggcggctacaaagtgactgctaagtgtttcggccatctcaccaagcaactgatgacgttggccgatggcagggtcgtgctggccctggaggggggtcacgatctgacggcaatatgcgacgcatcagaggcctgcgtgaatgcccttctgggaaacgagctggagcccttggccgaggacattctgcaccagtctcccaatatgaacgccgttattagccttcagaagatcattgagatccagagtatgtcactaaagtttagttag

SEQ ID NO: 190820 - DNA, 3078 bp, Artificial Sequence
  Description of Artificial Sequence: Synthetic coding sequence
atgcacagcatgatcagcagcgtggacgtgaagagcgaggtgcccgtcggtctcgaacccattagcccactcgacctgagaacggatttgcgcatgatgatgcccgttgttgatccggtcgtgagagaaaagcaactgcagcaggagctactgttaattcagcagcagcagcagatacagaaacagctgcttattgccgagttccagaagcaacatgagaatttgacccgtcagcatcaggctcagcttcaggaacacatcaagttgcaacaggaactgctggcaattaaacaacagcaggaactattggagaaggagcagaaactggagcagcagcgccaggagcaggaggtcgaaagacacagacgcgagcagcagctgcctccactgcggggaaaagaccgcggccgagagagagctgttgccagcacagaggtcaagcagaaactgcaggagtttctgctctctaagtccgccactaaagatacacctaccaatgggaaaaatcattcagttagtcggcaccccaaactgtggtacaccgcagcccaccatacaagccttgaccagagctctcctcccctaagtggcacttctcctagctacaagtataccttgccaggtgcccaggacgctaaggatgattttccccttaggaagacggaatctagcgtgtctagcagcagccctggctcaggtcctagtagcccgaacaatggccccacgggctctgtgactgaaaatgagacctctgtactgccccccacccctcacgctgaacagatggtgtcccagcagaggatacttatccatgaggactcaatgaacctcctcagcctgtatacttccccaagccttcccaacattactctgggcctgccggccgttccaagccagctcaacgcctccaattccttgaaagagaaacagaagtgtgaaacgcagactctacgtcaaggcgtcccactgccagggcagtatggaggtagtatcccagcgagttctagccatccccacgtgacgttagaaggaaagcctcccaactcaagccaccaggctttattgcagcaccttctcctgaaagaacagatgaggcagcagaagctgctggtggccgggggggtgccacttcacccgcaatccccactcgccacaaaggagaggatttcacctggcatccgaggaacccataagttacctcgacacagacctctcaacagaactcagagcgcccctctgccccagtccacactcgcgcagctggtgattcagcagcagcaccaacagtttctggagaaacagaaacagtatcagcagcaaatccatatgaataaactgctgagtaaaagcatcgagcagcttaagcagccaggctcacacctggaggaggctgaggaggaactacagggggaccaagcaatgcaagaggatcgcgctcctagcagcggcaattctaccaggtccgatagcagcgcctgtgtggatgacaccctggggcaagtgggagccgttaaagtgaaagaagagcctgttgattccgacgaggacgcccagatccaggaaatggagagcggtgagcaggcggcctttatgcagcaaccatttctcgagcctactcacaccagagccttatcagtgagacaggctcccttagcagccgtagggatggacgggctggaaaaacataggttggtgtccagaacacatagcagcccagccgcctccgtgctcccgcacccggcaatggaccggccattacagcctggctccgctactggaattgcctatgacccactcatgttaaagcaccagtgtgtctgcggtaacagcactactcatcctgagcacgctgggcgcattcagtccatatggagtcgccttcaagaaacaggactccttaacaagtgcgagagaatacaaggtcggaaagcttccctggaggagattcagctggtacacagcgaacaccactccctgctctatggcacgaatccactggacgggcaaaagctagatccgcgcatcctactgggcgacgatagccaaaaatttttctcatccctgccctgcggcgggctgggcgtcgatagcgataccatatggaatgagctacactcctcaggcgcagccaggatggccgtgggatgcgtcatcgaattggctagcaaggtggcctctggcgagttaaaaaatggatttgctgtagtgagaccgcccggccatcatgccgaggagtccactgcgatgggcttctgtttttttaacagtgtcgccatcaccgccaaatacttacgagatcagctgaacatctccaagattttgattgtggatctcgacgtgcaccatggcaacgggactcagcaggccttttacgccgacccctccatactgtacatctctctgcaccgatatgacgaaggcaattttttcccaggctcaggcgcacccaatgaggtcggtaccggtctgggtgagggttataatatcaatattgcctggaccgggggacttgaccctcctatgggggatgtcgaatacctcgaagcgttccgcactatcgtaaaaccagtggctaaagagtttgatcctgacatggttctcgtatctgctggattcgacgcacttgaaggccacacgccccctcttggaggttacaaggtgacagctaagtgttttggacaccttaccaaacagctcatgaccctcgccgatggacgggtggtgcttgctctcgaagggggccatgatcttactgccatctgcgacgccagcgaggcatgcgtcaacgctctcctcgggaatgaactggaaccacttgcggaagacatcctgcatcagtcacccaatatgaatgccgtgatatccttgcagaagatcatcgagattcagagcaagtactggaagagtgtgcggatggtggccgtccctaggggatgtgctcttgcgggggctcagttacaggaggagacagagacagtgtctgcactggcctccctgactgtcgatgtcgagcagccgttcgcccaggaggatagccgaaccgcaggagaacccatggaagaggagcccgcactctag

SEQ ID NO: 190821 - DNA, 1773 bp, Artificial Sequence
  Description of Artificial Sequence: Synthetic coding sequence
atgcacagcatgatcagcagcgtggacgtgaagagcgaggtgcccgtggggctcgaacctatttccccacttgacctccgtaccgacctgcggatgatgatgcctgttgtggaccccgtggtgcgggaaaaacagctgcaacaggagctcctcctcattcagcagcagcagcagattcagaagcagctactaatagcagaattccagaaacagcatgagaacctaacacgccagcatcaggcacagctacaagagcacattaaagagttgctcgccataaaacaacagcaagaactgttggagaaggaacagaagctcgaacagcagcggcaagagcaagaggtcgagagacaccgccgtgagcaacagctgccacctctgcgcggtaaggatcgagggagagagagggcggtggcatccaccgaggttaagcagaagctgcaagaattcctcttgtctaaatcagccaccaaggatacccccactaatggaaaaaaccacagtgtgtcccgccatcccaagctctggtataccgcagcacaccatacttctctcgatcaaagcagcccacccctttccggaacttctccttcttataagtatactctacctggcgcacaagatgccaaggacgatttccctttgaggaagaccgcctcagaaccaaacctgaaggtgcggagccggttgaagcaaaaggtggccgaacggaggagttcccctctgctgcggaggaaggacggcaacgtcgtcacttcattcaagaaacgcatgtttgaggtgactgagagctctgtttcttccagtagccctggatcagggcctagcagccccaacaacgggcccacaggtagcgttacggaaaacgaaacgagcgtcttgcctccaacccctcacgccgagcaaatggtgtcccagcagagaattctcatccacgaagatagcatgaaccttttgagcctgtacacgtcacctagtctgcccaacatcacccttggacttccggccgtcccctcgcagctcaatgcttcaaactcactgaaggagaagcagaagtgtgagacccaaactttgcgacagggcgtcccacttccggggcagtacggtggaagtattcctgcttcgtcgtcacatccccacgtcaccctggaaggcaaaccaccaaacagttcccatcaagcactgctccagcacctgcttctcaaggagcagatgagacaacagaaactcctagtcgcgggtggagttcctctgcacccacagagccccctcgctacaaaagaaagaatatccccggggattaggggaacacataagctgcccaggcatagacctttaaatcgaacccagtccgccccccttcctcagagcactctcgcgcagttagtgatccagcagcaacatcagcaattcctggagaagcaaaagcagtatcagcagcaaattcacatgaacaaactgctgtccaaatccatagagcagctgaagcaaccagggtctcatctggaagaggctgaggaggagctccagggtgaccaggctatgcaggaagatcgagcgccttcctcgggtaattccacaaggtctgactcctcagcctgcgtggacgacactttaggccaggtcggagccgtgaaagtcaaggaggaacctgtagatagtgatgaagacgcccagattcaggaaatggagtctggggagcaggctgcttttatgcagcaggtgatcggtaaagatctcgccccaggatttgtcatcaaggtcatcatatag

SEQ ID NO: 190822 - DNA, 1734 bp, Artificial Sequence
  Description of Artificial Sequence: Synthetic coding sequence
atgctgcagaccatctacgagagcgacagctgcttcagcagcgacggagtggccggtagggagcagttgctggctcagcaacgcatgcacagcatgatctcctctgtcgatgttaagtccgaagtccccgtggggcttgagcccatatctcccctggatcttcggaccgatctcagaatgatgatgcctgtcgtggaccccgtggttcgggaaaaacagctgcagcaagaacttctcctgatacagcagcagcagcagatccagaagcagctccttatcgcggagttccagaagcagcatgaaaaccttactcgccaacatcaggctcagctccaggaacacatcaaactgcaacaagaattgctggccattaaacagcagcaggaactgctggagaaagagcagaagctcgaacagcagagacaggagcaagaggttgaacgacatcgacgcgagcagcagctgccacccttgagaggaaaagaccgcggaagggagcgcgccgttgcctcaaccgaagtaaagcaaaagctgcaggaatttctgctgagcaagtcggccactaaggatacgcctactaacggaaagaaccattccgtctctcgtcacccaaaactatggtataccgccgctcatcatacatctttagatcagtccagcccacctctgtcgggcacatccccctcttacaaatatacgctgcctggtgcccaggatgcaaaggacgattttcccctgagaaagactgaatcaagcgtaagctcttcatcccctgggtcgggtccctcgtcccccaacaatggccccactggaagcgtaacagagaacgagaccagcgtgctgccccctacgccccatgcagagcaaatggtgagtcagcaacggatcctaatacatgaggacagcatgaaccttctgagcctttatacatcaccctcattgccaaatatcactcttggcctgccagcagtgccttcacagctcaacgccagcaactcgctcaaagaaaagcagaaatgcgaaacccaaacactccgtcagggggtccctctgcccgggcagtacggtggatctataccagccagttctagccaccctcacgtgacactcgaaggaaagccacccaattcatctcatcaggctttgctgcaacacctcctactgaaggagcagatgcgtcaacagaagctgctcgtagcagggggtgttcccctgcacccccagtccccactggctacaaaggagcgaatcagccctggaattaggggaactcataagctgcctcgacacagacctcttaatagaactcaaagcgctcctctgccccagagcaccctggcccagttagtaattcagcagcagcaccaacagttcctcgagaagcaaaaacagtaccagcagcagatccatatgaacaaactgctgtcaaagagtatcgagcagttgaagcagcctggttcacacttggaggaagctgaggaagagttgcaaggtgaccaggccatgcaggaagatagagcacctagttcagggaattccacacggagcgatagtagcgcctgtgtggacgacactttaggccaggtcggagctgtgaaggttaaggaagaaccagttgactcagacgaggacgcacagattcaagagatggagtcaggtgagcaagcagccttcatgcaacaggtaattgggaaggatcttgcccccggatttgttatcaaggtgatcatatag

SEQ ID NO: 190823 - DNA, 3201 bp, Artificial Sequence
  Description of Artificial Sequence: Synthetic coding sequence
atgcacagcatgatcagcagcgtggacgtgaagagcgaggtgcccgtgggcttggagccaatttctccacttgatctgcggacggatctaagaatgatgatgcctgtcgtggacccagtcgtgcgcgaaaaacagctacagcaggaactgctcctgattcagcagcagcaacagatccagaagcagcttttaatcgcagagtttcagaaacagcatgagaatctgaccagacagcatcaggcacagctccaggagcacattaaagagctcctcgcaataaagcagcagcaggaattgttggaaaaggagcagaaactggaacagcaaagacaggagcaggaggttgagcgtcatcggcgcgaacagcagcttcctccattgagggggaaggaccgcgggagagagcgagctgtggcttccactgaggttaagcagaaactccaggagttcttattgagtaagtccgctacaaaagacacgcctaccaacggaaagaatcactccgtgtctcgccaccccaaactctggtacacagccgcccatcatacttccttggaccaatcttcacctcctctgtcaggtacctctccttcctacaagtacaccctgcccggcgcacaagatgctaaggacgattttccgttgcgcaagactgccagcgaacccaacctgaaggtccggtctcgactaaaacagaaagtagcagaacggcgctcctccccactgctacgtcgaaaggatggcaatgtggtaaccagttttaaaaaacgcatgtttgaagtgaccgagagcagtgtttcctctagttcccccgggtctggcccttcctccccaaataacggccccaccgggtccgtgactgaaaacgagacatctgtattacctcccacaccccacgcagagcaaatggtgtcccagcagcgaatcctcattcatgaagacagtatgaatctgctgagtctttatacaagtccatctctccccaacattactctcggccttcccgctgttccttctcagctcaatgcgtctaatagtctgaaggaaaagcagaagtgcgaaacccagacgctcagacagggtgtacctcttccgggtcaatatggaggcagtattcccgctagttctagtcacccgcacgttacacttgagggtaaaccacccaactcaagtcaccaagctctgcttcagcatcttctgctaaaagaacagatgcgtcagcagaaactgcttgtcgcgggcggagtacctttacacccccagtcacccctcgcgaccaaggagaggattagtcccggtatcaggggaacacataagctcccaaggcacagaccgttaaatcgtacccagagcgcgcctcttccacagagcacactggcccagctcgtcatccaacagcagcaccagcagtttctggaaaaacagaaacagtaccagcagcagatccacatgaacaaactgctctctaaaagtattgaacaattgaagcaacctggtagccacctcgaagaggcagaggaggaacttcagggagaccaagccatgcaggaggatagagccccttcctctggaaactcgaccaggagtgattcctccgcctgcgtcgacgataccctcggacaggtgggagccgtgaaggtgaaagaagagccagtggatagcgatgaagatgcccagatacaggagatggaatccggggaacaggctgcttttatgcagcagcccttcctggagccaactcacacgagggctctgtctgtcaggcaggcacctctggccgctgtgggtatggatgggctggaaaagcacagactggtctcccggacacactcctccccagctgccagcgtcctgccccatcccgctatggacagacccctgcaacccggatccgctactgggatagcttatgatcctctgatgctcaagcatcagtgcgtgtgcggcaacagcacaacccatcctgaacacgctggacgcatccaatccatctggtcccgcctacaggaaaccggattgctgaataaatgcgagcgaatccaaggtagaaaggccagcctagaagaaattcagctggttcacagcgaacaccatagcctcctgtacgggacaaacccccttgatgggcagaaactggatcctagaatactgctgggggacgattcccagaagttcttcagttctctgccttgcggggggttgggggttgactctgatacaatttggaacgagctacattcatccggggcagcccgaatggctgtcgggtgtgttatagagctcgccagtaaggttgcctctggggagcttaaaaacggttttgccgttgtgcgcccccctgggcatcacgcagaagagtcaacagccatggggttctgcttttttaactctgtggccatcactgccaaatatctgcgcgatcagctcaatatttctaagatccttattgtggatctcgacgtgcatcacggcaatggcacgcagcaggcgttttatgccgaccccagcattctgtacattagtctacacaggtacgacgagggaaacttcttccccggatctggggcgccaaacgaggtcgggacggggcttggggagggttataacataaacattgcatggacaggaggacttgatccacctatgggggacgtggaatacctggaagctttccggaccattgtgaaaccagtggctaaggagttcgacccagacatggtattggtcagcgcgggctttgatgccctggagggccatacgcctccattgggtggttataaagtcacagccaaatgcttcgggcacctcactaagcagctgatgacattggctgatggccgcgtggtcctggccctggaagggggacacgacttgacagccatttgcgatgctagcgaagcatgtgtgaacgctctgctgggcaatgaactcgagccactggccgaagatatactgcatcagtccccaaatatgaatgccgttattagcttacagaaaattattgaaattcagtccaagtattggaaatccgtacgcatggtggccgttcccagaggatgtgcgcttgccggagcgcagctccaggaagagacagaaaccgtctctgccctggccagtctgacggtcgatgttgagcagcctttcgcacaagaggattccaggactgctggcgagccaatggaagaagaacccgcattatag

SEQ ID NO: 190824 - DNA, 447 bp, Artificial Sequence
  Description of Artificial Sequence: Synthetic coding sequence
atgcacagcatgatcagcagcgtggacgtgaagagcgaggtgcccgtgggtcttgaacctatctctccactggacctccgaacggacctgaggatgatgatgccagtggtcgacccggtcgtgcgcgagaaacaactgcaacaggaactgctgcttattcagcagcaacaacagatccaaaagcagctgctgattgcagagttccagaagcagcacgagaatctgactcggcagcatcaggcccagcttcaggagcatataaagctccagcaggaactgttagctatcaagcagcagcaggagttactagagaaagagcagaaactggagcagcagaggcaggaacaagaggtcgaaagacacagacgggagcaacagttgcccccactgcggggcaaggatcgaggacgagaaagggcagtcgcctctacagaagtaaagcagtag

SEQ ID NO: 190825 - DNA, 417 bp, Artificial Sequence
  Description of Artificial Sequence: Synthetic coding sequence
atgcacagcatgatcagcagcgtggacgtgaagagcgaggtgcccgtcggcctcgaaccaatcagtccactggacctccggactgatctccgcatgatgatgcctgtagttgatccagtggttagagagaagcagctccaacaagaactgctgctgattcagcagcagcagcagatacaaaaacaactgctgattgctgaattccagaagcaacacgagaatctgacacggcagcatcaggctcagcttcaggaacacatcaaactgcagcaggaactgttggctattaagcagcagcaggaactgctggaaaaagaacagaagcttgaacagcaacgtcaggagcaggaggttgagaggcaccggagagagcaacagctaccacctctcagagggaaagacagaggaagagaatag

SEQ ID NO: 190826 - DNA, 1767 bp, Artificial Sequence
  Description of Artificial Sequence: Synthetic coding sequence
atgatgagcagccccgcccagcccgacctgatgtggaacctggtgccctgggtgctcttctgtgggtgttgccgcatcttcccagatggagtcgctggacgggaacagctcctggcccagcagagaatgcattcaatgattagttctgtggacgtgaagtctgaggtacccgtcggattagaacccatatcacccctcgatctccggacagatctgcgaatgatgatgccggtggtcgatcccgttgtgagggagaagcaactgcagcaagagctgttgctgattcagcagcaacagcagatacagaaacagttgctcattgcagaattccaaaaacagcatgagaacctgacaaggcagcatcaggcgcaattgcaagagcacataaaggagctgctggccattaaacaacaacaggagttactggaaaaggaacagaagttggagcaacagcgccaggaacaggaggtggagcgtcaccggcgagaacagcagctacctcctctgcggggtaaggatcgaggaagggagcgtgcagtcgcaagcaccgaggtcaagcagaagttacaggagttcctgctcagcaaatccgctaccaaggatactcctaccaacgggaagaatcactctgtgagccgccatcccaaactttggtacacagctgcccaccacacctctctggatcaatcttccccaccgctgagtggcacatctccatcttataaatacacactgcccggagcccaggacgccaaggatgactttcctctgcggaaaaccgaaagctctgtgtcttcttcttctcctggcagtggcccaagtagtcccaataacggaccgactggttctgtgactgagaacgagacatctgtgctgcccccgacaccacacgccgaacaaatggtaagtcagcagcggatcctgatccacgaggattcaatgaacttactctcactttatacaagtccgtcacttccaaacatcacactcggattgccagcagttccatctcagctcaacgcctcaaatagtttaaaagagaagcagaagtgcgagactcagaccttgcgacagggagtccccttaccaggtcaatacgggggcagcataccggccagctcaagtcacccccacgtcacactagagggtaagccaccaaatagtagtcaccaggccctcctgcagcacttgctgctaaaagaacagatgagacagcagaagctgctcgttgccggcggggtgcccctccatccacagtcaccactggctactaaggagcgtatctcccctggcattagagggactcacaagcttccacgccaccgacctcttaatagaacacagagcgctcctcttccccagtccactctggcccagttggtgatccagcagcagcaccagcagtttctggagaagcaaaagcaataccagcagcagattcacatgaataaactgctctctaagtctattgaacagctcaaacagcctgggagccatctggaggaggctgaagaggagcttcaaggcgaccaagccatgcaggaagaccgcgctccgagcagcggtaattccacgcggtccgactcttccgcatgcgtggatgacacccttggccaggttggcgccgtgaaggtgaaggaggagccggtggattccgacgaagacgcccagatccaggagatggagtccggcgagcaggcggctttcatgcagcaggtaatcgggaaggacttagcgcctggattcgtgattaaggtaattatctag

SEQ ID NO: 190827 - DNA, 1641 bp, Artificial Sequence
  Description of Artificial Sequence: Synthetic coding sequence
atgcacagcatgatcagcagcgtggacgtgaagagcgaggtgcccgtggggttagagcctatctccccactcgatctccggacggatctcagaatgatgatgcctgtagttgaccctgttgtgagagaaaaacaactgcagcaggagctgctcctgattcaacaacagcagcagatacagaagcaactgctgatcgccgagtttcagaaacagcatgagaatcttaccaggcagcatcaagctcagctacaggaacacatcaaggagctgctggccattaaacagcagcaggagctgttagagaaagaacaaaaattggagcagcagagacaggaacaggaggtcgagcggcatcgtcgcgagcagcagctacctccgctaaggggcaaggaccggggccgcgaaagggctgtcgcctctactgaggtgaagcagaagttgcaggagtttttgcttagcaagtccgcaacaaaagacactccgactaacggcaagaatcattccgtttccaggcaccctaagctctggtacacagcagctcaccacaccagcctcgatcagagctcaccccccctgagcggcacttctccaagttacaaatataccctgccgggcgctcaagacgccaaagacgattttccactcaggaagactgagtcttctgttagcagctctagcccagggagcggcccatcaagtcctaataacgggccaactggatccgttaccgagaacgagaccagtgtgctgcctccaactccgcacgcagagcagatggtcagtcagcagcgcatcttgattcatgaggattctatgaatcttctgagcctatacacctcgccaagtctaccgaacatcactctcgggctgcccgctgttccttcgcagctaaatgccagcaacagtttgaaggagaagcaaaagtgcgaaacccagacactgcgacaaggagtgccactgcctggacagtatggcggctccattccagcatccagctctcatccacacgtgacactggaggggaaaccacccaattcatctcatcaggcacttctgcagcacctgctcctgaaggagcagatgaggcagcagaaattgttggtggctggaggcgtcccactgcatccccaatcccctcttgctactaaggaacgtatcagccccgggattagggggactcataagttgccacggcacagacctctgaacagaacccaatctgcacctttgcctcagtcaacactcgcccagctggtgatacaacagcagcatcaacagttccttgagaaacagaagcagtaccagcagcagatacacatgaacaaactcctgtccaagagtattgaacagctgaagcagcccggcagccatttagaagaggcagaggaagaactgcagggagaccaggccatgcaggaagaccgcgccccgtctagcggcaattccacacggtcggattcatctgcatgtgtggatgacacacttggacaggtcggagccgtcaaggtaaaggaggaaccggttgattccgacgaagacgcccagattcaggagatggagagcggtgagcaggccgcatttatgcagcaggtcatagggaaggacttagcgcccgggttcgttattaaggtcatcatctag

SEQ ID NO: 190828 - DNA, 3036 bp, Artificial Sequence
  Description of Artificial Sequence: Synthetic coding sequence
atgcacagcatgatcagcagcgtggacgtgaagagcgaggtgcccgtggggttggagccaatatcccctctagacttacgaactgatttaagaatgatgatgcctgtggtggaccctgtagtgagggaaaagcagctgcaacaggagctgttactgattcagcagcaacagcagatccagaaacagctgttgatcgccgaattccagaaacagcatgagaacctcacgaggcaacaccaggcgcagctccaggaacacatcaaggagctcctcgctattaagcagcagcaggagcttttggaaaaagaacagaagctggagcagcagcgacaagagcaggaggtggagcgccacaggcgtgaacagcagctcccccctttaagaggcaaagataggggccgggaacgggccgtggcttccactgaggtgaagcaaaagctgcaggagttcctcttatcaaagtcggccacgaaagacaccccaacgaacggcaagaaccactccgtatctcgacacccaaaactctggtacactgcagcccatcacacctcccttgaccaatcctcccctcccctgagtggcacatctcccagctataagtacaccctgcccggagcccaggatgcgaaggatgacttcccactgaggaaaacagctagcgagcccaacctaaaagttcgctcccgcctaaagcagaaggtggcagaaagacgttcctcccccttgttaagacgcaaggacgggaacgtggttacttccttcaagaaaagaatgttcgaagtgactgaaagttccgtgtcctcctcgtccccaggatccggaccctccagccctaacaatggccctacgggcagcgtgaccgaaaatgaaacatccgtcctgccaccaactccccatgccgagcagatggtatcacagcagcggatactgatacacgaagacagtatgaacctcctatccttatatactagcccaagcctgccaaatatcactcttggcctccccgccgtaccttctcagctcaatgccagcaatagtcttaaggagaagcagaaatgtgaaacacagacgttacgccagggagttccattgcccggacagtatgggggatccattcctgcctccagcagtcacccacatgtgactcttgaggggaagccacccaattctagccaccaggcactgctacagcatctgctgctaaaagagcaaatgcggcagcagaagcttcttgtcgcaggaggggttcctctccatccacagtctcctcttgccacaaaggagcgaatttccccaggtatacgaggcacacacaagctccctcgccaccgtccgcttaataggacacagtctgccccgctccctcagagcacactcgcccagctggttatacagcagcaacaccagcagttcctggaaaagcagaaacaataccagcaacagatccatatgaacaagctgctgagcaagagcatcgagcagttgaagcagccgggctcccacctggaggaagcagaagaagagctacagggagaccaggctatgcaggaggacagggctccaagctcagggaattccacccggtcggattcgagtgcctgcgtggacgacacattggggcaggtgggtgccgtcaaggtgaaggaggagccagttgacagtgacgaggacgctcagatccaagaaatggagtccggggagcaggccgcatttatgcagcagccattccttgaacccacccatactagagccctgagtgtccggcaggcccccttagccgccgtaggtatggacggccttgagaagcaccggctggtgagtcgcactcattcctcccctgcggctagcgtgctccctcatcctgcgatggaccggccgctacagcctggaagcgcaaccgggattgcatacgatccattgatgctgaaacatcagtgcgtgtgtggtaatagtacaacccatccggagcacgcagggagaattcagtcaatctggtcgcgcctgcaggagacaggtctgctcaataaatgtgaaaggatacaaggaaggaaggcctctctggaggagatccagttggtgcacagcgaacatcacagcttgctgtatggaacaaaccccctggatggtcagaagctggatccccgcatcctcctcggcgatgactcacagaagtttttttcctctctcccctgtggcgggctcggggtcgactccgatacgatctggaacgaacttcattcttcaggcgccgcacggatggctgttggctgtgtcatcgaactggcctctaaagttgcttccggggagctgaagaacggatttgcggtggttcgcccaccagggcaccatgcggaggagagtacagcaatggggttttgcttttttaactccgtcgctataacagcaaagtatctgagagaccagctgaatattagcaagatcttaatcgttgacctcgatgtgcaccatggtaacgggacccaacaggctttctacgcagatccctccatcttatacatctcactgcacaggtatgatgaggggaacttttttcccggttctggcgctccaaacgaagtgggcactggcctcggcgagggatataacataaatatcgcgtggacaggaggcctagatccgcctatgggtgatgtagaatatctggaagctttcaggacaattgtgaaacctgttgccaaagagtttgaccctgatatggtgcttgtttccgctggttttgacgcactcgaaggccacacgccccctctcggcggatataaagttaccgcaaaatgctttggtcatttgactaaacagctgatgacactggcggatggtcgggtggtgctggccctggagggcggccacgacctgaccgctatttgtgatgcctccgaagcttgcgtaaacgcgctcctcggaaatgagctggagcccctcgccgaggacatcctccaccaaagccctaacatgaacgcagtcatcagcctgcagaagatcatcgagatccagagcatgtctctgaagttcagttag

SEQ ID NO: 190829 - DNA, 72 bp, Artificial Sequence
  Description of Artificial Sequence: Synthetic coding sequence
atgcacagcatgatcagcagcgtggacgtgaagagcgaggtgcccgtggggctggaacctatctccccatag

SEQ ID NO: 190830 - DNA, 3210 bp, Artificial Sequence
  Description of Artificial Sequence: Synthetic coding sequence
atgcacagcatgatcagcagcgtggacgtgaagagcgaggtgcccgtgggtctggagcccatctctccactggatctacgaacagacctgagaatgatgatgcccgtggtcgatcccgtagtccgagagaagcagttgcagcaggagttactcctcattcaacagcagcagcagattcagaaacagctcctcatcgctgagttccagaagcagcacgaaaatcttactcgccagcatcaagctcagctccaggagcatataaaactgcaacaggagttgttggctatcaagcagcagcaggagctgctggagaaggaacagaaactggaacagcagcgccaggagcaggaggtggagcgacataggagagagcagcagctcccccctttacgtggcaaggatcgcgggcgggaaagagccgtggccagtactgaggtgaaacagaagctgcaggaatttttactgtccaaatcggctacaaaagacacgccgaccaacggcaagaaccacagcgtttcccgacacccgaagctatggtacaccgctgctcaccacacatcactggatcagtccagcccacctctttctgggactagcccctcgtacaaatataccttacctggggctcaagatgccaaggacgacttcccgttgcggaaaacagcttcagagccgaacttgaaggtgaggagcagactgaagcagaaggttgccgagcggcggtcctcgcccttactcagacggaaggacggtaacgtagtgaccagctttaagaagcgcatgttcgaggtgacagagagcagcgtgagttcctcttcaccaggaagtggacctagcagcccaaacaacggccctaccggctctgtgactgagaatgagacctccgtgttaccacctactccgcatgccgagcaaatggtgagccaacagaggattttgatccatgaggacagcatgaatctgttgagcttatacacctcaccaagtctacctaacatcacactcggcctccctgctgtgccttcacagctgaacgcatcaaactctctgaaagagaagcagaagtgcgaaacccagactctccggcagggtgtgcccttgcctggacagtacggaggctccatccctgcttcctcaagccatcctcacgtcaccctcgagggcaaacctcctaacagctcccatcaagcactcctccaacatctgttgcttaaggaacaaatgcgccagcaaaagctactcgtggctggcggcgtcccgctgcacccgcagtcccccctggccacaaaagagaggatctcgcccggtatacgcggtacccacaaactgcccagacataggcccctgaatagaactcagagcgcaccactaccacaatcaactctggcccaactcgtaattcagcagcagcaccagcagtttttggaaaagcagaaacaatatcagcagcagatacatatgaataaactgctgagtaagtcaatcgagcagttgaagcagccaggaagccacctggaggaagccgaggaggaactgcagggcgatcaggccatgcaggaggatagagccccctcatccgggaacagcactagatccgactcctctgcctgtgtagacgatacactcggacaggtcggtgcagtgaaggtgaaggaagagcccgtggattctgacgaagacgcccagatccaggagatggaatctggcgagcaggccgccttcatgcagcaaccatttctggaacccacacacactagggccctgtctgtccgacaggcacccctggcagcagtgggaatggacggcttagagaagcacaggctagttagtagaacccactcaagccccgccgcaagcgttctgccccacccagcgatggacaggcctctgcagccaggaagcgctaccgggatcgcctacgaccctctgatgctgaagcatcagtgcgtctgcggcaactccaccacccaccccgagcacgcaggcaggattcagtcaatttggtctcggttgcaggaaacggggctcttgaacaaatgtgaacgcatccaaggaagaaaagcatcattggaagagattcagttagtccacagtgaacatcatagcctcctttacgggactaatccgctggacggccagaaattggatccccgtatactgctgggggacgatagccagaagttcttttcgtccttgccatgtggcgggctcggcgtggattctgacactatttggaatgagctgcactcgagcggcgctgcgcggatggcagtgggctgcgtcatcgaactcgcatccaaggtagcctccggggaactcaagaatgggttcgcagtggtgcggcctcccgggcatcacgccgaagagtccactgcaatgggcttttgtttctttaatagcgtcgcgataacagctaagtacctcagggatcagttgaacatcagcaaaatcctcattgtcgacttagacgtccaccatggaaacggtactcagcaggccttttatgctgatccatccatcttatatatttcgttgcataggtatgatgaggggaatttttttcctgggagcggagcaccaaatgaagtgggcactggactcggcgaagggtacaacattaacatcgcgtggaccggtgggttagacccccccatgggagatgttgaatacctcgaggcctttcgaactatcgttaaacccgtggcgaaagagtttgatcctgatatggtcctggttagcgctggctttgatgccctggagggccacacaccaccactgggtggatacaaagtgacggccaagtgtttcggtcacctgaccaaacagctgatgactttagccgatggcagggtagtcctcgctctagaggggggtcacgatctgacagcgatctgtgatgcgtcggaggcatgcgtgaacgcccttctcggcaacgagctcgagccacttgctgaggatattttgcaccagtctcctaacatgaatgcggttatctcgctgcaaaagattatagaaatacagagcaagtactggaagtccgtgaggatggtggccgtgccgcgggggtgcgccctggccggggcgcagctgcaggaagagacagagacggtgagcgcattggcaagcctgaccgtggacgtggaacaaccctttgcacaggaagacagcagaactgcgggtgaacctatggaagaagaaccggccttgtag

SEQ ID NO: 190831 - DNA, 1689 bp, Artificial Sequence
  Description of Artificial Sequence: Synthetic coding sequence
atgatgatgcccgtggtggaccccgtggtgcgggagaagcagctgcagcaggaacttctgctgatccaacagcagcaacaaatacagaagcagctgttaatagccgagtttcaaaaacagcacgagaaccttacgcgccagcatcaggctcagctgcaggagcacatcaagttacaacaggaactactggcaataaaacaacagcaggagctgctcgagaaggagcagaaactggaacagcaaaggcaggagcaggaggtagaaaggcacaggagagaacagcagttgccaccactgaggggcaaagatcgaggtcgagaacgtgcagtcgcatcaacagaagtcaagcagaaactgcaggagtttctgctgtctaaaagcgctaccaaggataccccaactaacgggaagaaccattccgtgtcaagacaccctaagctgtggtacactgccgctcaccacaccagcctcgaccagagttcacctcccttgtccggcacgagtccatcttacaagtacactttaccaggtgctcaagacgcaaaagacgattttccactgcgcaagactgcatccgagccaaatcttaaagtgcgaagtaggttaaagcagaaagtggccgaaagaagaagttcaccacttctacggcgcaaggatggcaacgtggtgacttccttcaagaagaggatgttcgaggttacagaaagtagtgtgtcttcttctagtcccggatccggaccatcctcacctaacaatggacccactgggtcagttaccgagaatgaaacctctgtgctgccgcccactcctcatgctgagcagatggtatcacagcagagaattctcatccacgaggattcgatgaatctgctcagcctgtacacatcaccgtctctgcctaacataacattgggcctccccgctgtgcctagccaactgaacgccagcaactctcttaaagaaaagcagaaatgtgagacgcagacgctccggcagggagtccctttaccaggtcagtatggaggcagcatcccggcatcaagttctcatccacatgtgacactcgagggaaagccacctaactcttcccatcaggcactgttgcagcacctgctccttaaggaacagatgcgtcaacagaagcttctggtggccggaggcgttcctctccatccccaatcaccactcgctaccaaggagcgaataagtccaggaatacggggcactcacaagctgccgcgacacagaccactaaatcgaacacagagcgcccctcttccccagtccaccctagcacaattagttatccagcagcaacatcagcaattcctagaaaagcagaaacagtaccagcagcagatccatatgaacaaattgcttagcaagtccatcgaacagcttaaacagccaggctcacatctggaggaggctgaggaagaactccaaggagaccaagctatgcaggaggatagggccccttcgtccgggaactcaacacgcagtgatagctcagcctgcgtcgacgatacgctgggacaagttggcgccgtcaaggtcaaggaggagcccgtggatagcgacgaggacgcccaaatccaggaaatggaatccggcgagcaggcggccttcatgcagcaagtgattggtaaagatctggcccccggttttgtgattaaagtcattatctag

SEQ ID NO: 190832 - DNA, 1542 bp, Artificial Sequence
  Description of Artificial Sequence: Synthetic coding sequence
atgatgatgcccgtggtggaccccgtggtgcgggagaagcagctgcaacaagagctgctgctcatccagcaacaacagcaaattcagaaacagctcttgattgcagaatttcaaaaacagcacgaaaatttgacacgccagcatcaggcgcagcttcaggagcacatcaaggaactgctggccataaagcagcagcaagaactcctcgagaaagaacaaaaactggagcagcagcggcaggagcaggaggtcgaaaggcaccggcgtgagcagcagctccccccacttcggggaaaggaccggggccgggagagggccgtggcaagtacagaggtaaaacagaagctgcaggagtttttactgagcaagagcgctactaaggatacacctaccaacgggaagaatcattccgtatcccgacacccaaaactgtgggccgcgcaccatacctcgcttgaccagtcatctccgcctctctccgggacaagtccatcatacaagtatactctgcctggtgcacaggatgcaaaagatgattttcccctgcgcaaaaccgagtctagcgtctcctcttcctcccccggctctggcccttcaagtccaaacaatggccccacgggatctgtgacagagaacgaaacatcagttttacccccgacccctcacgcagagcagatggtgtctcaacagaggatcctgattcacgaggattcaatgaatttgctgtccttgtacactagcccttcccttccaaatatcaccctaggcttgccggccgtaccctcacagctgaacgcctccaacagtcttaaggagaaacagaaatgcgaaacccagaccctgaggcagggagtgcctctcccagggcagtacggcggaagcatacctgcctcgagctcacacccgcacgtaacgttagaaggtaagccaccaaactcttcccaccaggcgctgctccagcacctcctcctgaaagagcagatgagacagcagaaattacttgtggcaggtggcgtgcccctgcaccctcagagccctctcgccacgaaagagcggatttcgcctggcataagaggcactcataagctgcctcgtcaccggcctctgaatcgcacgcaatccgctccactgccccagtctaccttagcccagcttgtaatccaacagcagcaccagcagttcttggagaagcagaagcaatatcagcaacagatccacatgaataagttgctgtcaaagagcatcgagcagcttaagcaaccgggaagccaccttgaggaagcagaagaggaattgcagggtgaccaggctatgcaggaagacagggcaccttccagcgggaatagcacaaggagcgactcatcagcatgtgtggacgacaccctcgggcaggttggtgccgtcaaggtaaaggaagagcctgtagattccgacgaagacgcccagatacaagagatggagtctggagaacaggctgccttcatgcaacaggtcatcggtaaggacttggccccgggatttgtgataaaagtgattatatag

SEQ ID NO: 190833 - DNA, 1980 bp, Artificial Sequence
  Description of Artificial Sequence: Synthetic coding sequence
atgcgggtgaaccacaccgtgagcaccatgctgcccacctgcatggtccaccgacaaacaatgtcttgcagtggtgcaggagggataacagcctttgtggcctttcgtgacgttgccgtatactttactcaagaagaatggcgattgctctcaccggcccaacgaacactgcacagagaagtgatgctcgagacatacaaccatctcgtatctttggaaatcccgtcatccaaaccaaaacttatagcacagctggagagaggagaagccccctggagagaggagcggaagtgccccctcgatctgtgtcctgagagcaaaccagaaatccagctgtctccttcttgtcccctcatttttagttctcaacaggccctgagccagcacgtgtggttgtcccacctgtctcaactcttcagcagcctctgggcagggaaccctctgcatctgggaaaacattatcctgaagatcagaagcaacagcaagacccgttctgctttagtgggaaagcagagtggatccaggagggcgaggatagccgcctgttatttgggagggtgtccaagaacggaacttcaaaggccttgagtagcccccccgaggagcaacagccagcacagtccaaggaggacaacaccgtcgtggatatcgggagttctcccgagcgcagagcagatttagaagagacagacaaagtgttgcatggcctggaggtgtcaggatttggcgaaataaagtacgaagagtttggccctggcttcattaaggagtctaacctcctgtctctgcagaaaacacagaccggtgagacaccctacatgtacaccgagtggggcgatagctttggcagcatgagtgtgctaatcaaaaaccccaggacccactccggtggtaaaccctacgtttgtcgagagtgcggcaggggatttacttggaaatccaatttgatcacacatcagcgcacccatagcggggagaagccgtacgtgtgcaaggattgtggtagagggtttacttggaagtctaatctgttcacccaccagcgcacacactccggcctgaagccttacgtgtgcaaagagtgcggacagtcattcagccttaagagtaacctcattacacaccaacgggcccatactggcgagaagccatacgtatgtcgggagtgcggacggggttttcgccagcactctcacttggtgcggcataaacgtactcactcaggagagaaaccttatatctgcagggaatgtgaacaggggttcagccagaagtcgcacttaattaggcacttgcggacacacaccggagagaagccatacgtatgcactgagtgcggaagacatttttcttggaagtctaaccttaagacacatcaacgaacccactcaggggtgaagccttacgtatgcttggagtgtgggcagtgcttttcactgaagagcaacctgaacaaacaccaacggagccataccggcgaaaaacctttcgtctgcactgagtgtggcaggggcttcactcggaagtctaccctcagcacacaccaaaggacacacagcggggaaaagcccttcgtatgcgcagaatgcggacgtggttttaacgacaagtctacgcttataagccatcagcgcacacacagcggggaaaagccgtttatgtgtagggagtgcggccggcggttcagacaaaaacctaacctgttcaggcacaagcgcgctcactctggtgcattcgtgtgcagggaatgtggccagggtttttgcgccaagctgaccttgatcaagcaccagcgcgcacatgctggcggaaagccccacgtttgtcgcgagtgtgggcaggggttttccaggcaatcccatctcatcagacaccagaggacccattctggcgagaaaccgtacatttgtaggaagtgcggccgggggttttcgcgcaaatctaatttaatacggcaccagaggactcacagcggctag

SEQ ID NO: 190834 - DNA, 1923 bp, Artificial Sequence
  Description of Artificial Sequence: Synthetic coding sequence
atggccaccggcctgctgcgggccaagaaggaggccttcgtggccttcagagatgttgcggtgtacttcacacaggaagagtggcgccttctttcccccgctcagcggaccctgcatcgagaagtgatgttggagacgtacaatcaccttgtgtccctggagatcccctcatctaagcccaagctgattgcccagctcgagaggggggaagcgccgtggagagaggagcggaagtgtcccctggatctgtgccctgagtctaagccagagatccaactctccccatcatgccccttaattttctcatcccaacaagccctttcacaacatgtgtggctatcccacttaagccagttgttttccagtctgtgggctggaaatccactgcacctcgggaagcattaccctgaagaccagaagcaacaacaagaccctttctgcttcagcggaaaggcggagtggatccaagagggcgaggatagccgactgttgttcggacgtgtgtctaaaaacggtacgtcaaaagccctgtcttctcccccagaggaacagcaaccagctcagagcaaggaggacaatacagtcgtggacatcggcagctcccccgaaagacgcgcagatctggaagagactgataaggtgctgcacggcctggaggtgtccggctttggagagatcaagtatgaagagtttggtcctgggtttattaaagaaagtaacttgctgagtctccagaaaacacagacaggcgagactccttatatgtacaccgaatggggagattccttcggaagcatgtctgtgctgataaagaatccacgtacgcatagcgggggcaaaccatacgtgtgtagagaatgtggacgaggctttacctggaagtcaaaccttatcacccatcaacgcactcattctggtgaaaaaccttatgtgtgtaaggattgcggccgcgggttcacctggaaatcaaatctcttcacccaccagagaacacactctggcttaaagccatatgtgtgtaaagaatgtggacagagcttcagcctgaaaagtaatctgattacccaccaacgggcgcacaccggcgaaaagccatacgtctgtagggagtgtggccggggctttagacagcatagccatctggtacgtcataagcgaacccattcaggcgaaaaaccttatatatgccgagagtgtgagcagggtttttctcagaaaagtcatttgatccggcacttgagaactcatactggcgaaaaaccttatgtttgtaccgagtgtggccgacacttcagttggaagtctaatctgaagactcatcaacgcacgcattctggtgtcaagccctatgtgtgtctggaatgtggacagtgtttttccttaaagagcaacctgaataagcaccagaggtctcacaccggcgagaaaccttttgtctgcaccgaatgcggccgtgggttcactagaaagagcacgttatccacccaccaacggacacactccggcgaaaagcctttcgtctgtgccgagtgcggacggggattcaatgacaaatctacactgatatctcatcaaagaacccatagtggcgaaaaacctttcatgtgccgtgagtgtggaagacgcttccggcagaaacctaaccttttccgtcataagcgagctcattcaggggctttcgtctgccgggaatgcggtcagggtttttgcgccaagctcactcttatcaaacatcagcgtgcacacgcaggaggcaaacctcatgtgtgccgcgaatgtggccagggctttagtcgtcagtcccatctgataaggcatcaacgcacccacagtggcgagaagccatacatttgtaggaaatgcggccgaggcttcagtcgcaaatccaacctgatcaggcaccagcgcacgcactctggatag

SEQ ID NO: 190835 - DNA, 1317 bp, Artificial Sequence
  Description of Artificial Sequence: Synthetic coding sequence
atgctggagacctacaaccacctggtgagcctggagatccccagctctaagccaaaattgatcgcccaactggagaggggggaggccccttggagggaggagaggaaatgccccctggatctgtgccccgaatccaagcccgaaatccagcttagcccctcttgtcctcttattttctcgtctcagcaagctctatcacagcatgtgtggctgtcccaccttagccaactgttctcctctttgtgggcaggaaaccctctgcacctagggaaacattacccggaagatcagaagcagcaacaggacccattttgttttagtggtaaagcggagtggatccaggagggagaagatagtcggctgctgttcggacgggtctccaagaacgggacctctaaagccctgagctctcccccagaagagcagcaaccggcccagtctaaggaggacaacacagttgtagacatcggttctagcccggagcgtagagccgatctcgaagaaaccgataaagttctgcatggactagaggtcagcggctttggggagatcaagtacgaagagttcggacctgggtttattaaggaatctaacctgctctcccttcaaaaatcacacctgatccgtcaccttaggacccacacaggagaaaagccgtatgtgtgtactgagtgcggcaggcacttctcttggaaaagcaacctgaaaactcatcagcgcacccattcaggcgtgaagccttacgtgtgcctggaatgtggacagtgtttctcccttaagtcgaacttgaacaaacaccagcgctctcacacaggtgagaagcccttcgtgtgtaccgagtgtggcaggggatttacacgtaaatcaacattatctacccaccagcgtacgcatagcggcgaaaagccattcgtgtgcgctgagtgcggaaggggtttcaacgacaaaagtaccctgatttcgcatcaaaggacccacagcggcgagaagccatttatgtgtcgagagtgtggccggagattcaggcaaaagcctaacctgttccgtcacaagcgtgcacactcgggcgcctttgtctgcagagagtgcggacaggggttttgcgccaaactgactctgataaagcatcaacgcgcccatgcgggcggaaaacctcacgtctgccgcgagtgtggacaggggttttcgagacagtcgcacctgatccggcatcaaagaacacactccggggagaagccatacatttgcagaaagtgtggcagaggcttctcaaggaaaagcaatctgatcagacaccaaagaacccattctggttag

SEQ ID NO: 190836 - DNA, 1797 bp, Artificial Sequence
  Description of Artificial Sequence: Synthetic coding sequence
atgctggagacctacaaccacctggtgagcctggagatccccagcagcaaacccaagctgatagctcagctagaaagaggggaggcgccatggcgggaagagcgcaagtgcccactggacctttgccctgagtctaagcctgaaatccagctgagccccagttgccccctcattttttcttctcagcaggcactcagccagcacgtgtggttatctcatctgtctcagcttttcagctctctgtgggccgggaatcccctgcatctgggcaagcattaccccgaagatcagaagcagcagcaagacccattttgttttagtggcaaggctgagtggatacaggagggcgaggacagcagactgctgttcggtagagtgtccaaaaatgggacgagtaaagcccttagctcgcctcccgaggagcagcagcccgcccaaagcaaagaggacaacacagttgttgacatcggctctagccctgaacgccgcgccgacctagaagagactgacaaggtccttcacgggctagaagtgtccggctttggtgagataaagtacgaagagttcgggccaggattcattaaagagtcaaatttgctgtcattgcagaagacccagacgggcgagactccctacatgtacaccgagtggggggacagcttcggatcaatgtcagtcctgatcaaaaatcctcgcacccatagcgggggaaagccttacgtttgtcgagaatgcggaagaggttttacttggaagtcgaaccttattacgcaccaacggacccactccggcgagaaaccatacgtttgtaaagattgtgggagggggttcacttggaagagtaatctgttcacccaccagcggacccactctggcctcaaaccctatgtgtgcaaagaatgcggacaatccttttccctgaaatccaacctgattactcaccaacgggctcacaccggggaaaagccttatgtctgcagagagtgtggccgtggttttagacagcacagccatctggtaaggcacaaacgcacacatagcggtgagaagccttacatatgtagagaatgtgagcagggcttttcccagaaaagccacttgatccggcacttgcggacacacaccggcgaaaaaccatatgtttgtaccgaatgcgggcggcacttctcctggaagtcgaacttgaaaactcaccaaagaactcatagtggagtaaagccctatgtgtgcctggaatgtggccagtgcttttcgctaaaatccaacctcaataaacaccaacgcagtcacaccggagagaagccctttgtttgcacagagtgtggaagaggcttcacgcggaaaagcacactctctacccaccagcgcacccattccggagaaaaacccttcgtttgtgcagagtgcggaagaggctttaatgacaagtcgactctgatctcccaccagagaacccattcaggcgaaaaacctttcatgtgccgggagtgcggccggaggtttcggcagaagcccaatctgtttcggcacaaacgcgcccacagtggggcctttgtatgccgggaatgcggccaggggttctgtgccaaattgaccctcatcaaacaccagagagcccacgctggcggtaagccccacgtgtgcagggaatgcgggcagggattttcgagacagagccatcttatccgccatcagaggactcattctggagagaagccttatatctgtagaaaatgcggcaggggcttctcccggaagagcaatctgattagacaccaaaggacacactctggatag

SEQ ID NO: 190837 - DNA, 2190 bp, Artificial Sequence
  Description of Artificial Sequence: Synthetic coding sequence
agctggctgggccccggcaaggccagcctgctgcggagcttcccccacttgtgcacactgctgcccgacttccgtttgcaagaccctcagcgcgctcctgctttccacttgtcctccgagactctgcccttctctaggaagtctacgcaggagaccaggaagatggcgactgggctcctcagggctaaaaaggaagcttttgttgcttttagggatgtggccgtttattttacccaagaagaatggcgcttactttcccctgcccagaggaccctgcaccgtgaagtgatgctggagacttataatcatctggtttctcttgagattcccagcagcaagccaaagctgatcgcccagcttgaacggggagaggctccatggagagaggaaaggaagtgcccactcgatttgtgtccggctgaatccaagccggaaattcagctcagtccctcatgccctttgatctttagctcccagcaggctctaagccagcacgtgtggctctcgcacctgtctcagctcttttctagcctgtgggccggcaatccccttcatctgggtaagcattatcccgaggatcagaagcaacagcaggaccctttttgttttagcggaaaggctgagtggatccaagaaggagaggattcgcgcttgctgtttggcagggtgagtaagaacggcacgagtaaggctctgtcttctccaccagaggagcaacagccggcacagtcaaaagaagataacaccgttgtcgatattggaagtagtcccgagagacgggccgacctggaggagactgataaggtactccatgggctggaggtgtctgggttcggcgaaataaaatatgaggagttcggccccggttttataaaggagagcaacctactgtccctccagaagacacagaccggtgagactccttacatgtacaccgagtggggagactccttcggcagcatgtcagtcttgattaaaaacccccggactcatagcggcggcaagccctacgtgtgcagggaatgcggacgtgggtttacatggaagtcaaaccttataacacatcaacggacacattccggtgaaaagccctatgtttgcaaagattgcggccgaggcttcacttggaaatcgaacctgtttacacaccagagaacccacagcggattgaaaccatacgtctgcaaagagtgtggacaatcattcagcctaaaaagcaatttaatcacgcaccagagggcgcacacaggcgaaaaaccatatgtctgccgcgagtgcggccgaggatttcgtcagcactcacacttggtgaggcataagcggactcattcaggcgagaagccatatatctgtagggagtgcgagcagggattttcccagaagagtcacttgattcgacatctgaggacccataccggggagaagccctacgtttgcaccgagtgcggaagacacttcagttggaagagtaacttaaagacccaccagagaacgcacagcggggtcaaaccctacgtctgcctagaatgtggacaatgcttcagtttgaaatcgaacctgaacaagcaccagcgaagccacactggtgaaaaaccctttgtatgcactgagtgtgggagaggcttcacaaggaagtcgacactgtctactcatcagagaacacactccggagagaagccgtttgtgtgtgccgagtgcggaagaggcttcaatgacaaaagcaccttaatcagtcatcagaggacccattccggcgagaagccattcatgtgtagggagtgcgggagacgatttcggcagaagcccaacctcttccgacacaagcgcgcacattccggtgccttcgtttgccgagaatgcggccaggggttttgtgcaaagctgactcttattaagcaccagagagcccacggaggcagcttgatgtgtgccggctctgttgggaaggccctcgccggttctcataccagcctggacaccaggggacatatacaggaacggagcctaatctttgccgagagcgtggatggcgctctggtcggatcccccaccctctccgacattcgaggacatacccaagatcggaactttatgtgcattggcaatgtggtacaacccctggcacgcagccataccagcagcgacactcgcggacacactcagtgctgtggatttttctcccactgctag

SEQ ID NO: 190838 - DNA, 1161 bp, Artificial Sequence
  Description of Artificial Sequence: Synthetic coding sequence
atgtacaccgagtggggcgacagcttcggcagcatgagcgtgctgatcaagaaccccagaacacactccggaggaaagccctacgtctgccgtgagtgcggcaggggtttcacatggaagtctaaccttatcactcaccagagaacgcacagcggcgagaagccctacgtgtgcaaagattgtggtcggggcttcacttggaaaagtaacttgttcacccaccaaaggactcatagcggcctgaaaccctatgtctgcaaggaatgcggccagagcttcagcttgaaaagtaaccttatcactcaccagcgggcccatactggcgagaagccgtacgtgtgcagggagtgtggaagagggtttcgtcagcacagccacctcgtgcgccataagaggacccactccggagaaaagccatatatctgtcgtgagtgcgaacaaggattctctcagaagagccacctgatccgtcatctccggacgcataccggtgagaaaccatatgtctgtaccgaatgtgggcggcacttctcttggaagtccaatttaaagactcaccaaagaactcactctggcgtgaagccatatgtttgcctcgagtgtggtcagtgtttttctcttaagtcaaatctgaataagcaccagcgttcccatacgggggaaaaaccttttgtctgtactgagtgcggacgcggtttcacacggaagagtacactatccacgcaccagcggacccacagcggggagaaaccattcgtgtgtgcagagtgcggacgagggtttaacgacaagtctaccctcatatcccaccaacggacccactccggcgagaaaccttttatgtgtcgcgaatgtggaaggcggttccggcaaaaacctaacctctttagacacaaacgtgcacactcaggcgccttcgtgtgtcgcgagtgcggccaaggcttctgtgcaaagttaacacttatcaagcatcagagagcccatgctggcggtaaaccacacgtgtgtcgagagtgtgggcaagggttcagccggcagtcccacttaattcggcaccagcgcactcactccggcgagaagccttatatttgccggaaatgtggcagaggcttctctcgcaagtctaacctcatcaggcaccagaggacccactcaggctag

SEQ ID NO: 190839 - DNA, 612 bp, Artificial Sequence
  Description of Artificial Sequence: Synthetic coding sequence
atgggcggcagcctgcgggtggccgtgctgggcgcccccggcgtgggtaaaacggccattataagacagtttctgttcggagattatccggaacggcaccggcctacggatgggccaaggctttacaggcccgctgtcctgctggatggagctgtatatgatttatccatccgggacggcgacgtggcgggcccaggctcatcccccggtggccctgaggagtggcccgatgctaaggattggtccctgcaggacactgacgccttcgtcctcgtgtatgatatttgctcaccagactctttcgactacgtcaaagcattgcggcaacgcatcgcggaaacacgccccgcaggggctccagaggcccccattttggtggtggggaataaacgcgacagacagcgcctgagattcggaccccgacgggccctcgccgcactcgtaagacgggggtggcgttgcggatacctcgagtgcagtgccaagtacaattggcatgtattacgactgttccgggagctactcagatgtgccctggtaagagctcgccctgcgcacccagcactgcgcttacagggtgccctccaccccgcaagatgcagccttatgtag

SEQ ID NO: 190840 - DNA, 1479 bp, Artificial Sequence
  Description of Artificial Sequence: Synthetic coding sequence
atggacctgctgaaggccatcaccagccccctggccgccggcagcaagccctctaaaaaaaccggagaaaagtccagcggttcaagctcgcatagtgaaagcaagaaggagcaccacaggaagaaggtctccggatcgagcggcgaattgccactggaggatggaggaagccacaagtctaaaaagatgaagccattatatgtcaacacagaaaccctcactctgagggagccagacggtttaaaaatgaagctcatcttgtccccaaaagagaagggtagcagctctgtggatgaagagtcctttcagtaccctagccagcaagccaccgttaaaaagtcctcaaaaaagtccgcgagagacgaacagggtgccctgttactgggtcacgaattgcagtcctttttgaaaaccgctagaaaaaagcataagtctagctcagacgctcacagttccccgggccctgaggggtgtgggtccgacgctagtcaattcgccgagtcccattcagccaacctcgacctctccggactggaaccaatattggttgaaagtgactcctcatctggcggtgagcttgaggctggcgagcttgtcattgacgattcttacagggaaatcaaaaaaaaaaagaagagcaaaaagtcaaaaaagaagaaggacaaagagaagcataaggaaaagaggcactccaagtctaagcgaagtttgggcctatcggctgtgccagtaggtgaagtaaccgtgacctccgggcctccaccttcaattccatatgccggcgcagccgctccacccctgccgctgccagggctccacacagacggacacagtgaaaagaagaagaaaaaggaagaaaaagataaggaacgagaacgaggcgaaaagcctaagaagaagaatatgagcgcatatcaggtattctgtaaggagtacagagttactatcgtagctgatcacccaggcatagattttggcgagctttccaagaagctggcggaggtctggaagcaattacccgagaaggataagctgatttggaagcagaaagcccagtacctgcagcacaagcagaacaaagccgaagcgactactgtaaagagaaaggcttcatcttcagagggatctatgaaagtaaaggcctcaagtgtgggcgtcttgagccctcagaagaaatccccgcccacaaccatgcttttacctgcttctcccgcaaaggcaccggaaacagagcccatagacgtcgcagcccacctccagctgctcggcgagtccctgagcttgattggccatcgcctccaggagacagagggaatggtggcagtgtcaggaagtctcagcgttcttctggactcaattatatgcgcactaggccccctcgcgtgccttaccacgcagctgcctgaactgaatggctgtcccaagcaggtcctgtccaatactctggacaacatcgcctacatcatgccagggctttag

SEQ ID NO: 190841 - DNA, 1896 bp, Artificial Sequence
  Description of Artificial Sequence: Synthetic coding sequence
atggtgagcaagctgagccagctgcagaccgagctgctggccgccctcctagagtcaggactgtctaaggaagcgctgattcaggctttaggtgaacccggcccctacctactcgcaggtgaggggcccttggacaaaggcgagagttgtgggggcggtcggggagaactcgctgagctccctaatggactgggagagaccagaggatcagaagacgagacagacgacgacggagaagactttacacccccaatcctgaaagaactcgagaatctgagcccagaagaagcagctcatcaaaaggctgtcgtggaaaccttactgcaggaggacccttggagggtcgcgaaaatggtgaaatcataccttcaacagcataacatcccgcagagggaagtggtcgatacaacagggctcaaccagagccacctgtctcaacacctcaataagggcactcccatgaagacacagaaacgagctgctctctatacttggtacgtcaggaagcagagagaggtggctcagcagttcacacacgcagggcagggcggcctgatagaggagcctactggagatgaactcccaaccaagaagggacggcgaaaccgcttcaaatggggacccgcctcccagcagatactgttccaggcttacgagagacagaaaaacccttcaaaggaggagagagagacccttgtagaagaatgtaatcgtgccgaatgcattcagcgaggcgtcagccctagccaagctcaaggactgggctctaacctggttactgaggtaagggtgtataactggttcgccaatcggagaaaggaggaagccttcaggcataaactggcgatggatacatacagtgggccacctccaggccccggacccggccccgcgctacccgcccactccagtcctggactgccacctcccgcactgtccccctccaaggtccacggcgtccggtacggacagcccgccacctccgagacagctgaggtcccgagcagcagtggtggcccactggtgacagtctctacacccttacaccaagtctcccccaccggcctggaaccatcccattctttgttaagcaccgaagccaaactcgtgagcgctgcagggggcccgctccccccagtctctactctgactgccctacactctctggagcagaccagccccggcttgaaccagcagccccagaacctgattatggcttcactaccaggtgtcatgaccattgggcccggcgagcctgcttccctcggaccaacatttacaaatactggagcgtccaccctggtgataggactggcgtctacccaagcccagtctgtgcccgttatcaattctatgggatccagtttgaccacattgcagcccgtacagttcagccagccactacatccgtcttatcagcagccactgatgccccccgtgcagtctcatgtgacccaatcccccttcatggcgacgatggcccagcttcagtccccccatgccttatactcccacaaacccgaggttgcacaatatactcacacaggactgttgccccagacaatgctgataactgacacaacaaatttgagcgctctggcctccctcaccccaaccaagcaggtgtttaccagcgacaccgaagcatctagtgagtctgggctccacacaccagcaagccaggctaccacactgcatgtcccctcgcaagatcctgccagcatccagcacctgcagcctgcccatcgactgtctgccagcccaacggtgtcatcttctagtctggtactttaccaaagctcggactcaagcaatggacaatctcatctgttgccctccaatcatagcgtgatcgaaacatttatcagtacacaaatggcgagctcttcacagtag

SEQ ID NO: 190842 - DNA, 1719 bp, Artificial Sequence
  Description of Artificial Sequence: Synthetic coding sequence
atggtgagcaagctgagccagctgcagaccgagctgctggccgccctgctcgagtcaggcctgtctaaggaagcgttaatccaggccctgggagagcctggcccttacctcctcgcaggcgaggggcccttggataagggcgagtcatgcggcggaggacgaggcgagcttgccgaactgcccaacggactgggtgaaactcgaggctccgaagacgagactgacgacgatggtgaggactttactccgccaattcttaaagagctggagaatctttcaccagaagaggccgctcaccaaaaagccgttgtggagaccctactccaagaggacccctggagggtggcaaaaatggtcaaaagctacctgcaacaacataacattccacagcgggaagtggtggacactaccggcctcaaccagtcccatctgtctcagcaccttaacaaagggacaccaatgaagacgcagaaacgcgcagccctgtacacctggtacgtgcggaagcagcgagaagtcgcacagcagttcacccatgcgggccaaggtgggcttatcgaggagcctactggcgatgaactgcctactaaaaaaggtcggcgtaatagattcaaatgggggcctgccagccagcagattctgtttcaggcttacgaacgacagaagaacccgtccaaagaagagcgagaaacactggttgaagagtgtaacagggccgagtgtattcagcggggtgtaagcccttcgcaggcacaggggctgggctctaacctggttacggaagtgcgggtgtataattggtttgctaatcgcagaaaggaagaggcatttaggcacaaattggccatggatacctattccgggcccccacccggccccggccctggtccggctctccccgctcatagctcacccggactgcctcctcccgccctgagtccaagcaaggtgcacggtgtgcgttacgggcagcccgcaacaagcgagacagccgaagtaccctcgtctagcgggggcccactggttaccgtgagtacccctctccaccaggtttctccaaccggcctcgaacccagccactctcttctgagcactgaagctaagctcgtgagtgcagctggcggacccctgccccccgtgtccacactgacagccctacactctctggaacaaacatcaccagggctgaatcagcagcctcagaacttgatcatggcgagcttgccgggggtgatgaccatcggcccgggcgaacctgcctcccttgggccaacattcaccaataccggagcgagcaccctagttataggtctcgcttctacacaggcccagagcgtgcccgtcattaattcaatgggatctagcctgaccacgcttcagccagtgcagttttcccagcctctgcacccttcctaccaacaaccattaatgccaccagttcagagccatgtaacacagtctccattcatggctaccatggcacagctgcagagtcctcatggcgagcgcccagtgccccataccgcgggcgacgacgatcgtggttggctctctatggatgcgggtgagcgcggggcatggcaggccctccagagcgcctgcgtctcaggtacctccgtgttcccttactccagcaacgggcagagtcacctactgcctagcaaccactctgtgatcgagacttttattagcactcaaatggcctccagctcccaatag

SEQ ID NO: 190843 - DNA, 1566 bp, Artificial Sequence
  Description of Artificial Sequence: Synthetic coding sequence
atggtgagcaagctgagccagctgcagaccgagctgctggccgccctgcttgagagcgggttatcaaaggaggctctcattcaagcgttgggcgagccaggaccgtacctgctggctggcgaagggccccttgataagggagagagctgtgggggagggaggggcgagctagcagagttgccaaacggccttggggagactaggggatccgaagacgaaactgacgatgacggagaggacttcaccccgccaattcttaaagaacttgaaaacttaagcccggaggaggccgcccaccagaaagccgtcgtcgaaacgctgttacaggaggacccttggcgcgtggccaagatggtgaaatcctatttgcaacagcataacatcccccaaagagaagtggtggacactacgggtcttaaccagtctcacctcagccagcatctgaataagggcacccctatgaaaacacagaagagagcagctctgtacacatggtatgtgagaaaacagcgggaggttgctcagcagtttacacacgccggacaaggaggactgatagaggagccgacaggggatgagctgcctactaagaaggggagaaggaatcgttttaagtggggccccgcctcgcagcagatcctgttccaggcatatgaaagacaaaaaaacccaagcaaggaggaacgcgaaacactggtggaggagtgtaaccgcgctgagtgcattcagcggggggtgagtccaagtcaggcacagggtctcgggagcaatttagttaccgaggtacgcgtttataattggtttgctaacaggcgcaaggaagaggcatttcggcacaagctggctatggatacatacagtggtcccccccccgggcccggtcccggccctgctttgccggcccactcttcccccgggctacctcccccagccctcagccctagcaaagtgcacggagtacgatacggacagccggcaaccagtgaaaccgctgaagtaccatccagttctggggggcctctggtgaccgtaagcacgcccctgcatcaggttagtcctactggcctcgagccttcccacagtctgctctccactgaggccaagttggtgagcgctgccggcgggccgctgcctcctgtgtctacattaactgctctgcattcgttggagcagacaagccctggactgaaccagcagccacagaatctaatcatggcttccctgcccggcgtgatgacgattgggcccggcgaacccgcttcactggggcccacgttcactaacactggtgcctccacactggttattggaaaactcgtcgggatgggaggccatctcggaggcagattgatgggccagccccaaaatccaggcgcgggacgggccaccggcacacactctttcattcaccagcacgtgttcatccaatgcctgctgtggacttcacactgtgccacttcagtcattcctggagactccagcaacggacagtctcacctcctgcctagcaatcactccgtcattgaaacattcattagcacccagatggccagttccagccagtag

SEQ ID NO: 190844 - DNA, 1572 bp, Artificial Sequence
  Description of Artificial Sequence: Synthetic coding sequence
atggtgagcaagctgagccagctgcagaccgagctgctggccgccctcttggaaagtggtctctcaaaggaggcgcttattcaggccctgggcgagcctgggccgtatctgcttgccggcgaggggcccttagataaaggagaatcatgtggtggaggacggggggaattggctgagctgcctaacggcctgggcgaaacgcgcggatccgaggatgaaaccgacgatgacggtgaagatttcacacctcccatcctgaaagagctggaaaacctctcacccgaggaggcggcccaccagaaagcagtcgtagaaaccctcctgcaagaggacccgtggagagtcgcaaagatggtgaagtcatatctgcagcaacacaatattccacagagggaagtcgtggatacgaccgggctgaaccaatcacacctcagccagcatttgaataaggggacccccatgaagacacagaaaagggccgctctgtacacgtggtatgtccgcaaacagcgggaagtcgcccagcagttcactcacgccgggcagggcggcctcatcgaagaaccgacaggcgatgaattgcccactaagaaggggcggcgtaacaggttcaagtggggacctgcctctcaacagattctgtttcaggcttatgaacgccagaaaaaccctagcaaggaagagcgagagaccctggtggaggaatgtaaccgggctgaatgcatccagaggggtgtgtccccatctcaagcccaggggctggggtcaaatttagtgaccgaagtcagtgcagccggggggcctctacctcctgtttccacgcttacagcattgcattccctcgagcagacctcccccggacttaaccaacaaccccagaacttaattatggcgagtcttcccggcgtgatgaccattggccctggcgagccggcctctctgggtccaacattcaccaacacgggcgcttccacccttgttatcgggctggcatctacgcaggcccagagtgtccccgttatcaactctatgggaagttcgcttacaaccttacaacctgtccagttctctcaacccctgcatccttcctaccaacaaccattgatgccacctgtccagagtcatgttacccagagccccttcatggccacaatggctcagctccagtctccccacgcactatattctcacaaacccgaagtggcccaatatacacacacggggctgctgccccagaccatgctgattacagacactactaacctcagcgccctcgcatctttaacgccaacgaagcaagtgttcacatcggatacggaggccagtagtgagtctggcctgcacaccccggcaagtcaggcaacaacactgcacgtcccaagtcaggatcccgcaagtatccagcatctacagccggcacaccgattgtccgctagccctaccgttagcagcagttcactggtgctctaccaaagctccgattcgtccaacggccagtcccatctgcttccctctaatcacagtgtgattgagacctttatttccactcagatggcaagctcctcccagtag

SEQ ID NO: 190845 - DNA, 1812 bp, Artificial Sequence
  Description of Artificial Sequence: Synthetic coding sequence
atggtgagcaagctgagccagctgcagaccgagctgctggccgccttgctagaaagtggcctctccaaggaagccctcattcaggccctgggggaacctgggccctatctgttggcaggagaaggccccctggacaaaggagagagttgtggagggggcaggggggaattggccgagctccctaacggattaggcgagacccgcggctcagaagacgagactgatgatgacggagaggacttcactcccccgatcttgaaagagttggagaatctgagccccgaggaggctgcccaccaaaaggccgtagtggagacactgctgcaagaggatccatggagggtcgcaaagatggtcaagtcttatcttcagcagcataacataccccagagagaggtggtggataccactggcctgaatcagagtcacctgtcacaacacctgaacaaagggactcctatgaagacacagaagagagccgcactgtacacatggtacgtaaggaaacagcgagaagtagcgcaacagtttactcacgctggacaggggggtctcattgaagaacccaccggagatgaactgccaacaaaaaaggggagaaggaatagattcaagtgggggccagcatcccagcagatcctcttccaggcatacgaaagacagaaaaatccctctaaggaggaacgagagaccctcgtggaagaatgtaaccgagccgaatgcattcagcgtggggtgagtccaagccaggcccagggactgggctctaatctggtcacagaggtgcgtgtctacaattggttcgcgaacaggaggaaggaggaagcgtttagacacaaactggctatggatacatattccggtcctcccccgggacccgggcctggtcccgccttgcccgctcactccagtccagggctgccccctccagcacttagccctagcaaggttcacggcgtgcgctatggccaacccgcaacctccgagaccgccgaagtgccatcatcgtccgggggccccctggtgacagtatccaccccgctccaccaggtctctcctactggcctggagccctctcacagcctcctgagtacggaggccaagttggtctccgcggccggcggaccactgcccccagtcagtacgctgacagcattacattcactcgaacagacttcaccaggccttaaccaacaaccccaaaatctgatcatggcctctctgccaggcgtaatgactattggtcctggagagccagctagcctgggaccaacatttacaaacaccggagccagtacacttgtgatcggtctcgcctctacccaggcgcagtcggtgcccgtgatcaacagcatgggtagttcccttaccaccctgcagccagttcagtttagtcaaccccttcatcccagctaccagcagcccctgatgccccctgtgcagagccacgtaacgcagtcgccttttatggccaccatggctcagttgcagagtcctcatgccttgtattcacacaagcccgaggtggctcagtatacacacaccggccttttgcctcagacaatgctgatcactgatactacgaacctcagcgccctggccagcctgacccccaccaaacaggtctttacgagtgataccgaggcatcatcagagagcgggttgcacacacccgcctcccaggccactactcttcacgtgccatctcaggatcccgcatccattcagcatctgcaacccgcacaccggctgtcggcctctccaacagtgtccagcagcagtctggtcctatatcagagtcttggactatag

SEQ ID NO: 190846 - DNA, 837 bp, Artificial Sequence
  Description of Artificial Sequence: Synthetic coding sequence
atggtgagcaagctgagccagctgcagaccgagctgctggccgccctgctggagtcgggtctgtctaaggaggctctgattcaggcactgggtgagccgggaccatacttacttgccggcgaaggacctcttgataagggagaatcctgtggcgggggtagaggggaattagctgagctacctaatggtctaggcgagacccgtggatcggaagacgagacagatgacgatggcgaggatttcacgccaccgatcctgaaggaactagaaaacctgagccctgaagaagccgcccaccagaaagcagtggtggagacgttattgcaggaggatccatggcgagttgctaagatggtgaagtcttatctgcagcagcacaacatcccacagagggaggtcgtagacactacaggtctgaatcagagtcacctgagtcagcaccttaataagggcacccccatgaagacccagaagcgcgctgccctctacacgtggtacgtgaggaagcaacgcgaagtggcccagcgccggaatgcaagccgtgagggatgccctcatcaccgccatcgcggatgggcccccacatcgtcacggagatgtgtgtcgacaacaggactccctaccggggcaaaaaaaaagccgtctggcacctcgtggccctggacaaggactgcaggccccccccagggccaggcccgcgacctgcgatgtccgctcactgcgccacttgcctgtctgcatctgccctctcctcctgtgagatcaaccgtttgtgctatggactctttgcgcccagttcgacttcagaagtaccctcaggccgcagccgtcccctag

SEQ ID NO: 190847 - DNA, 360 bp, Artificial Sequence
  Description of Artificial Sequence: Synthetic coding sequence
atggtgagcaagctgagccagctgcagaccgagctgctggccgccttgctagagtctgggttgagcaaagaggctctaattcaggcattgggcgaaccgggtccttatctgcttgctggcgaagggccactggacaagggtgaatcttgcggcggcggtagaggcgaactggccgaactgccaaacgggctgggagaaacacgtggtagcgaggacgagaccgatgatgacggagaggactttacccctccgatcctgaaagagttggagaatctgagcccagaggaggccgcacatcagaaggcagtggtggaaacattgctgcaggtgcacccatgtagagccggaagggccgattag

SEQ ID NO: 190848 - DNA, 1989 bp, Artificial Sequence
  Description of Artificial Sequence: Synthetic coding sequence
atggtgagcaagctgagccagctgcagaccgagctgctggccgccctgctcgagagcgggttaagtaaggaggccctgatccaagcactaggggagccaggtccctacctgctggctggcgaaggacctctcgataagggtgagtcatgcggcggcgggcgcggggaactggcggagctgccaaacgggctgggggagacaagaggttccgaggacgagaccgatgatgacggtgaagattttacgcctccaattttgaaggaactggagaacctttcacctgaagaagctgcccatcaaaaagcagtggtggaaaccctgttgcaagaggatccatggcgtgtggctaagatggtcaagtcgtacctacagcaacacaatatccctcagcgcgaggtggtcgatactacaggtttgaaccagtctcatctctcccagcacctcaacaagggaactcccatgaagacccagaaaagagctgccctgtacacctggtatgttcggaagcaacgcgaagtcgcccagcaatttactcacgccggccagggcggactgatcgaggagcccactggagacgagctgccaaccaagaaggggcgccgcaatcggttcaagtggggacctgcgagtcaacagatcttatttcaagcctatgaacgccagaagaatccctcgaaggaggaacgtgaaacgctcgtggaggaatgcaatagggcagagtgtatccagcggggcgtatccccttcgcaggctcagggcctgggatctaatttggttacagaggttagggtttacaattggtttgccaacaggcgtaaggaggaggctttccgtcacaaactggccatggacacttatagtggcccacctccaggacccggacccgggcccgccctcccggcccattcctctcctggactgcctcctccggccctgtccccttcaaaggtgcacggagtgcgatacggtcaacccgctacctctgaaactgccgaggtgccatcctcctctggcgggccactcgtgacggtcagcactcccctgcaccaggtttcacccacagggctcgaaccctcacactccctgctcagcaccgaagcaaagctggtgtctgccgccggaggcccacttccccctgtgtctactttgaccgccctgcattcgttggaacaaacgtcacctggcctcaaccaacagcctcagaatttgatcatggctagcttgccgggggtgatgaccatcggtcctggtgagcccgcatccctgggccccacattcacgaacacaggcgctagtacgctggtgatcggattggcttcaactcaggcccagtcagtccctgttattaactcaatgggatctagcctgacaactctccagccagtgcagttctcccagcccctacatccttcctaccaacaacccctgatgccacctgttcagtcgcacgtgacacagagtccattcatggcaaccatggcgcaattgcagagcccacatgccctgtactcacacaagcccgaggtggcccaatatacgcacaccggtcttcttcctcagactatgctcattacagataccacgaacctgagtgctctggcttcccttacacctacaaaacaggttcggtcaagacctgcggggcccccacttgcgtgtgaccgggcgccgcatcctcatattccgagagcccaggaggccgccctgctgccgcaggtgttcacctctgacaccgaagcctcttctgagtctggtcttcatacaccagcctcccaggcaactactctgcacgttccgtcccaggaccccgcttcgatccagcaccttcaacctgctcacagactttcagccagcccaaccgtctcctcctcaagcctcgtcctttaccagtcgtcagacagctctaacggtcaaagccacctcctaccgtccaaccacagtgtaattgagacctttatctcaacgcagatggcctcaagctcacagtag

SEQ ID NO: 190849 - DNA, 744 bp, Artificial Sequence
  Description of Artificial Sequence: Synthetic coding sequence
atggtgagcaagctgagccagctgcagaccgagctgctggccgccctgttggagtcaggtttatctaaggaggccctgattcaagctctgggggagcccggcccttatctactggcgggcgaaggtcctctggacaaaggggagtcctgtggtggtgggagaggtgaacttgccgagcttccaaacgggctcggtgagactcgggggtccgaagacgagactgatgacgatggcgaggactttactccgccaatcttgaaggaattagagaacctgtcacctgaggaggccgcacaccaaaaggctgtggttgaaactctgcttcaagaagatccctggagagtggcaaaaatggtgaagagttatctgcagcagcataacattccccagcgagaagtggtcgacaccactgggctgaaccagagccacttgtctcagcatctcaataagggcactccaatgaagactcagaagcgggcagcactgtacacctggtatgtgaggaaacagagggaagtagcacagcagttcactcatgcaggccaaggtggtctgattgaggagcccacaggagacgagcttcccacaaagaaggggaggagaaaccgctttaaatgggggcccgccagccagcagattctatttcaagcttatgagcgccaaaaaaacccttctaaggaggaaagggagactctggtcgaggagtgtaaccggtgcgctctgtggacggcatgtgatcagtag

SEQ ID NO: 190850 - DNA, 1359 bp, Artificial Sequence
  Description of Artificial Sequence: Synthetic coding sequence
atggtgagcaagctgagccagctgcagaccgagctgctggccgccctcttagagagtggcttaagtaaagaggcgctgatacaagcacttggcgaaccaggcccttacttattagcgggagaaggcccactggacaaaggcgagtcctgtgggggaggaaggggagaactggcggagctgccaaatggcctgggggaaacccgagggtcggaggacgagacagacgatgacggcgaggactttactcccccaatccttaaggagttggagaatctttccccggaggaggccgctcatcagaaggctgtcgttgaaaccctcctacaagaggatccatggagagtagcaaaaatggtaaaatcatatttacaacaacataacattcctcagcgggaggtggtggacaccacagggctcaatcagagccatctctcacagcatctgaataagggcactccgatgaaaacacagaagagggccgcactctatacctggtatgtgcgtaagcagcgagaagttgctcaacagtttacacacgctgggcagggtgggttaattgaagaacccacaggagatgagctgcccacaaagaaaggccgcagaaaccggttcaaatggggcccagcgtctcagcagacatccccaggactgaaccagcagccccaaaacctgataatggcgtctctgcctggcgtcatgactatcggccctggagagccagcttcgttaggccccaccttcacaaatactggagctagtacccttgtgatcgggctggctagcacccaggcccagtccgtgccagttatcaactctatgggaagttctctaacaactcttcagccagtccagttttcccagcctctgcacccatcctaccagcagccactgatgccacccgttcaatcgcacgtgacccagtccccctttatggccaccatggcccagcttcaaagccctcacgccttgtactcccacaaacccgaggtagctcagtacacccacacaggtcttctaccgcagaccatgttgatcactgataccacaaatttatccgcactggcttccctgacacctaccaagcaagtgtttaccagcgatacagaggcgtcatccgagtccggattacataccccggcttcgcaggcaaccactttgcacgtgccatcgcaggaccctgcaagtatccagcacctccagcccgcgcaccggcttagtgctagcccgactgtctcaagttcatctttagtgctgtaccagtctagcgacagtagtaatggccagtctcacctgctgccgtccaatcactccgtgattgagaccttcatttccactcagatggcctcatcctcacagtag

SEQ ID NO: 190851 - DNA, 1212 bp, Artificial Sequence
  Description of Artificial Sequence: Synthetic coding sequence
atggtgaagagctacctgcagcagcacaacatcccccagcgggaggtcgttgataccacaggactcaatcagagtcatttatcccagcacctcaacaagggaactccgatgaagactcaaaagcgggcagccctgtatacttggtacgtccgcaagcagcgggaggttgcccaacagttcacccatgcaggtcagggcggtctgatcgaggagcctactggtgatgagctacctactaagaagggcagacggaacagatttaaatggggccccgccagccagcagatcttgttccaggcgtatgaaagacagaagaacccaagcaaagaggaaagagaaacactagtggaggagtgtaacagagccgaatgcattcagcgaggggtgagtcccagccaggcccaggggttaggatccaatttagtcactgaggtcagggtctataactggtttgcaaatcggaggaaggaggaggccttccgccacaaactggccatggatacatactcgggacctccccccggccccgggcccggccctgctctgccggcccatagctcacctgggctccccccccccgctctctccccctccaaggttcatggagtgagatacggccaaccagctaccagtgagaccgccgaggtgccaagtagcagcggaggtccgctggtaacagtgagcaccccactccaccaggtgagtcctaccggcttagaaccaagccacagtctcctgagcacagaagccaagctggtgagcgccgccggaggccccttaccacccgtgagtaccctgacagcactgcactcccttgaacagacgtcacccgggttgaatcagcaaccccaaaacctgatcatggccagcctgccgggggttatgaccatcggtccaggggaaccagccagcctcggtccgacgtttacgaataccggggcctccaccctggtgatcggaaaactggtcgggatgggtggacacctcggtggtcgcctcatgggccaaccacagaaccctggggcaggtcgagcgacaggcacccactccttcatacacaccacttgtatttaccctgtgcccaccctggaccagtccctgtgctatataagcgacacatgggtcaaccagactgatcaaaacctatctaactcctcacgagaagccggaacaaagcacaacaccagcatcctgtggtaccttcgccgatag

SEQ ID NO: 190852 - DNA, 1185 bp, Artificial Sequence
  Description of Artificial Sequence: Synthetic coding sequence
atggtgagcaagctgagccagctgcagaccgagctgctggccgccctcttagaatcaggcctgtccaaagaggcgctgattcaagccctcggggaaccgggcccttacctcctcgcgggtgaaggcccactggataagggcgagtcttgtggaggcggcagaggcgaattggctgaactacctaatgggctgggggagacaaggggaagcgaagacgagactgatgacgatggggaagactttactcctcccatcctcaaagagcttgagaaccttagccccgaagaggccgcgcaccagaaagctgttgttgaaaccttgctgcaggaagacccatggagggtcgccaaaatggtgaagtcctatctgcagcagcataacatccctcaacgcgaggtcgtggacacaactggtctgaatcagagccacctgtctcagcacctcaacaaaggtacccctatgaaaacccaaaagagagccgccctctatacctggtatgtccgaaagcagcgggaagtggctcagcagttcacacacgctggccaaggcgggcttattgaggaaccgacgggtgacgagctgccaactaagaagggccggaggaatcgcttcaaatggggaccagcttctcagcaaattctctttcaggcctatgaaaggcagaagaatccaagcaaggaggagcgtgagaccctggtggaggaatgcaaccgggctgaatgcatccagcgcggagtgagcccgtcacaggcccaaggtctaggttccaatttggtgacagaagtcagggtctacaactggttcgccaatcgtaggaaggaggaagcttttcggcacaagctggccatggacacatattctgggcctcccccaggcccaggcccagggccagcgctccccgcccatagcagccctggactgccaccacccgcactctcaccctctaaggtccatggcgtcaggtacggacagcccgccacctccgagacagctgaggttccaagctcatctggcgggccactcgtgacggtgtcaacaccactccatcaagtgtctcctaccggattagagcccagccactcactgttgagtacagaggcgaagttagtgtcagctgctgggggcccccttcccccagctgcttgtagccagccaggcagggttgctcgcctatttaatttctag

SEQ ID NO: 190853 - DNA, 1917 bp, Artificial Sequence
  Description of Artificial Sequence: Synthetic coding sequence
atggtgagcaagctgagccagctgcagaccgagctgctggccgccctgcttgagtcagggctgtctaaggaagctctcattcaggctctcggcgagccaggaccctaccttctcgccggagagggaccattagacaaaggcgagtcttgtgggggtggccgaggcgaattggcagaactgcctaatggcctgggtgagacccgggggtccgaggatgagacagacgatgatggcgaggacttcacgcccccgattcttaaagaactggaaaatctgtctccagaagaagccgcccaccagaaggcagtagtggaaactctgttgcaggaagatccatggagggttgccaaaatggtgaaaagttatctacagcagcacaatatcccccaacgagaggtggtagacactacaggcctaaaccagtctcacctgtcacagcatctgaacaagggcacaccgatgaagacgcagaaacgtgccgcactatatacgtggtacgtgcgtaaacagagagaagtggcccaacagttcacccatgcagggcagggaggactcatcgaagaaccaaccggtgatgagctccctaccaagaagggccgccgcaacagattcaaatggggtccagcttctcaacaaattctgttccaggcttacgagagacagaagaacccttctaaggaggagagggaaacgctggtcgaagagtgtaatcgggctgaatgtattcagcgcggagtctccccctcacaagcgcaaggattgggaagtaacctggttaccgaagttagggtatataattggttcgccaacaggaggaaagaagaagcctttcgccataagctcgctatggacacttattccgggccaccacccggcccaggtcccggaccagcattacccgctcacagtagtccgggactgccccctcccgcactgtcaccgtcaaaggttcatggcgtgcgctacggccagccagccacttctgagactgcggaggtcccaagctcgagcggtggaccactcgttacggtctccaccccactacaccaggtctcacctactggcctggaaccctcgcattcactactatccacagaagccaagctggtgagcgcagcaggggggccacttccaccagttagtacactgacggccctccacagtctggagcagacgtcacccgggctcaatcagcagcctcagaatctaatcatggctagcttgcctggcgtcatgaccattggccctggcgagcctgccagtcttggacccacattcacgaacaccggcgcatcaacattggtaattgggttggcctctacccaagctcagtcagtacctgttatcaacagcatgggtagctctttaacaaccctccaaccggtccaattcagtcaaccccttcaccctagttatcaacagccactcatgcctcccgtccagagtcatgttacacagtctccttttatggcaaccatggctcagctccagtcaccgcacgccctgtactcacacaagcctgaggtggcccagtacactcacactggtcttctaccccagaccatgctgatcactgacaccacaaacttatctgccctggcttccctcacaccaactaagcaggaggccgcacttcttcctcaggtattcacctccgacaccgaggcgtctagtgagagcgggctgcacacgcccgcctcacaggccacaaccctacacgtcccatcccaagatccagcctctatacagcatctgcagccagctcaccggctgtccgcctcacccacagtgtcatcgagttcactcgtgttataccagagttccgactcatccaatggccagtctcacctgcttcccagcaaccactccgtcatcgaaacatttatatctacacagatggcttcctctagccagtag

SEQ ID NO: 190854 - DNA, 1416 bp, Artificial Sequence
  Description of Artificial Sequence: Synthetic coding sequence
atggtgagcaagctgagccagctgcagaccgagctgctggccgccctgctggaatccgggctgagtaaagaagccttgatacaagccctgggcgagcccggcccctacctgcttgccggagaaggacccttggataaaggggagtcctgcggcggaggccgtggcgaactggcggaactcccgaacggtcttggtgagactaggggcagtgaagatgagactgacgacgacggagaagacttcactccccccattctcaaggagctggaaaacctgtctcccgaagaagccgcccatcagaaggctgtggtggaaaccttgctgcaggaagacccctggagggtcgcaaagatggttaaatcatacctgcaacagcataacataccacaaagggaagtggtagataccactggtctcaatcaatcccaccttagccagcatctgaataagggcacccccatgaaaacacagaaacgggccgccctgtacacttggtacgtccgtaaacaaagagaggtggctcagcagttcactcacgccggccaggggggactgatcgaggagccgactggtgacgagctgccaactaaaaaaggccggagaaataggtttaagtggggccctgcgagtcagcagatcctcttccaagcatatgagcggcagaaaaatccatccaaggaggaaagagagacgctggtggaagagtgcaaccgggccgaatgcattcagaggggagtgagccccagccaggctcaggggctgggttccaatctggtgacggaagtcagggtatataactggtttgcaaataggcggaaggaagaggccttccggcataagctagctatggacacctatagtggcccgccgccaggaccgggccccggccccgccctgccagcacactcaagccccgggttgcccccccccgccctctcaccatcaaaggtgcacggggtaagatatgggcagcccgctacctcagagactgccgaggtcccatcgagttctggggggcccctggtgacggtgagcactcccctgcatcaggtctcacccacaggactggaaccctctcattcgttgctttccaccgaggcaaaactggtcagcgcagctgggggtcccctgcccccggtttcaaccctgaccgccctgcactcattggagcagacatctccgggactgaaccagcagccacaaaatttaatcatggcttccctccctggggtgatgacaattgggccaggggagcccgctagcctgggacccacgtttacaaataccggcgcttctacgctggtgattggactcgcaagcacccaagctcagagtgtgcctgtgattaactctatggggtccagcctgacgaccctgcaaccggtacagttcagtcaacagggacccagcagctag

SEQ ID NO: 190855 - DNA, 1359 bp, Artificial Sequence
  Description of Artificial Sequence: Synthetic coding sequence
atggtgagcaagctgagccagctgcagaccgagctgctggccgccctgttggagagcggtctctccaaggaggcgctgattcaggccttgggcgaacccggaccgtacctgctagcgggtgaggggccactggataagggagagtcatgtgggggtgggcggggtgagctggcagaactaccaaatggcctcggggagacacgtgggagcgaggacgaaacggacgacgatggagaagattttacgccacccatcttgaaggagcttgagaatttgagcccggaggaagctgcccatcagaaggcggtcgtagagaccctgttacaggaagatccttggagagttgctaaaatggtaaagagctacttacagcagcacaatataccacagcgcgaggtagttgacacaacaggcctcaaccagagccacctgagccaacacttaaataagggaactcctatgaagacacagaagcgcgcggctctgtacacatggtacgtgaggaagcagagagaggtggctcaacaattcacacatgccggccaggggggtctcatcgaggagcccaccggggacgagttgcctaccaaaaaagggcgccgcaacagattcaaatgggggcccgcttctcagcagatactgttccaggcttacgagaggcagaagaatccctccaaagaggagcgtgaaacgctggtggaggagtgtaacagagcagaatgcatccagaggggggtctcacctagccaggcccaggggctgggctcgaatctggtgaccgaagtgcgcgtgtacaattggttcgccaatcgccgcaaggaggaggccttccgacacaagttagccatggatacttatagtgggccaccccctggcccaggaccggggccggcattgcctgcacactccagccccggcctgccacctcctgcactgtctccttccaaggtgcatggcgtgcggtacgggcagcccgcaacaagcgaaaccgccgaggtgccctcctcaagtgggggccctctcgtgaccgtcagcacaccactgcatcaggtcagtcctacagggttagaaccctcacacagtcttttatcaactgaagccaagcttgtaagcgcagcaggcggaccgcttcctcccgtatctacgctcacggctctgcactccctagagcaaacttcacctggactcaatcagcagccgcagaacttgatcatggcatcactgccaggggttatgaccattgggcccggcgagcctgccagcctgggccctaccttcactaacacgggcgcctccactctacccctcttcggagcaggagtcgccgagttaacgagacagcagggaccgtcatcttag

SEQ ID NO: 190856 - DNA, 1071 bp, Artificial Sequence
  Description of Artificial Sequence: Synthetic coding sequence
tgatggctggtgggcttctggggcggcagcggctgcaaggagttcgggttatgtctgcctgctggtcggcagacacaacccacacggtgggggcgtagattggcttggtggacaagggccgcctggccttgtggatcccgggcaatggtgtccaagttatcacagctccagaccgagctgcttgccgctctactggagtccggtctttctaaggaagccctcatacaggccctaggcgaacccggaccgtacctgctcgccggcgaggggcctctggacaagggggagtcgtgcgggggaggaaggggcgaactggctgagctccccaatggacttggagagactcggggctccgaagacgagacagatgacgatggcgaggactttactccccccatcttaaaggaattggagaacctttctccagaggaggccgcccatcagaaggcagtcgtagaaactttgctgcaggaagacccatggcgcgtggcgaaaatggtaaaatcatatctgcagcagcacaacatcccgcaacgcgaagtggtcgacaccactggattaaatcagtcacatttgagccagcacctgaacaagggtacacccatgaaaactcagaaaagagcggcgttgtacacatggtacgtgagaaagcagagagaggtggcacaacaattcacgcatgctggccagggcgggctgattgaggaacccacaggagacgaactacccaccaaaaagggtcggagaaatcgcttcaagtgggggccagcctcccagcagatcttgtttcaggcttacgaaaggcagaagaacccgagcaaggaagagcgagagactctagtagaggagtgtaaccgggcggaatgcatacagcggggtgttagtcccagccagccacaacccgcagaatacagatctcaagccggcttaagctcatggggacccccccctccctgtcagcatcccgattccactgctcagttgggggctgatatccctaggcctcagcctgcggctccagaaccacatcacggactgacctcctggggccacgatcatagagcttggtag

SEQ ID NO: 190857 - DNA, 2247 bp, Artificial Sequence
  Description of Artificial Sequence: Synthetic coding sequence
atgctgggcaccctgcgggccatggagggcgaggacgtggaggacgatcagctgcttcagaaactcagagccagtcgccgccgcttccagcgaaggatgcagagactcatcgagaagtacaaccaaccattcgaggacaccccagtcgtccagatggccactctcacctacgaaaccccccagggtctgaggatctggggcgggaggctgatcaaggagcgcaatgagggcgagattcaggactcatcaatgaagcctgcggatcggacggatgggagtgtgcaggcagcagcttgggggcctgagctgccttctcatcgaaccgtgctgggggccgacagtaaatccggcgaggttgacgctacatccgatcaggaagagtcagtggcgtgggccttagctcctgcagtccctcagagtcctctcaagaacgagttgagaaggaagtacctgactcaggttgatatactcctccagggggcagagtatttcgagtgtgccggtaatagggccggcagggatgtacgcgtcacacctcttccttctttggcctctccggctgtgcccgccccgggctattgtagtcgcatttcaaggaaaagcccgggtgacccagccaagcccgcctcaagtcccagagaatgggatccgcttcatccaagttctaccgatatggccctcgtccctaggaacgattctctgtccctgcaagaaacctcttcctcgagctttttgagctcccagccgtttgaggatgacgacatatgtaacgtaaccattagcgacttgtatgcgggaatgctgcacagcatgtcacgacttctgagcaccaagccttccagtatcataagcactaagaccttcattatgcaaaattggaactcccggcgaagacatcggtataagtcccgcatgaacaagacttactgtaagggggcccgtagatcccagcgtagctcaaaggaaaatttcataccgtgtagtgaaccagtgaaggggacaggcgctttgcgggactgtaaaaatgtgttggatgtgagttgtagaaagaccgggctgaagctagagaaagcttttctggaggtgaatagaccacaaattcacaaactggatccaagctggaaagaacgcaaggtaactcccagtaaatattcttcactgatctatttcgattcctcagctacctacaacttggatgaagaaaacagattccggactctgaagtggttgataagtccagtcaagatagtgagtcgtcccacaatcaggcagggtcatggagaaaaccggcaaagagaaattgagatccggtttgaccagctgcacagggaatattgcttgagtcctcgaaatcaaccccggcgaatgtgcctccctgacagttgggccatgaacatgtataggggtggacctgcttccccaggcggcctgcagggcctcgagactagaaggctttcgctgccttcttccaaagccaaggccaaaagcctgtccgaagccttcgagaatttgggaaagaggagcctggaggcaggaaggtgtctccccaagtccgacagttccagctcactaccaaaaacaaatcccacgcacagtgccactagaccacagcagacttctgacctgcacgtgcagggtaattcatccggtatcttccgtaagagtgtctcaccaagcaagaccctgtccgtccctgacaaagaggttcctgggcatggaagaaaccggtacgatgaaattaaagaagagtttgataaattacaccagaaatattgcctgaaaagcccaggtcaaatgactgtgcctctctgcatcggcgtttctactgacaaagcctctatggaagtgcgctatcagactgaggggtttcttggcaagctgaatcccgatccacacttccagggctttcagaagttaccttcaagtccattggggtgcagaaaaagcctgttaggcagtaccgctattgaagcaccctcatcaacatgtgtggctagagcaatcacgagggacggcacaagagatcaccaatttcctgctaaacgaccacgactaagtgagcctcaaggcagtggccgccagggaaattccctgggcgcctctgatggagtcgataatactgttagacccggcgaccagggaagttcttctcagccaaacagtgaagaaaggggcgaaaatacatcttatagaatggaagagaagagtgattttatgctggagaaactggagaccaaaagcgtttag

SEQ ID NO: 190858 - DNA, 2085 bp, Artificial Sequence
  Description of Artificial Sequence: Synthetic coding sequence
atgctgggcaccctgcgggccatggagggcgaggacgtggaggacgaccagctgctgcagaagctgagggccagccgcaggcggtttcaacggcgcatgcaaaggcttatagaaaaatacaaccagccatttgaggacacgccggtcgtgcagatggctaccctgacttatgaaacacctcagggcctgagaatctggggtgggagactgatcaaagagcggaacgagggcgagatccagcccgcagtgccgcagagccctctgaaaaatgagttaagaaggaagtacctgacgcaggttgacatacttctccagggtgccgaatacttcgagtgcgccggcaaccgtgccggaagagatgtacgtgtgaccccactgccaagcctggcatcccccgcagtgccagccccgggctactgtagtcgcatcagtaggaaatctcccggcgatccagcgaagccagctagctccccacgagagtgggatcccttgcacccatcctccacagatatggctcttgtgccacggaatgactcgctatccctgcaggagaccagttccagctcctttctgtcttcccagccattcgaagacgatgacatctgtaatgtgaccatctccgacctttatgctggcatgttgcactctatgagccggctcctgtcaaccaagccatctagcattatctctaccaaaacctttattatgcagaattggaattctcggcgtcggcaccgatacaagtcacgcatgaataaaacctactgtaaaggagccagacgcagccagcgtagctcaaaggagaactttatcccctgcagcgaaccggtgaaggggaccggagccctccgggattgcaagaatgtgctcgatgtttcttgcaggaaaaccggactaaagcttgaaaaggccttcttagaggtgaacaggcctcagatacacaaactggatccttcttggaaggagcgaaaggttaccccatccaagtattcaagtctcatttattttgacagctccgcgacttacaacctcgacgaggaaaaccgtttccgtacccttaagtggctgatctcaccagtcaagatcgtaagccgccctactatccggcagggtcacggagagaacaggcagagggaaattgagatacgcttcgatcagctccacagagagtactgcctgagccctcggaatcagccaagaagaatgtgcctgccagacagttgggccatgaacatgtatcggggtggccctgcatcccccggtggcctgcaagggcttgagaccagaaggttatccctgccatccagcaaggcaaaagccaaatccctatcagaagcttttgagaacctaggaaaacgttccctggaggctggcagatgcttaccgaaatccgattcttctagctctttacctaaaacgaaccctactcacagcgcaactcgacctcagcagacctcagatctgcacgtgcagggcaactctagcggcattttccgcaagtccgttagcccgagcaaaacattatctgtccccgacaaggaggtgcccgggcacggccggaacagatacgacgagatcaaagaagagtttgataaacttcaccagaagtattgcctgaagtcccctggacagatgaccgttcccttgtgtatcggagtgtcaacagacaaggcaagcatggaagtgaggtatcagacagaaggatttttaggtaaactgaaccctgacccccatttccagggctttcaaaagctgccatcttcacctctgggatgccggaagagtcttctcgggagtactgccatcgaggcgccttcctcaacttgcgttgccagggcgataacaagggatggaaccagggatcaccagtttccggcaaaacgacctcgtctcagcgaaccccaggggtcagggaggcagggcaattctcttggggcgtcagacggcgtggacaacactgtgagacccggcgaccagggatcctcctctcaacctaactccgaagagcgtggtgaaaacacaagttaccgaatggaagagaaaagcgacttcatgctggagaagctggaaaccaagagtgtgtag

SEQ ID NO: 190859 - DNA, 1992 bp, Artificial Sequence
  Description of Artificial Sequence: Synthetic coding sequence
atgctgggcaccctgcgggccatggagggcgaggacgtggaggacgaccagctcctccagaagctcagggccagccgccgcagattccagcgcagaatgcaacggctgatagagaaatataatcaaccattcgaagatacacctgtggtccagatggctactctaacatacgagactcctcaaggactgaggatctggggaggcagattgataaaagaacgtaatgagggcgaaatacagtgcgccggcaatcgcgcaggtcgcgatgtgcgcgtgacgccacttccttcgctggcctcaccagcagtacccgcgcccggctactgcagcaggatttctcgcaaatcccctggggatcctgctaaacctgcttcatccccacgggagtgggaccctctacacccaagtagcactgatatggcgttggtgccacgtaatgatagcttgtccctgcaggagacatccagcagtagcttcctgagttcgcaacccttcgaggacgacgatatttgtaatgtaaccatttccgacctgtatgcaggcatgctacactccatgtccagactattaagcactaagccgagtagcattatttccactaaaacattcatcatgcagaactggaactccaggagaagacacagatacaaatccaggatgaacaaaacctattgtaaaggagccaggcgatctcagcgatcgtccaaggaaaacttcatcccctgctccgagccagtgaagggcaccggggcccttcgtgattgcaaaaacgtgttggacgtgtcatgtcgtaaaaccggcctcaagcttgaaaaggcctttttggaagttaatcgtccgcagatccacaaattagacccgagctggaaggagcggaaagttacaccatctaaatattcatccctgatctactttgattctagcgccacatataatctcgatgaggagaaccgtttccgcacgctcaagtggcttatatctcccgtcaagattgtcagtagacccacaatacgccagggacacggggagaacaggcagagggagattgagattcggtttgaccagctgcaccgagagtactgtttgtccccacgcaatcagcctcgaaggatgtgcttgcctgatagctgggcgatgaatatgtacagagggggtccagccagcccaggaggtctccaaggccttgagacgcggagattaagtttgccaagctctaaagccaaagccaaaagcctgagcgaagccttcgaaaacctgggaaaaagaagtttagaggctggtagatgcctccccaagagtgactcttcgtcatccctacctaaaaccaatcctacacattctgctactcgaccccaacaaacaagtgatctacacgtgcaggggaattcatccggtatttttagaaagtctgtgtcaccatctaaaacgttaagtgttcctgataaggaggtccctggacacggccgcaacaggtacgatgaaatcaaagaagaatttgataaactgcatcagaagtactgcctgaaatcacccggacagatgacagtgcccctctgcatcggagtttccacagacaaggcttccatggaagtgcggtatcagacggagggattcctcggcaagctgaaccccgaccctcatttccagggcttccagaagcttcccagttcaccactgggctgtcgaaaaagcctgctgggaagtacagccatagaagctccttcctccacctgtgtggccagagcaatcacacgggatgggacccgtgaccaccagtttcctgcaaagagaccacgactctccgaacctcaggggtccggccggcaaggaaactccctcggggctagcgacggagtcgataacaccgtaaggccaggtgaccagggcagtagcagccagccaaactccgaggaaaggggggaaaatacgtcttacaggatggaagaaaaatccgacttcatgctcgaaaagctcgagaccaagtctgtgtag

SEQ ID NO: 190860 - DNA, 2181 bp, Artificial Sequence
  Description of Artificial Sequence: Synthetic coding sequence
atggaggaccggctgcacatggacaacggcctggtgccccagaagatagtatccgttcacctgcaagatagcacccttaaggaagtcaaggatcaggtgtccaataagcaagcccagatcctggagcctaagcctgagccgtccctggagatcaagcccgagcaggacggaatggaacacgtcggccgcgacgatccgaaagctttgggggaagagcccaaacagagacgtggcagcgcaagtgggtccgagccggcaggtgacagcgatcgtggcggaggccccgttgaacactatcacttgcacttgtcctcctgtcatgaatgcttggagctggaaaattctactatcgagtctgtgaagtttgcctccgccgagaatattcctgacctaccctatgactattctagtagtctcgaatccgtcgccgacgaaactagtccagaaagagaaggaaggagagttaatcttaccggaaaagcacccaatatcctcctgtacgtcgggtcagactcccaagaggccctgggtcggtttcatgaggtgcgctctgtcctcgccgattgcgtagatattgactcttacattctttaccatctactagaggacagcgccctcagagatccatggaccgacaactgcctgcttctggtgatcgctactcgggaatcgatacctgaggacttgtatcagaaatttatggcatacctctcccagggcggtaaagtcttgggccttagttcttctttcacttttggaggctttcaggtaacctccaaaggcgccttgcacaagacagtgcagaatctggtctttagcaaggccgaccagtctgaggttaagctaagcgtcctgtcaagcgggtgcaggtaccaggaaggacctgtcaggctctctcctgggcggttacagggtcatctagagaacgaggataaggataggatgattgtgcatgtaccgtttgggacacggggcggtgaagccgtcctttgtcaggttcatctggagctcccaccaagcagcaacatcgtccagaccccagaggacttcaaccttcttaagagcagcaatttcaggagatatgaagtgctccgtgaaattttgacaaccctgggactgtcctgtgatatgaagcaggtcccagctctcacacccctatacctcctttcagcagcagaggaaatcagggaccccttgatgcagtggctcggcaagcacgtcgactcggaaggcgagattaagagtgggcagctctcccttagattcgtttcttcttacgtcagtgaagttgagatcacacctagctgcatccctgtggtgactaacatggaagcgttctcctcagagcatttcaaccttgagatctacaggcagaacctgcaaacgaaacagttaggtaaggtgatactgtttgctgaggtgactccaactacaatgcgcttattggacggtcttatgtttcagacccctcaagaaatgggcctgattgttattgctgctaggcagaccgaggggaagggacgcggagggaacgtgtggctgtctcccgtgggatgtgccttgagtacgttactgatttccattcctctacgcagtcagctggggcagaggatacctttcgtgcagcacctgatgtctgtggcagtggtggaggccgtaaggagtatccctgagtatcaggacattaacctccgcgttaaatggccaaacgacatttactactcggatctgatgaagatcggtggagtgctcgtcaattctacactgatgggagaaacattttacatactgatcggttgcggatttaacgtaacaaacagtaaccctacaatctgcatcaacgacctcatcaccgagtacaataagcagcataaggccgaactcaaaccgttgcgagctgactatctgatagcgagggtcgtgactgtcttggaaaagctgatcaaagagtttcaggataaggggcccaactctgtactgcccctctattatagatattgggtgcacagtggacaacaagtgcatctggggtccgccgaaggcccgaaagtgtctatcgtgggcctggatgattccggctttttgcaggtgcaccaggaggggggggaggtggtgaccgtccatcctgacggcaattccttcgatatgctgagaaacttgattctgcctaagcgaaggtag

SEQ ID NO: 190861 - DNA, 2181 bp, Artificial Sequence
  Description of Artificial Sequence: Synthetic coding sequence
atggaggaccggctgcacatggacaacggcctggtgccccagaagattgtgagtgtgcacctgcaggattctaccttgaaagaagtgaaagaccaggtgtctaacaaacaggcacagattctggagcccaaaccggaaccgtccctcgaaatcaaaccggaacaggatggaatggagcatgtggggcgcgatgaccctaaagccttgggtgaagagcctaagcagcgaaggggctctgcaagcggttccgaaccggccggggactccgatcgtgggggcggccctgtcgaacactatcatctccatttgtctagttgccatgagtgcctggaattagaaaacagcacaatagagtctgtgaagttcgcctcagctgaaaacatacctgatctaccttatgattacagctcgagcctggaatctgtggctgacgagacttccccagagcgcgagggcagaagagtcaacctcactggtaaagccccaaacatactactgtacgtgggaagtgattcacaggaggccctgggtagattccacgaagtgagatctgtacttgccgactgcgtcgacatcgattcttatatcctatatcacttactggaggattccgcactgcgagatccatggaccgacaactgccttctcctggttatcgccactagggagagtatccccgaagacctgtatcagaaattcatggcttacttaagtcagggaggcaaggtgctgggcctgtccagcagctttacgtttggaggatttcaggtcactagcaagggggccttgcataagactgttcaaaacctcgttttttccaaagccgatcagtcagaagtcaagctgtcggtgctgtcctcaggctgccgctatcaggaaggccctgtgcggctcagccccggaagacttcaggggcacctagagaatgaggacaaggaccgaatgattgtgcatgtgcctttcgggacaaggggcggagaggcagtcctttgccaggtgcacctggaactgccccccagctcaaatatagtgcagacgcccgaggattttaatttgttaaagtccagcaacttcagacgctatgaggtcctgcgtgagatcctcacaacactcgggttgagctgcgacatgaagcaggtgccagccctcacacctctttatctgctgtcggctgcagaagagattcgcgaccccctgatgcagtggttaggaaaacacgtcgactccgagggagagataaaatcgggacagctgtcactcagattcgtgtcgtcttacgtgagcgaggttgagatcactccctcatgcattccggtcgtgacgaacatggaggccttttccagcgaacactttaatctggagatttaccgtcagaatctccagactaaacaactcggtaaggtgatacttttcgccgaggtgaccccgacgacgatgcggttgctggacgggcttatgtttcagaccccccaggagatgggcctgattgtcatcgccgctagacagacagaagggaagggaaggggcggtaacgtgtggctttcccccgtcggatgcgccctttcaacgctcctgatttcaatccctttgcggagccaactcggccagagaatcccctttgtccagcatttgatgtcagtggccgtagtggaggccgttcggagcatccctgaatatcaggatataaaccttcgcgtcaaatggcctaacgatatttactatagtgatctgatgaagatcgggggcgttctcgtcaacagtactcttatgggtgagacattctacatactgattggctgcggattcaacgtcactaactcaaatcccacaatttgcatcaatgatctcatcacagaatataataaacagcacaaagccgagctgaagcccctgcgagccgactatctaatagctagggtggttacagtacttgagaaactcatcaaggaattccaggacaagggccccaacagcgtactccccctttactaccgctattgggtccacagtgggcaacaggtacacctgggaagtgctgaagggcctaaagtatccatagtcggtctagacgatagtggcttcctccaagtccaccaggagggcggtgaagtggtgacagtgcatcctgacgggaattcctttgacatgctgcgtaacctgattctcccaaagcgaagatag

SEQ ID NO: 190862 - DNA, 264 bp, Artificial Sequence
  Description of Artificial Sequence: Synthetic coding sequence
atggaggaccggctgcacatggacaacggcctggtgccccagaagattgtgtcagtccacctgcaggacagcacactcaaggaggtgaaagaccaggtgtctaacaagcaggctcaaattttagagcctaagcccgaacccagtttagagattaagccagagcaggatggcatggaacatgttggaagagacgatccgaaggcgctgggcgaggaaccaaaacagaggcggggttccgcttctgggtccgagccggccggctag

SEQ ID NO: 190863 - DNA, 234 bp, Artificial Sequence
  Description of Artificial Sequence: Synthetic coding sequence
atggaggaccggctgcacatggacaacggcctggtgccccagaagattgtctccgtccacctgcaggattctaccttgaaagaggtcaaggaccaggtgtcaaacaaacaggctcaaatcttggaaccgaagcccgagccaagcctggagatcaagcctgagcaggacggaatggagcacgtgggtcgagacgatccaaaagcgcttggcgaggagccaaagcaacgcagatag

SEQ ID NO: 190864 - DNA, 279 bp, Artificial Sequence
  Description of Artificial Sequence: Synthetic coding sequence
atggaggaccggctgcacatggacaacggcctggtgccccagaagattgtgtccgtgcacctacaggacagcacattgaaagaggtgaaagatcaggtctctaacaagcaggcacagatcctcgagcctaaaccggaaccatcactggaaatcaagccggagcaggacgggatggaacatgtgggacgagatgaccccaaggccctgggggaagagcccaagcagcgcagaggatctgcgagcggcagcgaacccgccggcgattcagaccgcgggtag

SEQ ID NO: 190865 - DNA, 807 bp, Artificial Sequence
  Description of Artificial Sequence: Synthetic coding sequence
atgggcctgagccccagcgcccccgccgtggccgtgcaggccagcaacgccagcgcaagtcccccttccggatgtccgatgcatgaaggcaagatgaaggggtgtccagttaataccgaaccatccggacccacttgtgagaagaagacatactctgtcccagcacaccaggaaagagcctatgagtatgtggaatgtccaatcaggggaactgcagccgagaacaaggagaatttagatcccagcaatctcatgcccccccctaatcaaactccagctcctgatcaacctttcgcactaagtaccgtccgcgaggagtcctccattcccagggccgattccgagaaaaagtgggtgtacccatccgaacagatgttctggaatgccatgctcaaaaagggatggaagtggaaagatgaggatatttcccagaaggatatgtacaacatcattagaatccataatcagaataacgaacaggcgtggaaagagatcctcaagtgggaagcactccatgctgcagagtgtccatgtgggcctagtctcatcaggttcgggggtaaagccaaagaatattctccacgggcaagaattcgcagctggatgggatatgagctgcctttcgaccggcacgattggatcatcaatcgctgtgggacagaagttcgatatgtgattgactactacgacgggggggaggtgaacaaagactatcagtttacaattttagacgtccggcccgccctcgatagtctctccgccgtgtgggatagaatgaaggttgcctggtggaggtggacatcctag

SEQ ID NO: 190866 - DNA, 807 bp, Artificial Sequence
  Description of Artificial Sequence: Synthetic coding sequence
atgggcctgagccccagcgcccccgccgtggccgtgcaggccagcaatgcttccgcctccccaccttccggatgccctatgcacgaagggaaaatgaaaggatgcccagttaatacggagcctagcggaccaacctgcgaaaagaaaacttatagtgtaccggcccaccaggagcgggcgtacgaatacgtggaatgtccaattagggggacagccgcagagaacaaagagaatctagatccttccaacttaatgccacctcctaaccagacccctgcccctgaccagccttttgcactctcaacagtgcgtgaggagagtagtattccccgagcagacagcgagaagaagtgggtttatccatcagaacaaatgttctggaatgctatgctaaaaaagggatggaagtggaaggacgaggatataagccagaaggacatgtacaatattatccgaatccataaccagaataacgaacaggcgtggaaagaaatactcaagtgggaggccttgcacgctgcagaatgcccttgcggccctagtcttattcgattcggtggtaaggctaaggaatacagcccacgagccagaatccggagctggatgggttatgaacttcctttcgacaggcatgattggatcatcaataggtgcggaaccgaggtgagatacgttatcgactattatgacggtggagaggtgaataaggattaccagtttactattctggatgtgagacccgccttggactcgctgagcgctgtgtgggacaggatgaaagtcgcgtggtggcggtggacttcttag

SEQ ID NO: 190867 - DNA, 807 bp, Artificial Sequence
  Description of Artificial Sequence: Synthetic coding sequence
atgggcctgagccccagcgcccccgccgtggccgtgcaggccagcaacgctagcgcctctcctccatccggttgcccaatgcacgagggcaagatgaaggggtgccctgtgaacacagagccatctggccctacctgtgagaaaaagacttattccgttcctgcccaccaggaacgcgcgtatgagtatgtggaatgtcccatcagaggtactgcagctgagaataaggaaaatcttgaccctagcaatctaatgccacccccgaaccagacacctgccccagaccaaccttttgccctgtctacggtacgagaagagtccagcattccgagggcggactctgaaaagaagtgggtatacccctcagaacagatgttttggaacgcaatgttaaaaaagggttggaagtggaaggatgaggacattagccagaaggatatgtacaatatcatccgaatacataatcagaataatgaacaagcatggaaagagattctgaagtgggaagccctgcacgcagctgagtgtccatgtggccccagcctaatcagatttgggggcaaagccaaggagtacagtccacgggcccgaatccgatcttggatgggctacgagttgccgttcgataggcacgactggataattaaccgatgcggcacagaagtgagatacgtgattgactactacgatgggggggaggtaaacaaagactatcagtttacaattcttgatgtacgacctgccctggacagcctaagtgccgtatgggatcgaatgaaggtggcctggtggcggtggacatcttag

SEQ ID NO: 190868 - DNA, 1008 bp, Artificial Sequence
  Description of Artificial Sequence: Synthetic coding sequence
atggacaacgcccggatgaacagcttcctggagtaccccatcctgtcaagtggagactccggcacttgctcagcacgcgcatacccctccgatcatagaattacgacattccagagctgtgcagtaagtgccaacagctgtggaggagatgaccggttcctggtgggaagaggcgtccagatcggatccccacaccatcaccaccaccatcaccatcggcaccctcagccggccacctatcagacctcggggaacctgggcgtgtcttattcacattcatcatgcggccccagctacgggagtcagaatttctccgcgccctattctccatatgcactgaaccaggaagctgatgttagcggaggttacccgcagtgtgcccccgcggtatacagtggcaacctgtcctcaccaatggtccagcatcatcaccatcaccagggctatgcgggcggagctgttggatcaccacagtacattcaccacagctacggacaagagcatcaatccctggccctggccacatataacaattctctgtccccgctgcacgcgagtcaccaggaagcatgtcgttctcccgctagcgagaccagttcccccgcccagacattcgattggatgaaagtgaagcgaaacccaccaaaaacaggcaaagtgggcgaatatggctatttgggacagcccaacgccgtgcggactaattttacaacgaagcagctgacagagctggaaaaagaatttcacttcaacaagtacctgacccgtgcccgcagagtggagatagcggcctctttgcagctgaatgaaactcaggtcaaaatctggttccaaaacagaaggatgaagcaaaagaagagggagaaggaaggactgttacctatctcccctgcaactccccccgggaacgacgagaaagccgaggaatcttctgagaagtctagttcctctccctgtgtacccagccccggcagctcaacatctgatacacttaccacttcacactag

SEQ ID NO: 190869 - DNA, 414 bp, Artificial Sequence
  Description of Artificial Sequence: Synthetic coding sequence
atggacaacgcccggatgaacagcttcctggagtaccccatcctgagctctggagactcggggacctgctccgcacgggcgtatccaagtgaccacaggatcactacctttcagtcctgcgctgtgtctgccaactcatgcgggggggacgataggttccttgttggacgcggtgtgcagatcggcagcccgcaccatcatcaccaccatcatcaccggcacccccaacctgctacctaccagacgtcagggaacctgggtgtctcttattcgcacagcagttgcggccccagctatggctctcaaaatttctctgccccttattctccctatgctctgaatcaggaggccgaccctccccgttcactatcacttcctcggattggcgatatatttagctccgctgacttttag

SEQ ID NO: 190870 - DNA, 1233 bp, Artificial Sequence
  Description of Artificial Sequence: Synthetic coding sequence
atgagcgcccggaagggctacctgctgcccagccccaactaccccactacaatgtcctgctccgaatctccagctgcgaatagcttcctggtcgacagcctgatctcttcaggcagaggagaggctggcggaggcggcggcggcgcgggcgggggaggaggcggcggctattacgctcacggaggtgtctatcttcccccggctgcagaccttccgtacggcctgcagtcttgtggtctgtttccaacacttggtggaaagcggaacgaagccgccagccccggcagcgggggcggtggggggggactaggtcccggcgcccacggatacggtccaagtcccatcgacttgtggctagacgcccctcgctcgtgcaggatggaaccccctgacgggcctccgcccccaccccagcagcagccacctccccccccccagcccccccagccagcaccccaggccacttcttgctcttttgctcagaacattaaggaggagtcaagttactgtctgtacgatagcgccgacaagtgccccaaggtcagcgccactgcagcagagctcgctcccttcccacggggccccccccctgacgggtgcgccttgggaactagctccggcgttcccgtgcctggatattttaggctgtcccaggcatacggcactgcaaaaggttatggatccggcgggggtggcgctcaacagctgggggccggaccttttccggcccagccacccggccgcggctttgatctcccaccagcacttgcaagcggatccgctgacgctgcccggaaagaaagagctttagattccccgcctcccccaacactcgcttgcggatcgggtggaggttcccagggggatgaggaggcacacgcttcttctagcgcagccgaagagctgtcccctgccccttcagaatccagtaaagcatccccagagaaggactctctgggaaattcgaagggtgagaacgctgctaactggctcaccgcgaaaagtggtcgcaaaaagaggtgcccctataccaagcaccaaaccctggaattggagaaggaattcctgtttaatatgtatctgacccgcgaacggcggctggaaattagcaggagcgtccacctcaccgatcgacaagtgaaaatctggttccagaatcgccgcatgaagcttaagaaaatgaatagggaaaacaggattagagaactgaccgctaacttcaacttctcttag

SEQ ID NO: 190871 - DNA, 609 bp, Artificial Sequence
  Description of Artificial Sequence: Synthetic coding sequence
atgagctgcagcgagagccccgccgccaacagcttcctggtggactcactcatatctagcggtcgtggggaggccggaggggggggcgggggcgccgggggaggcggaggtggggggtactatgctcatggaggtgtgtatctgcccccggcggccgaccttccatatggcctgcaaagctgcggcctgtttcccacattaggcggcaaaaggaacgaggcagcttcccccggaagcgggggaggtgggggcggtctaggaccaggcgcacacggctacggaccaagcccaatcgacctgtggttggatgccccccgaagctgccgaaggagagccgcaacaaggggctggccggtacccagagctgcacctggggcccgctttagaagtccagctagggcctccctgcggcttgggcggtgtggacccgagggcgcgtcacctcggtttgctgcggctccccatgccgggttacggcagagacgcggacttgctggcagacgcggcggcgctagggttgtgttaggccgtgggggtgctctgcccggaccatttagagagcagcagtccctcgccggagaaggctttccaggccagttccagcggtag

SEQ ID NO: 190872 - DNA, 285 bp, Artificial Sequence
  Description of Artificial Sequence: Synthetic coding sequence
atgtgccagggcaacagcaagggcgagaacgccgccaactggctgactgcaaagtccggaagaaaaaaaagatgtccctatactaagcaccagactttggaactcgaaaaggaattcctgttcaacatgtacttgactcgggaacggagactagagatctcgcggagtgtccacctgacagaccggcaagtcaagatttggttccagaatcggcgtatgaaactgaaaaaaatgaacagggaaaacaggatcagggagctcacagccaattttaatttttcgtag

SEQ ID NO: 190873 - DNA, 942 bp, Artificial Sequence
  Description of Artificial Sequence: Synthetic coding sequence
atggacttcgacgagcggggcccctgcagcagcaacatgtacctgccctcctgtacctactacgtatccggacctgacttttctagcctcccatctttcttaccacagactccgtccagcaggcccatgacgtactcttactcctctaacctgccacaggtgcagcccgtgcgtgaggtgacctttcgggagtatgcaatcgagcccgccactaaatggcatccaagaggcaaccttgctcattgctacagtgctgaggaattggtgcatagggattgccttcaggctccaagtgccgccggcgttccaggtgatgtgctcgccaagtcctctgcaaacgtgtaccaccaccctacccctgcagtctcgagcaatttctattcaacagtagggcgcaatggagtcctgccgcaggcttttgaccagtttttcgaaaccgcttacgggactccggaaaacttggcctcgtcggattatccaggagacaaatctgcggagaaaggtcctcccgctgcgacagccacttcagcggccgcagcagctgcagcaaccggcgcacccgccacctcttctagtgactctggcgggggagggggatgcagggagacagcagctgcagccgaggagaaggaacgcagaaggagacccgagagctcctcatcacccgagagcagttctgggcataccgaagacaaagcggggggctcctcaggccagcggacccggaagaaacgatgcccttataccaagtaccaaatcagggaactcgagcgcgaattcttcttcagcgtatatattaacaaggaaaaacggctacagctatccaggatgctgaacctgaccgatagacaggtgaagatctggttccaaaatcgcagaatgaaggaaaaaaagatcaatagagatagactgcaatactattcagccaatcccctgctctag

SEQ ID NO: 190874 - DNA, 918 bp, Artificial Sequence
  Description of Artificial Sequence: Synthetic coding sequence
atggcccgggaggacagcgtgaagtgcctgcggtgcctgctgtacgcactaaatcttttgttctggctgatgtcaatctccgtattggcggtgagtgcctggatgcgcgactacctgaacaatgtactgaccctaacggccgagacacgagtggaggaggcagtgatcctgacctacttccccgttgtacacccagtgatgatcgccgtttgctgcttcctcattatagtgggcatgctggggtactgcgggaccgttaagaggaacttgctgttgctcgcctggtatttcggttccctcctagtgatattctgtgtcgaactcgcatgtggcgtctggacctatgagcaggagttgatggttccggtgcagtggagcgatatggtaacgctgaaagcccggatgacaaattacggtctgcccagatatcgctggctgactcacgcttggaactttttccaacgggaatttaagtgttgtggcgtagtctactttactgattggctggaaatgaccgagatggattggccacctgacagctgctgtgtgagagaatttcctggctgctcgaagcaggcccatcaggaagacctgtctgacttgtaccaggaaggatgtggcaagaaaatgtacagcttcctccgggggactaaacagctgcaggtgctgcgcttcttgggtatttctattggggtgacacagatcttagcaatgatattgaccattacactcttgtgggccctttattacgacaggcgagagcccggcactgaccagatgatgagtctgaagaatgataactcacagcacctatcttgcccgagcgtggaactgctgaagccctcattgtcccggatcttcgaacatactagcatggccaactctttcaatacacacttcgagatggaggaactgtag

SEQ ID NO: 190875 - DNA, 489 bp, Artificial Sequence
  Description of Artificial Sequence: Synthetic coding sequence
atgggcctggagaccgagaaggccgacgtgcagctgttcatggacgatgattcctactcccatcactctgggcttgaatacgccgacccggaaaagtttgccgactcagaccaggatagggatccgcacagattgaacagccatctgaagcttggcttcgaggatgtgattgctgagcctgtgaccacacacagcttcgacaaggtgtggatttgctcacacgccctgtttgaaattagtaaatatgttatgtataaattcctcaccgtgttcctcgcgatcccgttggctttcatcgcggggattttgttcgctacactctcctgtttgcatatctggatccttatgcccttcgtgaagacttgtttgatggtgcttcctagtgtacaaacgatatggaaaagtgtgactgacgttatcatcgcacccttgtgcacatcagtgggacgatgcttcagttcagtttctttgcagttatcccaagattag

SEQ ID NO: 190876 - DNA, 963 bp, Artificial Sequence
  Description of Artificial Sequence: Synthetic coding sequence
atgaccatgagcagcttcctgatcaacagcaactacatcgagcccaagtttccccccttcgaggagtacgcacaacacagcggatccgggggcgcggacgggggaccaggcggcggcccagggtaccaacaaccaccggccccacccacccagcacctaccgctccagcagcctcagctcccccacgccggaggtggccgcgaacccactgcctcctattacgccccacggactgcccgcgaaccagcgtaccctgccgctgctctatatcccgcccacggagcagctgatactgcctacccgtacggctatcgcggcggagccagcccagggaggccaccgcagcctgaacaaccccctgctcaggcaaaaggacccgcccacggcctgcacgctagccacgtgctccaaccacagctgccccctcccctccagcccagagctgttccccccgctgctcccagacgttgtgaggccgcccccgccacgccaggcgtgccagccggggggagtgctccagcctgtccattgctcctcgcagataagtctcctttggggttgaaagggaaagaacctgttgtttacccatggatgaaaaaaattcacgtgagtgcggtcaaccccagttataacggcggcgaacctaagagatctagaaccgcatacacacgccagcaggttctggagctcgaaaaggaatttcactttaaccggtacctcaccagacggagaagaatcgaaatcgctcacacgctatgtcttagcgagcggcaggtaaagatctggtttcaaaatcgcagaatgaaatggaaaaaagatcataagcttccaaatacaaaaatgagatctagcaattccgcctccgcctcagctgggcccccaggcaaggcccaaacccaatccccccacctccatccccacccccaccctagcaccagcacccctgtgccctcttccatctag

SEQ ID NO: 190877 - DNA, 963 bp, Artificial Sequence
  Description of Artificial Sequence: Synthetic coding sequence
atgaccatgagcagcttcctgatcaacagcaactacatcgagcccaaattcccacctttcgaggaatatgctcagcatagcggcagcgggggagccgatggcggccctggcggcggtcccggttatcagcagccacccgcccccccaacacagcacctaccccttcagcagccacaattgcctcacgctggcgggggtagagagccaactgcttcttactacgcccccagaactgccagggaacctgcatatccagcagcggccctgtatcctgctcacggtgctgcagacactgcatacccttacggttatcgaggcggtgcgagtcccggacgcccacctcagcccgaacagcccccagcacaggctaaaggccctgcccatgggctccatgcttcccatgtgctgcagccacagctgcccccacctctccagccacgagcagttccgcctgcagctcctagacgatgtgaggcagcaccagcgaccccaggggttccggccggagggagcgctcccgcatgcccacttcttctcgccgacaaatccccactgggactgaaaggtaaggagcccgtcgtatacccatggatgaaaaagattcatgtgagcgcagtaaacccaagctataacggtggcgagcccaaacgtagcaggaccgcatacacacggcagcaagtccttgagctggaaaaagaatttcattttaaccgctacttaacaaggcggcgtcgaatcgagatagcccacaccctgtgtctgtctgaaagacaagtcaagatttggtttcagaatcgtaggatgaagtggaaaaaagatcacaagttgcccaataccaaaatgcgctcaagtaattccgcatctgctagtgctggccccccaggcaaagctcagacacaatcccctcacctgcatccacaccctcacccttctactagcacacccgttccttcctcgatctag

SEQ ID NO: 190878 - DNA, 1140 bp, Artificial Sequence
  Description of Artificial Sequence: Synthetic coding sequence
atgctgaagcggtgcggccggcggctgctgctggccctggccggcgcactcctcgcctgtttgttagtgctgactgccgaccctcctccacctccccttcctgcagaaagggggcgtagagctctgaggtccctcgccgggcccgctggggcagcacccgctcccggactaggagcagccgcagccgctcctggcgccttggtgcgagacgtgcatagtttatctgaatacttcagtctgctgacccgggcgcggcgggacgccggccctcctcccggcgcagctcctaggcctgccgacggtcatccacgcccacttgctgagcccctggccccacgggacgttttcattgccgttaagaccacaaagaaattccatagagctcgtttggatctgctcctggaaacttggatctcacgtcacaaagagatgacctttatttttaccgatggtgaagacgaggcactcgccagacacacgggtaacgtcgtaattacaaattgcagcgctgcacatagccgacaggctcttagctgcaagatggccgtcgaatatgatcgttttatagaatcgggaaggaagtggttctgccacgtagacgacgacaactacgtgaacttaagagcattactgaggctgctagcctcatacccacatacacgcgatgtgtatgtgggaaaaccatctctcgaccggcccatacaggccatggaaagagtgtcggaaaacaaggtgagaccagtccatttttggttcgcaacgggtggtgctggcttctgtatcagcagagggctggcgttgaagatgtctccatgggctagcggaggacattttatgaatacagctgaaagaatccgcttgcccgacgattgcactattgggtacatcgtggaagccctacttggggtgcctctcatcagatctggactgtttcattcgcacctggagaatctgcagcaagtgcccacatccgagttacatgagcaagttacactgagttacggaatgttcgagaataagagaaatgccgtgcacgtaaaagggccttttagcgttgaagctgatccgtcccggttccgttccattcattgtcacctgtatccggacacaccgtggtgcccccggaccgccatcttctag

SEQ ID NO: 190879 - DNA, 813 bp, Artificial Sequence
  Description of Artificial Sequence: Synthetic coding sequence
atgagcagctacttcgtgaacagcttctgcggccggtaccccaacgggcccgactaccagctgcataattacggagatcactcatccgtgtctgagcagttccgggactcagccagtatgcatagcggccgttacggatatggttacaacgggatggacctgtcggtgggtcggtcaggctcgggacacttcgggtcaggagagcgcgccagatcctacgctgcatctgccagcgctgccccagcagaaccccgttattcacagcccgcaactagtacccattctccacagcctgatccactgccctgtagcgccgtcgctcctagtcccgggtctgattcccaccacggcgggaaaaactccctgtcaaattcctccggcgcatccgcggatgccggcagcactcacatttcttcccgagaaggcgtcggaacagcatccggcgcagaggaggacgcgcctgccagttctgaacaggcctccgcccagtctgagccgtctcctgcgccaccagcccaacctcagatatacccttggatgcgcaaactgcatattagccacgataatatcggagggcctgagggcaagcgggctcggacagcttatactcggtaccagactttagaattggaaaaagaatttcacttcaatagatatctgacgcggcgcagacgtatcgaaatagctcacgctttgtgcctgtcagagcggcaaattaagatctggttccagaaccgccgcatgaaatggaagaaagacaacaagttaaagagtatgagcatggccgccgccgggggggcctttaggccctag

SEQ ID NO: 190880 - DNA, 693 bp, Artificial Sequence
  Description of Artificial Sequence: Synthetic coding sequence
atgagcagcagctactacgtgaacgccctgttcagcaagtacaccgcaggagcttcactttttcaaaacgcagagccaacaagttgttcttttgcacctaatagccagcgaagtggatatggggccggagcaggtgccttcgccagtacagtgcctggattatacaacgtgaactcccctctctatcagagccctttcgcctctggctatggcctgggagccgacgcatatggaaacctgccctgcgcgagttacgatcaaaacattcctgggctttgttctgatctggctaagggtgcctgcgacaaaactgacgaaggcgcattacacggagccgccgaggctaacttccggatctacccatggatgagaagcagtggccccgatcggaagcggggcaggcagacttacactcgatatcagactcttgagttggagaaagaatttcatttcaatcggtacctgactaggcgccggaggattgaaattgcccatgcactctgcttgaccgagaggcagattaagatttggttccagaatcgcagaatgaagtggaagaaggagcataaagacgagggcccaactgccgctgcggcaccagagggcgctgtgccctctgcagcagccaccgccgccgccgataaggccgatgaagaagacgatgatgaggaggaggaagatgaagaggagtag

SEQ ID NO: 190881 - DNA, 93 bp, Artificial Sequence
  Description of Artificial Sequence: Synthetic coding sequence
atgagcagcagctactacgtgaacgccctgttcagcaagtacaccgccggcgcctcattatttcaaaatgctgagcctacctcctgcagctag

SEQ ID NO: 190882 - DNA, 792 bp, Artificial Sequence
  Description of Artificial Sequence: Synthetic coding sequence
caccactggggcggcaactactacgtggacagcttcctgctgggcgcagatgccgctgatgagctttctgtgggcatgaggagaggaccttggccccccaggcaggccgcaacattagcagagcacccggacttcagtccatgctctttccagagtaaagctaccgtatttggggcctcctggaacccagtccatagagcgccaacgctgtatcccgtttaccaccaccatcatcaccatccttatgtgcacccccaagccccggtggcggccgcagcccctgacggccgttacatgagatcttggcttgaacctacccccggtgcattgtccttcgcaggcctcccatcctctaggccatacgggattaagccagagcccctgtcagctcggcggggagactgccccactttggacactcatacgctctccctaaccgattacgcctgcggatccccacccgtagaccgcgagaaacaaccctccgaaggagcgttctccgaaaacaatgctgaaaatgagtctgggggcgacaagccccccattgaccccaacaatccagcagcgaattggcttcatgccaggtccacccgaaagaagaggtgtccatacactaaacatcagacattggaactcgagaaggaatttcttttcaacatgtacctgacgagagacaggcgatacgaggtcgcaaggcttctgaacctgaccgaaaggcaggtcaagatttggttccagaaccgaaggatgaaaatgaaaaaaattaataaggatcgcgccaaggacgagtag

SEQ ID NO: 190883 - DNA, 819 bp, Artificial Sequence
  Description of Artificial Sequence: Synthetic coding sequence
atggccaccaccggcgccctgggcaactactacgtggacagcttcctactgggagctgatgccgccgatgaactgtctgtgggacgctacgcccctggaacgctggggcaaccaccacgacaggcagccaccctggcagagcatcccgacttctcaccctgctccttccaatcaaaggccactgttttcggggcctcctggaatcctgtacatgccgctggcgctaacgctgttcctgctgcggtctaccatcaccatcatcatcatccatacgtgcacccccaggcacctgttgctgcagcggctccagacggaagatacatgagaagctggttggagccaacaccgggagcactatcctttgcagggctgccatccagcagaccctatggaataaagcccgaacccttatccgcccggcgcggagactgtccaaccctcgatacccataccctttcactgaccgattacgcctgtggaagcccacctgtcgaccgggaaaagcagcctagcgagggtgctttctctgagaataatgccgagaatgagtcagggggcgataagcctcctatagatcctaataacccggccgcaaactggctgcacgccaggtcgactaggaagaaacggtgtccctacacaaaacatcagactcttgaactggagaaagagtttctgtttaacatgtatctgacccgcgacaggagatacgaggtcgcgagactgttgaaccttacagagagacaggtcaaaatttggttccagaatcgacgcatgaagatgaagaagattaataaagatcgggccaaggacgagtag

SEQ ID NO: 190884 - DNA, 591 bp, Artificial Sequence
  Description of Artificial Sequence: Synthetic coding sequence
atggccggcttcagcccctggcggcggcggcagcggcggcggcggcgaaggcgacgcgccaggcagtcgcgcgcagctccggaactcgtaggggatctgggcagctttttactcctcggaagcacctttcttagcacagcaaggcactgtttcattacctccgttgagattgtgagtaggtacctttgtgcacgcgggtcaggtcgagctggacatcacggacccgggcgcgcccggccagccgtggccacgagcgcttttccagctcaggagcccagagtctttctgagaagtgccctgccagccggccgcctctcacctagcactacacatctgcacctcgtgaccgctgataatccagcagccaactggctgcatgctcggagcacccgcaagaagcgttgcccatacaccaagcatcagacgctggagctggagaaggagttcctgttcaatatgtatttaactcgtgacagaaggtatgaggttgcacgtttgctaaaccttactgagcggcaggtaaagatatggtttcagaatcgaagaatgaagatgaaaaagatcaataaggatagggctaaggatgaatag

SEQ ID NO: 190885 - DNA, 906 bp, Artificial Sequence
  Description of Artificial Sequence: Synthetic coding sequence
atggactacaaccggatgaacagcttcctggagtaccccctgtgcaaccgggggcccagcgcgtacagtgctcattcagcccctacaagttttccaccatcttcagcccaagccgtggactcttacgcctccgaaggccggtacggcggggggctgagctcgccggcattccagcagaactccggctatcccgcgcagcagccacccagcacactcggcgtcccttttccatcttctgctccttcaggctacgctcctgccgcctgctcaccctcgtacggaccctcacaatactacccgctcggtcagagtgagggcgacggcggttatttccatcccagctcctatggagcacagcttggcggcctgagcgatggttacggcgctgggggggcaggtccgggcccatatccaccccagcatcccccttatggaaacgaacagacagcaagctttgctccagcctacgctgatctgctgtcagaagacaaggagacgccttgcccttctgaaccaaatactcctacagcccggaccttcgattggatgaaggtgaagcgtaacccccctaaaacggctaaggtgagcgaacctggactgggaagcccatcaggcctcagaaccaactttactacccgccagctgacagagctcgagaaggaattccacttcaataaatacttgtcacgagctcgaagggttgaaattgccgccactctggaactgaatgaaactcaagtgaaaatttggttccagaacagacgaatgaagcaaaagaaaagggaacgcgaagaaggacgagtccctccagccccaccaggttgtcccaaggaagcggccggggacgcatctgaccagtcaacgtgcacaagcccagaagcctccccttcaagcgttacttcttag

SEQ ID NO: 190886 - DNA, 855 bp, Artificial Sequence
  Description of Artificial Sequence: Synthetic coding sequence
atggagcccggcaactacgccaccctggacggcgccaaggacatcgagggattactcggggcgggcgggggcaggaaccttgtggctcatagccctctgacctcccacccggccgcacccactctgatgccggccgtgaactacgctccactggatctacccgggtcggccgagccaccaaaacagtgccacccgtgtcctggcgtgcctcagggcaccagccccgcccctgtgccatacggctactttggagggggctattattcatgcagggtgagccgatcctcgctcaaaccttgcgctcaggcagctactctggccgcctatcctgcggaaacacctacggcaggggaggagtatccttcgcgacctactgagttcgcattctaccccggctaccccgggacgtatcagcctatggcctcttaccttgatgtcagcgtagtccagactctgggagccccaggcgaacctaggcatgatagcctgctgcccgtcgattcataccagtcctgggctctggccggtggctggaattctcaaatgtgctgccagggcgagcagaatcctcctggacctttttggaaggccgcattcgccgattcgtccggccagcatccgcccgatgcctgcgccttccgaaggggcagaaagaaacgtataccctactccaaagggcagctcagggaacttgagagagaatatgctgctaacaagttcattacaaaagacaagagacgtaaaatttctgcggcaacctcgctcagcgaacgccagataacaatctggttccagaatcgcagagtgaaagagaagaaagtgttagccaaagtgaaaaacagtgctacaccttag

SEQ ID NO: 190887 - DNA, 531 bp, Artificial Sequence
  Description of Artificial Sequence: Synthetic coding sequence
ccccggtgcccccccggcccccgggtgcccctggacgagcgggaggagattcggcaggagactcagcccattcggcacgtttccttctctggcagactgcggaggtctggcggagtgggatcacccgcagacggacttggccgcaggctggtggccgcgggacaggcagcccatggtctgcatcaacacgctgctgccggcactggcgagtttcatttcaacaaatacctgtgtcgtcctcggcgcgtggaaattgccgcgctgctcgacctgactgagcgacaagtgaaagtttggtttcagaataggaggatgaagcacaagcggcagactcaacatcgtgagcctccggacggggagccagcctgccccggggcactggaggatatctgtgacccagccgaagagcccgcagctagtcctgggggccctcttgcagggggcgtgggtagcttgctctcccctgcgggcggaggggcaggtggcctcaaaagagggcctcccgcatttagccggagcttaaggggttag

SEQ ID NO: 190888 - DNA, 1071 bp, Artificial Sequence
  Description of Artificial Sequence: Synthetic coding sequence
atgaacttcgagttcgagcgggagatcggcttcatcaacagccagccaagccttgctgagtgcctgacatcatttccagcagtgctggagacattccagacctcgagtattaaggagagcacattgataccaccccccccgccatttgagcagacctttccaagcctgcagcccggtgccagtaccctgcagcggcccagatcgcagaaaagggccgaagacggacccgcactgccgccccctccaccgccacctctgccagcagcccctccagccccagaatttccttggatgaaagaaaagaaatccgctaagaagccctcccagtccgccacctcaccctctcccgctgcaagcgctgtgcctgctagcggagtgggcagtcccgccgatggcctgggtctgcctgaggccgggggaggaggtgctcgccgactgaggacagcgtacaccaatacccagctgctggagctggagaaggaattccactttaacaaatatttgtgccggccgcgacgcgtggagatcgccgcactactagacctcaccgaaagacaagtgaaagtgtggtttcaaaacagacgcatgaagcataaacgacagacccagcatcgggagccaccagacggggagcccgcatgtcctggtgccttggaggacatttgtgatccagccgaggaacccgccgcttcccctggaggtccctcggccagtagagctgcatgggaggcgtgttgccatccacccgaagtggttcctggcgctcttagcgcagatcctcgccccctagcagtccgattggaaggagctggggcatcttcgcctggatgcgcactccgcggagccgggggcctcgaacccgggccactgccagaagatgtcttcagtgggagacaagattctcccttcctgcccgacttgaacttttttgccgccgattcttgcctccagttatcaggcggtttgtctccttctctgcaaggatccctggactctcccgtgcccttttctgaggaggaattggacttcttcacgtcaactctctgcgcgattgaccttcagttcccctag

SEQ ID NO: 190889 - DNA, 1296 bp, Artificial Sequence
  Description of Artificial Sequence: Synthetic coding sequence
atgcagaaggccacctactacgacaacgccgccgccgccctgttcggcggttattcgtcctacccggggtctaacggtttcggatttgatgttccaccccaaccacctttccaggctgctacccacctcgaaggcgattaccagcgtagcgcctgttctctgcagtcccttgggaacgcagcacctcatgccaaaagcaaggagctgaacggatcctgtatgcgccctggactagcacccgagcccctgtccgctcctcccgggagcccccctccatccgccgctcccacatctgccacaagcaattccagtaatgggggaggcccctcaaagtctggaccccctaagtgtggccctggaactaactctaccctgactaagcagatctttccttggatgaaggaaagtaggcagacaagcaagcttaagaataactcccccgggaccgcggagggttgtgggggaggcggaggtggcggaggcggaggcgggtctggcggttctggcggcgggggaggagggggggggggcggggacaagtctcccccgggaagcgcggcgagtaaacgtgcccgtacagcttatacctcggcgcagttggtagagctggagaaggagttccactttaatcgctacctctgtagacctagaagggtcgaaatggctaatctgctgaacttgtccgaaaggcagattaaaatctggtttcaaaatcgcaggatgaagtataaaaaggatcagaaagcaaaaggcctggcatcatcctccggcggcccttctcccgccggctcacctcctcagcccatgcagagtaccgctggctttatgaatgcgctccacagtatgacaccaagctacgaaagtccttcaccaccagcttttggcaaggctcatcaaaatgcctacgccctgccaagtaactaccagccgccactcaagggatgcggtgcaccacagaagtatcctcccactccagcacccgaatatgaaccgcatgttttacaagccaacggaggtgcatatggtacccccaccatgcaagggtcccccgtgtacgtgggaggaggtggttacgccgatcctctgcccccacccgccgggcccagtctttacggactaaaccacctgtctcaccacccttcggggaatctggactataacggcgccccccctatggccccatcccagcaccacgggccatgtgagccccaccctacatatactgatctctccagccatcatgcaccccctcctcaggggagaatccaggaagcccctaaactgacgcacttgtag

SEQ ID NO: 190890 - DNA, 900 bp, Artificial Sequence
  Description of Artificial Sequence: Synthetic coding sequence
atgaaggagagccggcagaccagcaagctgaagaacaacagccccgggacagctgagggctgcggcggtggcggaggtggtggtggcgggggaggctcaggcggctcaggcggcgggggcgggggcgggggcggcggcgataagagtcctcccggttctgctgccagcaagcgcgccagaacagcttacaccagcgctcagttggtggaactcgagaaggagttccactttaatcgttacctctgtaggccgagacgcgtggagatggctaacttgctgaatctctctgagaggcagataaagatttggttccagaatcggagaatgaagtataagaaggaccagaaggctaaggggcttgcctcttcaagcggcggtcctagcccagccggttcgccaccccagcccatgcaatccacagccggatttatgaacgccctgcattccatgacaccttcttacgagtcaccctccccaccagcctttgggaaggcacaccagaatgcctatgctctgcccagcaattaccagccccccttaaaaggctgtggagctccccagaaataccctccaactcccgctcccgagtatgagccacacgtgttgcaggccaacggcggagcttacggcactcccactatgcagggctcaccggtgtatgttgggggtggcggctatgccgatccactgccaccgccggcgggtcctagcctttatgggctgaaccatctctcccatcatccctctggtaatttggactacaatggcgcaccccctatggcgccaagtcaacaccacggaccttgtgaaccccaccccacatacactgatctgtcctctcaccatgctccgcctccccaggggcgcatacaggaggcaccgaagctcacacacctatag

SEQ ID NO: 190891 - DNA, 1296 bp, Artificial Sequence
  Description of Artificial Sequence: Synthetic coding sequence
atgcagaaggccacctactacgacaacgccgccgccgccctgttcggaggctactcctcataccctggctctaatggctttggattcgacgttcctccccaacccccattccaggctgccactcacctggagggggattaccagcgctccgcctgttcgctacagagccttggcaatgccgctcctcacgccaagtcaaaagagctcaacggaagttgtatgcgtcccgggttggcacctgaaccactgtccgcccctcccggtagtccgcccccctcggccgcccccacctctgccacctctaactcatcgaacgggggcggaccaagcaaaagtggcccgccaaagtgcggccccggcactaattccactttgaccaagcagattttcccatggatgaaggaaagccgccaaacaagcaagcttaagaataactcacccggcaccgctgaaggttgtggagggggaggaggcggaggcggcggcggcggatccgggggttcaggcgggggaggcggcggggggggcggaggcgataagtcccctcctggtagtgccgccagcaagcgagcccggacggcttacacctcagcgcagttagtggagctggagaaggaattccatttcaacagatacttgtgcaggccccggcgagtggagatggcaaacctcctgaatctgtctgagagacagatcaagatttggttccagaacagaaggatgaagtataagaaggaccagaaggcaaagggcctggcgtcctccagcggtggtcccagccctgctggaagtcctccacagcccatgcaaagtacagccgggttcatgaacgcgctccactccatgacaccgagttatgaatcgcccagcccaccagcattcggcaaggcccatcagaacgcatacgccctgcctagcaactatcaacctcccctcaaggggtgtggcgctccccagaaataccctccaacccctgccccagagtacgagcctcacgtgctgcaggctaacgggggagcttacggtactcccactatgcagggatctcctgtgtatgttggaggggggggctacgccgacccgcttccacctccagcaggaccttccctctatgggctgaaccacctctcccatcacccaagcggcaacctggactataacggcgctcctccaatggccccttctcagcaccatggaccctgcgaaccacatccgacttacacagatctgagctctcatcacgcgccgccccctcaggggaggattcaggaagcccctaagctcacacatctctag

SEQ ID NO: 190892 - DNA, 1077 bp, Artificial Sequence
  Description of Artificial Sequence: Synthetic coding sequence
atgcggcccggcctggcccccgagcccctgagcgccccccccggctctccccccccttcggcagcccctactagtgcaacgtcaaactcctctaacggcggaggtccttcaaagtcaggaccgcctaagtgcgggccagggaccaacagtactctgactaagcagatatttccttggatgaaggagtcccgacagaccagcaagctgaagaacaacagccctggaactgccgaaggatgcggcggaggaggcgggggcggggggggaggcgggagcgggggttccggaggcggcggcggaggggggggggggggcgataagtctcctcccggatcagccgcctccaagcgagcaaggacagcttacaccagcgcccagcttgtcgagcttgagaaggaattccacttcaaccgttacttgtgtcggccaagaagggttgaaatggccaacctgttgaacctgtctgaacgccagatcaaaatatggttccagaacaggcggatgaaatacaagaaagatcagaaagctaagggcctggcttcctcttctggcgggccatcaccagccgggagcccaccgcagcctatgcaatctactgcaggatttatgaacgctcttcatagtatgactccaagctacgagagcccctctcccccagcttttgggaaggcccaccagaatgcctatgctctgccctcaaattaccagccacccttaaagggttgtggagctcctcagaagtaccctcccacaccagcccccgaatatgaaccgcatgtccttcaggccaacggcggagcttacggtacgccaactatgcaagggtcacccgtctatgtggggggaggcggctacgctgatccactccccccacctgcaggcccctctctgtatggtctgaaccacttaagtcatcacccatcgggtaacctagattataacggtgctcctcctatggcgccttcccagcaccatggtccgtgcgagcctcaccctacctacacggacctcagttcccatcacgccccaccccctcagggccgcatacaagaggcgcccaaactcacccacttgtag

SEQ ID NO: 190893 - DNA, 1296 bp, Artificial Sequence
  Description of Artificial Sequence: Synthetic coding sequence
atgcagaaggccacctactacgacaacgccgccgccgccctgttcggcggttactctagctacccaggttctaatggattcgggttcgatgttccaccccagcccccctttcaagcagctacacatttagaaggagattaccaacggtccgcttgctctctgcagtcgctggggaatgccgccccacatgcgaagtcgaaggagctgaatggcagttgcatgaggcccgggttggccccagagccactgagtgcgcctcccggtagtcctccaccttctgcagctccgacctccgccaccagtaacagctctaatggcggagggccttccaaatcaggaccgccgaagtgtggaccagggaccaactctactctgacaaagcaaatttttccgtggatgaaagagtcaagacaaacgtccaagttaaaaaataattcaccgggcacagcagagggatgtggtggggggggcgggggtggcgggggtggcggaagcgggggtagcgggggcggaggcggcggcggaggtggtggcgacaaatctccccctggcagcgcagctagcaagcgggcccgaactgcatacacttcagcccagctggtcgaactggagaaggaattccacttcaatagatacctttgccgacctcgccgcgtggaaatggcaaacttattgaatctatctgaacgtcagattaagatatggttccagaatcgtcgtatgaaatacaagaaggaccagaaggcgaaagggctggcttcgtccagcggtgggccctctccggccggtagtcctcctcagcctatgcagagtactgcgggtttcatgaacgccctgcatagcatgaccccatcgtacgaaagtcctagcccgcctgccttcggcaaggcccatcaaaatgcgtacgccctaccatcgaattaccagccccctcttaaagggtgcggggccccccaaaagtaccctcccaccccagctcccgagtacgagccacacgttctacaggccaacggcggagcgtacggaacacccaccatgcagggaagtccagtgtatgttggagggggcggatacgcagacccactgcctccccctgctggaccttcactgtacgggctgaaccatctttctcatcatccttcgggtaacttggactataacggcgcccctcctatggcaccatctcagcaccatggaccttgcgagccgcacccgacttacaccgacctgagtagtcaccacgccccacccccccaggggcgcatacaggaggcaccgaaactgacccacctgtag

SEQ ID NO: 190894 - DNA, 900 bp, Artificial Sequence
  Description of Artificial Sequence: Synthetic coding sequence
atgaaggagagccggcagaccagcaagctgaagaacaacagccccggcacagccgagggctgcggaggcggaggcgggggcggggggggtgggggtagtggcggaagcggcgggggcggaggcgggggcggcgggggggacaagtcccccccaggctcagccgccagcaaaagagctcgaactgcttatacctctgcacagctggtcgagctcgaaaaggagttccactttaatcggtatctatgccgcccaagacgggttgagatggccaacctgttgaatctatctgagaggcagattaagatatggttccagaacaggcggatgaagtacaagaaagatcagaaagccaagggtcttgccagctcatcgggggggcccagcccagctgggtctccaccccagccaatgcaatctacggctggcttcatgaacgccctgcactctatgacaccatcctatgagagcccttcacccccagcctttgggaaggcacaccagaacgcatacgccctcccatctaactatcagcctccgttgaaaggatgcggtgcaccccagaaatatccaccaacgccggcccccgagtacgagcctcacgtattgcaggcaaacggtggtgcctatggcacccccacgatgcaagggagcccagtttatgtgggcggcggcggctatgccgacccccttcctccacctgccggcccttcactgtacggactcaaccacctgagccaccatccttctggcaatctcgattataatggggccccacctatggcaccaagtcagcaccacgggccttgcgagccacatcccacgtataccgacttatcatctcaccatgcgcctccaccccagggcagaatacaagaggccccaaagctaacccacctctag

SEQ ID NO: 190895 - DNA, 1077 bp, Artificial Sequence
  Description of Artificial Sequence: Synthetic coding sequence
atgcggcccggcctggcccccgagcccctgagcgccccccccggcagtcctccgccaagcgccgcccctacgagcgccactagtaactcttccaacggcggtggccccagtaaatctggaccacccaaatgtggacctgggactaacagcacattaactaaacagatattcccctggatgaaggaatctaggcagacaagtaagctaaaaaataattcccctggcacggccgaaggatgtggcggaggcggcggagggggtggcggcgggggatctggaggttctgggggcggcggaggcggcgggggaggcggcgacaaatccccccccggaagcgcggcgtccaagcgagctagaacagcttacacatccgcccagttggttgaactcgagaaggagttccattttaaccgatacctgtgccgacccagacgagtcgagatggccaatctgctcaacctgagtgaaagacaaatcaaaatctggttccagaaccgccgcatgaagtacaagaaggatcaaaaagctaaaggactggcatccagctccggcgggccctcccctgcaggttcccccccacagcccatgcagtctaccgccggctttatgaacgcactgcactccatgactccatcatacgagtccccgagcccccccgccttcgggaaggcccatcagaacgcctacgctctcccttctaattatcaaccacctcttaaagggtgcggggcccctcaaaagtatccaccaacacccgccccagagtacgaaccacatgttctacaggccaacggcggcgcatacgggaccccaactatgcagggaagcccggtgtacgtgggcggcgggggttacgcggaccccctccccccacctgccggtccgtctctttatggtctcaatcatctttctcatcatccttctggaaacttagactacaacggagctcctcctatggccccatcacagcaccacgggccgtgtgaaccacatccgacctacaccgatttaagctcccaccacgctcccccaccacagggaagaatccaggaagcccctaaacttacccacctctag

SEQ ID NO: 190896 - DNA, 1296 bp, Artificial Sequence
  Description of Artificial Sequence: Synthetic coding sequence
atgcagaaggccacctactacgacaacgccgccgccgccctgttcggcgggtactcttcataccccggctctaatggatttggtttcgatgtgccaccccaaccaccttttcaagccgcaactcacctggaaggagactatcagcgcagcgcctgctcgctgcaatcgctcggaaacgccgctcctcatgccaagtccaaagaacttaacggatcctgtatgcggcctggcctggcacctgagcctttaagcgccccaccgggcagtccccccccatccgctgcccccacaagcgccacgagcaacagttctaacggtgggggaccttcaaagtctggtccgcctaaatgcggtccgggcacaaattcaacacttacaaaacaaatcttcccatggatgaaggaatcacgacaaacgtctaagctaaagaataacagcccaggaaccgccgaagggtgcggtggcggcggcggcggaggaggtggagggggcagtggcggcagtggaggcggcggagggggtgggggcgggggagacaagtctccccccgggtctgccgcgtctaagcgcgcccgcactgcttacaccagtgcgcaactggtggaactggagaaagaatttcactttaacagatacctctgcagaccacggagggtggaaatggccaatctcctcaatctttcggaacgccagattaagatttggttccagaatcgtcggatgaagtacaaaaaggaccaaaaggccaaaggcctcgctagctcaagcggtggcccctcaccagctgggtccccaccccaacctatgcagagtacagccggattcatgaacgccctccacagcatgacaccttcctacgagagtccctcgccccctgcattcgggaaggcccatcagaatgcctatgcgctcccatcaaattaccagccacctctgaaaggatgcggcgccccgcaaaaatacccccctactcccgcccctgagtacgagcctcacgtgcttcaagcaaacggcggtgcgtacggaactcccaccatgcagggatctccggtttatgtgggaggcggagggtacgccgatcctctgcctcccccggcaggaccctccctctacggcctgaatcacttgagccaccacccatccggaaatctggactataatggagccccccctatggccccctctcagcaccacggcccttgtgaaccacatccaacctacaccgacttaagcagtcaccacgcgccacctccgcagggacggatacaagaggcgccaaaacttacccacctctag

SEQ ID NO: 190897 - DNA, 756 bp, Artificial Sequence
  Description of Artificial Sequence: Synthetic coding sequence
atggccatgagcagcttcctgatcaacagcaactacgtggaccccaagttcccaccatgtgaagaatatagccagagcgactaccttcctagtgaccacagcccaggctactacgctggagggcagaggagagagtcgtccttccaacccgaggcggggtttgggagacgcgctgcctgtacggtccaacgttacgctgcctgcagagatcccggacccccccctcctcctcctcctccgccaccccccccaccaccacccggtcttagtcccagggctccagctccgcctccggccggagcactcttacctgaaccagggcagaggtgtgaggccgtgtcaagctcaccccccccacctccttgtgctcagaaccccttacacccctccccatctcattcggcttgtaaggagccagttgtgtatccttggatgaggaaggtgcacgtatctacagtgaatccaaactatgccggcggggagcccaagcgttcaagaaccgcttacactcgacagcaggtcctcgagcttgagaaagaattccactacaacaggtatctgacgaggcgccgcagagtggagatagcccacgcattgtgccttagtgagaggcagattaaaatctggtttcagaaccgtcgaatgaagtggaagaaggatcataaactgcccaacacaaagatacggtcagggggcgctgcgggaagcgccgggggcccgcctggaaggcccaatggcggccctcgggcactatag

SEQ ID NO: 190898 - DNA, 810 bp, Artificial Sequence
  Description of Artificial Sequence: Synthetic coding sequence
atgagcagctacttcgtgaacagcttcagcggccggtaccccaacggccctgactaccagctcctgaattacggaagcggctccagcctctcgggctcctaccgtgaccctgcagccatgcacaccggctcgtatggctacaactataatggaatggaccttagcgtaaatcgatctagcgcatccagttctcactttggcgcagtgggcgagtcaagtagagcattccccgcccccgcacaagagcctagattccggcaggccgcctcatcttgtagcctgagcagtccggaatctctgccttgcactaacggtgactcacatggcgctaaaccgtcagcgagtagcccgtctgaccaggccacatccgcttcaagttctgccaactttactgagatcgacgaggcctccgccagctcagagcccgaagaggccgcttcgcagctgagctcacctagtctggcgcgcgcccaacccgagcctatggccacctccacagctgctcccgagggccagactcctcaaatctttccctggatgcgaaaattacatattagccacgatatgacagggcctgatggaaaacgcgctaggacagcgtacacgcgttatcagacactagagctagagaaggagttccacttcaaccgctacctcactcgcaggaggcggattgaaattgcgcacgcactctgtctgtctgaacggcagataaagatctggttccaaaataggagaatgaagtggaagaaagataataaactaaaatcgatgagcctggcgactgcaggctccgcctttcagccgtag

SEQ ID NO: 190899 - DNA, 1179 bp, Artificial Sequence
  Description of Artificial Sequence: Synthetic coding sequence
atggccgccctgcggcagccccaggtggccgagctgctggccgaggcacgacgggccttccgagaggagttcggtgctgaacccgagctggcagtgtctgcccccggtcgagttaacctgatcggagagcacactgactacaaccaggggttggtgctccctatggccctggagcttatgacagtattggtcggaagtccccgcaaggacggcttggtgtcactactgacaacctccgaaggagcggatgagccgcagagactgcagtttcccctgcccaccgctcagcgctccctggagccgggcacccccaggtgggctaattacgttaaaggcgtgatccagtactatcctgcagcccctcttccagggttcagcgcagttgttgtaagcagcgtcccactgggcggcgggctgagtagctccgcttcacttgaggttgctacttataccttcctgcagcagttgtgcccagactcaggaacgatcgcagctagggctcaggtgtgccagcaggctgaacattccttcgctggaatgccttgcggcatcatggatcagtttatcagcctgatggggcagaagggccatgctttactgatcgactgccgttcccttgagacatccttggttcccctttcggaccccaagctagccgtgctgatcacaaatagcaatgtccgccatagcctcgccagctccgagtaccccgtgaggagacgacaatgcgaggaggtggctagggccttaggcaaagagtccctgagagaagttcagctggaagagttagaagccgctcgtgacctggtctcgaaagagggcttccgaagggcacgtcacgtagttggcgagatcagacggacggcgcaggccgcagcagcgttgcgccggggcgattatcgagctttcgggaggctcatggttgagagtcaccgcagccttcgggacgactatgaggtgtcctgccctgagcttgatcagttagtagaggcagccttagcagtgccaggcgtgtacggcagtcgtatgaccggaggcggctttggcgggtgcactgtaacgctcttagaagcatccgccgcgccccacgccatgagacacattcaggagcactatgggggaacagccacattctacttgagtcaagctgctgacggtgctaaagtactgtgcctttag

SEQ ID NO: 190900 - DNA, 675 bp, Artificial Sequence
  Description of Artificial Sequence: Synthetic coding sequence
atgagcagctacttcgtgaacagcaccttccccgtgaccctggcctctggccaggagtcatttttgggacagcttcctctttacagttccgggtacgcggatcctctcagacattacccagccccctacggtccaggtccaggccaggacaaggggtttgccacaagctcttattatcctccggccggcggtggatacgggcgagccgccccctgtgattacgggcctgccccagcgttctatcgcgagaaagagtccgcctgcgcactcagtggggctgatgaacaacctccctttcacccagagcctcgaaaaagcgattgtgcccaggataaaagtgtttttggagagacagaggaacagaaatgctctacacccgtgtacccctggatgcagcgaatgaactcttgcaatagttctagttttggccctagtggacggcggggccggcagacttacactcgttatcagactctggagctcgagaaggaattccactacaacaggtacttaacgaggcgcaggcgtattgagattgcgcatgccctttgcctgaccgagcggcagatcaaaatttggtttcagaatcgtcggatgaagtggaaaaaggagagcaagctcctctccgcctcacagcttagtgctgaggaagaagaagaaaagcaggcagaatag

SEQ ID NO: 190901 - DNA, 654 bp, Artificial Sequence
  Description of Artificial Sequence: Synthetic coding sequence
atgagcagcctgtactacgccaacaccctgttcagcaagtaccccgccagctcatccgtatttgccaccggcgccttcccagagcagacatcttgcgctttcgcgagtaatccacaacgcccagggtatggtgcaggaagcggagctagtttcgctgccagcatgcagggcttatacccaggggggggtggaatggctggacaatccgctgccggtgtgtacgcggcaggttatggtctggaaccaagtagcttcaacatgcactgcgccccttttgagcagaacctgtcaggggtgtgcccgggcgacagcgcaaaagctgcaggggccaaggaacaacgcgacagcgacctggctgcagagtccaactttcggatctacccttggatgagaagcagcggaactgaccgaaaacgagggagacagacttacacgaggtaccaaacactggagctggaaaaagaattccattacaatcggtatctcacccggcgacgaagaatagagatcgctcacaccctgtgcctgacggaaagacagatcaagatctggttccagaaccgtcgaatgaagtggaaaaaagagaataaaaccgctggccccggcacaacggggcaggaccgcgcagaagcagaagaagaagaagaggaatag

SEQ ID NO: 190902 - DNA, 87 bp, Artificial Sequence
  Description of Artificial Sequence: Synthetic coding sequence
atgaagtggaagaaggagaacaagaccgccggccccggcaccaccggccaggaccgggccgaagctgaggaggaagaggaagagtag

SEQ ID NO: 190903 - DNA, 732 bp, Artificial Sequence
  Description of Artificial Sequence: Synthetic coding sequence
atgagcagctacttcgtgaacagcctgttcagcaagtacaagaccggcgagtctttgcgacccaattactatgattgtggatttgcgcaggacctgggcggtcggccgacagtagtctacggtccatcgagtggaggaagcttccagcacccctcccaaattcaggagttctatcacggaccctctagcctctccactgccccgtaccagcaaaacccatgcgcggtggcctgccatggagaccccggcaacttctatgggtatgaccccctccaacgtcagagcctgttcggtgcccaagacccagacctagtgcagtacgcggactgcaagctggccgccgccagcggtctgggagaggaagcggaaggctcagaacagagtcctagcccaacgcagctcttcccttggatgcgtccacaggccgccgcaggccgaaggcgcggtcgacagacctacagccggtatcaaactttagagctcgaaaaagagttcttattcaacccctatctcacccgcaagcggcgaatcgaagtcagtcacgctttaggcctcactgaacgccaggtgaagatctggttccagaacagaagaatgaagtggaaaaaggagaacaataaggataaattccctagctccaagtgcgagcaggaagagcttgagaaacagaaattggaaagagcccccgaggctgccgatgaaggggacgcgcagaagggtgacaagaagtag

SEQ ID NO: 190904 - DNA, 753 bp, Artificial Sequence
  Description of Artificial Sequence: Synthetic coding sequence
atgagcatcagcggcaccctgagcagctactacgtggacagcatcattagtcacgagtccgaggatgcaccacctgccaaattcccgtctggacaatacgcctcgtccagacagcctggtcatgctgagcacctggaattccccagttgcagctttcaacctaaggcgccagtgtttggcgccagctgggccccactgagcccccacgctagcgggtccttaccaagcgtctaccacccttacattcagcctcaaggagtacccccagccgagtctcgttatcttagaacttggttggagccagccccacgcggggaggcggctcctgggcaggggcaagcagctgtcaaggcagagccactcctcggcgcacctggcgaactgttaaagcaagggacgcccgagtattcccttgaaacctcagcggggagggaggcagtcttaagcaatcagcggccaggatacggcgataacaagatttgtgaaggctccgaagacaaagagcggcctgaccagaccaatccatccgccaactggctgcacgccaggtcctctcgaaaaaagcgctgcccctatacgaaataccagacactggagctcgagaaagagtttctcttcaacatgtacctgactcgggatagacgacacgaggtggccaggctgctgaaccttagcgaacgccaggtcaagatctggtttcagaaccgaagaatgaagatgaaaaagatgaacaaagaacagggtaaggagtag

SEQ ID NO: 190905 - DNA, 387 bp, Artificial Sequence
  Description of Artificial Sequence: Synthetic coding sequence
atgagcatcagcggcaccctgagcagctactacgtggacagcatcatatcacatgagagtgaagacgcaccaccggctaagttccctagtggacagtatgccagctcccgacagcctggccacgccgaacatctggaatttccttcttgttcgtttcagcctaaagcccccgtctttggagcttcttgggcccctctgtccccgcatgcttcgggatcccttccatcagtgtatcacccctatatccagccgcagggcgtgccacctgccgaatcccgctacctgcggacttggctcgagccggctcctaggggtggcgcggctcagactggtcatgcaagagttcagttcggaaacttcggaggtcagggtggcagggcagtgtag

SEQ ID NO: 190906 - DNA, 1029 bp, Artificial Sequence
  Description of Artificial Sequence: Synthetic coding sequence
atgacctgcccccggaacgtgacccccaacagctacgccgagcccctcgctgcacctgggggcggggaacgttattcccggtccgcaggcatgtatatgcagtctggttccgattttaactgcggcgtgatgaggggctgtgggctcgctccctctctgtctaaaagggacgaagggagcagtcccagcctcgctttgaatacatatccatcctatctgagccagctggacagttggggcgatccaaaggcggcatatcggctcgagcaacctgtgggcagacccctctccagttgttcgtaccctccaagcgtgaaggaggagaatgtgtgctgcatgtattctgcagagaagagagcaaaatccggtccagaggccgcgctgtactctcatcctctgccggaaagttgtctgggggaacacgaggtgccggtgcccagttattatagagcgtccccttcctacagtgctctcgacaaaacaccacactgctcgggcgcgaacgactttgaggcccctttcgaacagcgagcttccttgaacccccgtgccgaacacttggaaagcccacagctcggaggaaaggttagcttcccagagacaccaaaatcagactcacaaaccccatcccccaacgaaatcaagacagaacaaagcctggccggcccgaaagggtccccatctgaatccgagaaagagagagcaaaggccgcggatagcagccctgatacatctgataacgaggctaaggaggaaatcaaggcagaaaacaccacagggaactggctgactgctaaaagcggacgaaaaaagagatgtccttacacaaagcatcagaccctggaactggagaaggagttcctctttaacatgtacctcacaagagagcggagactcgaaatttccaagaccatcaacctgactgatcggcaggtcaagatatggttccagaatagaagaatgaagctgaaaaagatgaacagggagaatcgaatcagggagctcacctcaaatttcaacttcacatag

SEQ ID NO: 190907 - DNA, 915 bp, Artificial Sequence
  Description of Artificial Sequence: Synthetic coding sequence
atgttcaacagcgtgaacctgggcaacttctgcagccccagccggaaggaaaggggggcagatttcggagagcgcgggtcttgcgccagcaacctgtatctcccgtcatgcacctattatatgcctgaattcagcacggtttcttcatttctacctcaggcacccagtcgccaaatttcatacccatactccgcgcaggtgcctccagttagggaagtctcttatgggctggaacctagcgggaagtggcaccaccggaatagctattccagctgctatgctgccgccgatgagctgatgcaccgagagtgtttgcccccatccaccgtaacagaaattctcatgaaaaacgagggaagctacgggggacaccaccacccctcggctccacacgctactccagctggattttacagttcggttaataagaatagcgtgttgccccaggccttcgataggttttttgataacgcatactgcggaggaggggaccccccagcagagccaccctgttcgggaaagggtgaagccaaaggcgagccagaagcccctcccgcaagcggattggctagccgggccgaagccggagcggaggctgaagcggaggaggaaaacacaaatccttcgtcttctggcagcgctcattcggtggcgaaggaaccggccaagggggctgcccccaacgccccccggacacgcaaaaagcggtgcccatattccaaattccaaatccgggagcttgagcgggagttttttttcaatgtttacattaataaggaaaaaaggctccagttgagcaggatgctcaaccttacagatcgtcaggttaagatctggtttcagaatcgcagaatgaaagagaagaagttgtccagagaccggctgcagtacttttccgggaatcccctactgtag

SEQ ID NO: 190908 - DNA, 849 bp, Artificial Sequence
  Description of Artificial Sequence: Synthetic coding sequence
atgggcgagcacaacctgctgaaccccggcttcgtgggccccctggtgaacattcacactggagacaccttctacttcccaaactttcgggccagcggagcacagctgcctggactcccctcactttcttacccccgacgcgataacgtctgcagtctgtcctggccaagcgctgagccgtgtaacggatacccccagccataccttggatccccagtgtctctgaatccaccgtttgggagaacatgcgaactggcccgtgtggaagatgggaagggatactatagggaaccatgcgccgagggcggggggggcgggctcaagagggaggaacgtggcagggatccaggagccggccccggcgccgcactgctgcccctggagccctcgggaccaccagcactcggcttcaagtacgattacgccgccggaggaggcggcggtgatggcggtggtggggccggtccaccacacgatccccctagctgccaatcattggaatctgacagtagtagtagcctcctaaacgagggaaataaaggtgccggcgcaggagatcctggatccctggtctcaccccttaatcccgggggggggctttctgcgtccggagccccatggtatcccattaacagtcggagcagaaaaaagcggaaaccttactccaaactgcaactggcggaactcgagggcgaattcctcgtcaatgaatttataacaagacagagacgcagggaactgagcgatagactgaatttgtcagaccagcaagtgaaaatctggtttcaaaatcgtaggatgaaaaagaaacgccttcttttgagggagcaagctctaagtttcttttag

SEQ ID NO: 190909 - DNA, 993 bp, Artificial Sequence
  Description of Artificial Sequence: Synthetic coding sequence
atgaccaccagcctgctgctgcacccccggtggcccgagagcctgatgtacgtatatgaagattccgccgccgagagcggcattggcggtggaggtgggggcggcggaggcggtacaggtggggcgggaggtggctgcagcggcgccagtccaggcaaagcaccgtcgatggacggactggggtcctcttgcccagctagccactgtagggacctgctcccccatcccgtgcttggtcgacccccagcgccattgggagcccctcagggagccgtctacactgacattcccgcccccgaggctgccagacaatgcgctcctccacccgcccctccaaccagtagcagtgcgacactcggctacgggtacccatttggaggttcctactatggatgtcgcttaagccataatgtcaacctacagcagaaaccgtgcgcctatcatcctggagacaaatatcctgaaccttcaggggcactgcccggcgatgatctgtccagccgcgctaaggagttcgccttctatccgtccttcgcttcatcataccaggccatgcccggttatttagacgtcagtgtcgtgcccggcattagcggacaccccgagccccgccatgacgcactgatcccagtggaggggtaccagcactgggccctatcgaacggatgggactctcaagtgtattgctcaaaggaacaaagtcagtcggcacacctgtggaaaagccccttccccgatgttgtgccactccagcctgaggtgtcctcctataggcgaggccgcaagaaaagggtgccctatacaaaagtgcagctcaaggagctcgaaaaagaatacgccgcctcaaaattcattacaaaggaaaagaggcgacgcatctcggcaacaaccaatctgtcagagcgtcaggttactatctggttccagaacaggagagtgaaagaaaaaaaagtcgtgagtaagagcaaagctcctcacctgcattccacgtag

SEQ ID NO: 190910 - DNA, 795 bp, Artificial Sequence
  Description of Artificial Sequence: Synthetic coding sequence
atgatcatgagcagctacctgatggacagcaactacatcgaccccaaattccccccttgcgaagagtactcccagaactcttacatccccgagcattctcctgagtattatggacgcactcgcgaatcgggtttccagcatcatcaccaggaactctaccccccaccaccccctagaccgagttatcctgaacggcagtattcttgtacttcactgcagggacccggcaattctaggggccatggacccgcccaagccggacatcaccatccagagaagagccagtccttgtgcgaacctgctcccctcagcggagcttctgcatcgccgtcccctgcaccgcctgcgtgctcccagcctgcgccagatcacccctccagcgccgcgtcaaaacagcctatcgtctatccttggatgaaaaaaattcacgttagtaccgtaaatcccaattacaacggaggtgagccaaagcgaagccgaaccgcttataccaggcagcaggtgctggagctggagaaggaattccattataacaggtacctgactaggagacggagaattgaaattgctcacagtctttgcttaagtgaacgccagatcaaaatttggttccagaacaggcgcatgaagtggaaaaaggatcataggcttcctaacacaaaagtccggtccgcccccccagctggggcagcaccgtctaccctttcagcagccaccccagggacatcagaagaccacagtcagtcagcgacccctcctgagcagcagcgagcggaagatatcacaagactgtag

SEQ ID NO: 190911 - DNA, 795 bp, Artificial Sequence
  Description of Artificial Sequence: Synthetic coding sequence
atgatcatgagcagctacctgatggacagcaactacatcgaccccaaattcccgccgtgcgaagaatattcgcagaatagttatatcccagagcacagtcccgagtattatggccgcaccagggagtctgggtttcagcatcatcaccaggaactgtatccacctccgcctccccggccctcgtaccctgagcggcagtatagttgtacctctttacagggcccgggcaacagtaggggccacggtcccgcccaggccggccatcaccacccagagaagtcacaatccctctgcgaacctgccccattgtctggagctagtgcctcaccatcgccagctccccctgcgtgctctcaaccagcccctgatcacccaagctccgccgcctctaagcagcccattgtgtacccttggatgaagaagattcatgtctccaccgtgaacccaaactacaacggcggcgagcctaagagaagtcgcaccgcatatacacggcagcaggtcctggagttagaaaaggagttccactacaaccggtatctgacaagacggaggcggatcgagattgcgcactccctgtgcctttcggaacggcaaattaaaatttggttccagaaccgtagaatgaaatggaagaaggaccacaggcttccaaatacaaaagtgcgaagtgctccgccagccggtgctgcaccatcgacactttctgctgccactcctgggaccagcgaggaccactctcagagcgcaacaccacccgagcagcagcgagctgaggacattaccagactttag

SEQ ID NO: 190912 - DNA, 669 bp, Artificial Sequence
  Description of Artificial Sequence: Synthetic coding sequence
atgagcagctacgtggccaacagcttctacaagcagagccccaacatacctgcctataatatgcagacttgcggaaactacggttcggcctctgaggtccaagcttctcggtattgttacggcgggctagatctctcaattacgttcccgcctccagccccatctaattcgctgcatggcgtggacatggccgccaatccccgcgcccatccagaccgccctgcatgcagtgcagcggctgcaccgggtcacgcccccggtagggatgaggccgccccactgaacccgggaatgtactctcaaaaggctgcacggccagcactagaggagcgggcaaagagttcaggagaaattaaggaggaacaagcacaaacaggacagccagcaggtctctcccaaccaccggccccccctcagatctacccatggatgactaagctgcacatgtctcatgagacagatggcaagcgctcacgcactagttacacccggtaccaaaccctggagcttgaaaaggagttccacttcaatagatatctcacgagacggagaagaatagaaatcgccaacaacctgtgcctcaacgaacggcagataaagatttggttccagaaccgccgcatgaagtggaaaaaagacagcaagatgaagtcaaaagaagccttgtag

SEQ ID NO: 190913 - DNA, 708 bp, Artificial Sequence
  Description of Artificial Sequence: Synthetic coding sequence
atgaacagctacttcaccaaccccagcctgagctgccacctggccggcggacaagacgtgttgccgaacgttgcactgaactcaactgcttacgatcccgtgagacacttcagcacctacggagccgctgtggctcaaaatcggatatatagcacaccattctacagtccccaggagaatgtcgttttcagtagcagcaggggcccttacgactacggcagcaactcattttaccaagagaaggacatgctctccaactgtcgacagaacaccttgggacacaacacacaaacaagcatcgctcaagacttttccagtgagcaagggcgtactgctccccaagaccagaaggcctccatacagatttacccttggatgcaacgtatgaactcccactcgggcgtaggctacggcgcagaccgcaggcggggacgccagatttactcgcggtatcagaccctggaactagaaaaggaattccactttaatagatatctcacacgcagacggcggatcgagatcgccaatgcactgtgcttgaccgaacgacagatcaaaatttggtttcagaacaggaggatgaaatggaagaaggaaagtaatctgacctcgacgctcagcgggggtggtggtggcgcgaccgccgactccctgggcggcaaagaggagaagagagaggaaacggaggaagagaagcaaaaggagtag

SEQ ID NO: 190914 - DNA, 462 bp, Artificial Sequence
  Description of Artificial Sequence: Synthetic coding sequence
atgctgagcaactgccggcagaacaccctgggccacaacacccagacatcaattgctcaggattttagtagcgagcagggaagaactgccccccaggatcagaaggctagcatccaaatttacccgtggatgcaacgcatgaactcacactctggagttggttacggcgcagatcgccgaaggggacgacagatttacagccgttaccagactctggaacttgagaaagagtttcatttcaatcgctacttaacccgtcgccgtagaattgagatcgctaacgctttatgcctcacagagcgacaaataaagatatggttccagaatcgcagaatgaaatggaaaaaggagtccaaccttaccagcactctgtctgggggcggaggaggcgccacggccgacagcctgggcggtaaggaggaaaagagggaagaaacagaagaggaaaaacaaaaagaatag

SEQ ID NO: 190915 - DNA, 159 bp, Artificial Sequence
  Description of Artificial Sequence: Synthetic coding sequence
atgctgagcaactgccggcagaacaccctgggccacaacacccagactagcatcgcgcaagacttcagctctgagcagggtcgaaccgctcctcaagatcagaaggcatctatccagatatatccctggatgcagcgtatgaatagtcattcaggatag

SEQ ID NO: 190916 - DNA, 216 bp, Artificial Sequence
  Description of Artificial Sequence: Synthetic coding sequence
atgctgagcaactgccggcagaacaccctgggccacaacacccagaccagcattgcccaagacttctcatctgaacagggaaggacagctccgcaagatcaaaaggcatcaatccaaatctacccctggatgcagcgaatgaactcccactccgtttgcttcgtgcccggcagtctaggggttgggtatggggcggatcgcaggcgaggaaggtag

SEQ ID NO: 190917 - DNA, 729 bp, Artificial Sequence
  Description of Artificial Sequence: Synthetic coding sequence
atgagcagctacttcgtgaaccccctgttcagcaagtacaaggccggagagtcgctagaacccgcttactacgactgccgtttcccccagagtgtgggacggagtcacgccctggtgtacgggccaggcggctctgcccctggctttcaacacgcctcccaccatgttcaggattttttccaccacggcacaagtggaatctccaattcgggatatcagcagaatccatgtagtctgtcttgccatggggatgctagtaaattctatggctacgaagctctgcccagacaaagtttgtacggggcgcagcaagaggcaagcgttgtgcagtaccctgattgtaaatcctccgccaacaccaatagctctgaagggcaggggcacctgaaccagaatagctcaccttctttaatgtttccctggatgcgaccccacgcacctggccggcgcagcggcaggcagacttactctcgatatcagacactggaacttgagaaagagttcctattcaacccttacctgacacggaagaggcggatcgaggtcagtcacgctcttggccttaccgaaaggcaggtgaaaatctggtttcaaaaccgccggatgaagtggaagaaagagaacaacaaagataagttgccaggggctagggacgaggaaaaggtggaggaagaaggaaacgaagaggaagaaaaagaagaggaggagaaagaagagaacaaggactag

SEQ ID NO: 190918 - DNA, 783 bp, Artificial Sequence
  Description of Artificial Sequence: Synthetic coding sequence
atgagcgccaccggccccatcagcaactactacgtggacagcctgattagtcatgataatgaggatctgctcgcaagcagatttccagctaccggggctcatcctgccgccgcccggccgagcggtctggttcccgattgttcagatttccccagttgtagcttcgcgcccaagcccgccgtgttctcaacttcttgggcccccgtgccgtcacagtccagtgttgtgtatcacccctacggccctcaaccgcacttaggcgccgatactagatacatgaggacatggctggagcctctttctggagcagtctcgtttcccagttttcctgccggaggtcgtcattacgccctgaaacccgatgcttatccgggcagacgtgctgactgcggtccgggcgaaggacgtagctatccggattacatgtacggcagcccgggagagctgcgggacagggctccccaaacacttcctagccccgaggccgatgccctcgctggctccaaacataaggaagagaaagccgatcttgatccaagtaatccagttgcgaattggatacatgcacgttccacccggaaaaaacggtgtccctatacaaagtaccagactttggagctggagaaggaattcttattcaacatgtacctcaccagggatcggaggtacgaggtagctagggttctgaatctgaccgaacgacaggtaaaaatctggtttcaaaatagaaggatgaaaatgaagaagatgaataaagagaagaccgataaagagcagagctag

SEQ ID NO: 190919 - DNA, 783 bp, Artificial Sequence
  Description of Artificial Sequence: Synthetic coding sequence
atgagcgccaccggccccatcagcaactactacgtggacagcctgatcagccacgacaacgaggacctgcttgcgtctaggttccccgcaacaggtgcccaccctgctgccgcgagaccatccggacttgtgccggattgttctgatttccccagctgctctttcgctccaaagccagccgtgtttagcacatcgtgggctcccgtcccgtctcagtctagcgtcgtctatcatccatacggccctcagccccacctgggcgctgatacacgctacatgagaacatggctggagcccctctcaggcgcggtgagcttcccatcctttcccgctggcggccgccactacgcactgaaaccagacgcatatccaggacgtcgagccgactgtggcccgggagaggggaggagctatccagactatatgtacggtagtcccggggagctgagggatcgggctccacagactctgccctcccccgaagccgacgctctggcgggaagtaagcacaaagaggaaaaggccgacttggatccaagcaaccccgtcgccaactggatacatgcccgctctacacgtaaaaagaggtgcccttacaccaaataccagaccttggagctagagaaagaattcctgtttaacatgtatctgactagggaccgtcggtacgaagtggctcgcgtgctgaatctcacagaaagacaggtgaaaatttggtttcagaaccggaggatgaagatgaagaaaatgaataaggagaaaacagataaagaacagtcgtag

SEQ ID NO: 190920 - DNA, 987 bp, Artificial Sequence
  Description of Artificial Sequence: Synthetic coding sequence
atgagcagctacctggagtacgtgagctgcagcagcagcggcggcgtaggcggcgatgtccttagccttgcccccaagttttgtcgctctgacgcaagaccggttgcgctgcagccggctttccctctggggaatggggatggggctttcgtgtcttgtctgccactggccgctgcccgtcctagcccgtccccacctgccgcccccgctcgcccgtccgtgccacctcccgccgctccccaatacgctcaatgcaccctcgagggggcttacgagcctggggccgcacctgcagccgctgccggtggtgccgattacggcttcctgggatccggccccgcctatgactttccgggagtcctcggcagggctgccgatgacggggggagtcatgtgcactacgccaccagcgcagttttcagcggcgggggttcatttcttcttagcggccaagttgactatgcggcattcggagagcccggcccctttcctgcttgccttaaggccagtgccgatggacaccccggcgcattccagacggccagccccgctcctggcacataccccaagtctgtatcacctgcttcgggcctccctgccgctttcagcacctttgaatggatgaaagtgaagaggaatgcctccaaaaagggaaaactggccgagtacggcgccgccagccctagctcagccattcgcacaaatttcagcaccaaacagctgacggaactcgaaaaagaatttcatttcaacaagtacctcacaagagcgcggagaattgaaattgcgaactgcttgcatctgaacgacactcaagtgaaaatttggtttcagaacaggcgaatgaaacaaaagaagagggaaagggaagggctgctagctaccgcaatacccgtggctcctttacaactgcccctaagtggtaccaccccaacaaagtttataaaaaaccctggcagcccaagtcaatcccaggagccttcttag

SEQ ID NO: 190921 - DNA, 630 bp, Artificial Sequence
  Description of Artificial Sequence: Synthetic coding sequence
ctggagcgggccgcccgggtggagcgggccggcggcgccgcccagacagccgcagtccttctatccctttgtccagccccttactcgggaccgggattgaggccacacttagcttttgccccaggcagaccccgtgccgccgtgaggactgctagcggtagggcacccgtcagggctgttcacccagggggaggcttgcggacctggtgccggacctgccgggggagctggggccgcggactgcgacttcctggtgtgcgtgcaggagtaaggctccccgggagggcaggggctggcggaccattcccagcctgtctgaaagctagtgcggatgggcaccctggagccttccagacggcttccccagctcccggcacatacccaaaatccgtgagtcctgcttctggtctccccgctgctttctcaacgtttgagtggatgaaggtgaaacggaatgcaagtaaaaaagatagcgggttagggtttgtggaggaaacccggtctagagctaatagcatggagtctgcgtcaagcaccgactctgaaaacgtgccaggcatcgagaaaatcagcgggaggtcctcaccctggaacttttcgtggcagaccaggcgggtgtggggaaggtag

SEQ ID NO: 190922 - DNA, 1023 bp, Artificial Sequence
  Description of Artificial Sequence: Synthetic coding sequence
atgagcttccccaacagcagccccgccgccaacaccttcctggtggacagcctcattagcgcctgtagaagcgactctttctactcttcttctgccagcatgtacatgcctcctccctctgccgacatgggaacgtacggaatgcaaacttgtggactgctacctagcctagcaaaacgggaggttaaccatcagaacatgggaatgaatgtgcacccatatatcccccaggtagactcatggaccgacccaaataggtcatgtagaatcgaacagcccgtaactcagcaggtgcctacatgttcctttacaacaaatataaaggaagaatccaattgctgcatgtatagcgacaaacgcaataagctgatctcagcagaggtgcctagctaccagcgcctcgtcccagagtcttgtccggtggagaatcccgaagtgccagtgccaggttatttccgcctgtctcagacctacgcgaccgggaagactcaggagtataacaattccccagagggatcaagcaccgttatgctgcagctaaatccaaggggtgcagcgaagccccagctgtccgccgcgcagttgcagatggaaaagaaaatgaacgagcccgtgtccggtcaagaacctactaaagtgagtcaagtggaatctccagaggccaaaggaggcctccctgaggagcgatcttgtttggctgaagttagtgtttcatcccctgaggttcaagaaaaggagtccaaggaagagattaagtccgataccccgactagcaattggctcacagccaagagcggcaggaaaaaaagatgcccgtacacgaagcatcagactctagaactcgaaaaagagtttctgtttaatatgtatctgacgagagagaggcgcctcgaaatcagcaagtctgtgaaccttacagataggcaggtaaagatctggtttcagaacagacgtatgaaactgaaaaagatgtcacgagaaaacaggatccgcgaactcaccgcgaatctcacattctcgtag

SEQ ID NO: 190923 - DNA, 1017 bp, Artificial Sequence
  Description of Artificial Sequence: Synthetic coding sequence
atgaacgacttcgacgagtgcggccagagcgccgccagcatgtacctgccaggctgcgcctactatgttgcaccctctgacttcgcttccaaaccaagctttctgtcccagccatcttcctgtcaaatgacattcccatatagcagcaacctggctccgcatgttcagcctgtcagagaagtggcatttagagattatggactggaacgggcgaaatggccctatcggggtggtggtgggggaggtagcgccggcggagggtcctcgggcgggggtcccggaggcggtggggggggggcaggaggatatgctccttactatgccgccgccgccgccgctgccgccgcggccgccgctgccgaggaagctgcgatgcagagggagcttctacctccggccggacgaagacccgatgttctgtttaaagcaccagaaccagtgtgcgctgccccagggcctcctcacgggcccgcaggtgccgcctcaaacttctatagtgccgtcggtcgaaacggtatcctgccgcagggattcgaccaattttacgaggccgctcctggcccgccctttgccggtcctcagccaccaccccctccagccccaccgcaacccgagggcgcagcagataagggtgaccctcgcactggtgccgggggcggaggcgggagcccttgcactaaggcaacaccagggagcgagccaaaaggcgctgccgagggatccggcggggacggtgaggggccgcctggcgaagcaggagccgagaaaagttctagcgcggtcgctccacagagaagccgcaaaaagcgctgtccttatacaaaatatcagatcagggaactagagcgagagttcttcttcaatgtttacattaacaaagaaaagcgcctgcaactgagcagaatgcttaacctgactgatcgtcaggtcaagatctggtttcagaatcgaaggatgaaagagaaaaaactgaatcgcgacagactgcagtatttcaccggtaatcctctgttctag

SEQ ID NO: 190924 - DNA, 480 bp, Artificial Sequence
  Description of Artificial Sequence: Synthetic coding sequence
atgtacctgcccggctgcgcctactacgtggcccccagcgacttcgcttccaaaccaagctttctgagtcagccaagctcatgtcagatgacttttccctactccagtaacctggctcccggaggaggctccccatgtaccaaggctacacccgggtcggagccaaagggggccgcagagggctctggaggcgatggggaggggcccccaggagaggccggagctgaaaaatcgtcatcggcggttgccccgcagcgaagccggaagaaacggtgcccttacacaaagtatcaaattcgggagctggaaagagagtttttcttcaatgtctatattaacaaagagaagcggctgcagctaagcagaatgttaaatttgactgacaggcaggtaaagatatggttccagaatcgacgcatgaaagaaaagaagctgaatcgggatagattgcagtattttaccggcaatcctctgttttag

SEQ ID NO: 190925 - DNA, 813 bp, Artificial Sequence
  Description of Artificial Sequence: Synthetic coding sequence
atgtgcgagcggagcctgtaccgggccggctacgtgggcagcctgcttaacctccaatcccccgattccttctattttagtaacctgagacctaatggtggacagctagcggcactcccacctatcagctacccgaggggcgctctgccatgggccgccactcctgcatcttgcgcgcctgctcaacctgccggcgccaccgcatttgggggattcagtcagccctacctcgccgggagcggtccactggggctccaaccacccacagcaaaggacggaccagaggaacaggctaagttttacgccccagaggccgccgcaggacccgaagagcggggtagaacgaggccatcatttgccccagaaagttctcttgctcccgcagtggccgcactgaaagcagccaagtatgactacgctggggtcggccgagctacgcctggatccacgactttgctacagggagccccgtgtgcgcccggttttaaggacgatactaaggggccgcttaatctgaatatgaccgtacaggccgcaggtgtggctagttgccttcgacccagtctaccagatggactgccgtggggagccgccccaggaagggcccggaaaaaaagaaaaccatacacaaaacaacaaatcgctgagctggagaatgaattcctggtcaacgagttcatcaatcgtcaaaagagaaaggagctaagtaatcgactcaatttaagtgatcaacaggtgaagatttggtttcaaaataggagaatgaagaagaagcgagtcgtgctaagggaacaggctcttgccctttactag

SEQ ID NO: 190926 - DNA, 1299 bp, Artificial Sequence
  Description of Artificial Sequence: Synthetic coding sequence
atgctgttcgagcagggccagcaggccctggagctgcccgagtgcaccatgcaaaaggccgcctactacgaaaacccaggactctttgggggctacggctattctaagaccacagacacctacggttacagtaccccccaccaaccctaccctccccctgctgctgccagcagcctcgacactgactacccgggcagtgcttgttctatccagtcttccgccccgctgcgggctcccgcccataaaggcgcagagttaaatgggagctgtatgagacccggaactggcaacagccaaggaggcggcggtgggagccaaccccccggtctcaattctgagcagcagccaccccaaccccctcccccaccccccacactccccccatcgtcaccaaccaacccaggcggcggtgtgcctgctaaaaaacctaaagggggccctaacgctagcagcagcagtgccaccataagcaaacagatttttccctggatgaaggagtctcggcaaaactctaagcaaaaaaactcctgcgccaccgcaggagaaagttgcgaagataagagcccccccggacccgcaagcaaacgagtgcgcaccgcttatacttccgcccaacttgtagaattagagaaagaattccacttcaatagatatctctgtagaccacgtcgggtggagatggcaaatctgttgaatctcaccgaaagacagattaagatatggtttcagaaccgacgcatgaagtacaagaaggatcagaaggctaaaggtatcctgcattcccccgcctctcagagccctgagcggtctcctcctttaggtggtgctgctgggcatgtcgcctatagcggtcagctcccacccgtaccagggctagcgtatgatgcccctagtccgccagcctttgcaaagtcccagcccaatatgtacggattagcagcttatacggccccgctgagctcttgccttccgcagcagaagcggtacgccgccccagagttcgaaccccaccctatggcatccaacggtggcggcttcgctagtgccaatctgcagggatctcccgtctatgtcgggggcaatttcgtcgagtctatggcaccggcctccgggcccgtgttcaacctcggacacctgtcacacccatcctctgcttcagtggactactcatgcgctgcacagattccaggcaatcatcaccacggtccctgcgatccccaccccacctacacagacttaagcgcccaccatagtagtcagggtcgactgccagaggcgcctaaattgactcacctgtag

SEQ ID NO: 190927 - DNA, 1299 bp, Artificial Sequence
  Description of Artificial Sequence: Synthetic coding sequence
atgctgttcgagcagggccagcaggccctggagctgcccgagtgcacaatgcagaaagcggcttactacgagaacccgggtctgtttggggggtacggatattcaaaaaccaccgatacttacggatactccacccctcaccagccttatccaccgcccgccgctgcgagctcactagatactgattatccagggtctgcttgttcaatccagtctagtgcaccactcagagctccagctcataaaggggccgaactcaatggcagttgcatgcgccccggaacagggaattcccaaggaggaggcggaggcagccagccccccgggcttaactcagagcagcagccaccccaaccccctccacccccacccaccctcccgccctcatcccctaccaatcctggaggaggcgtgcccgctaagaaaccaaagggaggacccaacgcctcttcaagctccgcaaccatcagtaagcagatcttcccttggatgaaagagagccgacagaatagtaagcagaagaattcctgtgcgacggcaggggaaagctgtgaagacaagtccccccccggtcctgcctctaagcgggtccgtacagcttacacctcagctcagctggtggagttggagaaggagttccacttcaatcgctatctctgtcggccccggcgtgtcgaaatggccaatctgctgaacctcactgagcgacagattaagatttggtttcagaatcgccgcatgaaatacaagaaagatcagaaagcaaagggcatactacatagccctgcctctcagtctcccgaacggtccccaccacttggcggcgctgctggccacgtagcctacagcggtcagttaccgccggtccctgggttagcctatgatgcgccctctccaccagcattcgccaagagtcagcctaacatgtacggccttgccgcctacactgcgcctctttcctcttgtctgcctcagcagaagaggtacgcggctccagagtttgagccacaccccatggccagcaacggtggcgggtttgccagcgccaatctgcaagggtccccggtgtacgttggaggcaactttgtcgagtccatggctccggcctctggccccgtctttaacctcggacacttgtctcaccctagctcagcctcggtcgactattcttgcgccgctcagatcccggggaatcaccatcacgggccatgcgatccccacccgacatacacggacttatccgcacatcactcctcacagggcagacttcctgaagcgcccaagctgacgcacctttag

SEQ ID NO: 190928 - DNA, 303 bp, Artificial Sequence
  Description of Artificial Sequence: Synthetic coding sequence
atgctgttcgagcagggccagcaggccctggagctgcccgagtgcaccatgcagaaggctgcttactacgagaacccgggtttgtttggcggctacggatatagtaagacaacagatacgtacggatacagtactccccaccagccatatccaccccctgcagccgcctcatccctcgacaccgactatcctgggtccgcgtgttccattcaaagtagcgcccccctgcgagcacccgcacataagggagcagaactgaacggatcctgtatgagaccaggcacaggaaattcccaaggctag

SEQ ID NO: 190929 - DNA, 1299 bp, Artificial Sequence
  Description of Artificial Sequence: Synthetic coding sequence
atgctgttcgagcagggccagcaggccctggagctgcccgagtgcacaatgcaaaaagcggcttattacgaaaatcccggccttttcggtggctatggatactccaagactaccgacacttatggctatagcactccccaccagccctacccacctcctgctgctgcgagctccttggatacagattatcccgggagcgcctgttctatacagagttctgctcctctcagagcgcctgctcacaagggtgctgaactaaatggatcatgtatgcgacctgggaccggaaactctcagggaggaggtggcgggagtcaaccccccggtctcaactctgagcaacagcctccgcagccacctccccctcctcccacactaccaccatccagtcccaccaatcctggtggtggcgttccggccaaaaagcccaaaggcggaccgaacgcctcatcatcatccgctacaatatccaagcagattttcccctggatgaaggaatctcgtcaaaattcaaagcagaagaatagttgcgcgacggccggcgaatcatgtgaggacaagtctcccccggggcccgccagcaagcgcgttcggacagcctacactagtgcgcagctcgtggaactagaaaaagaattccacttcaatcgctacctgtgccggcctcgtcgggtagagatggccaacctccttaacctgaccgagaggcagatcaagatctggtttcagaatcgcagaatgaagtacaagaaggatcagaaggccaaaggaatcttacatagtcccgcctcacagtctcctgaacgcagcccacctcttggtggagcggctgggcacgtggcctattcggggcaactgcccccagttccaggcttggcgtacgacgcgcccagccctccagctttcgcgaagtctcagccgaatatgtacggactggccgcatatacggcacctctctcctcctgcctcccccagcaaaagaggtacgcggcccccgagtttgaaccacaccctatggcctcgaacggcggaggctttgcgtccgccaacttgcagggatcacccgtttacgttggtggtaattttgtagaatccatggccccggcctctgggccagtgttcaacctgggccacctgagtcatccatcctctgcttcagtggattactcatgcgctgcccagatacctggtaaccatcaccacggcccctgcgacccccaccctacttatactgaccttagcgctcatcatagtagccaagggcgtctgccggaggccccaaagctcacgcatctgtag

SEQ ID NO: 190930 - DNA, 768 bp, Artificial Sequence
  Description of Artificial Sequence: Synthetic coding sequence
atggtgatgagcagctacatggtgaacagcaagtacgtggaccccaagtttccaccttgcgaggagtatctgcagggcgggtatctcggagagcaaggcgccgattactacggcggcggtgctcaaggcgcagacttccagcccccgggattatacccccgccccgactttggggaacagccttttggtggcagcggaccaggacctggttctgcactccctgccaggggccatgggcaagaaccaggtggacccgggggacactacgctgctccaggcgaaccatgccctgctcccccagccccaccccccgcaccactgcccggcgctcgcgcctattctcagtctgaccccaagcagcccccttccggaacagccctgaagcaacccgcagtcgtgtatccttggatgaaaaaggtccatgtaaactctgtgaatccaaactacacaggtggcgaacctaagaggtctcggacagcctacacgcgtcaacaagtgttagagctagagaaggagttccacttcaaccggtacctcacacgcagacggcgaattgagatagctcacactctgtgcctgtccgagaggcagataaaaatctggtttcaaaaccggaggatgaagtggaagaaagatcacaaactgccaaataccaagggccggagttcctcttcttcatctagcagttcttgctcttcgagcgtggctcccagtcagcacctgcaaccgatggccaaagaccaccacaccgacttgaccacattgtag

SEQ ID NO: 190931 - DNA, 873 bp, Artificial Sequence
  Description of Artificial Sequence: Synthetic coding sequence
atgagcagctacttcgtgaaccccctgtacagcaagtacaaggccgcagccgcggctgctgccgctgccggtgaggccattaaccctacttattacgattgccacttcgccccagaggtggggggcaggcatgctgccgccgctgccgccctccagctctatggaaactctgcagcaggcttccctcacgctccacctcaggcccacgcccatccacaccctagtccccccccatcaggcaccggctgtggcggcagagagggtcggggccaggaatatttccaccccggaggaggatcccccgcagcggcctaccaggctgccccgccaccccccccacacccgcccccacccccccctcccccgccctgtggcggcatcgcctgccatggcgagcctgcaaagttctacggctacgacaacctgcagagacagccaatatttaccacacagcaggaggctgagttagttcaatatcctgattgcaaatcaagcagcggcaacattggcgaggaccctgaccacctgaatcagtctagctccccctcacagatgttcccttggatgcgacctcaagctgcgccagggaggagacgtgggaggcagacttatagccgattccaaactttggaacttgagaaagaatttctcttcaacccgtacttaactagaaagaggcgcatagaagtaagccatgctctggccttgaccgagcggcaggtgaagatctggttccagaaccgcagaatgaaatggaagaaggagaataacaaagataaatttccagtgagcaggcaagaggttaaagatggggagactaagaaggaggctcaggaactggaggaggacagagccgaagggctgactaactag

SEQ ID NO: 190932 - DNA, 870 bp, Artificial Sequence
  Description of Artificial Sequence: Synthetic coding sequence
atgagcagctacttcgtgaaccccctgtacagcaagtacaaggccgccgcagccgcagcggctgctgccggcgaagctatcaaccccacttattatgactgtcacttcgcacctgaagtgggcgggaggcacgccgcggctgcagcggcgcttcagctttatggtaacagtgccgccggtttccctcacgcgcccccccaagcgcacgcgcatccacatccgtccccccccccatctgggacagggtgtggcggacgggagggtaggggacaggaatattttcacccaggtggcggatctcctgcagctgcctaccaggccgcacctcccccacctccccaccccccacccccaccacctccaccaccctgcgggggtatcgcctgccatggcgagcccgccaagttctacggctatgacaatttgcagaggcagccaatttttaccacccaacaggaagcagagctggtgcagtacccagattgtaagtcaagttccggcaacattggtgaagacccagatcatttgaaccagtcaagttctcctagtcagatgtttccatggatgaggccccaggcccctgggcgcaggagaggtaggcaaacatattcacggtttcaaaccctcgaactcgagaaagagttcttatttaatccttacctgaccagaaaacggcgcattgaagtgtcccacgccctcgcattaacagagagacaggttaaaatatggttccagaacaggagaatgaaatggaagaaggagaataacaaggacaagtttcctgtaagcagacaagaggtcaaggatggcgagacaaaaaaggaggcccaagagctggaggaagatagagcagagggcctgacaaactag

SEQ ID NO: 190933 - DNA, 870 bp, Artificial Sequence
  Description of Artificial Sequence: Synthetic coding sequence
atgagcagctacttcgtgaaccccctgtacagcaagtacaaggccgctgccgctgcagccgcggccgcgggcgaggccatcaacccgacttattatgactgtcactttgctccagaggtgggcggtaggcatgccgccgctgctgcagccctacagctgtatggcaattctgcggctggcttccctcatgcccctccgcaagcccacgctcatccccacccaagtcctccaccgtcaggaaccgggtgtggcggcagggaggggagagggcaagagtactttcacccaggaggaggctctccagcggcggcctatcaggctgcaccacctccgcctcctcacccaccccctcctccgccacctcccccatgtggtggcatagcttgtcacggtgaaccggctaagttctatggatatgacaatctgcaacggcagcctatcttcaccacacaacaggaggctgagctggttcaataccctgattgtaaaagcagttctggaaacatcggcgaggatcccgaccacctgaatcagtcgagcagtccttcccaaatgtttccgtggatgagaccacaggcacctggtcgacgtcgcgggcgccagacgtactcccggtttcagaccctcgaactggagaaagagttcctcttcaacccttacctgacaagaaagcggcgtatagaggtaagccacgctctagccttgaccgagcggcaagtaaaaatctggtttcagaaccgaaggatgaagtggaaaaaggagaacaataaagataaatttcctgtgagcaggcaggaggtgaaggacggtgaaacaaagaaagaggcccaagagcttgaagaggacagagccgaagggttaacaaattag

SEQ ID NO: 190934 - DNA, 321 bp, Artificial Sequence
  Description of Artificial Sequence: Synthetic coding sequence
atgttcccctggatgcggccccaggccgcccccggccggcggcggggccggcagacttacagccgctttcaaacactggagctggagaaggaattcttgttcaatccctacctgactcgtaaacgccgaattgaagtgagtcatgcgctggccctgaccgaacgacaggtgaaaatctggtttcaaaacaggagaatgaagtggaaaaaggaaaacaataaagataaattcccagtcagtcggcaggaagtgaaggacggagaaacgaaaaaggaggcccaggagctggaagaggatcgagcagagggtctgactaactag

SEQ ID NO: 190935 - DNA, 1059 bp, Artificial Sequence
  Description of Artificial Sequence: Synthetic coding sequence
atgctgggcggcagcgccggccggctgaagatgagcagcagcggcacactgtcgaattactacgttgatagtcttatcggacacgaaggagacgaagtatttgcggcacgcttcgggccacccggcccgggagctcagggacgcccagccggagtcgctgatggacctgccgcaactgccgctgagtttgcgagttgttcctttgcgcccaggagcgcagtgttctctgcctcatggagtgcggttcccagccagccgcctgcagcggccgcaatgagcggcttgtaccacccttacgtaccaccacctccgctggctgccagcgccagcgaacctgggagatatgttcgtagttggatggaacccctgcctggatttcctgggggcgctggtggtgggggcggcggcggaggtggcggcccaggccgcggtcccagccctggcccctctgggcccgctaacggacgacactacggtatcaaacccgaaacgagggccgcacctgctcccgctaccgcggcatccactacatcatcctcatctacaagcctctcttcttcctcaaagcgcaccgagtgttcagttgcgcgggagtcacaagggagtagcgggcccgaattttcctgcaacagcttcctgcaagagaaagccgccgccgcaacaggcggaactggtcccggcgctgggatcggtgcagcgacaggcactggaggatcatctgagccaagcgcctgcagcgaccatcccattccaggctgttctctaaaggaggaagagaagcagcattctcagccacaacagcagcagttggaccccaataaccctgcagccaattggatccacgcccgcagcacaagaaaaaaaagatgtccatacacaaagtatcagacgttggaactggagaaggagttcctgtttaacatgtatctcaccagagataggaggtacgaagtcgcgcgcattctgaacctgaccgaacgtcaggttaaaatttggttccagaaccggcggatgaagatgaaaaaaatgtcaaaagaaaagtgtccaaaaggcgattag

SEQ ID NO: 190936 - DNA, 2757 bp, Artificial Sequence
  Description of Artificial Sequence: Synthetic coding sequence
ctgcagcccgtgtacgagagcatggccagccacgtgcaggtgttctcgccacacaccctgcagtcttctgctttctgttctgtgaaaaaacttaagatcgaaccttcatccaactgggacatgacgggctatggaagtcatagtaaggtctacagtcagtccaaaaacattccactgtcccagccggcaacaactacagtttccacctcactgcccgtacctaaccccagcctgccctacgaacaaacaatcgttttcccaggatcaacgggccacattgtagtgacatcagcatcatccacttctgtgaccgggcaggtacttggaggcccccataatcttatgagacgtagcacagtgtcccttttagacacctatcagaagtgtgggcttaagagaaagagcgaagaaatcgagaacacttcatccgtgcaaatcatcgaagaacacccccctatgatacagaacaacgcctccggggcaacagtcgccacagccactacttcaacagcgacatccaaaaatagcggaagtaactccgagggcgactaccaactagtgcaacacgaggtgctatgcagcatgaccaatacgtacgaggtgctggagttcctaggacgcggaacatttggccaagttgtcaagtgctggaagagaggaacaaatgagatcgtagctatcaagatacttaaaaatcacccctcctatgctaggcagggccagatagaggtaagcattctggcacgcctatctaccgaaagtgctgatgactataactttgtgcgggcatacgaatgcttccagcataaaaaccacacatgcctggttttcgagatgctcgaacagaatctgtacgacttcctaaaacagaacaagttctccccacttccgctgaaatatattaggcctgtcctgcagcaggtggcaacggcgttgatgaaacttaaatccctggggcttatccatgccgaccttaaaccggagaacattatgctggtcgacccatctcggcagccataccgcgtcaaggttatcgattttgggtcagcctcgcacgtgtcaaaggcagtgtgcagtacctatctgcagtcaagatattatcgcgcgcctgaaattatacttggattgccgttctgtgaagctattgacatgtggtcgctcggatgtgtcattgccgagctgtttctgggatggccactctaccccggcgcttctgaatatgatcaaattagatatatatcacagacacagggactgccagccgagtatctcctcagcgctggtaccaaaacaacaagatttttcaaccgcgacaccgacagcccgtatccactgtggcggttgaaaacccctgacgatcacgaagccgagactgggatcaagagtaaggaggcccgcaaatacatttttaattgtctggatgacatggcacaggtcaatatgacaacagacctggagggaagtgacatgctcgtcgaaaaagccgaccggcgtgagttcattgacctgctgaagaaaatgctcaccatcgatgcagataaacgcattacgcccatcgagactctgaaccatccctttgtaaccatgacacatctgctggacttcccccacagcacccacgtgaagtcatgtttccagaacatggagatatgtaaacgacgagttaatatgtatgacaccgtgaaccagagcaaaacccctttcataacccatgttgccccttccacatctacgaatctgaccatgacatttaataaccagctgacaacggtgcataaccaggcccccagcagcactagcgctacaatttccctggccaacccagaagtgtcaattctgaattacccgtccactctgtaccagccaagcgcagccagcatggccgccgtggcacaacggtccatgccactccaaacaggaacagcacagatatgtgcacgccctgacccttttcaacaagcacttatcgtgtgcccgccaggcttccaagggctccaggcatcaccttcaaagcacgcaggttattctgtgcgcatggaaaatgccgtccctatagtgacacaagcaccgggagctcagcctctgcagattcaacccggcctcctcgcccaacaggcctggccaagtggaacccagcagattctgctaccgcctgcctggcaacaactaacaggagtggccacacacacgtcagttcagcatgcaaccgtaatcccagagaccatggccgggacccaacaacttgccgattggcgaaatacacacgcccacggttcgcactataaccccattatgcagcagccagctcttctgactggccatgtgactcttccagccgcccaaccgctcaacgtcggagtggctcatgtgatgcggcagcagccaacaagcactacctcctcacgcaagagcaagcaacatcagtccagccagaggaagaacgtcatctcatgtgtcacagtccatgattcaccatactccgattcctcatcgaacacttcaccctattctgttcagcagagggccggccacaataacgccaacgcatttgatactaaaggaagtctggaaaaccactgcacgggcaacccaagaacaatcattgtgcctccgcttaaaacccaggcatctgaagtgctagtggagtgtgacagcttggtacccggcaaccttgggcccgggcaggggagaaacctgtccttagagtctggcttcccagcttttctgctgttagaaatgctcctctacggctcatag

SEQ ID NO: 190937 - DNA, 3597 bp, Artificial Sequence
  Description of Artificial Sequence: Synthetic coding sequence
atggcccccgtgtacgagggcatggccagccacgtgcaggtgttcagcccccacaccctgcagtctagtgcattctgttccgtgaaaaaacttaaaatcgagccttcatccaattgggatatgacaggttatggatcgcacagcaaggtgtacagccaaagcaagaatatccctctctcacagcctgctacaacgactgtgagcactagcttacctgtgccgaatcccagtctaccttatgaacagaccatcgtatttcccggtagcaccggccatatcgttgtcaccagtgccagctcaactagcgtgacaggccaggtgttgggggggccacacaacctcatgcgtcggtccaccgtgtctctgttggatacttatcagaagtgtgggttgaaacggaaatctgaggagattgaaaatacctcttctgtacaaataatcgaagaacatccccccatgatacagaataatgcctctggagccacagtggctaccgcgaccacatctacagccacctcaaagaattcaggcagtaactctgagggagactaccaacttgtgcaacacgaagtcctgtgttcaatgaccaatacttatgaggtcctagaattccttggccgaggcacttttgggcaggtagtgaagtgctggaagaggggaactaacgaaatcgtggccatcaagatcctaaaaaatcaccctagctacgccaggcagggccaaatcgaggtgtccatcctggcgagattgtctactgagagtgctgatgattataatttcgtgagagcctacgagtgcttccaacacaagaaccacacgtgtctggtctttgagatgctggagcaaaacctgtacgacttcttgaaacagaacaaatttagtccactgccactcaagtatatacgccccgttctgcagcaggtagcaacagctttaatgaagctcaaaagcttgggcctcattcatgcggacctgaagccagagaacatcatgctagtggaccctagccgccaaccgtatagggtgaaggtgatcgattttggatcagctagccacgtgtcaaaggctgtctgctcgacgtatcttcagagccggtattatagagcccccgagattattttagggttacccttctgcgaagcaatcgatatgtggagtctcggttgtgtgatagctgagcttttcctaggatggccactatatcccggagcgtccgaatacgaccaaattaggtacatttcacagacccagggactccccgccgaatacctcctttccgcaggaactaagaccacccggttcttcaaccgcgatactgactcaccctatccactttggcgactcaagacccccgacgatcatgaggctgaaaccggcattaagagtaaagaggcacgtaagtatatctttaactgcctggatgacatggcccaggtgaatatgaccacagatttggaagggtcagatatgttggtcgaaaaagctgatcgtagagaattcattgacctcctgaagaagatgttaacaatcgatgcagataaacgtattacccccatcgagacactcaaccaccccttcgtgactatgacccaccttctcgactttccgcactcaacccacgtaaagagttgttttcagaatatggagatctgcaaaaggagagtgaacatgtacgacactgtcaatcagagcaaaaccccttttattacccacgtggccccaagcacaagtacgaacctgacaatgacctttaacaatcaattaactacagtgcataaccaggccccgtctagcaccagcgccacaatctcattggcaaatcccgaagtttcaatactcaattacccctccaccttgtaccaaccttccgcagcaagcatggcggcggtcgcacagcggtctatgcctctgcagacgggtacagcacaaatctgtgccaggccagatccctttcagcaagccctgatcgtttgccccccaggattccaaggactgcaggctagtcccagtaagcacgccggatattcggtcagaatggaaaacgcagtccccatcgttacgcaggctcctggcgcacagcccctgcagattcagccgggtctgttggcacagcaggcctggccatcaggaacccagcaaattcttctgccccctgcctggcagcagctcaccggtgtggcaactcacacatccgtccagcacgccaccgttattcctgagacaatggccggaacccagcagctggcagactggcgaaacactcacgcccacgggtcccactataaccctataatgcagcaacctgctctgctgactggtcatgttaccttaccggccgcccaacccctgaacgtcggggtggctcatgtcatgcggcagcagcccacctccaccacaagctctcggaaatccaaacagcatcaaagcagtgtaaggaacgtctccacctgcgaggtgagttcttctcaagccattagctctccacagcgatcaaagcgcgtgaaggagaataccccccctaggtgtgccatggttcattcctcgcccgcgtgtagtacttccgtgacctgtggctggggcgatgtggcatccagcactacccgggaacgacagcgccaaacaatcgtcattcccgatactccatctcccactgtgtcagtgattactatcagttctgacaccgatgaggaggaagaacagaaacacgctcctacgagcactgttagcaaacagcgaaagaacgtgatatcttgtgtcactgtgcacgatagcccctatagtgattcatcgagtaatacaagcccttattctgtgcaacagagagccggccacaacaacgccaacgctttcgatacaaagggatccctcgaaaatcactgtacgggcaatcccagaaccatcatcgtgccacctctcaagacacaagctagtgaggtcctcgtcgagtgcgactcactggtgcctgtgaacacgagccaccactcatcttcctataagtccaaaagcagttcgaatgtcacatctactagcggtcacagctctgggtcctcttccggcgcaatcacttaccggcagcagcgccccggaccccactttcagcagcagcagcctctgaatctctcacaggcacagcagcacattaccacagacagaaccgggtctcaccgccggcagcaggcctatatcaccccgacaatggctcaggcaccgtacagtttccctcacaactctcccagccacggcacagtccatccccacctcgctgctgcagccgccgcagctcaccttcctacccagcctcacctgtatacgtacaccgctccggctgctctgggatctactggcaccgtggcccacttagtggcatcgcaggggagcgcccggcataccgtgcaacataccgcttatcccgccagtattgtgcaccaggtgcccgtttccatgggtcccagagtgctgccatcacccacaatccacccgagccagtatccggcccaatttgcacaccagacgtatatatctgcaagccctgcatcgactgtttatactggctatccattgtccccagctaaagtcaaccagtatccctatatctag

SEQ ID NO: 190938 - DNA, 3516 bp, Artificial Sequence
  Description of Artificial Sequence: Synthetic coding sequence
atggcccccgtgtacgagggcatggccagccacgtgcaggtgttctccccccacactctgcagtcttcagcattttgctccgtcaagaagctgaaaatcgagccctcctcaaactgggacatgacaggctacggtagccacagtaaggtttattcacaatcaaagaatattcccctgtcccaaccagcaactaccactgtgtcaacatcccttcccgtgccgaacccttctttgccttatgagcaaacaattgtgttccctggctcaacaggacatatcgtagtgacatcggcttcaagcacgagcgtcaccgggcaggttttaggaggccctcacaatttgatgcgccgctcaacagtgagtttgctggacacctatcagaaatgcggactgaagcgcaaatctgaagaaatagaaaacacctctagcgttcaaataatcgaagaacaccccccgatgatccagaataacgcaagcggggctactgttgccacggcgaccactagcacggcaacgagcaaaaatagtggaagcaacagtgaaggcgactaccagttggtacagcacgaggttctctgcagcatgacgaatacctacgaagtgctcgagtttttaggacgtgggactttcggtcaggtggtgaagtgctggaaacggggtacgaacgagatagtcgccattaagattctgaagaaccaccctagctacgccagacaaggacagatcgaggttagcatactggcacgactgtctactgaaagcgctgatgactacaactttgtgagggcatatgagtgtttccagcacaaaaatcacacctgtttagtctttgagatgctcgaacagaatctatatgattttctgaagcagaacaaattctccccattacctctgaagtatattcggcccgtactacaacaggtggcaaccgctctgatgaagctgaaatcactaggcctcattcatgccgatctcaagcccgagaacataatgctggtggacccatctcgccaaccctatagggttaaagtgatcgattttgggagcgctagccatgtctccaaggcagtctgttccacatacctgcagagccggtactacagggctccagagatcatcttaggacttccattctgtgaggcaattgatatgtggagccttggttgcgtgattgccgagctgtttttgggctggcccctgtatccaggcgcctccgaatacgaccagattcgatacatcagccagactcagggtctacccgccgaatatttactgagtgctggtaccaaaactacccgattcttcaatagggacactgactctccctatccgctgtggaggttgaaaactcccgatgaccatgaagccgagacagggattaaaagtaaagaggctcgcaagtatatcttcaactgtttggacgatatggcgcaagtaaatatgacaacagatctggagggtagcgacatgctcgtggagaaagccgatcggagagaatttatcgacctgctgaagaagatgctaacaatcgacgcggacaaacggattaccccaattgagactctgaaccaccctttcgtcaccatgacacacctcctggattttccacactccactcatgtgaagtcttgtttccagaatatggagatctgtaaaagaagggtgaatatgtatgacacagttaatcagtctaagacaccttttattacacatgtcgctccctcaacttcaaccaatctgactatgaccttcaacaaccagctgacaactgttcacaaccaaccttctgctgcctccatggctgccgtcgcacagcgctctatgccattacaaaccggaacagcccagatttgcgctagacctgacccctttcaacaggcactcatagtgtgcccccccggttttcagggactgcaggccagcccctcaaaacatgcaggctactctgtcagaatggaaaacgctgtgccgattgtcacacaggcacccggggcccagcccttgcagatacagcccgggctccttgcacagcaggcctggccaagcggaacccaacagattcttctgccccccgcgtggcagcaactgacaggcgttgcaacccatacctccgtgcagcacgccaccgtgatccccgaaactatggcaggtacacagcagctcgccgattggagaaacacccacgcccacggcagccattataatcctatcatgcaacagcctgccctgctgacaggacatgtgacgttgcctgccgcacagcccctgaacgtgggtgtcgcacacgtgatgcggcagcagcctacttccaccacaagcagccggaaatccaagcagcaccagagcagtgttagaaatgtgtccacctgtgaggtttccagtagccaagcgatttcttcaccacagaggtccaaacgggttaaggagaatacacccccccgatgtgcaatggtgcactcaagtccagcttgttcaacctccgtaacttgcgggtggggtgacgtagctagcagcacgacacgggaacgacagcggcaaacaattgttatacctgatacaccctctcctacggtgagcgtgatcacaatctcttcagataccgatgaagaggaggaacagaagcacgcccctacctctaccgtgagtaaacagagaaagaacgtaatctcatgtgtgacagtgcatgattccccttatagtgacagcagctccaacacgtccccatactcagtgcaacagcgagcagggcacaacaacgccaacgcttttgatacaaaggggtctttggaaaatcactgcactggcaacccaagaactattatcgtgccccctctcaaaactcaggccagcgaagtgctggtggagtgcgacagcctcgtcccagtgaacacttcccaccattcttccagctataagagtaagtctagttcaaatgtgacaagcacaagcggccacagcagtgggagcagttcaggagcaattacttacaggcaacaaaggccaggccctcactttcagcaacagcagcccctcaatttgagtcaggcccaacagcatatcaccactgatagaactgggagtcatcggaggcagcaagcatacataactcccaccatggctcaggcaccttacagtttcccgcataattcaccttcccacggcaccgtgcacccccacctggctgctgccgccgccgccgcacatttgccgactcagcctcatctgtatacatacactgccccagccgccctcggctccacaggtaccgtcgctcatcttgttgccagccaaggttcagcccggcatacagtgcaacacaccgcatatcccgcctctatcgttcaccaggtgccagtatccatgggaccaagggtcctaccttctcccactattcaccctagtcagtaccctgcccagttcgcacaccaaacctatatttctgccagccccgcctcgacagtatacaccgggtatcccctttcgcccgccaaggtgaaccagtacccatacatctag

SEQ ID NO: 190939 - DNA, 3648 bp, Artificial Sequence
  Description of Artificial Sequence: Synthetic coding sequence
atggccagccaggtgctggtgtaccccccctacgtgtaccagacccagagctccgcgttttgttctgttaagaagcttaaggtggaaccttcctcctgcgtgtttcaagaaagaaactaccctcggacttacgtcaacggacgtaattttgggaacagccacccgcccacaaaggggtctgcattccaaactaagattccgttcaatcgcccgcggggccataacttctcactacagacctctgccgttgtgctaaagaataccgctggcgcaaccaaggtcatcgctgcccaagcacagcaggcccatgttcaggcaccccaaatcggagcctggcgtaatcgcctacatttcctggaaggaccgcagaggtgtggacttaagcggaagagcgaggagctagacaatcactccagtgccatgcaaatagttgatgagctcagtatactgcccgctatgttgcagacaaacatgggaaatccagtgacagtggtgactgctacaactggcagtaagcaaaactgcactactggagaaggcgactatcagctggtgcagcatgaagtgctgtgttcaatgaaaaatacctacgaggtgctcgatttcctgggcaggggcaccttcggccaagtagttaagtgctggaagaggggcactaatgagattgttgctatcaagatcttgaaaaaccatccatcctacgcgcggcaaggtcagatcgaggtatccattctggcgaggctttcgactgagaacgctgacgaatacaacttcgtgcgggcgtacgaatgcttccagcaccgcaatcacacctgtttagtctttgagatgctggaacagaatctgtacgacttcctgaagcaaaacaaattttcacctctacctcttaaggtcatcaggccgatcctacagcaggtcgctacggcccttaaaaaactgaaatctcttggcctcatacacgcagatctgaaacccgaaaatattatgcttgtggatcctgtgcgacagccctaccgggtgaaagttattgactttggctcggcgtcccacgtgtctaagacagtgtgctcaacttatctgcaatctcgatattacagagcccccgagattattctgggcttgccattctgcgaagcaatcgacatgtggagcctgggctgcgttatagccgaactgtttttgggatggccactgtaccccggagcactcgaatatgaccagatcaggtacatctcccagactcagggattaccgggggaacagctgttaaacgtgggcaccaaaagcactagatttttttgcaaggaaactgatatgtcgcactcaggctggcggctcaagactttggaggagcatgaagcagagaccggtatgaaatcaaaagaagcccgtaagtacatatttaattccctggacgacgtggcacacgtcaataccgtcatggacctcgaagggagcgacctcctggctgagaaggccgatcggagagaatttgtttctcttctgaagaaaatgcttcttatcgacgccgatctacgcataactccagcagagaccttgaatcaccccttcgtcaacatgaagcacttgttggacttcccgcatagtaaccacgtgaagtcctgctttcacattatggatatctgtaaaagtcacttgaactcttgtgacactaacaatcacaacaaaacatccctcctgcggcccgtggccagtagctcaaccgccactctcaccgctaactttaccaaaattgggacactcaggagccaggcactgacgacctcagcccatagcgtggtgcaccacggaattcctctgcaagctggcacagcccagttcggctgcggcgatgcgtttcaacagactcttatcatctgcccgcccgcgatccaggggatccccgcaacacatggcaagcccacgtcgtatagtatcagggtagataataccgttcctctagttacgcaggcaccggctgtgcagcccctccaaataaggccgggcgttctgtctcagacatggtccggacgcacccagcaaatgctggtccccgcatggcagcaagtgacgccgttggcacccgcaactacaacccttacttctgagagcgtggcgggtagccacagattaggcgattggggcaagatgatatcctgcagcaaccactacaactccgtcatgccccaacccctcctcactaatcagatcactctctctgcccctcagcccgtgagtgttggaattgcacacgtggtgtggccacaacctgctacaactaagaagaacaaacagtgccaaaaccgcggcattctggttaagctgatggaatgggagcccggaagggaagagatcaacgccttctcttggagcaactctctgcaaaataccaatattccccatagcgcctttatttctcccaaaatcattaacggaaaagacgtagaagaggtgtcttgcatagagacacaggacaaccagaacagcgagggggaggcaagaaattgttgcgagacctctattcgccaagattctgactcttcggtctctgacaagcagaggcagacaatcataattgccgacagccccagcccagcagtgtccgttattactatcagtagcgatacagatgaagaagagacgtctcaacgccattcattgagagagtgtaagggctccctggattgcgaagcctgtcagtcaacactgaacatcgatcggatgtgctccctgagttcgccggactctactctatctacaagcagcagcggccaatccagcccctctccctgtaaacggcctaattctatgagtgatgaagagcaggaaagctcatgtgataccgtagatggctcccccacgagtgactcctcaggccacgactctccctttgccgagagtaccttcgtcgaagacacccacgagaacaccgagttagtgtcctccgcagacactgagactaaaccagccgtgtgctccgtagttgtgccaccagtggagcttgaaaacggccttaacgccgatgagcacatggcaaatacggatagcatttgtcagcccctgatcaagggacgcagcgcgcctggcaggctcaaccagccatctgctgtcggtacaagacagcaaaagctgacaagcgccttccagcagcagcatctcaactttagccaggtgcaacactttgggagtggacaccaggagtggaacggaaattttggacacagaagacagcaggcctatatccctactagtgtcacaagcaacccctttacgctgagccacggaagtcctaatcatacagctgttcacgcccatttggctggcaatacccatcttggaggccagcctaccctcctgccttatccctcatctgctaccttgtccagtgcagctccggtagcacacctcttagctagcccctgtacatcacgacctatgctccagcatcccacctacaatatatcccaccctagcggcatagtacatcaggtgcctgttggactcaaccctcggctcctgccctctccaaccattcatcagacacagtacaaaccaattttccctccacattcttacattgcagcctccccagcttacacaggattcccgcttagccccacaaaactgtcacagtatccttacatgtag

SEQ ID NO: 190940 - DNA, 3585 bp, Artificial Sequence
  Description of Artificial Sequence: Synthetic coding sequence
atggccagccaggtgctggtgtaccccccctacgtgtaccagacccagtccagcgctttctgttcagtcaagaagcttaaagtggaaccttcttcatgtgttttccaggagaggaactacccaaggacctacgttaacggccgtaatttcggaaatagccacccgcctaccaagggttcggctttccagactaagatcccatttaatcgaccccgcggccataacttctcactgcagacaagcgccgttgtgctgaaaaacaccgcaggcgctactaaggtgattgccgcgcaagcccaacaggctcacgtgcaggctcctcagattggggcttggcgcaaccgccttcactttttggaagggcctcagcgatgcggactgaaaaggaagtccgaggagctcgataaccattcctccgctatgcagatagtggatgaactctccatcctcccggctatgcttcagactaacatgggcaaccctgtcacagttgttaccgctactactggcagtaagcagaattgtactactggagagggcgattatcagttagtccagcatgaggtgttatgcagcatgaagaacacttacgaagttctcgatttcttaggtcgaggcacctttgggcaagtagtgaagtgctggaagagggggacaaacgagatcgtagctattaagattctgaagaatcacccctcttatgcgcgccaggggcagatcgaggtttcgattctcgcccgactgtccactgagaacgcagatgaatacaactttgtccgggcctatgaatgttttcagcatagaaaccatacatgtctcgtctttgagatgttggaacagaatctgtacgattttctgaaacagaacaagtttagccctctgccgctaaaagtgattaggccaatccttcagcaggtagccacagccctgaagaagctgaaaagcttgggtctgatacatgctgatctgaaaccagagaatattatgctcgtggatcctgtccgccagccttaccgagtgaaggtcatagactttgggtccgcttctcatgtctcaaagaccgtttgttccacatacctgcaatcccgctactatcgggctcccgaaataatcctgggactgcctttctgcgaagccatcgatatgtggtctctgggatgtgtgatcgctgaactcttcctcgggtggcctctgtatcccggcgcattggaatacgaccagataaggtatataagccaaacccagggactgccaggcgaacagctccttaatgttgggactaaaagtacccggttcttttgtaaagaaactgacatgtcccacagtggttggaggctgaaaaccctggaggagcacgaggccgagactggtatgaaatccaaggaggctaggaagtatatattcaacagtttggacgatgtggcccatgtgaatactgtcatggacttggaagggtccgacctgctggccgaaaaagccgatcgaagggagtttgtctctctgctgaaaaagatgctattgatcgacgccgacttgcgtatcacacctgctgaaaccctgaaccatcccttcgttaacatgaaacacctgctggacttcccccattctaaccatgtaaagtcctgttttcatatcatggacatatgtaagtcacacttgaatagttgtgatactaataaccataataagacctcactcctccggcccgttgcctcttctagtacagcgactctgacagctaacttcaccaagatcggtaccctgcggtcgcaagccttaaccacttccgcacactccgtcgtgcatcatggcattccactacaggccggcaccgcacagttcggctgtggggacgcctttcagcagactctgatcatttgcccgccggcaatccagggtatccccgctacccacggaaagccaacctcctatagcataagagttgacaacacggtgcctctggtcacgcaggctcccgctgtgcagccgctccaaatccgaccaggtgttctatcgcagacctggagtggccgcacacagcaaatgctggtgcccgcctggcagcaagtcaccccactggctcctgccactactacactgacctccgaatctgtcgcaggtagtcacagactgggagactgggggaaaatgatctcctgctcaaatcactacaactcagtcatgccccaacccttactgacaaaccagatcacactgtctgccccccaaccagtgagtgtgggcattgcccatgttgtctggccccagccggctaccaccaaaaaaaacaagcagtgccagaatagaagtaattccttacagaacaccaacattccacattccgccttcatctcccccaaaatcatcaatggtaaggacgttgaggaggtgtcctgtattgaaacacaagacaaccagaacagcgaaggcgaggcccggaactgctgtgagacctccatacgccaggattcagactcctcagtcagtgataaacagcgccagaccatcatcattgcggacagcccgagccccgccgtgtccgttataacgatttcctctgatactgatgaagaagaaactagccagcggcattcactcagggagtgcaaggggtccctggactgtgaagcctgccagagcaccctgaacattgatcgtatgtgttcactgtcaagcccagattcaaccctgtccacgagctcttccggccaatcttctccctcaccgtgcaaaaggcctaatagcatgagcgacgaggaacaggaaagctcttgcgatacagttgacgggtcccctaccagtgactcttccggccacgattctccttttgccgaatcaacatttgttgaagatacacacgagaatacggaactcgttagtagcgccgacaccgaaactaaaccagccgtgtgcagcgtcgtcgtaccccctgtggagctggaaaacggtttgaatgccgacgaacatatggctaacacagactctatctgccagccactcattaagggtagatctgctccaggccgactgaatcagccgtcggcagtgggaacccggcaacagaagctgacaagtgcgtttcagcagcagcacttaaacttctctcaggtccagcatttcggaagtggccaccaagagtggaatgggaattttggccacagacggcagcaggcttatatccccacatctgttacctccaacccttttactttaagtcatggttccccaaaccacactgccgtgcatgcacaccttgctggcaatactcacttgggcggtcagccaacgttactcccttaccccagcagcgcaactttgtcatctgcggcccccgtggcccatctacttgcgtccccttgtacatcacggcccatgctgcagcaccctacctacaatatcagtcacccttcaggtattgtacaccaggtacccgtgggactcaaccctcgcctgctgccatctcccacaatacatcagacacagtataaacctattttccccccgcatagttatattgccgcctcacctgcttacacgggattcccactgtctcctaccaagttgtcacagtatccctacatgtag

SEQ ID NO: 190941 - DNA, 3585 bp, Artificial Sequence
  Description of Artificial Sequence: Synthetic coding sequence
atggccagccaggtgctggtgtaccccccctacgtgtaccagacccagtcttccgctttctgctctgtgaagaagctgaaagtggagccatcaagctgtgttttccaggaaagaaattatcctcgtacttatgtgaatgggagaaactttgggaactctcatccacctacgaaaggtagcgcctttcaaactaaaataccattcaacagaccacgggggcacaacttctcgctacagacatctgctgttgtgctcaagaataccgcgggtgcgactaaagtgattgcagcacaggctcagcaagctcacgttcaggctccccaaattggcgcttggcgtaaccgcctccacttcctggagggtccacagagatgcggtctgaagcgcaaatccgaggaactggataaccactctagtgctatgcagatcgtggatgagttgtcaatcctaccggccatgctccagacaaatatggggaatccagtgaccgtggtcactgccaccacaggcagtaagcagaactgtacgaccggtgagggagattatcagctcgtgcagcacgaggtgctctgtagcatgaagaacacatacgaggtgctggactttctggggagggggactttcggacaggttgtaaaatgctggaaacgcgggacaaacgagattgtggccatcaagatcctaaaaaaccatccatcctatgctcgacagggacagatcgaggtgagtatactggctagactgtcaaccgagaatgctgatgaatacaactttgttagggcatacgaatgctttcagcatcgcaatcatacctgtctggtgtttgagatgctcgagcagaacttgtatgattttttaaagcaaaacaaatttagtcctctgccacttaaggtgatccgccctattctgcaacaggttgccacagccctcaagaaactcaaaagtctgggcttaatccatgccgacctgaagccggaaaatatcatgcttgtggatcccgttagacaaccctatcgcgtgaaagtgattgatttcggaagtgctagccacgtgtccaagaccgtttgctcaacatatttgcaatcccggtactaccgcgccccagagatcattctgggcctgcctttctgcgaagcaatagacatgtggtccttgggttgcgtaatagccgaactgttcctggggtggccgctatacccaggagccttagagtacgatcagatcaggtatatcagccaaacacagggattaccgggggaacagctactgaacgttgggactaaatcgaccaggtttttctgcaaagagaccgatatgagccatagcggatggagactgaagacattggaagaacacgaagccgaaactggtatgaaatctaaggaagctcgcaagtacatctttaacagcttggacgacgtggcccatgtgaacactgttatggacctggaggggtcagatctgttggcggaaaaggcagaccgaagggagttcgtgtccctactcaaaaagatgctactgattgatgccgacctgagaattactccagctgagaccctgaaccatccattcgtgaacatgaagcacctcctcgatttcccacatagcaaccacgtgaagagctgctttcacattatggacatctgtaagagccacttaaacagctgtgacaccaacaaccataataagaccagtcttttgcgccccgtggcgtcatcttcaactgcaactctgacggctaactttactaagatcgggacgctgaggagccaagccttgacaactagcgcacatagcgtggtgcaccacgggattcccttacaggccgggacagcgcagttcgggtgtggtgacgccttccagcagacgctgatcatctgccccccagccatccaaggaattcctgcgacgcatggcaagcctaccagttatagtatccgcgttgataacacagttccacttgtgactcaggcccccgcagttcagccgctgcagattagacccggagtcctgtcccagacatggtcggggcggacacaacagatgctggtgcccgcatggcagcaggtgacccctttagcacccgcgaccactacactgactagcgagtctgtggcaggatctcaccggctgggagactggggaaagatgatcagctgtagcaatcattataactccgttatgccccagccactgctgactaaccaaatcacactgagcgcccctcagcctgtgtccgtcggaatcgctcacgtggtgtggcctcaacccgcaaccaccaaaaagaacaaacagtgccagaacaggtccaacagcctgcagaatacaaacatcccgcacagtgcattcatttcccctaaaatcatcaatggcaaggatgttgaagaagtcagctgtatcgagacccaggataaccagaacagcgaaggcgaggcgagaaactgctgcgagacaagtatcaggcaggattccgattctagtgttagcgacaaacaacggcagactatcattatcgccgactccccatcccccgcggtatccgtaattactatctcatctgacaccgacgaggaagaaacgtcccagagacattcactgagggagtgcaagggtagcctggactgtgaagcctgccagagcacactgaatattgatagaatgtgttccttgagctccccagacagtacactgtccacttctagctcaggccagtcatcaccaagcccttgcaagcgaccaaatagtatgtccgatgaagagcaggaatcctcctgcgatacagtggacggcagtcccaccagtgattccagcggacacgacagtccattcgctgagagcacgttcgtggaggatacgcacgagaatactgaactggtgagctctgccgacaccgaaactaagccagccgtctgctcagtagtggtacccccagtagagttagagaacgggttaaacgcggatgagcacatggccaacacagactccatttgccagcctcttattaaagggagatccgctcccggacgcctgaatcaaccctctgcggttgggacacggcaacaaaaactcacatctgcctttcagcagcagcacctgaacttttcacaggtacagcatttcggcagcggccaccaggagtggaatggaaactttgggcatcgaagacagcaggcatatatcccaacatccgtgaccagcaatccattcactctgtcccacggatcaccgaaccataccgctgttcacgcccatctggccggtaacacccacctgggcggacagccaactctgctcccgtacccctcctctgccaccctgtcctcggctgcccccgttgcccacctgcttgcgagcccttgcacctcacgtccaatgctccaacatcctacgtataacatcagccacccatcaggaatcgtgcatcaggtgccagtgggactcaacccccgacttctgcccagtcccacaattcatcagactcagtataaacctatttttccgccacactcatacatagctgcttcgccagcatatacaggattccccctgagtcctacaaagctgagccaatacccatacatgtag

SEQ ID NO: 190942 - DNA, 3585 bp, Artificial Sequence
  Description of Artificial Sequence: Synthetic coding sequence
atggccagccaggtgctggtgtaccccccctacgtgtaccagacccagagcagcgccttttgtagcgtgaagaagctgaaggttgagccctcatcttgtgtcttccaggagcgtaactacccacgtacatacgtgaacggacggaactttggtaattcccaccccccaaccaagggttcagcctttcagaccaagatccccttcaatcgcccccgcggtcataacttttctctacagacttctgctgtagttctaaaaaacacagctggggccaccaaagttattgcagcccaagcccagcaggctcatgtgcaggccccacagatcggtgcctggcgtaatcgcctccactttcttgaggggccacagagatgtggcctcaagcgaaagagtgaagagctagacaatcactcttcggcgatgcagatcgtggatgagctgagcatcctcccagctatgttgcaaacaaacatgggaaacccagtgactgttgtgacagccaccacaggaagtaaacagaactgtactaccggagaaggtgactatcagctggtgcagcatgaagtgctttgttccatgaagaatacctatgaggtcttggactttttgggtagggggacatttggacaggtggtcaaatgctggaagcgaggcaccaacgagatagttgccatcaagatactcaagaaccaccccagttacgctagacaaggccagatcgaagtctccatacttgctcgtctatcaaccgagaatgcagacgaatacaactttgtacgggcttatgagtgcttccagcatcgcaatcacacctgcctcgtgttcgagatgctcgaacagaacttgtatgactttctaaaacagaacaagttctcacctctgccccttaaggtgattcggccgatcctgcagcaggtggcaacagcacttaagaaattaaaatcgctgggcctcatccacgctgacctgaagccagaaaacataatgcttgtcgacccagtcagacaaccataccgggttaaagtcatcgactttggcagcgcgtcccatgtatcgaaaactgtctgcagcacttacctgcagtcccggtattaccgcgcccccgaaattattctgggcctgcctttttgtgaagctatcgatatgtggtccctggggtgtgtaattgccgaattatttctcggatggcccctgtatcctggtgcacttgaatacgatcagattcggtatatcagtcagacccagggacttcccggggaacagttgcttaatgtggggaccaaatcaacccgcttcttctgcaaagagaccgatatgtcccactcaggatggcgtttgaagacccttgaggaacacgaggctgagactggtatgaagagtaaggaagcccgcaaatatatcttcaattcactcgatgacgttgcccacgtgaacacagttatggacctggagggctcagatctccttgcagagaaggctgacagaagggaatttgtgagccttcttaagaagatgctgctgattgatgccgacctgagaatcacacctgccgaaactctaaatcatccgttcgttaacatgaagcacttacttgattttcctcacagtaaccatgtcaagagctgcttccatatcatggacatctgcaagtctcacctgaatagctgcgatactaataaccataacaagacctctctcttgaggcctgtagccagctcctctacagccactcttactgcaaacttcactaagatcgggaccctccggtcgcaggcattgaccacttcagcccatagcgtcgtgcaccatgggatccccctgcaggccggaaccgcgcaatttggatgtggcgacgcatttcagcagaccctcattatctgcccaccagcaatccaaggcatccccgccactcacggaaaaccaacctcctattccatcagagtggacaatacagtgcccctggtgacacaagcccctgccgttcagcccctccagatccgtccaggcgtcttgagtcagacttggtctggaagaacacagcagatgcttgtgccagcctggcaacaggtcacccccctggcccctgctactaccacgttaacttctgaatccgttgctggatcgcaccggctcggagattggggtaagatgatttcttgctccaatcattacaattcggttatgcctcagcctttgctcactaaccaaatcacactgagtgctccacagcctgtgtccgtagggattgcccatgtagtgtggcctcaaccagccacaactaagaagaacaagcaatgtcagaaccggtccaatagcctgcagaacactaacattccccactctgcttttattagtcccaaaatcattaacggaaaagatgtagaggaggttagctgtatcgaaacccaggacaatcagaactccgaaggagaagccaggaattgctgtgaaacttctatccggcaggactcagacagctcagtgtcagataaacagaggcagaccatcatcatcgcagattctccatctcctgctgtcagcgtcattacaattagcagcgatactgacgaagaagagaccagtcagcggcactcactgcgggagtgtaagggaagcctggattgcgaggcatgccagtccactttgaacattgacagaatgtgcagtctgagttcccctgactccaccctttcaacgtcatcgtccggccagtctagcccttccccgtgcaagaggcccaattctatgagcgacgaagagcaggaatcttcctgtgacacagtggacggtagcccgaccagcgactcgtctgggcacgacagtccgtttgcagagagcacatttgtagaagatactcatgagaacacagagttggtctcaagtgcagacacggagaccaagccagctgtatgcagtgtggtcgtcccgcccgttgaactagaaaatgggctgaatgccgatgaacacatggcaaatacagattccatttgccagccactgattaaaggaaggtcagccccggggaggctcaaccaaccatcagccgttggaaccaggcagcaaaaactcacttcagctttccagcagcagcacctgaatttttcccaggtccagcattttgggtctggccaccaggagtggaacgggaacttcggtcaccgcaggcagcaggcgtacattccgacctcagtgacctctaatccatttactctgtcccatggcagtcccaatcacaccgctgtccacgctcacctggctggcaatacgcacctgggcgggcagcctacacttctcccatacccttcctcagcaacacttagtagcgccgcacccgtagcgcatctcttggcctccccttgtacaagccgtcctatgcttcagcatccaacatacaacataagtcacccttcaggcatcgtgcatcaggtgcccgtgggattgaatcctcgattgctaccctcccctacgatccatcaaacacagtataagcccatctttccaccccatagttatatcgcagcctcaccggcttatacagggtttccccttagtcccaccaagctgtcccagtacccctatatgtag

SEQ ID NO: 190943 - DNA, 231 bp, Artificial Sequence
  Description of Artificial Sequence: Synthetic coding sequence
atggccagccaggtgctggtgtaccccccctacgtgtaccagacccaatcttcagcattctgttccgtgaagaagttgaaggtggaaccttcttcttgcgtgttccaggaacgtaactatcctcgaacctacgtgaacggacggaatttcggcaacagtcaccctcccaccaagggctccgcattccagacaaagatccccttcaacaggccacgaggccacaacttttag

SEQ ID NO: 190944 - DNA, 1851 bp, Artificial Sequence
  Description of Artificial Sequence: Synthetic coding sequence
atgagcaccatccagagcgagaccgactgctacgacatcatcgaggtgctgggcaagggcacgttcggcgaagttgctaaggggtggcgccggtccacgggtgaaatggtggcaattaaaatccttaagaatgatgcctaccggaatcggatcataaaaaatgagttgaagttgcttcactgcatgcggggcttggacccagaggaagctcacgtgattaggtttttagagttctttcacgatgctcttaaattctacttagtttttgagctgctcgagcagaatcttttcgagttccaaaaggagaacaattttgccccgctgcctgccaggcatatacgaactgtgaccttgcaagtcctcacagcccttgcccggctgaaggagttagccatcatacacgccgatctgaaacctgaaaatatcatgctggttgaccagacccgctgcccattcagggtcaaagtcatagatttcggctcggcgtccatcttctccgaggtgcgctatgtgaaagagccatatatacaatcccgcttttatagggccccagagattctactggggctccctttttgcgagaaggtagatgtgtggagccttgggtgtgtgatggccgagttgcacctggggtggccactgtacccaggcaataacgagtatgatcaagtgcggtacatttgcgaaacacagggactcccaaagccacatctattgcacgctgcctgtaaggcccaccacttttttaagcgcaacccccatcccgatgccgccaacccatggcagctcaagtcttccgctgactacctggcggagacaaaagtaagacccttggaacgcagaaagtatatgctgaagtcacttgaccagatcgaaacagtgaacggtggctcagtggcctctaggctgacctttccagaccgtgaagctctggcagaacatgccgatctgaaatccatggtggagctcattaaaagaatgctcacttgggaaagccatgaaaggatcagtccttcggcggctttgaggcacccatttgtttcaatgcaacagttacgcagtgcccatgagactactcactactaccagttgagcctgcgtagttacagactgagcctccaggtcgagggcaagcctcccactcccgtcgtcgctgcggaagacgggaccccgtattattgcctggctgaggagaaggaggctgcaggaatgggttcggttgcaggcagctccccattctttagggaagagaaggctcctggaatgcagcgcgccatcgatcagctcgatgatctcagcttgcaagaagctggtcatggcctgtggggggaaacttgcacgaacgcagtgtctgacatgatggttcctctgaaagctgctattacagggcatcacgtgcctgactctggtccggagccaatcttggccttttactcgagccggctggccggaagacataaagccaggaaaccccccgccggaagcaagagtgatagtaacttttccaatctgatccggctgagccaggtgtccccggaagatgaccgcccatgccggggctcgtcttgggaggagggggaacaccttggggcctctgcagaaccattagcgatcttgcagagagatgaggatggacccaatatagacaatatgaccatggaggctgagaggccagatccagagctcttcgatccttcttcatgtcccggggagtggctttcagagcccgattgcactttggagagtgtgagaggtccacgggctcagggactcccgcctagacggtcccatcaacatggccccccccggggagctacgagctttctacaacacgtgactgggcaccattag

SEQ ID NO: 190945 - DNA, 1746 bp, Artificial Sequence
  Description of Artificial Sequence: Synthetic coding sequence
atggtggccatcaagatcctgaagaacgacgcctaccggaaccggatcatcaagaacgagctaaagctgctgcactgcatgcgtgggctggacccagaagaggcgcatgtgatcaggtttttggaattctttcacgatgccctgaagttctacctggtttttgaactactggagcaaaacctgttcgaattccagaaggagaacaattttgcacccctgcctgcccgtcacatcagaactgttacccttcaggtattgactgccctcgctcggctgaaagagcttgccatcatccacgcagacctgaaaccggaaaacataatgcttgtggatcagaccaggtgcccattcagagtgaaagttatagacttcggatccgcttcaattttcagtgaagtccgctacgtgaaggaaccttatatccaatcaaggttctatagagctcccgagatccttctcggccttcccttttgcgagaaagtggatgtctggagtctcggatgtgtgatggctgaattacacctgggctggccactttatccgggcaataatgagtacgaccaggtcaggtacatctgtgagacccagggacttccgaaaccacacttgttgcatgctgcgtgtaaagcccaccatttttttaaaagaaatccccatcctgatgctgccaacccttggcagcttaaatcctcggccgactatctggctgaaactaaagttcggcccctggagcggcgaaagtatatgttgaagagtttagaccagatagagaccgtaaatggcggcagtgtggcctctcggttaacttttcccgacagagaagccctagcggagcatgccgacttgaagagcatggtcgagctaattaaacgaatgctgacatgggaatcacatgagcgcataagcccaagtgcggccctgagacatccattcgtttccatgcagcagttacgtagtgcccacgagacaacacattactatcagctatctctcagatcctatcgactgagcctgcaggtagagggtaagccgccaactcccgttgttgcggcagaggatggtaccccatactattgtttggccgaggagaaggaagctgccggaatgggatcagtggccggctcctctccattttttagggaggagaaggcaccaggcatgcagcgggcaatcgaccagctggatgatctaagtcttcaggaggccggccatggactctggggtgaaacttgcactaatgctgttagcgacatgatggttcctctcaaagctgctataactggtcaccacgtgccagatagcggaccagaacctatcctggctttctactcttctaggttggctgggcgacacaaggcaagaaaaccgccagcaggcagcaaaagtgactcaaacttttccaaccttatcagactgtcccaagtctctcctgaagatgatcggccatgtcgcggatctagttgggaggagggtgaacacctgggggcttcagccgaacccctggctatccttcagagggatgaggatgggccaaatattgacaacatgaccatggaggctgagcggccggaccctgagttgtttgacccaagctcctgccctggcgagtggctgtccgagcccgattgcaccttggaatccgtcaggggccctcgggctcagggtttgccgcctagaagatcccaccagcatgggcccccaaggggcgccacctcctttctccagcacgtgactggacaccattag

SEQ ID NO: 190946 - DNA, 675 bp, Artificial Sequence
  Description of Artificial Sequence: Synthetic coding sequence
atgggcgagcagcccatcttcagcacccgggcccacgtgttccagattgacccaaacaccaagaagaattgggtccctacctctaagcacgcggtgactgtttcctacttttatgattctactaggaatgtgtatcggattatttccctggacggaagcaaggcgatcattaactcaaccataacgccaaacatgacattcacgaaaacatctcagaagttcgggcaatgggcagactccagagcaaacacagtttatggtctcggattttcctcagaacaccacttatccaaggtaacagagctcgagtgcgtctcgtctcaggcaaacgccgtccatacccacaagacagagcttaatcagactattcaggagctggaggaaacactcaaactgaaagaggaagagatcgagcgccttaagcaggagattgacaacgcccgggaactgcaggagcagcgcgacagcttaacgcagaagctccaggaagtggaaattcgtaacaaagacctggagggccaactgagcgacctagagcagcgcctggagaagtctcagaacgaacaggaggcattccgaaacaatctgaaaacattacttgaaattctggacggcaaaattttcgaactgacagaactgcgtgacaacctggcgaagctgctagagtgctcatag

SEQ ID NO: 190947 - DNA, 1065 bp, Artificial Sequence
  Description of Artificial Sequence: Synthetic coding sequence
atgggcgagcagcccatcttcagcacccgggcccacgtgttccagatagaccctaacaccaagaaaaattgggtacctacttctaagcatgccgtcacagtcagttatttctacgacagtacccgcaacgtctatcgaatcatcagtctggacggatccaaggcgattatcaactcaactataactcctaatatgaccttcacaaagacctctcagaagttcggccagtgggccgattcaagagccaatacggtgtatggattgggattttctagcgaacaccacttgagcaagtttgccgagaagtttcaggaattcaaagaagctgctcggttagctaaggaaaaaagtcaggaaaagatggaactcacatccacaccttctcaggagtccgctggtggcgatcttcagtcacccctcactccagagagcatcaacgggaccgatgacgaaagaacccccgacgtcacacagaacagtgagccgagagctgaacccactcaaaacgctctcccttttagccactccagcgcgatttcaaaacactgggaagcagagttagccaccttaaagggcaataacgccaagctcacggccgctctcctggagtcgacggctaacgtcaagcagtggaaacagcagttggctgcgtatcaggaagaagccgagagactgcacaagagagtgaccgagttagaatgcgtgtcctcccaagccaatgccgtccacacacacaagaccgagctgaatcagactatccaggaactcgaggagacacttaagctgaaagaggaggaaatcgaaaggctaaagcaggagatcgataatgcccgcgagctgcaggagcagagggactccctcactcagaagctccaagaagtggagatcagaaataaggacctggaagggcaactgagcgatttggaacagcgcctggaaaaatcccagaatgaacaggaggccttccggaacaacctcaagacgctgctcgaaattctggatgggaaaatttttgaactcaccgagctgcgtgataatctggctaagcttttagagtgcagttag

SEQ ID NO: 190948 - DNA, 534 bp, Artificial Sequence
  Description of Artificial Sequence: Synthetic coding sequence
atgggcgagcagcccatcttcagcacccgggcccacgtgttccagattgatcctaacacgaaaaagaattgggttccaacttcaaaacatgctgtgaccgtatcctacttctatgatagcactcgaaatgtgtatagaattatttccctcgatggcagtaaggctatcattaattcgacgattaccccaaacatgactttcaccaaaacgtcacagaaatttggacagtgggctgactcacgagctaatacggtatacggacttggatttagttcagaacatcatctgtctaaattcgccgaaaagttccaagagttcaaggaagctgctcgcctggctaaggagaagtcacaagaaaaaatggagctcacctctaccccttcgcaagagtccgccggcggtgacctgcagagccccctgactccggagtcgattaatggtactgacgacgagcgtactccagatgttacacaaaacagcgaacctcgtgctgaacccactcagaacgccctgcctttctctcacaggaaatag

SEQ ID NO: 190949 - DNA, 543 bp, Artificial Sequence
  Description of Artificial Sequence: Synthetic coding sequence
atgggcagcgccatcagcaagcactgggaggccgagctggccacccttaaaggcaataacgcaaaactcacagcagcactgctcgagagcactgctaatgtgaaacagtggaagcagcagctggctgcttatcaggaagaagcagagcgactccataagagggtcaccgagctggaatgcgtgtcatcccaggctaacgccgtgcacacacacaagacggaacttaatcagaccatccaagaactggaggaaacactgaagctcaaggaggaagagatagaaagactgaagcaagagatcgacaacgccagggagctgcaggaacagcgcgactccctgacccagaagttgcaagaggtggagattcgcaacaaggacttagaaggccagttgtccgatctcgagcagaggctggaaaagtctcaaaacgagcaggaggcgttcaggaataacttgaaaaccttgttggaaatcctggacgggaagatctttgagctgactgaactgagagacaacctcgctaagctgctggagtgttcatag

SEQ ID NO: 190950 - DNA, 1065 bp, Artificial Sequence
  Description of Artificial Sequence: Synthetic coding sequence
atgggcgagcagcccatcttcaccacccgggcccacgtgttccagattgatccaaataccaagaagaattggatgccggcaagcaagcaggcagtcactgttagctatttttacgacgtcacaaggaatagttacaggatcatatccgtggacggcgccaaagttatcattaacagtactataacccccaatatgacatttaccaagacctcccaaaagttcggacagtgggcggattcccgggccaatacagtgttcggactggggtttagcagcgaacaacagctgacaaagttcgccgaaaaattccaggaggttaaggaagcagccaaaatcgccaaggataaaacacaagagaagatcgagacgtcatctaatcactcccaggagtccgggcgagaaaccccttcttccacccaggcttcatcagtgaatggaacggacgacgagaaggcctctcacgcaggcccagccaatacacacctaaaaagcgagaacgacaagctgaaaatcgcactgacacagagcgccgccaacgtgaagaagtgggaaattgagttgcagacattaagggagtcgaacgcccgtctgaccactgctcttcaggagagtgcggcctccgttgaacaatggaagagacagttcagtatatgtcgagacgagaacgatcgcctaaggaacaagattgatgagttagaggaacagtgttctgagataaatagagagaaggagaaaaacacccaattgaaacgccgtattgaagaactcgaggccgagcttagagagaaggaaactgagctgaaagatctgcgaaagcagtccgaaataattccacagttgatgagcgagtgcgagtatgtgtccgaaaaactcgaagctgccgagagagataaccaaaatctggaagacaaagtgaggtcgctgaaaacagatatagaagagagcaagtaccggcaacggcatctaaaagtggagctgaaatccttcctcgaagtcctcgatggaaaaatagacgatctgcatgatttccggcgtggattgtctaaactgggaacggacaattag

SEQ ID NO: 190951 - DNA, 867 bp, Artificial Sequence
  Description of Artificial Sequence: Synthetic coding sequence
atgggcgagcagcccatcttcaccacccgggcccacgtgttccagattgaccctaatactaaaaaaaactggatgccagcatcaaagcaggctgttaccgtctcctacttttatgatgttacccggaattcctaccgtatcatttctgtggacggggccaaagtcattattaactcaacgattacgcctaacatgaccttcaccaaaacaagccagaaattcgggcaatgggctgattcccgcgccaacaccgtctttggcctcggattttctagtgagcagcagctaaccaagttcgcagaaaagttccaggaggttaaggaggcggcgaagattgctaaggataagactcaggaaaagatcgagacttcaagcaatcattcacaagcgtcaagcgtgaacggtaccgatgacgaaaaagcctcccacgcaggcccagcgaacacccatcttaagagcgagaatgataagctcaagatcgctctgactcagtccgccgccaacgttaagaacgagatcaaccgggaaaaggagaagaacacacagctcaaaaggcgcatcgaggaactggaggccgagctgcgagagaaggagacggaattgaaggatctgcgaaagcagtccgaaatcataccccagttgatgagcgagtgtgagtacgtgagcgaaaagcttgaggcagccgagcgcgacaaccagaatttggaagataaggtgcggtcattaaaaaccgacattgaggagagcaagtacaggcagagacacctgaaagtggagttgaagagcttccttgaagtcctcgatggaaaaattgatgacttgcatgatttccgaagagggttgtctaagttgggaacagacaactag

SEQ ID NO: 190952 - DNA, 900 bp, Artificial Sequence
  Description of Artificial Sequence: Synthetic coding sequence
atgggcgagcagcccatcttcaccacccgggcccacgtgttccagatcgatcctaatacaaagaaaaactggatgcctgctagtaagcaggccgtgacggtcagctacttctacgacgttacccgcaatagctacagaatcattagcgtggacggggctaaagtgatcataaactccaccatcacccctaatatgacctttactaaaacctctcaaaagttcggacaatgggccgactccagagcaaacaccgtgtttggcctcgggttttcgtccgaacagcagttaacaaagttcgccgagaaatttcaggaggtaaaggaggctgcgaagatcgccaaagacaaaactcaggagaaaatcgagacgagcagtaaccacagccaggagtcaggccgggagaccccatcctctacccaggccagttccgtaaacggaaccgacgacgagaaagcatctcatgcgggcccagctaacactcatctgaagagtgaaaatgataaacttaaaatcgctcttactcaatcagccgctaatgtgaagaacgagataaatagagagaaagaaaaaaatacccagctcaagaggcgaatagaggagctggaggccgaactcagagagaaagaaacggagcttaaagacctcaggaaacagtcagagataattcctcaattgatgagcgagtgcgaatatgtgtcagagaaactggaggccgcagaaagagataaccaaaatttagaggataaagtgcgcagtctgaagactgatatcgaggagagcaagtacaggcagaggcacttaaaggtagagctgaagtctttcctcgaggtgctggacggtaagatcgacgacctgcacgacttccgacggggtttatcaaagctggggactgacaattag

SEQ ID NO: 190953 - DNA, 1032 bp, Artificial Sequence
  Description of Artificial Sequence: Synthetic coding sequence
atgggcgagcagcccatcttcaccacccgggcccacgtgttccagattgatcctaataccaagaaaaactggatgccagcgtccaagcaagccgtgactgtgagctacttctatgatgtaacaagaaactcttacagaattatctccgttgacggggctaaagtgatcattaactctactatcaccccaaatatgacttttacaaagacatctcaaaagttcggtcagtgggcagattctagagccaacacagtctttggattggggttcagtagcgagcagcaactcactaagttcgcagagaagtttcaggaagtgaaagaagcagcgaaaattgcaaaagataagacacaggagaaaatagagacgagctccaaccacagtcaggcgtcatctgtaaacggaaccgacgacgagaaggcttctcatgccgggcccgccaacactcatctgaaaagcgaaaatgacaagttaaagattgcattgacccaatccgccgctaacgtgaagaagtgggagattgaattgcagactttacgggagagtaatgcccgcctgacaacagcgctgcaggagtctgctgcaagtgtggagcagtggaaaagacagttttcaatctgccgggatgagaacgataggcttcggaataagattgatgaactggaggagcagtgctctgagatcaacagggagaaggaaaagaatacacagttgaagagacgaatcgaggaacttgaggctgagttacgtgaaaaagagacagaactgaaggacctgaggaagcaaagcgaaattattccacaactgatgtcggagtgcgagtacgttagcgagaaacttgaggctgctgagcgtgataatcagaacctcgaagataaggtgagatccctgaagaccgacatcgaggagtcgaagtaccgccagcgccatctcaaggtcgaactcaaaagcttcctcgaggttcttgacggtaagatcgatgacctgcacgatttcagacggggattgagtaagctaggcaccgataactag

SEQ ID NO: 190954 - DNA, 15 bp, Artificial Sequence
  Description of Artificial Sequence: Synthetic coding sequence
tgaaccgacaactag

SEQ ID NO: 190955 - DNA, 4176 bp, Artificial Sequence
  Description of Artificial Sequence: Synthetic coding sequence
atggccgtggagggcagcaccatcaccagccggatcaagaacctgctgaggtcaccttcgatcaaattgcggaggtccaaagcaggcaacaggcgcgaagacctgtccagtaaagttacattggagaaggtgctcggaattacggtgagtggcggccgggggctcgcctgcgatcctaggtctggcctggtggcttacccagccgggtgtgtagttgtgctgtttaatccaaggaagcataaacagcatcacatcctgaattcgtctcggaagaccattacggcactggcgttcagtcccgacggcaagtatctggtgaccggcgagtctggtcatatgcccgccgttcgggtgtgggacgtggcagagcatagccaggttgctgaactacaggagcataagtatggagtcgcctgtgtcgccttctcacctagcgccaaatatatcgtatcagtgggctaccagcacgacatgatcgtgaatgtgtgggcctggaagaagaatatcgttgttgccagtaataaagtttcctctagagtgaccgccgtgtctttttcagaagactgctcttatttcgtgaccgccggtaaccgccatattaagttctggtacttagacgactccaagacgagtaaagttaatgcaactgtgccacttcttggtcgaagtggtctgctcggcgagctgaggaataacctgttcaccgacgtagcctgcggacgaggcaaaaaggccgattctacattctgtatcacctcaagtgggctgctatgtgagttctctgatcgcagactgctagacaagtgggtcgaacttcgtgtctatccagaggtaaaagactctaaccaggcctgcctgcccccatcctctttcattacgtgttcctctgataacaccatcaggctatggaatactgaatccagcggcgtgcacggttcaacattacatcgaaatatcctgtcctcagatctgataaaaatcatctatgtggacggcaacacgcaagcccttctcgatactgaactgccaggaggagataaagcggatgcgtccctgttggatcctcgcgtggggatcaggtccgtttgtgtgtctcctaatgggcaacacctggcctccggtgataggatgggtacactgcgggtccacgagctgcaaagcctgtccgagatgttgaaggtcgaagcccatgattccgagatcctgtgtcttgagtacagcaagcccgataccgggctgaagctgctagctagcgccagtcgcgataggctgatccatgtcctggacgccggccgggaatactctctgcagcagacccttgacgagcattctagtagcatcaccgcggtcaagttcgctgccagcgacggacaggttagaatgattagctgcggcgctgataagtctatctatttccggacagcccagaagtcaggggacggcgtccagttcacccggactcaccacgtggttcggaaaacgacactttatgacatggacgtggagccatcctggaaatataccgccatcggctgccaggatcgcaacattcggatcttcaatatttcaagcgggaagcaaaaaaagttattcaaaggaagtcagggggaggatggaacccttatcaaagttcagactgaccccagcggcatttacattgccacatcatgctcagataagaacttatctatcttcgacttttcatccggtgagtgcgtggctaccatgtttgggcacagcgagattgtcacagggatgaaattttcgaacgactgtaagcatctcattagcgtgtccggcgatagctgcatattcgtatggagactatccagtgaaatgactatcagtatgcggcagcgtctcgccgagcttcggcagcgtcagaggggaggcaaacagcagggcccatcatctcctcagcgcgcttcaggcccaaatcgacaccaggctccctctatgctcagccccgggccggcactgagctcagattctgacaaggagggcgaggacgagggcaccgaggaggagctgccagccctgcccgtcctcgcgaaatctaccaaaaaggccttagcgtctgttccgtcacccgctctcccacgttcactgtcacactgggagatgtcacgcgctcaagagagtgtcgggttcttagatccagctccggcagcgaaccctgggccaagacggcggggcaggtgggtccaacctggcgtggaactaagcgtgaggagcatgcttgacctacgacaactggaaaccttggccccaagcttgcaggacccctcccaggattccttagcaatcataccatctggcccgaggaagcacggccaggaagctcttgagacgagcctcacttcgcagaacgaaaaacctccccgtccccaggcttcacagccttgtagttacccccacattataagactgttatctcaggaagaaggagtgttcgcccaggatttagagccagctcccatcgaggatggcatagtgtaccccgagccgtcagataaccctactatggacacgtccgaatttcaggtgcaagccccggctagaggcaccctgggccgggtatatcccggatcgcggtcctcggaaaagcactcacccgactcggcctgttcagttgattactccagctcttgtcttagctctcccgagcatccaaccgaagacagcgaaagcaccgaaccactgagcgtagacggcatatcttctgacttggaggagcctgccgaaggcgacgaagaagaagaggaggaggagggggggatggggccctatgggttacaagaagggagcccccagacccctgaccaggaacagttcctgaaacagcactttgagacactagcatcaggtgctgctccaggtgcccccgtgcaggtccccgagcgatcagagagtcgatcgattagcagccggttcctgctgcaggtgcagaccagacctcttcgagagccttctcctagctcttcatcacttgccctgatgtctcgaccagcccaagttccgcaagcctctggagagcaaccaagaggtaacggtgcaaatccacccggcgccccaccagaagtggagccctcttccggcaatccatctcctcagcaagccgcaagcgtcctacttcctcgatgcagattgaatccagatagctcttgggcaccaaagcgggtggctacagccagcccattctccggcctgcagaaggctcagagtgtgcactccctggtcccacaggagaggcatgaagcgtctttgcaggcaccaagccctggcgccctgctcagccgtgagatcgaggctcaggatggtctgggaagtctcccccccgcagacggccggccatctagaccgcactcctaccagaacccaacaacatcttcaatggcgaagatctccaggtctatttccgtgggggagaacctcgggcttgtggcagaaccacaagcacacgcccccattagggtctcacccttaagcaaactggctctaccatcaagagcccaccttgttcttgacatacctaaaccactgcctgacagaccaaccttggccgcgttcagtcctgtgacgaaaggaagagcccctggggaggctgagaaacccggctttcctgttgggctgggaaaggcccacagcactactgagcgctgggcttgtctaggggagggaaccactccaaaacccaggaccgagtgccaggcccatcctggaccctcctctccatgtgcacagcaactgcccgtgtcttccctgttccagggccccgaaaatctgcagcctcctccacctgaaaagacccccaaccccatggaatgcactaagcccggggccgccctcagtcaggacagcgagcctgccgtgagtctcgaacagtgcgagcagctggtggcagagctccgcggctccgtgcgccaggcggttcgtctctaccattcggtggccgggtgtaagatgcccagcgccgagcagagtcgcatcgctcagctcctccgcgataccttttcctccgttagacaagaacttgaggccgtcgctggagctgtcctctcaagccccggctcctcgcctggagcagtcggggctgagcaaactcaggccctgctcgaacagtatagcgagcttctgctccgggcagtagagcggaggatggagcgcaagctatag

SEQ ID NO: 190956 - DNA, 1077 bp, Artificial Sequence
  Description of Artificial Sequence: Synthetic coding sequence
atgagcaccgcccgggagcagcccatcttcagcacccgggcccacgtgtttcaaatcgaccctgccaccaagagaaactggatccccgcaggtaagcatgccctgactgttagctacttctacgatgcaacccgcaacgtgtacaggattatttcaatcggcggtgccaaagctattatcaactcgactgtgacccccaatatgacctttaccaaaacctcgcagaagttcggacaatgggcagacagccgggcaaatacggtatatggcctcggattcgcatcagagcaacacttgacccaatttgccgaaaagtttcaggaagtgaaagaagccgcccggctggcaagggagaagtcccaggatggaggggagctcacatctccggccctaggcctggcgtcacaccaggttccaccctctccactggtgagcgctaatggtcctggggaagaaaagctgtttcgatcccaatccgccgacgcacccggcccaacagaaagagaaaggttgaagaaaatgctgagtgagggctccgtcggagaggtgcagtgggaagctgagttctttgctctccaggacagcaacaacaaactagccggagcgctgcgcgaggccaatgctgctgcagcccaatggcggcaacaacttgaagcacagagagcagaagcagaaagactgcggcagagagtggcagagctagaagctcaggccgctagcgaagtgactcctacaggcgagaaggaaggtcttggccagggccaatcgctggaacagctcgaagcactggtacagactaaagaccaggaaattcagaccctcaagtcccagactggtggccctcgagaggccctggaggccgctgagagagaggagacccagcagaaggttcagacgaggaacgccgaattggaacaccagctacgcgctatggagagaagcctagaggaggcacgagccgagagagagcgcgcccgcgcagaagtcgggagggcagctcaactcttagatgtgtcactctttgaactgtcagaactgagagaaggattggctaggctcgccgaagctgctccttag

SEQ ID NO: 190957 - DNA, 438 bp, Artificial Sequence
  Description of Artificial Sequence: Synthetic coding sequence
atgagcaccgcccgggagcagcccatcttcagcacccgggcccacgtctttcagattgaccctgcaaccaagagaaattggatccccgccggaaaacacgccctaacagtgagctacttctacgatgccacaaggaacgtgtacagaattatctccatcggcggggctaaagctatcatcaattcaaccgtgacccctaatatgacctttacaaagacctctcagaagtttgggcagtgggccgactcaagagctaataccgtgtacggcctcggtttcgcctctgaacagcacttgacacagttcgctgaaaagttccaggaagtgaaagaggctgctcggctggcccgagagaagtcacaggatggatggggtgggccacagtcagcccttgtagtgggaagtttcggagcagtgtttgagctgctgatcgtttag

SEQ ID NO: 190958 - DNA, 1086 bp, Artificial Sequence
  Description of Artificial Sequence: Synthetic coding sequence
atgagcaccgcccgggagcagcccatcttcagcacccgggcccacgtctttcagatcgatccagccactaagagaaactggattccagccggcaagcacgcactcacggtttcctacttttacgatgccacacgtaacgtgtacagaatcatctccatcggaggggcaaaagctatcattaacagtacagtgacccccaacatgacatttacaaagacctctcagaagttcggccagtgggctgactctcgagccaatactgtctacgggctaggatttgcttcagaacagcacctcacccagtttgctgagaagtttcaggaggtcaaggaagccgcccgattagcaagagaaaaatcccaggatggaggtgagctgactagccccgcccttggactagcttctcaccaggtgcctccttccccgcttgtgtccgctaatggtcctggggaagaaaaactctttaggtctcagtcagcagacgccccaggtccaacagagcgggaaaggctgaagaagatgctgtcagaaggttcagtcggagaggtgcaatgggaagctgagttctttgctctgcaagactccaacaacaagctagctggagctctgagagaggcaaatgcagccgcggcccagtggaggcagcagctcgaagctcaaagagccgaagccgagaggctccgccagcgcgttgctgagctcgaggcccaggcagcctcagaagttacaccaaccggggaaaaggaggggctgggccagggccagtcacttgagcaactggaggccctcgttcagactaaagatcaggagatacaaaccctcaagtcccaaaccggcgggccacgcgaggcacttgaggcagccgagcgtgaggagacccagcaaaaggtgcaggacttggagacacgtaacgccgaactggagcatcaactccgggccatggaacggtccctggaggaagcccgcgctgagcgggagagagcgagggcggaggtgggcagagctgcccagctgttggacgtcagtctcttcgagctgtctgagctccgcgaaggcctggcgagactcgcagaagcagctccctag

SEQ ID NO: 190959 - DNA, 1077 bp, Artificial Sequence
  Description of Artificial Sequence: Synthetic coding sequence
atgagcaccgcccgggagcagcccatcttcagcacccgggcccacgtcttccagatagatcctgctactaaacgcaactggatcccagcggggaaacacgcactcaccgtctcttacttctacgacgcaaccaggaacgtttacagaatcatttcgattggcggggccaaagcaatcataaattccacggtcacccccaatatgacctttaccaaaacctctcagaagtttggacagtgggccgatagtagggccaacacagtgtacggactgggcttcgctagcgaacagcatctgacccagtttgccgagaagttccaagaggtcaaagaggccgcccgactcgccagggagaaaagccaggatggcggagagttgacatctcccgcactgggcttggcctcccaccaggtgcctccttcacctctcgtgtccgccaacggccccggagaagaaaagctgttccgctcccaatctgcggatgcgccagggcccacagagagggaaaggctgaaaaagatgctcagtgagggcagcgtcggcgaagttcagtgggaggctgaattttttgcactgcaagattcgaacaacaaactggctggtgctctcagagaggctaacgcagcggcagcccagtggaggcagcagctggaggctcagagggccgaagccgaaagattgcgccagcgtgtggcagaattagaagcacaggctgcttcagaagtgacccccaccggagaaaaagagggcctcggccagggtcagtccttggaacagctggaagcactcgtgcagaccaaagatcaggagattcaaaccctcaagtcacagacaggcggaccaagagaggcccttgaagccgctgaaagagaggaaacccagcaaaaggtgcagaccaggaatgcggagctagagcatcagctgagagccatggagcggagtctcgaagaggccagagctgagagagagagagcccgagcagaggtcggacgggccgcgcagctcttagacgtctcgctatttgagcttagtgaattgagggaggggctcgccagactcgccgaggccgccccctag

SEQ ID NO: 190960 - DNA, 1086 bp, Artificial Sequence
  Description of Artificial Sequence: Synthetic coding sequence
atgagcaccgcccgggagcagcccatcttcagcacccgggcccacgtgttccagattgaccccgcaacaaagcgcaattggatccccgcaggcaaacatgcgctcacggtatcgtatttttacgatgcaacacggaacgtctatcgcataatcagtatcggcggtgctaaggccataatcaactcaacagttaccccgaacatgacattcaccaagacttcccagaagtttggccagtgggcggactccagagccaataccgtgtatggcctgggctttgcgagcgagcagcatttaacacaatttgctgagaagtttcaggaggtgaaggaggccgctcggctcgctcgcgaaaagtcccaagacggaggcgagctcacatcgccagctctgggactcgcctctcaccaggtgccgccctcccccttggtgtccgctaacggacccggggaggagaaattatttagaagccagtctgccgatgcccctggtcccactgaaagggagcgtcttaaaaaaatgctttccgaggggagtgtcggggaagtgcagtgggaggctgagttcttcgctctccaggacagcaacaacaagctggctggagcgcttcgggaagccaacgccgcggctgctcagtggcgccaacagctggaggcacagcgagcagaggctgagaggctgcggcaaagagtcgcagagctagaggcccaggcggcttctgaggtaacacccacgggagaaaaagagggtctgggccagggtcagtcccttgaacaactagaggctctcgtgcagacgaaggatcaagaaatacaaacactgaagagccaaacaggcggtccgagagaggcgttggaggccgcggagcgcgaagaaacacagcagaaagtccaagaccttgaaaccaggaatgcagaactggaacaccaactccgggcgatggaaagatccctggaagaagccagagccgagcgggagagagcccgagcagaagtggggagggcagcgcagctccttgatgtgagtcttttcgaactgagtgaactgagggagggcttggcgaggctcgctgaggctgctccatag

SEQ ID NO: 190961 - DNA, 1086 bp, Artificial Sequence
  Description of Artificial Sequence: Synthetic coding sequence
atgagcaccgcccgggagcagcccatcttcagcacccgggcccacgtgtttcagatcgaccccgctaccaaacgcaactggattccagcgggtaaacatgctctgaccgttagttacttttacgacgccaccaggaatgtgtacagaatcattagcatcggcggcgccaaggctatcataaattctacggtcacacctaacatgacgtttaccaagacctcacaaaagtttggacagtgggcagattcacgagcaaatacagtgtatggactgggtttcgcaagtgagcagcatctcacccagtttgccgagaaattccaagaggtcaaggaggctgctcgcttggcccgagagaagagccaggacggtggcgaactcacaagccctgcactcggtctggcctcccaccaagtgcccccatccccattagttagcgctaacggaccgggagaagaaaagttattccgatcccagagcgcagacgcccctgggcccactgagagagaacgtctcaaaaaaatgctttcggagggcagtgtgggcgaggtccagtgggaagctgagttctttgcacttcaggattcaaataataagctggctggcgccctccgagaagctaatgctgccgctgcacagtggcggcagcagctggaggcacagagagccgaagccgagagacttcggcaacgtgttgccgagttggaagctcaggcagcatcagaggttacccctacaggagagaaagagggattaggccagggacaaagcctggagcagctggaagcgttggtccagaccaaggatcaagagattcagaccttgaaaagtcagaccggtggtccacgggaggcccttgaggcagccgaaagggaagaaacacagcagaaagtccaagatcttgaaacccggaatgccgaactggagcaccagttgagagccatggagcgtagccttgaagaagccagagccgagcgggaacgcgctcgcgccgaggttggccgagccgcccaactgctcgacgtgtcactctttgaactgagcgagcttagggagggcctggctaggctggctgaggccgctccctag

SEQ ID NO: 190962 - DNA, 978 bp, Artificial Sequence
  Description of Artificial Sequence: Synthetic coding sequence
atgagcaccgcccgggagcagcccatcttcagcacccgggcccacgttttccaaatagatcctgctaccaaacgaaactggattcctgctggcaaacatgccctaacagtcagctatttttatgatgctacccgcaatgtatatcgcattatttcaatcggcggagccaaggcaattataaatagcacggttactccaaacatgacttttactaagacatctcagaagtttggtcagtgggccgactccagggcaaacacagtttacggcctgggcttcgcaagtgagcagcacttgacgcaggtgcccccatcacccctggtgagtgccaacgggcccggcgaagagaaactgttcaggagtcagtccgcagacgctcccggcccaacagagagggagaggttaaagaagatgctgtcagagggcagcgtaggagaggtgcaatgggaggcagagttctttgccctgcaggactccaataataagctggcaggcgccttaagagaggccaacgcggcggctgcacagtggcgacagcaactggaggcccagcgggcagaagccgagagattacgtcagagagttgccgagctggaggcacaggctgcctctgaagttactcctacgggggaaaaagagggtctcggccaggggcaaagcctggagcagctggaggctttggtgcaaactaaagaccaggagatacagaccctcaagtcccaaaccggcgggccacgtgaggctcttgaagccgccgagcgcgaagagacacagcagaaagtgcaggatcttgaaacacgcaacgccgaactggaacaccagttacgcgctatggagagatctctcgaagaagcccgggctgagcgtgagcgcgcccgcgcggaggttggacgcgcggctcagttgctcgatgtcagccttttcgaattgtccgaactaagagaaggcttggcacgtttggcagaggccgcaccatag

SEQ ID NO: 190963 - DNA, 1176 bp, Artificial Sequence
  Description of Artificial Sequence: Synthetic coding sequence
atggagagcgagaccgagcccgagcccgtgaccctgctggtgaagtctcccaaccaacgtcaccgcgaccttgagctctctggagaccgggggtggtcagtcggccatcttaaggcacatctttctcgtgtctaccccgagcggccccgccctgaggaccagcgcttaatttactcgggaaaattgcttcttgatcaccagtgcttgagagacctcttaccaaaacaagagaaacggcatgtcctacacctggtgtgcaacgttaagtcgccttccaaaatgcccgaaatcaacgcgaaggtcgccgagtcaacagaggaacctgcgggcagcaatcggggccagtaccccgaggacagttctagcgatggactacgtcaacgcgaggttctgagaaacctttcttctccaggatgggaaaatatcagcaggcctgaagccgcacagcaggcttttcaaggcctgggacctggcttttccggatataccccttatggctggctgcagttatcttggtttcagcagatttatgccagacaatactacatgcagtacttggcggctaccgccgcaagcggtgccttcgttcctcctccttctgcccaggaaatacctgtcgtttccgcccccgccccggctccgatccacaatcagtttccggctgaaaatcagcctgcgaaccagaacgccgccccgcaagtcgtggtgaaccccggggcgaaccagaaccttcgcatgaatgcccagggtgggccaattgttgaggaagatgatgaaattaatcgggactggcttgattggacctattcagccgccaccttctcggtattcctcagcatcctgtacttctactcgtctctttctcgcttcctgatggttatgggggctacagtggtgatgtatctgcaccacgtcggctggttcccattccggccacgtcccgtacagaatttcccaaacgatggtcctccacccgacgttgtgaaccaggaccccaacaataatttgcaagagggtactgatcccgagacagaagatcccaatcatctgccacctgatagggatgtcctagacggtgaacagacttccccttcgttcatgtctacggcttggctcgtttttaaaactttttttgcatcgttgctgccggaaggcccaccagctatcgccaattag

SEQ ID NO: 190964 - DNA, 699 bp, Artificial Sequence
  Description of Artificial Sequence: Synthetic coding sequence
atggagagcgagaccgagcccgagcccgtgaccctgctggtgaagtcccccaatcagagacatcgtgacttggaactttccggcgataggggttggtccgtagggcaccttaaggcacatcttagtcgagtgtaccctgagagacctcgacccgaagaccagaggctaatttatagtggaaaactgctcctggaccatcagtgtctcagagacctgctgcccaaagagaaaaggcatgtgctgcacctcgtctgcaacgttaagtcgccctctaaaatgcctgaaattaatgctaaagtagctgagagcacagaggaacccgcaggcagcaaccgtggccaatatcctgaagatagttcatctgacggcttgaggcagagggaagtcctgagaaacttatcttcacctggatgggagaatatctctcggcaccacgtcggatggttccccttcagacctcggcccgttcagaacttccccaacgacgggcctccacctgacgttgtgaatcaggaccctaataataatctgcaggagggcactgacccagaaaccgaggatcctaatcatttacctcccgatagggatgtgcttgatggcgaacagacatcaccttcattcatgtctacagcctggttggtgtttaagacattctttgcttccctcttacccgaaggaccgcctgcaattgccaattag

SEQ ID NO: 190965 - DNA, 1101 bp, Artificial Sequence
  Description of Artificial Sequence: Synthetic coding sequence
atggagagcgagaccgagcccgagcccgtgaccctgctggtgaagtcaccaaaccagcgacatcgcgacctggaattgagcggtgacaggggttggtcagtcggacatcttaaggcacacttgtccagagtttaccccgaaagacctagacccgaagaccagaggctgatttatagcggcaaattattactcgatcatcagtgtttgcgagatctgctccccaaagtggccgaaagcaccgaggagcctgccgggtctaaccgtggccaatatcccgaggattcaagctccgacggcctccgtcagagggaagtactgagaaatctgtcaagtcccgggtgggagaacattagtagacctgaggccgcccagcaagctttccaggggctgggtccagggttcagcgggtacacaccttacggatggctccagctctcctggttccagcagatatacgcgagacaatactacatgcagtatttggctgctaccgcagcaagtggcgccttcgtgccacctcctagcgcccaagagattccggtggtgtctgccccagccccggcccctattcataatcagttccctgcagagaaccaaccagccaatcagaatgctgccccacaagtggtggtgaatcctggtgctaatcagaatttacgcatgaacgcgcagggaggacccatagtggaggaggatgacgagatcaaccgggattggctggattggacctactcagcagcaacgttcagtgtattcctcagtatcctttatttctacagtagcctgagccgtttcctgatggtgatgggagcaacggtggtcatgtacctgcaccacgtcggctggtttcccttccgccctagaccagtccagaatttccccaatgacggcccaccacccgatgtggtgaaccaggatcctaataacaatctgcaggaaggaacagatcctgaaacggaagatcctaatcatttgcctccggaccgggatgtactggacggcgagcagacttctccatctttcatgagtactgcttggctggtgtttaaaaccttttttgcttcgctactgccagagggcccccctgccatcgctaattag

SEQ ID NO: 190966 - DNA, 1173 bp, Artificial Sequence
  Description of Artificial Sequence: Synthetic coding sequence
atggagagcgagaccgagcccgagcccgtgaccctgctggtgaagtctcccaatcagcgccacagggaccttgagctgtccggggatagagggtggagtgtgggccatttgaaggcgcacctgtcccgggtctatccagaaaggcctagacccgaagatcagcgtcttatatactccggcaagctgctgttagaccatcagtgcctccgggacttgttgcccaaagaaaaaagacatgtgttgcatttggtttgcaatgttaagtccccttctaagatgccggagattaatgctaaagtggcagagagtacagaggagccggccggatccaacagaggtcagtaccctgaggattcatcttccgatggcctccgccagcgggaggtcctacggaatctgagctcaccaggctgggagaacatatcccgccctgaagcagctcagcaggcctttcaggggctcggccccgggttcagcggctacactccgtacggctggctgcaactatcctggtttcagcagatctatgcccgccagtactacatgcaatatctggccgccacagccgccagtggcgcttttgttccccctccttctgctcaggagatcccagtggtttctgcccccgcccccgctccaattcacaatcagttccctgcggaaaaccagccagccaaccagaacgccgcccctcaagtggttgtgaatcctggcgccaaccagaacctcaggatgaacgcccagggggggcccatagtggaggaagacgatgaaattaaccgcgactggctggattggacgtactcagcagccacattttccgttttcctttccatcctgtatttttacagtagtctgtcccggttcctgatggtcatgggcgccactgtggtgatgtatctccatcacgtgggctggtttcccttccgcccccggcccgtccagaactttcccaacgatggccccccccccgacgtcgtgaaccaggacccgaataacaacctccaggagggaacggatcctgaaacagaggaccccaaccatctgccccctgacagggacgtcctggacggcgagcagactagtcccagttttatgagcacggcctggctggtgtttaaaacattcttcgccagtctcctacctgaggggccccctgctatcgccaactag

SEQ ID NO: 190967 - DNA, 1338 bp, Artificial Sequence
  Description of Artificial Sequence: Synthetic coding sequence
atggccgagctgaagtacatcagcggcttcggcaacgagtgcagctccgaagacccgaggtgtccgggttcactccccgagggccagaacaatcctcaggtgtgtccttacaacctatacgccgaacagctttccggctctgcttttacttgcccaaggtctactaataagaggtcttggctataccgcatactgccttctgtgagtcacaagcccttcgaatctatcgacgagggccaggttacgcataattgggatgaggtggatccagacccgaatcagcttcggtggaaaccatttgaaattcccaaggcgagccaaaaaaaggtggattttgtgtccggactacacaccttgtgtggtgctggggatattaaatcaaataacggactggcgatacacatttttctgtgcaacacaagcatggaaaaccgctgcttttataattcagacggcgacttcctaattgtgcctcaaaagggcaatctcctcatttacaccgagttcggaaagatgttggtgcagcccaacgagatctgcgtgatacagaggggcatgagattcagtatcgacgtgttcgaagaaactcgtggctacatcctcgaggtatatggtgtgcactttgagttacccgacctgggtcctataggggctaatgggttggccaatcctagagacttcctgatcccgatcgcctggtacgaagacagacaggtgccgggaggttacacagtgataaacaaatatcagggaaaactttttgctgcaaaacaggatgtcagcccttttaatgtggtcgcttggcatggaaattacacgccctacaaatacaatctgaaaaacttcatggtgattaactccgtggcatttgaccacgcagatcctagcatttttactgtactaaccgcaaaaagcgtaagacccggggtagcaattgctgacttcgtgattttccctcctcgttggggtgtggctgataaaacttttagacctccctactaccatagaaattgtatgtccgagttcatgggcctcattcgcggccactacgaggccaagcagggggggttcctgcccggggggggaagcctacactccacgatgacccctcatggaccagatgccgattgttttgagaaagcctcaaaggtcaaacttgcccctgagcgtattgccgacggcacaatggcctttatgttcgaatcatcattaagcctggccgtgaccaaatggggcctgaaagcctcaagatgtttggacgagaactaccataagtgctgggaaccactaaaaagccacttcacacctaatagtagaaatcccgctgaacccaactag

SEQ ID NO: 190968 - DNA, 2187 bp, Artificial Sequence
  Description of Artificial Sequence: Synthetic coding sequence
atggaggagacccagccccccccccagcccaagctgcccctgtgcgacagccttatgatttggctacagacttttaatacggcaagcccatgccaggatgttaagcagctgacatcaggagttgctatggctcaggtacttcaccaaatagacgccgcctggtttaatgagagctggctgagcagaatcaaggaggatgtcggagacaattggcgaatcaaggccagcaatgtgaaaaaagtgctacaaggtattatgagttattaccacgaattcctgggtcagcagatctcggaagcattaatacccgatctgaatcagataacggagtgttctgatcccgtggagttggggagattgctccagttaattctgggatgcgccataaactgcgaaaaaaagcaggagcatatacagaatattatgactctcgaggagagtgtgcagcacgttgtaatgacagccattcaggagctgatgagcaaggaaatcctgtcaagtccaccaaatgatgccgttggggagctggagcagcagctaaagagagcactcgaggagttgcaagaagcgctggcggagaaggaggagctgagacaaaggtgcgaggaactagatatgcaggttactacgcttcaggacgagaaaaactcactggtctccgaaaacgagatgatgaacgagaaactcgaccaactggatggctcattcgacgacccaaacaccgtcgttgcgaagaaatactttcacgcgcagctccagctggagcagctgcaagaagagaattttagattggaagccgcgaaggatgactacagagtgcactgcgaggaactagaaaaacaacttatcgaatttcaacacaggaacgacgagctcacatctctagccgaagagactcgagcattgaaggacgagattgacgtgcttagggccacgagtgataaagccaataaacttgaatcgactgtggagatttaccgccagaagttacaggacttgaacgatttgcggaaacaagtcaaaaccttgcaggagacgaatatgatgtatatgcataacactgtctcacttgaagaggaactgaaaaaggccaacgccgcaaggactcagcttgagacctacaaacggcaagttcaggacttgcatgtgaagctgtcctccgagtcaaagagagcagacacccttgcctttgaaatgaagcggctcgaggagaagcatgaagccctgctgaaagaaaaagagagattgatcgagcaacgggatactctgaaagagactaacgaggagctgcgctgcagtcaagttcaacaggatcatcttaaccaaacggacgccagtgctactaagagctacgagaatcttgcagcagaaatcatgcctgtcgaatacagagaggtgtttattcgccttcagcacgagaacaaaatgctcagacttcagcaggagggctctgagaatgaaagaatcgaagaactgcaagagcagttagagcagaagcaccgtaaaatgaacgaattagagacggagcagaggctgagcaaggagcggattagagagttgcaacagcagattgaagatctgcagaaatcattacaggagcagggttccaagtccgaaggtgaatcaagtagcaaactgaaacaaaaattagaggcccacatggaaaaactgacggaagtacatgaggagctgcagaaaaagcaggaacttatcgaagatttgcaaccagacataaatcagaacgttcagaagatcaacgagctcgaggcagcccttcagaagaaggacgaggacatgaaagccatggaggaacggtataagatgtatctggaaaaagcccgcaacgtgattaagaccttagatcccaagctaaatccagccagcgcggaaataatgctgctgcgcaagcagttagccgagaaggagcgccggatagaaatcctcgagagtgaatgtaaggtcgccaagttcagagattacgaagagaagctgatcgtgagtgcttggtacaacaagagcctcgctttccagaagttaggtatggagtcgaggctcgtctccgggggtggtgcatgtagcgacacaggtgcttgtactccagctcgaagttttctggctcagcagagacacatcactaatacacgccggaacctctctgtcaaggtcccagccacaacttccgactag

SEQ ID NO: 190969 - DNA, 2061 bp, Artificial Sequence
  Description of Artificial Sequence: Synthetic coding sequence
atggcccaggtgctgcaccagatcgacgccgcctggttcaacgagagctggctcagtaggataaaggaagacgtgggtgacaattggagaatcaaggcttccaacgttaagaaggtgctgcaaggcattatgtcttattatcatgagttcctcgggcagcagatttcggaggcactgattcccgacctgaaccagatcacagagtgcagtgatcccgtggaacttggacggctactgcaattgatcttaggatgcgccattaattgcgagaagaaacaggaacatatccagaacatcatgactctggaagagagcgtacagcacgtggtgatgaccgcgattcaggaactgatgtcaaaggagatcctgagctcacctcccaacgatgcagtgggagagctggagcagcagctcaaacgtgccctagaggaactacaggaagcgctggctgaaaaggaggagctccgccaaaggtgcgaggaactcgacatgcaggtgacaacactgcaggacgaaaaaaactcccttgtttctgaaaacgagatgatgaacgaaaaactcgaccagctggatggctctttcgatgaccccaatacggtggtggccaaaaagtacttccacgctcaactacaactggaacagctccaggaagagaacttcaggcttgaagcagccaaagacgattatcgtgtacactgtgaggagctggaaaaacagttgatcgagtttcagcatcgaaacgacgaacttacaagcttggctgaggagacgagagccctgaaggacgaaattgatgtgctacgggctaccagtgacaaggccaataaactggagtctacagtggagatttatcgacaaaagctgcaggatctgaatgacctgcggaagcaggttaaaaccctccaagaaacgaatatgatgtacatgcacaacacagtgtccctggaggaagaacttaaaaaggcgaatgcagccaggactcagcttgagacgtacaagaggcaggtgcaagatttacatgtcaagctgtcctctgagtctaagagagccgacaccctggccttcgaaatgaaaagattagaggaaaaacatgaggcactactgaaggaaaaagagagactgatcgaacagagggacaccctaaaagagaccaatgaagagttgcgctgcagtcaggtccagcaagatcacttgaaccagactgatgcctctgctaccaagtcgtacgagaatcttgccgcagaaatcatgcctgtcgaatatagggaggtttttattcggctgcagcacgagaataaaatgctcaggttgcagcaggagggcagtgaaaatgagagaattgaagaacttcaagagcagctggagcagaagcaccgaaagatgaatgaactcgaaaccgaacagaggctttcgaaggagcggatcagagaactccaacagcagatcgaggacctccaaaaaagcctacaagagcagggaagcaaatccgagggcgaaagctcgtctaaactgaagcaaaagctggaggcccacatggaaaagctgactgaggtgcatgaggaactccagaaaaagcaagaactaattgaggatctacagcctgatattaatcagaacgtccaaaaaattaacgaactggaagcagccttgcagaaaaaagacgaggacatgaaggccatggaggaaagatataaaatgtatctggaaaaggcacgcaacgtgatcaagacgctggacccgaaactgaaccccgcatcagcagagattatgttgctcagaaaacagttagcagaaaaggaacggcggatagaaattctggaaagcgagtgtaaagtggcgaagttccgagattacgaagaaaagttgattgtgagcgcgtggtacaacaagtccttggccttccagaagttggggatggaatctcgcctggtttcgggaggcggcgcctgttccgatacaggcgcctgtactcctgcacggtcttttcttgcccagcagcgccatataactaatactcgcagaaatctgtctgtgaaggtgcctgccaccacaagcgactag

SEQ ID NO: 190970 - DNA, 414 bp, Artificial Sequence
  Description of Artificial Sequence: Synthetic coding sequence
atggaggagacccagccccccccccagcccaagctgcccctgtgcgacagtcttatgatatggttgcagacctttaacacagcatccccttgtcaagacgtaaaacagctcacctcgggtgttgccatggctcaggtgctacatcaaatagatgcggcctggttcaacgagagttggctctcaaggattaaggaagacgtcggcgataactggaggatcaaagcctctaacgttaagaaggttctgcaagggataatgagctactaccacgagtttctgggccagcagatcagtgaagccttaatccccgacctcaaccagattaccgaatgctccgaccccgtggaattaggacggttgctccagctgatactggggtgcgcaatcaactgcgagaagaagcaggaacactag

SEQ ID NO: 190971 - DNA, 2154 bp, Artificial Sequence
  Description of Artificial Sequence: Synthetic coding sequence
atgagcgtggacaaggccgagctgtgcggcagcctgctgacctggctccaaacattccatgtcccatccccctgcgccagcccacaggatctaagcagtggacttgcggtagcctacgtcttaaaccagatcgacccctcttggttcaatgaagcctggttgcagggtatttctgaagatcctggcccgaattggaaactcaaagtgtcaaacttgaagatggtgttgaggagcctggtggaatattcccaggacgtccttgcacaccccgtgagcgaagaacatctgccagatgtgagcctgatcggggaattctcggaccccgcagagctcggaaaattgctacagctcgtattaggctgtgcaatctcctgcgagaagaagcaggaccatatccagcgtataatgacgctggaggaatctgttcagcatgttgtgatggaagccattcaggagctcatgaccaaggatacccctgactccttatcaccggaaacctacggtaacttcgatagtcagagcaggagatactatttcctgtcagaggaagccgaggagggtgacgagctgcagcagaggtgccttgacttggagcgtcagctaatgctgttgagcgaagagaaacagtccctggcgcaagaaaacgccgggctgagggagcggatgggacggcccgaaggggagggtacgcctggcctcacagccaagaaacttctactgctgcaaagtcagctggagcagctccaggaggaaaacttccgtctcgagtccggacgggaagacgaaagactgcgttgtgctgaacttgagcgggaggtagccgaactgcaacatcgcaatcaggcactgaccagcctcgcccaagaggcgcaagccttaaaggatgaaatggatgaacttagacagtccagtgaacgtgctggccaattggaagcgacactcaccagttgcaggaggcgacttggggaacttcgcgagctgcgaagacaagttcggcagcttgaggagagaaatgcggggcacgccgaacgcacaagacagctggaggacgaactgcgccgcgccggcagcctgcgagcacagctcgaggcacagcggaggcaagtacaagagctgcagggacagcgtcaggaagaggccatgaaagcagaaaagtggctttttgagtgccgaaatctggaggaaaaatacgagtctgtaaccaaagagaaggagaggctgctggcagaacgagactcattgcgtgaggctaatgaagaacttcgctgtgcacagctccagccccgcggcttgactcaggccgatccctcgcttgaccctacttcaacccccgtcgacaatctcgcggcagaaatcctaccagcagagctgcgcgagactctgctgaggctgcaactagagaataaaaggctttgtagacaggaggctgccgatcgcgaacgacaggaggaactgcagcggcatctggaagacgcgaatagagccaggcatgggcttgagacacaacaccgcctgaatcaacagcaactgtccgagcttcgcgcgcaggtcgaggacttgcaaaaagcgttgcaagagcagggtggcaaaactgaggattccatcttgctcaagcgcaaactggaagagcacctccagaaacttcacgaggctgatctcgagttgcagcggaagagggagtacattgaggagcttgaaccaccaacggattcttccacagccagaaggattgaagagctccagcataaccttcagaagaaggacgccgatctgcgcgccatggaggaacgttaccggcgctatgtggacaaggctaggatggtaatgcagaccatggaaccgaagcagcgcccggctgctggtgctccgcctgagctgcactcacttagaacacagttgagagagagagatgtcagaatcaggcatttggaaatggattttgaaaaatctcggagccagagggagcaggaggagaagctgctgatctctgcctggtacaacatgggaatggctctgcagcagagggcaggcgaggagagggcgcctgcgcatgctcagtcctttctagctcagcagcggttggccacaaattcacgtagggggccattaggcagattggccagtttgaatctgcgccctacggacaagcattag

SEQ ID NO: 190972 - DNA, 2160 bp, Artificial Sequence
  Description of Artificial Sequence: Synthetic coding sequence
atgagcgtggacaaggccgagctgtgcggcagcctgctgacctggctacagacatttcatgtacccagcccttgcgcttctccccaggacttgtcaagcggcctggctgtcgcttacgtgctgaaccaaatcgaccctagttggttcaatgaggcctggcttcagggcatctctgaggaccccgggcccaattggaagctgaaggtctcaaacttgaagatggttctgagaagcctcgtggagtatagccaggatgtgctcgcccacccggtgagcgaagagcacttgcccgatgtcagtttgattggggaattctccgatccagcagagctcgggaagcttctccaactagtgttaggctgcgccattagctgtgagaagaaacaggatcacatccaacggataatgactctggaggagtcagtccaacacgtggttatggaagcaatccaggagcttatgacgaaggatacacctgactctctgagccccgagacgtacggaaatttcgacagccaatcccgaaggtattacttcctttcagaggaagcagaggagggcgacgagctgcagcagcggtgtctggacctggagcgccaattaatgctgctgagcgaagagaagcaatctctagcacaggagaacgctgggctccgcgaaagaatgggacgcccggagggggaggggactccaggcctcactgcgaagaaacttttactgctgcaatcccagcttgagcagctacaggaagaaaatttccgattggaatccggccgcgaggatgagagactaaggtgtgctgaactagagcgcgaggtggccgaacttcagcaccgaaaccaagccctgacctccttggcacaggaagcacaagcgctgaaagatgagatggatgaactgcggcagagctcagagcgagccggtcaacttgaagctacacttacatcatgccgacgaaggttgggggagctaagagaactgcggaggcaggtcagacagctcgaagagcgaaacgccgggcacgccgagagaacgcgccaattggaggatgagctaaggcgcgcagggagcctcagagcacagctagaagcacagaggaggcaggttcaggagctacaaggccaacggcaggaggaggctatgaaggccgagaagtggcttttcgagtgtaggaacctggaggagaaatacgagagcgtgactaaggagaaagaaaggctattggctgagcgggattctctccgggaggcaaacgaggaattgcgatgcgcccagcttcaacctcgagggctaactcaggctgacccaagccttgaccccacttccacacccgtagataaccttgccgcagagatcttgcctgccgagctgcgggaaacgttactgcgacttcagctcgagaataagagactctgtcggcaagaagccgccgacagagaaaggcaggaggagttacagaggcacttggaagatgctaaccgggcaagacatggactcgaaactcaacaccgactcaatcagcagcagttatctgagttgagggcacaagtcgaagaccttcagaaagcgctgcaggagcaagggggcaaaactgaggatgctatttccattctgctgaagagaaaactggaagaacatctgcagaaactccacgaagctgatctcgagttgcagcgcaagcgggagtacattgaggaattggagccgcctacggactcctctacggcaagaagaattgaagaactccaacacaatctgcagaaaaaggatgcggatcttagagcaatggaagagagatacaggcggtacgttgacaaagccagaatggtgatgcaaacaatggaacccaaacagaggccagcagcgggggctccaccagaattacactctctgcgcacccagctgagagagcgcgacgtgaggatccggcacctggaaatggacttcgaaaagtccaggtctcagcgtgagcaggaggaaaaactgctaatctccgcatggtacaacatggggatggccctgcaacagcgagccggcgaagagcgggcccccgcacacgcccaatctttcctggcacagcagcggttggctaccaacagccggcgcggccccttagggcgattggccagccttaatcttcgccctacagacaagcactag

SEQ ID NO: 190973 - DNA, 2157 bp, Artificial Sequence
  Description of Artificial Sequence: Synthetic coding sequence
atgttcagcgtggagagcctggagcgggccgagctgtgcgagagcttactgacatggattcagacatttaatgttgatgcaccttgtcagacggtcgaggatctgacaaacggagttgtcatggcacaagttctgcagaaaatcgaccctgcctattttgacgaaaattggcttaaccgaattaagactgaagtcggcgacaactggcgactgaagattagcaacctgaagaagatattaaaaggtatcctggactacaaccacgaaatattaggacagcagattaacgactttaccctcccagatgtgaatctgatcggcgagcacagtgatgctgctgaactcgggcgtatgcttcaactgattctaggatgcgcagtgaattgtgaacagaaacaggagtatattcaagccataatgatgatggaagaatccgtgcagcatgtcgtaatgaccgccatacaggagctgatgtccaaagaatcacctgtgtcagccggtaatgatgcctacgtcgacctggaccgacagctcaaaaagacaaccgaagagctcaacgaagccttgagcgccaaagaggaaattgcccagaggtgccacgagcttgacatgcaagtggccgccttgcaggaggagaaaagctccctcctggccgagaatcaggttctgatggaacgactgaatcagtctgatagcatcgaggatcccaactcccccgccgggagaagacacctgcagctccaaacacagttggagcagctgcaagaggagaccttccgcctcgaagctgcaaaggacgattatagaatcagatgcgaggaactggagaaagagatatcagaactccgccagcaaaatgacgaactgactacccttgctgatgaggcccagagcctgaaggatgagattgacgtcctcaggcacagcagcgacaaagtgtctaagttggaagggcaagtcgaaagctacaagaagaagcttgaggatctcggggatctcaggcgacaagtaaaactgctggaagaaaaaaacacaatgtatatgcaaaacactgtttccctcgaggaggagctaaggaaagccaacgctgcgagatcacagctggagacctataagcggcaagttgtcgagctacagaatcggctatccgaggagtccaaaaaggcagacaagctggacttcgaatataagcgcctaaaggagaaagtggactcacttcagaaagaaaaggaccggctcagaacagagagagactcactgaaagagacaatagaagagctgaggtgtgtgcaggcacaggaaggccagctgaccacccagggcctgatgcccctgggttcacaggaatcttcggactctctggcagcagaaatcgttacgcccgagattcgggaaaagcttatccgcctgcagcacgagaataagatgttgaagctaaatcaggagggaagcgacaacgagaagatcgcactgctacagagcttgctggatgacgcaaatctccgcaaaaatgaactggagaccgagaacaggctggttaaccaacggcttctagaagtgcaaagtcaggtagaggagctgcaaaagtcactccaagatcaaggctccaaagcagaggattccgtgctgctcaaaaagaagctagaagaacaccttgaaaaacttcatgaagcaaataatgaattgcagaaaaaacgggccatcattgaagatctcgaacctagatttaacaattcatcactgaaaattgaagagctgcaggaggcccttagaaaaaaggaggaagaaatgaaacagatggaggaaaggtataaaaaatacttagagaaagccaaaagcgtaattaggacgttggacccaaaacaaaaccaaggggcggctcctgaaatccaggctctcaagaatcagttgcaggagcgtgatagattgtttcattcacttgagaaggagtatgaaaagactaaatcgcagcgcgagatggaggagaaatacattgtgagcgcttggtacaacatgggaatgaccctgcacaaaaaagcagctgaagaccggctggcctctactggatccggtcagagtttcctcgcccggcagcgacaggccacctcttcccggagaagttacccaggccatgtgcagcctgcaacagctagatag

SEQ ID NO: 190974 - DNA, 222 bp, Artificial Sequence
  Description of Artificial Sequence: Synthetic coding sequence
atgagcgccgagaccgccagcggccccaccgaggaccaggtggagattctggagtacaatttcaataaggtcgataaacacccagatagcaccacactctgcttaatcgctgccgaagccgggttatctgaagaagagactcagaaatggtttaaacaacggctggcgaagtggcgccggagtgaggggttgccatccgagtgtaggtcggttaccgactag

SEQ ID NO: 190975 - DNA, 222 bp, Artificial Sequence
  Description of Artificial Sequence: Synthetic coding sequence
atgagcgccgagaccgccagcggccccaccgaggaccaggtggagatactggagtacaacttcaataaagtggacaaacaccccgatagcaccactttgtgtctcatagcagctgaggcagggctgtcagaagaggagacacagaaatggttcaaacagcgcctcgccaaatggcgacgctcagaaggtctccccagtgagtgtcgctctgtgacggactag

SEQ ID NO: 190976 - DNA, 222 bp, Artificial Sequence
  Description of Artificial Sequence: Synthetic coding sequence
atgagcgccgagaccgccagcggccccaccgaggaccaggtggagatcctggaatacaacttcaataaagtagacaaacatccggattcaacaaccctctgcttgattgccgccgaagccggactctcagaggaagagacccagaaatggtttaaacagcgattagccaaatggaggaggagtgagggtctgccgtcggaatgtaggtctgttacagactag

SEQ ID NO: 190977 - DNA, 285 bp, Artificial Sequence
  Description of Artificial Sequence: Synthetic coding sequence
atgagcgccgagaccgccagcggccccaccgaggaccaggtggagatcctcgagtataacttcaacaaagtggacaagcatcccgattctaccacactgtgcctgattgccgcagaggcgggtctgtccgaagaggaaacccagggctcagatcttatatcaaggtccaaaatatggcatcccgagtcgtctccacaaagggagggatatccacacgatagtttgccctgccttgccttcgactatttcagcctcctccctccccaatgtaaggagatggtgtag

SEQ ID NO: 190978 - DNA, 276 bp, Artificial Sequence
  Description of Artificial Sequence: Synthetic coding sequence
atgctgatcttcctgggctgctaccggcggcggctggaggagcgggcgggcacaatgtcagctgagaccgcgagcggtccaaccgaagaccaggtggaaattctggaatacaactttaacaaggtggataagcacccagattcaacaactctttgtctaatcgctgcagaagccggcttaagcgaggaggaaactcagaagtggttcaaacagagactggctaagtggcgacgaagcgaaggcctgcccagtgagtgtcgatcggtcaccgattag

SEQ ID NO: 190979 - DNA, 222 bp, Artificial Sequence
  Description of Artificial Sequence: Synthetic coding sequence
atgagcgccgagaccgccagcggccccaccgaggaccaggtggagattctggagtacaattttaacaaggtggacaaacatccagacagtactacactctgccttatcgcagctgaggccggactgagcgaggaagagactcaaaagtggtttaaacaaagactcgctaaatggcggcgatctgaaggactgccctccgagtgtcgctccgttaccgattag

SEQ ID NO: 190980 - DNA, 285 bp, Artificial Sequence
  Description of Artificial Sequence: Synthetic coding sequence
atgagcgccgagaccgccagcggccccaccgaggaccaggtggagattctggagtacaactttaacaaagtcgacaagcatcccgactcaactacgttatgtctgatcgctgccgaagccggcctgagtgaggaagagactcagggctcagatttgatatcgcggagcaagatctggcaccctgaaagctcgcctcaacgggaggggtaccctcatgactctctgccatgcctagcatttgactatttctccctcttaccccctcaatgcaaagaaatggtttag

SEQ ID NO: 190981 - DNA, 222 bp, Artificial Sequence
  Description of Artificial Sequence: Synthetic coding sequence
atgagcgccgagaccgccagcggccccaccgaggaccaggtggagattctcgaatataactttaacaaggtagacaaacaccctgactctacaaccttgtgccttatagccgccgaagcgggattatccgaggaggaaacacagaagtggttcaaacaaagattggctaaatggaggcgctccgaaggtttacccagcgagtgcaggtccgtcaccgattag

SEQ ID NO: 190982 - DNA, 276 bp, Artificial Sequence
  Description of Artificial Sequence: Synthetic coding sequence
atgctgatcttcctgggctgctaccggcggcggctggaggagcgggcaggaactatgagcgcagaaacggcctccgggccaacagaggatcaggtggaaatcctcgagtataactttaataaggttgacaagcatcctgattctacgactttatgtcttatagcagctgaagcagggctctccgaggaagagactcaaaaatggtttaaacaacgccttgcaaaatggagaaggagcgaggggctgccatccgagtgccggtctgtgacagactag

SEQ ID NO: 190983 - DNA, 285 bp, Artificial Sequence
  Description of Artificial Sequence: Synthetic coding sequence
atgagcgccgagaccgccagcggccccaccgaggaccaggtggagattctggagtataacttcaacaaggtagataagcaccctgactccacaaccctgtgtctgattgctgccgaggccggtcttagtgaagaagaaacacaggggtcagatctgatttcgcggtccaagatatggcatcctgagtcctccccccagcgggaagggtatccccacgattccctgccttgccttgcctttgactatttcagccttctcccaccccagtgcaaggaaatggtctag

SEQ ID NO: 190984 - DNA, 222 bp, Artificial Sequence
  Description of Artificial Sequence: Synthetic coding sequence
atgagcgccgagaccgccagcggccccaccgaggaccaggtggagattctggaatacaatttcaataaggtggacaaacaccctgatagcaccacgctgtgcctgatcgctgctgaggctggcctctcagaggaagagacacagaaatggtttaagcagaggctcgcgaaatggaggcggtccgagggcctgcccagcgaatgccggtctgtgacagactag

SEQ ID NO: 190985 - DNA, 222 bp, Artificial Sequence
  Description of Artificial Sequence: Synthetic coding sequence
atgagcgccgagaccgccagcggccccaccgaggaccaggtggagatacttgagtacaacttcaataaagttgataaacaccctgactctaccactctgtgtctgatcgccgcggaggctggcttgtcagaggaagagacccagaaatggttcaagcagcgcctcgccaagtggagacgctcggaggggttgcccagcgaatgtaggagcgtgacagattag

SEQ ID NO: 190986 - DNA, 339 bp, Artificial Sequence
  Description of Artificial Sequence: Synthetic coding sequence
atgctgatcttcctgggctgctaccggcggcggctggaggagcgggccggaaccatgagtgcggagacggcctccggcccaactgaggaccaggtcgagatactcgagtataacttcaataaggtggataaacatccggattcaaccacactgtgtctgattgctgccgaggccggcctgtcggaggaggagacgcaggggtcagatctgatctccagatctaagatctggcatccagagtccagccctcaacgcgaaggatatcctcacgatagtctcccatgcctggcatttgattatttttctctgctaccgcctcagtgtaaagagatggtgtag

SEQ ID NO: 190987 - DNA, 222 bp, Artificial Sequence
  Description of Artificial Sequence: Synthetic coding sequence
atgagcgccgagaccgccagcggccccaccgaggaccaggtggagatactcgaatataatttcaataaagtcgacaagcacccagatagcaccacactttgtcttattgccgccgaagccggcctgtcagaagaagagactcagaaatggttcaagcagaggctggccaagtggcgccgatctgaggggctgccgtccgagtgtcgctcagtcacggactag

SEQ ID NO: 190988 - DNA, 222 bp, Artificial Sequence
  Description of Artificial Sequence: Synthetic coding sequence
atgagcgccgagaccgccagcggccccaccgaggaccaggtggagattcttgagtataactttaataaagtggataaacaccctgacagcacaactttgtgccttatagcagcggaggcgggcctctccgaggaggaaactcagaagtggttcaagcagcggctggccaagtggcggcgtagcgagggtcttccgagtgagtgcaggtccgttaccgactag

SEQ ID NO: 190989 - DNA, 222 bp, Artificial Sequence
  Description of Artificial Sequence: Synthetic coding sequence
atgagcgccgagaccgccagcggccccaccgaggaccaggtggagattctcgagtataattttaacaaggtcgataagcaccctgactcaacaaccctctgcctcatcgctgctgaggccggactgtctgaggaggagacacagaaatggttcaagcagagactggcaaagtggcgacggtcagaaggcttgccctcagagtgtaggtccgttacggactag

SEQ ID NO: 190990 - DNA, 144 bp, Artificial Sequence
  Description of Artificial Sequence: Synthetic coding sequence
atgagcgccgagaccgccagcggccccaccgaggaccaggtggagattctggaatataatttcaataaagtggataaacaccccgacagcaccaccctctgcctgatcgccgccgaagcgggcctctcagaagaggaaacttag

SEQ ID NO: 190991 - DNA, 1164 bp, Artificial Sequence
  Description of Artificial Sequence: Synthetic coding sequence
atggccaccgcccagctgcagcggacccccatgagcgccctggtgtttccaaataagatcagtaccgaacatcagtcactagtgcttgtgaagcgtctccttgcagtcagcgttagctgcattacataccttagaggcatattcccagaatgcgcctacggaacacgctatctggatgatctttgcgttaaaatcctaagggaagataagaattgtcctgggagtacacagcttgtcaaatggatgctcggttgctatgatgctttacagaaaaaatacgtttataccaatcccgaggacccccagactatttctgaatgctatcagttcaaattcaagtacacaaataatggtccgctgatggacttcatctcaaagaaccagtccaacgagtccagcatgctgtcaacagataccaagaaggctagcatcctcctcatccgcaagatttatatcctaatgcagaatctcgggcccctgccaaacgacgtttgcttgaccatgaaactcttttactacgacgaagtgacaccacctgactatcagccaccaggttttaaggacggcgattgcgagggagtcatatttgagggtgagcccatgtacttgaacgtcggcgaagtgtctactcccttccacatctttaaggtcaaagtaaccaccgaaagagagaggatggagaatatcgattcaaccattctgagcccaaaacaaattaaaacaccgtttcaaaaaatcttgagggacaaggacgttgaagatgagcaggaacattacacttccgatgacctagacattgagaccaagatggaagaacaagagaagaaccccgcctcttctgaactggaagagccaagcctcgtatgcgaagaggacgaaatcatgagaagtaaggagtctccggatctgtccatctcacacagccaggtagaacagctggtcaataaaacaagtgagctagatatgtctgagagcaaaacgcgttctgggaaagtgtttcaaaataagatggctaatggtaatcagccagtgaagagtagtaaagaaaaccggaaacgttcacagcatgagtccggcaggatcgtgctccatcactttgattcgagtagtcaggaatctgtgccaaaaagaaggaaattctccgaaccgaaggagcacatatag

SEQ ID NO: 190992 - DNA, 1185 bp, Artificial Sequence
  Description of Artificial Sequence: Synthetic coding sequence
atggccaccgcccagctgcagcggacccccatgagcgccctggtgttccccaataagatctctaccgaacaccagtcgctggtcctggtaaagcggctgctggccgtgagcgtctcttgtattacttaccttcgaggcatattccccgagtgcgcctacggcactcgatacctcgacgacttgtgcgtcaaaatccttagagaggataagaactgtcctggctcaacgcaactagttaagtggatgcttgggtgctacgatgccctgcaaaagaagtacctcagaatggtggtcttagctgtgtacaccaacccagaggatcctcagacaatttctgagtgctaccagtttaaattcaagtacaccaacaacggtccactaatggacttcatcagcaagaaccaatctaacgaaagctctatgctctcaacggacacgaaaaaggcttcaattttgttgatccggaaaatttacattctcatgcagaatctaggtcctctgccgaacgatgtgtgcttaaccatgaaactgttttactacgacgaagtcaccccaccggattaccagcccccaggattcaaagacggggactgtgagggtgtgatcttcgaaggggaacctatgtaccttaacgttggggaagtgagtacacctttccatatcttcaaggttaaggtgacaacagaacgggagcgcatggaaaacattgactccaccatcctgtcgcccaagcaaattaagaccccctttcagaagattctccgggataaggatgtggaggatgagcaggagcactatacttcggatgacctagacattgaaaccaaaatggaggagcaagaaaagaaccctgcctctagcgaactggaggaaccctccctggtgtgcgaagaggacgagattatgcgtagcaaggaatcacctgatcttagcattagccactcgcaggtggaacagctcgtaaacaaaacgtctgaattggatatgtcagagtcaaagactaggagcggtaaggtctttcagaataagatggccaatgggaaccagcctgtaaagagcagcaaagaaaatcgaaaaagaagtcaacatgaaagcgggagaatagtgctccaccacttcgactcttctagccaggaaagcgtgccaaaaaggcggaaattctcggagccaaaggagcacatctag

SEQ ID NO: 190993 - DNA, 573 bp, Artificial Sequence
  Description of Artificial Sequence: Synthetic coding sequence
atgcggctgtggaacaagatcagccggtggatgctgggctgctacgacgctctgcagaagaaatatctccggatggtcgtgctcgcagtgtacacaaatccagaagacccccagacaattagcgagtgttaccagttcaagttcaagtatacaaacaacggcccacttatggacttcatcagtaaaaatcagagcaacgagtcttcaatgctgtccacggacaccaaaaaagctagcatactcttaatccgcaagatttacatcctcatgcagaacctcggacctctgcccaatgatgtgtgcttgacgatgaagctgttctactatgacgaggtcaccccccccgactatcagcccccagggttcaaagacggcgactgcgagggagttatctttgagggggagccaatgtacctgaacgtgggggaggtctctacacccttccatatctttaaggtgaaagtaacgaccgagcgcgagcgcatggagaacatcgactctacgattctgtctccgaagcagattaagaccccattccaaaagatccttagggataaagatgtcgaggactag

SEQ ID NO: 190994 - DNA, 972 bp, Artificial Sequence
  Description of Artificial Sequence: Synthetic coding sequence
atgcggctgtggaacaagatcagccggtggatgctgggctgctacgacgcactccagaagaaatatctcaagatcatggaactgactgtgtatacgaatcctgaagacccacaaactatttccgaatgttatcagtttaaattcaagtacactaataatggaccgcttatggattttatctctaagaatcaatccaacgagtccagcatgttgagtacggatacaaagaaagcttccattttgttgattcggaaaatctacatattgatgcagaatctaggcccactcccaaatgacgtttgcctgactatgaaactgttctactacgacgaggttacacccccagattatcagcctcccggattcaaagacggggactgtgagggggtcatatttgaaggtgaacccatgtacttgaatgtcggagaagtcagtacacccttccatattttcaaggtgaaggtaactaccgaaagggaacggatggagaatatcgactcaacgatcctttcgccgaaacagataaagactcctttccaaaagatactccgtgacaaggatgttgaggatgagcaagagcattatacaagcgacgatctggatatcgagaccaagatggaagaacaggagaagaatcctgcctccagcgagctcgaggagcccagcctcgtctgtgaggaggacgagataatgaggtctaaggaatcaccagacctgtctatctcccatagccaagtagagcagctggttaataagacttcagaattggacatgagtgaatctaaaactcgctccggcaaggtattccagaataaaatggctaacggcaatcaaccagttaaatcatccaaggagaaccgtaagcgttctcagcatgagtcaggtcggattgtgctacaccacttcgatagcagctcacaagagtctgtcccaaagcggcggaaatttagcgaacccaaggaacacatttag

SEQ ID NO: 190995 - DNA, 1185 bp, Artificial Sequence
  Description of Artificial Sequence: Synthetic coding sequence
atggccaccgcccagctgcagcggacccccatgagcgccctggtgttccctaacaaaatctctaccgagcaccagtcgttggtactggtcaaaaggttactcgcggtctccgtatcatgcatcacctacctgcgggggatcttccccgaatgtgcatatgggacaaggtatctcgatgacctgtgtgtgaagatactgagggaggacaagaactgtcctgggtcaacacaactggtgaaatggatgctcgggtgttatgacgcgctgcaaaagaaatacctcaaaatcatggagctgaccgtgtacaccaatccagaggatccacagaccatttcagagtgctaccagttcaaattcaaatatacaaataatggaccacttatggacttcatctctaagaaccagtccaacgagtccagcatgctttctacagacaccaaaaaggcctccatcctccttatcaggaagatctacatcctcatgcagaacctggggccactgcctaatgacgtgtgcctgacaatgaaactgttctactatgatgaggttactcctcctgactatcaaccaccaggctttaaggatggtgactgcgagggagtaatctttgaaggggaacctatgtaccttaatgtgggagaagtaagcaccccctttcacatcttcaaggtcaaggtgacaacagagagagagcgaatggaaaatatcgattcaacgatcctgtcccccaaacagataaagacgccctttcagaaaattctgagagacaaggatgtggaagacgaacaggagcactacacttctgacgatctggacatagagacaaagatggaagaacaggaaaagaatccagcctcttccgagctggaggaaccctccctagtgtgtgaggaagatgagattatgaggtctaaagagtcacctgacctaagcataagtcactctcaggtggaacagctggtgaacaaaactagcgaactggacatgtctgaatcaaagaccaggtccgggaaggttttccagaacaagatggccaacgggaatcagcctgttaagagctcgaaagagaacaggaagaggtcgcagcacgagtcgggacggatcgtcctgcaccacttcgactcctctagtcaagagtcagtgccaaagcgcaggaaattttcggagccaaaggagcacatctag

SEQ ID NO: 190996 - DNA, 945 bp, Artificial Sequence
  Description of Artificial Sequence: Synthetic coding sequence
atgcggctgtggaacaagatcagccggtggatgctgggctgctacgatgctctccaaaagaaatatttgaggatggttgtgctcgctacaattagcgaatgttatcagtttaagttcaaatacacgaacaacggtccactgatggacttcatctctaaaaaccaatccaatgagtcatcgatgctctccacagataccaaaaaggcttcaatccttttaattaggaagatctacatcctgatgcaaaatctcggcccgttgcctaacgatgtttgcctgacgatgaaactgttctactacgatgaggtcacccctccagattaccagcccccgggtttcaaagatggggattgtgagggggttattttcgaaggcgagccaatgtatctgaacgtgggtgaagtgtctacaccattccacatcttcaaagtaaaggtcacgactgagcgggagaggatggagaacatcgactctaccattttgagtcccaagcagattaaaactccctttcaaaagatcctgagggataaggacgtggaggatgaacaagagcactacacgagcgatgatctggatatcgagaccaaaatggaagaacaggaaaagaatccggcatcatcagaactggaagagccatccctggtttgtgaagaggacgaaatcatgcggtctaaggaatctccagacctctccatcagccattcgcaggtcgagcagctcgttaacaagacaagcgagctcgatatgtccgaaagtaaaacccgctcaggcaaagttttccaaaacaagatggcaaatggaaatcagcctgttaaaagttctaaggaaaaccgcaagcgtagccagcatgagtcgggccggatcgttctacatcattttgatagctctagtcaagagtccgtccccaagagaaggaaatttagcgaaccaaaagaacacatctag

SEQ ID NO: 190997 - DNA, 495 bp, Artificial Sequence
  Description of Artificial Sequence: Synthetic coding sequence
atgcggctgtggaacaagatcagccggtggatgctgggctgctacgacgccctccagaaaaagtacgtgtacaccaaccctgaggacccccaaaccataagcgagtgttaccagttcaaattcaaatataccaacaacggcccgctgatggatttcatttcaaagaaccaatcgaacgaaagttccatgctctccacagataccaagaaggcttctattcttctgatacgcaagatttacatccttatgcagaacctcggacctttgcctaatgacgtttgcttgaccatgaaactcttttactatgacgaagtgactccgcccgattatcagccaccgggatttaaagatggcgactgtgaaggagtgatattcgagggggagcccatgtacctcaatgtgggcgaagtcagcacaccctttcacatctttaaggtgaaagtaactaccgagcgagaacgcatggagaacatcgattcaactatcctttcctag

SEQ ID NO: 190998 - DNA, 945 bp, Artificial Sequence
  Description of Artificial Sequence: Synthetic coding sequence
atgcggctgtggaacaagatcagccggtggatgctgggctgctacgatgcactgcaaaagaagtatttgcgatacttcctttttaagacaatcagcgagtgttaccagttcaaatttaagtataccaataatggacccctgatggattttatctccaagaatcaatccaacgaatcttctatgctcagtactgacactaagaaggcatccattctgttgatacgtaagatttatattctgatgcaaaaccttggtcctctgccaaacgacgtgtgtctgacaatgaaactgttctactacgacgaagtgaccccacctgactaccaacctcctggtttcaaggacggagactgcgagggagtgatctttgaaggggaacctatgtacctgaatgtcggggaggtttccacaccctttcatatctttaaggtgaaagtcacaactgagcgggagagaatggagaacatcgattccacaatcctgtctcctaagcagatcaaaacacccttccagaagattcttcgggacaaagatgtggaggatgaacaggagcactacaccagcgacgacctagatattgaaaccaaaatggaagaacaggagaaaaatcccgccagttcggagctggaggaacctagcctggtatgcgaagaggacgaaattatgagatccaaagagtctcctgacttgtccatttctcattcacaggtggagcagctggtgaacaagacgtcagagctggatatgtcagaatccaagacacgatcgggcaaagttttccagaataagatggccaatggcaaccagcccgtcaagtcctcaaaggagaaccggaagagaagccaacacgaaagtggacgcatcgtgctccatcattttgatagctccagccaggaatctgtgcccaagcgtcggaaattctctgaacccaaggaacacatctag

SEQ ID NO: 190999 - DNA, 6108 bp, Artificial Sequence
  Description of Artificial Sequence: Synthetic coding sequence
atggccagcgccgtgagccccgccaacctgcccgccgtgctgctgcagcctaggtggaaaagagtggtaggctggagtgggccagtgccccgtccccgccatggtcatagggccgtcgctataaaggagctgatcgtagtgttcggggggggcaatgagggcatcgttgatgagctacacgtctacaataccgctacaaatcaatggtttattccggcggtgcgaggagacatcccaccaggatgtgccgcttacggctttgtatgcgatggtacgcggctgctggttttcgggggaatggtggagtatggcaagtattccaacgacctgtacgaactccaggcaagccggtgggaatggaagagactaaaggccaaaacaccaaaaaacggacctcccccctgtcccaggctgggtcatagcttctcccttgtgggcaacaagtgttatctctttgggggcctggccaacgactccgaagatcccaaaaataacatccccaggtatttgaacgatctgtatatcctcgagcttagacctggcagcggagtcgtagcctgggacattccaatcacatacggtgtactgcccccacccagagaatctcacactgctgttgtatatacggagaaggataacaaaaaaagcaaactggtgatttatgggggcatgagtggctgccgcctaggcgacttatggaccttagatattgacacgctgacctggaacaagccaagtctgtcaggagtggcacccctcccaagaagtctgcactccgctacgactatcggcaacaagatgtacgtcttcggcggctgggttcctctcgtgatggacgacgtgaaggtggccacccacgagaaagaatggaagtgcaccaacacacttgcctgtctgaatctggacactatggcatgggaaactattctgatggacaccctggaggataacatcccccgagcaagagctggacactgcgctgtggccatcaatacaaggttatacatatggtcagggagggatgggtatcggaaagcctggaacaatcaggtctgttgcaaagacctatggtacctagaaacagagaagccacctccacctgctcgagtccagctcgtgagagcaaacacaaactccctcgaggtgtcatggggtgccgttgctacagcagattcctatttgctgcagctgcaaaaatatgatatccctgccacagctgctaccgctaccagccctactcctaatcctgtaccaagcgtacctgcaaatccccctaagagtccagcacccgccgcagccgcccctgccgtccaaccgcttacacaggtaggaattaccctgcttcctcaggctgcaccagccccgcccacaactactactatacaggttctcccgacagtcccaggatcatccatctccgtccccactgccgctcgaacacagggtgtgcccgccgtcctgaaggtgaccggcccccaagctaccactggcacaccacttgtgaccatgaggccggctagtcaagctggtaaggctcccgtgactgtcacgagtctgccagctggtgtacggatggttgttcctacccagtctgcgcagggcaccgtaatcgggtcaagtccacagatgtcaggaatggctgccctggcggccgccgcagcggcgacacagaagatccccccttcatccgcacctactgttctgagcgttccagccggcacaacaattgtaaaaaccatggcagttacccctggcacaacaacgctgccagcaacagtgaaggtggctagttcaccagtaatggtgagtaatccggcaaccagaatgctcaagactgctgccgcgcaggtcggaactagcgtatcgtcagcgacaaacacttctacaagacccatcatcaccgtccataagagcggtactgttaccgtcgctcagcaagcacaggtagtgacaactgtggtgggcggggtcactaagacgattaccctggtgaagagcccgatcagtgttccaggcggttcggccctgatttccaacctgggtaaggtgatgagcgtggtgcagaccaaaccggtacagaccagtgctgtcaccggtcaggccagtacaggtcccgtcacgcagatcatacagacaaagggacctctgcccgccggaacaatcctgaagcttgtgacaagcgccgacggaaaaccgacgaccattattacaaccacacaggccagcggtgcagggaccaagcctacaatcttgggtattagctcagtctcccctagcactaccaaacccgggacaactacgatcatcaagactatccctatgagcgctatcatcacgcaggccggagcaaccggtgtgacttccagtccagggatcaagtcccctattaccatcattactaccaaggtaatgacgagcgggacaggcgccccagccaagattatcaccgctgtaccgaagatcgctacgggccacgggcagcagggtgttactcaggttgtgctgaagggcgcacctggccagcctgggaccatcctgagaacggtgcctatgggaggagtgcgccttgtgacccccgtcacagtctcggccgttaagccggccgtgactaccctcgtcgtaaaggggacaaccggagtgacaactctaggaactgtgacaggaacagtctccactagcctcgccggggccggtggtcacagtacctccgccagcctggctactcccatcacaacccttggaacaattgccactctgagttctcaggtgataaatcctacggcaatcactgtgagtgcagcccaaaccaccctgacagccgcaggcggcttgacaacacccacaataaccatgcagcccgtctctcagccaactcaagtaaccttaatcactgccccttctggcgtagaagcccagccagtccacgatctccctgtctctattcttgcctcacccaccacagagcaacccactgccacagtaaccattgcagattcaggccagggggatgttcagccaggcaccgtaactctggtatgctccaacccgccctgcgagactcacgaaacaggtaccaccaataccgctaccaccactgtggtcgctaacctgggaggacaccctcagcccacacaagtacagttcgtctgtgatcgccaggaggcagcggcatccttggtgactagcacagtgggccagcaaaacggaagtgtcgttagggtctgttcaaatcccccgtgtgagacccatgagacaggcactactaataccgccaccacagctactagcaatatggctggacagcacgggtgttctaacccgccttgcgaaacacatgaaaccggaactaccaacacagccacaacggccatgagctcagtcggcgccaaccatcaaagggacgcaagacgagcttgcgcagccggcaccccggcggtgatccggatcagcgtggctacaggcgcattagaggccgctcagggatcaaagtcccagtgccagacgcgccaaacatccgccacatccaccaccatgaccgtcatggcaaccggggccccctgttctgctggtcccttgctgggccctagcatggctcgtgaacccggagggcgcagccccgctttcgtccagctggctcctctcagtagtaaggtgagactctcgtctccatctatcaaagacctgcccgccgggagacattcacatgcagtgagcaccgctgccatgacccggagcagcgtgggcgcaggagagccacgtatggccccggtctgcgagtccctgcagggaggaagtccctctacaaccgtgactgttacagcgttagaggctctgctgtgcccctcggccactgtgacccaggtctgtagcaaccccccttgtgagacgcatgaaacaggcactaccaacacagccaccacatccaatgcggggtccgcccagagagtctgttccaaccccccctgcgaaactcacgaaactggcacaacccacacagccacgacagccacctccaacgggggaaccggacagcccgagggaggtcaacaacctcccgcgggtcgaccatgtgagacacaccagaccacttccacgggtactacaatgtcagtgtccgttggcgcactgctccccgatgctacttccagccaccggaccgtcgagagtggcctggaagtcgcagccgcaccctccgtgacacctcaggctggaacagccctgttagctcccttccccacgcagcgtgtttgttcaaatcctccctgcgaaacacacgaaacaggaacgacccatactgcgacaactgttacaagcaatatgagctcaaatcaggatcctcctccagccgcttcagatcagggggaagtggagtctacacagggcgattctgtcaacattaccagcagttccgccataaccaccactgtgtcctctacccttacaagagcagtcacaactgttacccaaagtactcccgtacctggcccatccgttccaccccccgaagagctgcaggtgtcaccaggtccccgccagcaactccccccccgtcaactgctgcagtccgctagcaccgctctgatgggtgagtccgctgaggtgctgtcagcctctcaaacaccagaattgccagcagctgtggacctatctagcactggcgaaccttctagcggccaggagtcggccggttccgctgtggtcgccacagtggtggttcagcctccaccccctacccagagcgaggtggatcaactatctctacctcaggagctgatggctgaagcccaggcaggaacaactactctcatggttacaggactgacgcctgaggaactggctgttactgcagctgctgaggcagccgcacaggctgcggcgacagaggaagctcaagctctcgcgattcaggcggttttgcaggctgctcagcaggccgtaatgggcactggggaacccatggacacatccgaggccgcagcgaccgtgacacaggccgagctggggcatctgtcggccgagggccaagaaggacaggccacgacgatcccaattgtactgactcagcaggagctagctgcactcgtgcagcagcagcaactgcaggaggcccaggcccaacagcagcatcaccatctgcctaccgaggcactggcacctgcagactcgctcaacgaccctgccattgaatctaattgtctgaacgagctggctgggactgtaccaagcactgtcgctctcctgcctagcacagcaactgaaagcttagccccaagtaacacttttgtagcaccacagcccgtggtggtagcaagtcctgctaagctgcaagcggctgcgactctgacagaagtcgccaacgggattgagtccctaggagtgaagcctgatttgccccctcctccatccaaggccccgatgaagaaagaaaaccagtggtttgatgttggtgttatcaaggggacaaacgttatggtaacacattactttctgccaccagacgacgcggttcctagtgacgatgacctgggcactgtccctgattataaccaactgaagaaacaggagctgcagccaggcactgcgtacaagttcagggtggctggaatcaacgcttgtgggcgcgggcccttcagtgaaatttcggcctttaagacatgcttaccaggattcccgggtgccccttgtgccatcaagataagtaaaagtcccgatggagcccacctcacttgggaacccccatccgttacctcaggaaagatcatcgaatacagcgtctacctggcaattcagtcctctcaggccgggggcgagctaaagtccagcacccccgcgcagcttgctttcatgcgcgtgtattgtggtccaagtcccagttgcctggtgcaaagttcatctctcagcaatgcccatatcgactacactacaaagccggctataatatttaggatagcggcacggaacgagaaggggtatggcccagctactcaggtgagatggctccaagagacaagcaaggatagctccggaacaaagccggctaataagaggcccatgagtagccccgaaatgaagtccgctcctaagaagtcgaaggcagatggacagtag

SEQ ID NO: 191000 - DNA, 5901 bp, Artificial Sequence
  Description of Artificial Sequence: Synthetic coding sequence
atggccagcgccgtgagccccgccaacctgcccgccgtgctgctgcagcctcggtggaagcgggtggtgggttggtctggacctgttcctaggcccaggcatggacacagagccgtggctatcaaggaacttatagtagtctttgggggtggcaacgagggcattgtcgacgagttacacgtatacaacacagccacgaaccagtggttcatcccagcagttcggggggatatacctcctggttgcgccgcatacggctttgtatgcgatggaacacggctgctggtatttgggggtatggttgaatacggcaagtacagcaatgacctgtatgaacttcaagcctcccggtgggagtggaagagactcaaagcaaagacaccaaaaaacgggcccccaccctgcccgcgtcttggccacagtttttctctagtggggaataaatgttatctgttcgggggcctcgcgaacgatagcgaggatccgaaaaataacatacctaggtacctcaacgatttatacatcttggaattgagacccggctctggagtcgttgcttgggatatccccatcacgtacggagtcttgcccccacccagagagagtcacacagctgtggtttatacagaaaaagataataaaaaatcaaaacttgtgatctacggtgggatgagcggctgcagattaggggatctgtggacactcgacatcgataccctgacatggaataagccctcactgtccggggtggcgcccctgcccagatccttgcacagtgctaccacaatcggcaacaagatgtacgtgttcgggggttgggtccccctcgttatggacgatgtcaaggtagccactcacgaaaaggagtggaaatgtactaatactctggcttgtttaaatctcgataccatggcctgggagacaatcttaatggatacattagaggacaatattccccgcgcccgcgccgggcactgtgccgttgcgattaacactagactctacatctggtcaggtagagacgggtatcggaaggcatggaacaaccaagtgtgttgcaaagacctgtggtatcttgaaacagagaagccgccgccacctgccagagtccaattggtgagagctaatacaaattctctagaagcggccccggctccccccacaaccacaaccattcaggtcctgcccactgtccccggaagctctattagcgtgcccaccgctgcgaggacacagggagtgcctgcagtactgaaggtgaccggcccccaggcaacgaccggcacacccttggtgacgatgcgtccagcttcgcaggcaggcaaagctcctgtgaccgtcaccagcctcccagctggtgtccggatggttgtgccaactcagtcagcccagggaacagtcattggctcctctccccagatgagcggcatggccgctctggcagctgctgctgctgccacacagaagattccaccctcatcagcccctaccgttttgtcagtgcccgcaggaactaccatcgtcaagactatggctgtgacccctggaactacgaccctgcctgctacagtaaaggtggccagtagcccagttatggtgagcaacccagcaacaagaatgctgaagaccgccgccgcacaagttggaacctcggtctccagcgctaccaacacctctacaaggcctatcataactgtccataagtcaggcaccgttacagtggctcagcaggcgcaagtggtcaccaccgtggtgggcggcgtgaccaagacgatcactctggttaagagcccaataagcgtcccagggggtagcgccctcattagcaatctgggtaaggtcatgtcagtggtccagaccaaaccagttcagacttcggcagtgacgggccaggccagtactggaccggtgactcagattatacaaaccaaggggcctctacccgccgggacaattctgaaacttgtgacctcagccgacgggaaacctactaccatcatcacgactactcaggccagcggagccggaactaaacctacaatcctcggcatcagttctgtgagccccagtaccactaaacctggcaccacaactatcatcaagacaatccccatgtccgcaatcatcacacaggcaggggcaacaggggtgacatcaagcccaggcattaagtcacccataactattattacaacaaaagtgatgaccagcggcaccggcgcccccgccaaaataataactgctgtgccaaagatcgctacagggcatggccaacaaggtgttactcaggttgtgcttaaaggcgcacctggacaaccaggtactatcctcaggactgtgcccatggggggtgtccgccttgtgaccccggtcaccgtctcagccgttaaacctgccgtcactaccctggtagtcaaagggaccacgggagtgacaactttgggcactgtgaccggtactgtgagcaccagcttagctggcgctggcggccactccacctccgcttcccttgccacgccaataaccactctggggactatcgccaccctgtcaagtcaagtgatcaacccaactgctatcacggtaagcgccgcgcagactactctgacagcagccggtgggctgactacgcccaccattaccatgcagcccgtcagtcagcccactcaggtgactctcatcacagccccctccggcgttgaggcacagcccgtgcacgacctccccgtgagtattttagcgagcccgacgactgaacaacctaccgcaacagtaaccatcgccgacagcgggcagggtgatgtccaaccagggacagttacattagtgtgctcaaatccaccctgtgaaacccacgaaacagggaccacaaataccgctaccacaactgttgtcgcaaacctgggaggacaccctcagcctacccaggtgcaatttgtgtgcgatcgacaggaggctgccgccagtctggtaacatctacagttgggcagcagaatggctcagtggtgcgggtgtgttcaaatcctccctgtgagactcatgagaccggcactaccaacactgccacgaccgctacaagtaatatggctggccaacacggttgctctaatcctccatgcgagactcatgagaccggcactaccaacactgccacaactgcgatgtcaagcgttggtgccaatcatcagagagacgccagacgagcctgtgctgcaggcacccctgctgtcatccgtataagtgtcgctacgggtgctctagaagccgctcagggcagtaaaagccagtgccagacgagacagaccagcgctacatctactacaatgaccgtgatggccacaggtgcaccttgcagtgctggccctctcctcggcccctcaatggcccgcgaaccgggcgggcgatcccccgcatttgttcaattggctcctttatcctctaaggtaagattaagtagtcctagcattaaagatctgccggcggggcgacattcacatgctgtttccaccgcagcaatgaccagaagttccgtaggtgctggcgagccccgtatggcccccgtatgcgaatctttacaggggggatcacccagcacgacagtcaccgtgactgccttggaggctctcttatgcccttcagccaccgtgactcaggtttgctcaaatccaccctgcgaaacacacgaaacaggtaccactaatacggctacaactagcaatgctggtagcgcacagagagtttgtagcaaccccccctgcgagacccacgaaacgggtactacgcataccgcaaccacagctacttctaatggcggaacaggtcagcctgagggcggccaacagccacccgcgggacgtccctgtgaaacccatcagaccacaagcaccggcactactatgtctgttagtgtgggtgcccttctccctgacgctacttcttcacacagaactgtggagagcggattggaggtcgccgccgctcccagcgttacgccccaggctgggacagctctgctcgcaccctttccaacccagagggtctgcagcaacccaccatgcgaaacccatgagactggtactacccatactgcaaccaccgtcacctccaatatgagctccaaccaggatcccccaccggcggcttcggaccagggggaagtggagtctacacagggcgatagtgtcaacattactagctcctccgctatcactaccactgtaagctccacgctcacccgtgccgtgacaacagtcacccaatcaacacctgtccctggccctagcgtgccaccaccagaagagctgcaggtctccccagggcccaggcagcagctgccccctcggcagctgctccagtctgcctcaaccgctttaatgggcgaatcagctgaagtcctgtctgcaagtcagacccccgagctgccggcagccgtggacctgtcctctacgggcgagccttcttccgggcaggagtctgcgggcagcgcggtggtggctactgtcgtggtgcagccacctcccccgacccagagcgaggtggaccaactgtcgctgccccaggagctaatggctgaggcacaggctgggactacaacactgatggttaccggactaacccccgaagaactggccgtgactgccgccgccgaggccgcagctcaggcggccgccaccgaggaggcgcaggcactcgctatccaagctgtgctgcaggcggcgcagcaagctgtgatgggcactggagagccaatggacaccagtgaagccgccgcaaccgtgacacaggccgagcttggtcatttgagcgccgagggacaggaaggtcaggccacaacaattcccatcgttcttacacaacaggaattggcagccctggtgcagcagcaacaacttcaggaagcccaggcccaacagcagcatcaccatctccctactgaagcactggcccccgccgattcactcaatgaccccgccattgagtctaattgccttaacgagctcgccggaaccgtcccttcaacggtggcccttctgccttctaccgccactgaatcacttgccccttccaataccttcgtggctccccagcccgtcgtggtcgcctcaccggcaaagctgcaagccgcggcgactttaacagaggtggcgaacggaattgagagtcttggggtgaagcctgatctgcccccacccccttctaaggctcctatgaagaaagagaaccagtggtttgatgttggggtgattaaaggcacaaacgtcatggtgacacactactttttgccacctgatgatgcggtaccgtccgatgacgatctggggaccgttcccgattacaatcaattaaagaagcaagaactacagccaggtacagcatacaagtttagagtagccggcatcaacgcctgtggccgggggccattttctgagatctcagcattcaagacgtgtttaccggggttcccgggtgcaccttgcgccattaaaataagcaagtctcccgacggagcccacctcacatgggagccaccgtccgttaccagtggaaaaattatcgagtactctgtgtacctggctattcagtcatcgcaagcaggaggcgagttaaagagttcgacaccggcgcagctcgctttcatgagggtctattgcggtccgtcccccagctgtctggttcagtcctctagtctgtcaaacgcccacatcgactacactaccaaacccgccataattttccgcattgcagcacggaacgagaagggatacggaccggccacccaggtgcggtggctgcaggagacttctaaggactcatccggcacaaagcccgccaacaaacgcccgatgtcaagcccagaaatgaagagtgcaccaaaaaaatccaaggcagacggccagtag

SEQ ID NO: 191001 - DNA, 6243 bp, Artificial Sequence
  Description of Artificial Sequence: Synthetic coding sequence
atggccagcgccgtgagccccgccaacctgcccgccgtgctgctgcagcctcgctggaagcgggtcgtagggtggagtggtcccgttccaaggcccagacacggtcaccgtgctgtagcaatcaaggagctgattgtggtattcggggggggtaacgaagggattgttgatgaactccacgtgtataacaccgccactaaccagtggtttatccctgcagtcaggggagatattccgccaggatgcgctgcttacggtttcgtttgcgatggcactaggttgctggttttcggtggaatggtggagtatggcaaatacagcaacgacctgtacgagctgcaggcttccaggtgggagtggaagcgcctgaaagccaagaccccaaaaaatgggccacctccatgccctaggctgggtcatagttttagccttgttggaaataaatgttatctgtttgggggtctggcaaacgactctgaggatccgaaaaacaatatcccccgctaccttaacgacctgtacatcctggaactgcgaccgggatccggcgttgtggcttgggacattcccattacctatggcgtgttgccacctcctcgggaaagtcatacagcggttgtgtacaccgagaaggacaacaaaaaatccaaactcgttatttacggcggaatgagtggctgtcgactgggcgacttgtggacactcgacattgacaccttaacttggaataaaccttccttgtccggggtggcccctttgccacggtctctgcattctgctaccaccattggcaacaaaatgtatgtgttcgggggatgggtgccacttgtcatggacgacgtcaaggtagccacacacgagaaagaatggaagtgcactaacacactggcctgcctgaatttagataccatggcttgggagacaattctaatggacacccttgaagacaacatccccagagctagggcaggccactgcgcagtagcaataaatacgagactgtatatttggtcgggacgggacggctatcgcaaagcatggaataaccaggtgtgctgtaaggacctgtggtatctggagaccgagaaacctccacctcccgcgagagtgcagctggtaagggcaaacactaacagtctcgaggtctcttggggtgcagtcgctacagctgattcatacctgctgcaactgcagaaatacgacattccggcaaccgctgcaaccgctacctcccccacacccaaccccgtgccttccgttcctgccaaccctcctaagtccccagcccctgcagctgcagcgccagctgtccaaccactaacacaagtcgggattactcttctgcctcaggccgcccccgcacctcccactacaacaacaatccaggtgttacccaccgtgcccggttccagcatcagcgtgcccactgccgctaggacacaaggagtaccagcagttctaaaggtcaccggcccgcaggctacaacggggacccctcttgttactatgagaccggccagtcaggcgggaaaggcccctgtcaccgtgacatccctccccgctggtgtcagaatggtggtacccactcagtctgcccagggtaccgtgatcggatcctctccccagatgtcaggcatggccgctttggccgccgccgccgctgcaacccagaagatccctccaagtagcgcccccaccgtgctttccgtccctgcaggcacaaccatcgtgaagacaatggcagttacacccgggaccaccacactaccagccacagtgaaagtagcatcaagtcccgttatggtgtcaaacccggccaccaggatgctaaaaacagccgcagcccaggtcggcacatcggtttctagcgccaccaacaccagcactcgtccaattattaccgtacataagagtggtactgtcacagtcgcacagcaggcccaggtggtcacgacagttgtcggtggagtcacaaagactattactctggtgaagagcccaatctccgttcccggaggctccgcactgattagcaatctcggcaaagtgatgtccgtggtccagactaagcccgtccaaacgtcagctgtgaccggtcaggcttccacaggccctgttacccagatcatacagaccaagggcccccttccagctggcacaatactgaaactggttacctccgccgacggcaaaccaaccaccatcatcaccaccacccaagcgagtggggctggcaccaaaccgacaatcctcggaatctcaagcgtttccccttctactaccaaaccgggtacaaccactattatcaaaactattccgatgtcagctattattacccaggcgggagcaaccggggtcacatcctccccgggaataaaaagtccaatcacaataatcaccaccaaagttatgacatcgggtacgggcgccccagcaaaaattattaccgccgtgcctaaaattgcaactggccatggacaacagggggtgacacaagtagtgctgaaaggcgcccccgggcagcccggcacaatcctacggactgtcccaatgggtggagttaggctggtgacacctgttaccgtgtctgcggttaagcctgccgtgacgaccctggttgtcaagggcaccaccggcgtcacaacacttggtacagtgaccggtaccgtttctacatctctggccggagcaggtggccacagcacctcagcttccctggccaccccgataacaaccctggggaccatcgcaacactgtctagccaggtcatcaatcctacagccatcacagtcagcgccgcccagacaactctcactgccgctggtggactgactacacccactataacgatgcagcctgtgagccaaccaacacaggtgaccctcataactgcaccctccggggtcgaagcccaacctgttcacgatctcccagtgtccatcctcgcatcgcctacaactgaacaacccaccgcaaccgtaaccatagcagattctggacaaggggatgtccagccaggaaccgtgacactggtgtgctcgaatccaccgtgtgagacacacgagactgggacaactaacacggccactaccaccgttgtagctaatttagggggccatccacagccgactcaggtgcaattcgtctgcgatcgccaggaagccgccgcatctctggtgacttccactgtcggtcagcagaacggtagtgtcgtgcgggtgtgttccaatcccccatgtgagacacacgagactggtaccacaaacaccgccaccaccgcaacaagcaatatggcaggccagcatggatgttccaaccctccctgtgaaacacacgagactggaaccaccaataccgctaccaccgcaatgtcgtccgtgggagctaaccaccagcgtgatgcacgccgggcgtgcgccgccggaacacctgcagtaattaggatttctgtggctacgggagctctcgaggctgcccagggaagtaaaagccagtgtcagaccaggcagacctctgccactagcacaaccatgaccgtgatggcaactggagcgccatgctccgctggaccgctgttgggaccaagcatggctagagaacccggggggcgcagtcctgcatttgtccagctggctcccttgtcctctaaggtgagactcagctccccctcaattaaggaccttcccgccggcagacattcacacgctgttagtacggctgctatgacccgcagttccgtgggagctggcgagccgagaatggcccctgtatgcgagtcgttgcagggtgggtccccatcgaccactgtgaccgtcaccgccctggaggctctgctgtgcccgagcgccaccgtgacccaggtgtgcagcaacccgccttgcgagactcatgagacaggcacaactaatacggctacaacaagcaatgcaggctccgcccagagagtctgctctaacccgccctgcgagactcatgagacaggaacaacgcacacggccaccactgctacctccaacggaggtactggccagcctgaaggaggccagcaaccccccgccgggcggccctgcgagacgcaccagactacctcaactggcacgaccatgagtgtgagtgtaggggccctactaccggacgccactagctcccacagaacagtcgaatccggtcttgaagtggcagccgctccatccgtcaccccacaggctggcaccgctctgctggctccattccctacgcaacgcgtgtgctctaaccccccttgtgaaactcacgagactggtacaactcacacagcaaccactgtcacatcaaacatgtcctcaaaccaagaccccccccctgctgcatcagaccagggcgaagtggaaagtacacagggagatagtgtgaatatcacatcatcttctgccatcaccaccaccgtgtcctccacgctgactagggctgttacaaccgtcacccagtccaccccagtcccaggcccctccgtaccaaaaattagctcgatgaccgagacagctcctagagccctgaccactgaagtcccaatacccgctaagattacagtaaccattgctaatacagagacgagtgacatgccattctcagccgtggatatcctgcagccgcctgaggaactgcaggtaagcccagggcctcgccagcagttgccaccccgacagcttcttcagtcagctagcacagcattaatgggagaaagcgccgaggtactctcagccagccaaacccctgaacttcccgcagcggttgatctgtcatcaaccggagagccctcctccggccaggagagtgctggctcagctgtggtggctaccgttgtcgtacagccccctcctcccacacagtctgaggtcgaccagctcagcctcccgcaagagttgatggcagaggcacaggccggaacaaccactctgatggtgactggtttaactccggaggaactcgctgtaactgccgccgcagaggctgccgctcaggccgcagccacggaagaggctcaggcactggcgatccaggctgtgctccaggcagctcaacaggcagtaatggcagggactggggaacctatggacacatcagaagcagctgcaacagtcacacaagcagagctgggacatctgtctgcagagggccaggagggtcaagcgacgaccattccaatcgtgctaactcagcaagagctggccgctctggtccagcaacagcaattgcaggaggcccaggcccagcagcagcaccaccatttgccaacagaggccctcgcacccgcggattcgttaaatgatcccgcaatcgagtccaattgtctgaacgagctcgctggaacagttccttccaccgtagcccttttgccctcaaccgcaaccgagagcttggcccctagtaacacctttgtggcccctcaacctgttgtcgtggccagtcctgccaaattacaggccgcggcgacactcaccgaggtggccaatggcatagaatctctgggcgtgaagcctgacctgcctcctcctccttcaaaagctccgatgaagaaggaaaaccagtggttcgatgtcggggtcatcaagggaacaaacgtgatggttacacattactttttgccccctgatgacgccgtgccatcggatgacgatctgggtacagtccccgattataatcagctgaagaagcaggaactgcagcccggtacggcatataaatttagggtcgctggtatcaatgcctgtggacgtgggcctttcagcgagattagcgcctttaaaacctgtcttccagggttcccaggcgcaccatgtgccatcaaaatctccaagagccctgatggcgcccatctaacctgggaaccccccagcgtgacttccgggaagatcatcgagtacagcgtgtacctggccatccagagttctcaagcgggaggcgaactcaagtcttctacccctgcgcagctcgcttttatgcgggtttattgcggccccagcccctcttgtctggtgcaatcaagcagcctcagtaatgcgcatatcgactacaccactaaacctgcaattatctttcgcattgccgcgagaaatgaaaaagggtacggacctgctactcaggttcggtggcttcaggaaacttctaaagactcaagcggaactaaaccggccaacaagagacctatgtctagccctgaaatgaaatcagctcccaagaaatctaaggccgacggacagtag

SEQ ID NO: 191002 - DNA, 1305 bp, Artificial Sequence
  Description of Artificial Sequence: Synthetic coding sequence
atggacagcgtggagaagggcgccgccaccagcgtgagcaacccccgcggtcgtccatcccggggaagaccaccaaaacttcaaagaaacagtaggggaggccagggccggggagtagagaaaccaccacacctcgctgccctgatccttgcacggggcggatccaagggcataccccttaagaatataaaacaccttgcaggggtgcccctcatcggatgggtgctgagggctgccttggactccggggctttccagtctgtgtgggtgagcactgaccacgatgagatcgaaaacgtcgctaaacagttcggggcccaggttcatcgcagatcttctgaggtgagtaaggatagctctacctcgctggatgctatcatcgagttccttaactaccataatgaagttgatatcgttggcaacatccaggccacaagcccctgcctgcatccaactgacctccaaaaggtagctgaaatgatcagggaagaagggtatgactccgttttctccgtcgttcgtcgtcatcagtttcggtggagcgagatccagaagggagtgagagaagtaaccgaacccctgaaccttaatcctgccaaacgcccccggagacaggactgggatggcgagctgtacgagaacggaagcttttactttgctaagcgccacttgattgaaatgggatacctgcagggtggaaaaatggcttactatgagatgagggcagagcacagtgtggacatcgacgtagatatagattggccaattgccgagcagcgggtgcttcgatatggttattttgggaaggaaaagttgaaggaaattaagttactggtgtgtaatatcgatgggtgtttgactaacggccacatctatgtgagtggcgaccagaaggagatcatttcttatgacgttaaagacgcgataggcatatctttacttaaaaagagtgggattgaggtgcgcctcatctccgagagagcctgctctaagcagactctttccagcctgaagctcgattgtaaaatggaggtgagtgtgtccgataaactcgcggtggttgatgagtggagaaaggaaatgggcctgtgctggaaagaggtagcgtatctaggaaacgaggtatctgacgaagaatgcctaaaaagggttggactttccggggcacccgcagatgcctgctccacagcacagaaagccgtgggctatatctgcaagtgtaacggcgggagaggcgccatccgcgagttcgcagagcacatctgcctgctcatggagaaagttaacaattcctgccaaaaatag

SEQ ID NO: 191003 - DNA, 507 bp, Artificial Sequence
  Description of Artificial Sequence: Synthetic coding sequence
atggccttcaacgactgcttcagcctgaactaccccggcaacccctgccctggcgatcttattgaggtgttcagacccggataccaacattgggctctgtacctcggcgatggatacgtcatcaacatcgcacccgtagacggtattcccgcgagctttacatcggctaagtccgtgttttccagtaaggctctggtcaagatgcagttactgaaagatgtggtcggcaacgacacataccgaattaataacaagtatgacgagacatatcctcctctgcccgttgaagaaattataaaacggagcgaattcgtgattggacaagaggtggcctataacctgctggtcaacaactgcgagcactttgtcaccctgttgaggtacggagagggcgtgtcggaacaagctaacagagctatcagtaccgttgaatttgttaccgccgcagtgggcgtcttttcattcttgggcctcttccccaagggccagagggcgaagtactactag

SEQ ID NO: 191004 - DNA, 489 bp, Artificial Sequence
  Description of Artificial Sequence: Synthetic coding sequence
atggccctggcccggccccggccccggctgggcgacctgatcgagatctctagattcggctacgcccactgggctatttacgtgggagacggctatgtagtccatttagcacctgcgtccgagatcgccggcgctggcgccgcgtccgtgctttccgcattaactaataaagctattgtcaaaaaagagctgctttcggtggtcgctggaggcgacaactatcgagtgaataacaaacacgacgaccgatatacccctctgccgtccaacaagattgtgaagcgtgcggaagagttggtcggccaagagctaccttactccctgacttcggataactgcgagcacttcgtgaatcacctgcgctatggcgtgtcccggtcagaccaggtgacaggggctgtgaccacggtcggggtggccgcagggctgcttgcagccgctagtctggtgggcattcttctcgcccggagtaaacgcgaacggcagtag

SEQ ID NO: 191005 - DNA, 1023 bp, Artificial Sequence
  Description of Artificial Sequence: Synthetic coding sequence
atgaaggaggaccaggtggtggccgaggagcccggcttccaggacgaggaagagagcttgtttcaggatatcgaccttctgcaaaaacacggcattaacgtggccgacatcaagaagctgaagagtgtggggatatgcactattaagggaattcagatgactacgcgtcgcgccttgtgtaatgttaagggcctctctgaggcaaaagtcgacaaaataaaagaggccgcaaacaagctgattgagccagggttcctgacagcctttgagtacagtgagaaaaggaagatggtcttccacattacaactggtagccaggaattcgacaaactcttggggggcggcattgagagtatggcgatcacagaagccttcggtgaatttcgaaccgggaaaactcaattgtctcacacactctgcgtaacagcccagctgcctggcgccgggggctacccgggcggaaaaatcatattcatcgacacagagaacacattccggcccgaccgcctgcgcgacatcgccgatcgattcaatgtggatcatgacgccgttctagacaacgtcctgtatgcccgagcatatacaagcgagcaccagatggagctccttgattacgtggcagccaagtttcatgaggaggctggaatctttaagctccttataattgactctataatggccctgttcagggtcgactttagcggcaggggggagctggctgaacgtcaacaaaaactagcccagatgttgagtcgcctccaaaaaattagcgaggagtacaacgtggccgtgttcgtcaccaaccagatgaccgccgatccgggagcaactatgacattccaggctgatcccaaaaaacccattgggggccacatcctggcacacgcaagtaccactaggatttccctgaggaagggccgcggagaactgcgtatcgccaagatctatgacagcccggaaatgcccgagaatgaggctacattcgcaattaccgccggcggcattggcgatgctaaggaatag

SEQ ID NO: 191006 - DNA, 1080 bp, Artificial Sequence
  Description of Artificial Sequence: Synthetic coding sequence
atgagcgacgagggcagccggggcagccggctgcccctggccctgccgccagcttctcagggttgcagttctggaggcggcggggggggcagtagtgccgggggctccggaaacagcaggccacccaggaatctgcagggccttctccagatggcaatcactgctggtagcgaagaacccgaccctccccccgaacctatgagtgaagaacgcagacaatggcttcaggaagccatgtctgcggctttccggggacagcgagaagaagtagagcagatgaagagctgcttgcgcgtcctgtctcagcccatgccccctaccgccggcgaagccgagcaagccgccgatcagcaggagcgggaaggggcccttgagctcctggccgacctgtgcgagaacatggacaacgcagccgacttctgccagctgagcggcatgcacctcctggtgggccgctatcttgaggctggtgccgccgggctgaggtggagagcagcccagcttatcgggacctgcagccagaacgttgcggcaattcaagaacaagtgctgggactaggcgccctgcggaaacttctccgtctactggacagagacgcctgtgacaccgtgagggtcaaggccctgtttgcgatttcatgtttagtccgggagcaggaagcaggcctcctccagttcctgaggctggatggattttcagtgctgatgcgggcaatgcagcagcaagtgcagaagctgaaagtgaaaagtgcctttctgctacagaacctgcttgtgggccaccctgaacacaagggcactttatgttcgatggggatggtgcagcagctggtggcgttggtgcgaaccgagcactccccatttcacgagcatgtgctgggcgcattatgttctctcgttactgattttccacaaggggtgcgcgagtgcagagaacccgaactagggctggaagaactactgcggcatcggtgccagctgctgcagcagcacgaggagtatcaggaggagctggagttctgcgagaagctgctgcagacatgtttcagcagccccgcggatgactcaatggacaggtag

SEQ ID NO: 191007 - DNA, 774 bp, Artificial Sequence
  Description of Artificial Sequence: Synthetic coding sequence
atgagcgacgagggcagccggggcagccggctgcccctggccctgccccccgcatcccagggctgttcttcaggtggcggggggggaggatccagcgccggcggaagcggaaattcccggccacccaggaacttacagggcctgcttcagatggccatcaccgcagggtccgaggagcccgaccctccccctgagccgatgtccgaagaaaggcgccagtggctgcaagaggctatgtctgctgctttcagaggccagcgggaagaggtggaacagatgaaatcctgcctgagagtactgtctcaacccatgcctccaaccgccggtgaagctgagcaggctgctgaccagcaggaacgtgagggcgctctggagctgctggctgatctgtgcgagaacatggacaatgcagctgatttttgccaattaagcggtatgcacctgcttgtggggagatacctggaagccggggctgccggtcttcgctggagggccgctcagctcatcggcacatgtagtcagaacgtcgcagcaattcaggagcaagtcctgggcctgggggctcttcgcaagctgctacgccttctggatagggatgcctgtgatacaggagtgcgggagtgccgagaacctgaacttggcttggaagaacttctcagacatagatgccaactactgcaacaacacgaggagtaccaggaagagctagagttttgcgagaagctgttgcagacttgtttctcttcgccggccgacgatagtatggaccgatag

SEQ ID NO: 191008 - DNA, 1080 bp, Artificial Sequence
  Description of Artificial Sequence: Synthetic coding sequence
atgagcgacgagggcagccggggcagccggctgcccctggccctgccacccgcatctcagggatgctcatcaggtggaggcggaggaggttcaagcgctggaggctccggaaatagcaggcccccccgcaatttgcagggactactccagatggctattaccgccggctcagaagagcctgatcctcctccggagccaatgtccgaggagcgcaggcagtggctccaagaggcaatgtccgccgcctttcgcggccagagggaggaggtggagcagatgaaatcttgtttgcgcgtgcttagccagcccatgccaccaactgcaggtgaagcagagcaggcagccgaccagcaggagcgggagggggcactggaactcctggccgacttgtgtgaaaacatggataatgccgctgatttctgccagctctctgggatgcatctgctggtaggtcgatacctggaggccggagccgctggcctaaggtggcgggcagcacaattaattgggacttgtagccaaaacgttgctgctatccaggagcaagtgctgggcttgggcgccctccgaaagctgttacgcctgctggaccgcgatgcgtgtgatacagtcagggtaaaagctctattcgctatatcttgtttggtcagagaacaagaagccgggctgcttcagttcctgagacttgatggcttctcagtgttgatgcgtgcaatgcagcagcaggtccaaaaactgaaagtgaagagcgcattcctcctgcagaatctcctggtcggacaccccgagcataaggggaccttgtgttctatgggcatggtgcagcagctggtggctttagtcaggacagagcactccccattccatgaacatgtgctgggcgccctgtgtagcctggtgaccgactttcctcagggagtccgagagtgtcgcgagccggagttgggcctcgaggagctgctgcgccacaggtgtcaactgctccagcagcacgaagaataccaggaagaattggagttttgcgaaaagttgttgcagacatgcttctcgagccctgcagacgatagcatggatcggtag

SEQ ID NO: 191009 - DNA, 1443 bp, Artificial Sequence
  Description of Artificial Sequence: Synthetic coding sequence
atgcagatcccccgggccgccctgctgcccctgctgctgctgctgctggcagctcctgctagtgcgcagcttagtcgagccgggagatcagcacctctggccgcagggtgtcccgatagatgcgagccagcacgatgcccaccacagccagaacactgtgaaggcgggcgagcccgggacgcctgcgggtgttgtgaagtctgtggcgcaccggaaggcgccgcatgtggactacaggagggaccttgtggcgagggactgcagtgtgttgtccctttcggagtaccagcatccgcaactgtgcgacggagagcgcaggccgggctgtgtgtttgtgcgtcttctgaaccggtttgtggatctgacgcgaacacttacgcaaacctctgccagctcagagccgcctccagacgatcagaaagactccaccggccacctgttatagtcctgcagcgaggcgcatgcggacagggccaagaggatccaaatagcctgagacataaatacaatttcattgcagacgttgtggagaaaatcgcaccagctgtcgtgcatatcgagctgttcaggaagctgcccttctccaaacgagaagtgccagtggccagcgggagcggcttcattgtcagcgaggacggtttgattgtgaccaatgcccacgttgtgacgaacaagcaccgggtaaaggtggaactgaagaacggcgccacctatgaggcaaagattaaggatgtagatgagaaagccgatattgctcttattaagattgaccatcagggcaagttgccagtgctcttactggggcgctcatcggaactgcgcccgggggagtttgtagtcgccataggaagccccttctctttacagaacacagtgacaaccgggattgtttccacaacccagcggggtgggaaggagctgggactaagaaactccgatatggattatatccagaccgatgcgattatcaattacggaaattctggcggaccactcgttaatctggatggggaagtgatcgggattaacactttaaaggtgactgctggcatttcgttcgctatccccagtgataaaatcaagaagttcctgacggagagccatgataggcaggcaaagggtaaggccatcactaagaaaaagtacatcggcattcgaatgatgtccctcacctcatcaaaggccaaggagctaaaggataggcaccgcgacttccctgacgtcattagcggcgcatacattatagaagtcatcccagacacaccagccgaggcaggcggcctgaaggagaatgacgttatcatttccattaacggtcagagtgtggtgtctgctaacgatgtaagcgacgttatcaaacgagaatcgaccctaaatatggtcgtgcgccgagggaacgaggatatcatgatcaccgttatccccgaagagattgacccctag

SEQ ID NO: 191010 - DNA, 666 bp, Artificial Sequence
  Description of Artificial Sequence: Synthetic coding sequence
ggcaagctgcccgtgctgctgctgggccggagcagcgagctgcggcccggtgaattcgtagttgctatcggctccccattctcactgcaaaataccgttacgacaggcattgtgtcgactacccagaggggcgggaaggagctcgggctacggaattctgacatggactatatccagaccgacgcaattatcaactatggaaacagtggggggcctttggtgaacctagacggtgaagtcattggcataaacactctaaaagtgaccgctggcatatccttcgcgatcccctctgacaagattaaaaagttcctcaccgaatctcacgaccgtcaggctaaaggcaaagctattaccaaaaaaaagtatatcggtattcgtatgatgagcctaacctcttctaaagcaaaagagttgaaggaccgtcaccgcgattttcctgatgtaattagcggggcttacatcattgaagtgattcccgatactcccgcagaagcggggggccttaaggagaacgacgttattatatctattaacggacagagtgtagtgagtgctaacgacgtcagcgatgtgatcaagagagagagcactctgaacatggtcgtccggcggggcaacgaggatataatgatcacagtcattcccgaagagatagacccctag

SEQ ID NO: 191011 - DNA, 1344 bp, Artificial Sequence
  Description of Artificial Sequence: Synthetic coding sequence
atgggctgggccgcccggccccgggccctggcccccgccgcccccgaggccttgttgcacagcccaagaaggagatcacccgcattagcacttagcgcagctacagcagctgcggctcgcggacccgggcgagtacgccttctgcgtggcgtccggcgggctcgcgggcgcagagtgcgcccagcaggggggcctgttcggaggggcgccgcagtgcggggggcactgcggggagcttctctaggccatggcgccgccgcccgcgcagggagacccctgtgcgtcagacagcaactccgggcagcatcgcggcgaagcgaacgtctgcataggccgccagtaatcgtgctccagagaggagcctgcgggcaggggcaagaggacccaaacagtctcaggcataagtataattttattgccgacgttgtggagaaaatcgcccccgctgttgtacatatcgaactctttcggaagctgcctttttctaagcgggaggttcctgttgcctccggcagtggatttatcgtcagcgaggatggccttatcgttacgaacgcccacgttgtcaccaacaagcatcgtgtaaaggtggaactgaagaatggagccacctacgaggctaagattaaggatgtggatgaaaaggcagatattgcccttattaagatcgaccatcagggaaaactcccagtgttactgctcgggcgctcctcagagctcaggcctggagagttcgtggttgcaattgggtcacctttttcactccagaacacagttactactggaattgtctcgaccacgcaacggggcgggaaggaactggggctccggaactctgatatggattatatccagactgacgccattattaattacggtaattccggggggccgctggtgaatctggatggcgaagtgatcggcattaacacgctgaaagtgacggctggcatatccttcgccatccctagcgacaaaattaaaaagtttttgaccgaaagccatgacaggcaagctaaaggtaaggctataaccaagaaaaaatatataggtataagaatgatgtcacttacaagttccaaggctaaagagctaaaagaccggcatcgcgactttcccgatgtgatttcaggggcatatatcatcgaagtgattccagacaccccagccgaagctggcggacttaaggagaacgacgtgatcattagtatcaacggccagagcgtggtttctgccaatgatgtttctgacgttataaaaagggagtccaccctgaacatggtcgtgcgcagaggcaacgaggacattatgatcacagttattccagaagaaatcgacccatag

SEQ ID NO: 191012 - DNA, 1377 bp, Artificial Sequence
  Description of Artificial Sequence: Synthetic coding sequence
atggccgccccccgggccggccggggcgccggctggagcctgcgggcttggagggctctggggggaatccgctggggtcggaggcctaggttaactcccgatctgagagccctgctcacaagcggcaccagtgacccccgagccagagtgacctatggcacccccagcttatgggcccggctctccgtgggtgttaccgagcctcgagcctgcctgacctccggcacgcctggcccccgcgcccagctgactgcagtcactcctgacacccgcacccgtgaggcctcagaaaattctggtaccagatccagggcttggctggccgtggctctgggagccggcggagcagtgctgctcctcctttgggggggagggaggggcccacctgccgtgttggcggcagtcccgagtccaccgcctgccagtccacgctctcaatataatttcatcgcggatgtcgttgagaaaacggctccggcggtggtctacatcgagatcctggatcgccatccttttttgggcagagaggtgcctattagcaatgggagcggattcgtggtggcagccgacggcctgatcgttactaacgctcacgtcgtggccgacaggagacgggtcagggtgcgacttctgtctggggatacttacgaagcagttgttacagcagtggacccagtcgccgatatcgccactctaagaattcaaaccaaagaacccctcccgactctcccattgggacgcagcgctgacgtccggcagggcgaatttgttgtggccatgggtagccctttcgctctgcagaacaccataacgtccgggatcgtgagtagcgcacaacgccccgcccgagaccttggccttccccagaccaacgtggaatatatacagacggacgcagcaatcgacttcgggaactccggaggaccactggtgaacctagacggcgaggttatcggcgtgaatactatgaaagttaccgccgggatttccttcgcaatacctagcgatcggctgagagaattcctacacagaggagaaaaaaagaatagtagtagcggcattagtgggagccagaggcgctacattggtgttatgatgctgacgctgtccccatccatcctcgctgaattgcagcttcgcgagccaagctttccagacgtacagcatggcgtattaattcataaggtcattctggggtccccggctcaccgagccggtttacggcctggagacgtcatcctcgctattggagagcagatggttcagaacgccgaagatgtgtacgaagctgtgagaactcagagccaactggcagtccagataagacgcggcagagagacactgaccctgtatgtgaccccagaagttacggaatag

SEQ ID NO: 191013 - DNA, 1086 bp, Artificial Sequence
  Description of Artificial Sequence: Synthetic coding sequence
atggccgccccccgggccggccggggcgccggctggagcctgcgggcctggcgggctttaggggggatcagatggggccggcgcccacgtctgactcccgacctgcgcgccctgctcacttctggcaccagcgaccctcgggctcgggtaacatatggaactccttcactttgggcaagactttcagttggcgtcaccgaaccgagagcctgcttaactagtgggacccccggaccaagggcacagttgaccgccgtcaccccagatacccgcacccgggaagctagcgaaaatagtgggactagatcaagggcttggctggcggtagcccttggcgccgggggcgcggtcctcctgcttctttggggtggcggacgcggacctcctgcagtcctggctgctgtccccagcccgcccccagcttctccccgctcgcagtacaacttcatcgccgatgtggtcgaaaagaccgcgccagctgtggtatatattgagattctcgatcggcacccctttctgggccgcgaagtcccaatttccaatggcagcggcttcgttgtcgctgctgatggtctgatagtgaccaacgcccacgtggtggcggatcgcaggcgcgtcagggttagactcctttcaggtgacacctatgaggccgtcgttaccgcagtagaccctgtggctgatattgctactcttcgaatacagactaagttcggaaacagtggcggacctctagtaaacctggacggtgaggtaatcggagtgaacaccatgaaagttaccgccggcataagcttcgctatcccttcagaccgcctgcgtgaatttttacaccggggcgagaaaaagaatagcagctcggggatttctggcagtcaaagacggtatatcggcgtcatgatgctcactctgagtccgagagcaggcctgcgccctggtgacgtgatcctcgctatcggcgagcagatggtccagaacgctgaagacgtgtatgaggcggtccggacacagtcccaactggcggtgcagatacgcaggggccgggaaactctgacgctgtatgttacacctgaggtgacagaatag

SEQ ID NO: 191014 - DNA, 1362 bp, Artificial Sequence
  Description of Artificial Sequence: Synthetic coding sequence
atgcaggcccgggccctgctgctggccgccctggccgccctggccctcgcccgggagcctccagcggcaccatgccctgcaagatgtgatgtaagccgatgtccatcgccccgatgtccaggcgggtatgtgccagatctgtgcaactgttgtcttgtctgcgccgcttcggaaggcgaaccatgtgggggacctctcgactctccttgtggggaaagtctcgagtgtgtgcgtgggctgtgtaggtgccggtggagccacgccgtttgcggaaccgacgggcacacttatgcaaacgtgtgcgctttgcaggcagcgagtcggagggcattgcagctatcaggcacccctgtcaggcaactgcagaagggggcgtgccctctcggacttcaccaactgtcaagccccaggtataagttcaacttcatcgcagatgtggtggaaaaaatcgcccccgcagtcgtacatattgaactcttcctgcgacaccccctcttcggtaggaacgtgcccctctcctccggctcagggtttatcatgagtgaggctgggttgattatcacaaacgcccacgtggtgagttcaaattccgccgcccccggaagacagcagctgaaggtgcagctgcagaacggcgactcgtatgaggccaccattaaagatattgataaaaagagcgatattgcaacgattaagatccacccaaagaagaagctacctgtcttgctcctgggtcattctgctgaccttagaccaggcgagttcgtagtcgccatcggtagccccttcgcactccagaataccgtgacaacaggcatagtgagtacggcccaaagggagggcagagagctgggattgcgagacagtgatatggattacattcaaaccgatgctataattaactatggaaactcaggcggcccgctggtgaacctggatggagaagtgatcggcatcaataccctcaaggtgactgccggaattagcttcgccatcccatccgatagaatcacaaggtttcttaccgagttccaggacaagcaaataaaggattggaagaaaagatttataggcatccggatgagaaccatcacaccttcccttgttgacgaactgaaggctagcaaccctgattttccagaggtcagcagcggaatctacgtccaggaggtggccccgaatagcccctcacaacggggcgggatacaggatggagatatcatagtgaaggttaacggacgccccctggtggacagtagcgagcttcaggaggccgtgcttacagagtctccactgctgctggaggttagacggggcaacgacgacctccttttctctatagcccccgaggtagtaatgtag

SEQ ID NO: 191015 - DNA, 1431 bp, Artificial Sequence
  Description of Artificial Sequence: Synthetic coding sequence
atgatccggccccagctgcggaccgccggcctgggccggtgcctgctgcctggcctccttttacttctggtccccgtgttgtgggcaggggccgaaaagctgcacacacaacccagctgcccagctgtgtgccagccgaccaggtgccccgccttacccacctgcgcacttggaacaaccccagtgtttgacctttgtagatgctgtagggtttgcccagccgcggagcgcgaggtctgtggaggtgcacagggccagccatgtgctcctggattgcagtgtttgcagcctctgcggccgggcttcccgagtacttgcgggtgccccaccctagggggtgctgtgtgtggcagtgataggagaacttatcccagcatgtgtgcgcttagggcagaaaatcgcgctgccagacggctaggcaaggttccagcagtgcccgtgcagtgggggaattgcggtgacacaggaactagaagtgctggacccttgagaagaaactacaacttcatagctgcagttgtggagaaggtcgctccaagcgtcgtccatgttcagctctggggccggctcctgcacgggtcccgtttggtacctgtttatagcggtagcggcttcatagtctctgaagacgggttaataataaccaatgcacatgtcgttcgaaatcagcagtggatagaggtcgtgttgcagaacggtgctagatacgaggccgtagtgaaggatatcgatctgaaactcgacctggcagtcatcaagattgagtccaacgcagagctgcctgtccttatgctcggcagatccagtgacctacgggccggagagttcgttgtggcccttgggagccccttctccctccaaaacacagctactgccggcattgtgagtacgaaacagcgcggcggaaaggaactaggtatgaaggattccgatatggactatgtgcaaattgatgctacaatcaactatggtaactctggcggtcctttagtaaaccttgacggtgacgtaattggggtgaacagcctgagggtgacggatggtattagcttcgccatcccatccgaccgggtgagacagtttttagccgaatatcacgaacaccagatgaaaggaaaggctttctccaataagaagtatcttggcctgcagatgctgtccctgacggttcccctgtcagaggaactcaagatgcactatcccgactttccagatgtgtcttcaggcgtgtacgtgtgtaaggtggttgagggaacagcagcacagtcatctggcctccgcgaccatgacgtgatcgtcaatatcaacgggaagcccattaccacaacaacagacgtggtcaaggccctagatagcgactccctaagcatggccgtattacgaggaaaagataatctgctccttacagtgattcccgagacaataaattag

SEQ ID NO: 191016 - DNA, 8157 bp, Artificial Sequence
  Description of Artificial Sequence: Synthetic coding sequence
atgccccggaccaagcagatccacccccggaacctgcgggacaagattgaagaggctcagaaggagcttaatggggcggaggttagcaaaaaggagattctgcaagctggcgtgaaagggacaagcgagagcctcaagggagtgaaaagaaaaaagatagtggccgagaaccatttgaaaaagatccccaaatctccactgcgaaacccgctgcaagccaaacacaagcagaacactgaggaatccagttttgccgtgctccactcagctagcgagtctcataaaaaacagaattacattcctgtcaaaaacggaaagcagtttacaaagcagaacggtgagacaccaggcattatcgctgaagccagcaaatctgaagaatcagtgagccctaaaaaaccactgttcttacagcagccatcggagctgaggaggtggagatctgagggagcagatccagccaagttctctgatctggatgaacaatgcgactcctcctccctcagctctaagaccagaactgataactcagagtgcataagctcccactgcgggaccaccagcccaagctatacaaacaccgcctttgatgtgctgctgaaggctatggaaccagaactgtcgacgttgagtcagaagggctccccatgtgctataaaaacagaaaaattgaggcccaataagacagcgaggagccccccgaagctgaaaaactcctctatggatgcccccaaccagaccagtcaggagctcgtggccgaaagccagtcaagttgtacgtcatacactgtacacatgtcggccgcacagaagaacgaacagggcgctatgcagtcagcctcccacctgtaccaccagcatgagcatttcgtccctaagagcaaccagcacaatcagcagctcccgggatgtagtggtttcacaggtagcctgaccaatctgcaaaatcaggaaaatgctaagcttgagcaagtatacaacatcgccgttacttccagtgtcgggctgaccagtccatcgtcccggtcccaggtaaccccacagaaccagcaaatggacagcgccagccccctgtccatttcacctgccaattctacacagtctccacccatgcctatatacaattcaacgcacgtcgcatcggtggtaaaccagagcgtggagcaaatgtgtaacctccttctgaaggatcagaagcctaagaagcaaggcaaatacatctgcgaatactgcaatcgcgcttgcgctaagccatccgtcctgctaaagcacatacgttcccacaccggtgagagaccctatccctgtgtaacttgtggattctctttcaaaaccaaaagcaacctgtataaacacaagaagtcgcacgctcacacaatcaagctggggttagtgttacaacccgacgcggggggcctttttctttctcacgagtcccccaaagccctttccatacacagcgacgtggaagactcaggggagagcgaggaggaaggtgccacggacgagcggcaacatgacctgggggcaatggaactgcaacctgttcacataatcaaacgcatgtccaatgcggagaccctattgaagtcttccttcacaccctcctcaccagaaaacgtgatcggcgacttcctgctgcaggacaggtcagcagagagccaagctgttacagagcttccaaaggtagtggtgcaccatgtgaccgtgtcccccctcaggactgacagccctaaggctatggatcccaaacctgaactctcaagtgcccagaagcaaaaggatctccaagtcactaacgtgcagcctcttagcgctaatatgagccagggaggcgtatcacggctcgagacgaatgaaaattctcatcagaaaggagatatgaatcccttagagggcaaacaggactcccatgtgggcacagtccacgctcagctgcagcgacagcaggctaccgattactctcaagagcaacagggcaaactgctgtctcctcgctcattgggcagcacagatagcggctatttctccagaagcgagtcagcagatcaaactgtttctccaccaaccccattcgccagacgccttccaagcaccgagcaggactccggcagatctaatgggccgtctgccgccctggtgaccactagcacgccatctgctttacccactggtgagaaagcccttcttttacccggccaaatgcgaccaccgctagcaacaaagactcttgaggagagaatctccaagctgatatctgacaacgaagccctcgtcgatgataaacagctggattctgtgaagccgcgacgcacatccctttctcgtagaggcagtatagacagcccgaagtcctacattttcaaagacagttttcagtttgacctcaagccagtcgggcgaagaaccagctcctctagcgatattcccaagagtccgtttactcctaccgaaaagtcgaagcaggtattcctgctctccgtaccatcattggactgtttacccattacccggtcaaatagcatgccaacaaccggatatagtgctgttcccgccaatatcatcccaccacctcatccgctgcgcggcagccagtccttcgacgataagatcgggactttttatgatgatgtctttgtttcagggccaaacgctccagttccccagtcaggccatccccgcactcttgtgcggcaggccgcaatcgaagactcctcagccaacgagtctcacgtgctaggtaccggccagtcgctcgacgagtcacatcaggggtgccacgccgcaggtgaggctatgtcagtgcgaagcaaggcactggctcaagggccacacattgagaaaaaaaagtcacaccagggtcgtggaaccatgttcgaatgcgagacctgtagaaatcgttacagaaagttagagaactttgagaaccacaaaaaattctactgttcagaactgcatggtcctaaaacgaaggtggccatgagagaacccgaacattctcctgtccctggcggactgcagccacagattctccactaccgcgtggccggatcgagcgggatatgggagcagacgccgcagatacgcaagcgccgaaaaatgaagagcgtaggggatgatgaggaattgcagcagaacgagtccggcaccagcccgaagtcttctgaagggctgcaattccagaatgccctgggatgcaatccctctcttccaaagcataacgtcaccattcgttccgatcagcagcataagaatatccagttacagaatagccatattcatctggtggcgcgcggcccggagcagacaatggaccccaagctgtcaaccataatggagcagcagatctctagtgccgctcaggacaagattgagctgcagcgacacggcacaggcattagcgtcattcagcacaccaatagcctttctaggcctaactccttcgataagcctgaaccattcgaacgagcatccccagtgtccttccaggagctcaatcgaacgggcaagtcaggttctctgaaggttatcggaatttcccaggaggaatcccaccccagccgggacggtagccacccccatcagctggcactgagcgacgccctgaggggcgagctgcaggaaagttctagaaaatcaccatcggaaagacatgttttggggcagccttctcggctcgtcaggcagcacaatatacaagtcccagagattctggtgacagaagaacctgaccgggatcttgaggcacagtgtcacgaccaggaaaaaagcgagaagtttagttggcctcagagatccgagactttgagtaagctcccaactgaaaagcttccaccgaagaaaaagcggctgaggctagccgagattgagcacagctcaaccgaatcatccttcgattcaacacttagccgatctctttctagagagtcctcactgagtcatacttccagcttttctgcctcactggacatagaggatgttagcaagactgaagcctcaccaaaaatagactttttgaacaaagccgagttcctcatgatcccggcaggcctcaatacccttaatgtccctggatgccaccgggagatgcggcggaccgcatcggagcagataaactgtacacaaacttctatggaagtctcagatctgaggtctaagtcctttgattgtgggtccattacccctccccagaccacccctcttacagagctgcagcccccttcgagtccttccagggtgggggttactggacatgtgccccttttggaacgacggcgcggccccctggtacgtcagatttcccttaacattgccccggattcacacctgagtcccgtccaccctactagctttcagaacacggccttgccatccgttaatgccgtcccatatcagggcccgcaactaacttctacctctctggctgagtttagtgctaacactttgcacagccagacccaggtgaaggacctgcaggctgagacctctaacagcagttccactaacgtctttcccgtacagcaactgtgtgatatcaacctactgaatcaaattcatgctccgccttctcaccagtctacccagctgagtctgcaggttagtacccaaggctccaaacctgataagaattcagtgctgtcgggatcatcaaagtcagaggactgttttgcgcctaaataccaactccactgtcaggtttttacatccggcccatcctgttcttccaaccctgttcattcacttcccaatcaagtcatcagcgacccagtcggaacagatcactgcgtcacatctgctaccctgcctaccaagctgatcgactccatgtctaatagccatcccctccttccacccgagctccggcccctgggatctcaggttcaaaaggtgccaagttcttttatgctgccaatcagacttcaatcaagcgtcccagcatactgctttgcgaccctgacctcattaccacagatccttgtcacccaggacctaccgaatcagcctatttgtcagaccaatcactccgtggtgcctatttccgaggagcagaacagcgtccctacattacagaagggccaccagaacgcactgcctaatcctgagaaagaattcctatgtgagaacgtattctctgaaatgagccagaattcttccctctctgagagcctccctataactcagaagatttccgtaggaaggctatcacctcagcaagagagcagtgcatcctcaaagcgaatgcttagtcctgccaactccttggacattgctatggagaagcatcagaagcgtgctaaggatgagaatggcgccgtgtgcgcaaccgacgtgagaccactcgaggcactctcctctagggtcaatgaagcctcaaagcagaaaaaacctatcctggtgcgccaggtgtgcactacggagcccttagatggcgttatgttagagaaggacgtctttagccagcccgaaattagcaacgaggccgtgaatcttactaacgtgctcccggccgataacagttctaccgggtgttctaaatttgtcgtgattgaacctatctctgaacttcaggaattcgagaatattaagtcaagcacctccttgactctgaccgtcagaagcagccccgctccttcggagaatacacatatctcacccctgaaatgcactgacaataaccaagagcggaaatctcccggggtgaaaaatcaaggagacaaagtcaacatacaggagcagtctcagcagcctgtaacatccttgtctctgtttaacattaaagacactcagcagctggcctttccctccctcaagactactactaattttacttggtgctacctgctgcggcagaaatcactgcaccttccccagaaggatcaaaaaacctccgcatatacagactggaccgtatctgcaagcaatccaaacccactaggcttgccgacgaaggttgctctggctcttctgaattcaaaacagaacaccgggaagagtttgtattgtcaggcaataacgactcattctaaatcggacctacttgtgtacagcagcaagtggaagagctctttgtcaaaacgggccctcggtaaccagaagtcaacagtggtggaattctcgaacaaggacgcatctgaaataaactcggagcaggataaagaaaattccctcattaaaagcgaaccacgacggattaaaattttcgatggcgggtataagagtaatgaagagtacgtgtatgtgcgcggcaggggacggggaaagtacatctgtgaagaatgtgggattcgatgcaaaaaaccatccatgctgaaaaagcatattcgcactcataccgatgtccggccctaccattgtacttattgcaatttcagttttaaaaccaagggtaacctgacgaaacacatgaagtctaaggcccacagcaaaaagtgcgtcgacctgggagtgtctgtgggtctgatagatgaacaggatacagaggaatcagatgagaaacaacggttctcgtatgaaaggagtgggtacgatctggaggagagtgacgggccagatgaagacgataatgagaacgaagacgacgacgaggattctcaggcggagtcagttctgtcagccactcccagtgtgaccgctagtccacaacacctgcctagccgtagctctctccaggacccagtgagcactgatgaagatgtcagaataaccgactgtttttccggcgtgcatactgatccaatggacgtgttgccccgggcgctgctgaccagaatgaccgttttgagcaccgctcaatccgactataacaggaaaaccctgtctccgggcaaggcaagacaaagggctgcaagagacgagaacgacacaattcccagtgtggatactagccgatctccttgccatcagatgtctgtggactacccagagtctgaagagatcctgcgctcctcaatggccgggaaggccgtcgcaattactcagagtccgagtagtgtgcgcctgcctcctgcggccgcagagcacagcccccagacagctgctggaatgccttctgtcgcgtccccacaccccgacccacaggaacagaagcagcaaatcacactacagcctactcccggtctgccctccccacacacccacctgttttcgcatctccccctgcattcccaacagcagtctagaactccctataacatggttccggtgggaggaatccacgtggttccagccgggctgacgtattctacattcgtccctttgcaggccgggcctgtccaattgactataccagctgtgagtgtagtgcatagaacccttggcacccaccgcaacacagttaccgaggttagtggaaccactaaccccgccggggtcgcagaattatcttcagtggttccgtgcatacccattggacagatacgtgttcccgggctgcagaatctgagcacgcccggattacaatccctgccttctctgtctatggaaacagtcaatattgttggtcttgctaacactaacatggctcctcaggtgcacccaccaggcctcgccctgaatgccgttggtctgcaagtcctgacagccaatcccagctctcaaagttcccccgcgcctcaggcccacatcccgggcctgcagattttgaatatcgctctcccaacactaattccctctgtgagtcaggtggcggtggacgcgcagggtgcccccgagatgcccgcatcacagagcaaggcatgtgaaacacaacccaaacagacctccgtggcttctgcaaaccaggtatccagaaccgaatcgccccagggcctcccgacggtacaaagagagaacgctaagaaagttctgaacccaccagcaccggctggagaccatgccagactggatggactctctaagatggatacggagaaggccgcttccgctaaccacgtgaagcccaagcctgagctgacctccatacagggacagcccgctagcactagccaaccactactgaaggcccacagcgaagtatttactaagccctcaggccagcagactctctctcctgaccggcaggtgcctcgaccaaccgctctgccccggagacaaccaacagtccatttctctgatgtctccagcgatgatgatgaggatcgtctggtgattgcaacttag

SEQ ID NO: 191017 - DNA, 387 bp, Artificial Sequence
  Description of Artificial Sequence: Synthetic coding sequence
atgccccggaccaagcagatccacccccggaacctgcgggacaagatcgaagaggctcagaaagagctaaacggtgcggaagttagtaagaaggaaatcttgcaggccggtgtgaagggcacaagcgagtctctgaagggggtaaaacgcaaaaagattgtggcagaaaaccatctcaaaaaaatcccaaaatctcctttgagaaatcctctgcaggccaaacacaaacaaaataccgaggagtcatccttcgctgtcctccactctgcctcagagagtcacaagaaacaaaattatatccctgtgaaaaatggcaaacaatttaccaagcagaacggagagaccccaggtataattgccgaggctagcaagtccgaggagtcgtag

SEQ ID NO: 191018 - DNA, 429 bp, Artificial Sequence
  Description of Artificial Sequence: Synthetic coding sequence
atgccccggaccaagcagatccacccccggaacctgcgggacaagatcgaggaggcccagaaagaactgaatggggcggaagtgtctaaaaaggaaattctgcaagcgggagtaaagggcacttccgaatcattaaagggtgtgaaaagaaagaaaattgtggccgaaaaccatctgaaaaagatccccaagagcccactcaggaatcctctacaggctaagcacaaacagaatacagaggaaagcagttttgctgtgcttcatagcgcatccgaaagtcacaagaaacagaactatattcccgttaaaaatggcaaacaattcacaaagcagaacggcgagacgcctggtatcatcgcagaggcatccaaatccgaagaaagtgtgtcccccaagaaaccgcttttcctgcagcagccatcagaatag

SEQ ID NO: 191019 - DNA, 363 bp, Artificial Sequence
  Description of Artificial Sequence: Synthetic coding sequence
atgccccggaccaagcagatccacccccggaacctgcgggacaagattgaggaggcccaaaaggagctaaatggagcagaggtttcaaagaaggagatactgcaagcgggggtcaaaggtacctctgaatcattgaagggcgtgaaaaggaaaaaaatcgtcgccgaaaaccaccttaagaagatcccgaagtctcccctgaggaatcccctccaggcgaagcacaagcagaacaccgaagaaagctccttcgcggtgctccacagcgcgtcagagtcccacaaaaagcagaactacatcccagtgaagaacgggaagcaatttacaaagcaaaacggcgagacacctggcattatcgcatag

SEQ ID NO: 191020 - DNA, 1752 bp, Artificial Sequence
  Description of Artificial Sequence: Synthetic coding sequence
atgctgaagaagcacatccggacccacaccgacgtgcggccctaccactgtacatactgcaatttttcttttaagaccaaggacgagaagcagaggttctcttacgagcgatccggctacgaccttgaagagtccgatggaccagacgaggacgacaacgaaaacgaagatgacgacgaggattcccaagctgagtccgtgctcagcgccactccatctgtgacagcctctcctcaacacctccccagccgcagctccctgcaagaccctgtgtctactgatgaggacgtaaggattaccgattgtttctctggggtgcacacagaccccatggatgtgcttccacgcgctttgttaaccaggatgactgtgctgtcaacggcgcagagcgattacaaccggaagactcttagtcccggaaaggcccgccagcgagccgctcgagatgaaaatgacaccatccctagtgtcgatacaagtcgctccccctgtcatcagatgtccgtcgattatccagagtctgaggaaatcctgcgttcttcaatggctgggaaagctgtcgcgataacgcagtccccctcttcagtccgcctgcccccagccgctgcggaacactctccccagactgccgctgggatgccgtcagtggctagccctcacccggatcctcaggaacaaaagcagcaaatcacccttcagcccacccctggcctgccctccccacatacccatctgttcagccatctgcccttgcatagtcagcagcaatctagaacgccctataacatggttcctgtcgggggaatccacgtcgtaccagcgggactgacgtactctactttcgtccccctgcaagctgggcccgtacaacttaccatccctgccgtgtccgtggttcatcgaacacttggcactcataggaatacagtcacagaagtgtctggtacaactaatcctgccggtgttgccgagttgtcttcagtggtcccatgcattcccatcggacaaatccgcgtacccggacttcagaatctttccacacccgggctgcagtcactgccgagcctttccatggagactgtcaacatcgtgggtttggccaacaccaacatggccccacaagtgcacccccccggcctggccctgaatgccgtagggttgcaagtcctgaccgctaatccttcgtctcaaagtagtcccgccccccaggcccacatacccggactgcagattctgaatattgcccttccaacgttgattcctagtgtatcacaggtggctgttgatgctcagggagcgcctgaaatgcctgcatctcagtcaaaggcttgtgagacccagccgaaacaaactagcgtcgcttcagccaaccaggtcagccggactgaatcaccccaaggcctgccaactgtgcaacgcgaaaacgccaaaaaggtcctgaaccccccagcgcctgctggggatcacgcccggttggacgggctctctaagatggacaccgaaaaagctgccagcgcaaaccatgtgaaacccaagcctgagctgacctccattcaaggccagcccgccagcacaagtcaacccttgcttaaagctcattcagaagtctttacaaaaccttccggccaacagaccctgtccccagacagacaggtgccaaggccgacggcactgcccagacgacaaccaactgtgcacttctccgacgtatcatcagacgatgacgaggatagactggtgatcgccacctag

SEQ ID NO: 191021 - DNA, 2103 bp, Artificial Sequence
  Description of Artificial Sequence: Synthetic coding sequence
ggcgacaagttcagcttccagcgggccctgggcaaccagaagagcacggtcgtggaattcagcaataaggacgctagtgaaattaactcagaacaagataaagagaattctttgattaaatcagaaccccggcggatcaaaatttttgatggcggatataagtccaacgaggagtacgtgtacgtgcggggccggggtagaggcaaatacatctgtgaggaatgtggaatacgatgcaaaaaaccctccatgttgaagaaacacatccgtactcataccgatgttcgcccataccactgtacctattgtaatttcagtttcaaaactaaaggtaatctcactaaacacatgaagtccaaggcccacagcaagaaatgcgtggacctgggtgtcagcgttgggctcattgacgaacaagataccgaggaaagcgacgagaaacagagattctcctacgagcgctctgggtatgatctggaggaatctgacggacctgacgaagatgataacgagaatgaggacgatgatgaggattctcaagccgaatctgtgctcagcgctaccccgtctgtcactgcctcccctcagcatctcccaagtcgcagctctctgcaagatcccgtgtctaccgatgaggatgtccggatcactgactgctttagtggagtccatacggaccctatggacgtattgcctcgggcgttactgactaggatgactgtcttgtctacagcgcagagcgactataatcgcaagactctgtcacccggcaaggctcggcaaagggccgccagagatgagaatgatacaatcccttccgtggacacatcccgaagcccatgccaccagatgtcggtggattaccccgagtcggaggaaatactgcgatcatctatggcgggcaaggcggtggcgatcactcagtctccctcctcagtccggttgccacctgccgcagcagagcacagcccacaaaccgccgctgggatgccttccgtggcttctccccatcccgatcctcaagagcagaaacaacagatcacactgcagccaactccgggactcccaagcccacatacacacctgtttagccatctccctctccactctcagcagcagtccagaacaccgtacaatatggtgcctgtcgggggcattcacgttgtgccagctggccttacctatagcacgttcgtgccacttcaggcgggaccagtacagctgacgattccagcagtcagtgtggtgcaccgcacgctgggcactcacagaaacacggtaaccgaggtttctggcaccactaaccccgccggagtcgcagaactctcaagcgtcgtgccttgtatcccaattggccagataagggtacctgggctccagaatttgtcgacacctggcctgcagagcctcccatccttgtctatggagacagtgaacatcgtcggcctcgccaacaccaatatggctcctcaggtgcatcctcccgggctggccctaaacgctgttgggctacaagtccttacggccaatccctctagtcagagctctcccgccccccaagcccacattcccggcttgcaaattcttaatatcgccctgccaactctgattccttctgtgagccaggtggctgtggacgcacagggtgctcctgagatgccagcatctcagagcaaggcttgtgagacccagcctaaacagacctccgttgcttcagccaaccaggtctcccgcacagagtctccacaaggcctgcctactgtgcagagggagaatgctaaaaaggtcctgaacccccctgctcccgctggtgaccatgcccggttggatgggctgagtaaaatggacacagagaaagccgcctctgccaaccacgttaagcctaaaccagaactaaccagtatccagggacagcccgcctctactagccagccgctactgaaagcccacagcgaggtgttcaccaagccgtccggccagcagacattgtctcccgataggcaagtgccaaggcctaccgctctgcccagacgacagcctacggttcatttctccgacgtgtccagtgacgatgatgaggatagattagttattgcaacctag

SEQ ID NO: 191022 - DNA, 7341 bp, Artificial Sequence
  Description of Artificial Sequence: Synthetic coding sequence
atggacaccggcgacaccgccctgggccagaaggccaccagccggagtggcgagaccgataaggcatctggccggtggcggcaggagcagagtgccgtgattaagatgagcaccttcggttcacacgagggccagcggcaacctcagatcgaacccgaacagattggtaataccgcgtcagcccaactcttcggttcaggtaaacttgccagcccctctgaagttgtgcagcaggtggccgagaagcaatatcccccccaccgcccatccccttatagttgccagcattctctgagctttccgcagcacagccttccacagggagtaatgcactccactaagcctcaccagtccttggaaggccccccctggctgtttcctgggcctttgccttcagtggccagcgaagatctgtttccattccctatccatgggcacagcggcggttatccgagaaagaagatctccagccttaatccagcatattcacagtactcccagaagagtatcgagcaggccgaagaggctcacaagaaagaacataagccaaaaaagcccggcaaatacatctgcccctattgctctcgggcttgtgcgaagccttccgtgctgaagaagcatatccggtcacatacgggagaacggccctacccatgcattccttgcggcttcagctttaagaccaagtccaacctttacaagcatcgaaagtcccatgctcacgctattaaggccgggctcgtgcccttcacagaaagcgcggtgtcgaagttggaccttgaggctggattcatagatgtagaggccgagatccacagcgatggagaacagtctacagatacggatgaggaatcttctctctttgccgaagctagcgataaaatgtccccggggcccccaattcccctcgatatagccagtcgaggaggctatcacggtagtttggaagagtccctcggtggacccatgaaggttccaatcttgatcatccctaaaagtgggatcccactccctaacgaatcttcacagtacataggtcctgacatgttaccaaatccctcactcaataccaaagctgatgacagccacacggttaagcaaaaactggcgctgcggctgagcgagaaaaagggccaggacagtgaaccttctctcaacctgttatcaccacatagtaaggggagcacggacagcggatatttttctcggtctgagtccgccgaacaacaaattagtccacccaacaccaacgctaagagctacgaagaaatcattttcggtaagtattgtcggctctccccacggaacgccctctcagtcacgaccacatctcaggagagagctgccatgggacgtaaagggataatggaacctctgcctcacgtaaatactcgcctggatgtgaagatgttcgaggatcctgtttcccagctcatacccagcaaaggggacgtggacccgagccagacgtcaatgctcaagtccaccaagttcaactctgaatcaaggcaacctcagataatcccctcttctatacgcaatgaagggaaactatatcctgccaacttccaggggtcaaaccctgtgctgctggaagctccagtggacagctcaccactaatcagatccaattcggtgcccacaagctcagctacaaatctgaccatccctcctagtctgagagggtcgcatagctttgacgagagaatgacaggaagcgatgatgttttttatccaggcaccgtgggtattcctccgcagaggatgctccgcagacaggctgccttcgagttgccctccgtgcaagaaggccacgtggaggtggagcaccatggtcgaatgttgaagggaatttctagttcctccttgaaagaaaagaagctttcaccaggggacagagttgggtacgactacgacgtttgccggaaaccgtacaaaaaatgggaagattcagagacccctaagcagaactaccgtgatattagctgtttaagttctctgaagcatggcggcgaatactttatggatcccgtagtaccactgcagggtgtcccgagcatgttcggaacgacttgcgagaatcggaagaggaggaaagagaagtcagtgggtgatgaggaggacacaccaatgatttgcagctctatagtgagcactcccgtgggaatcatggcgtcggattatgatcccaagctgcaaatgcaggaaggcgtccgctctgggttcgcgatggcagggcatgaaaatctgtcccatgggcacacagagcggttcgacccctgtagaccccagttgcaaccgggcagcccatcgcttgtaagcgaagagtcaccttccgccattgatagcgacaaaatgagcgacttgggtggccgaaagccgcctgggaatgtgatcagtgtgatccagcacaccaatagcttatcgcgccccaacagttttgagagatccgaaagcgccgagctcgttgcctgtacccaggacaaagccccatctccatctgagacatgcgactctgagatcagcgaggcgccagtgagccccgagtgggcacctcctggtgatggtgcagagtcagggggcaaacccagcccatcccagcaggtgcaacagcagtcctaccatacacaaccaaggctggtaagacaacacaatatccaggtgccagagattcgcgttactgaggaaccagataaacccgaaaaggaaaaggaggcccagtcaaaggaacccgaaaaaccagttgaagaattccagtggccccagcgctctgaaacgttgtcacaacttcctgctgaaaagctgcctccaaagaaaaagcgtcttcgtctcgccgacatggagcattctagtggggaaagctccttcgaatctaccggcaccggactgtctcgctccccaagtcaagaatcaaatctctcccactcatccagcttcagtatgtcctttgagagggaagagacatccaagctgagtgctcttccaaagcaggacgagttcgggaagcactccgagttcttgaccgtccccgccgggtcctatagcctgtctgttccaggccaccatcaccaaaaggagatgaggcgctgcagcagtgagcagatgccatgtccccaccctgcagaagtgccggaggtccgttccaagagtttcgattacggaaacctctcccatgcccctgtaagtggagcagccgccagcactgtgtcaccatccagggaacgtaaaaagtgcttcttagtgaggcaagcctcttttagtgggagccctgaaatctctcagggtgaagtcggcatggaccagtcggtaaagcaggagcagttggagcatctccacgccggactacgaagtgggtggcaccacggcccccccgccgtgctgcctcccctgcagcaggaagatcccggtaaacaggttgcaggtccctgcccaccactgtcatccgggccactccatctagcacagccacagattatgcacatggacagccaggaatcattgcgtaaccccctgattcagcccacgagctatatgaccagtaagcacctacctgaacaaccccacttgtttcctcatcaagaaacaatcccattttcacctattcagaatgcattgtttcagtttcagtacccaaccgtctgtatggtgcatctgccagctcagcagcccccctggtggcaggctcactttcctcaccccttcgcacagcacccgcagaaaagctatggaaaacccagctttcagacagaaattcacagtagctatcccctggaacacgttgctgagcacacaggcaagaagcccgccgagtacgcccataccaaagaacagacctacccatgctattccggagctagcggactgcaccccaaaaatctcctgcctaagttcccaagcgatcaatcttcaaagtctactgaaacaccgtcagaacaggtgcttcaggaagattttgcctctgcaaatgccggctcacttcagagcctccctggcaccgtggtccctgtgagaatacagacacacgtgccaagttatggctccgtgatgtatacatctatatcccaaatcctggggcagaatagtccggctatcgtcatctgcaaggtggatgaaaatatgacccagcgcacgcttgtcacgaacgccgcaatgcaaggaatagggttcaatattgcccaggtgctcggccaacacgctgggctagaaaagtaccccatctggaaggctccccagaccctcccgctcgggctggagtcatccatcccactctgccttccaagcacatctgattctgtggcgacactaggcggatctaaacgcatgctgtcacccgccagcagcttagagctgtttatggagaccaaacagcagaagagggtgaaagaagaaaaaatgtacggtcagatcgttgaagagctgagtgccgtcgaactcacaaattcagacattaagaaggacctgtcaagacctcagaaacctcaattagtccgccaaggatgcgcgagcgagcctaaagacgggctacagagtggaagttcctcattctccagtttatctcccagctccagccaggactacccatctgtgagcccgagcagccgcgaaccctttctgccctccaaagagatgctgagcggctccagagcacccctcccagggcaaaagagttcagggccttcggagagcaaggagtccagtgacgagctcgatattgacgaaacggctagtgatatgtctatgtctcctcagtctagctctttacccgccggtgatggccaattggaggaggaaggtaagggccacaaacggccggtgggcatgctggtgagaatggcaagtgccccatccggtaacgttgctgacagcactctcctgctcacagacatggcggatttccaacagatcctgcagttcccctctctgaggaccaccacaaccgtgagttggtgtttcctgaactatactaagccaaattacgtccagcaggccacatttaaatcatctgtgtacgccagctggtgcatttctagttgtaatcctaacccctcaggtttgaacactaagacaacactcgcactcctccggtccaagcagaagattacggctgaaatctacacactagccgcaatgcatcggcctggcactgggaagcttactagttcgtcagcctggaagcagtttacccagatgaaacctgacgcaagttttctctttggcagcaagctggagcgcaaactcgtaggcaatatactgaaggaacgaggcaagggcgacatccacggtgataaggatatcggctcaaaacaaaccgagccaatccggattaaaatctttgagggtgggtataagtcaaatgaagactatgtatacgtcagaggacggggccggggtaagtacatatgcgaggagtgtggcatcaggtgtaagaaacccagcatgttgaagaaacatatccggactcataccgatgtgaggccatatgtttgtaaactctgcaatttcgcgttcaagaccaaaggtaatctcactaagcatatgaagagtaaagcccatatgaaaaagtgtctggagttaggagtttctatgactagcgtcgacgacaccgagaccgaggaggccgaaaacttggaagatctgcacaaagccgccgagaaacatagcatgagctccatcagcaccgatcatcaattttctgatgctgaagagagcgacggtgaagacggggacgacaatgacgatgatgacgaagacgaggatgatttcgacgaccagggggacctcacaccgaaaactcgatctagaagcaccagcccccagcctccaaggtttagtagtctgccggtaaacgtgggtgccgtgccacatggggtgcctagtgactcatccttgggtcacagttcactgatttcatacctggtcactctcccgtcaatccgcgtgacccagttgatgactccatccgactcttgtgaggatacacagatgactgaatatcagcgactctttcagtctaagtccaccgactctgagcccgataaggaccggctggatataccaagctgcatggatgaggaatgtatgctgccatcggagccaagcagctccccaagagacttcagccctagcagccaccactcctctccaggctatgattcttccccatgtcgcgataacagccccaagaggtacctgattccaaaaggtgatctgtcaccacggcgccacttgtctcctaggcgggacctgagcccgatgcgccatcttagtcctaggaaggaagccgcgctccggagagagatgtcccaacgcgacgtatctccgcggaggcacttaagcccccgccggcctgtctctcccggcaaggatattacagcgcgtcgggacctgtccccccgcagagaacgtcggtacatgaccaccattcgcgccccctccccacgcagagcgctctaccacaacccaccgttgtccatggggcagtatctacaggcagagcctatcgtcctcggcccacccaacttgagaagggggctgccacaggtgccttattttagcctgtacggagatcaggaaggtgcatatgagcaccctggctcctctttgtttccagagggacccaacgattacgtgtttagccacctgccactgcatagccagcaacaagtacgggcccccatccccatggtccctgtgggagggattcagatggtgcatagtatgccccctgccctatctagtcttcacccctctcccacactgcctctgccaatggaggggttcgaggaaaagaaaggagcatccggcgagtccttctcaaaagacccctatgtcctcagcaagcagcacgagaagaggggacctcatgcgcttcagagcagtgggccaccatccactccttctagcccccgcctgcttatgaagcagtctacctcagaagacagcttaaatgcgaccgaaagagagcaggaagaaaatattcagacatgcaccaaagctatcgcttcattgaggatcgccactgaagaggccgccctgcttggtccggaccaacctgctagggtgcaagagccccaccagaaccctctcggatcggcgcacgtctctatccgccatttcagccgacccgagccagggcagccttgcacctcagcaacccacccagacctgcacgatggagagaaggacaacttcggtacctctcagacacccttggcacatagtacgttttacagcaagagctgcgtagatgataaacaattggacttccacagtagtaaggaactttcaagctccactgaagagagcaaggatccttcatctgaaaagagccagcttcattag

SEQ ID NO: 191023 - DNA, 7341 bp, Artificial Sequence
  Description of Artificial Sequence: Synthetic coding sequence
atggacaccggcgacaccgccctgggccagaaggccaccagccggagtggcgaaacggataaggcttcaggccgatggcgccaggaacagagcgcagtaatcaagatgagtacattcggcagccacgaaggccagcgtcaacctcagatcgaacctgaacagatcggaaatacagcctccgcacagctcttcgggagcggaaagctagccagcccgagtgaggtcgtgcaacaggttgccgaaaaacagtaccccccccaccggccctctccttattcttgtcagcatagcctgtctttcccccagcactcactgcctcaaggtgtgatgcactctactaaaccacaccagtcattagagggcccgccgtggctgttccctggacccttaccctctgtcgcctccgaggatctgtttccattcccaattcacggacattctgggggttatccacggaaaaaaatctccagtctaaaccccgcctacagccaatatagccagaaaagcatcgagcaggccgaggaagcccacaagaaggagcataagcctaagaagcccggcaagtacatttgtccttactgtagcagagcatgcgccaagccttccgtgctgaagaagcacataagaagccatacgggtgagcgcccgtacccctgcatcccatgcggcttttccttcaaaaccaagagtaatttatacaagcaccgcaagagccatgcccacgcaatcaaggctgggctggtgccttttacggagagtgcagtatcgaagttggacctggaagccgggttcattgatgtggaggccgaaatccactccgatggtgagcagtccaccgacactgacgaggaatcaagtcttttcgctgaggcgtccgacaagatgagccctggaccacctattccactggacatcgctagtcgcggtggctaccatggttcactagaagagtctctcgggggtcccatgaaggtcccaattctgatcattcctaagagcggaatcccgctccctaacgagagctctcagtatatcggaccagatatgctccctaatccaagtctgaacaccaaggcagacgatagtcataccgtgaaacagaaactggctctgcggctttcagaaaagaaaggacaggatagtgaaccttctctgaatctgctatcccctcactccaagggaagtaccgactccggctacttctcgcgctcagagagtgccgagcagcagatcagcccccccaacactaacgccaagagttatgaggaaatcatctttggaaagtattgccggctgagccccaggaacgctctgagcgtaactacaacgagccaggaacgcgctgcgatggggcggaagggcatcatggagccactgccacacgtgaacacccgtttggatgtgaagatgtttgaagatcccgtgagccagctgataccaagcaagggcgatgtcgacccgtcccagacctctatgctgaagagcaccaaattcaacagcgaatcgagacaacctcagatcataccttcaagcataaggaatgagggcaaactttaccccgcaaactttcagggctctaatccagtgttgctggaagcaccggtagactcttcccccctgattagatccaacagcgtgcctacaagctccgcaacaaatctgaccatacccccatccctgagggggagccactcatttgatgagcggatgacgggcagcgatgacgtgttctaccccggaactgtaggtattcccccgcagcgtatgctgaggaggcaagctgctttcgagcttccatcagtccaggagggccatgtggaagtcgaacatcatggcagaatgttgaaagggatctcgtcgagttctctcaaagagaagaagctgtctcccggagatcgggttggatacgattatgacgtgtgccggaagccgtataagaaatgggaagatagcgagaccccaaagcagaactatcgagacatctcgtgtttatcttccctgaaacatgggggagagtactttatggaccccgttgtgccactccagggagtgccctctatgtttgggacaacctgcgaaaacagaaaaagacggaaagagaagagcgtcggcgacgaggaggacacgcccatgatctgcagtagcattgtgtccacacctgtcggaatcatggcttccgattacgatccaaagcttcaaatgcaggagggagtgaggtctggtttcgcaatggcggggcatgagaacttgtctcacggtcatacggagcgcttcgatccatgccggccccagcttcagccaggctctccgtcgctggtgtccgaggaatccccgagtgcgattgatagtgacaagatgagcgatttgggcggaaggaagccccctggtaacgtgatctccgtgattcagcacacaaactctctcagccggcccaactccttcgagcggtctgagagcgcagaactggtggcatgtacccaggataaagccccttctccttcagagacctgtgatagtgagatctccgaagctccagtcagtccggagtgggctcctcccggggacggcgccgagtccggcggtaagccctccccctctcagcaggtgcagcagcagagctaccacactcagcctagactggttcgccagcataacattcaggtacccgaaattcgagtcaccgaggaaccagacaagccagaaaaggagaaagaggctcaatctaaggagccagagaaacccgttgaagagttccagtggcctcagaggtctgagaccctgagccaactgcctgcggaaaaactgccgcctaagaaaaagcggctcaggctggcggatatggagcattcctccggagagagctcctttgaatccacagggacgggattatccagaagtcctagccaggaaagcaacctgtcacacagcagctccttttctatgtcattcgaacgcgaagagacaagcaagctatccgccctcccaaaacaagacgagtttggcaagcattccgaattcctgacagtgccagccggttcttactccctttcagttcccgggcatcatcaccagaaggaaatgcggcgttgtagctcagagcagatgccctgccctcaccctgcagaggtcccagaagtgaggtcgaagtcttttgactatggaaatcttagccacgcccctgtgagcggcgctgccgcctccacagtgtcccccagcagggaacgcaaaaagtgcttcctggttaggcaggcctctttcagcggctctccagaaatctcccagggcgaagttggtatggaccagtctgttaaacaagagcagctggagcatctccacgcggggttacggagcggctggcatcacgggcctcccgccgtgctaccccctttacagcaggaggatcctggcaagcaagtggctggaccttgcccgccactatctagtgggccgctgcacctggcacagccacagatcatgcatatggattcccaggaatcccttcgaaaccctctcatacagccaacatcatatatgacttcaaaacacctgcccgagcagccacatctttttccacatcaggagactattcccttctcccccatccaaaacgctctgttccagtttcagtaccccaccgtctgcatggttcatctgccggcccagcagcccccgtggtggcaggcccatttcccacacccttttgcccagcatccacagaaatcatacggtaagccatccttccagacagagatccactcctcatatccgttggaacacgtggcagaacataccggcaaaaaacccgccgaatatgcacatacaaaagaacaaacgtacccttgctactctggggcctcaggcctgcatcccaagaacttgctgcccaaatttccaagtgatcagagcagcaagtctacagagactccttcagagcaggtcctgcaggaggactttgcaagcgcaaacgccggttcactccagtcgttaccaggaacggtggtcccagtcagaatccagacacacgttccttcctatggaagcgtcatgtacacctccatcagtcaaatcctggggcagaactccccggctatcgtcatttgtaaggtcgatgagaacatgacccaacgaactctggttaccaacgctgccatgcagggcattggctttaacatcgctcaggtgctagggcaacatgccggtctggagaaataccctatatggaaagcccctcaaactctgccgctcggactggagtccagtatccccctgtgtcttcctagtactagcgactcagtcgccacactgggggggtcaaaacgcatgctgagtcctgcctcttctctagaactttttatggagacaaaacagcaaaaaagagtgaaagaagagaagatgtacggccagatagtagaggaattgagcgcggtagaactaaccaatagcgatattaagaaggatttatccaggccacaaaagccgcagctggtgcgccagggatgtgctagtgagccaaaagacggcctacaatccgggtcctccagtttctctagcttgagtccatcctcatctcaggactatcctagcgtaagtccaagctccagagagccattcctgccatctaaagaaatgctgtcaggatccagagctccgttacctggccagaagagtagcggtccctcggagagcaaggagtcatccgacgaactcgacatcgacgaaacggcgtctgacatgagcatgagcccccaaagctcatctttaccggcaggagacggccagctggaggaagaagggaaaggtcataaacggcccgtgggaatgctggtgcgaatggctagcgcccccagcgggaatgtggctgatagcacactcctactgaccgacatggctgattttcagcagatcctgcagtttcctagccttcgaaccaccaccacagtgagttggtgctttctcaactacacaaaacctaattatgtacagcaggctaccttcaaatcttctgtctacgcaagttggtgcatctcatcctgcaaccctaatccatctggcctgaatacaaagaccacccttgcgttgctgcggagcaaacaaaagattactgctgagatctacactctcgctgcaatgcaccgacctggaacaggaaaactcacctctagtagcgcttggaagcagtttacacagatgaaacctgacgcctccttcctatttggctctaaactggagaggaagctcgtggggaatattctgaaagagagaggcaagggcgacatccacggcgataaggacatcggaagcaaacagactgagccaattcgaatcaagatcttcgagggaggatataagtcaaacgaagactatgtctacgttcgggggcggggtagggggaagtatatctgcgaggagtgtggaattaggtgcaaaaaaccttccatgcttaagaagcatattaggactcacacagatgtcaggccttacgtttgcaagctgtgtaatttcgcctttaagactaagggcaacctgactaaacatatgaagagcaaggcccacatgaaaaagtgcctggaactgggggtctcaatgaccagcgtggacgacaccgaaaccgaggaagctgaaaacctggaggatcttcacaaggcggcagagaagcacagcatgtcctctattagcaccgaccaccagttttcagacgcggaggagtctgacggcgaggacggggatgacaatgatgatgacgacgaagacgaggatgatttcgatgaccagggagatctgacccccaaaacccggagcagatcgacatcccctcagcccccccgctttagttccttaccagtgaatgtaggagctgtgcctcacggagttccctcggattctagtcttggtcactccagtctgattagctacctcgtcacactcccaagtattcgggtgactcagctgatgactcctagcgactcgtgtgaagacactcagatgaccgaataccagagactgttccagtccaagtcgacggatagcgagccagacaaggaccggttagatataccaagttgtatggacgaggagtgtatgctcccgtctgagcccagcagttcaccacgagatttctcgccatcgtcccatcattcctcccctggctacgattcctccccctgtagggacaattcaccgaagcgttacttgatccccaagggagatctgagcccacgacgacatctgtcccccagaagggacctctccccaatgcgtcacctgtcccctcgaaaagaggccgctcttaggcgggagatgtcccagagagatgtttcccctcgtagacacctgagcccaaggaggccagtgtccccaggtaaggatattacggcacggcgcgatctgagccccaggagggaaagaaggtacatgactacaatcagggcgccgtcaccgcgtcgcgctttataccacaacccccctttgtccatgggacagtatctgcaggccgagcctatcgtcctggggccccccaatctcagacgtggtcttccacaggtgccttatttttccttgtacggggaccaggaaggcgcatacgagcatccagggagctccctgttcccagagggacccaatgactacgtgttttcccacctgcccttacactcccagcagcaagtgagggcgcccattccaatggtgccggtcggcggcatccaaatggtccactctatgccacctgccctgtcctctctgcacccatcgcctacactgcctctgccaatggaggggtttgaagaaaagaaaggggccagtggtgagagtttttctaaggatccctacgtgctgtctaagcagcacgagaagagaggaccccacgctctccagagctcagggccacccagtactccctcatcccccagattgctgatgaagcagtccacctccgaggactccctcaatgccaccgaaagggagcaggaggagaacatccagacttgcaccaaagcgattgccagtctccgcattgccactgaggaagctgcactgctcggccccgaccagcccgcaagagtccaggaaccccatcagaaccccttggggtcagcacatgtgtctattagacacttctcacggccggagcctgggcagccgtgcacaagcgcaacccacccagaccttcacgacggagagaaggacaacttcggcacgtcgcagacccctctggcccacagtacattttatagtaagtcatgcgttgacgataaacagctagatttccatagttccaaagaactttcatcatccacggaagagtctaaagatccgtcaagtgagaagtcgcagctgcactag

SEQ ID NO: 191024 - DNA, 7341 bp, Artificial Sequence
  Description of Artificial Sequence: Synthetic coding sequence
atggacaccggcgacaccgccctgggccagaaggccaccagccggagcggagaaaccgataaagcctctggaaggtggcggcaagaacaaagcgccgtaattaagatgtccacctttgggagtcatgaaggtcagagacaacctcagattgagcctgaacagatcgggaatacagcatcagcccagctcttcggcagtggcaaattagccagcccctcagaggtggtgcaacaggtcgccgagaagcagtatcctcctcaccgtccttcaccttactcttgtcagcattctcttagttttccacagcactcacttccacagggggtcatgcactcaactaagccgcaccagtcactggaggggcccccatggctgtttcccggccccctgcctagcgtcgcgagcgaagacctcttcccgttcccgatccacggtcactcaggtggttatccgagaaaaaagatttccagcttgaacccagcttattctcagtactctcagaagagtatcgagcaggccgaggaagcacacaagaaagaacacaagcctaagaagccaggtaagtatatctgcccatactgtagccgtgcttgcgcaaagccatctgtgctaaaaaagcacatacgctcccataccggcgagcgtccttatccatgtattccgtgcgggttctccttcaagactaaaagcaatttgtacaaacatcggaagtcccatgcccacgctatcaaggctggtcttgtgccctttactgagtcagccgtgtcaaagctggacctagaagctggctttattgatgttgaggctgagatacactccgatggggagcagtccacagatactgatgaggaatcctccctgtttgctgaagcctccgacaaaatgtccccaggaccccctatcccactcgatatcgcctcccgtggtgggtatcatgggtcattagaggagtcactgggcggacccatgaaggtcccaatccttatcattcctaagtctggtattccacttcctaatgagagctcccagtacattgggcctgatatgctcccaaatccgagcttgaatactaaagctgatgattcccacaccgtgaagcagaagctggcgctccggcttagcgagaaaaagggacaggattcagaacccagcctcaacctgctgagccctcacagtaaggggtctaccgactctggctacttctcaagaagcgagagcgcggagcagcagatcagcccacccaacaccaatgcaaagtcatacgaggaaattattttcggaaaatattgtcggctttccccccggaacgctctgtccgtcaccaccacaagtcaggagcgcgctgcaatgggccggaagggaattatggagcccctcccccatgtgaacactcgacttgacgttaagatgttcgaggatcccgtttctcagctcatcccgtccaaaggtgacgtggacccatcacagacctcaatgctcaaaagtacaaagtttaactcggaatcgaggcagccccagatcattccgtcttcaatccggaacgagggtaaactctacccggcaaattttcagggttccaacccagtgctcttggaagcacctgtagacagttcacctcttatcagaagtaactctgtgcccacctcctctgcgactaatctgaccatcccgccaagcctaagggggtctcattcgttcgacgaacgcatgacgggttctgacgacgttttttaccccggaaccgtagggattccccctcaacgaatgctacggaggcaagctgcatttgaactgccatccgtgcaggaaggccacgtagaagtggagcaccatggacgtatgctcaagggaattagttcttcctcactgaaggagaagaaactgtctcccggggaccgggtgggctatgactacgacgtgtgccgcaagccctataagaagtgggaagatagcgagacgccaaaacagaattaccgggatatcagttgtttgagtagcctgaaacacggcggagagtatttcatggaccctgttgtgccactacagggggtaccctctatgttcgggaccacttgtgaaaatcgaaaacgccgcaaggaaaaaagcgttggcgatgaggaggacaccccaatgatatgttctagtattgtctccactcctgtgggaatcatggcctctgattatgacccgaagctccaaatgcaggagggagtgcgtagcggcttcgccatggccgggcatgaaaatcttagccatgggcatacagagaggttcgacccatgtagacctcagctacaacctggttcacctagcctcgtgagcgaagaaagcccttctgctattgactctgataaaatgtccgatctgggagggcggaaaccaccaggaaacgtcatttccgttattcagcatactaatagcttgtctagaccaaatagctttgaacgctccgagagtgccgaactcgtggcctgtacccaagacaaggctcctagcccgtctgaaacttgcgacagtgagatctccgaggctcccgtctcacccgaatgggccccgccgggcgatggggcagagtccggaggcaaacctagcccaagccagcaggtacaacagcagtcttatcatacgcaacctagattggtaaggcagcacaatatccaagtgcccgaaattcgagttacagaagagccagataagcccgaaaaagaaaaagaggcccaaagtaaggagccggaaaaaccggtggaggaattccaatggccacagcggagcgagaccctgtcccagttgcctgctgaaaaattacctccaaagaaaaaacgcctccgcctggctgatatggagcactcctctggcgagtcatcttttgaatctacagggactggcctgagccggtcccccagtcaagagtccaatctgagccattcttcttccttttcaatgtcttttgagagagaggagacatcaaagctttctgcgctgccaaaacaggatgaatttggaaaacattccgagttcttaactgtacctgcagggagctactcccttagtgtgccaggacaccaccaccagaaggagatgagaagatgttcgtctgaacaaatgccttgtccacacccggccgaggtgccagaggtgagatccaagtcatttgattatgggaatctgtcccacgcacccgtgagcggagcagctgcaagcaccgtgagcccaagcagggaaaggaaaaaatgcttcctggttagacaagcctcctttagcggatctcccgaaatatctcagggcgaagtaggtatggatcaaagcgtcaaacaggagcaacttgaacatctgcatgctggattaaggtccggatggcaccacggcccaccggccgtcctgccccccctccaacaagaggatcctgggaaacaggtagccggcccctgtcctcccctgtccagtggtcctttgcatctagcacaaccacaaatcatgcacatggacagtcaggaaagcctgagaaatccgctgatccagcctacgagttatatgacctctaaacatctccctgagcagccccacctgtttcctcaccaagagacaataccttttagtccaattcagaacgctctcttccagttccaatatccaactgtctgtatggtgcatcttcctgcccagcaacctccttggtggcaggcccattttccacacccttttgcccagcaccctcaaaaaagttatggtaagccaagcttccagaccgagatccactcttcctatcctctggagcacgtggctgagcacacaggtaagaagccagctgaatacgcacatacgaaggaacagacgtacccttgctattccggcgcctctggactgcatccaaagaacctgctcccaaagttcccatctgaccaaagcagtaagtccacagaaacaccttccgagcaggttctgcaagaggacttcgcctcagccaacgcagggagcttgcagtcccttcccgggacagttgtacctgtgcgcattcaaacccatgtgcctagctatggcagtgtgatgtatacctcgatatcacaaatcctgggacaaaacagtcccgcaattgtcatttgcaaggttgacgaaaatatgacccagcgtacactcgtcaccaacgcagccatgcaggggatcggcttcaatatcgcacaggttctggggcaacacgccggtttagaaaaatatcccatttggaaggcccctcaaacattgcctttggggctcgaatcttctattcccctgtgcctcccaagcacttcagactcggtggcgactcttggaggctctaaaaggatgttatcgcccgcatcgtctcttgaactgtttatggagaccaaacagcagaaacgggtcaaagaggaaaaaatgtacggccagatagttgaagagttgtccgctgtcgaactgactaattccgatattaaaaaggatctgtctcgcccacagaagccccagttagtgcgccagggttgtgcaagtgagcccaaagatggcctgcagagcggtagtagctcattctcatccttgagtcctagtagcagtcaggactatcccagtgtgtcaccctcgagtcgggaaccttttcttccttccaaggaaatgctctctggctctagagcaccactgcctggccagaagagttcagggccttccgagtccaaggaaagtagcgatgaattggatatcgatgaaaccgcttccgacatgtctatgtcccctcaatccagttcactgcctgccggagatggtcagctggaagaagaaggaaagggtcataagaggcccgtcggaatgctcgttcggatggccagtgccccctccgggaatgttgctgatagcacactgctgcttactgacatggccgatttccagcagatcctccaatttcccagtctgcgcacaacgactaccgtatcttggtgctttctcaattacacgaaacccaactatgtgcagcaggctacctttaaaagctctgtttatgcctcctggtgtatttcatcctgcaaccccaatcccagcggcctgaacacgaagacaacattagcactactccggagcaagcaaaaaattaccgcagagatatacactctggcagctatgcatcgcccagggacggggaagctaaccagctcaagcgcttggaaacagtttacacagatgaagccagacgcctctttcctcttcggaagcaaacttgagcgcaaactcgtgggcaatatcctcaaggagagaggaaagggcgatatccatggggataaggatattggaagtaagcagactgaaccaattcggattaaaatcttcgaaggcgggtacaagagtaacgaggattacgtgtacgttcggggaagaggaagaggaaagtacatatgcgaggaatgtggaatcagatgtaagaagccctccatgctgaaaaaacatattcgcacacacactgatgtcaggccctatgtgtgtaagctgtgcaattttgccttcaaaactaaaggtaatctgactaaacacatgaagagtaaggcccacatgaaaaaatgcctcgagctaggcgtatccatgacctccgttgacgacactgaaactgaggaggctgaaaatctggaggatttacataaggccgccgaaaagcatagcatgtctagtatctcgaccgatcaccagtttagcgacgcagaggagtctgacggagaggacggagacgataatgatgatgacgatgaggatgaggatgactttgatgatcaaggggacctgacccctaaaacccgcagtagatcaacgagtccccagcccccccgtttctcgtctttacccgtaaacgtgggggccgtgccccatggagtgccctccgactcgagcctgggtcacagttctctaatttcttacctggttacacttccgagtattcgcgtcacccaacttatgactcctagcgactcttgcgaggatacacagatgacagaataccagagactgttccagtccaagtccacagactccgagcccgataaagatcgcctcgacatcccaagttgcatggacgaggagtgtatgctgcccagcgagccatcgtctagtccccgggacttctctccaagcagccatcatagctctccaggatacgacagctcaccatgtagggacaattccccaaaacgttaccttatccccaaaggcgatttgtcacctcggaggcacctttctcccaggcgggacctcagtcccatgcggcacctgagccctaggaaggaggccgctttacgaagagagatgtctcagcgcgacgtgtccccccgacgccacttgtcccccaggcggcccgtgtctccgggcaaagatataacggctagacgcgatctcagtccaagacgggagcggcgttacatgacgaccatccgagcgccatctcctcgtcgagccctctatcataacccaccactctctatgggtcagtacttgcaagcagagcctattgtgctgggaccgccaaatcttcgccgagggctaccccaggttccttatttctctctctatggagaccaagagggggcgtacgagcatcctgggtcgtctttgttccctgaggggcccaacgattatgtgttcagccacctcccgctgcacagccaacagcaagtcagggccccaattccaatggtgcctgtaggtggcattcaaatggtgcacagcatgcccccggccctctcaagtctgcacccatctccaactctgcccctgcccatggaggggtttgaggaaaagaaaggcgctagcggagaaagcttttctaaggatccatatgtgctctctaaacagcacgaaaagagaggaccacacgcactccagtcaagtggtcctccgagtactccttcctcacctcggctgctcatgaagcagtctacctcagaggattccctgaatgctaccgagcgtgagcaagaggaaaatattcagacctgcaccaaggccatcgctagcctccgcatcgctactgaggaggcggctttactgggacccgaccagcccgcacgcgtgcaggagccacaccagaatcccctgggatccgcacatgtcagcatccgtcactttagccgccctgaaccgggacagccttgtacctcagccacccacccagacttacacgatggagagaaggataactttggcacgtcccagactccacttgcgcacagcactttttatagcaagagctgcgttgatgacaaacagctggacttccattccagcaaggagctcagctcctctacagaagagtccaaagacccgtcgtccgaaaaatcacagctgcactag

SEQ ID NO: 191025 - DNA, 7221 bp, Artificial Sequence
  Description of Artificial Sequence: Synthetic coding sequence
atggaccccgagcagagcgtgaagggcaccaagaaggccgagggctcgccgagaaaaaggctgactaaaggggaggcaatacagactagcgtgagttccagcgtcccgtaccccgggtccgggacagccgccacccaggaatctccagcgcaggagctgttagcacctcagccatttccgggacccagctcggtcctacgtgaagggagtcaggagaagacaggccaacagcagaaaccaccgaaaaggccacctatagaagcatccgttcacataagccaactgccccaacaccctctgactccggcctttatgagtccaggaaagcccgaacacctactggaggggtccacctggcagctcgtggatcctatgcgcccaggaccttccggcagcttcgttgcccccggactacatccacagagtcagctgctgcctagccacgcctccattatcccccctgaagacctccctggagtccctaaagtgttcgttcctcgaccctcgcaagtgtctctaaaacctacagaggaggctcataagaaagaacggaagcctcaaaaacccggtaagtatatctgccagtattgtagtaggccctgcgcaaagccctccgtactgcagaagcatatccgctcccacacaggagagagaccatatccgtgtggcccatgtgggttcagttttaaaactaaaagtaatctgtataagcatcgcaaaagtcatgctcatcggatcaaggccggtcttgccagtggaatgggtggagagatgtatccgcatggcttggaaatggagaggatcccaggggaggaattcgaagagccaactgagggagagtctactgacagtgaagaagaaaccagtgctacctccgggcacccagccgagctctcaccccgccccaagcagccgttgctatcttccggactgtacagcagcggctcccactcatcctctcacgagcgttgctctctgtctcagagcagtactgcccagtcactggaggaccctccaccgttcgtggaaccttcatctgaacacccactcagtcacaagcccgaagatacccacaccattaagcagaaattagcactcaggctgagcgagcggaaaaaggtgatcgacgaacaggcattcctttctcctggcagtaaagggtccaccgagtcaggctacttctcccggagtgagagtgccgagcaacaggtcagtcctcccaataccaatgcgaaaagttatgccgaaatcatattcgggaaatgtggtcgcataggacagcggactgctatgttgacagcaactagcacccagccacttctgccgctcagtaccgaagataaaccatctctcgtgccattatccgtcccacgaacacaggttatagagcacattactaaattaatcaccataaatgaggctgtcgtagatacaagtgagattgacagcgttaagccccgcagaagctccctttcccggagatcatccatggaatctcctaaatcaagcttgtatagggagcctctttcatctcacagcgaaaaaaccaagcctgaacagtcccttctgtcactccaacacccccctagtaccgccccacccgtgccattgctgagaagtcacagcatgccttccgctgcatgtacaatctctactccccatcatcctttccgcgggtcatacagctttgacgaccacataacagattctgaagccctgagtcattcatctcatgtttttacatcccatccaaggatgctcaagcgtcagcccgccattgaactgcccctcggaggtgaatatagctctgaggagcctggccccagcagcaaagacaccgcgtcaaagcctagtgacgaggtggagcccaaagagtctgagctcacgaaaaaaaccaagaagggtctgaagaccaaaggcgtcatttacgaatgcaatatatgtggggcgcgctataaaaagcgggacaattatgaagcccataagaagtattattgcagcgaattgcaaatagctaagccgatcagtgcaggaacacataccagccctgaagcagagaagagccagatcgaacacgaaccttggagccagatgatgcactacaaactagggactaccctggagctgaccccactcagaaaacgccgcaaggaaaaatccctcggcgatgaggaagaaccccctgcttttgagtctaccaagagccaatttggcagcccagggccatctgatgcagcaagaaacctgccactagagtcaacaaagtctccggcggagccaagcaagagtgttccttccttagaaggacctacagggttccagcccaggacaccgaagccaggaagcgggtcagagtcagggaaggaacgcaggaccacaagcaaagaaatttcagtgattcagcatactagctccttcgaaaagtcggattccctggagcagccttcgggcctcgagggcgaggacaaaccgttagctcaattcccatcaccaccgcctgccccacatgggagaagcgcccattctctgcaaccaaagctggtgagacagccaaacattcaagtacccgagattttggtgacggaagagcctgaccggccagacaccgagccagaacctcccccgaaagagcctgagaagaccgaggagttccaatggccacagcgtagtcagacgctggcccagctgcctgctgagaagctacccccaaagaagaagaggctacgcttggctgagatggcacagagttcaggtgaatcctcttttgaaagctccgtccccctgtcccgaagtccctctcaggagtcgaatgtgtcactctcagggtcttccaggtctgcgtccttcgagagagatgatcatggaaaagccgaagccccctctccctcatcggatatgagacctaaacccttgggcactcatatgctgacggtgccgagccaccatccacacgctcgcgagatgcgcaggtctgcctcagaacaaagcccaaatgtgtcacactctgcgcacatgaccgaaacccggtcaaagtcattcgactatggatccctgtctctgacagggccctcagctcccgctcccgtcgcaccacccgcaagggtggcgcctccagagcgcaggaaatgcttcctggtgagacaagccagtctatcacggcctccagagagtgagctggaggtcgcccccaagggacgccaagagagtgaggaaccacagccttcctcaagcaagccatcagccaagtcttccttatctcagatctctagcgccgcgacaagccatggaggccctcctggcggaaaagggcccggacaggatcgaccacccttagggcctaccgttccctatactgaggccctgcaagtctttcaccaccccgtagcccaaacaccactgcatgaaaaaccctatctgcccccccccgtgtccctgtttagtttccagcacctggtacagcatgaacccggccagtcccccgaatttttttccacgcaggcgatgagtagtctactcagttctccttactctatgccccctttgcccccaagccttttccaagccccccctctccccttgcaacctaccgtgctgcacccgggacagctgcatttgccccagctgatgccacaccccgctaacatcccattcaggcaaccaccatcgttcttgccaatgccctacccgacttcgagtgctctgtcgtcaggcttttttctgccattgcagtcccaatttgctttgcaacttccgggagatgtcgagtctcacctcccacagatcaagacatcactcgcacctctagcaacaggctccgcaggcctgtcaccctctacagagtattcaagtgatatccgacttccacccgtcgcaccaccagctagttcatccgcccccacatccgctccacctcttgctttgccggcgtgccccgataccatggtgtccttagttgtgccggtccgcgttcaaaccaacatgccttcttatgggtctgccatgtataccacactaagccagatcctggtcacgcagtctcagggttccagtgccaccgtggccctccctaagttcgaggaaccacctagcaagggaactacggtctgcggcgccgatgtgcacgaggtagggcctggaccatccggcttgagcgaggaacagtcccgggcctttccaactccttatcttcgagtaccagtcacgctgccggagagaaaaggaacgagcctttcttcagagagcatcttatcattggagggcagctctagtacggcagggggcagcaaacgggtcttgagtcccgcagggtcccttgagcttacaatggaaacccagcagcagaagcgtgtgaaagaggaggaagcttccaaggccgacgaaaaattggagttagttaagccctgttctgttgtgctaacctcgaccgaggacggtaagaggcctgagaaaagccatttagggaatcagggccagggtaggcgtgagctggaaatgttgtcctccctttcatctgacccctccgatacaaaagagattcccccactgccccacccagcacttagtcacggcacagcacctggtagcgaggcgctgaaggaatacccccagccttccgggaaaccacaccgccgtggcctcacaccactgtccgtcaaaaaggaggactctaaagaacaaccagacctgccctctctggcaccaccatcttcactgcctctgagcgaaacctcctcgagaccggccaaatctcaagaaggaacagactccaagaaagtgctgcagttcccatccctccacacaaccacaaatgtgagttggtgttatctcaactacatcaaacccaaccacattcaacatgccgatagaaggtcaagcgtgtacgccggttggtgtatttcactgtacaaccccaacctccccggcgtgtccacaaaggcggcattgagtctcctccgttctaagcagaaagtttctaaggagacatatacgatggccactgcaccccacccagaagccggaaggctcgtgccatcctcctccaggaagcctcggatgaccgaagtccatttgccaagtcttgtcagccccgaggggcagaaagatctagctagggttgagaaggaagaggagcggaggggcgaaccagaggaagatgccccggcttctcagcggggggagccggcccgaattaagattttcgagggcggctataagagtaacgaagagtatgtgtacgttcgggggagaggacgcggaaaatatgtctgcgaagaatgcggcatccggtgcaaaaagccttccatgctgaagaaacacatacgcactcacactgacgttcgtccctatgtatgtaaacattgccattttgcttttaagaccaagggcaatctgactaaacacatgaaatcaaaggcgcactccaagaagtgtcaggaaacaggggtgctggaagaacttgaggcggaggagggcacaagtgacgatctgttccaggactcggaaggacgagagggatctgaggcagtcgaggagcatcagttttcggacctggaagacagcgacagtgatagtgacttggacgaggacgaagacgaggacgaggaggaatcacaggatgagttgtccaggccctcaagcgaggccccccccccgggtcccccccacgcactgcgggctgactccagtccaatcctgggccctcagccgcctgacgccccagcatcaggaaccgaagccacgcgcggttcaagtgtgagcgaagcagagcgccttacagcttccagctgctccatgagctctcaatctatgcctggtttaccttggttgggcccagcaccactcgggagtgtcgagaaggacaccggttctgcgctgtcctataaacccgttagcccacgccggccctggagtccaagcaaggaagcagggagcaggcctccccttgcaaggaagcactcacttacgaaaaatgacagcagccctcaacggtgctctcctgccagagagcctcaggcgtctgctccttcaccccccggcctgcacgtcgaccctggccgaggaatgggggcgttgccttgcggcagtcctcggttacaactgtctcctctgacactctgtcccctaggaagagagcttgctcctcgcgctcatgtgctctctaagctggaagggaccacggaccctgggcttccacggtattcacccacgcgccgctggagccctggccaagctgagtcacctccaaggtcagccccccctggcaagtgggcactcgcgggccctggctcgccctcagcaggcgagcatggacctggccttggtcttgaccctagggtgcttttcccccccgcccccctgccccataaactgttgagccgcagtcctgaaacatgcgccagcccctggcagaaagccgagagcaggagccccagctgctcccctgggccggctcaccctcttagcagtaggcccttttccgccctgcacgacttccatggccatatcttggcgcggaccgaggagaacatcttttcacatctaccgctccactcccagcacctgaccagggcgccatgtccccttatcccaattggcggaatccagatggtccaggccagaccaggcgcccatcccaccttactacctggccccacggccgcctgggtgagcgggttctccggtggaggcagtgacctcaccggggcgagagaggctcaggagcgaggacgctggagccccaccgagagcagcagcgcgtcagtatccccggtggctaaggtcagcaagttcaccctgtctagcgaacttgagggaggggactatcctaaagagcgcgagagaaccggcggcggaccaggacggccacccgattggacaccccatggcactggcgcccccgctgagcctacgccaactcactctccgtgcactccaccagataccctaccgcgcccgcctcagggacgccgcgccgctcaatcctggtccccgagattagagtctccccgtgctcccactaacccagagccttcggcaacgccccccctggatcgcagtagctccgtgggctgtctggccgaagccagtgcaaggtttcccgctagaactcggaatctaagcggggagccccgcacaagacaggactcgcctaaaccgtccggcagcggcgaaccgcgggctcatcctcaccaaccagaggaccgagtgccgcctaatgcgtag

SEQ ID NO: 191026 - DNA, 7221 bp, Artificial Sequence
  Description of Artificial Sequence: Synthetic coding sequence
atggaccccgagcagagcgtgaagggcaccaagaaggccgagggcagcccccggaagaggttgaccaaaggagaggcgatacagacatctgtgagcagctcagtcccttatcccggctctggcacagccgcgactcaggagagccctgctcaggagctgctggccccccagccttttcccggacccagttcagtgttgcgtgaaggttctcaggagaagaccgggcagcagcagaagcccccgaaacggcctcctatcgaggcctcagtacacattagtcagctgcctcagcaccctctcactcccgcgttcatgagtcccggtaagccagagcatcttctagagggcagtacttggcaattagttgatcccatgagacccgggccttcaggaagcttcgtcgcccccggcctccatccacagtctcagttgctcccgtcccacgcctcaattatcccccctgaagatttacctggtgtacctaaggtctttgttcccagaccaagtcaggtttcattgaaacccactgaggaagcacataaaaaggaaaggaagccgcaaaagccaggtaagtatatttgtcagtattgttctcgaccatgtgcaaaaccttccgtgctccagaagcacattaggagccatacaggagagcggccctacccctgcggcccgtgtgggtttagtttcaagacaaagagtaacctgtacaagcaccggaaatcacacgctcacagaattaaagccggattggcatccggaatgggcggcgagatgtaccctcacggactcgagatggaacgtattcctggagaagaatttgaagagcctacagagggtgagtccaccgattccgaggaagaaacctccgcgacctccggacaccctgctgagctctccccaaggcctaagcagccactgctttcttcaggcctgtattcctctgggtcccattcttctagtcatgaacgatgctccctaagccagtcctctactgcccaatccctcgaagaccctcctccctttgtcgagccttcttccgagcaccccctgagtcataagccagaagatacacataccattaagcagaaactcgctcttagattaagtgaaagaaaaaaagtgattgatgaacaagcattcctctctcctggaagtaagggctcaactgagagcgggtactttagcagatcggaatctgcagagcagcaggtcagccccccgaacacaaatgcaaaatcttatgccgaaattatctttggtaagtgcggacgaattgggcaacgaactgccatgctcaccgcgacatcaactcaaccactgctgccactgtccacagaggacaaaccctcactggtgcctctatccgtcccaaggacacaggtgatcgagcatattacgaagttgattactattaacgaggctgtggtcgacacctccgagattgactctgtaaagccaagacgatcatccctcagtcggcgctcgagtatggagagtccgaagtctagcttgtatagagaaccgctctcaagccacagtgaaaagaccaaacccgagcagtctctgttatccctgcagcatcctcctagcacagccccgccggtaccgttattacggtcgcattccatgccctcagcagcgtgtaccatctctacccctcatcaccccttccggggttcctattcttttgacgaccacatcactgactctgaggccttaagccattcgagccacgtgttcacaagtcatcctcgaatgctcaagcgccagcccgccattgaactgccactaggcggcgagtatagcagcgaggaaccaggaccaagtagcaaggatacagcatcgaaaccaagtgacgaagtagaacctaaggaatcagagctaaccaagaagacaaagaaggggctgaagacaaagggagttatctatgagtgcaacatatgtggtgcccggtacaaaaagagggacaattatgaggctcacaaaaaatactactgtagtgaattacagatcgctaaacccatttcagcaggcacccatactagcccggaggcggagaagtcccaaatcgaacatgaaccatggagccagatgatgcactataagctcggtactacacttgaactgacccctctgagaaagcggagaaaagagaaatctctgggcgatgaggaggagccccctgccttcgagtcgactaaaagtcagtttggatcccctggcccatcggacgcagcaagaaacttgccactggagagtacaaagtctcctgcggaaccgagcaaatccgtgccttcactcgaaggtccgacagggtttcagcctcgcacccccaaacctggctctgggagcgaaagcgggaaagagcgcagaactacttccaaagaaatctcagtcatacagcacacttcatcattcgagaagagtgacagtctggaacaaccttcgggcctcgagggcgaggataaaccactggcacagtttccatcaccacccccagccccacacggacgcagtgctcattccctgcagcccaagctggtgcgccagcctaacattcaagtgcctgagatcctagttactgaagagcctgataggcctgacaccgagcccgagcctccgccgaaggaacctgagaagacagaagaattccagtggcctcagcgaagccagaccttggcccagcttcctgcagagaagctgccacctaagaagaagcggctgaggctggcggaaatggcacagagttcgggagagagttcctttgagtctagcgtgcccttgtcacggtcaccctcacaggagtctaacgtgagtctcagcggctcctcccgcagcgcatccttcgagagagatgatcacgggaaagcagaagcccccagcccaagctccgatatgaggccaaagcctctcggcactcacatgctaacagtcccgtctcaccatcctcatgcccgggaaatgagacggtctgccagcgagcagagcccaaatgtttcacacagtgcacacatgacagaaaccaggtccaaatccttcgattatggatcactctcactcacagggccgagcgcccctgcccctgttgctcctccggctcgagtggccccacctgagagacggaaatgcttcctggtgcgccaggcctcactgtctcgtccgcccgagagtgaacttgaagttgcaccaaaggggcggcaggagagcgaagagccacagccaagttcatccaaacctagtgcgaagtcctcactctctcagatcagcagtgccgctaccagccatggagggccccctgggggcaaggggccgggccaggacaggccccctctaggaccaacagttccctacactgaggccctgcaggtatttcaccaccccgtggcccaaacacctctccatgaaaagccttaccttccacccccggtatctttatttagttttcagcacctggtgcagcacgagcctggtcaatctccggaattcttctccacacaagcgatgagcagtctcctgtcatcaccttattcgatgccacccttgccaccatccctgttccaggctccgccactgcccctgcagcccacagttctgcacccaggacagctccaccttccgcaactaatgccgcatccagcaaatattcctttccgccaacctccgagtttcctgccaatgccatatccgaccagtagtgctctgtcatccggtttcttcctgcctctccaaagccagttcgcgctgcagctcccaggcgacgttgaaagccatcttccccagataaaaacatcactcgcacccctggctactggctctgccggactctctccttcgaccgagtactcgtccgacatccggctgccccccgtagctccacctgcttcgagcagtgcccctacctcggcaccccccctggccctaccggcttgcccagatacaatggtttctctggttgtccctgtaagggttcaaacgaacatgccttcctatggaagtgctatgtacactacattaagtcagatccttgtgacacagagccaggggagctctgccaccgtcgcactgccaaaattcgaggaaccgcccagcaaaggcaccaccgtgtgtggagccgacgtgcatgaggtagggccaggcccaagcggcctgtctgaagagcagagcagagcgtttcccactccatatctcagggtgcccgtcaccctgcctgagcgaaaagggaccagtctgagcagcgaatcaatcctgtccttggaggggagctcatcgaccgctggcggttcaaaacgcgtactgagccccgccggctccctagagctgactatggaaacacaacagcagaaaagagtgaaagaagaggaggccagcaaagccgatgaaaaactggagttggtgaagccatgttctgtcgttctcaccagcaccgaagatgggaaaaggcccgaaaaatctcatctgggtaaccaaggacagggaagacgggaactagaaatgctgagcagcttgagctccgaccctagcgatacaaaggagattcctccactgcctcatcctgcactgtcacacggcactgcccctgggagcgaagcgttgaaggaatatccccagccttcaggaaagccacacaggcgcgggttgacaccgctgagtgtcaaaaaagaagacagcaaagaacaacccgatcttccttccctggcacctccctcctcccttcctctgtctgagacttcttccaggccagccaagagtcaggaggggacagactctaagaaggtgctacagtttccttctctgcacacaactactaatgtcagctggtgctacttaaactacattaaacctaaccatatccagcacgccgaccgccgttccagcgtctatgccggctggtgcatcagcttgtataaccctaatctaccgggtgtttccactaaagccgccctaagcctgctcaggtccaagcagaaggtctcaaaggaaacgtatacgatggcaacagctcctcaccctgaggcagggaggctggtgcctagcagctccagaaagccaaggatgacagaagtgcacctaccttccctagtctcacccgagggccagaaggacctcgcgcgcgtggagaaagaggaggaacggagaggcgagccggaggaggatgctcctgccagtcaacgcggagagcccgcgcgaatcaagatcttcgaggggggctacaagtctaacgaggagtacgtgtacgtcagagggcgcggacgtggaaagtatgtctgtgaagaatgtggaatccgctgcaagaagccaagtatgctcaaaaaacacattaggacccacacagatgttcgcccatatgtttgcaaacattgtcacttcgcatttaagacaaagggcaacttaacaaagcatatgaagtccaaagctcacagtaagaagtgccaagaaaccggagtcctggaagagctggaggctgaagaggggacctctgatgacctgttccaggacagcgagggcagagaaggctccgaggccgtagaggaacaccagttttccgatttggaagatagtgacagcgattcggacttggatgaggacgaagacgaagatgaagaagaaagtcaggatgagctttctcggcctagcagcgaggccccgccacctggtcctcctcacgctttgagggcagattcatctcccatcctggggccacaaccacctgacgctcccgcctccggcactgaggcgacaaggggttcttcagtgagtgaagccgagcggcttacagcatcctcttgtagcatgtcttcccaaagcatgcctggcttgccctggctgggccctgcacctctgggcagtgtggaaaaggacacaggctctgcgctgtcttacaagccagtgtctcctagacggccttggtcaccgtcaaaagaagctggctccagaccaccgctcgccaggaaacattccctcacaaagaatgattcctctccccagaggtgcagccctgccagagagccccaggcatccgcaccttctcctcccggcctgcatgtggacccagggcgcggaatgggggctctgccctgtggcagcccgcgtctgcagctgtccccactaacactgtgtccactgggcagagagctcgctcctcgggcccatgtgcttagcaagctggagggcactacagatccgggattaccccggtacagcccaacgcgaaggtggagcccgggtcaagccgagtctccgcccagatctgccccccccggcaaatgggccttggctggccccggcagcccctccgcaggcgagcacggacccgggctgggacttgacccaagggtgctgttccctccagcccccctccctcacaagcttctgagtagatcccccgagacttgtgcctcaccgtggcagaaggccgagtcgcggagtcctagctgctccccaggtccagcgcaccccctgagctcgcggccgttcagcgcactgcatgatttccatggccacattctagcacgcacggaagaaaacatcttctcccacctgccactccactctcaacatctaaccagggctccctgtcccctgattccaatagggggaatccagatggtgcaagcccggcccggcgcccatcccactcttcttccaggcccgaccgctgcttgggtcagcggattctccggcggcggttctgacctaacaggcgcaagggaagcccaggagcgagggcgctggtcccctactgaaagctcttccgcttctgtgagccccgtcgcaaaagtctctaaattcacgcttagcagcgagctagaaggtggcgactatccgaaagaacgagaacggaccggaggcggcccaggccggccccccgattggactccacatggcacaggggccccagcggagccgacccccacacactccccgtgcacccctccagacaccctccctcgccctcctcagggaaggcgcgcggcacagtcctggagccccaggctcgaatctccgcgggcgcctactaacccggaaccttctgccacccctcccctcgacaggtcatccagcgtgggctgcctggccgaagcttccgctagatttcctgctcggacaagaaacctgagcggggagcccaggactcgccaggattctccaaaacccagcggatccggagaaccccgggctcacccacaccagcccgaagatcgtgtacctcctaatgcctag

SEQ ID NO: 191027 - DNA, 7218 bp, Artificial Sequence
  Description of Artificial Sequence: Synthetic coding sequence
atggaccccgagcagagcgtgaagggcaccaagaaggccgagggctccccgcgcaaaaggctgaccaaaggcgaggcaatccaaacaagcgtctccagctcggtaccttaccctggctctgggaccgctgcaactcaggagtcccctgcgcaagagctgctcgcgccgcaaccgttccctgggccttcatccgtgctgcgcgagggcagccaggagaagacagggcagcaacagaagcctcctaagcggccccctattgaagcgtcagtccacattagccagttgccgcagcacccactgaccccggctttcatgtcccccggaaaacccgaacatctgttggaagggtcgacctggcagcttgtggatcccatgaggccgggcccaagtggaagttttgttgcaccaggcttgcacccacaaagtcagctcctaccctctcacgccagcatcataccgcctgaagacttaccaggggtccctaaagtgtttgtgcccaggccctcacaggtgagcctaaaacccacagaagaggcacacaagaaagagcgcaaacctcagaagccagggaaatacatttgtcaatactgcagtagaccttgtgccaagcccagtgtactccaaaaacatatacggagtcatacaggagaaaggccttacccatgcggaccctgcggattctcatttaagactaagtctaatctgtacaaacatcgtaagtcccatgctcaccgcataaaggccggcctagcgagcggaatgggcggggaaatgtacccccacggactggagatggaaaggatccccggtgaggagtttgaggagcctacggagggtgaatctacagatagcgaagaggagaccagtgctacaagtggtcatcccgccgagctgtcacctcgcccgaagcagcctctcctgtcaagcggcctgtatagcagtggaagtcattcttccagccacgagaggtgttcgttatcacaaagtagcacagcacagagcctggaagacccgccaccattcgtagagccctcttcagagcaccccttgtcacataagcctgaggatacacatacgatcaagcagaaattggcccttcgactgagtgaaaggaaaaaggtgatagacgagcaagcctttctctcccctggctcaaagggcagcaccgagagcggttacttctctcgttctgaatcagcagaacagcaggtgagcccgccgaataccaacgctaaatcctacgctgaaattatcttcggcaagtgcgggagaatcggtcagaggaccgctatgctgaccgccacttccacgcaaccgctgctgcctctgtccactgaagacaaaccgtctctggtgcccctgtcagtaccacggacgcaggtgattgagcacatcaccaagctcattactatcaacgaggctgttgtagatacctccgagattgattctgtcaagccaagaaggtcttcccttagtcgcagatccagcatggagtcccctaaatcctccctttatcgagagcctctgtcttcccatagtgaaaagaccaagccagagcagtcactgctgagcctccagcaccctcctagtacggcacctcccgtgcctcttctgcggagccattctatgccatctgccgcgtgcactatcagtactcctcaccacccttttcgaggttcatattcctttgatgaccatataaccgacagcgaggcgctttcgcactcttcccatgtgttcacctcccatccaagaatgcttaaaaggcagcctgctattgagctgccccttggtggcgagtattctagcgaggagccgggtccatctagcaaagatactgctagcaaaccctccgatgaagtcgaacctaaagaaagtgagctcacaaaaaaaacgaaaaagggattgaagacaaaaggagtgatttatgagtgtaacatttgcggcgctagatataagaagcgagataactatgaagctcacaaaaagtactattgcagtgagttgcaaatcgctaagccgatctctgccggtacacatacctcacctgaggccgaaaaaagccaaatcgagcacgagccctggagccagatgatgcattacaagctgggaactacactcgaactaacgccactaagaaagaggcgtaaggagaaaagcctcggagacgaagaggagccaccagcctttgagagcactaaatcacagtttgggagtccaggaccctctgatgctgcacggaatcttcctctcgagagtactaagtcgccagcagagccaagtaagtcggtcccctcactcgagggcccaaccggctttcagccaagaactccaaaaccagggagcggaagcgaatcagggaaggagcgcagaacgaccagcaaggagattagtgtaatccagcatacttcttcctttgaaaaaagcgactcactggagcagccttccggcctggaaggggaggacaagcctctcgcccaattcccatccccaccccccgctcctcacggacggagcgcgcactccctgcagcccaaactcgtgaggcagccaaatatccaggttcctgaaattctcgtcactgaggaacccgatagacccgacacagaacctgagcctcctcccaaggaacctgaaaagaccgaagaattccagtggccccagcgctcccaaacactggcccagctcccagctgagaaactgcccccaaaaaaaaaaaggcttcggcttgcagagatggcccagtcatctggagaatcttctttcgagtcctctgtacccctgtcaagatccccctcccaggaatcaaacgtgagcctaagcggatccagtcgttccgcaagcttcgagcgagatgatcatggtaaggcagaggctccctcgcccagcagtgacatgcgccctaagccactaggaacccacatgctgactgttccatcgcatcacccacatgcccgcgaaatgcgccgatccgcgagtgagcagagtccaaatgtgtctcacagcgctcacatgactgagacacgaagtaagagttttgactacggttcgctgagcctcacaggtccctccgcacctgcccccgtcgcccctcctgcgagggtcgcgccccctgagaggaggaagtgctttcttgtccgacaggcctcattatcacgccctcctgagtcagaactggaggtggcacccaaagggaggcaggagtccgaagaacctcagcccagcagcagcaaaccaagtgccaaaagtagcttgtctcagatcagctccgctgccactagtcacggggggcctccgggaggcaagggtccagggcaggacagacccccactggggcctacagtcccgtacacggaagccctgcaggtgttccatcatccagtggcacagacccccctacatgagaaaccctacttgcctccccccgtgagcctgttcagctttcaacacctggtgcagcacgagcccggacagagtcctgagtttttctctacgcaggcaatgagctcgttgttatcctctccatactcgatgccacctctgcccccatccctgtttcaggcaccccccctgcctttgcagcctactgtgctacaccccggacagctgcaccttccacagcttatgcctcaccccgcaaatataccattcagacagcctccctcattcctgcccatgccctatccaaccagcagcgccctgtcctcaggctttttcttgcctctgcaatcccagttcgcgttgcagctgccaggagacgttgagtcacacctgccacagattaagaccagcttggcccctttggccacaggctcggccggcctttctcctagtactgagtatagtagtgatattcgccttccaccagtggcccctcctgctagtagttcggcccccaccagcgcacctcctcttgccttaccagcgtgcccagatacaatggtgtctctggtggtgcctgtgagggtgcagacaaatatgccttcatatggaagcgctatgtatacgactctgtctcagatactggtgacccagtcacaaggttcgagcgctacggttgccctgcccaagtttgaagagcccccatctaagggaacaaccgtctgtggggccgatgtgcatgaggtcggacctggcccaagcggcctcagtgaggaacaatccagagctttcccgacgccatatctgagggtgcccgtcacactgccagagagaaagggaaccagcctctcaagcgagtccatactctcattggaagggtccagttccacggctggcggctccaaacgagtcctgagtcccgccgggagcttagagcttactatggaaacacaacagcaaaagagagtgaaggaggaagaagcctctaaggctgatgagaaactggagcttgtgaagccatgttctgtcgtgctcacttcaaccgaggacggaaaacgaccagaaaagagccatctcggcaatcagggccaggggcgcagagagctggaaatgctgtcttccctctcttcagatccttcggatacaaaagagattccccccctgccacatcctgcactgagccacggaaccgcccctggatcagaggcgctaaaggaatatccacagcccagtggcaaaccccacagaagaggcctcaccccgctgtcggtgaagaaggaggattcaaaggaacagcccgacttaccgtcgctggcgccaccctcaagcctacctttgagcgaaacttcatctcgtcctgccaaatcgcaggaagggaccgactctaagaaggtgctgcagtttccatctctgcatactactacgaatgtctcttggtgctacctgaattacattaagccaaatcatattcagcatgcagaccggcgatcttccgtctatgccgggtggtgtatatcactgtacaatcctaatcttccgggtgtcagcacgaaagctgccctctctctcctgcggagtaagcaaaaggtgtccaaagaaacatatactatggccaccgcccctcaccctgaggctggaaggctggtgccaagctcaagtcgaaaacccaggatgaccgaagttcacctgccttccttggtgagcccagagggccaaaaggatttagccagagtggagaaggaagaagagagacggggcgaacctgaagaagacgctcccgctagccagcgtggggagcccgcccgcatcaagatcttcgaaggtggctataagagcaatgaggaatatgtatatgtacggggtcgcggccgcggcaaatatgtgtgtgaagagtgtggaatccggtgcaaaaagccctcaatgcttaaaaagcatatacgcacgcacaccgatgtgcgtccctacgtgtgtaagcactgccactttgccttcaagacaaagggaaacctgaccaagcacatgaagtctaaagcacactcaaaaaaatgccaggaaacaggggtcctggaggaacttgaagccgaagaggggacatctgacgacttatttcaggattccgagggaagagagggttccgaggccgtggaagaacaccagttctcagatttggaggattccgactcagattccgacttggatgaggatgaagacgaggatgaggaagaatcccaagatgagcttagtagaccatcttccgaagctcctccaccaggtcccccccacgctctgagagcggatagctccccaatcttagggcctcagcctccggacgcccctgccagcggtacagaagcgacaaggggctcatctgtaagtgaagccgagcgattgactgcctcctcgtgcagtatgtcctcacagtccatgcctgggctcccttggctggggcccgcgcccctgggctccgttgagaaggacaccggatcggctctaagctataaaccagtttcgccgaggcggccttggagtcccagcaaagaagctggcagcagacctcctcttgctcggaaacacagcctgactaagaacgactcaagtcctcagagatgctctcctgccagggagcctcaggcaagtgccccgtccccacctggtctgcatgtcgaccccggtcgtggcatgggagctctcccctgtggatccccaagactgcagctgagccctttgactctctgcccacttggcagggaacttgcgccccgggctcatgtcctttcaaagctcgagggaaccactgacccgggcctacccaggtactcacctactcgtagatggtcaccaggccaggctgagtctccccctcgctcggccccccctggaaagtgggcactcgctggaccaggcagcccctctgccggggagcacggcccgggcctcggtttagacccgagagtgctttttccccccgcccctcttccgcataagttgttgtctcgaagcccggaaacatgcgcaagcccctggaaagccgaatcaagaagcccatcgtgtagccccggacctgcccaccccttgtcctccagacccttcagcgctctacacgatttccatggccacatccttgcccgtacggaggagaatatattttcccatttacctcttcatagtcagcacctgaccagggcaccgtgtccactgattccgattggcggtatccagatggtgcaagccaggccgggagcccatcctactctgcttccagggcccacagctgcttgggttagtggattcagtggaggcgggtctgatctgaccggcgccagggaagcccaggaacgaggcagatggagccccaccgagtcgagttccgctagtgtatcccccgtggctaaggtctctaaatttaccctgagctctgaactggaagggggtgattatcccaaagaaagagagcgtactggcggcggccctggccggcctcccgattggacaccacatgggacaggcgccccggcagagcccacacctacacacagcccctgcacccctccagacacgttaccacgcccgccccagggccgaagagcggcccagtcgtggtcaccacgcctggaaagccccagggcgcccaccaaccccgaaccaagtgctacccctccactcgataggtcgagcagcgtcggatgcctggccgaagcctccgctagattccccgccaggacacggaatctctcaggtgagccacgcaccagacaagattctcccaaaccctcgggctcgggagagccacgggcccacccgcatcagcctgaagacagagttcccccgaatgcgtag

SEQ ID NO: 191028 - DNA, 7218 bp, Artificial Sequence
  Description of Artificial Sequence: Synthetic coding sequence
atggaccccgagcagagcgtgaagggcaccaagaaggccgagggctcgcccaggaagcgacttaccaaaggagaagccatacagaccagtgtgtcctcaagcgtgccctaccccggatccggcactgctgcgactcaagaatcccccgctcaggaactccttgcgccacaacccttcccaggtccgtcgagtgtcctgcgggaaggttctcaggaaaaaactgggcagcagcagaagccgcctaaaagaccgccgatcgaagccagcgtgcatattagtcagctgcctcagcaccccctcactcccgcattcatgagccccggaaaacctgaacacttgctggaggggtctacctggcagttggtcgacccaatgcgacccggacccagcggaagttttgtggccccgggactgcatccacagtcccagctgctgccatcccacgcttcaattatcccgccagaagatctgcccggggtaccaaaggtatttgtacctcgtccatcacaggtttcactgaaacccacggaggaagcccacaagaaggaaagaaaaccacagaagcctgggaaatacatctgccagtactgctcacgaccgtgcgccaagccgagcgttctgcagaaacatatccgcagccataccggagagaggccttatccctgtggcccttgtggcttcagttttaaaactaaaagcaacctgtacaagcatcggaaatctcacgcgcacaggattaaagccggccttgcgagcgggatgggaggagaaatgtaccctcacggcctggagatggaacggattcccggggaagaattcgaggaacccacggagggggagagcacagacagcgaagaggaaacctctgccacatccgggcacccagccgagctctctcctagaccaaagcagcccctacttagctccggtttgtattcctccgggtcccacagttccagtcatgaacgctgctctttgtctcaatcctcaactgctcagtctctggaggaccctccgccctttgtagaaccatccagtgagcaccctctcagccataagccagaagacacgcacaccatcaagcaaaaactggcattaaggctcagcgagaggaaaaaggttatcgacgaacaggccttcctgagccccggaagcaaaggaagcaccgaaagcggatacttctctcggagcgagtcagctgagcagcaggtgagccccccaaatactaacgcgaaatcctatgccgagatcatttttggaaagtgtgggcgcattggccagaggacagctatgttaacagctacatccacccagccattactaccactctccaccgaagacaaaccgagtctcgttccactctccgtgcctcggacccaggttatagagcacatcacaaaactcatcaccatcaatgaagctgtggtggacacatccgagatcgactcggtgaaaccccgacgcagctctttaagtaggcgtagttccatggaatccccaaagtcttctttgtatcgtgagccattgtctagccactctgagaagaccaaaccggagcagagtctgcttagcctccagcatcctccctctaccgcaccaccggtgcctcttctgcgctctcacagtatgccaagcgccgcctgcaccatttccacccctcatcacccattccgcggaagttactccttcgacgaccacatcaccgattccgaggctctgtcacactcttcgcacgtgtttacttcccaccctaggatgttgaagcggcagcccgctatcgaactaccactgggcggagagtactccagtgaagagccgggaccgagctcgaaggatacagcttccaagccgagtgacgaggtagaacccaaggagtccgaactgaccaagaaaaccaaaaagggtctgaagaccaagggagtgatctacgagtgcaacatctgcggcgctcgttacaaaaaaagggacaactacgaagctcacaaaaaatattattgttctgagctgcagatcgctaaacctatcagtgcaggtactcacacctcaccagaagccgaaaagtcccagatcgagcacgagccgtggtcacaaatgatgcattataaactcgggactaccctggagctgactcccttaaggaaaagacggaaggagaagtctcttggagacgaagaggagccacctgcttttgaaagcaccaagtcccagtttgggtcccccgggcccagtgacgccgccagaaatctgccactggagagcaccaaatcccctgccgaaccttcaaagagcgtgccttcactggagggaccgactggcttccagcccaggacgcccaaaccaggttccggaagcgaatccggcaaagagcggcgaactactagcaaggagatttcagtcatacagcatacctcgtcatttgagaagtcggacagcctggaacagccttctgggctcgagggcgaggacaagcccctggcccagtttccatcccccccaccggctccacatggtagatccgctcattctctgcaacccaaattggttcgacagcctaatatccaggtgccagagatcctggtgaccgaggagcccgaccggcccgacacagagccagagccacctcctaaggagcctgagaagactgaggaatttcagtggccacagaggagccagacgttggcccagctgccagctgaaaaactgccaccgaaaaaaaagcgcctgaggctggctgaaatggctcagagcagtggggagagttccttcgaaagctccgtccccctaagcaggagcccttcacaggagtcgaatgtctccttatcagggagctccagaagtgctagctttgaacgcgatgaccacgggaaggccgaggctccatccccaagctccgatatgcggcctaaaccattaggcactcacatgctgactgtgccgagccaccacccccacgccagagagatgcgtcggagtgcatctgaacagtcccctaatgtttcccactctgcccacatgacagaaactcgcagcaaatcattcgactacggcagcctgtcattgacaggaccctctgctcccgcacctgtagcgccccccgctcgggtggcacccccagaaaggcggaaatgttttctcgttcgccaggcctccctgtctcggccgcctgaaagcgaattagaagtcgctccaaagggcagacaggaaagtgaagaaccgcaaccgtcaagtagcaaaccctcagccaagagcagcctgagccaaatttcctccgctgcaacctctcatggtggtcctcccgggggtaaaggaccgggccaggatcgaccccccttgggcccaacagtgccctacacggaggctctgcaggttttccaccacccagtggctcaaactccactgcatgagaaaccatatctacctcctccagtgtctcttttctcctttcagcaccttgtgcaacatgagcccggacagagccccgagttcttctccactcaagccatgtccagcttgctgtcatctccctacagcatgcctccactgcctccatctctgttccaggctccacctttgcctctgcagcccaccgtgctacacccgggccaattgcatctgccgcagcttatgccccaccccgctaatattcccttccgccagccccctagttttctcccgatgccatatcccacctctagtgcgctgagttcggggttctttctccctttacagtcccagtttgctctgcagctgcctggagatgttgagagccatctaccccaaattaaaactagcctggctcctctggctacggggtcagccggcctatccccctctacggagtattcttcggacatacgactgcctcccgttgccccccccgcttcgtcgtctgctcccacctccgccccccccttggcattgccagcatgccccgacacaatggtttccttagtggtgcctgtacgggtgcaaaccaacatgccttcctatggatctgccatgtacactaccctgagccaaattttggtcacgcagagccaggggtcctctgctactgttgctctccctaagtttgaagagcctccatcaaagggaacaactgtgtgcggcgccgatgtccatgaggtcggtcctggtccctcaggcttgtctgaggagcagtcccgggccttcccaactccctacctgagggttcctgtcaccctgcccgagcgaaaggggacctccctttcaagtgagtctatcttgtccctcgagggtagcagttccacggccggagggtccaaacgcgtgctgagccctgccggaagcctggagctgaccatggaaacacagcaacaaaagcgggtgaaggaggaagaagccagtaaagctgacgagaagctcgagctcgtgaaaccttgttcggtggttctgactagtaccgaggacggcaaaaggccagagaagagccacctgggcaatcaggggcaggggcggcgcgaattggagatgctgagttccttatcaagtgatccttctgacacaaaggagattccaccgcttccacacccggccctctcccatgggacagcacctggaagcgaagccctcaaggagtatccccagccaagcggcaagccccataggcgcggcttaactccactcagcgtcaaaaaggaagatagcaaggagcaacctgacctcccaagcttagctccaccgtcatctctgccgttaagcgagacatccagcagacctgctaagagccaggagggcacagacagcaagaaggtgctgcaattcccgagcctgcatacaacaacaaatgtctcctggtgctatctgaactacatcaagcccaaccatattcagcacgcagatcgccgcagctcggtgtacgctgggtggtgtataagcctctacaaccctaacctacccggtgtttctaccaaggccgcgctgagcctgctccgctctaaacagaaggtgagtaaagagacgtataccatggcaacagcaccccatcccgaggcagggcgattggtgccgtcttcctcaagaaaaccacgcatgactgaggtccatctgccctccttggtgtctccagaagggcagaaggatctggcacgtgtggaaaaagaggaagaaaggcgcggagaacccgaggaggacgcaccagcaagccaacgcggcgaaccagcgcgcatcaagatctttgagggaggctataaaagcaacgaagaatacgtctatgtgcggggaagagggcggggcaaatatgtctgcgaggaatgcggcattaggtgtaagaaaccgtccatgctcaagaaacacatcagaacccacacagacgtgcgcccctacgtctgtaagcattgtcattttgccttcaagacaaagggcaatctcacaaagcacatgaaaagcaaagcacactccaagaagtgccaggaaactggtgtattagaggaacttgaagccgaagagggaacctccgacgacttgtttcaggattccgagggccgggaaggatctgaggctgtggaagagcatcaatttagcgacctggaggactctgattctgatagcgatctggacgaggacgaagatgaagacgaggaggaatctcaagacgaattgtcccggccatctagtgaggcgccccctccaggaccaccccacgccttgagggccgattcatcccccattctgggccctcaacccccagacgcccccgcctctggcaccgaagccacacgaggcagcagcgtctccgaagccgaaagactcactgctagctcctgcagtatgagcagccaatcaatgccagggttgccttggctgggccccgctcctctgggctcagtcgagaaggatacaggcagcgcactgagctataagccagtcagtcccagacggccctggagcccctctaaagaggcgggctcaagacccccgctggctcgtaagcattccctgacaaagaatgatagctcgccacagaggtgctcacctgccagggagcctcaagcctcagctccatcccctccaggactccacgtcgatcctggtcgaggtatgggcgcccttccatgcgggtccccccgtcttcagcttagccccttgactctctgcccattgggccgggagctggcaccccgcgcacatgtgctctcaaaacttgagggcaccaccgacccaggtctgccgcggtactccccaacccgccgatggagtccaggccaggccgaatcaccacccaggtcagccccccctggcaaatgggcactagcgggtccaggcagcccttctgcgggggagcacggacctggcctggggctggatccacgtgtgctgttcccacctgcccccttaccgcacaaacttctcagcaggtcgcctgaaacctgcgctagtccctggaaggctgagtctcgttccccctcctgctctcccgggcctgcgcaccccctgtcctcacggccattctcagccttacacgattttcatgggcatatcttagcaagaactgaagagaatatcttttcccaccttcccctccacagtcagcaccttacccgcgccccgtgtccactcattcctattggcggcatccagatggtgcaggccagaccaggggcgcaccccacccttttgccgggccctaccgctgcctgggtaagtggcttttctggaggaggatccgatttaaccggggctagagaagctcaggaacgaggccgctggagcccgaccgagtcttccagcgctagcgtgtcacctgtggctaaggtctcaaaatttactctgtctagcgaactcgagggaggagattatcctaaggaacgcgagaggaccggtggaggaccaggccggcccccggactggacgccccacggcaccggcgccccagccgagcccactcccacccactccccttgcacaccccccgatacacttccccgtcctcctcaaggtaggcgtgccgcccaatcttggagtccacggctggagtctccaagggctcctacaaaccccgaacccagtgcgactccccctctggatcggtccagctccgtgggttgtcttgcagaggcatcggccagatttcctgccaggactcgcaatttgagcggggagcccaggacacgccaagatagcccgaaaccctccgggtccggcgaacctcgcgcccaccctcatcagccagaggatagggtccctcctaatgcctag

SEQ ID NO: 191029 - DNA, 9429 bp, Artificial Sequence
  Description of Artificial Sequence: Synthetic coding sequence
atggccaccctggagaagctgatgaaggccttcgagagcctgaagtccttccagcagcaacagcagcagcagcagcagcaacagcaacagcagcagcagcaacaacagcagcagcctcccccacctcctcccccaccccctcctccccaattgccacagccaccacctcaggcccagccccttctgccccagcctcagccccccccacctcctccacccccaccgccaggtcctgctgttgccgaagagcctttacaccggcctaaaaaggagcttagcgctacaaaaaaggaccgcgtcaaccattgcctgacaatttgcgagaatatcgtagcacagagcgttcgtaacagccccgagtttcagaagctgctcggaatcgcgatggagctgttcctcctatgctctgatgacgctgaaagcgatgtaaggatggtcgcagacgagtgtctgaataaggtaattaaagccctcatggactctaatctccctcgcctgcagctggaattgtataaagaaatcaagaaaaatggtgcacctcggtcgctgagagccgccctctggcgctttgcagagcttgctcacttggttcgccctcagaaatgtagaccttatctggtgaaccttctgccttgtcttaccagaacttccaaacgaccagaagagagcgtacaggaaaccctggctgctgcagtgcccaagatcatggcttcattcggcaactttgccaacgataatgagatcaaagtgctactgaaagcctttatcgccaacctcaaaagctccagccccaccattagacgcactgcggcaggttccgctgtttcgatctgtcagcacagccggcggactcagtatttttactcttggttactgaatgttctgttgggccttctggtcccggtggaggacgaacattcaacattactaattcttggcgttctcttaaccctgcggtatctcgttcctctattgcaacagcaagtgaaagacacgtccttgaagggctcattcggcgtcacacgaaaggaaatggaggtgagcccttccgcagagcagctggtacaagtgtatgaactgactctgcaccatacgcagcaccaggatcataacgtggttacaggggcgctggaacttctacagcagctgttccgtactccaccccctgaattgctccagactttgaccgccgtaggagggatcggccagcttactgccgccaaagaggaaagcggaggcagatcgcgatccggctctattgtcgaattgatcgcaggggggggctcttcctgcagtcctgtgctgtctcgcaagcagaaaggtaaggtactcctcggtgaggaagaggctcttgaagatgatagcgagtctaggtcagacgtctccagtagcgcgcttacagcaagcgtgaaggacgaaatctctggtgaactggcagcttcatccggagtgagcaccccaggaagcgcagggcatgatataataactgagcagccacggtctcagcacacactgcaggctgactcagtcgacttagcttcctgtgatcttacatccagcgcaaccgatggcgacgaagaggacatcttaagtcattcatcaagtcaagtatcagccgtgcccagtgatccagccatggatttgaatgacgggacccaggcttccagtcccatatcagacagttctcagacaaccacggagggaccagatagcgccgttaccccatccgattcgagcgagatcgtgctggacggcactgataatcagtacttggggctgcagattggtcagccgcaggacgaggacgaggaagctacaggaatcctccccgacgaagcgagcgaggcctttcgaaactctagtatggcgcttcagcaggcccacctgctgaaaaacatgagtcactgccgtcaacccagtgactcctcagtggataaattcgtgctccgtgatgaagccaccgaaccaggggaccaggagaataagccctgtcggatcaagggcgacatcggacagtcaacagacgatgactcagcaccactcgtgcactgtgtgaggcttctgtcggcgtcatttctcttgacagggggcaagaatgtcctcgtgccagaccgcgacgtccgcgtctccgtgaaagctctcgccctgagctgcgtgggcgccgccgtggccctccatccagaatcttttttctcaaaactgtacaaagtgcccctggacaccaccgagtaccctgaagagcagtatgtaagcgatattctcaattacattgaccatggggaccctcaggtgaggggtgccacagcgatactctgtgggacactgatttgtagcatattgtcacggagccggtttcacgtgggcgactggatggggacgatacgaactctgacaggcaacaccttctctctagctgattgcatcccgcttcttcgaaagaccttaaaagatgagagcagcgtgacctgtaagctcgcatgtaccgccgtacgcaactgcgtaatgagcctctgctcgagtagctactccgaattgggactgcaattgatcatcgatgtgctgacattgcgcaattcaagctactggctggtcaggacggagctcctcgagactctggccgaaatcgacttcaggcttgtaagtttcctggaagcgaaggccgaaaatctgcatcggggagcacaccactataccggtctgttgaaactacaggaaagggtgctgaacaacgttgtgatccacttattaggagacgaggatccacgagtccgacatgtggccgccgcctccctgatccggctcgtgcccaagctgttctacaaatgcgatcagggacaggcagacccggtggttgccgtcgcccgagaccagtccagcgtgtacctaaagcttcttatgcacgaaacgcagccgcctagccacttcagcgtttccaccattaccaggatctacagaggctacaacctgttgccctctatcacggatgtgaccatggaaaataatctgagccgtgtcatcgccgccgtgtcacacgagctgattacctcaacgacacgagccctcacatttggatgctgcgaggccctgtgtctgcttagtacggctttcccggtgtgcatctggagtctgggctggcattgtggggttcctcccttaagcgcatcagatgagtccagaaagtcttgcactgtgggcatggcaacaatgatcttaacactgctctctagcgcctggttcccgcttgacctcagcgctcatcaggacgcactgatcctcgctggcaatttgctggccgcctccgctcctaaatctctgagaagctcttgggcatctgaagaagaggccaacccggccgcaacaaaacaggaggaagtatggcccgcgctgggggacagagccctggtgccaatggttgaacagctgttctcacacctgctcaaagttattaatatttgcgcccatgtgctggacgatgtcgccccaggaccagctatcaaagccgcactgccttccctgactaatcccccttctctgagccctatcaggaggaaagggaaagagaaagaacccggagaacaggccagtgtacccctgagccctaagaaagggagcgaggcaagcgccgccagtcggcagtctgatacttcagggcctgttaccacgtctaagtcaagctctctgggctctttttaccaccttccgtcctacctaaaactgcatgacgtgttgaaggccactcatgctaactataaggtgactttggacctgcagaattcaactgagaaattcggcggcttccttcggtccgctttggatgtcttgtctcaaattttggagctcgccaccctccaggacatcggcaaatgcgtcgaagagattttaggctacctcaagtcttgcttcagcagagagccaatgatggcaacagtatgtgtacagcaactcctcaagacattatttggtacgaatctggcctcgcagttcgatgggctgagctcgaatccctcaaaaagtcagggcagggcccagcggctgggcagcagctctgtacggccgggcctataccattactgttttatggcgccttacactcatttcactcaggcattggccgacgcatctctgaggaatatggtacaggccgaacaagaaaacgacaccagcggttggtttgacgtccttcagaaggtctcaacacaactcaaaactaacctgacctctgtaaccaaaaacagggcagataaaaatgctatccacaatcacattagattgtttgagccgctggtgataaaagctctcaaacagtacaccaccaccacctgtgttcagttacagaagcaggtgctcgatttgctggcacagctagtgcagctgcgagtgaactactgcttgctggactccgaccaggtgtttatcggatttgttctcaagcagttcgaatatattgaggtcggacagtttagagaaagcgaagctatcatccccaatatattcttctttctggtgctgcttagctatgagaggtatcactctaaacagatcatcggaattccaaaaatcatacagctctgtgatggcattatggcaagtggacgaaaggctgtgacgcacgccataccggcgttacaaccgatcgtgcacgatctctttgtcctgcgggggacaaataaggcagatgctggaaaagagctcgagacgcaaaaagaagttgtagtgagcatgctgctcaggctcattcaatatcaccaagtcctggagatgtttattctggtcctgcagcagtgccataaggaaaatgaggacaaatggaaaagactctctagacagattgccgatatcattttaccaatgcttgccaagcagcagatgcacatcgacagtcacgaagccctgggagtcctgaatacactcttcgaaattcttgcaccctcatccctgcgccccgtggacatgctgctgagatccatgttcgtaacacctaatacaatggcttccgtatcaaccgtccaactctggataagcgggattctggcgatcctccgcgtgctgatttcccaaagtaccgaggacatcgtcctgtcacggatccaagagctgtctttcagcccctatctaattagctgtaccgtcattaacaggctacgtgatggggacagtacttccactttagaagagcattctgaaggcaagcagatcaaaaatttacctgaggaaactttcagccgatttctgctacagctggtggggatactactcgaggatatagtgacaaagcagcttaaagttgagatgtcggagcaacaacacacgttttattgtcaggagctgggaacactgctaatgtgcctgatccatattttcaagtccggcatgtttcggcggatcacggccgccgccacccgcttgttccgaagtgacggttgcggcgggtcattctacaccctggactcactcaacctgagggctagatctatgatcacaacgcatccggcactggttctcctctggtgtcagattttactgttggtcaaccacaccgactatcgctggtgggccgaggttcagcagactcctaaacgccactcactcagcagtactaagcttctttccccacagatgtcaggcgaagaggaggatagtgatctggctgccaagctgggaatgtgcaatagggaaatcgtgagacgaggtgctcttatcctcttttgcgactatgtttgccagaatctgcatgatagcgaacatctcacatggttaatagtcaatcacatacaggacctgatatcgttaagtcacgagccaccagtgcaggacttcatatccgccgttcacagaaactctgcggcatctggcctttttatacaggctattcagagccgctgcgaaaacctcagtacgcccaccatgctgaagaagactcttcagtgtcttgagggcatacacctctcacagagtggcgctgtgctgacactgtacgttgacaggctgctctgcacaccgtttagagtgctggcccgtatggtcgatatactcgcatgcagaagagtggagatgctcctggccgccaacctgcaatcaagcatggcacaactgcccatggaagagctcaatcggatccaggagtatctccaaagctcaggactggcccagagacatcaacgcctgtatagccttctagacagatttcggctctcaaccatgcaggacagtctgtccccaagccctccggtcagtagccatcctctggacggcgatggacacgtgtccctcgaaacagtttccccagataaagattggtacgtccacctggtgaagtcacagtgctggaccagatcagatagtgcccttcttgagggagctgagctcgtgaaccggattccagccgaggacatgaatgctttcatgatgaacagcgagtttaacctgagtctcctcgctccgtgtctctccctgggcatgtcagagatcagtggcggccagaagtctgcactgtttgaagctgccagggaagtcaccttagcaagggttagcggtacggttcaacaactgccagccgttcaccatgtcttccagcccgagctgccagccgagccagcggcctactggtcaaagttaaatgatctgtttggcgatgctgccctgtatcagtctctgccaacattggctcgcgccctggctcagtatctcgtggttgtgagtaaactccccagccatctgcatctccctccagagaaagaaaaggacatcgtgaagttcgtagtggctaccctggaagctctgagttggcatcttatacatgagcagattccactgtcattggatttgcaggccggtctagactgttgctgcctagcgttacaattgcctggcctgtggtctgttgtgtcttccacagagtttgtcacccacgcttgtagtctgatctactgtgtccattttatccttgaggccgttgcagttcagccaggcgagcagctgctgagccccgagagacggacaaacactccaaaggccatcagcgaggaagaggaggaggtggatccaaatacgcagaacccaaaatatatcacggctgcatgcgaaatggtcgccgaaatggtggagagccttcaaagcgtgcttgctctaggccacaaacgaaactccggagtgccagcctttctgacccctctcctgaggaacatcataataagtttggcccgtctgccattagtgaatagttacacccgggtgccccctctggtgtggaagttaggatggtcccccaaacctggtggagattttgggaccgcttttccagagataccagtcgagtttctgcaggagaaagaggtgttcaaggaatttatatacaggatcaacacactgggttggacaagtagaacccagttcgaagagacctgggccactctgctgggggtgcttgtgacacagcctctagtgatggagcaggaagaaagtccccctgaagaggatacagagaggacccagattaatgtcctggcagtgcaggccatcacgagcctcgtgctttcagccatgacagttcccgtggccggaaatcccgccgtttcatgtctggagcaacagcccaggaacaagccactgaaagccctggatacacgatttggtaggaagctctccattatcaggggcatagtggaacaggagattcaggctatggtgtcaaaacgcgaaaacatcgccacccaccatctgtaccaggcctgggacccagtcccctccctttctcctgctactacaggggcactgatcagccatgaaaaacttttactgcaaataaatccagagcgtgaactcggttcaatgagctataaactaggtcaggtcagcatccacagcgtctggctcggaaactcaattacccccctgcgggaagaagagtgggacgaggaagaggaagaagaagctgacgcgcctgccccatctagtcccccaacttcccctgtcaacagcagaaaacatcgagccggggttgacatccatagctgcagtcagtttctgttagaactgtacagccggtggattcttccctcttcttccgctcgtagaacaccagcaatcctcatcagcgaggtagtgcggtcgctcttggtggttagtgatctgttcaccgaacgcaaccagtttgaactaatgtacgtcaccttgacagaactgcggcgggtccaccctagcgaagacgaaatcctcgctcagtacctggtgcccgccacatgtaaggccgccgccgtactggggatggataaagcagtagcggagcccgtatcgaggttgcttgagtcgaccctccgctcgagccacctgcccagtagggtgggtgcgctgcacggcgtattatatgtcttggagtgcgatttactcgatgacacagcaaaacagctcatccctgtcatcagcgactatctgctgtccaatctgaaggggatcgcacactgcgttaatattcacagtcagcaacatgtgttggtcatgtgcgccactgcattctacttaatcgagaactacccattggatgttggacccgaattctcagcttccattatccagatgtgcggagtaatgctttcaggttcagaagagagcaccccctccatcatctaccattgtgcattgcgaggactggaaagactcttgttaagtgagcagctctctcgtttggatgcggaaagcttggtgaagctgtcggtggatagggtcaatgttcactcaccacaccgagcgatggccgccctgggactgatgttgacgtgcatgtatacgggtaaggaaaaggtgtcacctggccggactagcgacccaaatcccgccgcaccagatagcgagagcgtcattgtggctatggagagggtaagtgtgctattcgacaggattaggaaaggcttcccatgcgaggctagggtggtcgcccgcatcttgcctcagttccttgacgattttttccccccacaagacattatgaataaggtgatcggtgagtttctgtctaaccaacaaccctacccgcagtttatggccaccgtcgtttataaagtgtttcagactctccacagtaccggacaatctagtatggtgcgggattgggtcatgttgagcctgagcaattttacccagcgggcaccagtggccatggctacttggtccctctcctgcttctttgtttcagctagcacctccccttgggtggctgccatcctccctcacgtgatatcacggatgggaaaactggagcaggttgacgtcaacctgttctgtttggtggctaccgacttttaccggcatcagatcgaggaggagctggaccgtcgggctttccagtcagtcctggaagtggtggccgctcccggatctccctatcaccgcctgctcacctgcctgcgaaacgtgcacaaagtcaccacttgctag

SEQ ID NO: 191030 - DNA, 3114 bp, Artificial Sequence
  Description of Artificial Sequence: Synthetic coding sequence
atggaccggatggccagcagcatgaagcaggtgcccaaccccctgccaaaggtgcttagtagacggggggtgggcgctgggttggaagctgccgaacgagaatcttttgaaagaactcaaaccgtgtccattaataaggcaatcaatactcaggaagtcgcagttaaggaaaagcatgcaagaacttgcattctgggaacccatcatgagaagggagcacaaacgttctggtctgtagtgaatcggctccccctttctagtaacgctgtgttgtgctggaagttctgccatgtgtttcataagctcctgcgcgatggccaccccaacgttcttaaagattcactcagataccggaatgagctgagtgacatgtctagaatgtggggacacctaagtgaaggatacgggcagctttgtagtatttatttgaaactgctgcgaacgaagatggaataccatacgaaaaatcctcgtttccctggcaacctacagatgtccgaccgacagttggacgaagctggggagagcgacgtcaacaactttttccagctgaccgtggagatgttcgattaccttgaatgtgaactgaacctgtttcagaccgtctttaactcactggacatgagtcgctctgtctccgtaacagctgccggccagtgtagactagccccccttatacaagtgattcttgattgctcccacctatatgattataccgtgaaactgctctttaagctgcattcctgcttgcccgctgacaccctacaaggacaccgcgacaggttcatggagcaattcacgaaactgaaagatctgttctaccggtcaagcaacctgcagtattttaagcgcctgatccaaatcccacaactcccagagaacccacctaatttccttcgggcttcagccctcagcgaacacatttctccagtcgtggtcattcccgccgaagcgagctcccccgattcagaacccgtgctggaaaaagacgatctcatggatatggatgcctctcagcagaacctgtttgacaataagttcgacgatatcttcggcagcagtttttccagcgaccccttcaacttcaattctcagaacggcgtcaacaaagatgagaaagaccacctgatcgaacgcctgtatagggagatatctggcttaaaagcacagctggaaaatatgaaaactgaatcccagagggtggttctgcagctgaaaggacacgtctcagagctggaggcggatctcgctgagcaacaacacctgaggcagcaggccgctgacgactgtgaatttctgcgggctgagctcgacgagctgaggcggcagagagaggacacagaaaaagctcagcggtcattgtcagagatcgagagaaaagctcaggccaatgagcaaagatactcaaagctcaaggagaagtactctgaactcgttcaaaaccacgccgatttgcttagaaagaatgccgaggttacaaaacaggtctcaatggcgcgacaagcccaagttgatctagagagagagaagaaggaactcgaggactctctagaacgtatctccgaccagggccagagaaaaacgcaggagcagctggaggtcctggaaagcctcaaacaggagctcgccacaagccaaagagagttacaagttctccagggttcgcttgaaacatcggcacagtccgaggcaaactgggccgcagaattcgctgagttggaaaaggagagggacagccttgtcagcggagccgcacacagagaggaggagctgagtgccctgaggaaggagcttcaggatactcagctcaagttggcttcgactgaggaatctatgtgtcagctggctaaggaccaacgaaagatgctcctcgtgggatctcggaaggcggccgaacaggtcattcaggacgccctgaatcaactggaggagcctcctctgatttcctgcgcaggcagcgcagaccacttgttgagcactgtaacatccatttcatcgtgtatagagcagctcgagaaaagctggtctcaatatttagcctgccccgaggacatctcgggtctgctgcacagcataactcttttagcccatcttactagtgatgcaattgctcacggagctaccacatgcttgcgcgccccacccgaacctgcagattccctgacagaagcctgcaaacagtatggccgcgaaactttggcttacctggctagcctagaggaagagggatccctggaaaatgctgattctaccgcgatgagaaactgtctttccaagatcaaagccataggagaggagctgctgcccaggggcttggatattaagcaggaggagctcggcgatctggtagataaagagatggcggccacatcagccgctatagaaacggcaaccgcccgcatcgaggaaatgctgtccaagtcaagagcaggggacacaggcgttaaattagaagttaatgagagaattttggggtgttgcacctcgctgatgcaggccatccaggtattgatagtcgcttccaaggatctacaaagggaaattgttgagtcaggccgggggacagccagcccgaaggaattttacgctaaaaactcacgctggacagaaggcctgatttctgcttcaaaggctgttggctggggcgctaccgtgatggttgatgccgccgatttagtagtccaaggaagggggaagtttgaagagttaatggtgtgttcacatgagattgccgcgtccaccgcgcaattggtggcagcctctaaggtcaaggctgataaggatagtcctaacttggcacaactgcaacaggcgtccagaggtgttaaccaagccaccgccggagttgtcgcgtctaccatcagcggcaaaagtcagattgaggaaacggataatatggatttctctagtatgacccttacacagatcaagcgccaggaaatggattctcaggtgcgcgtactagagctggagaacgagctgcagaaagagagacagaagctaggcgagctgcgtaagaaacactacgagctagcaggcgtagcagaaggctgggaggaggggaccgaggccagtccccctaccttacaggaagttgtcaccgagaaggaatag

SEQ ID NO: 191031 - DNA, 2961 bp, Artificial Sequence
  Description of Artificial Sequence: Synthetic coding sequence
atggaccggatggccagcagcatgaagcaggtgcccaaccccctgcctaaagtgctcagtcggcgaggcgtgggtgctggcctggaagctgctgagcgtgagagttttgagcgcactcagaccgtgagtattaacaaggctattaatactcaggaggtggccgtaaaggagaaacatgcccggacatgcattctcggcactcatcatgaaaagggcgcccagaccttctggagcgtcgtgaacagacttccgttgagctctaacgccgtcctgtgttggaagttttgtcacgtgtttcataagttattgagggatggccaccctaatgtccttaaggattcactccggtacagaaatgaactgagcgacatgtcacgcatgtgggggcatctctccgaaggctacggccagctctgctccatatacctcaagctgctcaggactaagatggagtaccacacaaagaatccgagattcccgggaaatctgcagatgagcgatcgccagcttgatgaagccggggaaagcgatgttaacaactttttccagttaaccgttgagatgtttgactatttagagtgcgaattaaatttgtttcagacggtgttcaacagccttgatatgagtaggagtgtcagcgtgactgcggcaggccagtgtcgcctcgcacccttgatccaggtgatcctagactgttcacatctgtacgactacacagtgaagctgctgttcaaactgcactcgtgcctccctgccgacaccctgcaggggcaccgggaccgatttatggaacagttcacgaagctgaaagacctcttttatcggtccagcaacctccaatactttaagcggctgattcagataccacagctcccagaaaaccctcctaatttcctgagggcatctgctttgagtgaacatattagtccggtggttgtgattccagcagaggcttcatctccggactcggagccggtgcttgagaaagacgacctgatggacatggatgctagccagcagaacctcttcgataacaagtttgatgacattttcggtagctctttctcttctgaccctttcaactttaattctcagaacggggttaataaggatgagaaagatcacctgatcgagcgactctatagggagatctctggcctcaaagcgcagctggagaacatgaaaacagaatcccaacgggttgtgttgcagcttaaagggcacgtgtcagagttagaggcagatttagccgaacagcagcatctgcgccagcaggccgcagatgactgtgagttccttcgcgccgaattggatgagctaaggcgccagagagaagacaccgaaaaagcccagcggagtctttctgaaattgaacgcaaagcacaggctaatgaacagcggtacagtaagctgaaggaaaagtattctgaactggtgcaaaaccatgcagatctcctcagaaagaatgcggaggtgactaaacaggttagcatggctcgccaggcccaggtggacctggagagggagaaaaaggaactggaggattcattagaaaggatcagcgatcagggtcagcgaaaaacacaggaacaactcgaagtactcgaaagcttgaagcaagagctggccacctcacagcgggaactccaggtactgcaggggtcactggagacatccgcccaatccgaggcgaactgggctgccgagtttgctgaacttgaaaaagaacgtgattccctcgtgagcggagccgctcatcgggaagaagagctgagcgccctccgcaaggagttacaggatacccaacttaaactcgctagcacagaggaatctatgtgtcagctcgctaaggaccaaagaaagatgctactggtcgggagccgcaaggctgccgagcaggtgatccaagatgcactcaatcagctagaggagccccctctcatctcatgcgcaggttcggccgatcacttactctcaacagtgacttccatcagtagctgcattgaacaattggaaaaatcctggagccagtaccttgcttgcccggaagatatatccggtctgctgcatagtatcactttgctcgcacatctgacatccgatgccatcgcgcacggcgcaacgacgtgtctgcgggcaccccctgaacccgccgacagtctcacagaggcatgtaagcagtatggtcgcgaaaccctcgcgtacctcgcttctctggaagaggagggttcgctcgaaaacgcggacagcaccgccatgagaaattgcctatctaagattaaggccatcggtgaagaactcctccccagaggcctggacataaagcaggaagaacttggcgacctcgttgacaaagagatggcagctacctcagccgccattgagactgctaccgcccgaatcgagggaaccgcatcaccaaaagagttttacgccaaaaatagccggtggaccgagggcctgatcagcgcctctaaggccgtgggatggggtgcaaccgtcatggttgatgccgctgacctggtagtgcagggtcgaggtaaattcgaagagttaatggtgtgctcacacgagattgccgcctcaacagctcagctggtggctgcatccaaagtgaaagctgataaggattcccccaacttagcgcagcttcagcaggcctctcggggggtgaatcaggcgacagcaggggtcgttgcctcaaccatctccggcaagtctcagatcgaggaaactgataatatggacttctcctcaatgactttgacacagataaaacgtcaggaaatggattcacaagtgcgcgtgctggaactggaaaatgagctgcagaaggagaggcagaagctgggagagctgagaaagaaacattacgaactagctggcgtggctgagggatgggaggaaggaacggaggcctctccacctaccctccaggaggtcgtgacagagaaggaatag

SEQ ID NO: 191032 - DNA, 3207 bp, Artificial Sequence
  Description of Artificial Sequence: Synthetic coding sequence
atgaacagcatcaagaacgtgcccgcccgggtgctgagccggcggccaggtcactcactagaagcggaacgggaacagttcgacaagacccaagcgatctctatcagtaaagccatcaacacccaggaggccccagttaaagaaaaacacgctcgtaggatcatcctggggacccaccacgaaaagggggccttcacattctggtcgtacgcaataggccttcctcttccatcctccagtatcctcagctggaagttttgccatgtgctgcataaggtacttcgtgacggccatcctaatgttctgcacgattgccagaggtaccgctccaatatccgcgagatcggagacctctggggccatctgcatgacaggtacggacaactagtgaacgtgtacaccaagctgctgcttaccaagatatctttccatcttaaacatccacagttcccagccggcctggaggtgaccgacgaggtgctggagaaggctgccggaaccgacgtaaacaatattttccagctcacagttgagatgttcgactacatggattgtgaactaaagttgtccgaatcagtttttcgtcagctgaatactgccatcgccgtcagtcagatgtcctccggtcagtgtcggcttgctcccctgattcaggtgatccaggactgctcccacctctaccattacaccgtaaagctcctcttcaaattacactcctgcctgccggcggacacgttacagggacaccgcgatcggttccacgagcaattccattcactgcgtaatttctttaggagagcttccgatatgttgtattttaaacggctgatccagatcccacgccttcccgaaggtcctcctaactttctgagggcctctgccctagcggagcatataaaacctgtggtcgtaatccccgaagaggctcccgaagacgaggagcccgagaatctcatcgagattagcacagggccaccggccggtgaacctgtcgtggtggctgacctgttcgaccagacattcgggccccctaacggaagtgtgaaagatgatagagacttgcagatcgagtctctcaagcgcgaggtggagatgcttcggagcgagcttgagaaaataaagctggaagcgcagcgttatatcgctcaactgaagtcccaggtgaatgccctggagggagagttggaagaacagcgtaaacaaaaacaaaaggccctggtagataacgagcaactaagacacgagctcgcacagctgcgggcggcccagcttgaaggagagagaagccaaggactgagggaagaggctgagcggaaggcaagtgctaccgaagcccgctataacaaactcaaggagaaacactccgaacttgtgcatgtacatgcggaactgttacgcaaaaatgccgataccgcaaagcaactgaccgtgacgcagcagtcccaagaagaagtcgcgcgggtcaaggagcaattggccttccaggtcgagcaggttaaacgggaatccgaactgaaacttgaggagaaatccgatcagctggagaagctcaagcgcgagctcgaagctaaggcaggagagctggcccgcgcccaggaggctctttcacataccgaacagtcaaaaagcgagctctcgtcaagactcgataccttgagcgctgaaaaagacgcactctccggggccgtccgccagagggaggctgaccttctcgccgcccaatcactcgtaagagagactgaagcagcactgtccagagagcagcagcgaagcagtcaagagcagggcgagcttcagggccgcctggccgagcgggagtctcaagagcaaggactgcggcagagattgctcgatgaacagtttgcggtgctgcgcggagccgccgcagaagctgcaggcatcctgcaggacgcagtgtctaagctggacgacccgttgcatctgcggtgtaccagctcccctgactacctggtttctcgcgctcaggaagcactcgacgcggtgtccacgttggaagagggccacgcgcagtatctcacatcgctcgcagacgcctccgccctagtggctgctcttacccgcttctcccatctggcagctgataccattatcaacggcggcgccactagccacctggccccaactgacccggccgacaggcttatcgatacttgtcgcgaatgcggcgcgcgggctttggagctgatggggcagctgcaggaccaacaggctcttagacacatgcaagcttcactcgtgaggacccccctgcagggaatcctccagctgggtcaagagttgaagcccaagtccctggatgtccggcaggaggagctgggggcagtcgtcgataaagagatggcagccacgtctgcagccattgaagacgctgtccggcggattgaggatatgatgaatcaagcaagacatgcgagctcgggggttaagctcgaagtcaatgaacgaatactcaattcgtgtaccgacttgatgaaagcaatacgtttactcgtcacgacctcgacctcactgcagaaggagatcgtggagagtgggcggggagctgccacacaacaggaattctatgcgaagaattccagatggactgagggattgatttccgccagtaaggccgtgggctggggagccactcagctggtggaggccgccgacaaagtggtattacacacagggaaatacgaggagctcatcgtttgctctcatgaaatcgcggccagcacagcgcagctggtggctgcttcaaaggtcaaggccaataaacattccccacacctctctagattacaggaatgtagcaggaccgtcaatgagcgggcagctaatgttgttgcatcaaccaaaagtggccaggagcagatcgaagatagggatacaatggatttttcaggcctgtccctaatcaagttaaaaaaacaggagatggagactcaggtgagagtcttggaactggagaagaccctggaagctgagagaatgaggttgggcgagttgaggaagcagcattacgtgttggctggagccagcgggtccccgggggaggaagtagcaattaggccctccaccgctcccaggtctgtgacaaccaagaaaccccctttggctcagaaaccaagtgttgcaccacgacaggatcatcagctggataagaaagacggtatttatccggcacagcttgtgaactattag

SEQ ID NO: 191033 - DNA, 753 bp, Artificial Sequence
  Description of Artificial Sequence: Synthetic coding sequence
atggcccacgtgggcaccagccgggtgggcagcgtgctgagcatgtccctctccattcaccttctcgtcccaaccatgaccaagggcgagacaggaaaaccagggcaccacgaggcacccaggaccctgcaggcctttccttggacttgggcgcgcgcttccccaggcgtgagcgtggacatgagcgcaggcctgccacagagcttattgtgctggccaggagcgcccttactaccgacccctccattaccgagtgccacctacgtgggccacagtctgggattgccacgggctggatcatcagtcgggccctggttctctgggaggtgggtcggaggggctttagtgcaatggccactgggagggggaggcccaggaagtgtggccgccggactgggtggtccccttgtgagatggctgctggggggaggggcactggtgaggtggccccttggcggaggtggccctggcagtgtcgccgctggctggggaggcccatggttcggcggcagatgggtcggtggacctccaggctccgtagcagccggttgggggggaccagtaagatggccactggggggcggcggccctggctcagtggctaccggatggggcggtccctggttcggggggcgctgggtgggcgggcctcctggcagcgtcgcggcgggttgtggtggcgccctggtgcagtggccattagggggggggtctttacatagtatcccaagctttccacgcgcttggcgctag

SEQ ID NO: 191034 - DNA, 2016 bp, Artificial Sequence
  Description of Artificial Sequence: Synthetic coding sequence
atgcggcccaagcggctgggccggtgctgcgccggcagccggctgggaccgggagacccggccgcactgacatgcgcccccagcccatctgcatcacccgcgccagaaccatcggcccagccacaggcacggggcacgggccagagagttggatcccgcgctacttcaggatcccagttcttatcagaggcacgcaccggagctcgtcccgccagtgaagcaggcgccaaagccggcgcaaggcgcccatccgctttcagcgcgatccagggcgatgttaggtctatgccagataatagtgacgccccctggacgcgcttcgtgttccaggggccctttggcagcagagcgaccggtaggggaacaggtaaggcggccgggatctggaagacccccgcggcttacgtggggcggcgcccaggcgtcagcggtcccgaaagagccgctttcatcagggaactggaagaggcactctgcccaaaccttccacctccagtcaaaaagatcacgcaagaggacgtcaaggtgatgctctacctgttggaagaacttctcccgcccgtctgggaaagcgtgacctacgggatggtgctgcaacgggagagagatcttaatactgcagcccggatcgggcagagcctggtaaaacagaactcggtgttgatggaagagaacagcaaactggaggccctactgggatccgcgaaggaagagatcctctacctgaggcaccaagtcaacctcagggatgagctcttgcagctctactctgactccgatgaagaggatgaagatgaagaagaagaggaggaagagaaggaggcagaggaagagcaggaggaagaagaggccgaagaagacctgcaatgcgcccatccatgcgacgcccccaaactgataagccaggaagctctgctacaccagcaccactgccctcaactagaagcgcttcaggaaaaactgaggttgctggaagaggagaaccatcagctccgcgaagaagctagccagctggacaccttggaggacgaggagcagatgctgatactagagtgcgtggagcagttttccgaggcatcccagcagatggcggaactaagtgaagtcttggtgctgagattagagaattacgagcgtcaacagcaagaggtagctcggttgcaggctcaggtgttgaagcttcagcagaggtgtcggatgtatggtgccgaaaccgagaaactgcaaaagcagctggctagtgagaaggaaattcagatgcagttgcaggaggaatccgtatgggtcggatcacagctgcaggacttgcgcgaaaagtacatggactgtggaggcatgctcatagaaatgcaggaagaagtgaagacacttagacaacagcctccagtgtccaccgggtccgccacacactatccatattcggtaccactggaaacgcttccaggctttcaggagactctggcagaggagttgcgcacaagtcttcgtaggatgatctccgatcctgtgtactttatggagcggaactacgagatgccaagaggggacacctcatctctgcggtacgacttcagatattcagaggatcgggaacaagtgaggggatttgaggctgaagaaggcctgatgctcgccgctgacatcatgagaggagaggattttacacctgcagaagaattcgtccctcaggaggagttaggagctgccaaaaaggttccagctgaggagggcgtaatggaggaagccgaactagtctccgaggagacagagggatgggaagaagtggaattggaacttgacgaagctaccagaatgaatgtggttacctctgcactagaagcatctggcttgggccctagccatctggacatgaactacgtgctccagcagctggcgaactggcaggacgctcattaccgacgacagttaagatggaagatgctccaaaagggcgaatgtccacacggggctttgcccgcggcatctaggacctcatgcaggagctcttgccgctag

SEQ ID NO: 191035 - DNA, 1809 bp, Artificial Sequence
  Description of Artificial Sequence: Synthetic coding sequence
atgcggcccaagcggctgggccggtgctgcgccggcagccggctgggtcctggagaccctgcagcactgacgtgcgctccttcgcctagtgcatcacccgctcccgagcccagcgcccaaccgcaggctaggggaactgggcagcgcgtgggatcccgcgcaacctccggaagccaattcctctctgaagctagaaccggagccagaccagcctcggaggcgggggctaaagccggggcaagaagaccgtccgcgttttcagctatccagggcgatgtgcgaagcatgccagacaattccgacgccccctggacgagattcgtattccagggcccatttggctcgcgggccactggtaggggtaccggaaaggctgcaggtatttggaaaacaccggccgcctatgtgggcagaagaccgggggtgagcggcccagagcgtgcagctttcataagagagctcgaggaagccctgtgtccgaacctgcctcctccggtcaaaaaaatcacacaagaagacgtcaaggtaatgctgtatctgctagaagaagtgtgcaccgcatttctcatccagctgctccctccagtgtgggagtctgtgacatacggaatggtgctgcagagggaaagagacctgaatactgcagcccgaattggacagtcgcttgtgaaacagaatagcgtgctcatggaggagaattcgaaacttgaggcgttgctgggctctgccaaggaggaaattctatatctgcggcatcaggtcaacctgcgagatgagttgctgcagttgtattcagacagcgatgaggaggacgaggacgaagaggaggaagaggaagaaaaagaggccgaggaggaacaagaagaagaggaggcagaggaggacctgcagtgcgcacacccctgtgacgccccaaagttgatcagtcaggaagcgctccttcatcagcatcactgcccacagctcgaagctttgcaggagaaactgcgcttgctcgaggaagagaaccaccagctgagagaagaggcttcacagctggatactctggaagacgaggaacagatgctcatcctggagtgcgtggaacagttctccgaggcttcacagcaaatggcggagcttagcgaggtgctggtgcttaggctggagaattacgagagacagcaacaggaagtggcgcggcttcaggcacaggttctcaaactgcagcagaggtgcaggatggagactttgcccggtttccaggaaactctggccgaggagctccggacatctctgagacgtatgatcagcgatcctgtgtatttcatggagaggaattacgaaatgccgagaggagacaccagctctctgcggtatgattttaggtatagcgaagatagggagcaggtccgtgggtttgaggcggaagagggcctgatgctggccgccgacattatgcgcggggaggacttcaccccagctgaggagttcgttccacaggaagagctgggagccgctaagaaggttcccgcagaagagggcgtaatggaagaggcagagttagtcagcgaggagacagagggatgggaagaagtggaattggaactggacgaagctaccagaatgaacgtcgtgacatccgcactggaagccagcggtctgggcccaagtcaccttgatatgaactatgtcctccagcaactggccaattggcaggacgctcactatagaaggcagcttcggtggaagatgcttcagaaaggggagtgcccacacggtgcacttccagcagccagcaggacatcatgcaggtctagttgccgctag

SEQ ID NO: 191036 - DNA, 1860 bp, Artificial Sequence
  Description of Artificial Sequence: Synthetic coding sequence
atgcggcccaagcggctgggccggtgctgcgccggcagccggctgggcccgggtgatccagctgcattgacctgtgccccatcaccctccgcttccccagcgccagaacccagcgcacagccacaagctcgaggcaccggtcagagggtgggatccagagcgacctctggaagtcagttcctgagcgaagccaggactggtgcaaggccagcctccgaggccggagccaaggcgggtgcacgcagacctagtgccttttcagcaattcagggggacgttcgcagcatgccggacaacagtgacgccccttggacccggtttgttttccagggcccattcggttcacgggcaacaggcagagggacagggaaagccgcggggatctggaaaacacccgccgcatatgttggccgcagacccggggtctctggtcccgaacgggcggctttcatccgagaactagaggaggcgctatgtcccaatcttccaccccctgttaagaagattacacaagaggacgttaaggtgatgctctatttgttagaggagttactgccccccgtgtgggaatccgtaacttacggcatggtgctgcagagggagcgggacctgaacaccgccgctaggattggccagagtctggtgaaacagaattccgtcctgatggaggaaaatagcaaattagaagctctgctgggaagcgccaaggaagaaattttgtacctaagacatcaggtcaatctgcgggacgagctcttgcagctgtattccgactcagacgaagaggacgaagatgaagaggaagaggaggaagaaaaggaggccgaggaggaacaggaggaggaggaggcagaagaagatcttcaatgtgcccacccatgcgatgctcctaagctgatttcccaggaagctctattacaccagcaccactgcccccagctggaggcgcttcaagaaaagttgcggcttcttgaagaagagaaccaccagctacgcgaggaagcttctcagttagacacactcgaagacgaggaacaaatgctaatactcgaatgtgttgaacagttctccgaggcgagccaacagatggccgaactcagtgaagtcctggtgttgagactcgagaattatgagcggcagcagcaggaggtggctcggctccaggctcaagttctgaagctgcagcagaggtgccgcatgtatggcgcagagacagagaaactgcagaagcagctggcctccgagaaggagatccagatgcagctgcaagaagaggagacccttcccgggtttcaggagaccctcgccgaggaacttcgcacaagcctgaggagaatgatcagcgaccctgtgtatttcatggagcggaattacgaaatgcctcgtggagatacaagctccctcaggtatgattttcggtactccgaagaccgagaacaggtacgggggttcgaagctgaggaagggctgatgctggccgccgatatcatgcgcggagaagattttactcctgcagaggagttcgtgccacaggaggagctcggcgccgccaagaaggtgccggccgaagagggagtcatggaagaagctgagttggtgtccgaagagaccgaagggtgggaagaggttgagctcgaattggacgaagccaccaggatgaacgtcgttaccagcgcgttggaagcctccggcctcgggccaagccaccttgatatgaattatgtactccagcagctagccaactggcaggacgcacactatcgaagacaattacggtggaagatgctacagaagggagaatgcccgcatggcgccctccccgccgcgagtcggacatcttgccgctcctcatgtcgctag

SEQ ID NO: 191037 - DNA, 1785 bp, Artificial Sequence
  Description of Artificial Sequence: Synthetic coding sequence
atgcggcccaagcggctgggccggtgctgcgccggcagccggctgggaccaggtgatccagccgctctgacatgcgccccatccccttccgcgtcacccgcacctgaaccgtcggctcagccacaagcaagggggaccggccagcgtgtgggctctcgagccacctccggctctcagttcctgagcgaggcccgaactggtgccagaccagcctctgaggcaggagcaaaagcgggcgcccgcaggccttccgctttttccgcaattcaaggcgacgtgcggagcatgccggacaattcagacgcgccttggacccgattcgtcttccagggcccattcggctcacgcgccactgggaggggcactgggaaagctgcaggaatttggaagacccctgcagcgtacgtcgggcgacggccgggagtgagcggtccggagagggccgccttcatacgggaattagaggaagcactctgtcctaatcttccccccccagtgaagaagatcacccaggaagacgtgaaggtaatgctgtatctcctcgaggagcttctgcctcctgtatgggaaagcgtcacatatgggatggtcctccagagagagcgggatctcaacaccgcagcccgcattgggcagagcctggtgaagcagaacagcgtgctaatggaggagaactccaaactggaggccctgcttggtagtgcaaaggaggaaatcctgtacctcagacaccaggtgaatctgcgcgacgaactgcttcaactctacagcgacagtgatgaagaggatgaggacgaagaggaggaggaggaagagaaggaagctgaagaggagcaagaggaggaggaggcggaggaggacctacagtgtgcccacccatgcgacgctcccaagcttatcagtcaggaggccttgctgcatcagcatcactgtccccagctggaagccttacaagaaaagctgcgcctcctggaggaagagaatcatcagctacgggaggaggcctcacaacttgatacactggaggatgaggagcaaatgcttatcctggagtgtgtggaacagtttagtgaagcctcgcagcagatggccgaactcagcgaggtgttggttctccgacttgaaaactacgagcgccaacagcaagaggtagcccgtctccaggcacaggtcctcaaactgcaacaaaggtgcaggatggaaacccttccaggcttccaagaaactctggccgaggaattaagaacttcattgagacggatgatctcagatcctgtctactttatggagaggaattatgagatgccacgcggtgacacgtcaagtctcagatatgactttagatattcggaggacagagaacaagtccgagggttcgaagcggaggaaggtctgatgctcgcagctgacattatgaggggcgaggactttacacctgctgaagagttcgtcccacaagaagagttgggcgccgctaagaaagtgcctgctgaagaaggtgtgatggaggaagccgaattggtgtccgaggagaccgagggatgggaggaggtcgagttggagttagatgaggccacgaggatgaatgtggtgacgtcagctttggaagcatctggcttaggaccgtcgcatctggatatgaattacgtgctccaacagctggctaactggcaggatgcccattacagaagacagttaagatggaaaatgttgcagaagggcgagtgtcctcacggggcgctgccagcggcctctcggacaagctgccggtctagctgtaggtag

SEQ ID NO: 191038 - DNA, 837 bp, Artificial Sequence
  Description of Artificial Sequence: Synthetic coding sequence
atgaagttccgggccaagatcaccggcaagggctgcctggagctgttcattcacgtctccgggacagttgcaaggctggctaaggtctgtgtgctccgcgtcagacctgactccctgtgtttcgggcctgcgggttcaggagggcttcacgaggctaggctgtggtgcgaggtacgccagggtgcctttcagcagttccggatggagggtgtgtctgaggatctggatgaaattcatctggagcttacggcagagcacctcagtcgcgccgcccggtcggccgctggggcttccagtctcaagttgcagttgacgcataagcggcgccccagcctcaccgttgctgtggagttggttagtagcttggggcgggccaggtccgtagtccatgacctcccggtaagagtgctgcccaggagagtctggcgcgattgtctgccgccctctctccgcgcctcagacgcaagcatccgccttccaagatggcgtactcttcgcagcattgtcgagagaatggcgaacgtcggaagtcacgtcctcgtggaagctaacctatctgggagaatgactctctctattgagaccgaagtcgttagtattcagtcttattttaaaaacctcggtaatcccccccaaagcgcagtgggcgtgccagagaatcgcgatcttgagagcatggtccaagttagggtcgataaccggaagctgttgcagttcctggagggccagcagatccaccccacaactgcgctgtgcaatatttgggacaataccttactgcaactcgtccttgtgcaagaggatgtctctttacagtacttcatacctgcactgtag

SEQ ID NO: 191039 - DNA, 1065 bp, Artificial Sequence
  Description of Artificial Sequence: Synthetic coding sequence
atgaagagcctgctgctgctggtgctgatcagcatctgctgggccgatcatctgtcagacaactacaccttagaccatgatcgcgcgatacatatacaggccgagaacggccctcacctcctagtcgaggccgagcaggccaaagtgttctcacaccgaggcggcaacgtgaccttgccctgtaaattctaccgtgatccgaccgcgttcggcagtgggatccacaagatccgcatcaaatggactaaactcacttccgactacctgaaagaggtagacgtgttcgtttccatgggctatcacaagaagacgtatgggggctaccaaggcagggtgtttctgaagggaggcagtgactctgacgcctcacttgtcatcacagacctcacactggaagattacggtagatataagtgcgaagtcatcgaggggctcgaagatgacactgtagtcgtagcactggaccttcaaggagtggtgttcccttatttcccgaggctgggccggtataacctcaacttccatgaagcccaacaggcctgcttagatcaagatgccgttatcgctagttttgaccagctgtatgacgcttggaggggaggactggactggtgtaacgcaggatggttatctgacggctccgttcagtatcccataacgaagcctagagagccttgcggaggacagaatacagtccccggggtgaggaactacggattctgggataaagataagtcacggtatgacgtcttttgcttcacttctaactttaatggaaggttttactatttaatccatcctaccaaactcacatatgatgaagccgttcaagcttgccttaacgatggtgcccagatagcaaaagtaggacagatttttgccgcttggaagatcctcggatacgatcggtgcgacgcaggctggcttgctgacgggagtgttaggtaccccattagccggccgagaagacgctgtagtcccaccgaagcagccgtaaggtttgttggcttccctgacaaaaagcataaactgtacggagtgtactgctttagggcgtacaattag

SEQ ID NO: 191040 - DNA, 549 bp, Artificial Sequence
  Description of Artificial Sequence: Synthetic coding sequence
atgaagagcctgctgctgctggtgctgatcagcatctgctgggccgatcatctgtctgataactacacactggaccacgacagagcaatccacatccaggaaaacggcccacatctactcgtcgaggccgagcaggccaaggtttttagccatcgaggaggaaatgtgacccttccatgcaaattttaccgcgatcccacagcgttcgggtccggcatacataaaatcaggattaagtggacaaagttaacatcagactatctgaaagaggttgacgtctttgtaagcatgggttaccacaaaaagacctacggtgggtaccagggcagagttttcctgaaaggcggtagcgacagcgacgcgagcttggtgattaccgatttgactctggaggattatggtaggtacaagtgcgaagtgatcgaaggcctggaggatgacacagtggtcgttgctttggacctccagggggtagtttttccctactttccgcgcctgggcaggtacaacctcaatttccacgaagcccagcaggcgtgcctggattag

SEQ ID NO: 191041 - DNA, 477 bp, Artificial Sequence
  Description of Artificial Sequence: Synthetic coding sequence
atgaagagcctgctgctgctggtgctgatcagcatctgctgggccgaccatctgtctgataactacacccttgatcatgatagagccattcacatccaagcagagaatggaccccatctgctggtggaggctgaacaagctaaagtcttcagccaccggggaggaaacgtgactctgccctgtaaattctaccgcgaccccaccgcgttcggtagtggcatccacaaaatacggatcaaatggacaaagttaacgtctgactacctgaaggaagtagacgtcttcgtttccatgggctaccacaagaagacttacggagggtaccagggcagggtgttcttaaagggggggtcggactctgacgctagcctggtgattaccgatctcaccctggaagattacggaagatataaatgcgaagtaattgaggggctcgaagacgataccgtggtggttgcactggacctgcaggggtag

SEQ ID NO: 191042 - DNA, 600 bp, Artificial Sequence
  Description of Artificial Sequence: Synthetic coding sequence
atgaagagcctgctgctgctggtgctgatcagcatctgctgggccgaccatctgagcgacaattatactttggatcacgaccgggccatccatatacaagccgagaacggcccacacctcctagtggaggctgagcaggcaaaagtgttttcccatagaggcggtaatgtgacactgccttgcaaattttaccgagaccctaccgcattcggatctggcattcataagattaggatcaaatggacgaagctcacctctgattacttgaaggaagtggatgtgtttgtgtctatgggataccacaaaaagacttacggtggatatcaggggcgagtgtttcttaagggaggctctgactcagatgcgagcctggtgatcaccgatctgacgttagaagattacggacgctataaatgtgaggtcattgagggtctggaggacgacaccgttgtggtggcgctcgatctccagggggtggtcttcccatatttccctaggttgggtcggtacaatttgaatttccatgaagcccagcaggcctgtctggaccaggacgcggtgattgccagctttgatcagctgtacgatgcttggcgatag

SEQ ID NO: 191043 - DNA, 777 bp, Artificial Sequence
  Description of Artificial Sequence: Synthetic coding sequence
atgaagagcctgctgctgctggtgctgatcagcatctgctgggccgaccacctgagtgataattatacactcgatcacgaccgggcaatccatattcaggccgaaaacggacctcatcttctggtcgaggctgaacaggcaaaagtgtttagccaccggggtggcaacgtgactctgccctgcaagttctaccgcgacccaactgctttcgggagtggaattcacaagattcgcattaaatggacaaagttgacatctgattacttgaaggaggttgatgttttcgtgtccatgggatatcacaagaagacctatggcggataccaaggccgtgtgttcctgaagggagggtccgattccgacgcatccctggtcattactgatttgaccctggaggactatggaagatataagtgtgaagtcatcgaagggctagaggacgacaccgtggtggtagctctggacttgcagggggtagtgtttccgtattttcctagactggggagatacaatctgaactttcacgaagctcagcaagcatgcctggatcaggacgcagttattgcttcatttgatcagttgtacgacgcttggagagggggattggattggtgtaacgccggttggctatcagacggcagcgtgcagtatcctatcaccaaaccacgagagccctgcggcggccaaaatacagtgcccggagtgcgaaactatggcttttgggacaaagacaagagcaggtatgatgttttctgtttcacttcgaacttcaactag

SEQ ID NO: 191044 - DNA, 462 bp, Artificial Sequence
  Description of Artificial Sequence: Synthetic coding sequence
atgaagagcctgctgctgctggtgctgatcagcatctgctgggccgatcaccttagcgataactacactttagatcatgaccgggcgatccacattcaggccgagaatggaccccacctgctggtagaagctgaacaggctaaggtctttagccaccggggcgggaacgtgactctgccctgcaagttttatcgggacccgaccgcatttggctccgggatccataagatcagaattaagtggaccaaattgacctctgattacctcaaggaagtggatgtttttgttagtatgggctaccataagaaaacttatgggggctaccaaggccgtgtgtttctcaaagggggcagcgatagtgacgccagcctcgtcattacagatctgactctcgaggattatggcaggtataaatgtgaggtcatagaggggctggaagatgatactgtggtggtggcttag

SEQ ID NO: 191045 - DNA, 1683 bp, Artificial Sequence
  Description of Artificial Sequence: Synthetic coding sequence
atgttcgcccggatgagcgacctgcacgtgctgctgctgatggccctggtcggcaagacagcttgcggattctcccttatgagcctgctggagtccctcgatcctgattggacacctgatcagtacgattactcatacgaagactataaccaggaggagaatacttcttctaccttaactcacgctgagaaccccgactggtattacactgaagatcaagccgacccgtgtcaaccgaacccatgcgagcatgggggcgattgtctcgtacacggcagcactttcacctgcagttgccttgcaccattctctggcaacaagtgccaaaaggtgcagaatacatgcaaagacaacccctgtggcagaggccagtgcctgatcacacagagccccccatactacaggtgcgtttgcaagcatccatatacaggtccatcttgttctcaggtggtccccgtctgtagacccaacccttgccaaaatggcgccacctgctcaagacataaaagacgcagtaaattcacctgcgcatgtccggatcaatttaaaggcaagttttgcgaaatcgggtcagatgactgttatgttggagatgggtattcctatcggggcaagatgaatcgaactgtgaatcagcatgcatgtctctattggaatagccacttactcctgcaggaaaactacaacatgtttatggaggatgctgagacccatgggataggagaacacaatttctgtcggaatcccgacgccgatgaaaagccttggtgctttattaaagtgactaacgataaggtcaagtgggagtattgcgatgtgagcgcatgtagtgctcaggatgtggcctatccagaagaatctccaactgaaccctctaccaagttaccaggatttgactcatgcggtaaaaccgagattgccgaacgcaaaatcaaacgaatatatggcggcttcaagtccactgccggaaagcacccctggcaggcctcacttcaatcttccctaccactgactatctccatgccacagggacatttctgcggcggagcccttatacatccctgttgggttctgactgccgcccactgcacagatatcaaaacacgccacttaaaggtggtccttggcgatcaggatctaaagaaggaggagtttcacgagcaaagtttcagagttgagaagattttcaagtattcgcactacaatgaaagggatgagattccacacaacgacattgcattgctaaagctcaagcctgtggacggccattgcgctctggaatctaaatatgtgaagacagtttgccttcctgacgggtcattccccagtggaagtgagtgccacatttccgggtggggagtgacagagactgggaaagggtcgcgccaactgctcgacgccaaggtgaaattgatagcaaatacactgtgcaactcgcgccagttgtacgatcatatgattgacgactccatgatctgtgccgggaacctgcagaaacccggtcaggatacctgtcaaggcgactcaggtgggcctttgacatgcgaaaaagatggcacttactatgtctacggtatcgtgagctggggactcgaatgcggaaaacgccctggagtatatacacaggtgaccaagttcctcaattggatcaaggccacaataaagtccgaatctggtttttag

SEQ ID NO: 191046 - DNA, 534 bp, Artificial Sequence
  Description of Artificial Sequence: Synthetic coding sequence
atggaggagaacttcatctgcagccggaagaccatggccctgagcagtacatggatcctatcccccaagaagaccggaccgttgacttccatgataacagcaacccggatcataattcggaagagaactcctgtcgctcacctgcccaccttgcggattctaaccggcacaacactccgtacgaaattgattcacgcatcaccaacccctgtcaatacagtgggcaccgcatccagcatgggcgccccaagccatgctgctgcttggctgctctcactgggaatttctgtccgcaagtgcaagatccgggccaggactacacacgttgctggggctaacgtcagcttaccgcgggtgcttcctactacggctgtgagcgtgaataccctgactcaggttcctgccgctcctaaatggtttttatatgcaggtcaaactcccgcccggatggggctgccagctccaggcatctctggtgatccctcaagtcctgtgccagtcccaacatcatcccgaggcaacagcgtaaagtag

SEQ ID NO: 191047 - DNA, 843 bp, Artificial Sequence
  Description of Artificial Sequence: Synthetic coding sequence
atgttcgcccggatgagcgacctgcacgtgctgctgctgatggccttggtggggaaaacagcatgcggattctctctgatgagcctcctggaaagcctcgaccccgattggactcctgaccagtatgattatagctacgaagattataaccaggaggagaacaccagctcgacactaacccatgcagagaatcccgattggtattacactgaagatcaggcggacccatgtcagcccaacccctgtgaacacggtggcgattgtctcgtgcacgggagcaccttcacatgtagctgtctggctcctttttctggtaataaatgccagaaagtccaaaacacatgcaaggacaacccttgcggtcgcggccagtgccttattacccagtctcccccatattatcgctgtgtttgcaagcatccgtacactggcccgagttgcagccaggtggtccccgtctgccggcctaacccctgccagaatggggctacttgttctcggcacaaacgaaggtcaaaattcacctgtgcctgtccagaccaattcaaaggcaagttttgtgaaatcggttctgacgattgttatgtcggcgatgggtatagctaccgcggaaaaatgaacagaaccgtaaatcagcacgcctgcctctactggaattcacatctgctgctccaagagaactataacatgtttatggaagacgccgaaacccatgggataggtgagcacaacttctgccggaatccagacgccgacgagaaaccgtggtgctttatcaaagtcaccaacgacaaggtcaagtgggaatactgcgatgtttcagcttgctcagcccaagcttag

SEQ ID NO: 191048 - DNA, 1605 bp, Artificial Sequence
  Description of Artificial Sequence: Synthetic coding sequence
atgagcctgctggagagcctggaccccgactggacccccgaccagtatgattattcttatgaggactataaccaagaagagaacacgtcatctacccttacccatgccgagaacccagactggtattataccgaggaccaagcagatccctgccagcctaacccctgcgaacacggaggtgactgcctcgtgcatggaagcacctttacctgcagctgtctggctccgttctcaggcaacaagtgccagaaagtgcaaaacacatgcaaagacaacccctgcggaaggggccagtgtctaatcactcaaagccccccttactatcggtgcgtctgcaaacatccttacacaggcccaagctgttctcaggtggtgcctgtgtgtaggcccaatccctgtcagaatggggctacctgttcccgacacaagcggcgtagcaagtttacctgcgcatgcccagatcaattcaagggcaagttctgcgaaatcgggagcgacgattgttatgttggcgacggatattcttaccgaggcaaaatgaatcggacagtgaaccaacatgcctgtctgtactggaattcccatctgttgttacaggaaaactacaacatgttcatggaggacgccgagacccacgggattggtgagcataacttctgcagaaatccagacgccgatgaaaaaccctggtgctttataaaggtgactaacgataaagtaaaatgggagtactgtgacgtatccgcctgctcagctcaggatgtagcttatcctgaagagtcccccaccgagccctctactaaattgcctggctttgactcctgcggtaagactgagatcgcagagaggaagataaaacggatttacggaggtttcaagagcactgccggaaagcacccatggcaagccagccttcagtcatctctgcccctaacgatttccatgccacaggggcacttctgcggaggagcgcttatccacccgtgttgggtcctgactgcggcacattgtactgacattaagactagacatcttaaggtcgtgctcggggatcaggatctcaaaaaggaggagtttcatgagcaatcttttcgagtggagaaaatctttaagtactcccactataatgagagagacgagatcccacacaacgatatcgcccttctgaagctgaaacctgtagatggtcactgtgccctggagagtaagtatgtgaaaacagtctgtctcccagatggttccttcccctcaggcagcgagtgccatatcagcgggtggggggtaacagagacaggaaagggctcccggcagctactggatgccaaagtcaagctaattgctaacaccctgtgtaattcccgacagctttacgaccacatgatcgacgactccatgatctgcgccggcaacctgcagaagcctgggcaggatacctgtcagggggattctggcggccccctgacgtgtgaaaaagacggcacttactacgtgtacggaatcgtctcctggggtctagagtgtggaaagagacccggggtttacacacaggtaacgaagttccttaactggattaaggcaaccataaaatcggaaagcggattctag

SEQ ID NO: 191049 - DNA, 1656 bp, Artificial Sequence
  Description of Artificial Sequence: Synthetic coding sequence
atgctgcccctgctgctgctgcccctgctgtggggcggcagcctgcaagagaaacccgtctacgaactccaggtccagaagagcgtgacagttcaggagggcttgtgtgtcttagtcccctgcagcttcagctatccgtggagatcctggtactcttcgccccccctgtatgtgtactggttcagagacggagaaattccatattacgctgaagtagtcgccaccaataatcctgatagaagagtcaaaccagagacccagggcagattcaggctgttgggcgatgtacagaagaagaactgctccttgagcataggggatgctcgtatggaagatacagggtcatattttttcagagttgagcggggcagggatgtcaagtactcctaccagcagaacaaactcaatctggaggtcacggccctcattgagaagccagatatccactttcttgaacctttagagtctgggaggcctacacgactcagttgttcactccccgggtcatgtgaggcgggtccccctcttactttttcatggacaggaaacgcactctcaccgctagaccctgaaacaacaagatcatctgagttaaccctgacaccacgcccagaggaccacggcactaatctcacgtgtcagatgaaaagacaaggtgctcaagttacaactgagagaacagtgcagttgaatgtgtcctacgccccccaaacaatcacaatcttcagaaatgggatcgcactggagatcctgcagaatacttcgtatctgcccgtgctggaaggccaggccctgagattgctctgcgacgcgccttcaaatccacctgcccatctgagctggttccagggatctcctgcgttaaatgccaccccaatcagtaatactggcattctggaacttcgaagagtccgctccgctgaggagggcgggttcacgtgtagagcgcagcaccccctcggattcttacaaatcttcctgaatctgtccgtttactctctgccacagctcctgggcccaagttgtagttgggaagcagaagggctgcactgcaggtgtagctttcgggcgcgcccggccccttccctttgctggaggttagaggaaaaaccattggaaggaaatagcagtcaggggagtttcaaagtgaattcaagcagcgccggaccatgggcaaactcttccctgatcctgcacggagggttgtcatctgacctcaaggtcagctgtaaagcgtggaacatttatggcagtcagtccggctccgtcctcctccttcagggcaggtccaacctcggaacaggcgttgtccccgcagctctcgggggagccggggtgatggctcttctgtgcatctgtttatgtctgattttcttcctgatagttaaggcccgccgcaagcaggccgctggacgtcccgagaagatggacgacgaagatcccatcatgggcacaatcacgagtggcagcagaaaaaaaccgtggcccgatagccctggagatcaggcatccccccctggcgacgccccccctctcgaggagcagaaggaactacactacgcctcactgtccttttcagagatgaagagtcgcgagccaaaggatcaggaagccccgagcactaccgagtatagtgaaataaaaaccagcaagtag

SEQ ID NO: 191050 - DNA, 558 bp, Artificial Sequence
  Description of Artificial Sequence: Synthetic coding sequence
atgttccgggaggtgttcgccgacgaggaccccgccacctacgtgtgggatggaaactaccatcagccgtgggagcccgccgccgccggtgccgttggggccggcgcatatagagaggtcgaggcagaagacccgggtaggttggccgtggaagcactggtgcgtacgcggcgctgcgtgtgcgtggcccagaggtggggaggaaaacgggaagtgatgtatactgcctttaaagccctgggagactctgtggactacgtgcaattttgcagagtctgcgattccgataccaggctggaccccatggcactcttagagttggtccgggtgcttgatgaggaccccagagtaggggccgtggggggagatgtaagaattttgaaccccctcgactcatgggtttccttcctatcatctctacggtactgggtcgcattcaacgtcgaacgggcttgccagagctactttcattgcgtaagctgcatctccggtccccttggtacacccccagggccagcggccacccagcgccgtccacgacctagctgcggcggctag

SEQ ID NO: 191051 - DNA, 645 bp, Artificial Sequence
  Description of Artificial Sequence: Synthetic coding sequence
atgttccgggaggtgttcgccgacgaggaccccgccacctacgtgtgggacgggaattatcatcaaccttgggaacctgccgccgctggggcagttggcgcaggggcataccgcgaagtggaagctgaggaccctggtcgtttggctgtcgaagcgcttgtgaggactcgccgttgtgtgtgcgttgcacagaggtgggggggtaagagagaggttatgtacaccgccttcaaagccctgggggacagtgttgactacgtccaggtgtgtgattctgacactagactggacccaatggctctgttagagctagtgcgggtactggacgaggacccccgtgtgggcgccgttggtggcgatgtgcggattctcaacccactggatagctgggtcagcttcctcagcagcctgcgctactgggtggctttcaatgtggagagggcctgtcagtcttactttcactgcgtgtcctgtatctccggacccctggagtcctgtccaggcccacgcgagcatgccatgatgccgtcctttctggctcctgtgcaggtgcacttacaggtgcctctcctgttgcgcgacgcactcgtgctgccggccgtggctgagcccgccgacaccctggtgcaggtggtgctcccatag

SEQ ID NO: 191052 - DNA, 1734 bp, Artificial Sequence
  Description of Artificial Sequence: Synthetic coding sequence
atgcggcaggacgcccccaagcccacccccgccgcctgccggtgctcagggctagccaggagggtgttaacaatcgcctttgcccttctgatcttagggctcatgacatgggcctatgccgctggggtgccccttgcctcagatcggtacggattacttgcttttggactgtacggcgcgtttctgtcagcacacctggtggcccagtcactgtttgcctatttagagcaccggagggtcgctgccgcggccagggggcccctggatgcagctacagcaaggtctgttgccctgaccatttctgcataccaggaggaccctgcttatttgaggcagtgtcttgcatctgcccgagccctcctctaccctagggctaggctacgagtgttaatggtagttgacggaaaccgagccgaagatctctacatggtagacatgttcagagaggtctttgcagacgaagatcctgccacatatgtatgggatggaaactatcaccaaccttgggaacctgcagccgctggagcagttggagctggggcctaccgcgaggtggaagcagaagatcctggcaggctcgccgtggaggcgctggtgagaacgcggagatgcgtttgtgtggcccagagatggggcggtaagcgagaggtgatgtacacagcattcaaagctttgggggacagcgttgactacgtacaagtgtgcgatagtgacaccaggttggatcctatggcacttctcgagctggtgagagtgctggatgaggacccccgcgtaggtgcagtgggcggagacgtccgaatcctcaaccctctcgactcgtgggtgtcatttctaagcagccttagatactgggtggctttcaatgtggagcgggcttgccaatcctactttcattgcgtttcttgcattagcggccctctaggcttgtacaggaataacctactgcaacagttcctggaagcatggtacaatcagaagttcctagggacccactgtaccttcggagacgaccgccatttgacaaataggatgctgtcaatgggctacgccactaagtacacatctaggagccgctgttactctgaaactccatctagtttcctgaggtggctgtcccagcagaccagatggtccaaatcatatttccgggaatggctgtataacgccctatggtggcaccggcaccatgcctggatgacttatgaggccgtggtatctggtttgtttcctttcttcgtcgccgcaaccgtgctgcgcctgttttatgctgggcggccttgggctctgctttgggtactgttgtgtgtccagggggtggccctggccaaggctgcttttgctgcatggttgcggggctgtctaagaatggtacttctatccctgtacgccccactgtacatgtgcggcctcttgccagctaaattcctggctctagtgacgatgaaccagagcggatgggggacctccgggcgaagaaaattggctgcgaattacgtgccattactccccctagcattgtgggccttgctgctgctgggcggtctggtgaggtccgtcgcacatgaagcccgtgcagattggagcgggccatcccgcgcagccgaagcctatcaccttgccgccggggctggcgcctatgtcggatattgggttgcaatgttaacactatattgggtgggagtcaggagactgtgcagaagaagaacggggggttacagggtgcaagtttag

SEQ ID NO: 191053 - DNA, 1659 bp, Artificial Sequence
  Description of Artificial Sequence: Synthetic coding sequence
atgcactgcgagcggttcctgtgcatcctgcggatcatcggcaccactctgttcggggttagcctgctgctgggcattacggccgcatatatcgtgggttaccaatttatacagactgacaattactacttttcatttggcctgtatggagccttcttggcaagccaccttattatccagagtctgttcgccttcctggagcacagaaaaatgaaaaaatcgctcgagacccccatcaaactgaacaaaactgtcgccctctgtattgctgcctatcaagaggacccagattatctcaggaagtgtctgcagtccgtgaaacgcctgacgtatccaggaatcaaagtagttatggttatcgacggcaatagtgaggacgacctctatatgatggatatttttagcgaagtgatgggcagagataaatctgccacttacatctggaagaataactttcacgagaaagggcccggtgaaacagacgagagccacaaagagtcatcccagcacgtcacccagttggtgctctccaataagagtatctgcatcatgcagaagtggggcgggaagagagaggtgatgtataccgcatttcgcgctttggggaggagtgtagattacgtacaggtgtgcgatagtgacacgatgctggaccctgcttcatctgtcgagatggtgaaggtcctcgaggaggaccctatggtcggaggcgtgggcggcgacgtgcagattctcaacaaatacgactcatggatcagctttctgtcctctgtccgctattggatggctttcaacatcgagagggcgtgtcagtcctacttcggatgtgtgcaatgcattagcgggcccctcgggatgtaccgaaattctctgctgcatgagtttgtggaagattggtataatcaggagttcatgggcaaccaatgcagttttggagacgatcgacatctgactaaccgggtgctgagcctcggatacgcgacaaaatacacggcgcgatccaagtgcttgaccgagaccccaatcgaatatcttcggtggttgaaccaacagacaaggtggtctaagagttactttcgggagtggttgtataatgccatgtggtttcataagcaccacctgtggatgacctatgaggctattatcacaggattctttcctttctttctgatcgcaacggtcattcagttgttctatcgagggaaaatttggaacatcctccttttcctcctgacagtacagctggtcggactgataaagagttctttcgcttcctgcctccggggcaatatcgtaatggtattcatgtcactttatagcgttctgtacatgtccagtcttttgccagccaagatgttcgctatcgccactataaataaggccggctgggggacctccgggcgtaagaccatagtagttaacttcattggactaattcccgtaagcgtctggttcacgatcttactgggtggagtaatcttcacaatctacaaagagtctaagaggcctttctccgagtcaaaacagacagtactgattgtaggcacactgctgtacgcctgttattgggtgatgttactcactttgtacgtggttctgatcaacaagtgcggtcggcgaaaaaagggtcagcaatacgatatggtgctcgacgtgtag

SEQ ID NO: 191054 - DNA, 951 bp, Artificial Sequence
  Description of Artificial Sequence: Synthetic coding sequence
atgcactgcgagcggttcctgtgcatcctgcggatcatcggcaccacactctttggggtttctttgctgctgggaattacggccgcatatattgtgggttatcagttcattcaaaccgataattattacttcagcttcgggctgtatggcgctttcttagcctcccaccttatcatacaatctctgttcgcttttctcgaacatcgcaaaatgaaaaaatccctagaaacgcccatcaaactcaataaaaccgttgctctgtgtattgcggcttaccaggaggaccccgattacctgcgtaaatgcctgcagtccgtaaagagattgacctacccaggcatcaaggtagtgatggtcatcgatggcaactcagaagacgacctgtatatgatggatatattctcagaggtcatggggagagataagagcgctacgtacatctggaaaaacaactttcatgagaagggtcccggggaaacagacgagtctcataaggagtcgtcacagcatgtgacgcagctcgtgctgtcgaataaatccatctgcatcatgcagaagtggggcggcaaaagagaggtgatgtacacagctttccgggcgttgggcaggtccgttgactacgtgcaagtttgtgacagcgacacaatgttggatcccgcgtcctcagtggaaatggtgaaggtactcgaagaggacccgatggttggaggcgtcggaggagatgtacaaattctcaacaagtatgattcttggatctcattcctatcttccgtgagatactggatggcttttaatatcgaaagggcatgtcagtcatattttggctgcgtgcagtgcatttccggacccctaggaatgtataggaacagcttgctgcacgtactgaccttcgccgtcacgcacaatacactggtgcccctgggggctgtgcagtattgtgggattcggtag

SEQ ID NO: 191055 - DNA, 1389 bp, Artificial Sequence
  Description of Artificial Sequence: Synthetic coding sequence
atggcccaggtgagcatcaacaacgactacagcgagtgggacctgtccaccgatgcgggcgagcgagcgaggctcctgcaatcaccatgcgttgatacagcgcctaagtctgaatgggaagcctctccaggaggactggacagagggacaacttccactctgggagcgatctttatcgtggtcaatgcctgtctcggagctggcctgctcaatttccctgcagccttttcaaccgccgggggagtggccgctgggatcgccctgcaaatggggatgctggtgtttatcattagcgggttggtaatcctggcatactgttcacaggctagcaatgaaaggacctaccaggaagtcgtgtgggcagtttgcggcaagctcactggcgtgttatgcgaggtagccattgcagtatacacctttggcacctgtatcgcctttctcattattattggagaccagcaggataagattatcgctgtgatggcgaaagagcccgaaggcgccagcggcccctggtacaccgacagaaaattcactatctctttgacagccttcctgttcatcttgccgctgagtattcctcgcgaaatcggattccagaaatacgcctcgtttctgagcgtcgtaggtacttggtacgttacggcgatagtaatcataaaatacatctggcccgacaaggagatgactccaggtaacatcctgacacggccagcctcgtggatggcagtgttcaatgcgatgccaactatttgcttcggtttccagtgccacgtctcaagcgtacccgtgtttaacagtatgcagcagcctgaggttaaaacgtggggcggagtggtgaccgccgcaatggttatcgctttggctgtctacatggggacaggtatttgtggtttcctgactttcggtgcggctgtggatcccgatgtgcttctgagctatccgtccgaagatatggctgtagcagtagcccgtgcctttatcatcttgagcgtgctcacatcctatccaattcttcacttttgcggtagagcagtagttgagggcctgtggcttagataccagggcgtgcctgttgaggaggacgtcggcagggaacgcagacgccgagtactgcaaactctggtgtggtttcttctgacactcttactagccctgttcatacctgatatcgggaaagtgataagcgtcatcggggggctggcggcatgttttatctttgtgttccctggtctctgcttgattcaggccaagctgtcggaaatggaagaagtcaaaccggcttcttggtgggtgctggtttcatatggcgtgttactcgtgacacttggtgcattcattttcgggcaaacaacagcaaatgcaatttttgtcgatctgcttgcctag

SEQ ID NO: 191056 - DNA, 1662 bp, Artificial Sequence
  Description of Artificial Sequence: Synthetic coding sequence
atgcccgtgcagctgaccaccgccctgcgggtggtgggcaccagcctttttgccctggcagtcctgggagggatcttggccgcctacgtgactggctaccagttcatccacaccgagaaacactacctcagtttcgggctctatggcgcaatcctgggtctgcacttactcattcagagtctattcgctttcctggagcatcggcgcatgaggagggccggacaggctctgaaactgcctagcccccggcgggggtcagttgcactgtgcatcgcggcttatcaagaggacccagattacctgaggaaatgcctcagatctgcccagcgcatttcttttcctgacttaaaagtggtgatggtggttgacggcaacaggcaggaggacgcttatatgctggacatctttcacgaagtcctgggcggcacagagcaagccggcttttttgtgtggaggtcaaacttccatgaagctggagagggcgaaaccgaggccagcctgcaggagggtatggatcgagtcagggatgtagtgcgggcgtctacatttagctgcattatgcagaagtggggcggcaagagagaagtaatgtacaccgcattcaaggcacttggggatagcgtggactacatccaggtgtgcgacagtgataccgtcctggacccggcatgtaccattgagatgctgcgtgtgctggaagaggacccccaggtgggaggagttggtggagacgtgcaaattctgaacaagtacgacagctggatctctttcttgtctagcgtgagatattggatggcattcaatgtggaacgggcctgccaatcgtatttcgggtgtgtgcagtgcatcagtgggcccctaggcatgtatcggaattcactgctgcagcagttcctcgaagactggtaccaccagaaatttctgggctctaagtgcagctttggcgacgatcgtcacctaactaatcgcgttctttccctcgggtaccgcactaaatatactgctcgaagtaagtgtctgaccgaaacccctaccaagtatttgagatggctaaaccaacaaacacgttggagcaagtcttattttagagagtggttgtataactctctttggtttcacaagcatcacctctggatgacctatgagagtgtggtgacaggcttttttccgtttttcctgatcgccaccgtcatccagctgttttatcggggtcggatatggaatatactcctgttcttactaacagtgcaactggttggcattattaaagctacgtatgcatgtttcttgcggggcaatgcagaaatgatattcatgtccctctactccctcctgtatatgtcatcattgttgccagccaaaatcttcgcaattgcgaccattaacaaatcaggctggggtacatctgggcgaaaaacgatcgtggtcaatttcatcggacttatccccgtgagtatttgggttgccgtcctgctgggtggactggcctataccgcgtactgccaagacctgttctccgaaacagaattggcctttctggtgagcggagccatcttgtacgggtgttattgggttgcattgctcatgttgtatctggccattatcgctagacggtgcggaaaaaaacctgagcaatacagcctggcctttgcagaagtgtag

SEQ ID NO: 191057 - DNA, 1308 bp, Artificial Sequence
  Description of Artificial Sequence: Synthetic coding sequence
atggccgcccacctgctgcccatctgcgccctgttcctgaccctgctggacatggcccaggggttccggggacccttactgcctaaccgaccttttacaaccgtatggaatgcaaacacccagtggtgcttagagagacacggggtcgacgtggatgtcagcgtgttcgacgtcgtggcaaatccaggccagacgtttcgaggaccagatatgactatattttacagcagccagctgggcacatacccgtactacacaccaacaggcgagcctgtctttggcggcctgccacaaaacgcatcactgattgcacatttagctagaactttccaggacatccttgccgctattccagcaccagatttctccggtctggccgtcatcgactgggaggcttggaggccccgctgggccttcaactgggataccaaggacatttacagacagagatcccgcgctttggtacaggcccaacaccctgactggcctgccccgcaggtagaggctgtggcgcaggaccaattccagggcgccgctagggcatggatggccggcaccctgcagctggggagagccctgaggccacgaggtctatggggcttctatgggttccccgactgttataattatgacttcctgtcccccaattacacgggtcagtgcccttccggcatcagggcacagaacgaccagctgggatggttgtggggacaaagtcgggctctgtatccaagcatctatatgcctgccgtgctggagggcacagggaagtcccaaatgtatgtgcaacatagagttgccgaggcgtttagggtcgctgtggctgccggggaccctaacctgcccgtgctcccttatgtgcaaatcttctatgataccactaatcactttctgccgctggatgagctcgaacattcattgggggaaagcgcagcccagggcgcggctggagtcgtgctttgggtttcctgggagaacacacgcaccaaagagtcatgtcaggccatcaaggagtatatggatacaaccttgggcccgtttattctgaacgtgacgagcggcgcactgctttgcagtcaggcgctctgtagtgggcatggacgctgtgtccggcggacttcccaccctaaggcccttttattgctgaaccctgcatcctttagcattcagctcacccccggagggggccccctgtctctgcgaggtgccttgagcctggaggatcaagcccagatggccgtggagttcaaatgtcgatgctatcccggttggcaagcgccatggtgtgagcggaaatctatgtggtag

SEQ ID NO: 191058 - DNA, 1308 bp, Artificial Sequence
  Description of Artificial Sequence: Synthetic coding sequence
atggccgcccacctgctgcccatctgcgccctgttcctgaccctgctggacatggctcaaggcttccggggcccgctcctccccaatcgcccttttacaaccgtgtggaacgctaacacccagtggtgtcttgagagacacggtgttgacgtcgacgtgagtgttttcgatgtggtggccaaccccgggcagacgttccgaggtcccgacatgacaatcttctatagcagccagttggggacatacccgtactacacccctaccggggaaccagtatttggaggcctgcctcaaaatgctagcctcattgctcacttagcaaggaccttccaagatatactggccgccatccctgccccagattttagcggacttgccgtgattgattgggaggcttggcgccccagatgggcttttaactgggataccaaggatatttacagacagcgaagccgcgccctggtgcaggcgcagcacccggattggcccgccccacaggtagaagctgtggcacaggaccagtttcagggtgccgctcgcgcatggatggccggaactctgcagctcggacgagccctgcgtccccgcgggctttggggattctatggcttccctgactgttacaattatgactttctgagtcctaattacaccggccagtgtccctccggaatcagggcccagaacgaccagcttgggtggctttggggacagtctcgtgccctatatccatccatctatatgcctgctgtgctcgaaggaactgggaaatctcaaatgtacgtccagcatcgagtggcggaggctttcagggtcgccgttgccgctggggatcctaatctgcccgtactgccttacgttcagatattttatgataccacaaaccacttcttgccactggatgaactcgagcattctctgggagagtctgctgctcaaggcgctgccggcgtggtcttgtgggtcagttgggaaaatacacggacaaaagaatcctgtcaggcgataaaagagtacatggacacaacactaggaccatttattcttaatgtgacttcaggtgctctgttatgttcccaagcgctgtgtagcggtcatggcaggtgtgtacggagaacatcacatccgaaagcactcttactactgaaccctgcctcgttctctatccagctgactccaggaggaggcccactcagccttcggggggccctgagcctggaggaccaggcccaaatggccgtggagtttaagtgtcgctgctatcccggatggcaggcgccctggtgcgagaggaagagcatgtggtag

SEQ ID NO: 191059 - DNA, 1218 bp, Artificial Sequence
  Description of Artificial Sequence: Synthetic coding sequence
atggccgcccacctgctgcccatctgcgccctgttcctgaccctgctagatatggcccagggcttccggggacctctgctgcctaataggccctttacgactgtttggaacgctaatacgcagtggtgcctagagcgccatggggtcgatgtggatgtgtccgtgttcgacgtggtagccaaccctggccagacgtttaggggtcccgatatgacgattttctatagctctcaactgggaacatatccttactacaccccaaccggagaacccgtttttggcggcttaccgcagaacgcatcgctaatcgcccatctggcacgcacgtttcaggatatcctggctgccatccccgccccagatttctccggcctagcggttattgattgggaagcctggagaccaaggtgggccttcaattgggacacaaaggacatctatcggcagagatcgcgcgctttagtgcaagcacagcaccccgactggccagcacctcaggtagaggctgttgcccaggaccaatttcagggagctgcacgtgcctggatggccggaaccctccaattgggcagggccctgcgccctcgcggattatggggattctatggctttcctgactgctacaattatgatttcctaagtcctaactatacaggtcaatgcccctccggaattcgggcccaaaatgatcagcttggctggctatggggccagagcagagctctgtatccgtcaatctacatgcccgccgtgctggagggaacaggaaagtctcagatgtacgtccagcatagggtcgccgaggccttccgggttgctgtggctgctggagaccctaatcttcccgttctaccttatgtccagatcttttatgacacaacaaaccacttcttgccactggagagctgtcaagcaattaaagagtatatggacactaccctcgggcctttcatattaaacgttacctccggagcactgctgtgctcccaggcattgtgctcgggacacggcagatgcgtaagacgaacatcccatcccaaggcccttctcctgctaaatccagccagctttagcatccagcttacgccaggtggaggcccacttagtctgagaggtgccctctcgctcgaggaccaggcccagatggctgtagaattcaagtgcaggtgctatcccggatggcaggccccttggtgtgagagaaaatccatgtggtag

SEQ ID NO: 191060 - DNA, 1308 bp, Artificial Sequence
  Description of Artificial Sequence: Synthetic coding sequence
atggccgcccacctgctgcccatctgcgccctgttcctgaccctgctcgacatggcacagggatttagaggacccctgctgcccaatagaccctttactactgtctggaacgcaaatactcagtggtgcctggaaagacatggcgtggacgtcgacgtgagtgtgttcgacgtggtggcaaatccggggcagaccttcagggggccagacatgacaatcttttatagttctcagctggggacttacccttactacacgccaacaggagagcctgtctttggggggctcccgcaaaacgcctctctcattgctcatctggctcggacatttcaagatatcttagccgccattccagcaccagatttcagcgggctggcggtgattgattgggaagcctggcggcctcgctgggcttttaactgggacacaaaggatatctatcgacagcgctcccgtgcactcgttcaagctcagcacccggattggccagctccccaggttgaggctgtggctcaggatcaattccaaggggccgcccgggcgtggatggctggcactctgcaactgggccgagctctgagaccacggggcctctggggcttttacgggttccccgattgttacaactatgattttctttcgccaaactataccgggcaatgccctagtggtatcagagcccaaaacgaccagctagggtggctgtggggccagtcaagagccttataccccagtatctatatgcctgctgtgttagagggaaccggaaaatctcaaatgtatgtgcagcacagggttgccgaggctttccgagtggccgtggctgcaggggacccaaatctgcccgtcctcccctatgtacagattttttatgatacaaccaatcattttctgcccttggatgaacttgaacacagtctgggtgaaagtgctgcacagggcgccgccggggtggttctctgggtgtcttgggagaataccagaactaaggagtcatgccaggccataaaggagtacatggatacgacccttggtccgtttattctaaacgttacctctggtgctctactgtgtagtcaagccctttgcagtggtcacggccgctgtgtccgacgcaccagtcacccaaaggctttactgctccttaatcccgccagtttttcgattcaattaacccctggcggagggccattatctctaagaggggccttaagtctagaggatcaggcacaaatggctgtggaatttaaatgccgctgctaccccggctggcaggcgccctggtgcgaacggaagtccatgtggtag

SEQ ID NO: 191061 - DNA, 312 bp, Artificial Sequence
  Description of Artificial Sequence: Synthetic coding sequence
atggccgcccacctgctgcccatctgcgccctgttcctgaccctgcttgacatggcacagggatttagaggacctctgcttcccaaccgcccttttacaaccgtgtggaacgccaacacccagtggtgcctcgagcggcatggggttgacgtggatgtcagtgtgttcgacgtggtcgccaaccctgggcaaacatttcgcggtcccgatatgactatcttctattcaagtcagctgggtacatacccctattatactcctactggggagccagtgtttggtggtttgcctcagaacgcctcactaatctag

SEQ ID NO: 191062 - DNA, 531 bp, Artificial Sequence
  Description of Artificial Sequence: Synthetic coding sequence
atgtacgtgcagcaccgggtggccgaggccttccgggtggccgtggctgcaggggacccaaatctaccagtgctgccatatgtccaaatcttttatgatacaaccaaccacttcctgcctttggacgagctggagcatagcctaggcgaatcagcggcgcagggggccgccggcgtcgtcctgtgggtctcttgggagaatacaagaacaaaggagtcttgtcaagcgatcaaggaatacatggataccacattagggccctttatcctcaatgttacttcaggcgccctcctttgtagccaggctctatgctctgggcacgggagatgtgtaagacgcacttctcaccccaaagccctgctcctgctgaacccagcgtcattttccatccagttgacgccgggaggcggtccattgtctttgagaggcgccctcagcttagaagaccaggctcagatggcagtggagtttaaatgtaggtgttaccccggctggcaagccccttggtgtgagagaaagtctatgtggtag

SEQ ID NO: 191063 - DNA, 210 bp, Artificial Sequence
  Description of Artificial Sequence: Synthetic coding sequence
atggccgcccacctgctgcccatctgcgccctgttcctgaccctgctggacatggcccaaggtttcagagggccattactgccaaataggccattcacgacggtgtggaatgcaaacactcagtggtgtctcgagagacatggggtggacgtggatgtgagtgtattcgatgtggtagctaaccctggacaaacattccggggaccatag

SEQ ID NO: 191064 - DNA, 762 bp, Artificial Sequence
  Description of Artificial Sequence: Synthetic coding sequence
atggccggcaccctgcagctgggccgggccctgcggccccggggcctgtggggattttatgggttcccggactgctataattatgactttctcagtcccaactacaccgggcagtgcccctccggcatcagggctcagaacgaccagctggggtggttgtggggtcaatcccgcgctctgtacccatccatctatatgccagctgtgctggagggtaccggtaagagccagatgtacgtgcagcaccgagttgccgaagcattccgtgtagccgtggctgcaggggacccaaatctgcctgttcttccatatgtacaaattttctatgatactactaaccactttctccccttagacgagctggaacactctttgggggaaagcgctgcacagggagccgccggcgttgtgttgtgggtgagctgggagaatactaggaccaaggagtcatgtcaggccatcaaggaatacatggacaccaccctgggccccttcatcttaaatgtaacatctggagccctcctgtgctctcaagcgctgtgctccgggcatggaaggtgcgtccgtagaacttcccatcccaaggcattgctgctgctgaacccagcgagcttctccatccagcttaccccgggtgggggcccactcagtctgcgtggggcgctgtccctggaggaccaggcacagatggcagtcgaattcaagtgtcgatgctatccaggctggcaggccccgtggtgtgagaggaaatctatgtggtag

SEQ ID NO: 191065 - DNA, 1422 bp, Artificial Sequence
  Description of Artificial Sequence: Synthetic coding sequence
atgcgggccggccccggccccaccgtgaccctggccctggtgctggcagtcagctgggccatggagcttaaaccaaccgccccccccatttttactggacgccccttcgtagtggcttgggatgtgcctacacaggactgtggtcctcgactgaaagtccccctggacctcaatgctttcgacgtccaagccagccccaacgaagggttcgtcaaccaaaatatcaccattttttaccgggaccgccttggcctctacccccgattcgactctgccggacgctcggtgcacggcggtgtcccccagaacgtgagtctatgggctcatcggaaaatgctgcagaagcgcgtcgaacattacatacgtacacaagagagcgccggcttggctgtgattgactgggaagactggcgcccagtctgggtgcgcaactggcaggacaaggatgtttatcgaaggctgtcccgtcaattggttgcctcacgtcaccctgactggccccctgacagaatcgtgaaacaggcccagtacgaattcgaattcgccgcccaacagttcatgcttgaaacgctgcgctatgttaaggccgtcaggccccgccatctgtggggtttctacctctttcccgactgctacaaccatgactatgtccagaactgggagtcctataccggtcgctgtcctgatgtcgaagtggcaaggaacgaccaactggcctggctgtgggctgagagcacagctttgtttcccagtgtctacctcgacgagacacttgcctcttcacggcacggcagaaatttcgtttctttcagagtgcaggaagctctgagggtcgcccgaacgcatcatgctaaccacgctctccctgtctatgtctttactcgaccaacctacagccgcagactgactggcctgtctgagatggaccttatttccactatcggcgagagcgctgcactgggggcagccggggtgatactctggggggacgccggttatactacgagtacagagacctgccagtacctcaaagattacctgaccagactgttagttccatacgtggtgaacgttagctgggcaacccagtactgtagtcgtgcgcagtgtcacgggcacgggcgatgcgtccggagaaacccatccgcgagtacatttcttcatctctccaccaacagtttcagactggtccctgggcatgccccgggcgaaccacaattgagacctgtcggcgaactgtcctgggccgacattgaccacctccaaacgcactttcggtgtcagtgttacttaggttggagcggggagcaatgccagtgggatcaccgacaagcagctggcggagccagtgaggcctgggcgggtagccatttaacttccttactagcactggccgcgctggccttcacatggaccctgtag

SEQ ID NO: 191066 - DNA, 1422 bp, Artificial Sequence
  Description of Artificial Sequence: Synthetic coding sequence
atgcgggccggccccggccccaccgtgaccctggccctggtgctggctgtgagttgggccatggaactgaagccaaccgccccccctatttttaccggccgcccatttgtcgtggcttgggatgttccaacccaagactgcgggccaaggctgaaagtccccttggacctaaatgcctttgatgtccaggcttctcccaatgaggggtttgttaaccagaacattacaattttctatcgagacaggctcgggctttaccccagattcgatagcgccggcagaagcgtgcatgggggggtgccccaaaacgtatccctttgggcccatcgtaaaatgctccagaagagagtggaacactacattcggactcaggagtccgctggactcgctgtcatagactgggaagactggagacccgtctgggtgcggaactggcaggacaaggacgtgtacagaagactgtctcgtcaactggtggccagtcgtcacccagactggcctcctgatcgtatcgtgaaacaagcccagtatgaatttgaattcgcagcccagcagttcatgttggaaaccctcaggtacgtcaaagcagttaggccacgccacctgtggggtttctatctgttccctgactgctacaatcatgattatgtgcagaactgggaatcctacactgggaggtgccccgacgtggaagtggctcgcaatgatcagctcgcttggttgtgggctgaatccaccgctctcttcccctccgtttatttggacgagaccctagcctcctcgcgacatggtcgaaattttgtctcttttcgagttcaggaggctcttcgggtagccaggactcatcacgccaaccacgccctacccgtgtacgtgtttacacgacctacgtacagtagaagacttacgggacttagcgagatggacctcatcagtactatcggtgagtcagccgcattaggggccgctggggtaatcctatggggcgacgctggctataccacctccacggaaacctgtcagtacctaaaggactacttgactcgcctgttggtgccatacgtcgttaacgtgagttgggccacccagtattgttccagggcccagtgtcatggacatggaaggtgcgtccggcggaacccctctgcctctacgtttctgcatttaagcaccaacagcttccggctggtgcctggtcacgcacctggcgagccacaattaaggcccgtcggtgaactgtcctgggctgatatcgatcatctgcaaacacattttagatgccagtgctatctgggctggagcggtgagcagtgtcaatgggaccaccgtcaggcagcgggcggcgcttctgaagcttgggccggctctcacctgacaagcctgctcgctctagccgcactggcatttacttggacgttatag

SEQ ID NO: 191067 - DNA, 147 bp, Artificial Sequence
  Description of Artificial Sequence: Synthetic coding sequence
atgcgggccggccccggccccaccgtgaccctggccctggtgctggcagtatcttgggccatggagctcaagccgacagctccacccatttttaccgggaggccatttgtggttgcctgggacgtccccacacaggactgtggctag

SEQ ID NO: 191068 - DNA, 354 bp, Artificial Sequence
  Description of Artificial Sequence: Synthetic coding sequence
atgcgggccggccccggccccaccgtgaccctggccctggtgctggctgtctcatgggctatggaacttaagcccaccgcgccacccatatttacaggaaggccttttgtcgtggcctgggacgtacccacacaggattgcggaccgagactgaaagtgcctctggacctaaacgcattcgatgttcaggcgagtccaaatgagggctttgtcaatcagaacatcactatattctatagagacagactaggcctttacccacggttcgatagtgcagggcgatcagtccatgggggcgttcctcaaaacgtttcactttgggcccataggaaaatgctccagaagagggtgtag

SEQ ID NO: 191069 - DNA, 246 bp, Artificial Sequence
  Description of Artificial Sequence: Synthetic coding sequence
atgcgggccggccccggccccaccgtgaccctggccctggtgctggccgtatcatgggccatggagctgaaacccacagcgcctcctatctttacagggagaccgtttgtggtggcctgggacgttcctacgcaggactgtggacctcggctgaaagttccgctggacctgaatgcctttgatgttcaagctagcccaaacgaaggatttgtaaaccaaaacatcacaatcttttatagagattag

SEQ ID NO: 191070 - DNA, 231 bp, Artificial Sequence
  Description of Artificial Sequence: Synthetic coding sequence
atgcgggccggccccggccccaccgtgaccctggccctggtgctggcagtgtcttgggccatggagttgaagcccacagctccacccatatttacaggcagacccttcgtggtggcatgggatgtccccacccaggattgcggtcctcggctcaaagtccctctcgacctgaatgcctttgatgtgcaggcttctccaaatgagggatttgtgaatcagaacattacctag

SEQ ID NO: 191071 - DNA, 1422 bp, Artificial Sequence
  Description of Artificial Sequence: Synthetic coding sequence
atgcgggccggccccggccccaccgtgaccctggccctggtgctggccgtcagctgggcgatggagctgaaacccaccgctccacccattttcactggaagacccttcgttgtggcctgggacgttcctacccaggattgcggccctcgtctcaaggtcccactggacctgaatgcctttgatgtccaggcgtctcctaacgaagggtttgttaaccagaacattaccatcttctaccgtgatcgtttaggtctctaccctcgattcgacagtgcaggaaggtccgttcacgggggagtcccccagaacgtgagcttgtgggcccatcgaaagatgctgcagaaacgtgtcgagcactacattagaactcaggaatctgccggccttgctgtgatcgattgggaagactggcgtcctgtgtgggttagaaactggcaggataaggacgtctatcggaggctctctcgacagctagtagcttccaggcatcccgattggcccccggaccgtatcgtgaagcaggcacaatacgagttcgagttcgctgctcagcagtttatgcttgaaacactgcgctatgtaaaggccgtgagacctagacacctgtggggattctatctcttcccagattgctataatcacgattatgtgcagaactgggaaagctacaccggtcgctgcccggatgtggaggtagcacgcaacgaccagctggcctggttgtgggccgagtcaacagctctctttccctctgtctacctggacgaaaccctagctagttcccggcatggcaggaactttgtgtcattcagggtgcaggaggcgctgagggttgcccgtactcaccacgcgaatcacgccctgcccgtctatgtgttcaccagacctacatactcacgacgtctgaccggattgagtgagatggacctgatatctaccatcggggagtcagccgctctcggggcagccggtgtcatactatggggggacgctggatacactacaagtaccgaaacttgtcaatacctcaaagactatctaacaagactcctagttccctacgttgtaaacgtttcttgggcgacccagtactgttcccgcgcacagtgtcacggacatggccgctgtgtccgcaggaatccatctgcctctacatttcttcacctgagtactaacagcttcagactcgtccccggccatgcccctggcgaaccccagctgaggcccgtgggagagttgagctgggcagatattgaccacctacagacgcactttagatgtcaatgttatctggggtggtcaggcgagcagtgtcaatgggaccaccgccaagcagccgggggagcctctgaggcctgggcagggagccatctcaccagtcttctggcacttgctgcgcttgcattcacgtggacactctag

SEQ ID NO: 191072 - DNA, 1422 bp, Artificial Sequence
  Description of Artificial Sequence: Synthetic coding sequence
atgcgggccggccccggccccaccgtgaccctggccctggtgctggcggtgtcttgggctatggagctaaagcccactgccccccctatttttaccggtcgaccgttcgtggtcgcttgggacgtgcctacacaggactgcggaccaagactaaaggtgccactggacctgaatgccttcgacgtccaggcaagtcctaatgaaggattcgtgaaccagaacattacaattttctaccgcgatagactcgggttataccctcggttcgattctgccgggaggtccgtgcatggaggagtgcctcagaatgtgagcctctgggctcacaggaagatgctgcaaaagcgcgtcgagcattatattagaacacaggaatccgccgggcttgccgtaatagactgggaagattggcggcccgtctgggttcgcaactggcaggataaggacgtgtacagacggctatcgcgccagctggtggcctccagacatccagactggcctccagaccgcatcgtgaagcaagctcagtatgagtttgagttcgccgcccagcagtttatgctggagacactgcgctacgtgaaagcagttaggccccggcacctgtgggggttctatttgttcccagattgctacaatcatgactacgtccagaactgggagtcttacacgggtcggtgccctgatgtagaggttgcaagaaatgatcagctggcctggctatgggcggaaagcactgccctgttcccctctgtttatctggacgagaccctggcaagctcacggcacggccgaaacttcgtgagcttccgcgtccaggaggccctgcgagttgctagaactcaccacgcgaaccacgctctgcccgtgtatgtgttcactcgtcccacctacagccgacgcctgaccgggcttagtgagatggacctgatctccacgatcggtgaatcagcagcactgggggctgcgggggtaattctgtggggagacgcgggctacactacttccactgagacctgccagtatctgaaagattatctgactcgactcttggtcccctacgtcgtgaatgttagctgggccacccaatactgttcccgcgcacagtgtcatggccacggccggtgcgtccgacggaatccctctgcgtcaacttttctccacctttcaactaattccttccgcttagtccccggacatgcgcctggagagccccagctccgacctgtgggagagctctcgtgggcagacatcgatcatcttcagacccattttaggtgccaatgctatctcggttggagtggagaacaatgccagtgggaccataggcaagcagccggaggtgcgtctgaagcttgggccggttctcacctgacaagtctgttggccctggccgctctggccttcacttggactctatag

SEQ ID NO: 191073 - DNA, 366 bp, Artificial Sequence
  Description of Artificial Sequence: Synthetic coding sequence
atgcgggccggccccggccccaccgtgaccctggccctggtgctggctgtgagctgggctatggagctaaagcctactgccccacctattttcactgggcgaccttttgtggtcgcttgggacgtcccgacccaggactgtgggccacgtctgaaggtacccctggacctgaacgcattcgatgttcaggcatctccaaatgagggcttcgtaaatcagaacatcaccatcttctacagggatcgattgggtctctaccctcgttttgacagcgccggccggagcgtccacggtggagtgccacaaaacgtgtccctttgggcccacagaaaaatgttacagaagcgcgtcgagcactatatctag

SEQ ID NO: 191074 - DNA, 1254 bp, Artificial Sequence
  Description of Artificial Sequence: Synthetic coding sequence
atgaccacccagctgggccccgccctggtgctgggcgtggccctgtgcttggggtgcggtcagccactgcctcaagttcccgaacgcccattctctgtgctgtggaacgtccccagcgcccactgcgaagcacggtttggcgtgcacttaccccttaatgccctaggaatcatcgctaacagagggcagcacttccacggacaaaacatgaccatattctataaaaaccagttgggcctctacccatattttggcccgcggggaaccgcacacaacggtggaatccctcaggctttgccgctcgacagacatctggctctggccgcatatcagatccaccactccctgcggccaggatttgccggccccgccgtgttagattgggaagagtggtgtcctttatgggcggggaactgggggaggcgccgagcatatcaggcggcctcgtgggcttgggcacagcaggtttttccagatttggacccacaggagcagctgtataaggcttacacaggattcgagcaggcagctcgggcgctcatggaggacaccttgcgcgtcgcacaggcccttcggccccacggcctttggggtttctatcattaccctgcgtgtgggaatggatggcacagcatggcatccaattataccggtaggtgtcacgctgcgaccctcgccagaaacacccagctccattggttgtgggcggcctcctctgctctgtttcccagtatctaccttccaccccggctccctcctgcccaccaccaagcctttgtgaggcatcgcctagaagaagcgttccgcgtcgccttggtcgggcaccggcacccccttccagtgctagcgtacgtgcgtttgacgcatcgcagatccggccggtttttaagccaagatgatctagtccaatcaatcggagtaagtgctgcgctaggggctgccggcgtggtcctatggggggatctgtccctgtctagctcagaagaagagtgctggcacctccatgattaccttgttgacacactagggccatatgtgattaatgtgacccgcgctgccatggcatgcagtcatcagcggtgtcacggtcacggaaggtgtgcccggagggatccaggacagatggaggcctttttgcatctatggccagatggatccctgggggactggaagagtttctcttgtcattgttattgggggtgggcagggcctacatgccaggaaccccgaccgggaccaaaagaggctgtctag

SEQ ID NO: 191075 - DNA, 1164 bp, Artificial Sequence
  Description of Artificial Sequence: Synthetic coding sequence
atgaccacccagctgggccccgccctggtgctgggcgtggccctgtgtctgggatgcggacagccattgcctcaggtccctgagcgcccctttagcgtgctgtggaacgtgccctctgcccactgcgaggctcgattcggagtccacctccctctcaatgctctgggcataatcgccaaccgtgggcagcatttccacggccagaacatgacaatattctacaaaaatcagctcggactatatccttatttcggcccacgaggaaccgcccataacggtggaattcctcaggcgttaccattggacagacatttggctttggccgcataccaaatccatcactcacttcgccctggcttcgccggaccagccgtcctggactgggaggaatggtgtcccctgtgggccgggaattgggggcggcgccgcgcttaccaggccgctagctgggcatgggcccaacaggtgttccctgacctggaccctcaggaacagctatacaaagcctataccggcttcgagcaggccgctcgggccctgatggaggatacattaagagtggctcaagctctgcgcccacatggcctatggggcttctaccactatcccgcatgcggcaacgggtggcattcaatggcatccaattacaccggaagatgccacgctgccactctggcaaggaatacccagctgcactggctgtgggcagccagcagtgccctgttcccttcaatttacctccctcccaggttaccccctgcacatcaccaggcatttgtaagacatagactggaagaggccttccgagtggccctggtgggacatcgccaccccttgcctgtcctggcctatgtgcgtcttacacacaggcgctcgggaaggttcttgtcccaagaggagtgttggcacctccacgactatttagtggacaccttgggtccttatgtcattaacgtgacacgcgccgctatggcgtgtagccaccaaaggtgtcacggacacggacgatgtgctcggcgggaccccgggcagatggaggctttccttcatctttggcccgacgggtctttgggcgactggaagtcgttctcctgtcactgttattggggctgggcgggtccaacttgtcaggaaccccgtccagggcccaaggaggcggtatag

SEQ ID NO: 191076 - DNA, 507 bp, Artificial Sequence
  Description of Artificial Sequence: Synthetic coding sequence
atgctgccccccgcccaccaccaggccttcgtgcggcaccggctggaggaggcttttcgggtcgcactggtgggacacaggcacccacttccggtgctggcgtatgtcagactcactcacagaagaagcggtcgcttcctctcgcaggacgatctggtacaaagcatcggtgtttctgctgcgctgggagccgctggtgtggtgctgtggggcgacttgtcactcagtagttccgaggaagaatgttggcacctccacgactacctggtggacaccctgggaccatacgttataaacgtcaccagagcggccatggcctgtagtcaccagcggtgccatggacacggccgttgtgctcgcagagatcctggccagatggaagcctttttacatttgtggcccgacgggtcgttgggcgattggaaatcgttttcctgccactgttactggggttgggcgggccccacctgccaggaaccccggccgggacccaaggaggccgtgtag

SEQ ID NO: 191077 - DNA, 483 bp, Artificial Sequence
  Description of Artificial Sequence: Synthetic coding sequence
atgaccacccagctgggccccgccctggtgctgggcgtggccctgtgccttggctgcggccagcccctgcctcaagtgccagaaagaccctttagcgtgctgtggaacgtgccatctgcgcattgtgaggcaagattcggtgtgcatctgccactcaacgccctgggaatcatcgcaaaccgaggacaacactttcacgggcagaatatgactatattctacaaaaaccagctcggcctgtatccttatttcggcccgcgcggcaccgcccacaatgggggcattccacaggcgctgcccctagatcgccacctggcacttgcagcttaccaaatacaccatagcctgagaccaggtttcgccggacctgctgtgttggactgggaagaatggtgcccgctttgggctggaaactgggggcgcagacgtgcataccaggcagcatcttgggcctgggcgcagcaggtctttcccgatttatag

SEQ ID NO: 191078 - DNA, 1164 bp, Artificial Sequence
  Description of Artificial Sequence: Synthetic coding sequence
atgaccacccagctgggccccgccctggtgctgggcgtggccctgtgtttggggtgtggtcagcccctcccacaagtgcctgagcgtccattcagcgtactctggaatgtccctagcgctcactgcgaagcccggtttggggtgcatctgccgttgaatgcactcggcataatcgccaatagagggcaacactttcacgggcaaaatatgacgattttttataaaaatcagctgggactgtacccctactttggcccccgcggcactgctcacaatggcggcataccccaggcactgccactggaccgtcacttggcactagcagcctaccagatccatcacagtctgcgacctggtttcgctggcccagctgtgctggactgggaagaatggtgccctctatgggctggcaactgggggcgccgccgggcttatcaggccgctagctgggcttgggcgcagcaggtgttcccagacttagaccctcaggaacagctgtacaaagcctatactgggtttgagcaggctgcaagggcactcatggaagatacactgcgggtcgcgcaggcactgagaccacacgggctgtgggggttctatcattatccagcctgcggcaatggatggcatagtatggcctctaactatacgggccgatgccatgctgctacattggctcgcaatactcagcttcactggctgtgggcagcctcctcagccttgtttccaagcatctacctcccacctcggttacccccggcccaccatcaagcctttgtccggcatagactggaggaggcgttccgtgtcgctctggtgggacaccgccacccgctgcctgtgttggcttacgttcgcctgacacaccggcggtctggcagattcctctctcaggaggaatgctggcacttgcatgattatctcgtagacacactcgggccttatgttatcaatgtaacacgtgcagccatggcatgttcgcatcagcgctgtcacgggcatggcagatgcgcaagacgagatcctgggcaaatggaagcttttctgcacctgtggcccgacggcagcctgggcgactggaagagtttttcctgccattgctactgggggtgggccggtccaacatgccaggaacctaggcctgggcccaaggaggccgtctag

SEQ ID NO: 191079 - DNA, 417 bp, Artificial Sequence
  Description of Artificial Sequence: Synthetic coding sequence
atgctgccccccgcccaccaccaggccttcgtgcggcaccggctggaagaggccttccgggtcgccctcgtagggcaccgacatccccttcctgtgctggcttatgtcagactcacccacagacggagcgggagattcctctcccaggaagaatgctggcatctgcacgactacttggttgataccctgggaccctatgtgattaacgtcaccagagccgcgatggcgtgcagccatcaaaggtgccacggacacggtcgctgtgcgcgtagagaccccgggcaaatggaggcctttcttcatttgtggcctgatggtagcttgggggactggaagtcatttagctgccattgctactggggctgggccggtcctacttgccaggagcctaggcccggcccaaaggaagccgtgtag

SEQ ID NO: 191080 - DNA, 1518 bp, Artificial Sequence
  Description of Artificial Sequence: Synthetic coding sequence
atgagcagcgtgcagcagcagcccccccccccccggcgggtgaccaatgtgggctcccttctcctcacgccccaagagaacgaatctctgtttaccttcttagggaagaagtgcgttaccatgtcgtctgccgtggtccagctctatgccgcagatcgcaactgcatgtggtctaagaaatgcagtggagttgcatgtttggtgaaggataacccacagaggagttactttctgcgtatcttcgatatcaaagacggtaaactgctttgggagcaggaactgtataacaacttcgtgtataattccccgcgcggctacttccacaccttcgcgggcgacacatgtcaggtggcgctgaatttcgctaatgaagaggaggctaaaaaatttaggaaggcagttacagatcttctgggcaggagacagcgcaagtccgagaagcgacgagatcctccgaatgggcccaatctacctatggctacagtagacatcaaaaaccccgagattactaccaaccggttttacgggcctcaggtgaataacataagccatacaaaagagaaaaaaaagggcaaggcgaagaagaagcgcttaacgaaggctgatattggcaccccaagcaactttcaacatataggtcatgtcggctgggaccccaacaccggtttcgatttaaataatctcgatccggaactcaagaacctcttcgacatgtgtgggatctctgaggcccagctgaaggatagggaaacaagtaaagtgatttacgacttcatagaaaagaccgggggggtggaggcggtaaagaacgaactgcggaggcaggcgcctcccccccctccgccttctagaggtggaccaccaccgcctcctccccctccccacaacagcggccctcctccaccacccgccaggggcagaggagccccacctccacccccgagccgggcccccaccgccgcacccccgcctccccctccgtccagaccttcagtggcggtgcctccccctcctcccaatagaatgtacccaccacctccacccgcactaccctcttccgccccatctggacctcctccacctccacccagtgtgctcggcgtgggtccagtagctccgccaccacccccaccgccgcctccaccaccaggcccacctccaccccctgggctcccctcagacggggaccaccaggtgcccacaaccgccggaaacaaagcggcactcctcgaccagattcgtgaaggcgcacagctgaagaaggtcgagcagaatagtcgacctgtgagttgtagtgggagagatgcccttttagatcaaattagacaaggaatccaactgaagagcgtcgccgacggccaggaatcaaccccccctactcccgcaccgacatcgggtatcgtcggagcactcatggaggtcatgcagaagagaagtaaggcaatacatagtagcgacgaggacgaagatgaggacgatgaggaagactttgaggacgatgatgagtgggaagactag

SEQ ID NO: 191081 - DNA, 1446 bp, Artificial Sequence
  Description of Artificial Sequence: Synthetic coding sequence
atgaaggtgctgagcgagggccagctgaagctgtgcgtggtgcagccagtgcatttgacttcctggcttctgatctttttcatcctcaaatctatcagctgcctgaagcccgcccgccttcctatttaccagaggaagccctttatcgccgcatggaatgcacctacagatcaatgcttgatcaaatataacctgcggctgaatctgaagatgttccctgtgattggttcccctctcgcaaaggctcgcggacagaacgttacaatcttctatgtcaatcgcctgggttattatccatggtacacatcccagggggtgccaatcaacggcggccttccccagaatatttctctccaagtgcacctagagaaagcagaccaagatatcaactactatatccctgcagaggacttctcaggacttgccgtgattgattgggagtattggagaccccagtgggctcggaattggaattctaaagacgtctatagacaaaaaagccgcaaattgatctccgacatgggcaagaacgtctctgccaccgatattgaatatctcgccaaggtgacttttgaggaatctgctaaggcttttatgaaagagactatcaagctggggatcaagtcccggcctaagggactgtgggggtactatctctatcctgattgtcataactacaatgtgtacgcacctaactactcggggagctgtcccgaggatgaggtgctgcgaaataatgaactctcctggctctggaattcatccgctgccctctacccctcaatcggtgtgtggaagagccttggagattccgagaacatcctgcgatttagcaaatttcgggttcacgaatctatgcggatctccacaatgacctcccacgattacgctttacccgtgttcgtctatacacgcctggggtatagggatgaaccgctgtttttcctatccaagcaagatctggtcagcaccataggagaatctgcagccttaggggcagctggaatcgtgatttggggtgacatgaacctgacagccagcaaggccaactgcacgaaagtgaaacagtttgtctccagcgaccttggcagctatatagccaacgtcacaagggctgctgaggtttgcagtttacatctgtgtcgaaataatggcaggtgtatccggaagatgtggaacgccccgagctacctccatctgaacccggcttcataccatattgaggcaagtgaggatggagaatttactgtgaagggcaaggcatcggacacagacctggcggtgatggcggatacatttagttgtcactgctaccaagggtatgagggagcagattgcagggaaatcaagactgcagatggctgctcaggtgttagcccctctcctggttctctaatgacattatgtttactgcttctggcatcctaccgcagcatccagctctag

SEQ ID NO: 191082 - DNA, 138 bp, Artificial Sequence
  Description of Artificial Sequence: Synthetic coding sequence
atgaaggtgctgagcgagggccagctgaagctgtgcgtggtgcagcctgtgcatctcactagctggctgttgattttctttattttgaaatctatctcatgcctgaaacccgcacgcctcccaatctatcaacgctag

SEQ ID NO: 191083 - DNA, 192 bp, Artificial Sequence
  Description of Artificial Sequence: Synthetic coding sequence
atgaaggtgctgagcgagggccagctgaagctgtgcgtggtgcagccagtacacttgacctcctggcttctcatcttctttatcctcaaatctatcagctgcctgaagcccgccagactccctatctaccaaagaaagccatttattgcagcctggaatgctccaactgaccagtgtctaatcaagtactag

SEQ ID NO: 191084 - DNA, 15366 bp, Artificial Sequence
  Description of Artificial Sequence: Synthetic coding sequence
atgaccagccggcggctggaggagagcatgggcgccgtgcagatgggcctggtcaacatgtttaaagggttccagagtaaggtgttgccacctctttctccgaaggtagtgaccgaggaggaggtcaatagaatgctgacaccatctgagtttttaaaggaaatgagtcttaccacagaacagaggttagccaaaacacgcctgatgtgccgtccccagataatcgagctgctggacatgggcgaaaccacgcaccagaaatttagcgggatagacctggatcaggccctgtttcagccctttccctccgaaatcattttccagaactacaccccatgtgaggtctatgaagttcccctaattttgcggaataacgataagatccctagactggtgaaagttgttgaagagtcctcgccctacttcaaagtgatctcccccaaagacattggacataaagtcgcacccggagtaccaagcattttccgaattttatttacccccgaggaaaacaaagattacgcgcatacgcttacatgcgtgacagagcgggaaaagtttatagtcccgattaaggccagaggcgctcgagctatactggacttccctgacaagttgaacttcagcacctgcccggtcaagtactccacacagaaaatcctgctggtgagaaacataggtaataaaaacgcagtattccacatcaaaacctgtaggcccttttcgattgagccagccatagggacactcaatgtcggggaatccatgcaattggaggtagagttcgagccccagagcgttggtgaccacagtggaagactgatcgtgtgttatgacaccggagagaaagtgttcgtgtccctgtacggggcagccatcgacatgaatattcgcctggacaagaattccttgacaatagagaagacatatataagtttagctaatcagcggactatcacaatacacaataggagtaacataatagcccactttttgtggaaggtgttcgctacccagcaggaagaggatcgagaaaagtaccgtgcttgtgacgacttgattaaagaggagaaggacgaaactgacgagttctttgaggaatgtatcacagatccgctcttgcgggagcacctctctgtgttgagtcgtacttttgcaaatcagaggcggctcgtccagggagactccaaactattcttcaataatgtcttcacagtagaacctctggagggcgacgtgtggcctaatagcagcgccgagatcactgtttactttaaccccctggaagccaagctgtaccagcagaccatctattgtgatatcctgggcagggagatcaggcttcctttgagaattaagggcgagggcatgggccccaaaatccacttcaacttcgagctcctagatatcggaaaagtttttaccggttctgcccactgttacgaggccattttgtataataagggatcaatagacgccctatttaacatgacgcctcctacaagcgctcttggggcgtgtttcgtgtttagcccgaaggaaggtataatcgagccttctggagtacaggctatacagatctctttctcctctaccatattgggcaacttcgaagaagaattcctcgtgaacgtgaatggctcgccagagcccgtgaaacttacgattcgcggatgtgtcattgggccgacttttcacttcaacgttccagcactccatttcggggatgtgtcattcgggtttccgcataccctgatctgttctctcaacaacacctccctgatccctatgacatataagctgcgcattccaggcgacgggctaggacataagagcatctcatactgcgaacagcatgtggattataaacgcccgagttggacaaaagaagaaatatcttctatgaaaccaaaggagttcaccattagccccgactgtggaactataaggccacaaggttttgccgctatccgagtgaccctgtgcagtaacacagtgcagaaatatgagctcgcactggtcgtcgatgtcgagggtattggtgaggaagtgctggccttactgatcacagccagatgtgtagtgccagccctgcacctcgtcaataccgaagtggattttggccattgctttctgaagtatccatacgaaaagaccttgcagttggcgaatcaggatgatttgcccgggttttatgaggtccagccccaggtctgcgaggaagttccaaccgtgttgttcagctcccccaccccaagcggtgtgatttcacctagctcgactatccatatccccctagtgctggagacacaagtaactggagagcaccgcagcaccgtgtatatttccatatttgggtcccaggacccaccactggtgtgccatctaaaatctgccggcgagggtcctgtaatctacgtgcaccccaatcaagtggacttcggcaacatttatgtgctcaaagactcatctagaattctcaatctctgcaatcagtcgtttatcccagccttttttcaggcacatatggctcataaaaagagcctatggaccatcgaacccaacgaaggcatggttccaccagaaactgatgtacagctggccctgacggcaaatcttaacgacacgttaacatttaaagactgcgtgattctggacattgaaaacagctccacctaccgtattccagtgcaggcctccgggaccgggtccacaatcgtctccgacaaaccttttgctcccgagctaaacctcggcgcacattttagcctcgatacccactactaccactttaaactgattaacaagggtagacgaatccagcagttattctggatgaacgattccttcagaccacaggctaaactgagcaaaaaggggagagtcaagaaaggacatgcccacgtgcagccccagccatcaggaagccaggagccccgagacccacagtctcccgtgttccacttgcaccccgcttccatggaactgtaccctgggcaagctatcgacgtcatcctggaaggatatagtgcgaccccgagaattgtcaaggaaaagctggtttgccatgctatcatcggagctcagaagggaaaatcgctggtaatggcagtaaatattacgtgcgagtttgtcgcgccacttatacagctgagcacaaagcagctgatctacagactggagaagaaacccaatagcattctcaagccggattaccagccactcgcaatcaagaacataagcaccttacctgtgaacttgcttttatctacgtccgggccgtttttcatttgtgaaacagataaatcgctgcttccggctacacccgagccaatcaagctggagattgacgaggaaaagaatctgctgatcaaatttgaccctagctacaggaacgatcttaacaactgggtggccgaagagattcttgccatcaagtacgtggaacacccccagattgatagcttggaccttcgcggagaggtgcactacccaaatttgtccttcgaaaccaaagagttagatttcgggtgtattctgaacgatacagagcttattagatatgtgaccatcaccaattgctcacccctggtggtgaaatttcggtggttcttccttgtgaacgatgaggagaaccagattcgcttcgtgacacttcccaagaagccatatagtgccccggtttctcagatggagtccatccctgctactagcgaagcagccagcccgccggccatactggttactgttgagtcgccagagatggacctgaatgattttgtgaagacagtgctggttgacgaggacgctaggccagaagaaaaggagttgcggaagacgaaggccagcagcgtaatctcagatgagatcaagatatccagtacggaaatcgagaggatctatagctcgcagtcacaggtggaagatcaggagtcactgcagacatgcgagcagaatgagatgctcagtattggcattgaggaggtgttcgacatactaccgctgttcggcgttctgcagccccactcctcccaccaaatcagctttaccttctacggccacgcaaacataatcgcacaggcaaaggccctgtgcgaggtcgaagagggcccaacttacgaaattacactgaagggggaggcctcacttgtgaattactctttcgacacaaaagatattcactatggactgcagctttttgatcacgtgaccgagagggaaatcacattgaccaacatggggaaggtggggttcgaattcaaagttctgactgatcatcaatcgagtcccgacaacctgttacctggtgtacccctgattctgccagtctctggattcatttcttcccaccaggagcaagtgctgaaggtgtattatctgcctggtgtacctgaggtgttcaagaggtcctttcagatccagattgcacaccttgatccggagaatatcacgctctcaggggagggcatatttccgcaaatctgtttagacctcccgaggaacctgaccgccaacgagaagtatgaaatgtttcttaatcaggcacgaaagaatacagacaaggagtacaataaatgtgagatgcttgatcactttgacatcattacagaggaggttcccgaggatgaaccggcagaagtcagtgctcatctacagatggaagtcgagagactgatcgtacagtcctacgtgttagagcatcagaagactactaccccagaccccatggacgacccatgtttcagtcaccgctctcgtaggaagctggccaagatacagctgcctgaatatatcttagacttcggttacattatacttggcgaggtacgcacgcacattatcaagattatcaacacgtcccactttccagtgtcttttcacgccgataaaagagttctgcatgagaccgggttttctaccgagctggatcgggtgaaaaacctgcctcactgcgaaactgaaatctttgaagtgagattcgatcctcagggagcgaatttgccagttggctcaaaagaagtgatactccctattaaagttgtgggggggcctacagtgcatatatgtctccaggctaaagtgacaattccaactatgactttaagccgcggcaaagtggactttgccacaatacagtgtggccagtgcctggtggaaaccattcagctgtctaaccacctgcaggtgccttgtgaatggttcgtacagagtcaaaaacctgttgacaaactggagaagcatatgccgaagtatctgcgccaaaaactgcgagctgaactgaagccgaagactcggatatttgagatccagcctatttctggtgtcctggatcctggggagaagtccaatgtgcaagttaaatttatgcctaaggaggagaaattctactcccagacactggtttttcagatcgcccaatcagctcagaaactgaccctcttggccagaggccagggtctggagcccagactggagttcagcccctcggtacttgacctgggccctctgttgctgtgtgctcctggcgacgaggcagaggtgattgtgaaaaacccctgcaactttcccatagagttctatagcctagagtttgatcagcagtaccttatcgaagaaaagatcctcaggaagttaaaggggtacgattcatataacacacttttgctgcctccaaggaacccgggtgagaagctgccccctgagctctacgagtattttaaagagatcaagaaaagtaaggaagaacagatgagagccaagtacctcgaaaatctcgctcaagagaatgaagaggaggacataacatccagcgatcagggcacttccaattctacaaaacggacttcactgagtaggggtattagcgtcaccagtaatcttgaagaatggcatgctttactggttgagtctaagacatacctggaagaggaagaagacgaagaatcactcgagaagattattttccaaactgacaagctgcagtccatcgactctcactctatggaggaggtgggtgaagtggaaaacaacccagtatctaaagcaatcgctagacatctgggtatcgacatctcagcggagggaaggctcgccaaaaatcgaaagggaattgcaatcattatacatggaacaccactgagtggcaaatccgccaacgctgtttccgtggccaagtactataacgccgcttgtttgtccatcgattctatcgtgcttgaagctgtcgccaactcaaataatatacctgggattcgtgctcgtgagctttgtattcgagctgctatcgagcagagcgtgaaagaaggtgaggaggcagcccaggaggccgcagtcggacagaatgttatagggcaaggtagattgtctacagacacccttgggaagctggcaagtgagatgactctcgtggctcccgaaattaagcccgggaaaagtgtgcggggaagtgtggtgattaccaagtctaaggccgactcacacgggtccggatctcagaaacagcaccatagccaccagtctgagaccccacagatctcgtcctccccactgcctcccggccctatccaccgctggctgtcggtgtctccaagcgttggaggagagacaggcttaatgagctgtgtgctgcccgacgaactgctagtacagattctggctgagcgtattcagcttagcgattgctatcgaggagtcgtgttcgacggcctggatacattgttcgctcagaatgcagcagcagccctcttgtgcttactgaaagcaatcggttctcgagagcatatatacatacttaacatggctcaggactatgcggcgatgaaggctcaagagaaagcaaaaaaagagcaggaggagagaaagcacaagggagccctggagaaggaaaaggaaagactccagaatatggatgaagaggagtacgacgcgttgaccgaagaagagaaactgacctttgaccggggtatccagcaggcactgcgtgagagaaagaaacgggagcaagagcgcttggctaaagagatgcaagagaaaaagctgcagcaggagttggagcggcagaaagaagaagatgagctgaaacgaagggtcaaaaaagggaagcagggcccaattaaagaagagcctccgatgaagaagagccaggccgctaacaagcaggtgcccccattgacaaaagtcgacgtcaaaatggaaactatcgagcgaaagatttcggtgagggaacagacaatgtctgagaaagaagagttgaacaagaagaaaaggaatatgggggacgtttccatgcacgggctgcccctggtccaggatcaagaagacagtgagggtgacaattccaaggaccccgacaagcagctggctcccaaattcaaaacctacgaactgaccctcaaagacgtccagaacatcctgatgtattgggaccgaaaacagggggtacagctgccaccggctggcatggaggaagcaccgcatgaacccgatgatcagaggcaggtacccttaggcgggcggaggggccggaaagatcgagaaagagaaaggcttgaaaaggagagaacggagaaagagcgtctggaacgtgaaaaggctgaacgagaacggttagaaaagcttcgcgctctggaagaacgtagcgattgggaaggcgagggcgaagaagaccacgagggaaagaaagaaaaggacctgggagttcccttcctagacatccagactccagacttcgagggtcttagttggaagcaggcccttgagtccgataaactccctaagggggagcaaatacttgacatcctcggtctgggtgcatctgggcctccgatacccccccccgccttgttctccattgtaagctatcccgtgaagcgtcccccacttaccatgaccgacgatttggaacatttcgtattcgtgatcccaccctccgaggacatcagcctagacgagaaaaaggagatggagattgaatccgatttcctggccacgactaataccacaaaggcccaggaggagcagacgagtagttctaagggggggaaacaaaaaatgaaggagaagatcgaccaggtgttcgagattcagaaggacaagcggcacatggccctgaaccgaaaagtcttgtcaggcgagcctgccgggacaatatctcagctgtctgacacagacttggacaatttcaacggtcagcactctcaggaaaagttcactcgcctcaatcattttaggtggattgttccagcaaacggcgaggtgacactccaggtacattttagctctgacgaatttggtaacttcgaccagacgttcaactttgagatcctgggaacgtgctgtcagtatcagctctactgtcgcggcatctgtacctacccttatatatgccaggaccctaaggtagtcttccctcagcgaaaaatggacatgaagacgaatgaggtcatcttcaaaaagtacgtcatgagtacagagacatactatttcggtccgcttctctgcggaaagtctagagacaagtataagtcctccctgttccccggaaacatggagacattgactatcctgaatactagtctgatggtagtggaggcgtccttttacttccagaatgatgtcaaggccaacacttacttcttggagccgaacactatggtgttgaagccgaacgaaaaacaaatcctgaacgtgtgggcctacccgacttcagttggagtatttgaagattcaattgtctgttgcatcaatgacaaccccgagccagcaatattccagctttcctgtcaaggcataaggccggagctggagttggaacccaggcagctccacttcgaccgactactcctccaccgccaggaatcccgcgtggtactcctccgcaatgtgacattattacctgtggcttggcgcatcaccagtcttgagcacctcggggatgactttacggtgtccctcatgcagggtactatcccacccgaggccgaatacggactgcacctctactttcagcctacaaagcccgtcaatatcaaaaaggctatcaggctcgaagttctagatgctgagaacttgctcggggttgttcagatcgaaaatattatggtgtttgcagaagcgtacgatatagccctcgatatcacatttccaaagggggccgagggcggattagattttgggattgtgagggtgaccgaggaggcaaaacagcctctgcagcttaagaaccggggcaagtacgaaatagctttctctttttcggtggatagtgtgggtattagtacccccaatattaactccatgattagtgttcaacctaagaagggtagtctgacacccacagaaaagcccacaaacgtacaggtgttctttcatgccaagaaggaggtcaaaatagaacaccagcccgtattgagatgtcaaataattgagccaaatatcagcgagggaggcgaaataatagccagcataccaattaaattttccgcaaatgcggtctactctaaatataacattacaccctctagtgtcatcaacttcggcgcccttatttgtggcactcgtaagagcaccacgttcaccattgaaaaccagggggtgaccgatttcaagttcgctctttataagctgacaggcgaatctccaattcaccagaagaaagcagcctcccacgtgcgtcacgcgcgctcaagggagagcgaatcattctataagaccggcagctctcgggctgccaagtttagtgataccatccagaaggaggtaaccacgaccgggcaggcaaggttcgcgcacgggatgtttaccgtatatccaggctttggatcaataccttctgggggacaacaagtaatcaacgtggactgcgtcgccgacgccatgggaaagtgtgaggaatttatcgccattgatatctctggcagagaccccgctgtccatcccgcaggcattctctacacactcctggccgaggcatgccttcctgccttcgttactgaaaataacgccctgatctttgaggagcatcagatttgtacgagcgccaaccttcatcacatactgcagaccatagaaagcggaggcctgtttgtcgaagatgagaataagttcattttctgtaatgtcctggtggggaggcaggctaaagcccgcttcaagatctcaaacgtgggcaagatcacttgcgatgtaaatatcgtggtacgtcctatctcaaataagccttttgccagaattgtcgatatatttgaggtcgagccctccaagatgtgtatcgcatcccactcacacgctttcgctacagtgtcatttacgccccaaatcatgcagaattaccagtgcatcttcgaggcaacccttgatggactccctagcaccttagccaagagcagagggctcgtgttcgacatagccggagaaggaaacctgccaagggttaccgtcgtgagacccgtcttacataaccagtacggcaatcccctgttgctcttcaagaggctgctgcttggccacagtgaaaagctgccgctaattcttaaaaataacggtgtgttgccagctcaactgcacgtggacttacaagacgagctgggcgttttctcacttaaaggcagaccaaccaccgcctatatttatatcaccgaagagaataagccacatgtcaaggctaagaaggctcatacagcaagccttgtggtgagtcccggcgacactgccgagttcgacgtggtcttccactcacaaaaggttggacgcatgcgcggtatcatccacttgtcagtgatcaacaaccaatacgaggaaacttcaatccacatggtgggagaaggttatgaggatgacatcactttggataacatccatggcctcgtggcacctactagccaagaggatatttcaatttctgaattcaccgagatcatcgaagacaacgatatggaagacttagtagcagctgcccttgtggatcacattcagtttggcgattgccatatcggccactcatataacgcctcattcacagtcactaatcactctcaggtgaatttgattcggttcgagtggcccgtaagcgccacaattgcattcagtccacagatggggcacttgcacccaggctgtgctaaggatatcgttgtgaccatgaaaagcgacgtgcctataaatctgaaaaatatgcgcatacgatgcaaactgtcccggatcatgtttcagctgcctgccgaccaagtaccagactgggacgaccgaatgcatacagttaagtgggtagacgttcctcgcaatatgcccgggacatttaccacaaagagaaaggtgattgagacagacccagagccggctcattccgtactggaagagaattatcaagagctccagttgcagatcagcgcaaacgtcgatttcgcatcctaccactgtcaggcccgggatgtgcgctttaaggaaacactggtgtatcaaactagagtgttcgaattcgatgtgatcaactccggccgcgtgcagctggaattctcttgggtatcagaagatacttcaaaggccgtgtcatttgcaaagcctgatcaccagggaagtgcacaaaaagaccagttaagccaagggacaatgcacactgggtcgactcttgattccactatggaccactgggctgagggcagtcctcagcctttctcggtcgagccgtcctcaggcattgttcctgtgggaaaaatacagaagtttaaggtgaagttttcccccctcgacatcggagatttcgagagtaatctattctgccagatccccaacctgcccccgggcgagcagggacctgtgctcgtggcaaagggtaggtcgaccctgccgatctgccactttgatctcaaagatagcgactatatatcagggcaccaaaggaatcctgaactgcgcgggtccagcggcggagctctagatccaaacaccagagtcattgagttcaccacagtgggtatcggcggtaagaaccttcgaacctttacgatcctcaacccaacaaatagcacctacagcttttgttggatctccgaggagatcgagtccctccaaaacccagctgcctttacttgcctgacagaaaagggcttcatccatcctgagaaaaaagccgaaatcgtgtttcagtttactcctttccatctgggcatcacagagtctagctggacttttctgattccagagcataatatcaccgttccttttcttcttgtgggcaagacaactgagcctctcatcagcttgaacaaaagccaccttaacttttcgagcttactcatcggccgagaagcgcgggaaaccgtccagataatcaacaaggaggagcagggatttgatttttccttccaggacaatagcagatactctgagggcttttctaacagcctcctcgtttgtcctatggaggggtggatccctcccctatcaagattccccatcgacattttttttactccaaaacaggaaggcgatgtaaattttaatcttatatgtaatgttgagaagaaagtccatcctgttacacttaatgtgaaagcagaggggtacaccatgaatgttgagattaagtgcaaggaccgcacaggaagcataaccttattgactcccaatcaaacgaacatcataaatttttacgaggtggagttaaatgaatgtgtccaatgtgaattcaattttattaataccggcaagttcacgttttccttccaagctcaactgtgcggatccaagaccctgctccagtatttagaatttagccccattgactccaccgtggacgtaggccagagcgtgcatgccaccctgagtttccagcctttaaagaaatgtgttctgaccgatctggaactcatcattaaaatctcccatggcccgaccttcatgtgcaatatttccggctgcgctgtctcacctgcgatacacttctccttcacgtcctataacttcggaacttgtttcatctatcaggctggaatgcctccttataagcagacactggtcatcactaacaaggaggaaaccccaatgtccattgattgcctctacaccaataccacacacctggaagtcaacagccgcgtggatgtggtgaaaccaggtaacaccctggagatccctatcaccttttaccctcgggagagcattaattatcaggaactgatccctttcgagatcaatggccttagccaacagacagtggaaatcaagggaaaggggacaaagatgaaaatcctcgttctagatcctgctaatcggattgttaagttgggtgccgtgctccccggccaggttgtgaagcgcacagtgagcatcatgaataattccttagcccagctgacctttaaccagagcatactgtttaccatccctgaacttcaggaacctaaggtcttgactttagccccattccataatattaccctaaaaccgaaagaggtctgtaagctcgaagttatctttgcccctaaaaagcgcgtgccaccctttagtgaggaagtctttatggaatgtatggggctgctgaggccacttttcctcctcagtgggtgttgccaggcccttgaaatttcactggaccaagagcacatcccattcgggccagtcgtataccaaacgcaggccacgcgacggatactcatgatgaatactggagacgtgggagcccgcttcaagtgggacatcaagaaatttgagccacatttctcaatttcgccagaggagggctacatcacttccggcatggaagtgagtttcgaagtcacatatcatccaaccgaagtggggaaggagtcactgtgtaagaacatcctatgttacatccaggggggctcccccctgagccttacattatccggcgtttgtgttggaccaccggccgtcaaagaagttgtgaactttacctgccaggtgcggagcaagcacactcagaccatactcctgagcaatcggacaaatcagacctggaacctacatcctatctttgagggggagcactgggaaggtccagagtttatcaccctggaggctcaccagcagaacaaaccttacgaaatcacctacaggccgagaactatgaatctggagaaccggaaacaccagggcaccttatttttcccacttcccgacgggaccggctggctgtacgcactacacgggacttctgagcttcccaaagccgtggccaatatatatagggaggtgccctgcaagaccccttacactgagctccttccgatcaccaattggttaaacaagcctcagaggttcagagtgattgtggagatacttaaacccgaaaagccagacctgagcattacgatgaagggactcgactatattgacgtactgagtggcagcaagaaagattacaaactgaatttcttcagccataaagaagggacctatgcggccaaagtcatctttcggaatgaggtaacaaacgagtttctgtactacaacgtgagctttagggtgatccctagtgggattataaagaccattgagatggttactcctgtccggcaagtggcttcagcctccatcaaactggaaaaccctctgccatactccgtcacctttagtacagagtgtcggatgcccgacatcgccctgccatcacagttcgttgtccctgcgaattctgagggaacatttagctttgagttccagcctctcaaggccggagagacatttggccggttaacattgcataatactgatctgggctactaccagtacgagctgtacttgaaggccacgcccgccctgccagagaagcctgtgcatttccagacagtattaggctccagtcagattatcttagtaaaattcatcaattatactcgccagcgcacggagtattactgccgtacggactgcacagattttcacgctgaaaaactgatcaacgctgctcccggcggccaggggggcaccgaggccagcgtggaggtcctgttcgaaccttctcatcttggggagactaaaggaatcttgatcctcagctcactggccggcggggaatatattattccactcttcggaatggctttgccccctaagcctcaaggaccattttctattagggccggatattcaatcatcattcctttcaagaatgttttttaccacatggtcaccttttctatcatcgttgacaaccctgcctttactatccgggccggcgagtcggtcaggccgaaaaagatcaataatatcaccgtctccttcgaagggaacccttccggctcaaagacacccataactactaagctgaccgtctcctgtccgcctggcgaaggatcagaaaccggggttaaatgggtgtattacttaaaaggaattacactgtag

SEQ ID NO: 191085 - DNA, 2853 bp, Artificial Sequence
  Description of Artificial Sequence: Synthetic coding sequence
atggagagcgccggcggcttcaagctgggcatggagcccctgagcggagggggtgtgtgtgagaagaagaagctactcaaaatgactagcagaagactcgaggaaagcatgggagccgtgcagatgggcctggtcaatatgttcaagggcttccagagtaaggttctcccccccttgtctccaaaggtggtgaccgaggaggaggtgaaccgtatgctgaccccaagcgagtttctcaaagaaatgtcactgactaccgagcagcgcctggcgaaaacacgcctgatgtgtcgtcctcagataatcgagctgctggatatgggtgaaacaacacaccagaaattctccggaattgacctcgatcaagcactgtttcaaccattccctagcgagatcatattccagaactacaccccttgtgaagtctacgaggtgcctctcatcctgcgtaacaacgacaaaatcccgcgtctcgtgaaggttgtggaggagagttctccgtacttcaaagtgattagtcctaaagatatcggccacaaagtggctcccggggtgcccagcatctttagaattctatttacccccgaggagaataaggactacgcccatactcttacctgcgtgaccgagcgcgagaaatttatcgtcccaattaaggctaggggcgcgagggccattctggacttccccgacaagttgaacttttcaacctgccccgtgaaatattcgacacagaagatcttacttgttaggaacataggcaacaaaaatgctgtttttcacattaagacctgtcggcctttttcaatcgagcctgccatcggcaccctgaacgtgggagagagcatgcagctggaggtggaatttgagccccagtccgtgggggaccactcgggtcgtctgatcgtttgctatgacaccggggaaaaagtgttcgtgtccctgtacggcgcagccattgacatgaatatcagactagacaaaaactccctgaccatagaaaaaacctacatcagcctcgcaaatcagcgtaccatcacaattcacaacagaagtaacattattgctcacttcctctggaaggtctttgctacccagcaggaagaggatcgggagaagtacagagcctgcgacgacctcatcaaggaggaaaaggatgagacggatgaattttttgaggaatgcatcactgatccgctgttgagggaacatctatctgttctgtctcggacctttgctaatcaacggaggttagtccagggggattctaaactgtttttcaacaatgtttttactgtggagcctctcgagggtgacgtctggccaaattcttcagcagaaatcaccgtgtatttcaaccctctggaggcaaagctgtatcagcagactatttattgtgatatcctcggacgcgagattcgcctgccattgcggattaaaggagagggcatgggccccaagatccacttcaactttgagctactcgatatcggaaaggtttttactggcagcgctcactgttacgaggccattctatacaataaaggctctatagatgccttatttaacatgacacctccaactagcgcccttggggcatgctttgtgttctcccctaaagagggaatcatcgagcccagcggcgtgcaggccatacagatatctttttcttcaacgatcctcggcaactttgaggaggaattcctggtcaatgtgaacgggtcacccgaaccagttaagctcacaatccgaggctgcgtgatcggtcccacctttcatttcaacgtgcccgccttacacttcggcgatgtgtctttcggatttccgcatacgctgatttgctcacttaataacacatcgttgattccaatgacttacaaactacggatcccaggagacggactgggccacaagagtatctcctattgtgaacagcatgttgactacaagcgcccatcctggaccaaagaggagataagtagtatgaagcccaaggagttcacaatctccccggactgtggaaccatcaggccacagggctttgccgccatccgggtgaccttatgtagtaataccgtccagaagtatgaactagcactggtggtggacgtagaggggataggagaagaggtgctggctctgttaatcacagccaggtgtgttgtgcctgcgctgcacctggtcaataccgaggtggactttggccattgctttttaaagtacccatacgagaaaaccctccaattagctaaccaggacgacctaccgggtttctatgaagtgcaaccacaggtctgcgaggaggtgcctacagtgctctttagttctcccactccgtcaggcgtgatctcgccaagtagtacaattcacataccgctcgtgttggagacacaggttacaggcgaacaccgctccaccgtgtacatcagcatttttggttcccaagatccacctctggtatgccaccttaaatcggctggcgaggggcccgtgatttacgtgcatccgaaccaggtggacttcggcaacatctacgtattgaaagacagtagccgcatcttaaacctgtgtaatcagtcatttatcccagcttttttccaggcccacatggctcataaaaaatcactgtggactattgagccaaatgaaggcatggtgccccccgaaaccgacgtgcaacttgcccttacggcaaacctcaatgacaccctcacattcaaggactgtgtcattctggacatcgagaattcctctacataccgtattcccgtacaagcttctggcaccggcagtacaatcgtgtccgacaagcctttcgctcccgaactcaacctgggggcccattttcgctag

SEQ ID NO: 191086 - DNA, 2823 bp, Artificial Sequence
  Description of Artificial Sequence: Synthetic coding sequence
atggagagcgccggcggcttcaagctgggcgagaagaagaagctgcttaagatgacaagtagaagactcgaggagagcatgggagccgttcagatgggcttggtgaatatgttcaagggattccaaagtaaagttttgcccccactgagtcccaaggtcgtcactgaggaggaggtcaatagaatgctgacaccatcagaatttctcaaggaaatgtcgctcacaacagaacaacgccttgcaaaaaccaggctgatgtgccggcctcagatcatcgaactcttggacatgggagagacaacccaccagaagttttcaggtatagatctggatcaggcgctgtttcagccatttccatctgaaatcatcttccagaattataccccatgtgaagtttatgaagtgcccttgattctgcggaacaacgataaaatccccaggctggtgaaggtcgtcgaagaatcaagcccctattttaaggtgataagccccaaggacattgggcacaaggtcgcgcccggggtgccgtccatattccgaatactgtttacacccgaggagaataaggactacgcccacacgctcacatgcgtgacggagagggaaaagtttattgtacccataaaggcccgcggcgcacgggcaatactggatttccctgacaagctgaatttcagtacttgtcctgtgaagtatagtacacaaaaaattcttctggtcaggaacatcgggaataaaaatgcggtgtttcacatcaagacatgtcggcctttttcgatagagcctgctatagggaccttaaacgtaggggagtctatgcaactggaggtagagtttgaacctcagtccgtcggagatcattcaggcaggttgatcgtgtgttatgacaccggggaaaaggtcttcgtttcactgtacggagcggccattgacatgaatatccggctggataaaaactcgctgacaattgaaaagacatatatcagcttggccaatcagcgcactatcacaatacataaccggtctaacattatcgcccattttctctggaaggtgtttgccacgcagcaggaagaagacagagaaaaatatcgggcctgcgacgaccttatcaaggaggagaaagacgaaaccgatgaattttttgaagagtgcataacagatccgctcctgcgcgagcacctgtctgtgctgtctcgtacctttgctaatcaacgcaggctggtgcaaggggactctaagctgtttttcaacaatgtgttcaccgtcgagcccctcgagggcgacgtgtggcctaattcttcagctgagattaccgtgtactttaatccgcttgaagcaaagctctaccagcagactatctactgtgacatcttaggcagggaaattcgtctccctttgaggatcaagggagaaggcatgggccctaagatccactttaactttgagctactcgacattggcaaagtgtttactggatccgcacactgttacgaggccattctgtacaacaagggatcaatagacgccttattcaatatgaccccgcccactagtgccctaggcgcttgcttcgttttttctccaaaagagggaatcattgagccaagcggagttcaggcaatccagatctcattctctagtacgatcctgggtaattttgaagaagaattcctggtcaacgtgaacgggtccccggaacccgtgaagctgaccatcaggggatgcgtgatcggaccgacctttcacttcaacgtacctgccttacacttcggcgacgtctcatttggttttccccacactcttatctgttcattgaataacacatcccttatccccatgacatataagctgagaattcccggcgatggccttggccataaatccatttcgtattgcgagcaacacgtggattataagcgcccttcttggactaaagaggagatcagttccatgaaaccaaaggagtttacaataagcccagactgcggtaccataagaccgcagggttttgccgctatccgtgtcaccttgtgtagcaataccgtacagaaatatgaattggctctggtagtagacgttgagggcattggcgaggaagttcttgccctgttgatcacagctagatgtgtagttcctgccctacatctcgtgaataccgaggtggatttcggtcactgcttcttgaaatacccttatgagaagacactgcagctggctaaccaagacgatctacccggcttttatgaggtccagccccaggtctgtgaggaagttccaacggttctttttagcagccctaccccatcgggggtgatctccccctcaagcaccattcatatcccactcgtcctggaaacacaggttacaggagaacatcgctccacagtatacatcagtatttttggctctcaggaccctcccttggtgtgccacctaaagtcggctggggaaggcccagtgatatatgtgcacccaaaccaagtggatttcgggaatatctatgttctgaaggatagttctcgcattcttaacttatgtaatcagagtttcatacccgcattctttcaggctcatatggcccacaagaaaagtttgtggaccatcgagcctaatgaaggcatggtgcctcctgagacagacgtgcagctcgctctcaccgctaatctcaacgatactctaacatttaaagactgcgttattcttgacatcgaaaattcatcaacatacagaataccagtgcaggcctctggaactggttctacgatcgtgtctgacaagccctttgctccagagcttaatttaggagcacacttccggtag

SEQ ID NO: 191087 - DNA, 15363 bp, Artificial Sequence
  Description of Artificial Sequence: Synthetic coding sequence
atgaccagccggcggctggaggagagcatgggcgccgtgcagatgggtctggtaaatatgttcaagggctttcagtcaaaagtactccccccgctgagccctaaggttgtgaccgaggaggaggtgaatagaatgttgactcctagcgaatttctgaaagagatgagcctgaccaccgagcagcgcctcgcaaaaacaaggctcatgtgtcgaccccagattatcgagctgctggacatgggagaaaccacccatcaaaaattctccggaatagatttggaccaagccctgttccagcccttcccttccgagattatctttcagaactacactccatgcgaagtgtatgaggtacccctcattctgcggaataacgacaaaataccccggttggtcaaggtggtggaggaaagcagcccgtacttcaaagttatttcccccaaggatatcgggcacaaagttgccccaggagtcccatcaatctttcgcatcttatttactcccgaggaaaacaaggattatgctcacacactgacctgtgtgaccgagagagagaagtttattgtgccgataaaagctaggggggccagggcaatcttagacttcccagataaactcaatttcagtacgtgtcctgtgaaatattcaacccaaaagatactactcgtgcgcaacattggaaataagaacgccgtgttccatatcaagacatgccgtcctttcagcatcgaacccgctattggcacattgaacgtcggtgaatccatgcagctggaggtcgaattcgaacctcagtcggtgggcgatcatagcggtcgtttgatcgtctgttacgataccggggagaaagtctttgtatcactctatggtgcagccattgatatgaatatcagattggataaaaacagcctgacaattgaaaagacctacatctcgttggccaaccaacgcactatcactatccacaaccgctccaacatcatagcacacttcctgtggaaggtattcgccacccagcaagaagaagatagagagaaataccgggcctgtgacgatcttataaaagaggaaaaggacgaaactgatgagttcttcgaggagtgtattacagacccattactgcgggagcacctgagcgtgttaagccgcacatttgctaatcagagaagactggtccaaggtgacagtaaacttttcttcaacaatgtcttcacagtggaacctctcgagggagatgtgtggcctaactcttctgccgaaatcacagtttattttaatcctctggaggcaaaactttatcagcagaccatatactgtgacatcttgggaagagaaatcagactgccactgagaattaaaggagaaggcatgggccctaagattcacttcaattttgaactgttggacatcggcaaggtgttcacagggtccgcgcattgttatgaagcaatcctgtataacaaggggtctattgacgcgctcttcaatatgacccctcctacatcggctctgggcgcctgctttgtgttttccccaaaggagggaatcattgaaccttccggagtacaggccattcagatttctttcagtagcactatactcgggaacttcgaggaagagttcctggttaatgtaaacgggtcgcccgagccagtgaagctcacgattagaggatgcgtcataggccctacgtttcactttaacgtgcccgccctgcactttggagatgtcagctttggattcccccataccctgatctgtagcctcaataacacttcactcatcccaatgacatacaaactaaggatccccggcgacgggctaggccacaagtccatctcatactgtgaacagcatgtggactacaagaggccatcttggacaaaggaggaaatcagctctatgaagccaaaggagtttacaattagcccagactgcgggactatcaggcctcagggctttgccgctataagggttaccctgtgttccaatactgtccaaaaatatgagctggccctggtggttgatgttgaaggtattggagaagaagttctggcgctcttaatcactgcgcgctgtgttgtccctgctctgcacctggtgaacacagaggtggacttcggccattgtttcctcaagtatccatatgagaagaccctgcagcttgccaatcaggatgacctcccgggcttttacgaagtgcagcctcaggtctgtgaggaagtgcctacggtgctgttctcctcaccaactcccagcggagtgatctccccctctagcactattcacatacccttggtgctggagacacaggtcactggcgaacatcgttctactgtttatatcagtatattcggatctcaggacccccctctggtctgtcatcttaagtccgcaggagaagggccagtcatctatgtgcacccgaatcaggtagatttcggtaatatctacgtgctgaaagattccagtcgaattctgaatctgtgtaatcagtcttttattcctgcattcttccaggctcatatggctcataaaaaaagcctctggaccatagagccaaatgagggtatggtgccgcccgagaccgatgtacagctggccttgacagccaacttaaacgatacactgacgttcaaggattgtgtgatcttagatattgagaattcatctacttacaggatcccggttcaggcctcgggaacaggatccacgattgtgagtgataagccattcgcacccgagctgaatctgggcgcccatttttctctggacacacattactaccatttcaagcttatcaacaagggccggaggattcagcaactgttttggatgaacgactcttttcgcccacaggcaaaattgagtaagaagggacgggtgaagaaaggtcatgctcatgtgcagccccagccctcaggaagtcaggagccacgagacccacagtctccagtcttccacctccatcccgcctctatggaactgtacccagggcaggccatcgatgtcatcctggagggatacagcgcgacccctcgtattgtgaaggagaagcttgtgtgccacgctatcatcggtgctcagaaggggaagtctctcgttatggctgtgaacatcacctgtgagtttgtggccccgttaatacagttgtcaactaagcagctgatatatcgcctggagaaaaagcctaatagtatccttaaacctgactaccaaccgttggccattaaaaatatcagtacacttccagtcaatttattgctgtcaacttcaggccccttttttatttgcgaaaccgacaaaagcttgttacccgccacacccgagcctatcaaactggagattgatgaagaaaaaaacctcttgatcaagtttgacccctcgtatagaaacgacttgaataactgggtagccgaggagattctggctatcaaatacgtggagcacccccagatcgactctctcgacctccgaggcgaggtacactacccaaacctcagcttcgagaccaaggaattggactttggatgcatcctgaatgatacggaactgattagatacgtcaccatcactaactgctcaccacttgtggtgaagttccggtggttctttttggtgaatgatgaggagaatcaaatccgattcgtgaccttgcccaagaagccgtacagcgcccccgtgagtcagatggagtccatccctgccactagtgaggctgcttctcctcctgctattctagttactgttgaaagcccggaaatggacctcaatgacttcgtcaagaccgtcttggtggatgaggacgcaagacccgaagaaaaggaactcaggaagacaaaggcctcaagtgtgatttcagacgtgcgatgtccattccacggagaagagcggatctacagtagtcagtctcaggtcgaggatcaggagagcctgcagacctgtgaacaaaatgagatgttgtccataggcatagaagaagtctttgatattttgccactgttcggcgtgcttcaaccgcattcaagtcaccagatcagcttcactttttatggacacgccaacattatcgcccaggccaaagccctgtgtgaagtggaagaaggaccaacttatgaaatcacgctgaaaggcgaagcctccctggtcaattactcctttgatactaaggacattcactatggactccaactgtttgatcacgtgacggagcgagaaataacccttaccaatatggggaaagtcggctttgaattcaaagtgcttacagatcatcagtccagtcctgataacctactgcccggcgtgcctctcatcctgcccgtgagtggctttattagttctcaccaggaacaagtgctgaaggtgtactacctccccggggttcccgaggttttcaagcgttcatttcagatacagatcgcacatctcgatccagaaaacatcacattaagcggcgagggcattttccctcagatctgcctggacctgccccgtaatttgacagctaatgagaagtatgagatgttcctgaatcaggccagaaagaataccgataaggagtataacaagtgtgagatgctggatcattttgacatcattacggaagaggtgccagaggacgaacccgcagaggtttccgcccacctccagatggaagtggagagactgatcgtgcaatcttatgtgctagaacaccaaaaaactacgacccccgaccctatggacgatccatgtttctcacaccgatccagacggaaacttgcgaagattcaactcccagagtacattcttgacttcgggtacattatcctgggcgaggtcaggacccacattatcaagatcatcaatacgtcccactttccagtgagctttcatgccgataagcgggtgctgcacgaaaccggcttctcgacagagcttgatcgcgtcaaaaatctaccccactgcgaaaccgaaatcttcgaagttcgcttcgacccccagggcgccaatttgcctgtaggatccaaggaggttatcctgcctatcaaagtcgtcggagggcccacagtgcacatctgtctgcaggccaaggtgacaatcccaaccatgacattaagcagagggaaagttgatttcgccactattcaatgtggacaatgtctcgtagaaactattcagctgagcaatcatcttcaggtcccctgcgaatggtttgtgcagtctcagaaacccgtggacaaactcgagaaacatatgcccaagtaccttcggcagaaactcagagctgaacttaaacctaagacgcgaattttcgaaattcagcccatctcaggggtcctggacccgggcgaaaaatcaaacgttcaggtcaaattcatgccaaaggaagagaaattctattctcagacactggtgttccagattgcccagtcagcgcagaagctcacccttctggctagagggcaaggcctcgagccccggcttgagttctctccttcagtgctagatcttggtccattattgctgtgtgccccaggcgacgaagccgaagtcattgtgaaaaacccttgtaattttccaatagaattttactccttagagttcgaccagcaatacttaatcgaggagaagatccttcggaagctcaaaggttatgacagttacaacaccctgttactgcctcccagaaatcctggggagaagctgcccccagagctgtacgaatacttcaaggagattaaaaagagcaaagaggaacagatgcgagccaagtacctggaaaacctcgcccaggaaaatgaagaggaagatataacttcttctgatcagggcacatccaattcaacaaaacggacctctctgtctcgtgggatctcagtcacctcgaatctagaagagtggcacgccctgctcgtcgagagcaagacctatctggaagaagaggaggacgaggagtcacttgaaaagattattttccaaaccgataaattgcagtctatagacagtcactccatggaggaagttggcgaggtggaaaacaatcctgtcagcaaagcaatcgcacgtcatcttggcattgacattagtgcagaggggcggctggccaaaaaccgcaagggaattgctatcattattcatgggactccactttctggaaagagtgccaatgcagtgagcgtggctaagtattataatgcagcttgtctgtccattgactcaatcgtgctcgaagccgtcgccaacagcaataatattcccggaatccgggcccgagaactttgtattagagcggctattgagcagagcgtcaaggagggggaggaagccgcgcaggaggcagcagtcggtcaaaacgtgatcggacagggtcggctctctacggacacgctcgggaagctggcttctgaaatgaccttagtggcgcccgagatcaagcccggaaaatctgttaggggatctgtggttattacaaagagcaaggccgatagccatggaagtggttcgcagaagcagcatcattctcaccaatctgagactcctcaaatttcctcctctccgctccctcccggcccaattcaccgttggctgagcgtgagccctagcgtcggcggagagacaggtttaatgtcttgtgtcctgcctgacgaactgttggtccagatccttgccgaacggatccagctgtccgactgctacagaggagtggtgtttgacgggttagatacattgttcgcacaaaacgcagcagccgctctcctctgccttttgaaggctattggctctagggagcacatttacatcttaaatatggcacaagactatgctgccatgaaggcccaggagaaggctaagaaggaacaggaggagcgtaagcacaagggcgcgttagaaaaagaaaaagagagacttcagaacatggatgaggaagagtatgacgctctgacggaagaggagaaattaacgtttgatcgcgggatccagcaggccctgcgtgaacgaaaaaagcgggagcaggagaggctagctaaagagatgcaagagaaaaagctgcagcaggaactcgagcgtcagaaggaagaggatgagctgaagagaagagtcaagaaaggaaagcaggggccaatcaaagaagagccccccatgaaaaaatctcaggctgccaataagcaagtgccacctttgacaaaggtggacgtgaaaatggagaccattgagcgtaagatcagcgtgagagagcagactatgtctgagaaggaagaattaaacaagaagaagcggaatatgggcgatgtgtccatgcatgggctgcccctggttcaggaccaggaggacagcgaaggtgacaactcaaaggaccctgataagcagctggccccaaagttcaagacctacgagcttactcttaaggatgtgcagaacatcttaatgtactgggatcggaaacagggagtgcaactcccacctgctggcatggaggaagccccacatgaacccgacgaccagagacaagtgcctctcggtgggcggagagggaggaaggaccgcgagagggagcggctggaaaaagaacgaaccgagaaagaacggctcgagagggagaaagctgagcgtgagaggctggagaagcttcgtgccctcgaggaaaggtcagactgggagggggagggtgaagaggatcacgagggaaagaaagaaaaggacctgggagtgccattcctagacattcagacccccgacttcgagggcctgtcctggaaacaggccctggaaagtgacaagttaccaaaaggggaacagattcttgacatcctaggactgggagctagcggcccccctattccccctccggcattgttctccatcgtgtcttatcctgtgaaaaggcccccgctgaccatgacagatgatctagaacactttgtcttcgtgatacccccaagtgaagatatctccctggacgagaagaaggagatggaaatcgaaagcgattttcttgccaccacaaatactaccaaagcccaggaagaacagacgagctcctctaaagggggcaaacaaaaaatgaaggagaagatcgatcaagtgttcgagattcagaaggacaagcgccacatggctctgaacaggaaagtactcagcggtgaacctgcaggcaccatctctcagttgtctgatacagacctagataattttaatgggcagcatagccaggagaaatttacccggctgaaccactttagatggattgtgcctgctaacggtgaagtcacgctgcaggtccatttcagcagcgatgagtttggtaattttgatcagacattcaactttgagatcttaggaacatgctgtcagtatcaactgtactgcaggggcatttgcacatacccatacatttgccaggatcccaaagtggtctttccccagagaaagatggatatgaaaacgaatgaggtaatttttaagaagtatgtgatgagcactgagacttattattttggaccgctactatgcgggaagtcccgcgataaatacaagtcttctctgtttcctggcaacatggagactttgacaattctgaacacatctttgatggtcgtcgaggcgtcattctacttccaaaacgacgtcaaggcaaatacatattttttggaacccaacacaatggtgttaaaaccaaatgagaagcagattcttaatgtgtgggcctatccaacatctgtaggcgtatttgaagattctattgtgtgctgcattaacgataaccctgaacctgccatttttcagcttagttgtcaaggcattcgtcccgagctcgagttggagcctcgtcagctgcactttgatcggctgctacttcaccgacaggagtctagagttgtgctccttcgcaatgtcacacttcttcccgtggcttggaggattacgtcactggagcatctgggcgatgattttacagtttcacttatgcagggaaccatccccccggaagccgaatacggtctacatttatactttcagccaactaaacctgttaacatcaaaaaagctattcgccttgaggtcctggacgctgagaacctgctcggagtggtccaaatcgaaaacataatggtgttcgcagaagcttacgacattgcccttgacatcacttttcctaagggcgccgaaggggggcttgatttcggcatcgtgagggtgacagaagaggcaaaacagcccctccaattgaagaatcgcggtaaatacgagattgctttctcattcagcgtggattccgttggcattagcactcccaatattaattctatgatttcagtgcaacctaagaagggcagcctcacccccactgaaaagccaacaaacgttcaggtcttcttccacgctaaaaaggaggttaaaattgagcaccagccagtgcttcgctgccagattattgaacctaatatatcagaaggaggcgagatcattgccagcattccgataaaatttagtgccaacgctgtctactcaaaatataacataacgccaagctcagtgataaacttcggagccctcatatgtgggaccagaaagtcaacaacttttacaatcgaaaaccagggggtcacagatttcaagtttgccctttacaagctgaccggcgagagcccaattcaccagaagaaggcagcatcgcacgtgcgccatgctaggtcccgcgaatccgagagcttctacaagacaggcagctctcgcgccgcaaagttctctgataccatccagaaagaagtcaccacaaccgggcaggcccggtttgcacatggcatgtttaccgtttatccagggttcgggagcatcccttccggcggccagcaggtgattaatgtggattgtgtggccgatgcaatgggaaagtgcgaggagtttattgctatcgatatttccggacgcgatcccgccgtccatccagccggcattctgtacactctgctcgccgaggcttgtctgcccgcttttgtgaccgagaacaatgccctaatttttgaggagcaccagatctgcaccagtgctaacttacatcacattttgcagaccattgagagcgggggcctgtttgtcgaggacgaaaataaattcattttttgcaatgtgttggtgggccgacaggctaaagctaggttcaaaatcagcaatgtgggcaagatcacctgtgatgtgaacatagttgtgaggcccatatctaacaagccctttgccagaattgtggatatctttgaggtggagccctccaaaatgtgcatcgccagccacagccacgctttcgccactgtttcatttaccccacaaataatgcagaactatcaatgtattttcgaagcaactctggatgggctcccttcaactcttgccaaatcccgaggccttgtcttcgacatcgcgggtgaaggaaacttgccgcgggtcaccgtagtgagacccgtcctgcataatcagtatggaaacccactgctactttttaagcgtctgctgctcggtcactcggagaagctgcctctgattcttaagaacaatggagtactgccagctcagcttcatgttgacctgcaggatgagcttggggtattttccctgaaaggacgcccgaccactgcatatatttacataacagaggaaaacaagccacatgtgaaagccaagaaggcccataccgcatccctggtggtgtcaccaggagacacagccgagttcgacgttgttttccactcacagaaggtgggcagaatgcgggggattattcatttatcagtgattaacaaccaatacgaggagacgagtattcatatggtcggagagggctatgaggacgatatcaccctggacaacatccacggactggtggcacctaccagccaggaagacatttctatctcagagttcaccgaaattatcgaggacaatgacatggaggaccttgtcgccgcagcgctggttgatcacatccagttcggagactgtcatattggccacagctataatgccagctttacggtcaccaaccatagtcaggttaacctcatccgcttcgaatggccagtctccgctaccatcgcttttagtccccagatgggccacttgcaccccggctgtgccaaggatattgtcgttacaatgaaatcagatgtgccgattaatctgaaaaatatgagaatccgttgcaagctgtctaggattatgttccaactgccagccgatcaggtcccagactgggacgacaggatgcacaccgtgaagtgggtcgacgttcccaggaacatgcctggtacatttaccaccaaacggaaagtcatcgagactgatcctgaaccggcacactcagtgctggaagaaaactaccaggaactccagctgcagatttctgctaatgtagactttgcatcctatcactgccaagcacgggacgtccgatttaaggagacactagtttatcagaccagggtgttcgagtttgacgtcatcaacagcggaagggtccagctggaattttcctgggtttccgaagatacatccaaagccgtgagtttcgctaagcccgaccatcaagggtcagctcagaaagaccagctgtctcagggtaccatgcacaccggaagtaccttagatagcaccatggatcattgggctgagggatcaccacagccattctcagtagaaccatcgtctggtatagtacccgtaggcaagattcagaagtttaaggtgaagttttccccactcgacatcggggattttgagagcaacctgttttgtcagatccctaacctgccccccggggagcagggcccggtgttggtcgctaagggccgttccacgctgcccatctgccactttgatcttaaggattctgattacatcagtgggcatcagcgaaaccccgaattaagaggatcctctggcggtgcgctggaccctaacaccagggttatcgaatttacaacggtcggcattggcggcaaaaaccttagaacgttcactattctcaatcccacgaattccacatattcgttttgttggatctctgaagagattgagagcctgcaaaaccctgcagcttttacctgccttaccgagaagggttttatacatcccgagaaaaaagcggaaatcgtcttccagttcaccccgttccacctggggataaccgagagctcttggacatttttgattcccgaacacaacattaccgtcccattcctgcttgtgggcaaaacaacagaacccctcatctctttgaacaaaagccatcttaatttttctagtctcctgatcggcagggaagccagagaaaccgtccagataatcaacaaggaggaacagggttttgatttcagttttcaagataattcacgctactccgagggtttcagtaattcgctattggtgtgtccaatggaagggtggatcccccccttgtcacgctttccaattgatattttctttaccccaaaacaggagggtgacgtcaacttcaatctaatttgcaacgtggaaaaaaaggtgcatcctgtgacactgaacgtgaaagcagaggggtataccatgaacgtcgagataaagtgtaaggataggaccgggtcaataacattgttgacaccaaatcagaccaacatcattaatttctatgaagtggaacttaacgaatgcgtacagtgcgagttcaatttcatcaacactggaaaattcactttctccttccaggcacagctttgcggctccaaaaccctgttgcagtacctggaattcagcccgatcgatagcacagtcgatgtaggacagagtgtgcacgctactctgagtttccagccgctgaagaagtgcgtgctcacagacctagagttgattatcaagatcagtcacgggccgactttcatgtgcaacattagcgggtgcgcagtttcacccgcaatccacttttccttcacctcctataactttggaacttgctttatttatcaggccggaatgccaccttacaagcagaccttagtgattactaacaaggaggagaccccaatgtccatcgattgcctgtataccaacaccacccatttggaggttaactcccgggtggatgtcgtgaagcccggaaatactctggaaatccctatcacattctaccctcgggaatccattaattatcaggagcttattcctttcgagattaatggcctttcccaacagaccgtggaaatcaaaggcaaaggaacgaaaatgaaaatcctagtgctggatcctgctaacagaatagtaaagctgggggccgttcttcccgggcaggttgtcaagcgcacagtctccatcatgaacaactctctggctcagctaacctttaaccagtccattttgtttaccataccagagttgcaagagccaaaggttctcaccctggctccttttcacaatatcaccctaaagccaaaggaagtttgtaaattggaggttatttttgcccctaagaaacgcgtgccaccattcagcgaggaagtgttcatggagtgcatgggtctgctcaggcctttgtttcttctaagtgggtgctgtcaggccctagagatttctctggaccaggagcacattcctttcggaccggtggtgtatcaaactcaagcaactaggcgcatacttatgatgaacactggcgatgtgggagccaggtttaaatgggacatcaagaagtttgagccccacttttcaatatcccccgaggagggctatattacttccggaatggaggtctcctttgaggtgacctaccatcccacagaagtaggcaaggaatcactgtgcaagaacatcctttgctacatccagggcggtagccctctcagcctgaccctctcaggcgtttgtgtggggcctccggccgtaaaggaggttgtgaacttcacctgtcaggttcgctcaaaacacacccaaacgatcttactgtcgaatcgcaccaaccagacctggaatcttcaccccattttcgagggtgagcactgggagggaccagagttcatcacccttgaggcacatcaacagaacaaaccatatgaaattacctaccggcctcgtacgatgaacctggagaatcgaaaacaccaaggaactctcttttttccccttccagacggtaccgggtggctgtatgctctccatggaacatctgaattaccaaaggccgtggcgaatatctatagagaggtcccctgtaagactccctatacagaattgttaccaatcaccaattggttaaacaagccacaacgtttccgagtaatcgtagagatacttaaacctgaaaagccagatctctcaataaccatgaaagggttggattatatcgatgtcttgtcagggagtaagaaggactacaaattgaattttttttcacacaaagaaggtacttatgctgctaaggtgatttttcgtaacgaggtcactaacgagtttctgtactacaacgtgtcatttcgtgtgatacccagcggtatcattaaaaccatagaaatggtgacccccgtgcgacaggtcgcatccgccagcattaagctggagaatcccttgccatattcggtgactttttccaccgaatgcagaatgcccgatatcgccctcccttctcagtttgtagttcccgctaacagcgagggcacctttagcttcgagttccaaccgctgaaagctggcgaaaccttcggacgtctgactttgcataacactgacctgggctattaccagtacgaactgtatctgaaggccacgcccgcattgcccgaaaaaccagttcactttcaaacagtcctggggagctcacagattatccttgtgaagttcattaattatacaaggcagcgtaccgaatactactgccgaacagattgcaccgatttccacgcagagaaactgataaacgccgctcccgggggccagggaggcacggaggcgtctgtggaagtgctgttcgaaccttcgcacctgggcgagaccaagggcatcctaatcttgtctagcctggccggaggggagtacattatccccctgtttggtatggcgctaccacccaaaccacagggacccttctctattcgagccggctactctatcatcattccttttaaaaacgtcttctatcacatggtgacattcagcatcatagtggataacccagccttcacaatcagagctggtgagagcgtccggcccaagaaaattaataatatcaccgtgtcttttgagggtaacccaagtggatctaaaacacctatcaccaccaagttgactgtttcctgtccccctggtgagggaagcgaaacgggagtgaaatgggtgtattatcttaagggaataaccctttag

SEQ ID NO: 191088 - DNA, 3054 bp, Artificial Sequence
  Description of Artificial Sequence: Synthetic coding sequence
atgaccagccggcggctggaggagagcatgggcgccgtgcagatgggcttagttaatatgtttaaaggttttcagtcaaaggtgcttccccccctgtcacccaaggtggtgaccgaggaagaggtgaaccggatgttgacaccatctgaatttctgaaagagatgagtctcaccaccgagcagcggctggcgaagactcggttaatgtgccggccccaaataatcgagctgcttgacatgggggagacaacccaccaaaagttctctggaatagacctggatcaggcattatttcaaccttttccctctgagatcatttttcagaattataccccctgtgaggtgtacgaagtccctctaatcctcagaaataatgacaagattccaaggctcgtgaaggtagtggaggagagtagtccctatttcaaggtcataagtccaaaagatattggccacaaagtggcacctggagtaccctctatttttcggatattatttactcccgaggaaaacaaggattacgcccacacacttacatgtgttactgaacgggaaaaattcatcgtgccaatcaaggcccgaggtgccagagcaatcctggacttcccggacaagctgaacttctccacatgcccagtgaaatactcaacccagaagatcctgctggtcagaaacataggcaacaagaatgctgtgttccacataaagacatgcaggccattctcaattgaacccgccatcggcaccttaaacgttggcgaatccatgcagttggaagtggagttcgaaccacagtctgtcggagaccactcaggcagactgatcgtctgttacgataccggcgaaaaggtgttcgtatccctctatggggccgccatcgacatgaatatcagactggataaaaacagtctaacaatagagaaaacatacattagtctcgccaatcagcgcacaatcaccatccacaatcggagcaacatcattgctcactttctatggaaggtgttcgccactcagcaggaagaagatcgggaaaagtatcgggcctgcgatgatctgatcaaagaggaaaaagacgaaactgatgaattcttcgaagagtgtataactgaccctctgcttcgggaacacctttctgtactgtcaagaacattcgcgaaccagcgacggcttgtgcagggcgacagcaagctcttctttaacaacgtgtttacagtagaaccccttgagggggatgtctggccaaactccagtgccgagatcacagtctactttaatcctttagaggctaagctctaccaacagactatatattgcgatatactcggaagagaaattaggctaccgcttaggattaaaggagagggaatggggcctaaaatccatttcaacttcgaacttctagatatcggtaaagttttcactgggagcgctcactgctacgaagcaattctctataacaaaggcagtattgatgctctgttcaatatgacccctcccacctcagctctgggcgcttgttttgtgtttagccctaaggaaggtattatcgagcccagcggggtccaagccatacagattagctttagtagtaccatcctcggcaattttgaggaggagtttctggtgaacgtgaacgggagtcctgagcccgtcaagctcactatacgcggctgtgtgattggaccaacattccacttcaacgtacctgccctgcactttggcgacgtctccttcggttttccccatactctgatctgctcactgaacaacacatccctgattccaatgacttataagttgaggatccctggcgatggactgggccataagtccatcagctactgcgagcagcatgtcgactacaaaagaccttcttggaccaaggaggagatctcttcaatgaagccaaaagagttcactatttctcccgactgcgggaccatacgccctcaagggttcgctgccatacgtgtgactctgtgttcgaacacagtccagaagtacgaacttgcattggtggttgacgtcgagggcatcggcgaggaggtccttgcactcctgatcaccgcgcgatgcgtcgtgccagcactacacctggtgaacactgaagtcgactttgggcactgcttcctgaaatacccttacgagaaaacccttcagttggccaaccaggatgacctgcccggattctatgaagtgcaacctcaggtgtgcgaggaagtccccaccgtgctcttctcctctccaacaccctctggcgtcatctctccaagcagtaccattcatatcccactagtactggagacgcaagttacaggcgaacacaggagcaccgtgtatatcagcatttttgggtctcaggaccctcccctcgtgtgccacctgaagagcgctggcgagggacctgttatctatgtgcatcccaaccaggtcgatttcggaaacatatatgtgctgaaggacagctcccggatcttgaacttatgcaatcagagctttatccctgcattcttccaggcccatatggcgcataagaagagtctgtggacaatcgaacccaatgaggggatggtacctccggaaaccgacgtgcaactcgcactcacggctaaccttaacgacacacttactttcaaagactgtgttatacttgacatagagaatagctcaacgtatcggatccccgttcaagccagtggaactggcagcacaatcgtttcagacaaaccattcgccccagagctgaatttaggagctcacttttccttggacacccactactaccatttcaagttaatcaacaagggtcgccgaattcagcagttgttttggatgaacgactcttttaggcctcaggcaaaattatctaaaaaagggcgcgtgaagaaggggcacgctcacgtccagcctcagcccagtgggagtcaggaaccacgggatccccaatcaccagtgtttcatctccaccccgcctccatggagttatacccaggccaagcaattgacgtcatcctcgagggctatagtgcaaccccccgggtacgcggctag

SEQ ID NO: 191089 - DNA, 2223 bp, Artificial Sequence
  Description of Artificial Sequence: Synthetic coding sequence
atgaccagccggcggctggaggagagcatgggcgccgtgcagatgggccttgtgaacatgttcaaaggctttcaaagtaaggtgctgccgccgctcagccccaaggttgtgacagaagaggaagtgaacaggatgctcactccctctgaatttctcaaagagatgagccttacaacagagcagagactcgccaaaacacgattgatgtgtcggccacaaattatagagcttcttgatatgggcgagactacccatcagaaattcagtggtatcgaccttgaccaggccctgttccagcccttcccttctgagatcatcttccagaattatacaccctgcgaggtgtatgaggtccccctcatcttacgcaataatgacaaaatccctcgattggtgaaggtggtggaggagtcttccccgtattttaaggtgatttctcccaaggacatcggtcataaggtggcaccaggcgtcccatctatttttcgaatcctatttacacccgaggaaaataaagattacgcccatacactgacatgcgtgaccgaacgggaaaagtttatagtgccaattaaagccagaggtgccagagctatcctcgattttcccgataaacttaacttcagcacttgccccgtaaagtattctacacagaagatattgctggtgcggaacattggtaacaagaatgctgtcttccacataaaaacctgtcgccctttcagcatcgagcccgccattggaacacttaacgttggagaaagcatgcagttggaagtcgaattcgagccacagagcgtgggggaccacagcggccgacttatcgtatgttacgatactggagagaaggtttttgtaagcttgtacggggctgccatcgacatgaacattcgattggataaaaattcattgaccatcgagaagacatatatttctctcgcaaatcagcgtacaatcaccattcataatcgcagcaatataatcgcccactttctctggaaagtgtttgcgacacagcaggaggaggatcgggaaaaatatagagcctgtgacgacctaatcaaagaggagaaagatgagaccgacgagttctttgaagaatgcatcacagaccctctgttgagggaacacctatcggtcctctcaagaaccttcgcaaatcagcgcagactggtgcagggagattcaaaattgttctttaacaatgtatttaccgtggagccactggaaggtgacgtgtggccaaacagctccgccgaaattaccgtctattttaacccacttgaggcaaagctctatcaacaaaccatatattgcgacatcctgggccgcgagattcggcttccactgagaattaaaggcgaggggatgggtcctaagatacactttaatttcgaactgctggacattggaaaggtgtttacaggcagtgcccactgctacgaagcaatactttacaacaaaggatccatagatgcactgtttaacatgacccccccgaccagcgcactgggggcatgttttgtgttcagtcccaaagaaggcatcattgagccatcaggggtgcaggccatccagatatctttctcctccacaatcctgggaaacttcgaagaggagtttctggtaaatgtgaatggctctcccgagcctgtcaagttgacaatccggggatgtgttatcggaccaacgtttcactttaacgtcccggcactgcacttcggggacgtctctttcgccacacaggagctgagggatccacaggtgctcattccgtttcagcgttttccgcacactctaatctgtagtctgaataacacgtccctcatccctatgacttataagttgcgtatcccgggagatggactgggacacaagagtatttcctactgtgagcagcatgttgattataaacgcccgtcatggactaaggaagaaattagcagtatgaaacccaaagagttcactatcagccccgattgtggcaccataaggccacagggtttcgccgcgattagagtgaccctctgctcaaatacagttcagaaatacgagttagcacttgttgtggacgtcgaaggaattggcgaagaggtcctcgccctgcttattactgcgtctgcccccgagctgtgcaaccgaaaggttatgctgtctgtacttcaatggaagatccatcgcgccaagcgaagcctacccagggataccgtggccgtgacctag

SEQ ID NO: 191090 - DNA, 3645 bp, Artificial Sequence
  Description of Artificial Sequence: Synthetic coding sequence
atgaccagccggcggctggaggagagcatgggcgccgtgcagatgggattggtcaacatgttcaagggattccagtcaaaggtgttgcccccactctccccaaaggtagtgactgaagaagaggttaaccgcatgctgacaccttctgagttcctcaaagaaatgtcactgactacagagcagcgcttggctaaaactagattaatgtgcagaccacaaataatcgagctcctggacatgggcgagacaacccatcaaaagttcagcggaatcgaccttgatcaggccctgttccaaccatttcccagtgagatcattttccaaaattatacaccctgcgaagtatatgaagtgccactgattctacgcaataatgacaagatcccccggctagtaaaggtggtcgaagagagttcaccttacttcaaagtaatttctcctaaagatattggccacaaagtcgctccaggcgtgccctcaatttttagaatcctctttacccccgaggagaacaaggactacgctcacacactcacgtgcgtgaccgagcgcgagaagttcatcgttccaatcaaggctcgcggggctcgggccatattggactttcccgacaaattaaatttctccacttgtcctgtcaaatacagtacccagaagatcctgctggtccggaacattggtaacaaaaacgccgtgtttcacattaagacatgtcgaccattctcaatcgagccagccatcggaactttgaacgtcggtgagagcatgcagctcgaagtggagtttgaaccccagtcagtaggggatcattccggccggttaatagtctgttatgacactggagagaaggtctttgtgtcgttatacggagcggctatcgacatgaatatcaggttagataagaacagtctcactatcgaaaaaacgtacatcagtctggctaatcaaaggactattaccattcacaatcgcagcaacattatagcacactttctgtggaaagtgttcgcaacccagcaagaagaggaccgcgagaaataccgtgcctgtgacgatctgattaaggaggaaaaggacgagacggacgaatttttcgaggagtgcataactgacccacttctcagagagcacctgagtgtgctttcgcgtaccttcgccaatcagcggaggctggtccagggtgattcaaagcttttctttaataatgtgtttaccgtggaacccctggaaggggatgtctggcctaacagctccgctgagatcaccgtgtatttcaatcctctggaggctaagttatatcagcagacaatttattgcgacatcttaggaagggaaattagattgcccctcagaatcaaaggggagggaatgggaccaaagattcattttaattttgaacttttggatatcggaaaggtgttcactggctccgcacattgctatgaggccatactgtacaataagggctctattgatgccttattcaacatgacaccgcccaccagtgctttaggtgcctgtttcgttttctcgccaaaggagggtataattgaaccttctggagttcaggctatacagatctctttttcttccacaatccttggaaacttcgaggaggagttcctggtaaatgtaaacggcagcccggagccagttaagctaaccattcggggctgtgttatcgggccaacgtttcatttcaatgtgcccgccctacacttcggggatgtgtctttcggctttccacacaccctgatttgcagcctcaataataccagtcttatccccatgacatataaactgcgcatccctggcgacggcctgggccacaagtcaatctcctactgtgagcagcacgtagattataaaaggccttcgtggactaaggaggagatatcttccatgaaacctaaagaatttaccatttctccggattgcggaacgattagaccccagggttttgcagccattagagtgacactgtgctccaatacagtccagaagtacgaactggctctggtggtggacgtcgagggtattggcgaggaagtgctggcactacttataaccgcacggtgtgtagtgcccgccctccacctcgtaaacacagaggttgacttcgggcactgttttctgaaatatccatatgagaagacattgcagttagcaaatcaggatgaccttcctggcttttacgaagtccagccacaggtgtgcgaggaggtacctacagttctattttcaagtcccaccccgagcggcgtgatcagcccatcctcgaccatccacattccccttgtgctggaaacccaagtgactggtgagcatagatcgacggtgtacattagcattttcggaagccaggaccctcctctggtgtgccacctcaaaagtgccggggaaggtccagtcatatatgtgcatcctaatcaagtggactttggcaacatctatgtcctgaaagactcttcgagaattttgaatctttgcaatcagtcattcataccggcttttttccaagctcatatggcacataaaaagtcattgtggacaattgagcccaatgaggggatggtgcctcccgagaccgacgtccaactagccttgacagccaatctgaatgacaccctgacattcaaggactgcgttatcctggacatcgaaaacagcagtacatacaggatccctgtgcaagcaagcggcactggcagtacaattgtttccgacaaaccatttgcaccagaactgaacttgggcgcacacttctcactcgacacgcactactatcacttcaagctgatcaataagggtagacgaatccagcagcttttctggatgaatgattcctttcgtccccaagccaaactcagcaagaagggcagggtcaaaaagggccacgcacacgtgcagcctcagcctagcgggtcccaggagccccgcgaccctcagagccctgtgtttcacctgcacccggcaagcatggagctttatccaggacaggcgatcgacgtcattcttgagggctactcagcgacccccagaaaaccgaattctatcctgaagcctgactaccagcctcttgcaattaagaatatttccacactgcccgttaacctgctcctgagcacttcaggtccgttttttatatgtgaaaccgataagagcctccttcccgcaaccccagaaccgataaagctggaaatcgatgaggaaaaaaacctcctgatcaaatttgatcccagctacaggaacgatctgaataactgggttgctgaagagatcttggcgataaagtacgtcgagcaccctcaaatagatagtctggatcttagaggcgaagtgcactacccaaacctttcattcgaaacaaaggaattggattttggctgcatcctgaatgataccgagcttatccgctacgttaccattacaaactgctcaccccttgtcgttaagttcagatggttcttcctggtgaacgatgaagagaaccaaatacgctttgtcacacttcctaagaagccatactccgccccagtatctcagatggaatccataccagctacttccgaggccgcctctcctccagcgatcctggtaaccgtggagtcaccagaaatggacctaaacgatttcgtgaagtag

SEQ ID NO: 191091 - DNA, 3054 bp, Artificial Sequence
  Description of Artificial Sequence: Synthetic coding sequence
atgaccagccggcggctggaggagagcatgggcgccgtgcagatggggctagtaaacatgtttaaggggttccagagtaaagtattaccacccctatccccgaaagtggttacagaagaagaagtcaacaggatgctgacaccatccgaatttttgaaggaaatgagccttaccacagaacagcgactcgctaagacaaggctcatgtgtcggccacagatcatcgagctcctggacatgggggaaacaacacaccagaagttttccggtatagacttagatcaagcgttgttccaacccttcccctctgaaatcatctttcagaattacactccctgtgaggtgtatgaagttcctctaatcttgagaaacaatgacaagattccacgattagtaaaggtggtggaagaaagctcaccctatttcaaggttatttcgcctaaggacatcggtcataaggtggccccaggcgtgccttccattttcagaatcctttttacaccggaggagaacaaagactatgcccatacactcacatgcgtgacagaacgggagaagtttatagttcccatcaaggctcggggggcccgcgccatcctcgatttccctgacaaactgaatttctcaacatgtcccgtgaagtacagcacccagaaaattctcttggtgaggaatatcggtaacaagaatgcagtttttcatatcaaaacctgtcgacctttcagtatcgaacctgcaataggaactcttaacgtcggggagtcgatgcagcttgaggtggaattcgagccgcaatcggtcggtgaccattctggcagacttatagtgtgctacgacaccggggaaaaagttttcgtgtctttgtatggggcggcaatcgatatgaatatcagattggataagaattcgcttacaatcgagaaaacttatataagtcttgccaaccaacgaaccatcacaattcataaccgaagcaatattatcgcccactttctttggaaggtcttcgccacgcagcaggaagaggatcgcgaaaagtaccgtgcttgcgatgatctcattaaagaggaaaaagacgagaccgatgagttcttcgaagagtgcatcacggaccctctgctaagggaacatctgtccgtgcttagtcgaacgttcgctaaccagcgcaggctggtgcaaggggattctaaactctttttcaacaatgttttcactgtagagccacttgaaggggacgtgtggccaaacagcagcgctgagataacggtgtatttcaacccgttggaagctaaactctatcagcaaaccatctattgtgacattctcggccgcgaaatcaggcttccactgcgcatcaaaggagaggggatggggcctaaaatccacttcaacttcgaactcctggacatcggaaaagtattcacaggctcggcacactgctacgaagcgatcttgtacaataaagggtccattgacgccctctttaacatgactcctcccactagtgctctcggagcctgtttcgtgttctctcccaaggaggggattattgaacccagtggggtacaagcaatccaaatttcctttagttcgactatactggggaacttcgaagaagagtttctggtgaacgtcaacggaagcccagaacctgtgaaactgactatcagaggctgtgtcattggacccacctttcatttcaatgtgcctgctttgcactttggcgacgtcagctttggatttccccacacactcatttgttcgctgaacaatacctctctcatcccaatgacttataagctccggatccccggagatggactaggtcacaagtccatttcttattgtgagcaacacgttgattacaaaaggccctcttggaccaaagaggagattagtagtatgaaacccaaggagttcacaatcagcccagactgcggaactattcgaccccagggatttgctgctattagagtgaccctctgcagcaacactgtgcagaaatacgagctcgctctcgtggtggacgttgaaggcataggagaagaggttctggcactgcttatcaccgcgcgttgcgtggtgccggccctgcatctggtcaatactgaagtcgatttcgggcactgcttcttgaagtatccttacgagaagaccttacagttagccaaccaagatgatctccccggattttatgaggttcagccgcaagtttgcgaggaggtgccaacggtgctgttctcgagccctactccaagcggcgtcattagtccaagcagtaccatccatattcctctcgtcttggaaacacaggtgaccggcgagcataggtcaactgtgtatatctccatcttcggatcccaggaccccccactagtgtgtcatctaaagtcagctggcgaaggccctgtgatctacgtgcaccctaatcaggtcgacttcggaaacatctacgtcctcaaagattctagccggatcctgaacctgtgcaatcaaagcttcatcccggctttcttccaggctcacatggcccataagaaatctctctggacaatcgaacccaacgagggtatggtccctcctgagacagacgtgcagctggcattgacagctaacctcaatgacacactcacctttaaggactgcgtcattctggacatcgagaactcctctacctatagaatccctgttcaggcatctggcaccggcagcaccatcgtgagtgacaagcccttcgctccagaactgaatctgggcgcacacttctcactggacacccactattaccatttcaagctaataaataagggcaggaggattcagcaacttttctggatgaacgattcgttccggccacaggctaaactgtccaagaaggggagggtgaagaaaggccatgcacatgtgcagcctcaaccctcaggatcgcaggagccccgggatcctcagtctccggtattccacctgcatcctgcctcgatggagctttatcctggccaagcgatcgacgtcattctagagggctattccgctaccccaagagttaggggatag

SEQ ID NO: 191092 - DNA, 822 bp, Artificial Sequence
  Description of Artificial Sequence: Synthetic coding sequence
atggccacctgggacgagaaggccgtgacccggcgggccaaggtggctcccgccgaaagaatgtccaagttcctgagacactttacggttgttggtgatgactaccacgcttggaacatcaattataaaaagtgggagaatgaggaagaagaagaggaggaggagcaaccacccccgacccccgtctcgggggaggagggaagagcagcagccccggacgtcgcccccgcacccggcccagcgccccgggcccctttggatttcaggggcatgttaaggaagctgttctcctctcaccgatttcaggttatcatcatttgtctcgtggtactggatgccctcctagtactggccgaactgatcctggacctgaagataatccaacccgataagaacaactatgccgctatggtgtttcattacatgtccataacaattctggtgtttttcatgatggaaatcatcttcaaactatttgtatttcgtctcgaatttttccatcataagtttgagattttggacgcagtagtggtagtagtcagctttatcctggatattgttctgttgtttcaagagcaccagttcgaggctcttggtctgctgattctcctgagactttggagggtggccagaatcatcaatggaatcataatttccgtgaagacgcgatctgagcgacaattgctgcggttgaaacaaatgaatgtgcaattagctgccaagatccaacatcttgaattttcatgcagtgagaaggagcaagagatcgaacgcttaaataaattgctgaggcaacacggtctgctcggggaggtgaactag

SEQ ID NO: 191093 - DNA, 822 bp, Artificial Sequence
  Description of Artificial Sequence: Synthetic coding sequence
atggccacctgggacgagaaggccgtgacccggcgggccaaggtggctcctgccgagcgaatgtctaaatttcttcgacactttaccgtggtgggtgatgattaccacgcctggaatatcaactacaagaagtgggagaacgaggaagaagaggaagaggaagagcagcccccacccaccccagtctcaggtgaggaggggcgggctgcagcccctgacgtggctcccgcccctggtcctgctcctagggcaccgctggattttcgaggcatgctgagaaaactgttctcatctcaccgctttcaagtgatcataatttgtctcgttgttcttgatgcccttcttgtgctcgcagagctgatcctggacctaaagataatccagcccgacaagaacaattacgctgcgatggtgttccactacatgtctatcacaattctggtgttttttatgatggagataattttcaaactctttgttttccgcctcgagttcttccatcacaagttcgagattctagacgccgtggttgtggtggtgagcttcatcctagacatcgtcctgctcttccaggaacaccagtttgaggcattaggcctgctgatcctgttgaggctgtggcgcgtggctaggattataaatggtatcataatttccgttaaaactaggtccgagcgtcagttgctcagactcaagcagatgaacgtgcagctcgcagccaagattcagcatttggaattctcatgctctgagaaggagcaggaaatagaaaggctgaataagctactgagacaacacggactgctcggggaagtgaactag

SEQ ID NO: 191094 - DNA, 237 bp, Artificial Sequence
  Description of Artificial Sequence: Synthetic coding sequence
atggccacctgggacgagaaggccgtgacccggcgggccaaggtggcaccagcggagaggatgtccaagttcctgaggcatttcaccgtggtgggcgacgactaccacgcctggaatatcaactacaagaaatgggaaaatgaggaggaggaggaagaagaggagcagccccctccaactcccgttagcggagaggaaggcagagctgctgcccctgatgtggctccagcaccctag

SEQ ID NO: 191095 - DNA, 900 bp, Artificial Sequence
  Description of Artificial Sequence: Synthetic coding sequence
atggaggagctgctgcccgacggccagatctgggccaacatggacccagaagaacgcatgctggccgcggctactgcgttcacgcacatttgtgccgggcaaggtgagggtgacgttaggcgcgaggcacaatcgatccaatacgacccttactctaaggcttcggtcgcccccgggaagcggccagctctgcccgttcaactgcagtatcctcacgtcgaatctaatgtcccctctgaaacggtgagtgaagcctcccagcgcctaaggaagcctgtcatgaagcggaaggtgctaaggcgtaaacctgatggagaggtgttggtgacggatgaatcgattatctccgagtccgagagtggaactgagaacgatcaggatctgtgggacctgcgtcagcgcctgatgaatgtacagtttcaggaggacaaggagtcatccttcgatgtgtcccagaagtttaaccttccacacgagtatcaggggatctcgcaggatcagctgatctgctcactgcagcgcgaaggtatgggcagccccgcatatgaacaggatctaattgtcgccagtcgacctaagtcttttatcctccccaaattggaccagcttagccgaaatcggggtaaaactgatagggtcgctcgctacttcgagtacaagagagattgggattccatacgcctgccgggtgaggaccataggaaagagttgaggtggggcgtaagggagcagatgctatgtcgtgccgagcctcaatccaaaccacagcacatctatgtcccaaataactatctggtccccaccgaaaagaaacggtctgccctccggtggggagtgaggtgtgatctagctaatggggtgattccacgcaaactgccttttccactgagtccctcttag

SEQ ID NO: 191096 - DNA, 900 bp, Artificial Sequence
  Description of Artificial Sequence: Synthetic coding sequence
atggaggagctgctgcccgacggccagatctgggccaacatggaccccgaagaaagaatgctggcagctgccacagcatttacacacatctgtgccggccagggcgaaggcgacgtgagacgggaggcccagtcaattcaatacgacccttactccaaggcctccgtcgcccctggaaagaggcccgcgttgcccgtacagctgcagtacccgcatgtggagagcaatgtaccttctgaaacagtgtccgaggcttctcagcggttgcggaagcccgttatgaaaagaaaagtgttgagaagaaagcccgatggagaggttttagtgacggatgagagtatcatatccgagagtgagtccggcactgagaatgaccaggacttatgggatctgagacagcgcttgatgaacgtgcagtttcaggaagacaaagaaagctctttcgacgtcagtcagaagttcaatctgcctcacgaataccagggaatttcacaggatcagttgatctgttccctgcagcgcgaagggatgggtagcccagcctacgagcaggaccttatcgtcgccagccgccccaagtcattcattctccctaagctcgaccagctgtcgcggaacagggggaaaaccgacagggttgcgaggtacttcgagtacaaacgtgactgggactctataagactgcctggtgaagaccacagaaaagagcttaggtggggcgtaagggagcagatgttatgccgagccgaaccccaaagcaagcctcagcacatctacgttcctaacaactacctggttcccacggaaaaaaaaagatctgcactgagatggggagtccgctgtgatctggccaacggggttatcccacggaagcttccatttccactctcaccatcatag

SEQ ID NO: 191097 - DNA, 900 bp, Artificial Sequence
  Description of Artificial Sequence: Synthetic coding sequence
atggaggagctgctgcccgacggccagatctgggccaacatggacccggaagagcggatgctggccgcggctaccgctttcacccatatctgcgccggtcagggggagggagatgtacggagagaggctcagagcattcagtacgatccgtactcaaaagcgagtgtcgcccctggtaagcgccctgctctgccagttcagctccagtacccacatgtggagtcaaatgtgccctccgaaacggtaagcgaggcatcacagagattacggaaaccggtgatgaaacggaaagtcctcaggcggaagccagacggtgaagtcctggtgaccgacgagtcaatcatctcagaatccgaatcagggaccgaaaatgatcaggacttgtgggacttacgccagcggctgatgaacgtccagtttcaggaggacaaggagtcctcttttgacgtttcacagaaatttaatcttccacacgagtaccagggcatatcccaagaccaactcatttgctctctgcagagagaagggatggggtccccagcctatgagcaggatctgattgtggcaagccgccctaagtctttcatcctgcctaagctagatcagttgagtagaaatagaggaaaaacagaccgagtagcgcggtacttcgaatacaaacgagactgggattcaatcaggttacccggagaagaccaccggaaagagctgcgctggggcgtgcgggagcagatgctgtgtcgggcagaaccccagtctaaacctcagcacatctacgtgcccaacaattacttggtacccacagagaagaaaaggtccgctttgcgctggggagtgaggtgcgatttggccaacggggtgatccccaggaaactaccgttcccgctgtcaccaagctag

SEQ ID NO: 191098 - DNA, 1113 bp, Artificial Sequence
  Description of Artificial Sequence: Synthetic coding sequence
atgctgccccggctgatctgcatcaacgactacgagcagcacgccaagtcagtgttaccaaaaagtatctacgattactacagatctggggctaatgacgaggaaactctggcagataacatcgcggctttcagcagatggaaattgtacccaagaatgctgcggaacgtggcagaaactgatttgtctacctcagtcctgggtcagcgagtgtctatgccaatatgtgtcggagcaaccgccatgcagcgtatggcccatgtcgacggggagctcgccacagtgcgggcatgccagtcactgggaactggaatgatgctcagttcatgggccacctcatcaattgaagaagtcgccgaagcaggccccgaagccctcagatggctgcagttgtacatttataaggaccgtgaggtgacgaagaagctggttcgacaagcagagaagatgggttataaggctattttcgtcaccgtggacacaccttatctggggaatcggctggacgacgtgcggaaccgttttaagttaccaccccagttgcggatgaagaattttgagacgtccactctaagcttttcccctgaggagaatttcggcgatgattccggcttagccgcctacgttgcgaaggctattgacccttcaatctcctgggaggacatcaagtggctgcggcgactgacgtctctacctatcgtcgctaaggggattctcagaggtgacgatgcccgtgaggctgtgaagcatgggcttaacggcattctggtgagtaatcacggggcgagacagctcgatggtgtaccagcgaccattgatgttctgccagagatagtggaggctgttgagggcaaagtggaggtgtttttggatggtggcgtgagaaaggggaccgacgttctgaaagcgctggccttgggcgccaaagcagtgtttgtgggccggcctatagtatggggactggcctttcagggagagaaaggggtccaggacgtgttggaaattctcaaagaggagtttcgattagccatggccttatccggttgccagaacgtgaaagtgattgataagaccctcgttaggaagaatccactcgccgtgtcaaaaatatag

SEQ ID NO: 191099 - DNA, 1056 bp, Artificial Sequence
  Description of Artificial Sequence: Synthetic coding sequence
atgagcctggtgtgcctgaccgacttccaggcccacgcccgggagcaattgagtaaatctacgcgtgatttcatcgagggaggcgccgacgactcaatcaccagggacgataacatcgccgcttttaagcggattcggctgagaccaaggtacctgcgagatgtctccgaagtagacacacgaacaactatccaaggcgaagagataagcgcccccatctgtattgcccccactgggtttcactgcctcgtgtggccggatggagagatgtcaactgcccgggcagctcaggctgctgggatttgttatattacctctacattcgcatcttgctccttggaggacattgtgatcgcagcacccgagggcctgcgttggtttcaactgtacgtgcacccagatttacagttaaacaagcagcttatccaacgggttgagagcctggggttcaaggcactggttatcactcttgacacccctgtgtgcggcaatcgcagacatgatatccgaaatcaactgagaagaaatttgaccctgactgacctccaatcccctaagaaggggaacgccattccgtacttccagatgacacctatctcaacttctctctgttggaacgacctgtcgtggttccaatctataactagactcccaatcattctgaagggcattctcactaaggaggacgcggagttagccgtgaagcacaacgtgcagggcataatagtaagcaatcatggcggcaggcagctggacgaggtgttggctagtatagacgccctgacagaggtggtggctgccgttaagggcaaaatagaagtgtacctagatgggggtgtccgtaccggcaacgacgtgttgaaggcactggctttgggagcaaagtgcattttcttgggtaggccaatcttatggggactcgcatgtaagggcgagcatggggtgaaggaagtgttgaacattctgacaaatgagttccacacgagtatggccctcaccggctgcagatcggtcgctgagatcaatagaaacctggttcaattctcccggctgtag

SEQ ID NO: 191100 - DNA, 1095 bp, Artificial Sequence
  Description of Artificial Sequence: Synthetic coding sequence
atggaggacaagatgtggagcgagtgcgagggccccgagatgagcctggtatgtttgacggactttcaggctcacgcaagggaacagctgtccaaatcaactcgggacttcattgagggtggggcagatgactcaatcacaagagacgacaacatcgcagccttcaagcggattagactgagacccaggtacctacgggacgtatctgaggtggacactcggactactatccaaggggaggaaatatcagcacctatctgcattgccccaacgggctttcattgtctcgtatggccggacggggagatgtctaccgctagggcagcccaagccgctggaatttgttatataacttctacttttgcaagctgttcattagaggacatcgtgatagccgctcctgagggcttgaggtggtttcaactgtacgtacatccagacctgcagttgaacaagcagctgattcagagagttgaatcccttggattcaaggcactggtaatcactctggatacgccggtgtgcgggaataggcggcatgatataaggaaccagctgaggagaaacctgacactgacagaccttcaaagtcccaagaagggaaacgccatcccctacttccagatgaccccaatatcaacatccctctgctggaatgacctaagctggttccagagcattactaggctcccaatcattttgaaaggcatactcacaaaagaggacgccgaacttgctgtgaaacataacgttcaagggatcatcgtatcaaaccacggcggccgccagctggacgaagttctggctagcatcgacgccttgacggaggtcgtagcagctgtaaaggggaagattgaagtgtatctggatggcggcgtccgaactgggaacgacgtcttaaaagcactggcactgggagcaaaatgtatttttctgggaagacccatcttatggggccttgcatgcaagggcgagcacggggtcaaggaggtcctgaatatactgaccaatgaatttcacacgtctatggcccttaccgggtgtcgctcagtcgccgagataaaccgaaacttggtgcagttttcgaggctttag

SEQ ID NO: 191101 - DNA, 561 bp, Artificial Sequence
  Description of Artificial Sequence: Synthetic coding sequence
atgagcctggtgtgcctgaccgacttccaggcccacgcccgggagcagctctcaaagtccactcgcgatttcatcgaaggtggtgccgatgatagtatcacccgggacgacaacatcgccgccttcaagagaatacgattacggcctcggtacttacgcgatgtgagcgaggtagacacacggacgacaatacaaggtgaagagattagcgcgccaatatgcatcgccccaactgggttccattgcctggtgtggccagacggtgaaatgtctactgcccgggctcctgagggcctgcgatggtttcaactttatgtgcacccagatctccaactgaacaagcaacttattcagcgcgtggagagcctggggttcaaagctctcgtcatcacattggatactcctgtgtgtgggaaccggcgccatgacatacggaatcagcttcgccgaaacttaactctgaccgacctccagagccctaaaaaaggcaacgccatcccgtatttccagatgaccccgatcagtaccagcttgtgttggaacgacctgtcatggttttag

SEQ ID NO: 191102 - DNA, 2292 bp, Artificial Sequence
  Description of Artificial Sequence: Synthetic coding sequence
atggtggcctgccgggccatcggcatcctgagccggttcagcgcctttaggattctacgcagcagaggctacatctgtaggaatttcactggctccagtgcccttttgacccgcacccacataaactatggagttaaaggggatgttgccgtggtacgaataaactcacccaactccaaggtgaatacgctctctaaggagctgcacagtgagttctctgaggtgatgaacgaaatatgggctagtgaccagataaggagtgcagttctgatatccagtaaaccaggatgctttatcgccggcgccgatataaacatgctggcagcttgcaaaacccttcaagaagtgactcagctgtcccaggaagcccagcgcattgttgagaagcttgagaaatctacgaagcccatcgttgctgctataaacggttcctgtctgggcggcgggctcgaggttgccattagctgccagtacagaatcgccacaaaggacagaaaaactgttttgggaacaccagaggttcttctgggcgctctgcctggtgctggaggcacacagaggctccccaaaatggttggcgtgcctgccgccctcgatatgatgctgaccgggagaagtatcagggcagatagggccaagaagatggggttagtcgaccagctcgtggagcccctgggcccagggctaaaaccccccgaggaacgtactatagaatacctcgaggaagtggccattactttcgcgaaaggattggccgataagaagattagtccaaaaagggataagggactggtggagaaactgaccgcttacgccatgaccatcccattcgtcagacagcaagtctacaagaaggtggaggaaaaggtcaggaagcagacaaaaggcctctatcctgccccactcaaaattattgacgtggtcaagacgggcatcgagcaggggtcggacgcagggtatttgtgcgagtcacagaaattcggagaattggtgatgactaaagagagcaaggcactcatgggattgtatcatggtcaagtgttgtgcaagaagaataagtttggagccccacagaaggacgtcaaacacctggcgattctgggagcagggctaatgggcgccggcattgcccaggtgtcggtggataagggtctcaagacgatacttaaggatgccacactgacggcactcgacaggggccagcagcaagtgttcaagggtcttaacgacaaagtgaaaaagaaggccctgacctcttttgagagggatagcatcttttcaaacttgacaggtcaactggattaccagggctttgaaaaagctgacatggtgatagaagccgtttttgaggacctgtccctcaaacaccgcgtgctcaaggaggtggaggccgtcatccccgatcactgcatatttgccagcaacacttctgctttgcctatctcagagattgcagcagtttccaaacgaccagaaaaggttattggcatgcattacttcagtcctgtagataagatgcagttgctggagatcattaccactgagaagaccagtaaggatacctctgcctcagcagttgcagtcggactgaaacaggggaaggttatcatcgtggttaaagacggccccggcttctacactacgcgttgtttagcacctatgatgagcgaagtcattcgaatcctacaagagggcgttgaccccaagaagctggactcattgactacttctttcggatttcccgttggggccgccaccttggtagatgaggtgggcgtcgatgttgctaaacacgttgcagaagatctggggaaggtcttcggggagcggtttggaggagggaatccagaactgcttacccagatggttagtaaaggcttcctcgggcgaaaatctggcaagggcttctatatctaccaagaaggggtcaagagaaaggatttgaattctgacatggactccattcttgcatccctgaagcttccacctaaatcagaagttagctcagacgaggatattcagtttcgtctggtaaccaggttcgtaaatgaagcggtcatgtgcctccaagagggaattcttgcgacacccgctgaaggcgatatcggcgcagtgttcggcttgggttttccgccctgcttgggaggaccatttcggttcgttgacttatacggtgcccagaagattgttgatcggctgaaaaaatacgaggctgcatatggcaagcaattcacgccatgccaacttctcgcagatcatgctaactcaccaaataaaaagttttatcagtag

SEQ ID NO: 191103 - DNA, 783 bp, Artificial Sequence
  Description of Artificial Sequence: Synthetic coding sequence
atggagagcaagggcatgtggcagctgttcgagctgaccctgcccatacagtccatgctcgccgcctgcaagacgcttcaggaagtgacacaacttagtcaagaggcacaacggattgtggaaaaacttgagaagagcaccaagcctatcgtggccgctataaatggctcatgcctgggggggggcctcgaagttgccatttcttgtcagtatcgtatagccaccaaggaccggaaaactgtgctgggcacccccgaagtgctgctgggggctcttccaggggcagggggcactcagcgcctccctaagatggtaggggtgcccgccgccctcgatatgatgctcactggaaggtccatcagagctgaccgggctaaaaaaatgggtctggtcgatcagttggtggaaccacttggcccggggctgaagcctcccgaagagagaacaattgagtatctggaagaggttgctataacattcgcgaagggcctggctgataagaaaataagtccaaagagggacaaagggctcgttgagaagctgacggcttacgccatgacaatccctttcgtccgtcagcaggtgtataaaaaagtagaggaaaaggttcgtaagcagaccaaagggctatacccagcccctctgaagataatcgacgtcgtgaagacaggcatcgagcaagggtctgacgccggctatctctgcgagagccaggttaatctattcccatttaacgttctgctgtccgtcaagggtaagttgaagatccagagtagcgtttag

SEQ ID NO: 191104 - DNA, 1425 bp, Artificial Sequence
  Description of Artificial Sequence: Synthetic coding sequence
atgaccatcctgacctaccccttcaagaacctgcccaccgccagcaaatgggcactgagattttctatcaggcccctgtcttgctcttcacagctgagagctgcccccgctgttcagacgaagacaaaaaagacactagctaagccaaatattaggaatgtggtcgtcgtggacggagtacgcacaccgttcctgctcagcggaacctcctataaggacctgatgccccatgacctagcccgtgctgccctgacaggactgctccatcgaacctccgttcctaaagaggtcgtggattatatcatttttggcacagtaatccaggaagttaagacgtcaaacgtagcccgtgaggctgcactgggcgccgggttttccgataaaacacctgcccacacagtcactatggcatgcatctctgctaatcaggcaatgactactggcgtcggactcatcgctagtggacagtgtgatgtcatcgttgcaggtggcgtggaactgatgtcggatgtgccgatccgtcacagccggaagatgagaaagctcatgctggaccttaacaaggccaaatccatgggacaacgtctctctctgatctctaaattccgattcaattttctggctcccgagttgcctgctgtcagcgagtttagtaccagcgagactatgggtcattctgctgataggttagcagcagcatttgccgtgagtaggttagaacaggatgagtatgcactgcggtcccactccctggccaagaaggcccaggacgagggccttctgtcagacgttgttccatttaaggtgccggggaaagacaccgtgacaaaggacaatggaatccgccccagtagtctggagcagatggcaaagcttaaacccgcgtttataaaaccatacggcactgtaacagccgccaacagctcctttctgactgacggagcgtccgctatgctgattatggcggaggaaaaggctctggcaatgggctataagcctaaagcctatcttcgggattttatgtatgtgagccaggatcctaaagatcagctgctgttggggccaacatatgcgactccgaaagttctggagaaggccggcctcaccatgaacgacatcgacgccttcgaattccatgaagcatttagtggtcaaatcctggctaacttcaaagcaatggattctgactggttcgcagagaattacatgggaaggaagaccaaagtcggcctgcccccgctcgaaaaatttaacaactggggtggctctctatctctgggccacccatttggtgcaaccggttgtagactggtcatggctgctgccaaccgcttaagaaaagaaggcgggcagtatggcctcgtggcagcttgtgcagccggagggcagggacatgccatgatcgtagaggcctatcccaagtag

SEQ ID NO: 191105 - DNA, 258 bp, Artificial Sequence
  Description of Artificial Sequence: Synthetic coding sequence
atgaccatcctgacctaccccttcaagaacctgcccaccgccagcaagtgggcgcttaggttttcaataagacctttaagctgtagctcccagctgcgcgccgcaccagccgtccaaaccaagaccaagaagaccctcgcaaagccaaatattcgcaatgtcgttgtggtcgacggtgttcgcacccctttcttgctatctgggacctcttacaaggatctgatgccgcacgacctagctcgcgccgctctcacgtag

SEQ ID NO: 191106 - DNA, 531 bp, Artificial Sequence
  Description of Artificial Sequence: Synthetic coding sequence
atgaccatcctgacctaccccttcaagaacctgcccaccgccagcaaatgggcgctgagattttccatccggccactgtcctgctcttctcagctccgcgctgcaccagcagtgcagactaaaactaagaagaccctcgccaagcctaatatccgaaacgtggtggtggtcgatggcgtgcgcaccccgtttctgttgtctggaactagctataaagatcttatgcctcacgatctggcgcgtgcagcactgaccgggttacttcatagaacatccgttcctaaagaggtcgttgattacattatcttcggaaccgtgatccaggaggtaaagacgtcaaacgtcgcaagggaagcagccctgggcgcaggctttagcgataaaactcccgcccacactgttacaatggcctgcatctcagccaatcaggcaatgacaaccggggtgggcttgatcgcctctgggcagtgcgatgtcattgtggccggaggtgtggaattgatgtctgatgtccccatccgccactcttag

SEQ ID NO: 191107 - DNA, 453 bp, Artificial Sequence
  Description of Artificial Sequence: Synthetic coding sequence
atgaccatcctgacctaccccttcaagaacctgcccaccgccagcaagtgggccctacggttctccatacgacccctgagttgcagtagccaactcagggcggctcccgccgtacagaccaagacgaaaaagacccttgctaagcccaacattaggaacgtggtggtagtcgacggcgtaaggacccctttcctcctgtcaggcacatcatacaaggatctaatgcctcacgatctagctagggccgccctcacaggattgctccaccgcacaagcgtacccaaggaagtggtggactacattattttcggaaccgtgatccaggaggtgaagacgtccaatgtcgccagggaggcggcactgggcgctgggtttagcgacaaaacacctgcccacactgtgacaatggcatgtatatccgccaaccaggccatgacaactggtgtggggtag

SEQ ID NO: 191108 - DNA, 1380 bp, Artificial Sequence
  Description of Artificial Sequence: Synthetic coding sequence
atgaccatcctgacctaccccttcaagaacctgcccaccgccagcaaatgggccctgcggttctccatcaggcctctaagctgcagctcccagttgcgagccgctcctgccgttcaaacaaaaaccaagaaaacccttgccaaacccaacattaggaacgttgtcgttgttgacggggtgcgaactccgttcctcttgagtggaacctccggattattacacaggaccagcgtccctaaagaggttgtggactatatcatttttggaacggtgattcaagaagtcaaaactagcaatgttgccagagaagccgccctcggagccggattttctgacaagacccccgcccatacagtgacgatggcctgtatctctgcgaaccaggctatgacaactggggttggcctgatcgcttccggacagtgtgatgtaatagttgcaggaggggttgaactgatgtctgacgtaccaatccggcatagcaggaagatgcgtaagctgatgctggatctgaacaaagccaagtcaatgggacagagattgtccctcatttccaaatttcgattcaattttctcgcaccagaattacctgccgtgtctgaattctcgacatccgagactatgggccatagcgccgaccgacttgccgcggccttcgctgtgtctcgcctggaacaggacgaatatgctctgaggagccacagtcttgctaaaaaagcccaggatgagggtctcctgtctgatgtcgtgccgttcaaagtgcctgggaaagacactgttaccaaagacaatgggataagacccagcagcttggagcaaatggccaaattgaagcccgcttttatcaaaccatacggcaccgtaactgctgcaaatagcagcttcctgaccgacggtgcttcagctatgctgatcatggccgaagagaaagcattggcaatggggtacaagcccaaagcttacctacgggacttcatgtacgtgagccaggatccgaaggatcagctgctgctgggcccaacgtacgcaacccccaaagtgctggagaaagccggcctcacaatgaacgatattgacgcattcgaattccacgaggcattctctgggcagattctggcaaatttcaaggcgatggacagtgactggtttgcagaaaactacatgggccgcaagaccaaagttgggttacctccactggaaaaattcaacaattggggtggatccttgtcgctgggccacccgttcggcgctacggggtgcaggctggtcatggccgcggctaataggcttcgcaaggaaggcgggcaatatggcctggtggcggcatgcgcggccggtgggcaagggcatgccatgattgtggaagcgtaccctaagtag

SEQ ID NO: 191109 - DNA, 1359 bp, Artificial Sequence
  Description of Artificial Sequence: Synthetic coding sequence
atgaccctggtgagcggctggctgctgtacggctggatcatcgccgtgcagactaaaacaaaaaaaaccctcgccaagcccaacatcaggaatgtggtggttgtggacggagttcgcactccctttctgttgtcaggcacgtcctacaaggaccttatgccgcacgacctggcaagggctgctcttactgggcttcttcatcggacatccgtgccgaaggaagttgtcgattacatcattttcgggacagtcatccaggaagtcaaaacttccaacgttgctcgggaagccgccctcggcgccggcttctctgataaaacccctgctcataccgtaaccatggcttgcattagtgccaaccaggccatgaccacaggtgtgggactgatagccagtggacagtgcgacgtgatagtcgcaggcggcgtcgagctcatgtctgacgtgccaattcgccattccagaaagatgaggaagcttatgctcgatctgaacaaagccaagtcaatgggccaaagattgtcccttatcagtaagttcaggtttaattttctggcaccagaattgcccgcggtgtccgagttctctacaagcgagaccatggggcatagtgccgaccggctcgccgccgccttcgccgtgtcacggctagagcaagacgagtatgcactccggagccattccctggccaagaaagctcaagacgaaggattactttccgacgtcgtccccttcaaggtgccgggcaaagatacagtgaccaaagacaatggcatacgacccagcagcctggagcaaatggcaaaacttaagcccgccttcataaagccttacggaacagtgacggctgcaaatagctcatttctgaccgacggcgcatcagctatgttgattatggccgaggagaaagccctggctatgggctacaagccgaaggcctacctgcgagattttatgtatgtctcccaggatcccaaggaccagcttctgctgggccccacttatgccactcccaaggttttggaaaaagcaggcctgacaatgaatgatatcgacgccttcgaatttcacgaagccttttcaggtcagatcctggcgaactttaaagccatggattcagattggttcgccgagaattacatgggccgcaaaacaaaagtgggcttgccacctctcgagaagttcaataattggggggggagcctgtcgcttggccaccctttcggtgctaccgggtgccgattagtcatggcagcggctaataggctgcgcaaagaaggcgggcagtacggccttgtggctgcatgcgctgccggaggccagggtcacgcgatgattgttgaggcctatcccaagtag

SEQ ID NO: 191110 - DNA, 783 bp, Artificial Sequence
  Description of Artificial Sequence: Synthetic coding sequence
atgaaggtggaggtgctgcccgccctgaccgacaactacatgtacctcgttattgacgatgaaacaaaggaggctgcaatcgtcgatcccgtgcagccccagaaggtagtcgatgccgcccgcaaacacggcgtgaagctgacaaccgtccttaccacccaccatcactgggatcacgctggtggaaatgaaaagctggtcaagctcgaatcaggtctgaaggtctatgggggcgacgatcggattggcgcattgacacacaagatcacccacctgagtacactccaggtcggatccctaaacgtgaaatgtctcgctacaccctgccatacctccggacacatttgctattttgtatcaaagccgggtggctctgagcccccagccgtctttactggagatacattgtttgtggcgggctgcggaaaattttacgaaggtaccgctgacgagatgtgtaaagctctcctggaagtgctgggccgcctcccccccgatacaagggtgtattgtggacacgaatataccatcaataatctcaagtttgcgagacatgtggagccaggcaatgccgcgataagggagaagctggcatgggctaaggagaagtattccatcggcgagccaaccgttccttctacactggcagaggagttcacctataacccattcatgcgggtgcgcgagaagactgtgcagcagcacgcaggggaaaccgaccccgtgaccactatgagggcggtgaggcgggaaaaagatcaatttaagatgcctcgggactag

SEQ ID NO: 191111 - DNA, 927 bp, Artificial Sequence
  Description of Artificial Sequence: Synthetic coding sequence
atggtggtgggccggggcctgctgggccggcggagcctggccgccctcggagcagcatgtgctcgccgaggtctgggcccagcattactgggcgttttttgccacacagatctgcgcaagaatctgactgtagatgagggaaccatgaaagtggaagtgctgcctgctctgacagataattatatgtacctggtgattgacgacgagactaaggaggccgctatcgtggatcctgtgcagcctcagaaagtcgtcgacgctgccaggaagcacggggtgaagttgactaccgttcttacaacccaccaccactgggaccacgccgggggcaacgagaaactggtaaaattagagtctggtctcaaagtttacgggggcgacgatagaatcggggccctcactcacaagatcacccacttgtctacactgcaggttggcagcttgaatgttaagtgtttggcaaccccatgtcacacaagcggtcacatctgctacttcgtcagtaaacccggtggttcggagccacccgctgtgttcactggggacactctttttgtggccgggtgcggaaagttctacgaaggaacagccgatgaaatgtgtaaagccctgctggaagtcctggggcgactcccacccgatacgagagtctactgcggacacgagtacacgatcaataatttgaaatttgccagacatgttgaaccgggtaatgctgcaatacgcgaaaagctggcctgggcaaaagaaaaatacagcattggggagcctactgtcccgtcgacgctggccgaagagttcacttataatcctttcatgagagtgcgcgagaaaactgtgcagcaacatgccggggagacagatccagtgaccaccatgcgtgccgtgaggagggagaaggaccagtttaagatgccgcgggattag

SEQ ID NO: 191112 - DNA, 711 bp, Artificial Sequence
  Description of Artificial Sequence: Synthetic coding sequence
atggtggtgggccggggcctgctgggccggcggagcctggccgccctaggcgccgcctgcgctcgtcgcggccttggcccagcactccttggggttttctgtcataccgatttacgcaagaacctcaccgtggatgaaggaaccatgaaggttgaggtcctgcccgccttgactgacaactatatgtacctggtgatagacgacgaaaccaaggaagcagccattgtcgatccagtgcaaccccaaaaggtggtggacgctgctaggaaacacggagtcaaattgaccacagtgcttactactcatcatcattgggatcatgctggagggaacgagaagctggtgaaactggaatctgggctgaaagtgtatgggggagacgataggatcggggccctaacccataagattactcacctttctacactccaggtcaccccgtgcctgtggttggccgcaggcagttccatgaagggactaaggatgaggtgcgtgaagctctgctggcgctcctgggccggaagcccccggacccaggagtccactgtcgcgaccagcaccccttctaccacatcctcactccatgccacgtggtcgcctgctatgccaccatctggccggtcgtggccgggacctcgtagatccaccgcatccggatctccccagtgtcatccaccatggcagcgatcccttcctacaacccccagctag

SEQ ID NO: 191113 - DNA, 1128 bp, Artificial Sequence
  Description of Artificial Sequence: Synthetic coding sequence
atggccatgaccggctggagctgcctggtgaccggcgccggcggctttttaggccaaagaataataaggttgttggtgaaagagaaggagctcaaggaaatacgggtgctggacaaggcgttcggccccgaacttagagaggaattctctaaacttcagaataaaacaaaactgactgtgcttgagggtgacatattagacgagccattcctgaaaagggcctgtcaggatgtctcggtgatcatccatactgcgtgtatcatcgatgtgttcggcgtgactcacagagagtctatcatgaacgtgaacgttaaaggcacacagctgctgctagaggcctgtgtgcaggccagtgtccctgtttttatatatacttcatctatagaggtcgcaggccccaatagttataaagaaatcatccagaatggccacgaggaggaaccactggaaaatacatggcccgctccatacccccactccaaaaagctggctgagaaagccgtcctggcagcaaacgggtggaacctgaagaacgggggaacactttacacctgtgccctgcgacctatgtatatttacggtgaaggcagtagattcctgtctgcctccatcaatgaggcgctgaacaacaacgggattctgagttctgtgggcaaattctctaccgttaacccggtctacgtggggaacgtggcttgggcacacattttagctttgcgggccctgcaagatcccaagaaagcacctagcatcagggggcaattctactatatctcagatgataccccacatcagagctatgataatctgaattacacgttatctaaggagttcggactcaggctcgattcaaggtggagctttcctcttagccttatgtattggatcgggtttctccttgagattgtaagcttcctcctccgccccatctatacttatcgccccccttttaataggcacatcgtcactctgagtaactccgtgttcaccttctcctataagaaggcgcagcgagatctggcgtataaacctctgtacagctgggaagaagccaaacagaagaccgtcgaatgggtcgggagcctggtcgataggcacaaggagaccctgaaatccaagacccaatag

SEQ ID NO: 191114 - DNA, 1122 bp, Artificial Sequence
  Description of Artificial Sequence: Synthetic coding sequence
atgaccggctggagctgcctggtgaccggcgccggcggcttcctggggcaacggatcatccgcctgctggtgaaagagaaagagctgaaggaaatacgcgtgctggataaggccttcggccccgaactgcgcgaggaattttccaagctgcagaacaaaaccaagctcactgtgttggagggggatattctggacgagccatttttgaaacgagcatgccaggatgtgagtgtaatcatccacacagcttgtatcattgatgtcttcggcgtgacccatcgggagtctattatgaatgtgaacgttaaaggcacacagctgctactggaagcctgtgtgcaggccagcgtgccagtgtttatctatacgtcctctatcgaagtcgcagggcccaactcctacaaggaaataattcagaatggccacgaggaagagccgctggagaatacgtggcctgccccctacccccattccaagaaactggccgagaaagccgtgctcgcggctaatggctggaatctgaaaaatggcggtaccctgtacacctgcgcgctccgaccaatgtacatttacggagaggggtccaggttcttatctgcaagcatcaatgaggcactcaacaataacggaatcctgtcgagcgttggcaaatttagcactgttaaccccgtttacgtgggtaacgtggcttgggcccacatcttggctttgcgcgctcttcaggaccctaagaaagcccctagtatccgaggccagttctattacatatcagatgataccccgcaccagtcatacgacaatcttaactacacactttccaaagagttcggcctgaggctggattcaaggtggagcttcccacttagtctgatgtactggattggttttctgttggagatcgtgtcgtttctcttgaggccaatatatacttatagaccaccattcaatcggcatattgtgaccctgtcgaactctgtttttacgttttcatacaagaaagcacaacgggatctcgcctacaagccactgtactcttgggaggaagcaaagcaaaagaccgtcgagtgggtgggctccctggtcgatagacataaggaaacactgaagagcaaaacacaatag

SEQ ID NO: 191115 - DNA, 1122 bp, Artificial Sequence
  Description of Artificial Sequence: Synthetic coding sequence
atgaccggctggagctgcctggtgaccggcgccggcggcttcctgggtcagcggatcattcgcctcttagtgaaggaaaaggagcttaaagagattcgagtgctagataaggctttcggcccggagctcagagaggaattctctaagctgcagaacaaaaccaaactgacggtcctggaaggagatattctggacgagccatttctcaaacgcgcttgccaggatgtgtccgtgatcatccacactgcctgcattatcgatgtgtttggagtgacgcacagagagtcgataatgaacgtaaatgtcaaagggactcagctcttgcttgaagcatgtgtgcaggcatctgtgcccgtatttatatatacctcttctatcgaggtcgctggcccaaacagttacaaagagatcattcaaaacggtcatgaggaggagccattagagaacacatggcccgctccctacccacatagtaagaaattggccgagaaggcggtacttgctgctaacggatggaacctgaagaacggtgggaccctctacacatgtgctctcagacccatgtacatttacggagaggggagtaggttcttaagtgcctcaattaacgaggccctgaacaataatggaatccttagtagcgttggcaaattcagtacagttaatcctgtctatgtggggaatgtggcatgggcacatattctggccctgcgtgcacttcaggacccaaaaaaagcgccttcaatacgaggacagttctactacattagcgatgatacacctcatcagagctacgacaatttgaattatacactaagcaaggagtttggcctgcggctagattccagatggagttttccgctctctctcatgtactggataggcttcttattagaaatcgttagctttcttcttagacctatatacacgtacagacccccttttaatcggcatatcgtaactctgtccaacagcgtattcaccttttcctacaaaaaagcgcagagggacctagcctataagcccctgtatagctgggaggaagccaagcagaagactgtcgagtgggtaggatctttggtggaccggcataaagaaactctgaagagtaaaactcagtag

SEQ ID NO: 191116 - DNA, 249 bp, Artificial Sequence
  Description of Artificial Sequence: Synthetic coding sequence
atgaccggctggagctgcctggtgaccggcgccggcggcttcctgggccagaggataatccgccttctagtgaaggagaaggaactaaaggaaatcagggtcctggacaaagcctttggccccgagttacgggaagagttctccaagctccagaataagacaaaattgactgtactagagggtgatattctggatgaaccattccttaaacgcgcctgccaggatgttagcgtaattatacatacctag

SEQ ID NO: 191117 - DNA, 1119 bp, Artificial Sequence
  Description of Artificial Sequence: Synthetic coding sequence
atgggctggagctgcctggtgaccggcgccggcggcctgctgggccagaggatcgtgaggctattggtggaagaaaaggaactgaaggaaattagagctctggataaagctttccgacctgaactcagggaagagttctccaagctccagaatcgtaccaagttgacagttttagagggagacattttagacgagccctttctgaaacgggcttgtcaggatgtgtcggttgttatccacactgcatgcatcatcgacgttttcggtgtaacgcacagagaatctatcatgaacgtgaacgtgaaaggtactcagttactcctggaggcatgcgtccaggcgagcgtaccagtgttcatatatacatcatctatcgaggtagcagggccaaactcttacaaagaaatcatacagaatggacatgaagaggagcctttagagaatacatggcctacaccctacccttactccaagaagttggccgaaaaggctgtgctcgcggccaacggctggaatcttaagaatggggacacactgtatacctgcgccctgcgccccacatacatttacggtgagggcggccctttcctctccgcctcaatcaacgaagccttaaacaataacggtatactgtcgtccgttggcaaattcagcaccgtgaatcctgtttatgtggggaacgtggcctgggcccatatcctggctctgagggctctgcgtgaccctaaaaaggctccgagtgtccgcggtcagttctactacattagcgatgatactccgcaccaaagctacgataacctcaattatatcttgagtaaggaattcggactgaggttggattcacggtggtccctgcccttaactctgatgtactggatcgggttcttgttggaggtagtctcctttctgctatcacctatttattcctatcaaccaccgtttaatcgtcatactgtgacactctcaaatagcgtcttcaccttttcatataaaaaggcacaaagggatctcgcctataaacctctttacagctgggaagaagctaaacaaaagacagtcgaatgggtggggtcactcgtggaccggcacaaggaaactctgaagtcaaagacccagtag

SEQ ID NO: 191118 - DNA, 588 bp, Artificial Sequence
  Description of Artificial Sequence: Synthetic coding sequence
atgggctggagctgcctggtgaccggcgccggcggcctgctgggccagagaatagttcgcttgctggtcgaggagaaagagctgaaggagattcgcgcacttgataaggcattcaggccagagcttagagaagagttctctaaactgcaaaaccggacgaagctcacagtccttgagggtgatattctggacgagcccttcctcaagagggcctgccaggacgtcagcgttgtcattcatacagcatgtattatcgacgttttcggggtgacccatcgggagagcatcatgaacgtcaacgtgaaggggacgcagctcctgctggaggcctgtgtgcaagcgagtgtccctgtgtttatctacacttcgagcatagaggttgcaggccccaacagttataaggagatcattcagaatgggcatgaagaggagcctctagagaacacatggcccacaccctacccatatagcaagaagctggccgaaaaagccgtcctggccgccaacgggtggaatttgaaaaatggggatactctatacacttgtgccctcaggcctacatatatatacggcgaagggggcccgtag

SEQ ID NO: 191119 - DNA, 1119 bp, Artificial Sequence
  Description of Artificial Sequence: Synthetic coding sequence
atgggctggagctgcctggtgaccggcgccggcggcctgctgggccagcgcatcgttcgtctgctcgtggaagagaaggagttaaaagagatccgtgccctagataaggcttttcgccccgagctgagggaagagttcagtaaactgcagaaccgaaccaaactgactgtccttgaaggtgacatcttggatgagccttttcttaagagagcttgtcaggatgttagcgtagtgatacataccgcatgcatcatagatgtttttggcgtgactcatcgggaaagtataatgaacgtgaatgtgaaagggactcagcttctgctggaggcctgcgtgcaggcttcagtgcccgtttttatttatacgagctcgatcgaggtggcaggcccaaacagttataaggaaatcattcagaacggccatgaggaggagccactggagaacacatggccaacaccctatccatattccaaaaaactagctgagaaggctgttctcgcagctaacggctggaatcttaagaacggcgatactctatacacctgtgcgttgcgcccaacgtatatttacggcgagggcggccccttcctgtcagcctcaataaacgaggcacttaacaataatggcattctgtcctcagtagggaagttttccacggtcaaccccgtgtatgttggcaacgtagcctgggcacatattctggccctgcgcgccctgcgggatcctaagaaagccccctccgtcaggggacagttttactacataagtgatgataccccacaccagtcatacgacaatcttaattatatcctttccaaagagtttggcctcaggctggattctcggtggagtctgccattaaccctgatgtactggattgggtttctgttggaagtcgtctcattcttactcagtccgatctatagctaccagccgcccttcaacaggcatacagtgaccttgtcaaatagcgtgttcacattttcatataaaaaggcacagagggacctggcatacaagccactgtactcctgggaggaggccaagcagaaaaccgtcgaatgggtgggctcccttgtcgaccgtcacaaggagaccctgaaaagtaagacacaatag

SEQ ID NO: 191120 - DNA, 591 bp, Artificial Sequence
  Description of Artificial Sequence: Synthetic coding sequence
atggccgacagcgcccaggcccagaagctggtgtacctggtgaccggtggctgtgggtttcttggcgagcatgttgtgcgaatgctgctgcagagagaaccacgactgggagaattgcgggtgttcgaccaacatctcggtccttggcttgaagaactaaagaccggtcctgtccgagttactgccatccagggcgatgtgacccaagctcatgaggtggcagctgccgtagccggcgcgcatgttgtcatccacacagccggactggtcgacgtgtttggacgggcctcccccaaaacaattcacgaagtgaatgtccaaggaacccgcaatgtgatcgaggcatgcgtccagactggcacacgcttcctagtctacacctctagtatggaggtcgtgggacccaatacgaagggccatcctttttaccgaggaaatgaagatacaccgtacgaggcagttcaccggcatccatacccatgcagtaaggcattggccgaatggctggtcctggaagctaatggacggaaggccatgctgcctgggtgcacatgttggcaaccagggagctggtcaagcggtcaaccctag

SEQ ID NO: 191121 - DNA, 1110 bp, Artificial Sequence
  Description of Artificial Sequence: Synthetic coding sequence
atggccgacagcgcccaggcccagaagctggtgtacctggtgaccggcgggtgtggtttccttggggagcacgtggtacggatgctcctgcagagagagccgcggctgggcgagctcagggtttttgaccagcatctgggcccatggctcgaggaactgaaaacaggtcctgtgcgtgttacggctatccaaggagacgtgacgcaagctcatgaagtcgccgctgcggtagccggggctcatgtggttatacatacggctggcttggtggatgtatttggccgagcctccccgaagacaatccacgaagtcaatgtacaggggacaaggaacgttatcgaggcttgcgtccagactgggacccggtttctggtgtataccagttcaatggaggttgtgggaccaaataccaaaggccacccgttctatagaggtaatgaggacacaccctatgaggcagtgcaccgccacccttatccctgcagcaaagccctggcagagtggctggtgttggaggccaatggcaggaaggtccgaggaggcctacctctggtcacctgtgccttacgacctacagggatatacggtgaggggcatcagattatgcgcgatttctatcgtcaagggctccgcctaggcggctggctattccgcgccataccagctagcgtcgaacacgggcgcgtttacgtcgggaatgtggcttggatgcacgtgctcgccgcccgggagctggagcagcgcgcaaccctgatgggagggcaggtgtatttctgttacgatggctctccataccggagctacgaggactttaatatggagtttttaggaccttgtggattaagactggtgggggcgcgcccattgctaccttactggctgcttgtgttcctggctgcgctgaacgcactgctccagtggctcctccgacccctggtgctctacgccccgctgctgaacccctacactttagcagttgcaaacacaacctttaccgtctccaccgacaaggctcagaggcattttggctatgagcctctgtttagctgggaggactcacggacaagaacgattctgtgggtgcaggcggccaccggatcagcacagtag

SEQ ID NO: 191122 - DNA, 591 bp, Artificial Sequence
  Description of Artificial Sequence: Synthetic coding sequence
atggccgacagcgcccaggcccagaagctggtgtacctggtgaccggcggatgcggattcctgggggagcacgtagtacggatgctcctccagagggagcctaggctgggggagttacgggtgtttgatcaacacctggggccttggctcgaggaactaaagaccggacctgttcgggtaacagccatacaaggcgacgtcacgcaggcgcacgaggtggccgccgcagtcgctggcgcacacgtggtgattcatacagcaggcctcgtggatgtgtttggtcgcgcttctcctaaaaccatccatgaggtaaacgttcagggtacacggaatgttatagaagcctgcgtacagacgggaaccaggtttcttgtgtacacctcatcaatggaggtcgttgggccgaacaccaagggtcacccgttttatcgtggcaatgaagacaccccatacgaagctgttcacaggcatccctacccatgctccaaggccctagccgaatggctcgtcctggaggccaacggcagaaaggcaatgctgcctgggtgtacctgttggcagcctggctcctggtcttccggccagccttag

SEQ ID NO: 191123 - DNA, 1086 bp, Artificial Sequence
  Description of Artificial Sequence: Synthetic coding sequence
atgagcggcaacggcaacgccgccgccaccgccgaggagaacagccccaaaatgagggtcatcagggtgggaactagaaagagccaactcgctaggattcagactgacagtgttgtggccactctaaaggcctcttatcccggactccagttcgagatcattgctatgagtacaacaggggacaaaattttagacactgccctctccaagatcggcgagaaaagcctttttaccaaggaactggaacacgctcttgagaagaatgaggtggatttggtggtgcacagtttaaaagatctacccaccgtgcttcccccaggattcaccattggggcgatctgcaaaagggagaacccccacgatgcagtggtttttcacccaaagttcgtgggcaaaaccttggagacactaccggagaagtctgtggtcgggacgtccagtttgcggcgggccgcacaactccagagaaagtttccccatttagagtttaggtcaatccgcgggaacctaaacactaggttgcgaaagctggatgagcagcaggagttctccgctataatactcgctacagctgggcttcagcgaatgggttggcataatcgggtgggccaaattctccacccagaggagtgtatgtacgccgtcggccaaggcgccttgggcgtcgaggtgagagccaaagaccaagacatccttgatcttgtaggcgtgctgcacgacccggagactctgttgcggtgcatagccgagcgggcttttctcaggcatttggagggcgggtgtagcgtcccggtcgcggtgcacactgctatgaaagacgggcaactatatttgaccgggggcgtctggtctctggacgggtccgattctatccaagagacaatgcaggcgacaatacatgttcctgcacagcacgaagacggaccagaggatgatccgcaactggtgggcatcaccgctaggaacattccacgtgggcctcagctcgctgcgcaaaacctggggatttcgctcgccaaccttctgctgtctaaaggtgctaaaaatatactagatgtggcccgccagctaaatgacgcacattag

SEQ ID NO: 191124 - DNA, 1035 bp, Artificial Sequence
  Description of Artificial Sequence: Synthetic coding sequence
atgcgggtgatccgggtgggcacccggaagagccagctggcccggattcaaacggatagcgtggttgcaactttgaaggccagttaccccggcttgcagttcgagattattgccatgagcacaaccggcgacaagattctggatactgccctgtccaagattggagaaaaaagcctcttcacgaaggagctcgagcacgctctggagaagaatgaggtggatcttgttgtgcactctttgaaggatctacctacggtgctgccccccggttttacgattggagccatctgtaagcgagagaatcctcacgacgctgtggtctttcatccaaaattcgtggggaagacattagagaccttacctgaaaagagcgtggtgggaacttctagtctgcgccgcgccgctcagctgcaacgaaagtttccccacctggaatttagatctattagggggaacctgaataccagactgcgtaagttagacgagcagcaggaattttcagcaataattctcgctaccgcggggctgcagagaatgggatggcacaatagggtcggccaaatcctgcaccccgaggagtgcatgtacgctgttggccagggagccctaggtgtggaggttcgggccaaagatcaggatattcttgatctggtcggggtgctgcatgatccagagaccctgctgcgttgcatcgctgagcgagcgttcctacggcacctggaaggaggctgctctgtcccagtggctgtccacaccgccatgaaggacggacaactatacctgactgggggcgtgtggtctctcgatggcagtgattctattcaagagactatgcaagccacgatccatgtaccagcccaacatgaagacggtcccgaggacgatcctcagctcgtgggtataacggcccgcaatataccacggggaccccaacttgcggcccagaaccttgggatatctttggcaaatcttttgttaagtaaaggtgcaaagaacattctggacgtggctagacaactgaatgatgcacactag

SEQ ID NO: 191125 - DNA, 1035 bp, Artificial Sequence
  Description of Artificial Sequence: Synthetic coding sequence
atgcgggtgatccgggtgggcacccggaagagccagctggcccggatccaaacagattcagtagtggctacactgaaggctagctatcccgggcttcaattcgaaataattgctatgagcacaactggagacaagatccttgacactgcactgtccaagatcggcgagaaatccttattcaccaaagaactggaacatgctttggaaaaaaatgaagttgacctggtggtgcacagcctcaaggacttgcccacagtgttgccccccgggtttactatcggcgctatctgtaagagagagaatcctcatgacgcggtcgtgttccaccctaagttcgtcggcaaaacactggagacgctccctgagaagtctgtggttgggacatcaagtttgagacgggcggctcagctccaacgaaagttcccgcatttggagttcaggtcaatacggggcaatctgaacacccgactccgcaaactggacgagcaacaggaattcagtgctatcattttggccactgcaggcctccagcgaatgggatggcacaaccgcgtcggacaaatcctccaccccgaggagtgcatgtacgccgtggggcagggggccctaggcgtagaggtccgggcgaaggaccaggacatcctggacctcgtcggagtcctgcacgatccggagacactgctaaggtgcattgctgagcgggcatttttgagacacctggaggggggctgttctgttcctgtcgccgttcacacggccatgaaggacggccagttataccttacaggcggcgtctggtcgctcgatgggtccgattcaattcaggagacgatgcaggctactatacacgtgccggcgcaacacgaagacggtcccgaagacgaccctcagctggtgggcatcactgccaggaacattcctcggggaccccagctagcagcacaaaacctgggcatctccctggctaatctgctgctgtccaaaggcgcaaaaaacatcctcgacgtagcccgtcagctgaatgatgcccattag

SEQ ID NO: 191126 - DNA, 564 bp, Artificial Sequence
  Description of Artificial Sequence: Synthetic coding sequence
atgcgggtgatccgggtgggcacccggaagagccagctggcccggattcagaccgattcggtcgtcgcaaccctgaaagctagctatccaggccttcaattcgagataatcgctatgagtaccacaggggacaaaattctcgatactgctctgtctaaaattggcgagaagagcctcttcacaaaggagctagagcacgcgctggagaagaacgaagtcgatctcgtggtgcactccctgaaagacctcccaactgtactgccgcctgggtttacgatcggggccatttgtaagcgagagaatccccatgatgccgttgtgtttcaccctaagttcgttgggaagaccttggagaccctgccagagaaaagcgtggtggggacttcctctttacggcgcgctgctcagctccagcggaaattcccccacctggagtttcgctcaataaggggcaacctgaatactcgcttgaggaaactggacgagcagcaggagttctcagcaattatcctggccactgccggactccagcgcatggggtggcacaatagggtaggacagtag

SEQ ID NO: 191127 - DNA, 1035 bp, Artificial Sequence
  Description of Artificial Sequence: Synthetic coding sequence
atgcgggtgatccgggtgggcacccggaagagccagctggcccggatccaaaccgatagtgtagtcgccacgctgaaagcttcttatcctgggctgcagttcgagataattgcgatgagcactactggggataaaatcctagataccgctttgtcaaagatcggagagaaaagcttgttcaccaaagagcttgagcatgctctggagaagaatgaggtcgatcttgtcgtgcattctctgaaggacctgcccactgttctcccccctggattcacaattggggccatatgtaagagagagaaccctcacgacgccgtggttttccatccaaagtttgtggggaagacccttgagacactgcccgaaaagagtgtggtcggaaccagctcactgcgccgcgcggcccagctgcagagaaagttcccccacttagagttccgctctataaggggcaacctaaacacacgtttgaggaagcttgatgaacaacaggaatttagcgccattatacttgctacagcggggttgcaacgaatgggctggcacaaccgggtagggcagatcctgcaccctgaagaatgtatgtacgcagttggtcagggtgcattaggggtcgaggtaagagctaaggatcaggatattttggatctggtaggcgttctgcacgacccagaaacactgttaagatgcattgctgagagggcattcttgcgacatttggaaggagggtgttccgtgccagtggccgtgcacaccgctatgaaagatgggcagttatacttgacaggtggtgtctggtctctcgatggcagcgacagtattcaggagacaatgcaggccacaattcatgtccccgcacagcacgaagacgggccggaggatgatccccaattggtcgggattaccgcgaggaatatcccccgaggaccccagttggcggcccaaaatctcgggatctcactagccaacctacttttaagtaaaggagccaaaaatatccttgatgtggcacgtcagctaaatgacgcccactag

SEQ ID NO: 191128 - DNA, 564 bp, Artificial Sequence
  Description of Artificial Sequence: Synthetic coding sequence
atgcgggtgatccgggtgggcacccggaagagccagctggcccggatccaaacagattctgtagtggctacgctcaaggcaagctaccctggactccaattcgagataattgctatgagtacaaccggagacaagatcctggatactgcactcagcaagattggagagaagtcactcttcacgaaagagctcgagcacgccctggagaaaaacgaagtcgacctggtcgttcattcactgaaagatctgccgacagtactgccccctggctttaccatcggcgccatctgtaaacgtgagaacccacatgatgccgtagtgttccacccaaagttcgtggggaagaccctggaaacactgcccgagaagagtgttgtcggcacctcttcactgaggcgtgccgcccagctgcaacgcaaatttcctcacctggaattcagatccattagaggcaatctgaataccagattacgtaaactcgatgagcagcaggaatttagtgctattatactcgcaaccgcgggactgcaacgaatgggctggcataatcgtgttggtcaatag

SEQ ID NO: 191129 - DNA, 915 bp, Artificial Sequence
  Description of Artificial Sequence: Synthetic coding sequence
atgcgggtgatccgggtgggcacccggaagagccagctggcccggatccagaccgatagcgtcgttgccacccttaaagcctcctatcctggtttacagttcgaaattatcgccatgtccaccacaggtgacaaaattctagacactgccttgagtaagataggtgagaagagccttttcactaaggaactggagcacgcgctagaaaagaatgaagtagacctggtagtgcactccctaaaggatttgccaaccgtcttaccacccgggtttaccattggcgccatttgcaaacgggagaatccccacgatgccgtggtttttcacccaaagttcgtcggcaagaccctcgaaactctgcccgagaagtccgtggttggaacatcctctcttcggcgggctgcccagctccagcgcaagtttccccatctggagtttcggtctattcgaggcaacctaaacaccagactgcgcaagctggatgagcagcaggagttcagcgccatcatccttgcaacagccgggttgcagagaatgggctggcacaacagagtagggcagatacttcatcctgaagaatgtatgtacgcagttggtcaagaaggtggctgttccgtcccagtggcggtgcacacagctatgaaagatggacagctctacttaactggcggagtgtggtctctcgacggatcagatagcattcaggagacaatgcaggccacaattcacgtgccagctcagcacgaagatgggcctgaggacgacccacagctcgtcgggataaccgcccggaacataccacgcggtccccagttagctgcccagaatctcggtatcagtctggccaatctccttctcagcaagggagctaagaatatcctcgacgtggcacgccagctaaacgatgctcactag

SEQ ID NO: 191130 - DNA, 966 bp, Artificial Sequence
  Description of Artificial Sequence: Synthetic coding sequence
atgagcggcaacggcaacgccgccgccaccgccgaggagaacagccctaagatgagggtgatccgcgtcggcaccaggaagagtcaattggcccggatccagactgactctgttgtagccacattgaaggcttcatacccagggctgcaatttgaaatcattgcgatgtccacgaccggggataagattttggataccgcgctgagcaagatcggggaaaagagcctcttcacaaaagagctcgagcacgccttagagaagaatgaggtggatctggtcgtgcattcgctgaaggatcttcccaccgttctgcctccaggatttactataggggccatctgcaaacgtgagaacccacatgacgcggtggtcttccaccccaagttcgtcgggaagaccctggagacactccctgaaaagagtgtcgtgggaacaagttcactccggcgcgcagcccagctgcaacgaaagtttccacatttggagttcaggagtatccgcgggaacctgaatacacgtctgaggaaactggatgaacaacaggagttcagtgccattatcctggcgacggccggattacagagaatgggatggcataaccgagtaggacaaattctgcatcctgaagagtgcatgtacgcggtggggcaggagggcgggtgttctgtgcctgtggccgtacatactgccatgaaggacggtcagctgtacctgaccgggggagtgtggtctctggatggctccgatagcatccaagaaaccatgcaggccacgatccatgtgccagcacagcatgaagatggccctgaggatgacccgcagctggtagggatcactgcgcggaacatccctcggggaccgcagctggctgcccagaatctgggcatttccctcgccaacctgttgctatcgaaaggcgcgaaaaatatactggacgtggcacggcaattgaacgacgctcattag

SEQ ID NO: 191131 - DNA, 879 bp, Artificial Sequence
  Description of Artificial Sequence: Synthetic coding sequence
atggccttcatgaagaagtacctgctgcccatcctgggcctgttcatggcatattattactactcagccaacgaggagttccgacccgagatgcttcaaggaaaaaaggtgattgtgaccggtgcttccaaggggattggcagggagatggcttatcacctggctaagatgggagcccatgtggttgtgacagccaggtccaaggagactctccagaaggtggtgtcacactgccttgagttgggagccgcctctgcccattacatcgctgggaccatggaggacatgacatttgcggagcagtttgtcgctcaggcagggaagctgatgggagggctcgacatgctgatactaaatcatatcaccaacacatccctcaatctgttccacgacgacatccaccacgtgaggaagtcaatggaggtcaacttcctctcctacgtggtgctcacggtcgccgccttgcctatgctgaagcaaagtaatggctccattgtggttgtcagtagtctggctggaaaggttgcgtatcctatggtggctgcatattccgccagtaagtttgcacttgatggcttcttctcttccatccggaaggaatatagcgtttccagggttaacgtctccattacgctgtgcgtgttgggcctcatcgacaccgagacagccatgaaggctgtgagcggaatcgtgcatatgcaggcagctcctaaagaggaatgcgctctggaaataatcaagggcggcgcactccggcaggaagaagtctactacgactccagcttatggactacccttctgattcgaaacccttgcaggaagatactggaatttctgtactccacaagctataacatggatcgttttatcaataaatag

SEQ ID NO: 191132 - DNA, 879 bp, Artificial Sequence
  Description of Artificial Sequence: Synthetic coding sequence
atggccttcatgaagaagtacctgctgcccatcctgggcctgttcatggcttactattactattccgccaatgaggaattcaggccagagatgctgcagggtaaaaaggtgattgtcacaggggcgtctaaaggcatagggcgtgagatggcctaccacttggccaagatgggggctcatgtggtcgtgaccgcgaggagtaaagaaacactccagaaggtcgtgtcccactgtttggaactgggtgcggcgtctgcccactacatagccgggaccatggaagacatgaccttcgccgagcaattcgtggctcaagctggtaaacttatgggagggctcgacatgctgatcctgaatcacatcacaaacacatcactaaacctgttccacgacgatattcaccacgtcagaaaatccatggaggtcaatttcttatcttacgtggtcttgacagtagcagcgcttcctatgctcaaacaatctaatggctccatagtggtggttagcagcctggcgggcaaagtagcctatcccatggtggctgcctacagcgccagtaaattcgccctggacgggttcttcagttccataaggaaggagtattccgtttctagagtaaatgtgtctattacactgtgcgtcctgggcctcatcgataccgagaccgctatgaaagccgtgagtggcattgttcatatgcaggccgccccaaaagaagaatgcgccctggagattatcaaggggggagccttgagacaggaagaagtttactacgacagctcgttatggacaactctgctgatcaggaatccatgtcggaagattctggaatttttatactccacgtcatataacatggataggtttatcaacaagtag

SEQ ID NO: 191133 - DNA, 879 bp, Artificial Sequence
  Description of Artificial Sequence: Synthetic coding sequence
atggccttcatgaagaagtacctgctgcccatcctgggcctgttcatggcttattactattactccgctaacgaagaatttcggcctgagatgttacaaggaaagaaagtgatcgtaactggggcctcaaaaggtattggccgggaaatggcctaccatctggccaaaatgggcgcgcacgtcgtagttaccgcccgctctaaggagacgctgcagaaggtggtttcgcactgcctggaacttggggccgccagtgctcactacatagcggggactatggaagacatgacatttgccgagcagttcgtggcccaggccggcaaactcatggggggactcgacatgcttatcctgaatcatatcactaacacctcccttaatctcttccatgacgacattcaccacgtccggaagtcgatggaagtcaatttcctttcgtacgtggtccttacagtggctgccctgcctatgcttaaacaatctaacgggtcaatcgttgtggttagctccctcgcaggcaaggtggcatacccaatggtagctgcgtattccgcctccaagtttgcattggacggtttcttcagttccattcgcaaagagtactctgtatcacgagtgaatgtgtcaatcacactgtgtgttctcggcctaattgatacagagaccgccatgaaggcggtctccggtattgttcacatgcaggcagctcccaaggaggagtgcgctctggagattattaaaggtggagccctccgtcaggaagaagtgtattatgattctagtctctggactaccttgctgattaggaatccgtgtcgcaagattcttgagttcctgtactcaacatcctacaacatggacaggttcattaacaaatag

SEQ ID NO: 191134 - DNA, 1218 bp, Artificial Sequence
  Description of Artificial Sequence: Synthetic coding sequence
atggagcggtggccctggcccagcggcggcgcctggctgctggtggccgcaagggctctgctgcagctgctcaggtccgatcttaggctcggcaggccactcctggctgcactggctctgctggctgcgctcgattggctctgccagcgcctgctgccccctcctgccgcgctcgcagtgctggccgccgcaggatggatcgccctgtcaaggctggcccgtccacagagactgccagttgcgacccgagctgtccttatcacagggtgcgactctggtttcggtaaagagaccgccaaaaagcttgattccatgggctttactgttctcgccaccgtcctggaactcaattctcctggcgcaatcgagctccgtacatgttgcagcccccgacttcgcctcctccagatggatctcactaaacccggagacatttctagagtgctggaattcactaaagcccacacaacctctacaggcctttgggggctggtcaacaatgcgggccataatgaggttgtagccgatgcggagctgtctccagtcgcgacctttagatcatgcatggaagtcaatttttttggggcgctcgaactgacgaaaggccttctccctcttttacgctcttcacgggggcgaattgtgaccgtgggctctccagccggagacatgccctacccctgtctgggcgcatatgggacttctaaagctgccgtagcgctgttaatggacaccttttcttgtgagctactcccctggggagttaaagtgagcattatccagcctggatgctttaagactgagagcgtccgtaacgttggtcaatgggagaaacggaaacagctgctgttggcaaatttgccacaggagcttcttcaagcttacggcaaggactacatcgagcacctccatgggcagtttctacacagcctacgacttgctatgtctgaccttactccagtcgtggacgctataacagacgccttgctggcagccagacccagaagacgttattatccaggccaggggcttggacttatgtatttcatccactattaccttcctgaaggtctgcgacggcggtttttacaagcttttttcatttctcactgcttgccccgggctctccagccagggcagcccggcactacaccgccccaggatgctgctcaggatccaaacctgagtccaggaccttctccggccgtggccagatag

SEQ ID NO: 191135 - DNA, 2232 bp, Artificial Sequence
  Description of Artificial Sequence: Synthetic coding sequence
atggaggccgtggccgtggccgccgccgtgggcgtgctgctgctggccggagctggtggcgcggccggcgacgaagcccgggaagccgcagcagtgagggcgctcgttgccagattactcggacctggtcccgcagctgacttcagcgttagtgtggaaagggcactggccgcaaagcccgggctggacacttacagtctaggaggtggcggcgcagcccgcgttagggtgaggggaagtaccggcgtcgctgcagccgctggccttcacaggtacctgagagatttctgtgggtgccacgtagcgtggtctggttcacaactgcgcctgccgcggcccctgcctgctgtccccggagaacttacagaggcaactcctaatcgctatcgctattaccaaaacgtttgcactcaatcatatagctttgtgtggtgggattgggcgcgatgggagcgagagatcgactggatggcactgaatggaattaacctcgcgctggcttggtcaggccaggaggctatttggcaaagggtgtacctggcgttaggcctgacacaggccgaaattaacgagttcttcactggaccagctttcctcgcttggggccggatggggaatctacacacttgggacgggccactacccccaagctggcacatcaagcagctttaccttcagcaccgcgtactcgaccagatgcgatcctttggaatgacccccgttcttcctgccttcgccggtcatgttcctgaagctgtgacgagggtgttcccccaggttaatgtgactaagatgggctcgtgggggcatttcaattgcagctatagctgtagcttcctcctggcgcctgaggacccgatctttcctatcattggctcactttttctaagagaactgatcaaggaattcggaacagaccacatctatggcgccgacacattcaacgaaatgcagccaccatcctctgaaccatcctatctggctgcggctacaacagccgtttatgaagccatgacagctgtcgacaccgaggccgtctggctattacaggggtggctgttccagcatcagccgcagttttgggggccggcccagataagagcggtattgggtgctgtccctcgaggcagactgttggtgcttgatttgtttgctgagtcacagccagtgtacacaagaaccgccagctttcaaggccagccattcatctggtgcatgctccataatttcggcggcaaccacgggctgtttggagcccttgaagctgtcaacggcgggcccgaagctgcacgcttgttccccaacagcactatggttggtactggcatggccccggaaggcatatcacagaatgaagtggtttatagtttgatggccgagctggggtggcgcaaggaccccgtgcccgatctcgcagcttgggtgacatcatttgcagcccggcggtatggggtgtctcatccagatgccggagcggcgtggcgcctgctcttgagatctgtctacaattgcagcggagaggcttgccggggccataatagaagcccacttgtaaggagaccgagtctacagatgaacacgtccatttggtataaccgctccgacgttttcgaggcttggaggctcctgctgacatcagctccatctctagctacttcaccggcattcagatatgacctgctcgatctgactcggcaggctgtccaagagctcgtatcgttgtactatgaagaggctcgcagtgcgtaccttagtaaagaactggccagccttctgagggcaggtggcgtgcttgcttatgagttactgcctgcactggatgaggtgctcgccagcgactctaggtttttactgggctcatggctcgagcaagcccgtgccgctgctgtgtccgaggccgaggcagacttttatgaacagaacagccgctaccagctgacactgtggggcccagaaggcaatattttggattacgccaataaacagttggctggtctggttgccaattactacacccctagatggaggttatttttggaggccctggttgattccgtggcacagggcatcccgttccagcagcaccaattcgataaaaatgttttccagctagaacaagcgttcgtgttaagtaagcagagatacccaagccagccacggggcgacactgtggacctagccaagaaaattttcctcaaatactaccctaggtgggtggccggatcatggtag

SEQ ID NO: 191136 - DNA, 450 bp, Artificial Sequence
  Description of Artificial Sequence: Synthetic coding sequence
atggcccggaccgtggtgctgatcaccggctgcagcagcggcatcggcctgcacttagctgtcaggctggcatccgacccaagtcagagttttaaggtttatgccactctccgggacttgaagacacagggtcgtctgtgggaggcagccagggccttagcttgtccccctgggtcactcgagaccttgcagcttgacgtgcgcgattccaagtctgtggcggccgcacgcgaacgagtaactgaggggagagttgacgtgttagtgtgtaacgctggactcgggctgcttggcccgcttgaggctttgggtgaagatgcagtggcctctgtactggacgtgaacgttgttggcactgtgcggatgctgcaggccttcctgcccgacatgaagcgaagaggatctggacgggtcctggttaccgggagcgtcggcggactgatggcctag

SEQ ID NO: 191137 - DNA, 987 bp, Artificial Sequence
  Description of Artificial Sequence: Synthetic coding sequence
atggcccggaccgtggtgctgatcaccggctgcagcagcggcatcggactccatctcgccgtgaggctagccagtgacccctcccaatcatttaaggtctatgccacactgcgggacctgaaaactcaaggcaggctgtgggaggccgctagggctttggcgtgcccccctggctcactggagactcttcagctagatgttagggactcaaaatccgtggccgctgcccgggagcgcgttaccgaagggcgggtggacgtgttagtctgtaatgcaggtctcgggctgttggggcctttggaagcactgggggaagacgctgtcgccagtgtgctcgatgtcaatgtggtgggtacggtgcgaatgctgcaggccttcctgcctgacatgaagcggagaggatccgggagagtcctggtgacaggctctgttggggggttgatgggtctgcccttcaacgacgtgtactgtgctagcaagtttgccctggagggcctctgtgagtcgcttgccgtcctgcttctaccctttggggttcatctcagcctgatcgagtgtgggcctgtgcacacagcctttatggagaaggtgttgggcagtcccgaggaagtcctcgatcgcactgatatccacactttccaccggttctatcagtacttggcccactctaagcaggtgttcagggaggccgcacagaatccggaggaggttgctgaagtattcttaaccgcactcagagccccgaagcccacactgcggtacttcacgaccgagcggttcctgcccctcctacggatgaggctggatgacccaagtggctccaattatgtgactgccatgcacagggaagtgttcggagatgttcctgctaaggccgaggccggagcagaagccggtggcggagctggacccggcgctgaggacgaggcgggaaggggcgccgtgggagatccagagctgggggatcccccagcagctccccaatag

SEQ ID NO: 191138 - DNA, 447 bp, Artificial Sequence
  Description of Artificial Sequence: Synthetic coding sequence
atggcctgcaccgtggtgctgatcaccggctgcagcagcggcatcgggttgcatctcgctattcacttggcactggacccatcccaaagctttaaagtgtatgctacactgcgagatctgaagactcagggcaggctctgggaggccgcacgcgcccttgcttgccctcaagggtcattagaaagactgcagttagatgtgcgcaacagctcaagtcttgccgccgccagagaacgggtcactgaaggccgggtagacgtcctcgtgtgcgatactggtttaggcttgttaggccctctgggggaagacgccgttgcctcagttctggatgttaatgttgtaggaactgtgagagtattgcaggatttcctcccagacatgaaaagaccgggaagcgggagggttttggtgacaggctctatgggcggtctgatgggtgagtggtag

SEQ ID NO: 191139 - DNA, 786 bp, Artificial Sequence
  Description of Artificial Sequence: Synthetic coding sequence
atggccgccgcctgccggagcgtgaagggcctggtggccgtgatcactggcggggcctctgggctcggcctggccaccgctgagcgacttgtgggccaaggagcctcagcagtactgctggacctgccgaatagtgggggggaagcccaggcaaaaaagctcggaaacaactgtgtgtttgctcccgctgatgtgacttccgaaaaagacgtacagacggccctggcactcgccaaaggcaaatttggccgggttgacgtcgccgtgaactgcgccggcattgctgtggcttccaaaacctacaaccttaagaaaggacaaacacacaccttagaggatttccagagggtactagatgtgaacctgatgggcacgttcaacgtcatacgactcgttgcgggagaaatgggacagaacgagccagaccagggcggtcagaggggcgtgatcatcaatactgcctccgtggccgctttcgaaggccaggtcgggcaggccgcatattctgcctcgaaagggggcattgtcggaatgacactgccaatcgctcgggatcttgccccgatcggaatccgcgtcatgacaattgctcccggattgtttggcacaccattactcacatccctacctgaaaaggtgtgtaatttcctcgcctcacaagtcccttttccgagccgccttggagatcccgcagagtatgcccacctggtgcaggctatcattgagaatccctttctgaatggagaggtaatccgcctggacggagccattcggatgcagccctag

SEQ ID NO: 191140 - DNA, 510 bp, Artificial Sequence
  Description of Artificial Sequence: Synthetic coding sequence
atggccgccgcctgccggagcgtgaagggcctggtggccgtgatcacaggcggtgccagtggacttgggcttgccacagccgagaggcttgttgggcagggcgcttccgctgttctcttagatctccccaactctggtggggaagcacaggccaaaaagctaggcaataattgtgtcttcgcccctgccgacgtaacaagtgaaaaagacgtgcagaccgcgctggcactcgccaaaggcaagttcgggagggtagatgtcgccgtcaactgcgctgggatagcggtggcgtccaagacatataatcttaaaaagggtcagactcacactttagaagactttcagcgcgttctggatgtaaacctgatggggacctttaatgtaattcgacttgtggctggggaaatggggcagaacgagccagaccagggcggacagcgaggcgtgattatcaataccgccagcgtcgccgcttttgagggccaagtatgccttgcaccgcattgctag

SEQ ID NO: 191141 - DNA, 759 bp, Artificial Sequence
  Description of Artificial Sequence: Synthetic coding sequence
atggccgccgcctgccggagcgtgaagggcctggtggccgtgatcacgggaggtgcttccgggctcgggttggccaccgcggaacggctggtaggccaaggagcttcagcagtgctcctggacttgccaaatagcggcggcgaggcccaagccaagaagctggggaataattgtgtcttcgcccccgcggatgtgacctctgaaaaagacgtgcagacggcgcttgcactggcaaagggtaagtttggtcgcgtggatgtggctgtcaactgcgccgggattgcagtcgcaagcaagacatataacctcaagaaggggcaaacgcacacactggaggatttccaaagagtgcttgacgtgaatctgatgggaactttcaacgtcattcgcttggtcgcaggagagatgggccagaacgaacccgaccaaggcgggcaacggggagttattataaacactgcgagtgtcgccgcctttgagggacaggttgggcaggccgcttactctgccagtaagggtggcatcgtgggaatgacgttgcccattgcaagagacctcgctcctatcggattattcggcacccctctgctgacctctctgcctgagaaggtctgtaatttcctcgcttcacaggtgccattccctagtcggttgggcgaccctgcagagtacgcccatctggtgcaggccattatcgaaaacccctttctcaacggggaagtcatccgactcgatggtgctattagaatgcagccctag

SEQ ID NO: 191142 - DNA, 903 bp, Artificial Sequence
  Description of Artificial Sequence: Synthetic coding sequence
atgaagttcctgctggacatcctgctgctgctgcccctgctgatcgtttgtagtctggagagtttcgttaaattgttcattccaaagcgccgaaaatcagtcactggcgagatagtcttaatcacaggtgccggacatggaatcgggagactcaccgcctatgagtttgcgaaattgaagtcaaaacttgtgctgtgggatattaacaagcacggactcgaggagactgctgccaaatgtaaggggcttggggcgaaagtgcacacatttgttgttgactgctcgaaccgggaagacatctattcgtcggcaaaaaaggtgaaggctgagatcggcgatgttagcatcctggttaataacgccggggtggtgtatacatctgatcttttcgccacccaggaccctcagatcgagaagacatttgaggtgaacgttctggctcacttctggaccacgaaggcatttcttcccgccatgacaaaaaacaaccatgggcacattgtgactgtcgccagcgctgcaggacacgtcagcgtgccttttctcctggcctattgtagctcgaagttcgcggcagtcggattccacaagaccctgactgacgaattggctgcgctccagattacaggggttaaaacaacctgtctgtgtcccaattttgtgaatactgggttcatcaagaacccttccacatcactgggacccaccttagagcctgaggaggttgtcaacaggcttatgcacgggatattaaccgagcagaaaatgattttcataccgtcgtcgattgcattcctcactacgctcgaacggatcctccccgagcgctttctcgccgtcctgaagcaaaagattagtgtgaagtttgatgcagtgataggttacaaaatgaaggcccagtag

SEQ ID NO: 191143 - DNA, 795 bp, Artificial Sequence
  Description of Artificial Sequence: Synthetic coding sequence
atgaacatcatcctggagatcctgctgctgctgatcaccatcatctactcctatctcgaatccttggttaagttcttcattcctcagcgccgcaagtccgttgctggcgaaattgttctcatcaccggtgctgggcatggcatcggtcgccagaccacctatgagtttgcaaaaaggcagagtatcctagttctctgggacattaataaagttaagaaagaggtcggggacgtcaccatcgtggtgaacaatgcaggaactgtgtaccctgctgacctcctgtccactaaggacgaagagatcactaagacttttgaggtcaacatcctcgggcacttttggatcactaaggccttgcttccctccatgatggagagaaaccacggccacatcgtcacagtggcgagtgtgtgtgggcacgagggtatcccatatctgatcccctactgttctagtaagttcgccgctgtgggatttcatcgcggtctaacaagtgagctccaagccctggggaaaacaggtattaaaactagctgcttgtgccctgtctttgtgaatactggctttacgaagaacccgagcacccgcctctggcccgtgctcgaaacagacgaagtggtgcgtagcctaatcgacggcatcctgacaaataaaaaaatgattttcgtcccttcttatatcaatatttttttaaggttgcaaaaattcttgcccgaaagggcatccgccattttaaacaggatgcagaatatccagtttgaagcagtagtgggccataagattaagatgaaatag

SEQ ID NO: 191144 - DNA, 903 bp, Artificial Sequence
  Description of Artificial Sequence: Synthetic coding sequence
atgaacatcatcctggagatcctgctgctgctgatcaccatcatctactcataccttgagagtttggtgaaatttttcatcccgcagagacgtaagagtgttgccggagaaatagtgctcattactggagcgggtcacggcatcgggaggcagaccacctatgaatttgcaaaaagacaatctatcctagtgctttgggatatcaataagaggggggtggaagagaccgcagccgaatgcaggaaactgggggtgacagcccatgcatatgttgttgactgctcaaacagggaggagatttaccgcagcctgaaccaggtgaaaaaagaggtgggggatgtaacgatcgtggttaataacgccggtacagtgtacccggccgacttgctgtccaccaaggatgaggagattaccaagacgtttgaagtcaatatcttgggtcatttttggatcacaaaggccctgttgccatcaatgatggaaaggaaccacggccacattgtaaccgttgctagcgtgtgcggtcacgaagggatcccttatctgattccttattgttctagtaaatttgccgctgtcgggtttcaccgaggcctcacttcagagctgcaggcacttggcaaaaccggcataaagacttcttgtctctgcccagtattcgtcaatacagggttcaccaaaaacccttcgacgcggttgtggcctgtcctggagaccgatgaggttgtgagatctctcatcgacgggattctgaccaacaaaaagatgatatttgtaccttcttatattaacatattcctgcgcctacaaaagttcttgccagagagagccagcgcaattctgaacaggatgcagaatattcaattcgaggctgttgtgggccacaagataaagatgaagtag

SEQ ID NO: 191145 - DNA, 813 bp, Artificial Sequence
  Description of Artificial Sequence: Synthetic coding sequence
atggccaccggcacccggtacgccggcaaggtggtggtggtgaccggcggaggtcgtggaattggagctggcatcgtacgggcgtttgtaaatagcggagcaagagtggtaatctgtgataaggatgagagcggaggacgggctctcgaacaggagcttcctggcgcggtctttatactgtgcgatgtgactcaagaggatgatgttaaaaccctggtgagcgagactatccgtcgcttcggccgcctggactgtgtggtcaacaatgcgggacaccacccgcccccgcagaggccggaagagacttctgcgcagggctttagacaactgctggagcttaacctgctcggcacttacacactcacaaagttagccctcccctatttgaggaaatcacagggaaacgttatcaacatctcgtcgctggttggagctatcgggcaagcacaggcagttccatacgtcgcaaccaaaggcgccgtcaccgcgatgactaaagcattagccctcgatgaatcaccatatggagtgagggtgaactgtatctctcccggcaatatatggacacctctgtgggaagagctggccgcgctcatgcctgatcctcgggccaccatcagggaaggtatgctcgctcagcccctaggccgcatgggccagccggccgaagttggtgccgccgccgtgtttcttgcctcagaggcaaatttttgtactgggatcgagctgttggtgaccggaggtgccgagctgggctacggctgcaaagccagcagatctacgcctgttgatgcacccgacattccctcctag

SEQ ID NO: 191146 - DNA, 1164 bp, Artificial Sequence
  Description of Artificial Sequence: Synthetic coding sequence
atgagcaccttcttcagcgacaccgcctggatctgcctggccgtgccaaccgtactatgcggcacagtcttttgcaagtacaagaaaagtagcggccagctgtggtcttggatggtgtgtttggctggactttgcgccgtctgcttgctcatactcagtcccttctgggggttgatactgttttcagtctcttgttttctgatgtacacgtatctgagtggccaggagttgttaccagtcgatcagaaggccgttctggtgacaggcggcgattgtggcctggggcacgccctgtgcaagtatctagacgaactgggttttactgtattcgcaggtgtgctgaatgagaatggacccggagccgaagagctcagaaggacttgctcacctagactctctgtgctgcagatggacattaccaaacctgtgcagatcaaggatgcctatagcaaagtagccgccatgttacaagaccgaggactctgggcagtgattaacaacgccggggtcctcggcttcccaacggacggggaactcctgctgatgactgattataagcagtgcatggctgtgaatttttttgggaccgtggaggttacaaagactttcctgcccttgctcaggaagagtaagggccggcttgttaatgtgagttccatgggcggtggcgcgcccatggagcgcctggcctcatacggtagcagtaaggcagcggttacaatgtttagctctgtcatgcgactcgagctctctaaatggggaatcaaagtagctagtatacagcccggcggctttctgactaatattgctggaacaagtgataagtgggaaaaactggaaaaagacattctggaccatctccccgccgaggtgcaggaggattacgggcaagactacattttggctcaaagaaattttctgctccttatcaattctctggcttcaaaagacttcagccccgtgttgcgagacattcaacacgcgattctagctaagtcaccttttgcttattatacccccggaaagggtgcctacctatggatatgtcttgcccattacttgccaatcgggatttacgactactttgcaaagcgacactttggtcaggacaagcctatgccaagggcactacgtatgccaaattataaaaagaaagccacatag

SEQ ID NO: 191147 - DNA, 783 bp, Artificial Sequence
  Description of Artificial Sequence: Synthetic coding sequence
atgggcgacgtgctggagcagttcttcatcctgaccggcctgctggtgtgcctcgcctgcctggctaagtgtgtgagattctcccgctgcgtgcttttaaactactggaaggttctgcctaagtcatttctgagaagtatgggacagtgggccgtgataactggggctggtgatgggatcgggaaagcctatagctttgaacttgctaagcggggtctgaatgtggtgctgattagccgcacactggagaagcttgaggccattgccaccgagatagagcggactacaggtcgtagcgttaagatcattcaagctgatttcactaaggatgacatttacgagcacatcaaagagaaattggcaggcctggagatcggtattttggtgaacaatgttggcatgttgccaaatctgctgccatcacactttctgaatgcccctgatgaaatccagagcctcatccattgtaatatcacaagtgtggtcaagatgactcagctaatactaaagcacatggaatccaggcaaaaaggactgattctcaacatctcttctgggatagcccttttcccttggcctctctactctatgtattctgcctcaaaggccttcgtatgtgctttttcaaaggcacttcaagaggagtataaagctaaggaagtgatcatccaagcaggatttttgtctctgattcctgcctgggccttctacagtggggcctttcagaggctactcttgacgcattacgtggcttacctgaagctaaacactaaggtgcgctag

SEQ ID NO: 191148 - DNA, 933 bp, Artificial Sequence
  Description of Artificial Sequence: Synthetic coding sequence
atgggcgacgtgctggagcagttcttcatcctgaccggcctgctggtatgcctcgcatgccttgctaaatgtgtgagattcagcagatgtgtcctgctgaactactggaaagtgctgcctaagagcttcctgcgatctatgggccagtgggctgtgattactggggcgggtgacggaatcggaaaggcgtatagcttcgaactcgccaagagaggactcaatgtggtgctaattagcaggacactcgaaaagttggaagcaattgctaccgagattgaaagaactaccggcagaagcgtgaagattatccaggctgatttcaccaaagacgatatctacgaacacatcaaagagaagttagctggactggagataggcatcctggtgaataacgtgggcatgctgccaaatctactgccgtcccactttctgaatgcccccgacgagatccagtctctgattcactgcaacataacgtccgtggtgaaaatgactcagctgatcctgaagcatatggaaagtcggcagaagggcctgatactgaacatctcatccggcatcgccctttttccatggccactttactccatgtattcagcctcgaaggcctttgtgtgtgcgttttcgaaggctttacaggaagaatacaaagccaaagaagttattattcaagtgctgactccttatgccgtgtctaccgctatgacaaagtacctcaatacgaatgtgatcacgaaaaccgcggatgaatttgtgaaagaatctttgaactacgttactatcgggggggaaacatgcggctgcctggctcatgaaattctggcaggattcttgtcactcatccccgcctgggcgttctattcgggtgctttccagcgcctgttactgacccactacgtcgcttatctaaagcttaacacaaaggtgaggtag

SEQ ID NO: 191149 - DNA, 2211 bp, Artificial Sequence
  Description of Artificial Sequence: Synthetic coding sequence
atgggcagccccctgcggttcgacggccgggtggtgctggtgaccggcgcaggcgctgggctgggtagagcttacgcgctggcgttcgccgaacgtggggctctcgtggtcgtcaacgacctgggtggcgattttaagggggtcggaaaggggtcacttgcagctgataaagtcgtagaagaaatccggaggaggggcggaaaagccgtcgccaactatgactccgtcgaggaaggcgagaaggtcgtgaagactgccctggatgcattcggcaggatcgatgtggtggtgaacaacgccggcattctgagggatcgcagctttgcacgcatctcggatgaagattgggacatcatccaccgggtgcacctgcgaggatcttttcaggttaccagggccgcttgggagcacatgaaaaaacagaaatatggccggatcattatgacgagttctgcaagcggtatttacggcaactttggtcaggcaaattactccgctgccaagcttgggctgttaggcctggccaactctctggcaatcgagggcaggaaatcaaatattcactgtaatactattgcccccaatgccggatcacgcatgacacagacggtgatgcccgaagacctggtggaggcactgaagccagaatatgtcgcacccctcgtactctggctgtgtcacgagtcctgtgaggaaaatggtgggctgttcgaggtgggcgcaggctggataggtaagctgcgctgggaaaggacccttggcgcaatcgtcagacagaagaatcaccctatgacacctgaggcggtaaaggctaactggaagaaaatttgtgactttgaaaatgcctcaaagccccagagcattcaggagagtaccggcagcataatcgaagtactctccaagattgattctgaggggggcgtctcagcaaatcacacctctcgggcaaccagcacggcaaccagcggctttgccggagctatagggcagaaactcccacccttcagctatgcatatacagagctggaagctatcatgtacgccttgggtgtgggcgcatcaatcaaagacccgaaggaccttaaatttatctacgaaggaagcagcgatttctcttgtctacctaccttcggtgtgataataggccaaaaatctatgatgggcggaggcctggctgaaataccaggactctctatcaatttcgctaaagtgctccacggggagcaataccttgagctctacaagcctctccctcgcgccgggaagcttaagtgcgaagccgtggtggctgatgtactcgacaagggcagtggcgtggtgataattatggatgtctactcatactcagaaaaagagcttatctgccacaaccagttctcactctttctggtaggctcggggggctttggtggcaaaagaacaagcgataaggtgaaggtcgccgtggccattcccaaccgcccccccgatgctgtactgacagatacgaccagcttaaatcaagcggctctgtatcgcctgtctggcgactggaatccactgcacatagatccaaatttcgcttcactcgcggggtttgataaaccgatactgcacggcttgtgtaccttcgggttctctgcgagaagagtgctgcaacagttcgcagataacgatgtctcccggttcaaagccattaaggccaggttcgctaagcccgtatatcccggtcagacgctccaaacagagatgtggaaggagggcaaccgaatacatttccagaccaaagtgcaagaaaccggagacatcgtgatctccaacgcctacgtggaccttgcgcccactagcggaacatctgctaagactccatctgaaggcggaaaattgcagagcacttttgtgttcgaagaaattggcaggcgactgaaggatattggccccgaggtggttaaaaaagttaacgcagtgtttgagtggcacattactaagggaggaaatattggtgccaagtggacaatcgaccttaagagtggtagtggaaaggtgtaccaggggccagccaagggagcagcagacactaccattatcctgtcagacgaggactttatggaggttgtgctggggaaactagacccgcagaaggccttttttagtggacgactgaaagcccgggggaacatcatgttgtcacagaaattacagatgatcctgaaggattatgcgaaactgtag

SEQ ID NO: 191150 - DNA, 2286 bp, Artificial Sequence
  Description of Artificial Sequence: Synthetic coding sequence
atggtgatcctggaggccccccacctgctgcggcggaaggagcccgaaactcctggtttaagctcccgtatcggtccatcactctgccctggcttttgtcgcaagcgatccgtgtcctgttgtttccagaatctgtgcaacaaccctatggagaaaattatatcccaatgtaggtttttcgtttcaatgaatgatctcggtggcgattttaaaggcgtcggaaaaggctccctggccgctgataaggtagtagaggaaatacggagacgcggtggtaaagctgttgccaattacgatagtgtggaggagggtgagaaagtggttaaaactgcccttgatgcctttgggcgcattgatgtggttgttaacaatgctggaatcctgcgggatagatcatttgctagaatttccgatgaggactgggatatcattcatcgagtccatctaaggggcagtttccaggtgaccagggccgcctgggagcacatgaagaaacagaagtatggccgaataattatgaccagtagcgctagcggaatctacggaaactttgggcaagcaaactactctgcagctaagctaggtctacttgggctggccaattccctggccatcgagggtaggaagagcaacattcattgtaacacgatcgcccctaacgccgggtctaggatgacccagacagtcatgccagaggatctggtggaggccctcaagcccgagtacgtagctcctctggtgctctggctctgtcacgagagttgcgaagaaaacggcgggttattcgaggtgggcgcagggtggataggcaaacttcgctgggaacgtaccttaggtgccatcgtgcggcagaagaaccaccctatgacacccgaggctgttaaagccaactggaagaagatctgcgacttcgaaaacgcaagcaagccccaatccatccaggaatctacaggcagcattatcgaggtactgtcaaagatagacagcgagggcggagtctcagctaaccacacctcccgggctacatccaccgcaaccagtgggtttgctggcgccataggtcagaaattaccccctttctcttacgcttacacagagttagaagccatcatgtacgctctgggcgttggcgccagcatcaaagacccaaaggatctcaagtttatctacgaagggtcaagcgacttctcatgcttacctacctttggcgtgatcatcggacagaaatctatgatgggaggcggactagccgaaatcccagggctcagcatcaatttcgccaaagtcttgcacggtgagcaatacctggagttgtacaagcccctgcccagagctgggaagctcaagtgtgaggcagtggttgccgacgtgcttgacaagggtagcggcgtcgttataataatggacgtgtattcctatagcgagaaagagctgatatgtcacaaccaatttagcctcttccttgtgggaagcggtggctttggaggaaaaagaactagtgataaagtgaaggtggctgtggccatccctaacaggcccccagacgccgtcctgacggatacgacttcgctcaaccaggcagccctataccgtttgagtggggattggaacccgctgcatatcgaccctaacttcgcctctctggccgggttcgacaagccaattctgcatgggctgtgcacctttggattctcggcccggagagtgctccaacaattcgccgacaacgacgtttcacgattcaaagccattaaggcacgttttgcgaagcccgtgtatccggggcagaccctgcagactgaaatgtggaaggaaggcaatcgaatccacttccagacgaaggtgcaggagacaggtgatatcgtgatctccaatgcatacgttgatttagcacctaccagtggcacaagtgctaagaccccgagcgagggaggcaaactccagtcaacattcgtgttcgaagagatcggtcggaggttgaaagatattggccctgaagtggtgaaaaaggtcaatgccgtatttgagtggcacatcacgaagggcggcaatataggagccaaatggacgattgatctgaagagtgggagcggaaaggtctatcagggcccggctaagggggctgccgacactacaattatcctgtccgacgaggactttatggaagttgtactgggaaagctggacccgcagaaagcctttttttctggacgactcaaggctagggggaatatcatgctgtcgcagaagcttcagatgattctgaaggactacgccaaattgtag

SEQ ID NO: 191151 - DNA, 2139 bp, Artificial Sequence
  Description of Artificial Sequence: Synthetic coding sequence
atggagaagatcatcagccagtgccggttcttcgtgagcatgaacgacctggggggagattttaagggagttggcaaaggtagtctcgccgcggataaagtagtagaagagattcggcgcagaggtgggaaagccgtggccaactacgactcggttgaggaaggtgagaaagtggttaagactgcgctggacgctttcggcaggatcgatgtggtggttaataacgctggtatattgcgcgatagatccttcgcccgtatcagcgacgaagattgggacataattcacagggtgcacctgagggggagcttccaggttaccagggcagcctgggaacacatgaaaaagcagaagtatggacggattatcatgacatccagcgcatctggcatttatggcaactttggacaggcaaattacagcgccgctaaactggggctgctgggtttggccaattctctcgccatcgaaggccggaaatccaatatacattgcaacaccatcgctccaaacgccggatctaggatgactcagactgttatgcctgaagacctcgtggaggcactgaagccagaatacgtggctcctctggtattatggctctgccatgaatcgtgcgaagaaaatgggggtctgttcgaggttggcgccggttggatcggcaagctaagatgggagagaaccctgggcgccatagtgcgccagaagaatcacccaatgacccccgaagccgttaaggcgaattggaaaaaaatttgtgacttcgagaacgcatctaaaccacagtctatccaggaatcaaccgggtcaattattgaagtgttgtccaaaattgattccgagggaggcgtctccgccaatcatacttcacgggcaacgtcaactgctacaagcggctttgctggggcgattggacagaagctgcctcctttctcttatgcctataccgagctcgaagcgatcatgtatgccctcggagtgggagcgagcatcaaagatcccaaggacctgaaatttatttatgaaggaagctctgacttctcatgcctccccacattcggcgttatcatcggccagaaatcaatgatgggtggcggccttgccgaaatccccggcctctcaatcaacttcgcaaaggtgctgcatggcgagcaataccttgaattatataaaccccttcccagagcaggaaagctgaaatgtgaagccgtggtggcagacgtgctggacaaaggctctggcgttgtgatcataatggatgtgtactcctacagcgagaaggaattgatctgtcataaccagtttagcttgttcctagttggttctgggggcttcggcggcaagagaacctccgacaaagtgaaagtcgccgtggcaatccccaatcgcccacctgatgcagtgttaaccgacactacatcgctgaaccaggccgctttgtatagactgtccggcgactggaatcctctgcacattgatcccaactttgcgtctttggctggcttcgacaagcccatcctccacgggctgtgcaccttcgggttctctgccaggagagtgttacagcagttcgccgataatgacgtgtcgaggttcaaagccataaaggcccggttcgcaaagcctgtatatcctggtcagaccctacagacagagatgtggaaggagggcaatcggatccattttcagactaaagttcaggagaccggcgacatcgttataagcaatgcctacgttgatctggcaccaaccagcggaacctccgccaagacaccatctgagggtggaaaactccagtctacttttgtgtttgaggagataggcagacgcctgaaagatatcggcccagaggtagtgaaaaaggtgaacgccgtctttgaatggcacatcaccaaagggggaaacatcggagctaagtggactatcgatctgaagagtggcagcgggaaggtatatcaagggcctgccaagggtgccgcagataccactatcatcctctctgacgaagatttcatggaggtggtactcggcaagctggacccccagaaggcctttttcagcgggcgtctcaaggcacgaggtaacattatgctcagccagaagttgcagatgattctgaaggactacgccaagctgtag

SEQ ID NO: 191152 - DNA, 1800 bp, Artificial Sequence
  Description of Artificial Sequence: Synthetic coding sequence
atgaagaagcagaagtacggccggatcatcatgaccagcagcgccagcggaatctacggcaattttggccaggcaaattacagcgccgcgaaactcggtttattggggctggctaattctttagctatagaaggcagaaaaagcaatatccactgcaatactatcgcccccaacgccgggagccggatgactcagacagttatgccagaagacctggtggaggccttaaagcctgaatacgtcgcgccgcttgttctctggctctgtcacgagtcatgtgaggaaaacggaggtctctttgaggtcggagctggatggatcggaaaacttaggtgggaacgaacacttggagccatcgtacgccagaaaaaccatcctatgactccagaagccgtgaaggccaattggaaaaagatctgcgacttcgagaacgctagtaaaccacagtctatccaagagagcaccggttccatcatcgaagttctgagtaagatcgactctgagggtggagtttccgctaatcacacctcaagagctacttctactgcaacgagcggctttgccggagctattggtcagaaactgcctcccttttcatatgcttacaccgagttggaggccataatgtatgcactgggagtgggggcaagtattaaagatcctaaggaccttaaatttatttacgagggttcctcagactttagctgcttgcctacatttggggtgattattggacaaaaaagcatgatgggaggggggctggctgaaattccggggctgagcatcaatttcgctaaggtgttacatggagagcagtatctcgagctgtacaaaccgctcccaagggcaggtaaactgaagtgtgaggccgtggtggcagacgtgctcgacaaggggtctggcgttgttatcattatggacgtgtactcttacagcgagaaagagctgatctgccataaccaattttccctgttccttgtggggagtgggggctttggtggtaagcgcacttcagacaaggttaaggtcgctgtagccattcccaacaggcctcctgacgcagtgctcactgatacgaccagcctcaatcaggctgcactctatcggttgtctggtgattggaaccctctccacattgacccaaactttgcttcactcgccgggttcgacaagcccattctgcacggactgtgtacattcggcttctctgcccgaagggtgcttcagcagttcgccgataatgacgtctcccgttttaaggctataaaggcccggttcgcaaagccagtgtacccagggcaaacactccagactgaaatgtggaaagaggggaacagaattcacttccagactaaggtacaagagacaggcgacattgtcatcagcaacgcatacgtggatctggcacctacatccgggacaagcgcaaagacaccatctgagggcgggaagctccagtctaccttcgtcttcgaggagatcggacgacgtctgaaagacatcggccctgaggtggtcaagaaggtcaatgcggtgttcgagtggcacatcaccaagggcgggaatatcggagcaaagtggaccatcgacttgaagtcagggtccgggaaagtctaccaggggcctgctaagggtgccgctgacaccactattatcctgtcagatgaagattttatggaagtcgtgctgggtaaacttgatccccaaaaggcctttttctcaggaaggctgaaagctaggggtaacataatgctctcacaaaagctgcagatgatcctgaaagattatgcaaagctgtag

SEQ ID NO: 191153 - DNA, 2157 bp, Artificial Sequence
  Description of Artificial Sequence: Synthetic coding sequence
atgggcagccccctgcggttcgacggccgggtggtgctggtgaccggtgcaggcgccgtgaacgacctgggaggtgattttaagggggttggcaaaggttccctggccgccgataaggtggtcgaagaaatcagaaggcggggcggaaaagctgttgcaaattatgacagtgtagaggaaggggagaaggttgtgaaaaccgctctcgatgctttcggcaggattgacgtggttgtcaataatgccggtattctacgcgatagatcttttgccaggattagtgacgaagattgggatatcattcatcgcgtacaccttcgcgggtcattccaggtgacccgggccgcgtgggaacacatgaaaaaacagaagtatggaagaataattatgacctcctcagccagtggcatctacgggaattttgggcaagcaaattactccgccgccaaacttggcttactgggtctagccaatagcctagccatcgaaggtaggaagtctaatatacactgcaataccatcgccccaaatgccggatccaggatgacacagactgtaatgcctgaagatctggtcgaagccctgaagcctgaatacgttgcaccactggtgttatggctgtgccacgagagttgcgaagagaacggtggtcttttcgaggtgggcgctggctggattggcaagttgaggtgggagagaactcttggcgctattgttcgacagaaaaatcaccctatgactcccgaggccgtcaaggcaaattggaagaaaatctgtgatttcgagaatgcaagcaagccacaaagcattcaggaatctaccggcagtatcattgaggttctatctaagatcgattcagaaggaggggtgtccgcaaatcatacttcacgtgccaccagcactgctactagcgggtttgcaggagctatcggccagaaattgccgccttttagctatgcgtataccgaacttgaggccatcatgtacgccctcggagtcggagcttctattaaggatccaaaggatcttaagttcatatacgaaggtagctccgacttctcttgtctccccacctttggcgtcatcatcggacagaaaagtatgatgggtggcggattagctgagatccccggactctccattaatttcgccaaggtcttgcacggagaacagtacctggaactgtataagcccttaccccgggcaggcaaacttaaatgcgaggccgtcgtggccgacgtgctggacaaagggtccggagtggtgattattatggacgtgtactcctatagtgagaaggaactaatatgtcataatcagttctccctctttctagtgggcagtggtggattcggcggcaaaagaacatctgataaagtgaaagtagctgtggctattcctaacagacctcctgatgccgtcctgacagatacaacctccctgaatcaggccgcgctgtaccgcctatccggggattggaatcctcttcacatcgatccgaattttgcatcactcgcgggctttgacaagcccattttgcacggactgtgcacctttgggttcagcgcccgcagggtgctccagcagtttgcagacaacgatgtcagccgcttcaaggccattaaggcccgctttgcaaagcccgtgtatccaggtcagaccctccagaccgagatgtggaaggagggcaaccgcattcacttccagacgaaggtgcaggaaacaggagatattgtcatttctaatgcttacgtcgatctggcccccactagtgggacgtcagccaaaactccctcggaggggggaaagttgcagtccacctttgtgttcgaggagattggccggcgactgaaagatatcgggcctgaggttgtgaaaaaggtcaacgccgtatttgagtggcatattacaaaggggggcaacattggggctaaatggaccatcgatcttaaatcagggtctggcaaggtgtatcaggggccggcaaagggcgctgccgatacaacgatcattttatccgacgaagatttcatggaagtggtgttgggcaaactggatccacagaaggcattcttcagcgggcgcctcaaggcaagaggcaatatcatgctcagtcagaagctccagatgatacttaaagactatgccaaactgtag

SEQ ID NO: 191154 - DNA, 1026 bp, Artificial Sequence
  Description of Artificial Sequence: Synthetic coding sequence
atgcggaaggtggtgctgatcaccggcgccagcagcggcatcggcctagcactgtgtaagcggcttttggccgaagatgatgagctccacctctgtttggcttgccgtaatatgtcaaaggcggaggcggtgtgcgccgccctactcgcttcacatccaaccgctgaagtgaccattgtgcaggtggacgtatccaacctgcaatccgtttttcgcgcaagtaaagagctgaagcagaggttccaaagactggactgtatctacctcaatgccggaattatgccaaacccgcagctgaatatcaaagctctgttctttgggctcttttcccgtaaagtgattcacatgttctccactgccgagggccttctaacccaaggcgataaaatcacagctgatggcctgcaggaggtttttgaaactaacgttttcgggcactttatacttatcagggaactggagccgctgctgtgccacagcgataatccgagccagttgatttggacatcctctcgatctgctaggaagtctaactttagtctggaggactttcaacattccaaaggaaaggaaccgtacagcagtagcaagtacgcaacagacctgctgagcgtcgctctgaatagaaattttaatcagcaggggctgtacagtaatgtggcttgtccgggaaccgccctgacaaatctgacttacgggattcttccacccttcatttggacactccttatgccggccatcttattgctgaggttcttcgcaaacgcatttaccctaacaccatacaatgggactgaagctctggtatggctctttcatcagaagcctgagagtctgaatcccttaattaagtatctgtctgctaccaccgggtttggccgaaactatattatgacacagaagatggacttggacgaagataccgcggagaagttttatcagaagctgttggagctcgagaaacatatccgggtaacaatccagaaaactgacaatcaagccaggctgtcaggcagttgcctgtag

SEQ ID NO: 191155 - DNA, 336 bp, Artificial Sequence
  Description of Artificial Sequence: Synthetic coding sequence
atgcggaaggtggtgctgatcaccggcgccagcagcggcatcggccttgctttgtgcaaaaggctgctggctgaagacgatgaactgcacctttgcttagcctgccggaacatgtccaaagcagaggccgtctgtgctgcactcttagcatctcaccccacagccgaggtaaccatagtacaggtggacgtgagcaacctgcagtctgtgtttagggccagtaaggagttaaagcagaggttccagaggctggactgtatctatttgaatgccggcatcatgccgaatcctcagttaaacattaaggccctcttcttcggattgttttctagttag

SEQ ID NO: 191156 - DNA, 255 bp, Artificial Sequence
  Description of Artificial Sequence: Synthetic coding sequence
atgcggaaggtggtgctgatcaccggcgccagcagcggcatcggccttgctttatgtaaaaggttattagccgaggatgatgaacttcacctttgcctcgcctgtcggaacatgtccaaggcagaagcagtttgcgcagccctgctggcttcccatcccacagccgaggtgaccattgttcaggtggatgtgtctaacctgcagtccgtgtttcgtgcatcgaaggaattgaagcagcgttacattagctgctag

SEQ ID NO: 191157 - DNA, 921 bp, Artificial Sequence
  Description of Artificial Sequence: Synthetic coding sequence
atgcggaaggtggtgctgatcaccggcgccagcagcggcatcggcctagctctgtgtaagaggctcctcgccgaggatgacgagcttcatctatgcttggcctgcagaaacatgagcaaggccgaagccgtgtgcgcagcacttctggcaagtcacccgacagctgaggttaccatcgtgcaggtcgatgtctctaacctccagtctgtgttcagggcatctaaggaacttaaacagagatttcagagactggactgtatctacctgaatgccggaataatgcctaacccccagcttaacataaaagctcttttttttggacttttcagcaggaaagtaattcacatgttcagcaccgccgagggcctgctgacgcagggagataagatcacagctgatggtctgcaagaagtattcgaaaccaacgtatttgggcattttatcctgattcgggagctcgaaccactgctgtgccattccgacaatccatctcagttgatctggactagctcacgatctgcgcgaaagagtaatttctccttagaggacttccagcactctaaggggaaggaaccttatagcagctctaaatatgcgacagacctactgtcggtagcccttaacaggaatttcaatcagcaactgagatttttcgccaacgctttcactctgacgccttataatgggacggaggcactggtgtggctcttccaccagaagcccgaaagcctgaaccccctaattaagtacctgtcagccacaacaggattcggtcgcaattatataatgacgcagaaaatggacctcgatgaggatactgccgaaaagttttaccaaaagctacttgagctcgagaaacacatccgtgtgacgattcagaaaactgataaccaggcccgtctgagcgggagctgcctgtag

SEQ ID NO: 191158 - DNA, 360 bp, Artificial Sequence
  Description of Artificial Sequence: Synthetic coding sequence
gtggtgatccgggagctggagcccctgctgtgccacagcgacaacccttcccagctgatctggactagcagccggagtgcccgcaagtcaaacttctctctggaggacttccagcactcaaagggaaaggaaccatacagctcatctaagtacgccacagacctgcttagtgtcgcacttaacagaaacttcaaccagcagcttagattttttgcgaatgcttttaccctgacaccatataacggcacagaagctctggtgtggctgttccaccagaagcccgaatctctcaatcccctcatcaaatacctgagtgcaacaactggctttgggcgtaactacatcatgacccagaagtag

SEQ ID NO: 191159 - DNA, 966 bp, Artificial Sequence
  Description of Artificial Sequence: Synthetic coding sequence
atggagcggaagaaccagaccgccatcaccgagttcatcatcctggggttctctaacctgaatgagtggcagtttctcctattcaccatcttctttcttacttatttctgtaccttaggaggcaatatccttataattctcacgaccgttacagaccctcatctgcatacccctatgtactacttcctggggaacctagcctttattgacatttgctacacgacctcaaatgtcccccaaatgatggtccacctgctttcgaagaaaaaaagcatctcttatgtcggatgtgtggtccaactgttcgcttttgttttctttgtggggagtgagtgcttgctcctggctgcaatggcgtatgatcgctacatcgctatttgcaatccactgagatatagcgtgattctgtccaaggttctgtgtaaccaactggccgcttcctgctgggccgcaggcttcctgaatagtgtagttcataccgtactgacattctgcctgccattctgcggcaacaaccagatcaattactttttttgcgatatccctccccttctaatactgtcctgtggcaacactagtgtgaacgagcttgccttgctcagtaccggagtcttcataggatggacaccattcctgtgcatcgtgctatcatatatctgcattatttctacaatcttgagaattcagtcatctgaagggagacgtaaggcgttttccacctgtgcctcccacttggcaattgtgtttcttttctatggtagcgcaatttttacctatgttcgccctatctcgacctacagtctcaaaaaggacagactagtaagcgtcctatacagtgtcgtcacaccgatgctcaaccccattatttacactctcagaaataaagatattaaggaagccgtcaagaccatcggctcaaagtggcaacccccaattagcagtttggacagtaagctgacctattag

SEQ ID NO: 191160 - DNA, 786 bp, Artificial Sequence
  Description of Artificial Sequence: Synthetic coding sequence
atggccagccagctgcagaaccggctgcggagcgccctggccctggtgaccggtgctggttctggcattggaagagcagtgtctgtacgcttggccggtgaaggggccacagtggccgcctgtgatctcgatagggcagcagcccaggagacagtccggctcctcgggggaccaggcagcaaggagggccctccacgcggcaaccacgccgcgttccaggcggatgtgtcagaggccagggcggcccgatgcctgctagagcaggtgcaggcgtgcttttccagacccccatctgtggtagtttcctgcgcagggattacacaagatgaattcctgctccacatgtctgaggatgattgggataaagtgatcgccgtaaacctgaagggaacatttctggtgactcaggccgctgctcaggccttagtcagcaacggctgccgcggctcaatcattaacataagctccatcgtcggaaaggtaggcaatgtgggacagacgaattacgcagcgtctaaagctggcgttattgggctgactcagaccgcagcacgagaactcggccgccacggcatcagatgcaattccgtgctccctggattcattgctactccaatgactcagaaggtcccacagaaagtggtggataagatcaccgagatgattcccatgggacatctgggtgaccccgaggatgtagctgatgtggtggcgtttcttgctagcgaggactcaggttacataactggcacttcagtcgaggttaccgggggtctattcatgtag

SEQ ID NO: 191161 - DNA, 786 bp, Artificial Sequence
  Description of Artificial Sequence: Synthetic coding sequence
atggccagccagctgcagaaccggctgcggagcgccctggccctggtcacgggtgctggcagcggaattggccgagctgtatcagtgcgcttagccggagagggggctactgttgcagcatgtgacctcgacagagcagccgcccaagaaaccgtgaggcttctcggaggaccgggctccaaggagggcccaccgaggggtaaccacgcagcctttcaggccgatgtgtcagaagcacgtgcggctcgctgcctgctggagcaggtgcaggcgtgtttttcccgcccaccctctgtagtggtgtcctgcgcgggcatcacacaagacgaatttctcctgcacatgagtgaagacgattgggataaggtgatagcagtgaaccttaagggtacattcctggttactcaagccgctgctcaagccctcgtcagcaatggctgcagagggtcgataatcaatatttcctccatcgtgggcaaggtcggaaacgtggggcagacaaattatgcagcctctaaggcaggagtgatagggcttacacaaactgccgccagagaattgggcaggcacggcattcgatgcaactccgtgctccccggattcatagccactcctatgacgcagaaagttcctcagaaggtggtcgataagattacagagatgatccccatgggccaccttggagacccagaggacgtggccgatgtcgtggccttcttggctagtgaagattcaggctacattacagggacctcagtggaggtgacaggagggctctttatgtag

SEQ ID NO: 191162 - DNA, 786 bp, Artificial Sequence
  Description of Artificial Sequence: Synthetic coding sequence
atggccagccagctgcagaaccggctgcggagcgccctggccctggtgacaggcgctggttctgggatcggtcgggccgtttctgtgaggctcgccggcgagggcgccactgttgcagcctgcgacctggacagggccgcagcacaagaaacagtcaggctccttggcggacccggctcaaaagagggccctccacgcggcaatcacgccgcctttcaggccgacgtgtccgaagcgcgagccgccagatgtcttcttgagcaggtacaggcgtgtttctcaaggccgcccagtgtggttgtgtcctgtgctggaatcacacaggacgaatttctactgcatatgagcgaggatgattgggacaaagttatcgccgtgaacttgaagggcacctttctcgtgacccaagcagcagcccaggcactggtttctaatgggtgtcgtggctccattataaatatttctagtatagtgggtaaggtgggcaatgttggtcaaacaaactacgcggcatctaaggccggagtgatagggttaacccaaaccgctgctcgcgaactcggcaggcacggtatcagatgtaatagtgtgttgcccggcttcatagccacccccatgactcaaaaagtgcctcagaaagtggtggacaagataacagaaatgatcccaatgggccacttgggtgatcccgaagacgtagccgatgttgtggcgttcctggcatcagaagactctggatatataactggcacttccgttgaggtcaccggaggcctctttatgtag

SEQ ID NO: 191163 - DNA, 786 bp, Artificial Sequence
  Description of Artificial Sequence: Synthetic coding sequence
atggccagccagctgcagaaccggctgcggagcgccctggccctggtcacaggtgccgggtccggaatcggacgagcagtgtctgtccgtctggcgggtgagggtgccaccgtagccgcttgcgatctggaccgcgccgcggcacaggagactgtgagattgttaggtggtccaggaagtaaggaagggccgcctagggggaaccacgccgcattccaagccgacgtctcagaggccagagctgctcggtgtctacttgagcaggttcaagcttgtttctcacgccccccctccgtggtggtgtcatgcgccggcattacccaggacgagttcctcctgcacatgtctgaagacgactgggacaaagtcatcgcagtgaacttgaagggcacattcctggtcacccaggccgctgctcaagcactggtatcaaacgggtgtcgtgggagcatcataaatatctcttcaatcgttggaaaagtaggtaatgtgggccaaaccaactatgctgccagcaaggcgggagtaattgggctgacacagaccgcagctcgcgaactcgggcgacacggtatacgatgcaacagcgttctgcccggctttattgccacccctatgacccagaaggtgcctcagaaggtagtggataagattaccgagatgattccaatgggccacctgggcgacccagaggatgttgctgacgtggtagcgttcctcgcaagtgaggactctggatatatcacaggtacgagcgtcgaggttacagggggcctgtttatgtag

SEQ ID NO: 191164 - DNA, 786 bp, Artificial Sequence
  Description of Artificial Sequence: Synthetic coding sequence
atggccagccagctgcagaaccggctgcggagcgccctggccctggtcaccggtgcgggtagcgggataggtcgcgcggtgagcgttcggctagctggagagggtgctaccgtggctgcctgcgaccttgatagagccgcggcgcaggagaccgtgagactgctcgggggccccggtagcaaagagggtccgccacgtggcaaccatgccgcctttcaggccgatgtgagcgaggcaagggctgcccgctgcctgctggagcaagtacaggcttgcttcagccgccctccttccgtcgtggttagttgtgcaggtattacgcaggacgaatttctgctgcacatgtccgaagacgactgggacaaggtgattgctgttaacctgaaaggaactttcctcgtcactcaggccgctgcacaggctcttgtatctaacggatgccgcgggtccatcatcaacatttcctccattgtcgggaaagtggggaatgtgggtcagaccaactatgctgccagtaaagccggcgtgatcggcctcactcagaccgctgcacgggaattgggccgccatgggatccgctgtaattcagtcttacccgggtttattgccacacctatgacccaaaaggtgcctcagaaggtcgtggataaaatcaccgaaatgatcccaatgggccacctcggagacccggaagacgtcgccgatgttgtggcatttttggcaagcgaggattcaggttacatcactggcacgtccgtcgaagtgactggaggccttttcatgtag

SEQ ID NO: 191165 - DNA, 1848 bp, Artificial Sequence
  Description of Artificial Sequence: Synthetic coding sequence
atggtgagcggccccctggccctgcggtggtgcgcctgggccggcagaggcgacatgggtcccgatatggaacttccatcccattcaaagcagctgctgctgcagctgaatcagcaaaggactaagggctttttgtgcgatgtgatcataatggtggaaaactcgatttttcgcgcccacaagaatgtgttggctgcgtcctcaatctattttaagtccttggtcctgcacgacaatctgattaacctggataccgacatggtctcgtctacagtgttccagcaaatcttagacttcatctatacaggcaaactgctgccgagtgatcaacctgctgaaccaaatttctccacactactgacggcggccagctacttgcagttgccagagcttgctgccctctgccggcggaagctgaagagagccgggaagcctttcggctccggccgggcaggcagcacaggcatgggcagaccccctaggagccagcgcctgtcaactgcaagcgtgatccaggcacgctaccagggcctggtggacggcaggaaaggagctcacgccccgcaagaattgcctcaagcaaaggggtctgacgacgaactttttctgggcggtagcaaccaagattccgtccagggcctgggccgggccgtgtgtcctgccggcggagaggcaggcttgggggggtgtagctcttccacaaacgggtcgagcggagggtgcgaacaggaactcggcctagatctgtctaagaaatccccccctctgccaccagctactcctgggcctcaccttacccccgatgatgctgctcagctctcagacagtcagcacggatcccccccagccgcttccgcacctcctgtggccaacagtgccagctactcagagttggggggaacccctgatgagccaatggacctcgagggggctgaggataaccacttatcgctgcttgaggcgccgggcggtcaaccccgaaaaagtctgaggcactccacaagaaagaaagagtggggaaagaaggagccagttgctgggagtccattcgaaagaagggaggctggcccaaaaggtccctgccccggcgaggagggcgaaggcgtcggagatagggtgccaaacgggattttggcctccggcgccggcccctctggaccgtacggggaacctccctatccctgcaaggaggaggaggagaatggaaaagacgcgtctgaagacagcgcacaatccggctcagagggaggttcaggacatgcatcagctcactatatgtacagacaggaggggtacgaaaccgttagttacggcgataacctgtatgtatgcattccatgcgcgaaaggttttccgtcctccgaacagcttaacgcacacgtcgagacacatacggaggaagagttatttatcaaggaggaaggagcctatgaaaccggatcaggaggagccgaggaagaagctgaagacttgtcagcgccctccgctgcctacaccgcagaacccaggcctttcaagtgttctgtttgcgagaaaacatacaaagaccccgcgacactgcgccagcacgaaaagacccactggctgacccggccgttcccctgcaatatttgtgggaagatgttcacccagaggggtactatgacccggcatatgcgctcccacctgggactgaaacctttcgcctgcgatgagtgtgggatgcggtttacccggcagtacaggctgaccgagcacatgagagtccatagtggagagaagccatatgaatgccagctttgtggcgggaaatttacgcagcagagaaacctcatttcccatttgagaatgcacacatccccaagttag

SEQ ID NO: 191166 - DNA, 1848 bp, Artificial Sequence
  Description of Artificial Sequence: Synthetic coding sequence
atggtgagcggccccctggccctgcggtggtgcgcctgggccggcagaggtgacatgggtcccgacatggagttgccgtctcacagtaagcagctgctgctgcaattaaaccagcaaaggaccaaaggcttcttgtgtgatgtcatcatcatggtcgaaaatagcattttccgagcccataaaaatgtgctggcagcctcatctatctactttaaaagtctcgttctgcacgataatctgatcaacctcgacaccgatatggtcagcagcaccgtgtttcagcagatactggattttatttacacagggaagctactgcctagcgatcagcctgctgaaccaaacttttctaccctgctcaccgccgctagttacctacagctccctgagctggctgccctgtgccgccggaagctaaaaagggcaggtaagccctttggctctggcagagccggaagtaccggcatgggtagacctccgcgcagtcagcggctgagtaccgcctctgtaattcaagccagataccagggcctggtggacggccgcaaaggggcacacgctccgcaagagctgccgcaggctaagggctctgatgacgaacttttccttggagggagtaaccaagattccgtccagggactgggaagagccgtctgtcccgccgggggggaggccggcctgggcggctgttccagtagcaccaacggttccagcggtgggtgtgaacaagagttgggcctggacctgtctaagaagtctccgccactgcctcccgctacccctggaccgcacctgacgcccgatgacgccgcccagctctcagactcgcaacacggtagcccccctgctgcttccgccccacccgtggctaattccgcatcttatagcgaactgggtgggacaccagacgagccgatggatttagaaggagctgaggataaccacctgagcttgcttgaggcacctggaggtcaaccgaggaaatcactgcggcactccacacggaaaaaggaatggggcaaaaaagagcccgtcgcaggaagccctttcgagcggcgtgaggcaggcccaaaaggaccatgtcccggagaagagggcgaaggcgttggagatcgtgtaccaaacggaattctcgcatccggtgcagggcctagtgggccctatggggagcctccttacccatgcaaagaggaagaggagaacgggaaggacgctagcgaggacagcgcccaatccggcagcgagggtgggtcaggtcatgcatctgcacattacatgtatcggcaggaagggtatgagacagtgtcatacggagacaacctgtacgtgtgcatcccctgcgcgaaaggcttcccttcctctgaacagctgaacgcacacgtggagacccacaccgaggaagaactgttcattaaggaggaaggagcctacgaaacgggatccggcggagcagaggaggaggctgaagatctcagtgcgccatccgcagcttacactgccgaaccccggcctttcaaatgtagcgtctgcgagaaaacgtacaaagaccctgccaccctaaggcagcacgagaagacccactggctcaccaggccatttccctgcaatatatgtggcaagatgtttacgcaacgcggtactatgacacgtcatatgagatctcaccttggactcaagcccttcgcttgcgacgaatgtggaatgcgctttacaaggcagtataggctcaccgaacacatgcgcgttcactctggagaaaagccttatgagtgccagctgtgtgggggcaaatttacacagcagcggaatctgatcagccacctgcgcatgcatacgtccccatcatag

SEQ ID NO: 191167 - DNA, 1848 bp, Artificial Sequence
  Description of Artificial Sequence: Synthetic coding sequence
atggtgagcggccccctggccctgcggtggtgcgcctgggccggcagaggtgatatgggccccgacatggagttacctagccactcgaaacagctgctgctgcagctaaaccaacaaaggactaagggattcctatgcgacgttattattatggttgagaatagtattttccgagcgcataaaaacgtccttgctgcaagcagcatctactttaagagcctggtactccatgataatcttatcaacctcgacacggatatggtgtcatcaacagttttccagcagattctagacttcatctacacaggcaagttgctaccttccgatcaaccagcagaaccaaacttttccacccttctgaccgcagcgagttaccttcagctccccgagctcgcggcattgtgccgtagaaaactgaaacgcgccggcaaacccttcggcagcgggcgcgcagggtctaccggcatgggacgacccccccgatctcaacgcctgtcaactgctagtgttattcaggcgaggtatcagggactcgtagacggtcggaagggagctcatgccccacaagagttgccacaagcaaagggtagcgacgacgaactctttctcggcggctcaaatcaggactctgttcagggacttggcagagccgtttgtcccgcaggaggtgaggccggcctcgggggctgctccagctccacgaatggctcctctggtggctgcgaacaggaactggggttggatctgagcaagaagtcaccacctttacccccagctaccccaggtccacatctgactccagatgatgcagctcagctctccgactctcaacatggaagcccccctgccgcaagcgccccacccgtggctaattcagcttcctactctgaacttggaggcacaccagacgaaccaatggatctcgaaggggccgaagataatcacctcagcttgcttgaggccccagggggacagcctcggaaatcactaaggcacagcacccgcaagaaagagtggggaaagaaagagccggtggctggcagtccgtttgagcgaagggaggccggccccaagggcccttgtccgggagaagaaggcgagggggttggagatcgggtgccaaacggcattctggcatccggcgcaggcccatctggcccatacggcgagcctccttatccttgtaaggaggaggaggaaaacggtaaagatgcctctgaggacagtgcgcaaagtgggagcgaaggtggctccggccacgcctcagcacattatatgtaccggcaggagggctacgaaacagtgtcttacggggacaacctgtacgtatgcatcccctgtgcaaagggttttccctccagtgaacagctgaatgcccacgtcgagacccacacagaggaggagctttttatcaaggaagagggggcttacgaaacaggatcagggggggctgaagaagaagccgaagatctgagcgccccctccgccgcctataccgctgaacctcgtccttttaagtgttcagtgtgcgagaagacgtacaaagaccccgccacacttcgtcagcacgaaaaaactcactggcttaccagaccttttccttgtaacatttgtgggaaaatgttcacccaaagaggaacaatgacaagacatatgagatctcaccttggcttgaagccttttgcctgtgacgagtgtggtatgagattcacccgacaatataggttaacagagcacatgcgagtgcatagcggagagaagccttatgaatgtcagctctgtggcgggaagttcacccagcaacggaacctcatctcacacctccgaatgcacacctcaccatcctag

SEQ ID NO: 191168 - DNA, 2670 bp, Artificial Sequence
  Description of Artificial Sequence: Synthetic coding sequence
atggacgcccggggcggcggcggccggcccggcgagagccccggcgctacacctgctcccgggccaccacctcctccccccccagcaccaccccagcagcaaccacctccgcctcccccgccggcacccccccctggacctggccctgcgcctccccagcaccctcccagggccgaagctttgccccccgaggcggctgatgagggaggtcccaggggcagactcagaagccgggactcatcttgtggtagaccaggtacccctggcgccgcctccacagcaaaagggtcccccaacggagaatgcggaagaggagagcctcagtgctcaccagcagggccggagggccccgcccggggccctaaggtctcgttttcttgcaggggcgccgcctctgggcccgcaccaggtcccggccccgccgaagaagctgggtcggaggaggcaggacccgcgggtgagccacgtggcagccaggcatcatttatgcaacgacagtttggcgctctcctgcagccaggcgtcaacaagtttagccttagaatgttcggttcccagaaggcagtggaaagagaacaagaacgcgtgaagagcgccggggcctggattatccacccttactctgatttcaggttctactgggactttacaatgctgctctttatggtggggaacctcatcattatccctgtgggtataacattcttcaaggatgagacaaccgccccttggatagtgtttaatgtagtgagtgatacgttttttttgatggatttagttctgaattttaggacgggaattgttatagaggacaacaccgaaattatactcgatcctgaaaaaatcaaaaagaaatacctccgtacctggtttgtcgtggatttcgtttcatcaattcctgtggactatatattcctgattgtggaaaaaggcatcgattcagaggtgtacaagacagctcgcgccctccgcattgtccgcttcactaaaattctgagcctgctccgactgctgcggctttcccgtttgataagatacatccatcaatgggaggagatctttcacatgacttatgacctcgcatctgccgtgatgcgtatatgcaacctgatcagcatgatgctcctcttgtgccactgggacggctgcctccagtttttggtaccaatgctgcaagacttcccacggaattgctgggtctccattaatggaatggtcaatcacagctggtcagagttgtactcttttgcgctgttcaaggcaatgtcccacatgctctgtattggctatggcagacaggcccctgaaagtatgacggatatttggcttactatgctatctatgattgtgggagcaacctgctatgccatgttcattggacacgcaactgctctcatacagagtctggactcaagcagacgacagtatcaggagaagtacaagcaggtggagcaatacatgtctttccacaagctcccagctgacttcaggcagaagattcacgactattacgagcacagatatcaaggtaagatgttcgacgaggactcaattctaggcgagctgaatggacctctccgagaggaaattgtgaactttaactgccgtaagctggttgcctccatgcccctcttcgctaacgccgaccccaatttcgtgacggccatgctgactaagctaaaatttgaggtattccaaccaggagactatattattagggaaggcacaatcggtaagaagatgtactttattcagcatggggttgtgtcggttcttaccaagggcaacaaagaaatgaagcttagcgacgggtcttactttggggaaatctgcctgctgactcgtgggagaagaaccgcctcagtgagggcggatacatattgtcgcctctatagcctttctgtggacaattttaacgaagtgttggaagagtatccaatgatgcggagggccttcgaaacggtggcaattgaccggctagatcgaatcggcaagaagaactcaatcttgcttcacaaagttcagcacgatctgaacagtggggtgttcaacaatcaggagaatgctatcattcaagaaatcgtgaaatacgacagagagatggttcaacaggctgagctgggacaaagagtcggactatttccgcctcctccaccgccacctcaggtgacttccgctatcgcaactcttcagcaagcagccgctatgtctttttgtccccaggttgccaggccactcgtgggccctctggcgcttggaagcccaaggcttgtgaggagaccgccccccgggcctgcgccagccgcagcatcccccgggcccccacccccagcctccccccccggcgcaccagccagtccgagagcccccagaactagcccttacggcggcttgcctgccgccccactggccggacccgctctgcccgcacggaggcttagccgagctagtcgccccctgagtgcgagccagcctagtctgccccatggggccccggggccagctgcatcaactcggccagctagttcctcaactccccgcctcggtccaacaccagcggcacgggccgccgcgcccagtccagaccgtcgtgatagcgcaagccctggagccgcaggaggccttgatccccaagatagcgcgcgttctaggctcagctctaacctgtag

SEQ ID NO: 191169 - DNA, 2325 bp, Artificial Sequence
  Description of Artificial Sequence: Synthetic coding sequence
atggaggccgagcagcggcccgccgccggcgccagcgagggcgccactccgggactcgaggccgtaccaccagtcgccccaccccccgccacagcagcatccggccctattcccaagtcgggtccagagccgaagcggcgccatttaggtactttgctccagcccacagttaacaagttcagtctcagggtgttcgggtcacacaaagctgtggaaattgagcaggaaagggtgaagtcagccggagcgtggatcatccacccttactccgacttccggttctactgggacctgatcatgctattgcttatggtaggcaatttaatagtcctcccagtgggtatcactttctttaaagaagaaaacagcccgccatggatagtattcaacgtactcagtgataccttttttctgcttgacttagtcctgaactttaggaccggcattgtggtagaggagggggccgaaatcctgctggccccccgcgccatccggacacggtatcttagaacctggttcctagtcgacctgatttcatctatccccgtagattacatttttttggtcgtggagctagaacctcgtctcgacgcagaggtctataaaaccgcacgagcgttgcgaatcgtccggttcaccaaaatactttctctgctcagactactgcgcctgtcccgtctgatccggtatattcaccagtgggaggagatctttcatatgacatatgatcttgcctcagccgtggttcgcattttcaatctcattggtatgatgctacttttgtgccattgggacgggtgcctccagttcctagtgccaatgctgcaggattttcctcccgattgttgggtgtcaatcaatcacatggttaatcattcctggggccgccaatatagtcacgcccttttcaaggcgatgtcccacatgctgtgcatcggctatgggcaacaggcacccgtaggcatgccagacgtgtggctgacaatgctcagcatgattgtcggcgcgacatgttatgccatgttcattggtcatgcgactgctctgatccagagtcttgactcaagtcgtcgtcaataccaggagaaatacaagcaggtggagcagtacatgagttttcacaaactaccggccgataccaggcagcgcattcacgaatattacgaacaccgatatcagggaaagatgtttgacgaggagtctatcctcggggagcttagtgaacccctgcgggaagaaatcatcaactttacatgtcgcggactcgtggctcatatgccccttttcgctcacgctgatcctagttttgtcacagccgttttaaccaagctgcgatttgaagttttccaacccggggacctcgtggtacgagaggggtcagtgggccggaaaatgtactttatccagcatgggctgctgagtgttctggcacggggcgcgagggacactcgccttacagatggctcttattttggagaaatttgcttactgacaagggggcggcggaccgcttcggtccgggccgatacttactgtaggctttacagcttgtctgtcgaccactttaacgccgtccttgaggaatttccgatgatgcgccgcgcgttcgagaccgttgctatggaccgacttctcagaattggaaaaaaaaactcaattcttcagcgtaagagatccgagcccagcccgggttcatctggcggcatcatggaacaacacctggtgcagcatgatcgtgacatggctaggggggtcagagggcgagccccctctacaggtgcgcagctgagtggcaaacccgtgctatgggagcccctcgttcatgccccacttcaagcagccgccgttacctcaaatgttgccatcgctctcacccaccaaaggggccctctgcccctgtcacccgactcaccagctaccttactcgcccgatcagcctggaggtccgctgggtcccctgccagccctctggtgcctgtccgagccggaccgtgggccagtaccagccgattgccagctccaccggctagaactctgcacgcatcactctcaagagccggcaggagtcaagtgtccctgctgggtccccccccaggtgggggcggccggaggctcggaccacggggcaggcctttgtctgctagtcagccatcactgccacaaagagcaacaggcgacggctcccctgggcgtaaaggctccggttcagagcggctgccaccatccgggctgctggccaaaccacctcgcacagcccaacccccccgcccgccggttcctgagccagcaactccaagaggcctacagctgtcagctaatatgtag

SEQ ID NO: 191170 - DNA, 3612 bp, Artificial Sequence
  Description of Artificial Sequence: Synthetic coding sequence
atggacaagctgccccccagcatgcggaagcggctgtacagcctgcctcagcaggttggggccaaggcctggatcatggatgaggaagaggatgctgaggaggagggcgctgggggcaggcaggacccatctaggcgtagcattcggctccgccctctccccagcccgtcaccaagcgcggccgccggcggcaccgagtcccggtcatcagccctgggtgccgcagatagtgaggggcccgcccggggggctgggaaatcctctacaaatggggactgtagacgcttccgcggcagcctggccagtctggggtccaggggcggtggcagcggcgggacaggcagcgggagttctcacggtcaccttcacgactccgccgaagagagacgcctcattgcagagggcgacgcgagcccaggtgaggatagaactcccccaggactggctgccgaaccagagcggcctggcgctagcgcacaacccgcagcttcacctccccccccgcagcagccaccccagcccgcttcagcatcctgcgagcagccttccgtggacactgccattaaggtcgaaggaggcgccgctgcaggagatcagatattgccggaggctgaagtgcgtttgggccaggcaggctttatgcagaggcagtttggggctatgttgcaacccggcgtcaacaagtttagcctacggatgttcggcagtcaaaaagccgtggaaagagaacaagagagagttaagagtgccggtttctggatcattcacccctattccgactttcgcttctactgggacctcaccatgctgctgttgatggtgggtaatttaattatcatcccagtcggaataactttcttcaaagacgagaataccaccccttggattgtgtttaatgtagtgtcagataccttttttcttatcgatctggtcctgaatttcagaacgggtatcgtggttgaggacaacacagagataatcctcgatcctcagcgcattaagatgaaatacctgaagagctggttcatggtcgactttatcagctctatcccagtagactacatttttctgatcgtggaaacacgaattgacagcgaagtctacaagacagcgagggctctcagaatcgtccggttcactaaaatcctgtctctcctccgcttacttcgactgtcgagactcatacgctacatccaccagtgggaggagatattccacatgacatatgatctggcctcagcagtggtgcggatagttaatctcataggtatgatgctcctgttgtgtcattgggacggttgcctgcagtttttagttcctatgctccaggactttcctgatgattgctgggtcagtatcaataatatggtcaacaactcatggggaaagcagtactcgtatgccctatttaaggccatgagtcacatgctgtgcataggctacggcaggcaggcccccgtgggcatgtcagatgtctggctgaccatgctctctatgatcgtaggagcaacttgctatgccatgtttatcggtcacgctactgcgctgattcagtctttggatagctctcgccggcagtatcaggaaaagtataaacaggtggagcagtacatgagcttccataaactgccgcccgatactcgccagcgcatccatgattactatgagcacagataccagggcaaaatgtttgatgaggagtcaatcctgggggagctcagcgagcctttaagggaagaaattataaattttaactgtaggaaactagtggctagtatgcccctgtttgcgaatgcggacccaaatttcgttacctctatgctgacaaagctgcgattcgaagtcttccaacccggcgattacattatccgtgagggaaccattggcaaaaaaatgtatttcattcagcacggcgtggtctccgttctgacgaagggcaacaaagagactaaacttgccgacggctcttacttcggcgaaatctgcctgcttacacgaggacgccgcacggccagcgttagggcagacacatactgtagactctacagcctctctgtggacaattttaacgaggttttagaggagtaccctatgatgcgcagggcatttgagaccgtggcactggacaggttagatcggataggcaagaagaattcgattcttctacacaaagtgcaacacgatctgaactccggggtgttcaactatcaggagaatgaaattattcagcagatcgtgcagcatgatagagaaatggcccattgcgctcacagggtgcaggcagcagctagcgccaccccgacacccaccccagtgatatggacgcccctcattcaggctccactgcaggcagcagccgccaccacttctgttgctatcgccctaactcaccacccaaggctgcctgccgcaatattcagaccacccccaggctccgggctcggaaacctaggcgccggccaaactcctcgacatctcaaacgtctgcagtctctcattccgtccgctctaggcagcgcatcccctgctagcagcccaagtcaggtagacacgccatctagctccagctttcatatacagcagctggctggattttccgctcccgcggggctatctccgctgttaccatccagtagttcttcacctcctccgggcgcttgcggctcaccttctgcccccacccccagtgctggtgtcgcggccacaactatcgccggcttcggacacttccacaaagccttaggtggctcactgtctagcagcgattccccgttgttaactcctctgcagccaggggctcggtctccccaagccgcccaaccctctcccgctccaccaggcgcacggggaggactcggcctgcccgagcattttctgcctcccccgccctcaagccggagtccctcatcgagcccgggacagttgggtcagccaccaggcgaactgtccctcggcctggccacagggccactgtccacacccgagacaccacctaggcagcccgagccaccctctttggtggcaggcgcctcagggggagcatctcctgtaggctttacaccacgaggaggcttaagcccaccaggtcactcccccgggccgcctagaacatttccatcagcccctccacgagctagcgggagccacggaagcctgctccttccacctgcgtcttcacccccacccccccaggtcccacagaggagagggacaccccccttaacccctgggcgcctgacccaagacctcaagctcatttcagcgtctcagcccgcgctgccccaggatggagcccagactctgaggagggcgtctccgcactcttctggggaaagtatggccgcgttcccactttttccccgggccggcggcggcagcggcggatctgggtctagtggaggactcggtccgcccggacgaccttatggagctatcccaggacagcacgtcacactgccaagaaagacatcttcgggaagtctgcctccccccttatcactgttcggcgccagagcgacctcctccggaggcccgcctctgacggccggcccccagagggaacctggagcacgccccgagcccgtcagatctaagctgcctagtaatctgtag

SEQ ID NO: 191171 - DNA, 396 bp, Artificial Sequence
  Description of Artificial Sequence: Synthetic coding sequence
atgaacctgcccagcaccaaggtgagctgggccgccgtgaccctgttgttactgctgctgctgctccctccagccctgctctcttcaggcgcggccgcacaacctctcccagattgctgtcggcaaaagacatgtagttgtcgtctttacgaactgcttcacggcgctggcaaccatgctgcagggatcctcacactcgggaagcggcggtcagggccaccaggcctccagggtaggctgcagcgtttattgcaggcaagcggaaatcatgccgcgggcatcttaactatgggtcgcagagcaggagccgagcccgccccaaggccgtgtttaggcagacggtgtagtgctcccgccgcggcgagcgtggcccctggtgggcagtcagggatctag

SEQ ID NO: 191172 - DNA, 1050 bp, Artificial Sequence
  Description of Artificial Sequence: Synthetic coding sequence
atggccgccaccgccgccgaggccgtggccagcggcagcggcgagcctagggaagaggccggagcccttggcccagcatgggacgagtcccagctccgttcttatagctttcccacccgcccaatcccccgtctgtcccagagtgatccacgggccgaagagcttatagagaacgaagagcctgtggtgttgactgataccaatctggtgtatccagctttgaagtgggatctcgaatatctgcaagagaacattggtaatggagactttagcgtgtattccgccagtacacataagtttctctattacgatgaaaagaagatggctaactttcagaactttaagccccgtagcaaccgtgaagagatgaagttccacgagtttgtggaaaagctgcaggatatccagcagcgcggcggtgaggaacggctttatctgcagcagacactcaacgacaccgtcggaagaaagattgtcatggattttctgggtttcaactggaattggatcaataagcagcagggcaaacgcggatggggccagctcacatccaacctgttgcttatcggcatggaggggaacgtaactcccgctcattatgatgagcagcaaaatttcttcgctcagatcaagggctacaaacgctgtatcctgttccctccagaccaatttgaatgcctgtacccatacccagtgcatcatccgtgtgatcgacagtcgcaggtcgatttcgataatccggactatgagcggttcccgaatttccagaatgtggtcggctacgaaaccgtggtggggcctggcgatgtgctctacataccaatgtattggtggcaccacattgagagcctgctgaatggaggcatcaccattaccgtgaacttctggtacaagggtgcgccaacccccaagagaatcgagtacccactgaaggcccatcagaaggtcgcgatcatgcggaacattgaaaagatgttaggggaggcgctggggaatccccaggaagttggacccttattgaacaccatgataaaaggcagatacaattag

SEQ ID NO: 191173 - DNA, 1149 bp, Artificial Sequence
  Description of Artificial Sequence: Synthetic coding sequence
atggtgagcgtgggctgcgtggtgttcctgttcttcttcttcggcgttcgcaatcgccgatcctttcggtttcgctggggacccagcctcgccgcagaaatggccgccacggcagccgaggcagtagctagcgggtccggggaaccgcgcgaggaggccggagcccttggccccgcttgggatgaatcacagctccggtcatactccttcccaacaaggcctatccctaggctgagtcaatcagatcccagggccgaggagctgattgagaacgaggagcctgtggtgctcaccgatactaacttggtgtaccctgctttgaagtgggacctggaatatctgcaagagaatatcggcaacggagacttctctgtttatagcgcctccactcacaaatttctgtattatgatgaaaaaaaaatggccaacttccagaattttaagccaaggtctaacagagaggagatgaagtttcatgagttcgtggaaaaacttcaagatattcagcagcgaggaggagaggaacggctgtacctccagcaaacactaaacgatactgtaggaaggaagatcgtaatggactttctgggcttcaactggaattggatcaataagcaacagggaaagcgaggttggggacagctcactagcaacttgctcctcatcggcatggagggcaatgtaacaccagcacactacgatgagcagcagaacttcttcgcccagattaagggatacaagcgttgcatcctgtttcccccggatcaatttgaatgcctgtatccttacccagtacaccatccttgtgaccgccagagtcaggtggacttcgataacccagattacgaacgcttcccgaatttccagaatgtagtgggctatgaaaccgttgtggggcccggagacgtactgtatatcccgatgtactggtggcaccatatagaatctttactgaatggcgggatcaccatcaccgtcaacttctggtacaagggggccccaacacctaagagaattgagtaccccctaaaggctcatcaaaaggtggcaatcatgcggaatatagaaaagatgctaggggaagcacttggcaaccctcaggaagtgggccctcttctgaacacgatgattaaaggtcgttacaattag

SEQ ID NO: 191174 - DNA, 579 bp, Artificial Sequence
  Description of Artificial Sequence: Synthetic coding sequence
atggccaacttccagaacttcaagccccggagcaaccgggaggagatgaaatttcacgagttcgtggagaaacttcaggacatccaacagagaggtggagaagagaggctgtatctgcagcagacacttaatgatacagttggccggaagatcgttatggatttcctcggatttaactggaattggattaataaacagcaggggaagcgaggctggggacagctgacgtccaacttactgctgatagggatggagggcaatgtcactcctgctcattatgatgagcaacagaacttcttcgcacagatcaaaggatataagcggtgcatccttttccctcctgatcagttcgaatgcctctacccataccctgtgcaccatccttgtgacaggcagtcccaggtggacttcgataaccccgattacgagcggttcccgaatttccagaatgtcgtcggctacgaaacagtggtgggacccggagacgttttatatatccccatgtattggtggcaccacattgaatcccttctgaatggaggtatcacaatcactgttaatttttggtacaaaggttag

SEQ ID NO: 191175 - DNA, 1803 bp, Artificial Sequence
  Description of Artificial Sequence: Synthetic coding sequence
atgcggcccgccgccggcgccgcccggcggccccggtgctgcacctcttggttgacacgctgcccatcacccgctgcctctgcccctacttggacccgcccactgtcctgcgcgtctcctagcgcaacatgcgcctgtacagccagtgctccacagctagaacttatcggtcattctatattcgatttcatccacccatgtgaccaggaggaactgcaggacgcccttaccccccagcagacactgagcaggaggaaggtcgaggctcccacagaacgatgcttttcactgaggatgaagtcgactttgacctctagaggccgaactctcaacctcaaggccgccacttggaaagtattaaattgttccggacatatgcgggcgtataaacctcctgcccagactagcccggcaggatctcctgacagcgaaccaccactgcaatgcctggtgctgatttgtgaggcaatcccgcatcctggctcattagaacctcctcttgggcgcggcgcctttctaagtcggcacagcttagacatgaaatttacttactgcgatgatagaatagcagaggtggctggctacagtcccgacgacttgatcggttgttccgcatacgagtacattcacgccctcgatagcgacgccgtgagtaaatcgattcatactcttctgagcaaggggcaagccgtgacgggacagtatcggttcctggctcggagcggtggctacctttggacgcagacccaggccactgtggtgagcggaggccggggaccccagtcagagagcatcgtgtgtgtccacttccttatcagccaagttgaagagacgggggtcgtgctgagcctggagcagacagaacagcactcacgtagaccaattcagaggggtgctccgtcccagaaggacacgcctaacccaggagattcgctggatactcccggcccaaggatcctagctttcctccacccacccagcttgagtgaagccgccctggctgcagacccacggagattctgctctcccgacctacggaggctgctcgggccaatacttgacggggccagtgtagccgccaccccttccacccccttagcgacgcggcacccgcagtccccgctgtccgccgatctgccagacgaactgccggtcggaacagaaaatgtacataggctcttcacttcggggaaggacacagaggccgtcgaaacagacctcgatattgctcaggacgcagatgcgttggacctcgagatgctggcgccatacatctctatggacgatgactttcagctaaacgcctcagagcagctccctcgcgcctatcacagacccctgggcgccgtgcctcggcctcgcgccagatcctttcatggtctgagcccgccggcgctagaacctagcctgttgcctcgatgggggagtgatcccagacttagttgctcctcccctagtcggggcgacccaagcgcgtcttcacctatggccggggctcggaaacggactctggcccagtcgagtgaagatgaggacgaaggagtcgaactgctgggggtgcggccccctaaacgttcaccatctcccgagcatgagaacttccttctctttcctcttagcttgagcttcctgttaaccggagggcccgcccctggcagtctacaggatccatcaacacccctgctgaatctgaatgagccactaggacttggcccttccctgctctctccttactccgatgaagatacaactcagcctggcggccccttccagcctagagccggttcagctcaagctgactag

SEQ ID NO: 191176 - DNA, 1353 bp, Artificial Sequence
  Description of Artificial Sequence: Synthetic coding sequence
atgcggcccgccgccggcgccgcccggcggccccggtgctgcaccagctggctgacaagatgtccttcacccgcagcctctgcccccacatggacccgcccattatcctgcgcttctccctctgcgacttgcgcgtgtaccgcgtcggcaccccagttagagctgattggacattccatattcgatttcatccatccttgtgaccaagaggaactgcaagatgctttaaccccgcagcagactttaagcaggcgcaaagtggaagcaccgacagaaagatgcttctccctccgaatgaaaagcacactgacgagccgagggagaactctaaatctgaaagctgctacatggaaagtgctaaattgcagcggccacatgagagcatacaaacccccagcccagacaagtcctgccggatcgcccgacagcgaacccccacttcagtgcttagtcctgatatgtgaggctatccctcatccgggatccttggagccacctttgggtcgaggcgctttcctctcaaggcatagccttgacatgaagtttacttattgcgacgacagaattgccgaggtggccggatacagccccgacgatctgattggttgttccgcatacgagtacatccacgccctcgattcagatgcagtctccaagagtattcatacactgttgtccaagggccaagccgtgaccgggcagtacaggtttttggctcggtctgggggatacctttggactcagacccaggccaccgtggtctcagggggccgcggacctcaatctgagagcattgtgtgtgtgcattttctcataagtcaggtcgaggagacaggagtggttttgagtctcgaacagacagagcagcacagccggcgtcccattcagcggggggcaccatcccagaaagatacccccaacccgggtgacagtctagacacccctggaccacggatcctcgcattcttacaccctccttccctttccgaagccgccctggccgctgaccctcgccgcttctgctctccagatctgcgacgactcctggggcccatcttggatggtgcatcggtggctgcaacgccatcaacccctctagccactaggcatccccagtcacccttgtccgccgacttgcctgatgaacttcccgtcggcactgagaacgttcatagactattcacgagcggcaaagataccgaagctgttgagacagatctggatattgcccaagatcccagtaccccattgctgaacctgaatgagcccctcggctttcacttcgttacccaatccggagtgcagtggcacaagcactcgagcccccagccccggccccctggattgaaatag

SEQ ID NO: 191177 - DNA, 1899 bp, Artificial Sequence
  Description of Artificial Sequence: Synthetic coding sequence
atggccctgggcctgcagcgggcccggagcaccaccgagctgcggaaagagaagagcagggatgcagcccggtccagaagatctcaagaaactgaagtcctatatcaactggctcataccctaccattcgcccggggagtctctgctcacttagacaaggctagtattatgcgactcacaatatcataccttcgcatgcacagactttgtgctgccggggaatggaatcaggttggagccgggggggaaccactcgatgcatgctatctgaaggcgctcgagggattcgtgatggttcttacggcagagggcgacatggcatacctcagcgaaaatgtgagcaaacaccttgggctgtcacagcttgaactcatcggacatagcatatttgacttcattcatccctgcgatcaagaggagctccaggatgcattaactccccagcagaccttgtcccgccggaaggttgaggcacctactgagaggtgcttttcactgcgcatgaagagtacactcacaagcaggggacggacactgaatctgaaggccgcaacgtggaaggtcctgaactgcagcgggcatatgcgggcttacaagcctccagcccaaacctcccctgcagggtcccctgatagcgagcccccacttcagtgcctggtcctcatatgcgaggccatcccccatcctggcagtttagaacctcccctggggcgcggagcattcctatcaaggcactcattggatatgaaatttacttactgtgacgatcgcatcgctgaagttgcagggtattctcccgacgatctgattgggtgctccgcatacgagtatatccatgctcttgatagtgacgcggtcagcaagtctatccatactcttctttccaagggccaggcggtcactggccaatatcgctttctcgctagaagcggcggatatctttggacacaaacgcaggcgacagtggtgagcggcggaagaggtccccaaagcgagtccattgtgtgtgtgcactttttgatatcccaggtcgaggagactggcgtggtcctttcacttgagcagacagagcagcactcccgacgcccaatccagcgcggggcaccttcccagaaagacacccccaacccaggcgatagcctggacactcccggcccgaggatcctcgcatttctgcatcccccatccctctccgaagctgccctggctgctgaccctcggaggttttgctcgcccgatcttcgtagattgctcgggcccattctggacggagcctccgtagcggccaccccgagcacacctttggctactcggcatcctcagagccccctgtctgcagacctccctgatgagctccctgtagggactgagaacgtgcatcggttgtttacctccggaaaggatacagaagccgtggagacggatctggatatcgcccaggatgctgatgctctggacctggaaatgctagcaccctatatctctatggatgacgacttccagctaaatgcttctgagcagctgccgcgtgcttaccaccggcctcttggcgcagtgcccagacctagggctcggagcttccacgggctttctccccctgccctggagccctccttgcttcctcggtggggctccgacccccgcctaagctgctccagccccagtagaggggaccctagtgcttcctcccctatggcgggagcccgaaaaagaaccttggcgcagagtagcgaagacgaggacgagggtgtagagcttctgggagtgagaccaccaaagcgcagcccaagccccgaacatgaaaactttctcttattccctctcagcctcgtgtgttggggaatcaacgggattttatggccctcactcccaagctggctaaagcccactgtattgtag

SEQ ID NO: 191178 - DNA, 1731 bp, Artificial Sequence
  Description of Artificial Sequence: Synthetic coding sequence
atgcggctgaccatcagctacctgcggatgcaccggctgtgcgccgcaggagaatggaatcaggtgggggcaggaggggagccactagacgcatgttatctgaaggctctggagggctttgtcatggtactgacggccgaaggtgatatggcttatctgtcagaaaacgtctccaaacatttgggcctgagtcagctggaactcatcgggcacagtatcttcgatttcatccatccctgtgatcaggaggagttgcaggacgcattgacgccccagcaaaccctgagccgccgaaaggtggaagcacccaccgagcgctgctttagcctcaggatgaagagcacactcacgagtagaggacgaaccctgaacctcaaagctgccacctggaaagtcttgaactgcagtggtcacatgcgcgcatataagccacccgctcagacttctcccgctggtagtcctgactccgagccccctcttcagtgcctggtactgatttgtgaagcaattccccaccctggtagcctggagccacccctggggcggggggcttttttgtcacgtcactctttggacatgaaattcacgtattgtgatgatagaattgccgaagtggctggctacagccccgacgatctcatcggatgcagcgcctacgaatatatacacgctttagacagtgatgcagtgtccaagtccatacacacactgctgtctaaaggccaagctgtaactggtcagtaccgcttcctcgcccggtcagggggatacctctggacacagacgcaggcgacagtcgtctcagggggaagaggcccccagtctgagtcaatagtttgtgtgcattttttgatctcgcaggttgaagaaacgggcgttgtgctgtccttggagcaaacagaacagcactcccgacgccccatccagagaggagctccctcacagaaggacacccctaaccccggagactctttggacacacctggaccaagaatcttggctttcctgcatcccccttcactctccgaagctgcactagccgccgatcccaggcggttctgtagtcccgacctccgccgcttactgggtccaattctggacggcgccagtgtggccgcgacaccttctacacccttggcaacccgacacccacagagccccctgagcgccgacttacccgacgaacttccggtggggactgagaatgtccatagactgtttacatctggaaaagatacagaagccgtggagacggacctcgacatagcacaggacgccgatgcccttgatctggaaatgctcgcgccttacatctccatggatgacgacttccagttgaacgcatccgagcagttgcctcgtgcctaccaccggcctctcggtgctgtgcctagaccccgggccaggtcttttcacggtctctctccccccgcgctggaaccaagcctgctgccacgatgggggagtgacccccgtctgagctgttcctctccatcccgaggagacccttccgcctcctcccctatggcaggagcccgcaaacgaactctggcccaatcttcagaagacgaggacgagggggttgagctgctgggagtgaggccaccaaagagatcaccgagccccgagcatgagaacttcctgcttttccctctgtctctcgtgtgctggggtattaacgggattttatggccttcgcttcccagctggctcaagcctactgtcctttag

SEQ ID NO: 191179 - DNA, 2004 bp, Artificial Sequence
  Description of Artificial Sequence: Synthetic coding sequence
atggactggcaggaccaccggagcaccaccgagctgcggaaggagaagtctagggacgcggccaggtccaggcgatcacaagaaacggaagtgctgtaccagttggcacatacactgcccttcgcccgaggtgtcagcgcccatcttgacaaggcatcaattatgcgcctgacgatttcatatctgagaatgcacagactctgtgcagctggcgagtggaatcaagtgggggcaggtggagagcccctcgacgcgtgctacctaaaagctctcgagggattcgttatggtgttaactgccgagggcgacatggcctatttaagcgagaacgttagtaagcatttaggcctctcacaattagagctgattggccatagtattttcgatttcattcatccctgtgaccaagaggaattgcaggatgcactgaccccacagcagacactgtcacgccggaaggtggaggccccaactgaaagatgtttcagcttgcgcatgaagtcaaccctcacctcaaggggaagaaccctgaacctgaaagccgctacgtggaaggtgttgaactgtagcggccatatgagggcgtataaaccaccggcccaaacaagcccagcaggctctcccgatagtgagccacccctgcagtgtcttgtgctgatttgtgaagccatcccgcaccctggctcgctcgagcctccactaggaaggggcgcctttctgagccgccactcactcgatatgaaattcacatactgcgatgacaggatcgcagaagtggcagggtacagccctgatgacctcatcgggtgtagcgcctacgaatatattcatgctctcgacagcgacgccgtctccaagtctatccatactctgctttccaagggccaggccgtgacagggcagtacaggtttctagctcgctcagggggctacctgtggacccagactcaggctacggtggtctccggcggccggggaccccaaagtgaatcaattgtatgcgtgcacttcttgatctcccaagttgaggaaaccggcgtggtgctatcactggaacagactgagcagcacagcaggagacctatccagaggggcgccccatcccaaaaggatacccccaacccgggagattcactcgatacccccggtcctcgcatcctggcgttccttcacccaccatccctgagcgaagcagctctggctgcagatccccggaggttttgttcacccgatctgcggcgccttttgggtccaatattagatggtgcatccgtggccgctacaccttcgaccccattggccacgaggcaccctcagagccctttgagtgcagatttgccggacgagttgccagtcggaaccgagaatgtccacaggctgtttacctctggaaaagacacggaagctgttgagaccgatctcgatatagcgcaggatgccgatgcacttgatctggagatgttagcaccctacatctctatggacgacgattttcaattaaatgcaagcgagcagctgcctagagcttaccatcgaccgctgggggccgtacccagacccagagcgaggtccttccatggacttagcccccccgccctcgagccctctcttctcccccgttggggatcagatccacggctgtcatgctccagcccctcccgcggtgacccctcagctagctcacctatggccggggcgcggaaaagaaccctcgcacagagctctgaagatgaggatgaaggagtggagctcctgggtgttcgcccacccaagcgtagtccatcaccagagcatgagaatttccttctgtttcctctgagtctcagctttcttctgactggggggcccgctccaggttctctccaggacccatctactccacttttgaaccttaacgaaccactcgggctgggaccgagccttctgtccccatatagcgacgaggacactacccagccggggggtccgttccagcctcgagcgggttccgcacaggccgactag

SEQ ID NO: 191180 - DNA, 1842 bp, Artificial Sequence
  Description of Artificial Sequence: Synthetic coding sequence
atgcggctgaccatcagctacctgcggatgcaccggctgtgcgccgcaggcgagtggaaccaggttggagcaggaggcgaacctcttgacgcgtgctacctgaaagcattggaggggttcgtgatggttcttactgcagagggggacatggcgtacctttcagaaaacgtctctaagcacttaggccttagccaactggaactcattggccacagcattttcgactttatacacccttgcgatcaggaagaattgcaggacgccctcacaccacagcaaaccttgtccaggcgaaaagtggaggctcccaccgaaaggtgttttagcctgcgcatgaagtctaccctcacgtcccgggggaggactctgaatttgaaggctgcaacatggaaggttctaaattgttcaggccacatgagggcttacaagccgcccgctcaaacctccccagccggcagccccgacagcgagccccccctgcagtgtttagtgcttatttgcgaggccattcctcacccggggtctttagagcccccactgggccgaggagcatttctttctcgtcactccctcgacatgaaatttacatactgtgacgatcggatcgccgaggtggccggttactctccagatgatctaatcggctgctccgcttatgaatatattcatgcactcgacagtgatgcagtatctaagagcatccataccctcctttccaaggggcaggcagtcacgggacagtaccggttcctagctagatcgggtgggtacctgtggactcagacacaagcgaccgttgtgtctggcggcagagggcctcagtccgagtccatagtgtgcgtgcacttcctcatttcccaggtagaagagacaggagttgttctgtccctggagcaaactgaacagcattccaggaggccaatccagagaggagctccttctcaaaaggacacgcccaacccaggtgattcgctggacacccctggcccacgcattctggcatttctccacccgcccagcttaagtgaagccgccctcgcggccgatccacgaaggttttgtagccctgatttgcgcagattactgggccccatactggatggcgcctctgttgccgcaacaccatcaacgcctctggccacaaggcacccccagagtccgcttagcgccgacctgcccgatgagcttcctgttggaaccgagaatgtgcataggctttttacttccggaaaagacaccgaggcagtggaaacggatctagacatagcccaagacgccgacgccctggatttagaaatgctagcgccctacatttccatggacgacgattttcagctcaacgcatccgagcagttgccacgagcgtaccacagacccctgggtgcagtcccacggcctagagcccgctcatttcacggactgagcccaccagccctcgagccaagtctgctccccaggtgggggtccgaccccagactctcatgcagctcaccttcacggggtgatccgtccgcctcttcacccatggctggcgcccggaagagaactctggctcaaagcagcgaagatgaggacgagggagtggaactgctaggtgtccgtccaccaaaacgatcacctagccccgaacacgagaatttccttctgtttcccctctctctctcatttctgttgaccggtggccctgcacctgggagcctgcaggacccatctactcccctgctcaatctgaacgaaccactcggtctagggccttcccttctcagtccttattcagatgaggacacgacacagcccggtggtccttttcaacctagagcggggtccgcacaggcagactag

SEQ ID NO: 191181 - DNA, 2010 bp, Artificial Sequence
  Description of Artificial Sequence: Synthetic coding sequence
atggccctgggcctgcagcgggcccggagcaccaccgagctgcggaaggaaaagagtagagatgccgcacggtcacgcaggagccaagaaactgaggtcttgtatcaactggctcataccttaccattcgcgaggggggtttccgcccatttggacaaggcctcaataatgcggttaactatcagttatcttcggatgcaccggttgtgcgccgccggagagtggaatcaggtcggtgcaggcggagagcccctggatgcttgctacttaaaagcacttgaagggtttgtgatggtgctcaccgcagagggtgacatggcttatctctctgaaaatgtgtcaaagcatttgggcctcagccagctagagttgatcggacattcgatctttgattttattcatccgtgtgatcaggaagagcttcaggacgccctgactccacaacagacactgagcaggcgcaaggttgaagctcccactgagagatgtttcagcttgcggatgaagtccacattgacaagtcggggacgcacccttaacttgaaagccgccacttggaaagtcctgaattgctccggccacatgcgagcctacaagccccccgcacagacctcacctgcaggctcccctgattccgagccacccctgcagtgtctggtgctgatatgcgaggccattccgcatccgggatcccttgagccaccgctggggaggggtgctttcctctcccggcactctctggacatgaagtttacttactgtgacgacagaatcgcagaagtcgcgggttatagcccagatgacctgattggatgctccgcgtatgagtatatacatgctctagattctgacgccgtgtccaagagcattcacacacttctgtctaaaggccaggccgttactggccagtatcgatttctggcgcgcagtggcggatatctctggacacagacacaagctactgtggtgtcggggggccgcggtccacagagcgaatcaattgtgtgcgttcatttcctgataagccaagtggaagagaccggggtcgtcctaagcctcgagcagacagaacagcattcccgacggcctattcagcgcggcgcgccctcacagaaggatacccctaatcccggagactcactggataccccagggcctagaatcctggccttcttgcaccctcctagcctgtccgaggcagctctcgcagctgatcctcgtcgcttctgctcacctgatttgagacgactgctaggccctatcttggacggggcaagtgtggccgccacccctagcacccctctggccacccggcacccgcagtccccactaagtgcagatctgccggatgaacttcctgttgggacggagaacgttcaccgcttgttcacctccggcaaagacacagaagctgtagaaacagacctcgatattgcccaagatgccgacgctttagacttggagatgctggctccatatatctccatggacgatgacttccagttgaatgcctctgaacaactgcctcgcgcataccatcgacccttgggtgccgtgccccgaccccgagcccgatcctttcacgggctgagcccccctgctctcgagccttccctactcccccggtggggctccgatccccggcttagctgctcaagcccaagtcggggtgatcctagtgcttcctcaccaatggccggcgccaggaagcgtacgttggcccagtcaagcgaagacgaggatgagggcgtcgagctgttgggggtacggccaccaaaaagaagccctagtcctgagcatgaaaacttcctccttttccccctgagtttgagctttctgttaacagggggtcccgctcctggctccctgcaggacccaagcacccctcttctcaatctgaatgagccactggggctgggaccatcgctgttgagcccgtactcagacgaggacactactcagcccggtgggccgtttcaacctcgagctggctccgctcaggctgactag

SEQ ID NO: 191182 - DNA, 1092 bp, Artificial Sequence
  Description of Artificial Sequence: Synthetic coding sequence
atggccctgggcctgcagcgggcccggagcaccaccgagctgcggaaagagaaatctagagatgccgctagatccagacgcagtcaggagacggaggtgctgtatcagctcgcccacacactcccatttgcccgcggggtctccgcccatttggacaaagcctcgataatgcgactgaccatttcatatctccgcatgcaccggctgtgcgctgccggggagtggaaccaggtgggagctgggggagaacccttagacgcatgttacctcaaggccctagagggctttgtcatggtgttaacggctgaaggagatatggcctacctgtcagaaaatgtaagcaagcatctgggactgtcccagctcgagctcatcggacatagtatctttgacttcatccatccatgtgatcaggaagagcttcaggatgctctcactcctcagcaaacgctgtcacgcagaaaggtggaggctcctacggagagatgtttttccttaaggatgaaatcaacactaacgtcccggggccggaccctgaacctcaaggccgccacctggaaagtgcttaattgtagtggacacatgcgcgcatataagccaccagctcagacttcccctgctggaagtcccgactccgagccacccttgcaatgcctggtgctcatctgcgaggcaattccgcaccctggtagcctggagcccccacttggtcgcggagcctttctctctcgacattcactggacatgaaatttacatactgtgacgaccgtatcgctgaggtcgcaggctatagtcctgacgatcttattgggtgttccgcctatgagtatatccatgccctggactcggatgcagtgagcaaaagcatacacacctgtatgtatcccatctcccccggcgctaagccagctgcaacatggccccccgcggatactcgtactccacaactgcccatcccgcaggatgcactacctccccacctgaacacatcttccctgctgcccaaaccccaggggactgtctcttttttggcgccctcttacccagtccctcgatacttcagcccccaccttccgccttggtggccgtag

SEQ ID NO: 191183 - DNA, 1839 bp, Artificial Sequence
  Description of Artificial Sequence: Synthetic coding sequence
atgctgcccatgcccagcggccggccccggagctgcgcccggaagtctccagggatgaggccagcagccggagcggcgcgtcggcctaggtgttgcacaagctggctcaccagatgtccctcaccagccgccagcgcccctacatggacccgtcctctgtcttgtgctagcccatccgccacctgcgcttgtactgcaagcgcgccacaactggaactcattggacacagcatctttgattttattcatccttgtgaccaggaggagctacaggacgctcttacaccccagcaaacattgagccgcaggaaagtggaggcaccaacagagagatgctttagcctgcgcatgaagtccactttgactagccgcggtcgtaccctaaacctgaaagcagcaacctggaaggtgctgaattgtagcggtcacatgcgagcttacaagcctcccgcccagacaagtcctgctggcagccccgactctgaaccccccctgcagtgcctggtgctgatctgtgaggcaataccccacccgggttcgctcgagccacctctgggcagaggcgccttcctgagccggcacagcctcgacatgaagtttacctactgcgacgacaggatcgccgaagtggcagggtactcccctgatgatctgattggatgctcagcctatgagtacattcatgcgttagatagcgatgcggtgagcaagagtatccacactttgctctctaagggacaggccgttacagggcagtaccggttcctggcaaggagcggtgggtacctgtggacacagacccaagcgacagtggtgagtgggggcaggggcccacaaagcgaatcaatcgtctgcgtgcacttccttataagccaggtggaagaaactggagtggtcctgagcctcgaacagaccgaacaacactctcggcgccccattcaacggggggcaccctcacaaaaggatacccctaatccaggcgattctctcgacacacctgggccgcgcatcctagcatttctgcatcctcccagcctatccgaggcggctctggccgccgaccccaggagattctgctcaccggacctgcgccggctgctgggcccgatcctggacggcgcgagcgtggccgccacaccatctacacctctggctacccgccatccacaaagtcccctgtctgccgatctgcctgatgagcttcctgtcgggaccgaaaacgttcacagactcttcacttcagggaaagacacagaggcggtcgagaccgacctcgatattgcccaggatgctgacgcactcgacctggagatgttggctccctacatctcaatggacgacgactttcagttaaatgcatctgaacagctaccgcgagcctatcaccgtcccctcggcgcggtgcctagacctcgggccagatcctttcatggcttgtcccctccggccctggaaccctcgctgttacctcggtgggggagcgatcctcgcttgtcatgctcttctcccagcagaggagatcccagcgcttcctccccaatggcaggcgcccgtaaaagaactctcgctcaatcatcagaagacgaagacgagggggtggagttactgggagtgcggcctccgaagcggtcaccttcccccgaacatgaaaatttccttctctttccgctgtccttgtcattcctgctcaccgggggaccggctccaggttccctccaagacccaagcacgcccttactgaacctgaatgaacccttaggttttcactttgtgactcaatcgggcgtgcagtggcacaaacatagttctcctcagcccaggccaccaggtctcaagtag

SEQ ID NO: 191184 - DNA, 600 bp, Artificial Sequence
  Description of Artificial Sequence: Synthetic coding sequence
atgcggcccgccgccggcgccgcccggcggccccggtgctgcaccagctggcttacccggtgtccttcccctgccgcttccgcacccacgtggacacggcccctgagttgtgcaagtccttctgcaacgtgcgcctgtactgcctcagcaccacagctggaactcattggacattcaatttttgattttatccacccatgcgaccaagaggagctgcaggatgccttgacgccacaacagactctgagtcgaaggaaggtggaggccccaaccgaaaggtgttttagcctccggatgaagtccaccttaaccagtcgcggcaggaccctaaatttgaaagctgctacgtggaaggtcctgaactgttccggtcatatgagggcctacaaaccccctgcacagacctctccagcaggctctcccgattctgaacctcccctgcagtgcctagtgctgatctgcgaagccattccccacccgggcagccttgagcctcctttgggccggggtgcctttctcagtcgccattctctggatatgaagtttacttactgcgacgatcgtatcgctgaggtggctggctacagtccaatgacctag

SEQ ID NO: 191185 - DNA, 714 bp, Artificial Sequence
  Description of Artificial Sequence: Synthetic coding sequence
atgcggcccgccgccggcgccgcccggcggccccggtgctgcacctcatggctgacccgctgcccatcccctgccgccagcgcaccgacctggacacgccctctttcttgcgcctctccttctgcaacttgtgcctgtaccgcctcagctccgcaagaggagctgcaagatgccctgactccacaacaaacgctaagccggaggaaggtggaggctccaacagagcgctgtttcagcctccggatgaagtcgacattgacgagccgcggtcgcactctgaacctaaaggctgcaacctggaaggtgctcaactgctctgggcacatgcgggcatataagcccccggcccagacatcccctgcggggagccctgactccgaacccccactgcaatgcttagtgctcatctgtgaagctatacctcatccagggtctcttgaaaggttcgtgcctgtctcatccgctgcaacgagcctgtgtttgccctctctgagcccttccaaagtggccggatattcccctgacgatctcataggttgcagtgcctacgagtatatccatgccctggattccgacgccccccaggacgctctgccaccgcaccttaacacatctagtctcctgcctaagccacaaggtacggtctcctttttagccccctcatatccagtcccccgatatttttcaccgcatctgccaccctggtggccctag

SEQ ID NO: 191186 - DNA, 1092 bp, Artificial Sequence
  Description of Artificial Sequence: Synthetic coding sequence
atggccctgggcctgcagcgggcccggagcaccaccgagctgcggaaagaaaagagccgggacgccgcaagatcccgacgatcacaggagacagaggtgctatatcaattggcccatactctacctttcgcccgaggagtgagtgcacatcttgataaggccagtataatgcgcctcacaatcagctatctgagaatgcatagactatgcgccgccggggaatggaaccaggtgggggcaggcggcgagccattagacgcctgctacctaaaagctcttgaaggattcgttatggttctgacagctgaaggcgacatggcatatctgtccgagaatgttagcaagcatctcgggctgtcacaactagagttaattggccactctatttttgattttatccatccgtgcgatcaggaggaactacaggacgcgctgacgccccaacagaccttaagccggaggaaggtggaagctccgacagagagatgcttctctctgaggatgaaatctacgctgactagtcgggggaggaccctgaatctgaaggccgccacttggaaggttctgaattgtagcggccatatgcgggcatataagcctcctgcccagacgagtcctgccggcagtcccgatagtgagcccccgttgcagtgtttagtgcttatttgtgaagcgatcccccaccccggttctctggaaccaccattggggagaggggcattcctcagtaggcattcattagacatgaaattcacttactgtgacgataggattgctgaagtagcggggtacagtcctgacgacctcatcggttgttcagcctacgagtatatccacgcactggactcagatgccgtctccaaatctatccacacctgcatgtatcccatcagcccaggcgccaaaccagccgccacgtggccacccgcagatactcgtacccctcagttacccatcccacaagacgcgctgccaccacatcttaatacctcctccttgctgcccaagccgcagggtaccgtgtctttcttggcgccctcttatccagtacctcgttatttctccccacatctgcccccctggtggccatag

SEQ ID NO: 191187 - DNA, 2976 bp, Artificial Sequence
  Description of Artificial Sequence: Synthetic coding sequence
atggccgacaaggtgcggcggcagcggccccggcggcgggtgtgctgggcgttggtcgccgtgttacttgcggacctgctggcccttagcgacacactggctgtcatgtcagtggacctgggttccgaaagtatgaaggtcgcgattgtactcaataaggaatcgagacggaaaacacccgtcattgtgactctgaaggaaaatgagaggttctttggagactctgccgcctccatggccatcaagaaccccaaagcaactctgcggtatttccagcacttattaggaaagcaagcggataacccccatgttgcgctttatcaggcacggtttcctgagcacgagcttactttcgacccccagagacagactgttcacttccagatctctagccagctccaattcagtccggaagaagtgctcgggatggtgttgaattattcgcggagtttggctgaggattttgccgagcagcctattaaagacgccgtcatcacggttccagtgttttttaatcaggctgagaggcgtgccgtgctccaggccgcaagaatggccgggctgaaggtgctgcagcttataaacgacaatactgccaccgcattatcgtatggcgtctttagacggaaggatattaataccactgctcagaacattatgttctacgacatgggctctggaagcactgtctgcactatcgtaacctaccagatggtgaaaaccaaagaagcaggaatgcagccccagctccagattcgcggcgttggtttcgatcgtactctgggggggctcgaaatggaactgagactaagagagagactggctggcctgttcaatgagcagcggaaaggtcagcgcgccaaagatgtaagagagaatccccgggcaatggccaaactgctgcgagaggctaatagactgaaaaccgtactgtccgccaatgctgatcatatggcccaaattgagggtcttatggacgatgtcgatttcaaggccaaagtcaccagagtcgaatttgaagagctctgcgccgacctgttcgaaagagtgcccgggcccgtacagcaagctcttcagagcgccgaaatgtccctggatgaaatcgaacaggtgatactggtgggaggagcgacacgggtaccccgagtccaggaggtgctgcttaaggccgtgggcaaggaagagctcggtaagaatatcaacgccgacgaggcagctgctatgggagcagtttaccaggcggccgccctctcgaaagcctttaaagttaagcccttcgttgtacgggacgccgtggtgtatcccattttagtggaattcactcgcgaagtagaggaggaaccaggaattcactctcttaaacacaataaaagggttctctttagccgcatgggaccatacccacagcggaaggtcattacttttaataggtattctcacgacttcaattttcacattaactatggggatctgggcttcctgggcccggaagatttgcgagtattcggatcacagaatctgacaacagttaagctgaagggtgtgggtgactctttcaagaagtatcctgattacgagtctaaaggaattaaggcacattttaatctggacgagtcgggagttctgtccctggacagggttgagagcgtatttgaaacactcgtcgaggattctgctgaggaagaatccacactaaccaagctgggcaatacaatatccagcttgttcggcggagggactacccccgacgccaaagagaacggcaccgatacagtgcaagaagaggaagagtctccggccgagggcagcaaggatgagcctggggaacaggtggagctcaaggaggaggccgaggctcctgtcgaagatgggtctcagccccccccgcctgaaccaaaaggagatgccacacctgagggagaaaaggcgacagaaaaggagaacggagacaaaagcgaagcgcagaagccaagcgagaaggctgaggctgggcctgaaggtgttgctccagcgcccgagggggaaaaaaaacagaagccagcacggaagagaaggatggtcgaggagattggagtggaactggtggttttagaccttcccgatctgcctgaagacaaactagcccagagtgtacagaaactacaagatttgacactccgcgacctagagaaacaggaacgggaaaaagccgcaaattccctggaagcgtttattttcgaaacacaagacaagctgtaccagcctgagtaccaagaggttagcaccgaagaacagcgtgaggaaatttccggcaaactttccgcagcgtcaacttggctcgaggatgagggagtgggtgcaaccactgtgatgctaaaggagaaactggctgagttacgcaaactctgccaggggctgttcttcagagtagaggagaggaagaagtggcctgagcggttaagcgccttggacaaccttctgaatcactctagtatgtttctgaagggggcgagactaattccagagatggaccagattttcaccgaagtggagatgacaaccctggagaaggtcattaacgagacttgggcttggaagaacgctacactcgccgagcaggctaaattaccagcaacagaaaagcctgtcttgcttagcaaagacatagaggccaagatgatggccctagatcgagaggtgcagtatttgttgaacaaggctaaatttacaaaacctagaccacgccccaaagacaagaatggaacacgagctgaaccacctttaaatgcatcagcaagtgaccaaggcgaaaaggtgatccctccagcaggtcagactgaggacgctgagcccataagcgagccagaaaaagtggagaccgctggctctgaacctggagatacagagcccctggaattggggggccccggggcagaacccgaacaaaaggagcagtcaacgggccaaaagcgacctctcaaaaacgacgaactgtag

SEQ ID NO: 191188 - DNA, 3000 bp, Artificial Sequence
  Description of Artificial Sequence: Synthetic coding sequence
atggccgacaaggtgcggcggcagcggccccggcggcgggtgtgctgggctcttgttgcagtcctgctggcggatctgctggcactttccgatacactggccgtgatgagcgtggacctgggttctgagtcgatgaaagtagctatcgttaagccaggcgtgcccatggagatagttctgaataaagaatctcgcaggaagacgccagtaatcgttactcttaaggagaacgaacggttcttcggggactctgctgcgtcaatggcaattaaaaatccaaaggcaaccctgcgctacttccagcacctgctgggcaagcaggccgacaacccgcatgtggccctataccaagccagattccctgagcacgaactcacttttgatcctcaacgtcagactgtccatttccagatctcctcgcagttgcagttctcacccgaggaggtgcttgggatggtgctcaactactctcgctccctggcagaggactttgccgaacagcccattaaggatgcagtgattacggtgcccgtctttttcaatcaggcagagcgccgagccgtgctgcaggctgctcggatggcaggacttaaagtccttcagctgatcaacgataatactgcgaccgctttgagttacggcgtgttccgacgaaaagacatcaacactacagcccaaaatattatgttctacgatatgggaagtgggtctacagtgtgcacaatcgttacataccagatggtaaagaccaaggaggctggtatgcagccgcagctccagatcaggggagtcggctttgatagaacactgggaggtctggagatggagctgcggttgagagaaagactcgccggcctcttcaacgagcagcgcaaagggcagcgcgctaaagacgtgcgagaaaatcctcgggctatggccaagctcctgagggaggccaataggctgaagactgtactgtcagctaatgctgatcatatggcgcagatcgaagggctcatggatgacgtcgatttcaaggccaaggttactcgcgtggaattcgaggaactgtgcgcagatctgtttgagagggttccgggccccgtccagcaggctttgcaatccgcggaaatgtcccttgatgagattgagcaggttatcctagtgggaggcgccacaagggttcctcgggttcaggaagtcttgttaaaagcagtgggtaaagaagagttgggtaaaaatattaatgctgatgaggctgctgcgatgggggccgtgtatcaggccgccgcactctcaaaagccttcaaagtgaaaccttttgtggtgagagacgccgtggtgtatcctatcctggtggagtttactcgcgaagtggaggaggagcccggaatacacagcctcaaacacaacaagagagtactcttcagtcgcatgggcccttaccctcaacgcaaggttatcaccttcaatcgctacagccacgactttaatttccacattaattatggggacctcggtttcctggggccagaggatttacgcgtttttgggagtcaaaacctaaccaccgtaaaacttaaaggcgtcggggactcatttaagaagtatcccgattacgaatccaaggggatcaaagcccattttaacctggacgagtccggcgtcctcagcttggacagggtggagtccgtgtttgagacactggtggaagatagtgctgaggaggagtcaaccctgacaaagctgggcaatactatctctagcttatttggaggaggaaccacacccgacgccaaggagaacggtacagacaccgtgcaggaagaagaggagagcccagcagaaggttcgaaagacgagcctggtgagcaggtggagctcaaagaagaggcagaagctcccgtagaggatggttcgcaaccacccccgccagagcccaagggggacgccacccctgagggcgaaaaagccactgaaaaggaaaacggcgataagtctgaggcccagaagcccagcgaaaaagccgaagcaggaccggagggagtggctcctgccccggaaggcgagaaaaagcagaagcccgcgaggaaaaggagaatggtggaggaaatcggcgtcgagttagtggtactggaccttcctgacttacctgaagataagcttgcacaaagtgtgcagaaattgcaggatctgaccctaagagatttagaaaaacaggagcgggaaaaggcggccaactctctcgaggcgttcatatttgagacacaggataagctgtatcagcccgaataccaggaggtttcgactgaggagcagcgggaggaaatctccggtaaactgtctgctgccagtacatggctcgaggacgaaggggttggagccacaaccgtgatgctaaaggaaaaactggccgagcttcggaaactttgccaaggccttttcttccgcgtggaagagaggaagaaatggcctgaaaggttatctgcgctggataatcttttgaatcattcgtctatgttccttaaaggcgcccgactgatccccgagatggaccagatctttacagaagtcgagatgacaacactcgagaaggtgattaatgagacctgggcctggaagaatgcaacgctcgcggagcaggccaaactgcccgcaaccgagaagcccgtgctgctcagtaaagacatcgaagcaaagatgatggccttggacagggaagttcagtacctccttaacaaggccaaattcaccaagcctcgccccagacctaaggataagaatgggacgcgcgctgagcctcctctgaacgcctctgcttccgaccagggtgagaaagtgattcccccagccggacaaaccgaagatgctgagcctattagtgagcccgaaaaggtggagaccggtagcgagcccggtgataccgagccactcgaacttggaggaccaggcgcagagcctgaacagaaagaacagtccacgggtcaaaagcgccctcttaagaatgacgaactgtag

SEQ ID NO: 191189 - DNA, 2547 bp, Artificial Sequence
  Description of Artificial Sequence: Synthetic coding sequence
atggtgctgaactacagccggagcctggccgaggacttcgccgagcagccaataaaagacgcagtcataaccgttcccgtattcttcaaccaggccgaaaggcgcgccgttttacaagcagccaggatggcgggacttaaggtgctgcagctgataaacgataacactgcaacagccttatcatatggagtattcagacggaaagatatcaatactactgcccagaacatcatgttctacgatatgggtagtgggtctaccgtgtgtacaatcgtgacttaccagatggtgaaaaccaaggaggccgggatgcaacctcaattgcagattaggggcgtcggatttgataggaccctgggtggcctggagatggaacttagacttcgcgaacgccttgcaggcctgtttaacgagcagcggaagggccagcgcgcaaaagacgtcagggaaaaccctagggctatggcaaaactgctgcgggaagctaatcgcctcaaaacggtcctaagcgcaaacgcagaccatatggctcagatcgagggtctgatggatgatgtggattttaaagccaaagttactagggtggagttcgaggaattatgtgcagacctgttcgagcgggttccagggcctgtccagcaggcactccagtctgcggagatgtctctggatgaaatcgaacaggttatcctagtggggggagccactcgcgtcccacgcgtgcaggaagtcctgctgaaggctgtaggaaaagaggagctgggtaaaaacatcaacgctgacgaggccgcagcgatgggagcagtgtaccaggccgcggccctgtccaaagcgttcaaggtcaagccattcgtggttagagacgcggtggtgtatccaatcctggtggagtttacccgagaagtcgaagaagagcctggaatccactctctcaagcacaataagcgcgtgctgttcagcagaatggggccctacccacagcggaaggtaatcactttcaacaggtacagtcatgattttaacttccatatcaattacggcgacctgggatttctgggtccagaggacctacgagtctttgggtcacagaacctcactactgtgaagctaaagggggttggcgactcattcaagaagtacccagattacgagagcaaaggcattaaagctcacttcaacctggacgaatccggcgtgctttcactagaccgggtcgagtcagtttttgaaaccctcgtggaagactccgccgaggaggagtctacactgacgaaactgggaaacacgatctcatccctttttggtggcggcacaacgccggatgccaaagagaatggcacagacacggtacaagaggaagaggagtcgcccgctgagggatcaaaagacgagccaggagagcaggtcgagctcaaagaagaggctgaagccccagtggaagacgggagccagcctccaccccccgaacccaagggagacgccactccagagggagagaaagccacggagaaagagaacggggacaagtctgaggcgcagaagccgtccgaaaaggccgaagctggaccagaaggggtggcaccagctcccgagggggagaagaagcagaagcccgccagaaaaaggagaatggtggaagagattggcgtagagcttgtagttctggacctcccagaccttcccgaggacaaactcgcacagtcggtgcagaaactgcaggacttgacactccgcgatctggaaaagcaagaacgggaaaaggccgccaatagcttagaagcttttatcttcgaaacacaggacaagctttatcagccagaatatcaggaagtatcaacggaggaacagagggaggagatttccgggaaattgtccgcagcttccacttggcttgaggacgagggagtgggcgctacaacagtgatgctgaaggaaaagctcgcagagctccgcaagctgtgccagggcttattttttcgcgtcgaggaaagaaagaaatggcccgaaagacttagcgctctggataacttactgaaccatagctccatgttcttgaagggcgccagactcatccccgagatggaccagatcttcacagaagtagaaatgacgactctggaaaaggtgattaatgagacatgggcatggaagaacgctaccctggctgaacaagcaaagctccctgcaacagagaaacctgtgctcctgtccaaagatattgaagctaagatgatggcactggacagagaggtgcagtatctcctgaataaggcaaagttcactaagccaagacctaggccaaaagataagaacgggacaagggccgagccacctcttaatgcctctgccagtgaccaaggggaaaaggtgatcccacctgcgggacagactgaggatgccgaacctatctctgagccagagaaggtcgaaaccggatctgagcccggcgataccgagcctctcgagttaggaggcccaggagcggaacctgaacaaaaggaacagtccacaggccaaaaacgccccctgaaaaacgatgagttgtag

SEQ ID NO: 191190 - DNA, 2040 bp, Artificial Sequence
  Description of Artificial Sequence: Synthetic coding sequence
atggccgacaaggtgcggcggcagcggccccggcggcgggtgtgctgggccctggtggccgtgttactggcagaccttcttgctctatccgacacccttgccgtaatgtctgtggatttgggttctgagtctatgaaggtggccattgttaagcctggtgtgcccatggagatcgtgcttaacaaggaaagccggaggaagacaccggtgatcgtgaccctcaaggagaatgagcggttcttcggggacagcgccgcctcaatggctattaagaaccccaaggccactctgcggtacttccagcacctgcttggcaagcaggctgataatcctcatgtcgctctttaccaagctcgcttcccagagcacgaactcacttttgacccccagcggcagactgtgcactttcagatcagctctcagcttcagtttagcccggaggaggtcctgggcatggtgcttaactactcgcgaagcctggcagaagactttgctgagcagccaatcaaggacgctgtgatcaccgtccccgttttttttaaccaggctgaacgccgtgccgtacttcaagcagccaggatggccggtctcaaggttttgcagttgataaacgataacactgctaccgccctgtcatatggcgtctttagaagaaaggacattaataccacagcccaaaatattatgttttatgacatgggttctggttctaccgtctgcaccattgttacatatcagatggtgaagacaaaggaagccggcatgcagcctcagcttcaaatccggggcgtgggtttcgatagaacgctcgggggactggagatggagctgaggctaagggagcggcttgccggcttgtttaacgagcagagaaaagggcaaagggctaaagatgtgagggaaaacccccgggcgatggccaagctactgagggaggctaaccggttgaagactgtgttgagcgccaatgcggaccatatggcacaaattgagggcctgatggatgacgtcgattttaaagctaaagtgactagagtggaatttgaggagctgtgcgccgacctgtttgaacgtgtacccggacctgtgcaacaggccctgcagagcgccgagatgagcctcgatgagattgagcaggtcattcttgtcggcggagccaccagggttcccagggtgcaagaggtgctcttaaaagcagtcggaaaagaagagctggggaagaacataaatgcggacgaggcagccgctatgggggctgtgtaccaggctgccgccttatctaaggcattcaaggtcaagcccttcgtcgtgcgggacgctgtagtctatcccatcttggtagagttcacaagggaagttgaggaggagcccgggatccattctcttaaacacaacaagagagtgttgtttagtagaatggggccctacccacaacgaaaagtcattaccttcaacagatattctcacgacttcaatttccacataaactacggagatttaggattcctcggacccgaggacctaagagtattcggaagccagaatctcaccacagtcaagctcaaaggcgtaggcgactcatttaagaagtaccccgattacgagagcaaggggatcaaggcccactttaatctggacgaatcaggggtcctcagcctcgatcgagtcgaatcagtcttcgaaaccttagtagaggattccgccgaggaagaatccaccctgaccaagttaggtaacacgattagttcgctgtttggtgggggtacaactcccgatgctaaggagaatggaacggacactgtgcaggaggaagaggagagcccagctgagggcagcaaagatgagcccggtgagcaggtggaacttaaggaggaggcggaggctccagtcgaggatggctcgcagccaccgccgcctgaaccaaaaggcgacgctacgcctgaaggagagaaagccaccgagaaggaaaatggtgataagagtgaggctcagaagcccacgtccgtgtgccgggcttcagtgacacgcttcgggttctag

SEQ ID NO: 191191 - DNA, 444 bp, Artificial Sequence
  Description of Artificial Sequence: Synthetic coding sequence
atggccgacaaggtgcggcggcagcggccccggcggcgggtgtgctgggcactggtggcagtcctgctggcagacctgttggccttatcagataccctcgccgtgatgagtgtggacctcggcagcgagtccatgaaagtagcgattgtcaagcctggtgtcccaatggagattgtcctcaataaagagtctaggcggaaaacacccgttatagtgacactgaaggagaacgaacggttctttggtgacagcgccgccagtatggccatcaagaaccccaaggcgacccttcgatactttcagcacctgctaggcaaacaggcggacaaccctcacgtagctctctaccaagcccgcttccccgagcatgaattaactttcgatcctcagagacagactgtgcattttcagattagtagccagctccagtttagtcccctttag

SEQ ID NO: 191192 - DNA, 1680 bp, Artificial Sequence
  Description of Artificial Sequence: Synthetic coding sequence
atggccatcaagaaccccaaggccaccctgcggtacttccagcaccttttaggcaaacaggcagacaacccccacgtggcgttgtaccaggcaaggttcccagaacatgagctgacattcgatccacaacggcagaccgtgcatttccagatcagctcacaactgcagttctcccccgaggaagtgttggggatggttctgaactactccagatcactggccgaggactttgcagagcagccaatcaaagatgcagtgataaccgtcccagtttttttcaatcaggcggagcgtcgcgcggtgctacaagcagcgcgaatggctggcctgaaagttctacagttgattaatgataataccgctactgccttatcttatggtgttttcagacggaaggacatcaataccaccgctcagaacatcatgttctacgatatgggctcaggctccaccgtgtgcacaatcgtaacatatcagatggttaagaccaaagaagccgggatgcagccccaattgcaaatccggggagtcggcttcgatcggactctgggtgggctagagatggagctgcgactgcgggaacgacttgccggcctctttaatgagcagcgaaaaggccagcgggccaaagacgtcagagaaaaccctcgggcgatggctaagctgcttcgggaggcgaatcgactgaagaccgtgttatccgccaacgcagatcatatggcacaaatcgagggactcatggacgacgtggattttaaggcgaaggtgacaagagtggaatttgaagaactctgcgctgacctcttcgagagggttcctgggccagtgcaacaagcattgcaatcagcggagatgtcactggatgagattgagcaggttattctcgtcggaggggctacaagagtgccccgcgtacaggaggtgctcctcaaagcagtggggaaggaggagttgggcaagaatatcaacgcagatgaggcagctgccatgggggcggtttaccaggcagctgctctttcgaaagcgttcaaggttaagcctttcgtggtaagagacgcggtcgtgtatcctatactggtcgagttcacccgtgaggtcgaggaggagccaggaatccactctctgaagcataataagcgcgtgttgttctctcgaatgggcccatatccacagaggaaagttattacattcaacagatacagtcacgactttaactttcacatcaattacggtgacctgggcttcctggggcctgaggaccttcgcgtctttggatcccagaatctaacgactgtgaagttaaaaggggtcggcgactcgtttaaaaagtaccctgactacgaatcaaagggtatcaaagcacacttcaatctggacgagagcggggtgctgtccctggatcgtgtcgagagcgtcttcgagacgctagtcgaggattccgcagaggaagaatccactttgacgaaattaggaaacactatttctagtctattcggcgggggcacaacacctgatgccaaagaaaatggtaccgacaccgttcaaatgctgttcttgtgtcctgctagactccctcagagcaaacaggctatagacaggttccatactgcagtcacttgtatggagccaccatggggacgaaggtgtcgtgcccgcccagcctggaggctatgctcatag

SEQ ID NO: 191193 - DNA, 2943 bp, Artificial Sequence
  Description of Artificial Sequence: Synthetic coding sequence
atgtggcagagccggggccccatgctgttccacctgggcctgtgcgttggggctgccggcatgattcgggagtggtttgtgccaatcagacgcgaaaaaggatctcgcttgatttgcccaggaggcactatggccgacaaggtgcggcgccaaagaccacgacgaagagtttgctgggccctcgttgcagtgctactggccgacttgttggctctgagcgacaccttggctgtcatgtccgtggacctcggatcagaatccatgaaggtggcaatagttaagcccggggtgcccatggaaattgtcctcaacaaagaatccaggagaaagacaccggtaatagttaccctcaaggagaacgaacgtttctttggtgattcagccgccagcatggctattaaaaacccaaaagcaacgctgagatacttccaacacttactgggtaaacaagctgacaacccacacgtggccctatatcaggcgcgcttccccgagcacgagctaacattcgatcctcaacgccagacagtgcacttccagattagctcccagctgcagttctcgcccgaggaagtgctggggatggtgctgaattatagcaggagcctggctgaagattttgctgaacagccgataaaggatgcagtgattaccgtacctgtcttctttaaccaggcagaacgacgggccgtcctgcaagcagcccgcatggctgggctcaaggtgctgcagctcatcaacgataacaccgccacagcactttcttatggcgttttccgccggaaagatataaacacaaccgcccagaatattatgttctacgacatggggagcgggtccacggtctgcaccatcgtgacttaccagatggtaaagactaaggaggctggtatgcagccacagttgcagatcaggggtgtgggcttcgatcgcacacttggaggcctggagatggaactgcggttacgtgagagactggcgggcctcttcaatgaacagcgcaaagggcagagagctaaagacgttagggagaaccccagggcgatggctaaactgctgagagaagcgaaccgtctgaaaacggtgttatctgcaaatgccgaccacatggcccagatcgaaggccttatggatgacgttgactttaaggccaaggttacgagagtggagttcgaagaactctgtgctgatctgtttgagagagtgccagggcccgtccagcaagccctgcagtcggccgaaatgagtctggacgagattgaacaggtgatactcgttggtggagccactcgtgttccacgagtgcaggaggtgctgcttaaggccgtggggaaggaagaactcggaaaaaacataaatgctgatgaggccgccgctatgggagcagtgtaccaagccgcggctctgtcaaaagctttcaaggtgaagccatttgtagtgcgcgacgccgttgtttatcctattctcgttgaattcactagagaagtcgaggaagaacccggtattcattccttaaaacataacaaacgcgtcttattctctcgcatgggaccctacccccaacggaaggtaataacattcaaccgctattcccatgacttcaatttccatatcaactacggcgatcttggttttctgggccctgaagatctgcgcgtgtttggtagccaaaacctaacaaccgtgaagctcaaaggcgtgggcgattcatttaaaaaataccccgattacgaatctaagggtataaaggcccatttcaacttggacgagagcggtgtgctgtccctggatcgggtggaatcagtctttgagaccctcgtggaggactcagccgaagaggaatcaactctgactaaactcggtaatactatctcctcattatttggcggggggacgacaccggacgccaaagaaaacggaacagataccgtccagaagccctccgagaaagccgaggctggcccagagggggtcgcacccgctcctgagggggagaaaaagcaaaagccagcacggaagcgccgtatggtggaagaaatcggagtcgaactggtagttctggacctgccagacttgcccgaggacaaactggcacagtcagtgcaaaaactgcaggaccttactctgagggatctcgagaagcaagagagggaaaaagcagcaaattcgctggaagctttcatattcgaaacacaggacaaactctatcagccagagtaccaggaggtcagcacagaagaacagcgcgaggagatctctggaaaactgagcgccgcctctacctggctcgaagatgagggcgtgggcgcaaccaccgtgatgcttaaagagaagctcgccgagctgagaaagttatgccaaggccttttcttccgggtggaagaaagaaagaaatggccggaaagactgtcagccctggacaacctcctgaatcactcatcaatgtttctgaagggagctaggttaattcccgaaatggaccagatcttcacagaagtagaaatgacaacactggagaaggtgatcaatgagacatgggcctggaagaacgccacactggccgagcaagcgaagttgcctgcaactgagaagcccgtgctgttgtctaaggacattgaggccaaaatgatggcccttgatcgggaggttcagtatcttctgaataaggctaaattcactaaaccacgcccacgcccaaaagataagaatggcacgcgagccgagccgccgttaaacgctagtgcttcagaccagggcgaaaaggtcattccacctgcaggacagaccgaggacgctgaaccaatcagtgagcccgagaaagtggagacaggatcggaaccaggcgacacggagcctctggaattaggcgggcccggcgccgaacccgagcagaaggagcagagtacagggcagaagcggcctctgaagaatgacgaactgtag

SEQ ID NO: 191194 - DNA, 333 bp, Artificial Sequence
  Description of Artificial Sequence: Synthetic coding sequence
atggccccccggggctgcatcgtggccgtgttcgccatcttctgcatcagtcgtctgctctgctcccatggcgcgcccgtggcgcccatgacgccatatctgatgctgtgccagcctcataagaggtgcggagataagttctatgatccgctgcagcattgctgctatgatgacgctgtcgtccctcttgccaggacccagacttgcgggaattgcacattcagagtctgtttcgaacaatgctgtccctggaccttcatggtcaaacttatcaatcagaattgcgactccgcccggaccagtgatgatcgtctgtgtcggagtgtcagctag

SEQ ID NO: 191195 - DNA, 360 bp, Artificial Sequence
  Description of Artificial Sequence: Synthetic coding sequence
atggtgccccggatcttcgcccccgcctacgtgagcgtgtgcctgctactgttatgtccacgggaagtcattgcccctgccggatctgaaccttggctatgtcagcccgcccctcgatgcggagataagatttataacccactggagcagtgctgttacaacgatgccatcgtcagtctgtccgagacccggcagtgtggccctccctgcacattttggccctgtttcgagctatgttgcctggactcattcgggctgacgaatgattttgttgtgaagctcaaggtccagggcgtgaactctcagtgccacagctccccaatctcctcaaagtgtgagtcacgtcggcggttcccttag

SEQ ID NO: 191196 - DNA, 393 bp, Artificial Sequence
  Description of Artificial Sequence: Synthetic coding sequence
atgcggttcagcgtgagcggcatgcggaccgactacccccggagcgtcctagccccagcttacgtgtctgtgtgtctgttattgctgtgtcctagagaagtgatcgcccctgctggctccgagccctggctctgtcagcccgcccctcggtgcggtgataagatatacaatccactagagcaatgctgctataatgatgccatcgtctccctgagcgaaacaagacagtgtggtcctccttgtaccttctggccttgcttcgagctttgttgccttgactcgtttggactcaccaatgatttcgtcgtgaagctcaaagtccagggcgtgaattcgcagtgtcactcttctcccatctcatctaagtgtgaaagccgtcgacggtttccctag

SEQ ID NO: 191197 - DNA, 378 bp, Artificial Sequence
  Description of Artificial Sequence: Synthetic coding sequence
atgcggccccggtgctgcatcctggccctggtgtgctggatcaccgtcttcctgttgcagtgctccaagggcaccactgatgcgcccgtcggctctgggctctggctgtgccagccgactcccaggtgtggtaataaaatttacaaccctagcgagcagtgctgttacgacgacgccattctttccttgaaggagactcgcaggtgtgggagcacttgcactttttggccatgtttcgaattatgctgccctgaatccttcggccctcagcagaagttcctagttaagttgagagtgctcggaatgaagtcccagtgccatctgagcccaatcagcagaagttgcacacggaatcggaggcatgtgctttacccatag

SEQ ID NO: 191198 - DNA, 375 bp, Artificial Sequence
  Description of Artificial Sequence: Synthetic coding sequence
atggtgccccggatcagcgccgccatcttcatcttcgagctgctgggttctaatagtgaaggcgtgactgacctgcgcctatggttgtgtcagcctgccccgagatgcggggaatggacttataatccccttgaacagtgctgcgatgatggcgtgatactggatctgaatcaaacacggctgtgtggaagtagctgcaccttctggccttgcttccagcactgctgcctggagtctttgggcagccaaaaccagacagtcgtgcgatttaaggtacctggcatgaagcccgattgcaagtcaagccccatcacccggatctgcgcacaggaatatcatcctaaaagccccgtcagtagatctgacctgatctag

SEQ ID NO: 191199 - DNA, 1068 bp, Artificial Sequence
  Description of Artificial Sequence: Synthetic coding sequence
atgggccccggccggtgcctgctgaccgccctgctgctgctggcccttgccccacctccagaagctagccaatactgtggacgcctagaatactggaacccggataacaaatgttgctcatcttgtctacagcgttttggcccccctccttgcccggactacgagttccgtgaaaactgcggactgaatgaccacggagatttcgtgacgccaccctttcgcaagtgctctagcggccaatgcaacccagatggcgccgagctgtgtagtccatgcggtggcggggcagttactccaactcctgctgctggcggaggccgcacaccctggcggtgccgcgaacggcccgtgccagccaagggtcactgccccctcaccccaggaaacccaggggccccttccagtcaggagaggagttccccagcctcaagcattgcttggaggaccccggagcctgtccctcagcaggcctggcccaattttctcccactggtggtgctggttctgctgctcacattagctgtcattgcgattcttctgtttatcctgctttggcatctatgttggccgaaagaaaaagcggatccctatccatatcccggcctagtgtgtggggtgcccaatacacacacacctagctccagccatctcagctctccgggggcgcttgagacaggcgatacttggaaagaggcaagcctgttgcctctcctttctcgagagctctcttccctggcaagtcagccgctgtcacgcctcctggacgagctggaggtattggaagaactcatcgtactgctcgaccctgaacctggcccaggcggaggtatggcacatggaaccacccgacacttagccgcaaggtacggactgcccgcagcttggagcacctttgcctactctctgcgcccctctcgttcaccccttagagccctcatcgaaatggttgtagcccgggagccatcagccagtcttggccagttggggacgcacttggctcagttagggagagccgatgcgctgagagtgctgagcaaacttggctcaagtggcgtgtgttgggcttag

SEQ ID NO: 191200 - DNA, 504 bp, Artificial Sequence
  Description of Artificial Sequence: Synthetic coding sequence
atgggccccggccggtgcctgctgaccgccctgctgctgctggccctggctcctcccccagaagcgagccaatattgtggccggctggaatattggaaccccgataacaagtgctgtagctcatgtctgcaaagatttggccccccgccatgcccagagctgagcagtctcgcatcccaacctctaagtaggctgctggacgagctggaggtgctcgaagagcttattgtgctactggaccccgagccaggaccaggaggagggatggcccatggcaccactaggcatctggccgctcgctatgggttgccagcagcctggagtacattcgcttattccctgagaccatctaggtccccgttgagggccttgatagagatggtggtggcacgcgagccctcagcaagtctgggccagctgggcactcacctggcgcagttaggcagagccgacgcactcagggtgctgtcaaaacttggaagtagcggcgtgtgctgggcgtag

SEQ ID NO: 191201 - DNA, 723 bp, Artificial Sequence
  Description of Artificial Sequence: Synthetic coding sequence
atgcccgagcgggacagcgagcccttcagcaaccccctggcccccgatggtcacgacgtggacgatccacattcctttcaccagtccaagctgaccaacgaggattttcggaagttgctaatgacaccccgggccgccccaacttctgctcccccgtccaaatcccgtcaccacgaaatgccccgtgagtacaatgaggatgaggaccctgccgccaggcgtagaaagaaaaaatcctattacgccaagttgcggcagcaggagatcgaacgggaaagagagctggctgagaaataccgtgaccgcgcaaaagagcgcagggatggtgtgaacaaggactatgaagagacagaacttatatctacgactgccaattacagagctgttgggcccaccgctgaagctgacaaatctgcagctgaaaaacggcggcagttgattcaagagtctaagtttctgggcggggatatggagcatacccacctagtcaaggggttggactttgcactgctccagaaagtgcgggccgaaatcgccagcaaggagaaagaagaggaggaactgatggagaaaccccaaaaagaaacaaagaaagacgaagaccccgaaaataaaatagagtttaaaacccgcctgggtagaaacgtgtaccggatgttgtttaaatccaaggcctacgaacgaaacgagttgttcctcccgggtcggatggctatgtggtag

SEQ ID NO: 191202 - DNA, 1674 bp, Artificial Sequence
  Description of Artificial Sequence: Synthetic coding sequence
atgcccgagcgggacagcgagcccttcagcaaccccctggcccccgatgggcacgacgtcgatgatccccactcttttcaccagagtaaattgaccaacgaggacttccgtaagctcctcatgaccccgcgcgcagcgcctacatcagcccctcctagtaagagtcggcaccatgaaatgcccagggaatacaacgaagacgaagatcccgcagctaggcggaggaaaaagaagtcatattacgcgaagttgcgacagcaagaaattgaacgagagcgcgaactcgcagagaagtaccgcgatagagccaaggagaggcgcgatggcgtcaacaaagactatgaggagactgagctgatatctaccactgccaactaccgtgccgtcggccccacggccgaggccgacaaatctgcggccgaaaaacggcgtcagttgatccaggagtccaaatttttgggcggtgacatggagcacacacacctagtgaagggcttggattttgctctgctccagaaagtgagggccgagatcgctagcaaagaaaaagaggaggaagagttgatggaaaaacctcagaaagagaccaaaaaagatgaagacccagaaaataaaattgagtttaaaacacgcctgggaaggaacgtatatagaatgttgtttaagtcaaaagcttacgaaaggaatgagctttttcttcccggccgtatggcctatgtggttgacctggatgacgagtatgctgacactgacatacccacaacgctgatacgaagcaaagcagactgccccaccatggaggcgcagactacccttacaacgaatgatattgtcatctccaaacttacccagatcctgtcttatcttcggcagggcactcgaaacaaaaaactgaagaaaaaggacaaggggaagctggaggaaaagaaaccaccagaggccgacatgaacatctttgaggatatcggtgactatgtaccctccacgacaaaaacaccccgcgataaagagcgagagcggtatcgggaaagagagcgtgatcgggagagggaccgggaccgcgatagggaacgcgagcgcgagcgagacagagaacgcgaacgtgagcgggacagggaaagagaggaggaaaagaaacgtcacagctattttgagaagcccaaagtggacgacgagcccatggacgtggacaaggggcctgggagcactaaagagctcatcaaatcgatcaatgagaagttcgctggatctgcaggttgggaggggacagagtccctcaaaaagcctgaagacaaaaaacagttgggagatttcttcggtatgtcaaattcttacgctgaatgttaccctgctaccatggatgacatggccgtagactcagatgaagaagttgattacagtaagatggatcagggcaacaagaaggggcccctgggccggtgggattttgacacacaggaggaatactcggaatatatgaataacaaggaagctctgcccaaggcagccttccagtatggcatcaaaatgtcagagggccggaagacgcgcaggtttaaagagaccaacgataaggccgagttagaccgccagtggaagaagattagtgcgataatcgagaagagaaagaagatggaggcagatggggtggaagtcaaaagacctaagtactag

SEQ ID NO: 191203 - DNA, 1560 bp, Artificial Sequence
  Description of Artificial Sequence: Synthetic coding sequence
atggacgccgacgagggccaggacatgagccaggtgagcggcaaggaatctccacccgtaagcgacactcccgacgagggagacgagccgatgcctattcccgaggacctaagcactacatcaggagggcagcagtccagtaagagcgacagggtcgtggcatccaacgtgaaggtagagacccaatctgacgaagagaatggtcgggcttgcgaaatgaacggtgaggagtgtgctgaagatcttcggatgctcgacgcctccggggagaaaatgaacggtagccacagagaccaggggtcttcagctctgtccggggtaggaggaatccggctgcccaacggaaaactgaaatgtgatatttgcgggatcatttgtataggccctaacgtgttgatggtacacaagcggagccatactggggagagacctttccagtgcaatcagtgtggcgcaagttttacccagaagggtaacttgctgagacacatcaaactgcattccggtgaaaaaccatttaagtgccatctgtgtaattacgcttgtcgccgcagggacgcgctaacaggtcatcttagaacacattcagtcggcaagcctcacaagtgtggatattgcggacgctcgtataaacagagaagctccctggaggagcacaaggagcggtgccataactaccttgagagtatgggcctgcccgggaccctgtacccagtgatcaaggaggagaccaaccacagcgagatggccgaggatctgtgtaagattggctccgagagaagtctggttctggaccgactggcttcgaacgtcgccaaaaggaagagcagcatgccacaaaagttcctgggggataagggacttagcgacacaccatatgatagcagtgcatcttacgagaaggagaacgaaatgatgaagagccatgtcatggaccaggccattaataacgccataaattacctgggcgctgagtcgctcagacctctggtccaaacccccccaggaggctccgaagtggtccccgtgatcagcccaatgtaccagcttcacaaacctcttgctgagggtaccccacgtagcaatcatagcgcgcaagacagcgctgtcgagaacctgcttcttctaagcaaggccaagctcgtgccaagcgagagagaagcctctccttccaattcatgtcaggactccactgacacagagtccaataacgaggagcagagatctggactgatatatcttacaaatcatatcgccccccatgccagaaatggcttgtctctgaaggaagagcaccgggcctacgatctgctacgagccgcaagcgagaacagccaggatgccctacgggtagtctcaacatcaggcgagcagatgaaagtgtataaatgcgagcattgtagagtgctcttcctagaccatgttatgtacactattcacatgggctgccatgggtttagagatccttttgagtgtaatatgtgcggatatcatagccaggatagatacgaattcagctcacacatcacacgaggagaacatcgattccatatgtcttag

SEQ ID NO: 191204 - DNA, 1299 bp, Artificial Sequence
  Description of Artificial Sequence: Synthetic coding sequence
atggacgccgacgagggccaggacatgagccaggtgagcggcaaggaatcaccgcctgtgtccgacaccccagatgaaggcgacgagcccatgcctattcctgaagacttgtccacaacctccgggggtcaacagagttcaaagagtgaccgtgtggtgggagaacgcccgttccaatgcaaccagtgtggcgcaagcttcacgcaaaagggaaacctcctgcggcacattaagcttcattcaggcgagaagccattcaagtgtcacctgtgcaactacgcttgtcggcgaagagacgctttgactggccacctcaggacacatagcgtaggaaaaccacataaatgcggatactgtggccgctcgtataaacaaaggagttccctagaagaacacaaagagcgttgccacaactacttagagagtatgggcctgccgggaacactttacccagtgattaaggaagaaacaaaccacagcgagatggcagaggatctttgcaaaatcggtagcgaacgctcacttgtgctagacagactcgcgtccaacgtcgctaagagaaagtcctctatgccacaaaaattcctaggggacaaaggcctttccgataccccgtacgatagttccgcctcctacgaaaaggaaaacgagatgatgaagtcacatgttatggaccaggccatcaacaatgctattaactatctgggggccgagagcttgaggccactcgtgcagacccccccgggtggttcagaggtcgtacccgttatcagtcctatgtaccagctgcacaaaccgctggcagagggcaccccccgttcgaaccattctgcgcaggattccgcagtggagaacttactcttactgtctaaggctaaactggttccatccgagagggaggcttcacctagtaatagctgccaggactccacggacaccgagtctaataacgaagaacagcgctcagggctcatctatctaaccaaccatattgccccgcatgcgcgaaatggcctgagtctgaaagaagagcaccgggcttacgatctcctgcgcgctgccagcgaaaacagccaggacgccctccgagtcgtgagcacttcaggagagcagatgaaggtttacaaatgtgagcactgtagggtcctcttcttagaccatgtgatgtacacaattcacatgggctgtcacggctttcgcgaccccttcgaatgtaacatgtgtgggtaccacagccaggaccggtacgaattcagctctcacattacccgtggggagcaccgcttccacatgtcgtag

SEQ ID NO: 191205 - DNA, 870 bp, Artificial Sequence
  Description of Artificial Sequence: Synthetic coding sequence
atggacgccgacgagggccaggacatgagccaggtgagcggcaaggagtcaccccctgtcagtgacacacctgacgagggcgatgaacctatgccaatcccagaagacctgagtactacttctgggggacagcagtccagtaaatctgatagggtggtgggtgataagggactttctgatacaccttacgattcctcggcaagctatgagaaggaaaatgaaatgatgaagtcccacgtgatggaccaggcaattaataatgccataaactatttgggggcagagtcactgcgccccctcgtgcagaccccccctggaggaagcgaggtggtccctgtgatctccccaatgtatcagcttcacaagccactagccgaaggtactccccggagcaatcacagtgcacaggacagtgccgtggagaatcttttgttgctcagtaaagcgaaactggtgccttccgaacgcgaagcgagtccgtccaattcgtgtcaagactccactgatacggagagcaataatgaggagcaacgctctggtctgatctacctgacaaatcatattgctccacatgctagaaacggcttgtcactcaaggaggagcatcgggcctatgacttgctgcgagcggcatccgagaatagtcaggacgctttgagggtagtgagcacgtccggtgaacagatgaaggtgtataagtgcgagcactgtcgggttctcttcttggatcatgtaatgtacaccatccatatgggatgtcacgggttcagggatccattcgaatgcaatatgtgtgggtaccactcccaagatcgatatgagttttcgagtcatataactcgaggcgaacatagattccacatgagctag

SEQ ID NO: 191206 - DNA, 1131 bp, Artificial Sequence
  Description of Artificial Sequence: Synthetic coding sequence
atggacgccgacgagggccaggacatgagccaggtgagcggcaaggagtccccccccgtctcggatacgcctgacgaaggggacgagcccatgcccatccccgaggacctttctaccacctcaggcggtcagcagtcctccaagtccgacagagtggtcgcctccaacgtcaaggtggagacccagtctgacgaggagaacggaagagcctgcgaaatgaacggcgaggaatgtgccgaggacctacgaatgctggacgcctcaggtgagaaaatgaatgggagccacagagaccaggggtcttctgcactctcaggcgtaggcggaattaggctgcctaatggcaagttgaagtgtgacatatgtgggatcatttgcattggacctaacgtcctgatggtgcacaagagatcgcatacaggagataaaggattatccgataccccttatgactcctccgcctcttacgaaaaggaaaacgagatgatgaagtcacacgtaatggaccaggctattaacaatgccattaattacctgggggccgagtcattgagacctctggtgcagacacctccgggcggcagcgaagtcgtgcccgtgatctccccaatgtaccagcttcataaacctctagccgaagggactccccgttcaaaccactccgcccaggactcagctgtcgaaaatctgttactgctctctaaagcgaaactagtgccttctgaacgtgaggcaagtccctccaactcctgtcaagattccactgatactgaatcaaataatgaggagcagcgctcgggactgatctaccttaccaaccacatagcccctcatgcaagaaatggcctatctctgaaagaagagcaccgggcatacgatctgctgcgggcagccagtgagaatagccaagatgcactgcgggtcgtatctacctccggagagcaaatgaaagtctataaatgtgagcactgtagagtgctgtttcttgaccatgtgatgtacaccatccacatgggttgccatggcttccgagaccctttcgagtgcaatatgtgcggataccattcgcaggaccggtacgagttctctagccacatcacgcgcggggagcaccgcttccatatgagctag

SEQ ID NO: 191207 - DNA, 1299 bp, Artificial Sequence
  Description of Artificial Sequence: Synthetic coding sequence
atggacgccgacgagggccaggacatgagccaggtgagcggcaaggaaagtccaccggtcagcgatactccagacgagggcgacgagcctatgcccatcccagaggacttgagcactacctcagggggccagcaaagtagcaagagtgatagagtggtcgcgtctaacgttaaagtcgaaactcagtcggatgaggaaaatggccgagcttgcgagatgaacggagaagagtgtgcggaggacctccgcatgctggacgcctccggcgaaaagatgaatggcagccaccgagatcagggatcttctgcgctgtccggagtaggcggcattcgtctccctaacggcaaattaaagtgcgatatctgtggcattatctgtattgggcccaacgtcttaatggtccataagagatctcatactggcgagcgacctttccagtgtaatcagtgtggtgcaagcttcactcaaaagggaaacctgctgagacacattaagctgcactcaggcgaaaaacctttcaagtgtcacctctgtaactacgcctgtcggcgacgcgacgcattgacaggacacctgaggacgcattccggagataaggggctgtccgatactccctacgattctagcgcgtcctacgagaaagaaaatgagatgatgaaatcacatgtgatggaccaggcaattaataacgcgataaattacctgggggcggaatcgctgcgccctctggtgcagacgccacctgggggctctgaggtagtgcccgtgatatcccccatgtaccagttacacaagccgctggcagaaggaacccccaggagcaaccacagtgctcaggatagtgcggtcgagaatttacttttgttatcaaaggcgaaactcgtgccatccgagcgagaggcatctccttctaacagctgccaagactcaactgacactgagagcaataacgaggagcagcggtccggactgatctatctgacgaaccacatcgccccccatgcccggaatggactttccttaaaggaagagcacagggcctacgatctgctgagggctgcatccgagaactcgcaggacgctttgagagtcgtttcaacgtcaggggagcagatgaaggtgtacaagtgcgagcattgtagagtgctctttcttgaccatgttatgtacactatccacatggggtgtcatggattccgggacccctttgagtgtaacatgtgtggatatcacagccaagatcgctatgagtttagcagccacatcacacgaggagaacatcgctttcacatgagttag

SEQ ID NO: 191208 - DNA, 1434 bp, Artificial Sequence
  Description of Artificial Sequence: Synthetic coding sequence
atggacgccgacgagggccaggacatgagccaggtgagcggcaaggaaagtccaccagtttctgacacacctgatgagggggatgaacctatgcctatccctgaagatcttagcacaacttccggtggccagcagtcgagcaagtcagaccgggtggtggccagtaatgtgaaggtggaaacccagagcgatgaagaaaatggccgggcatgtgaaatgaacggtgaggagtgtgccgaggacctgagaatgttggatgcctccggcgaaaagatgaatggctcccatagggatcagggcagctctgccctgtcgggagttggagggatccggctccctaacggaaagctgaagtgcgatatctgtggcatcatctgcatcggacccaacgtgctgatggtacacaagaggagtcacacaggtgagcggccattccagtgtaatcagtgcggggcctcttttacacagaagggcaacctgctccggcatatcaaacttcattccggtgaaaagccctttaaatgtcacctctgcaactacgcttgtagacggagggatgccttgacaggccaccttaggacccattctgtgattaaggaagagacaaaccattctgaaatggccgaggacctctgcaagattgggagcgaaaggagtctggtccttgaccggctggcttcaaacgtggcaaagaggaaaagcagtatgccgcaaaaatttctgggggacaaaggtttgtcagacaccccttacgactcctcagcttcttacgaaaaagagaatgagatgatgaagtcccacgtgatggatcaggctataaacaacgcaatcaattacctgggtgctgagtcattgagacctctggtgcagactccaccaggggggtcggaggtcgtcccagtcattagtcctatgtaccaacttcacaaaccgttggccgagggcacgcctaggtccaatcattctgcccaagattcggcagtggagaaccttctcctgctgtcgaaggctaaactcgtaccctcagagagggaggccagccctagtaacagttgtcaagattccaccgacacggagtccaataatgaagagcagagaagcggcctcatttacctaaccaatcatatcgcgccccacgcccgaaacggcttgagcttaaaggaagagcatagagcttacgaccttctcagggccgcctccgagaatagtcaggatgcactgagggttgtcagcacctccggagaacagatgaaagtgtacaaatgcgagcactgccgcgtgttgtttctggaccacgttatgtacaccattcacatgggctgtcacgggtttcgcgaccctttcgagtgcaatatgtgtggataccattcccaggaccgatatgaattttcctcgcatattacacgtggagagcacagatttcatatgtcctag

SEQ ID NO: 191209 - DNA, 1299 bp, Artificial Sequence
  Description of Artificial Sequence: Synthetic coding sequence
atggacgccgacgagggccaggacatgagccaggtgagcggcaaggaatctcctccagtgagcgacacacctgacgagggagatgagcctatgcctattcccgaagatctgtctacaactagcggaggtcagcaatcttcaaaaagcgacagggtcgtcggtgagcggcccttccaatgtaatcagtgtggggcctcgttcacacagaagggcaaccttttgagacatataaaacttcatagcggtgaaaagccttttaagtgtcatctttgcaattacgcctgtaggcgtagagacgcacttaccggtcacctgcgaacgcattccgtggggaagccacacaagtgtggctactgtggtagaagctacaagcagcgctcctcgttggaagaacataaggagaggtgccataactacttggaatcaatgggtctgccaggaaccctgtaccccgtgatcaaagaagagaccaaccattctgaaatggccgaagatttgtgtaagattgggtcagaacgatctctggtactcgaccggctggcgagtaacgtggccaaaagaaagagcagcatgccgcaaaagtttctgggtgacaagggcctgagcgacacgccatacgactcctccgcttcatacgagaaagaaaatgaaatgatgaaatcccatgtgatggaccaagctattaataacgccatcaattacctcggagccgagagcttgcgcccccttgtgcaaaccccccccggaggaagcgaagtcgtgcctgtgattagtcctatgtaccagctgcataaacccttggcagagggaacccccaggtctaaccatagcgctcaggatagcgctgtggagaacctgctgcttcttagcaaagccaaactcgttcctagcgaacgcgaagcaagcccatctaacagctgccaggattctacagataccgagagtaataatgaagagcaacggtccggcctgatctatttaaccaatcacattgctccccacgctcgcaacggcctgagtctgaaggaggagcaccgggcctacgacctgctgcgggctgcttcagagaatagccaggacgcactgcgggtcgtgagcacgtccggcgagcaaatgaaagtgtacaaatgcgagcattgcagagtcctgttcctggatcacgtgatgtacaccatacacatgggctgccacgggttcagagatccatttgagtgcaacatgtgcggctaccatagccaggaccgatacgagttcagttcacacattacgcgtggagagcacaggttccacatgtcctag

SEQ ID NO: 191210 - DNA, 1434 bp, Artificial Sequence
  Description of Artificial Sequence: Synthetic coding sequence
atggacgccgacgagggccaggacatgagccaggtgagcggcaaggagtctccacctgtctccgatacccctgacgagggagatgagcccatgcctatcccagaagacctcagcacgaccagtgggggccaacaatcaagcaagtctgaccgggtggtggcttccaacgtcaaagtggagacacaatcggacgaggagaatggacgtgcttgtgaaatgaacggagaggagtgtgctgaggacctgcgcatgttagacgcatccggggagaaaatgaatggtagtcatcgtgaccagggcagttccgccctgtcaggggtgggaggaattagactccccaacggcaaactcaagtgtgacatctgtggcattatctgtataggtcccaacgtgctaatggtccataagaggtcacacacgggggagcggccattccagtgcaaccagtgtggtgcttcatttactcagaagggaaacttgctccgacacattaagttgcactcaggcgagaagccatttaagtgccatctatgtaactacgcatgccggaggcgtgatgcattgaccggccacttacgaacacacagcgtgatcaaggaagaaactaatcatagcgaaatggctgaggacttgtgtaaaattggctccgagaggtccctcgtgctggaccggctcgcaagtaacgtggccaagcgtaagagttcgatgccccagaaattcctcggagataaaggtctttcagacactccatacgactccagcgcaagttacgaaaaggagaatgagatgatgaaaagccacgtgatggatcaggccatcaacaacgcaataaactatctgggggcagagagtctgcgccccttggtacagactccccccggaggctcggaggttgtgccagtgatctcccccatgtaccaattgcacaaacctctggcagagggtacaccgcgcagtaaccactccgcgcaggactctgcagtcgagaatttacttctgctaagcaaagctaaactcgtcccctctgaaagagaggctagccccagtaactcttgtcaggactccacagataccgaaagtaacaacgaggagcaaaggtccggcctgatctacttaaccaaccatatagccccccatgcacgcaatggactgagcctcaaggaagaacaccgcgcctacgacctgctgcgggcagcctcagagaatagccaagatgcactgagggttgtctcaacaagcggtgaacagatgaaggtgtacaaatgcgagcactgtcgggttctgttcctggatcacgtgatgtacaccatccacatgggttgccacgggtttagggaccctttcgaatgcaatatgtgcggataccactcccaggaccgttacgaatttagcagccacatcaccaggggagagcaccgctttcatatgagttag

SEQ ID NO: 191211 - DNA, 681 bp, Artificial Sequence
  Description of Artificial Sequence: Synthetic coding sequence
atggacgccgacgagggccaggacatgagccaggtgagcggcaaggagagccctccagtttcagacacgcccgatgagggagatgagcctatgcctatccctgaagacctctcgaccacatctggagggcagcaaagctcaaaatctgaccgggtcgttgccagtaacgtgaaggtggaaacccaatcagacgaggagaacggcagagcttgtgagatgaatggggaggaatgcgccgaggacttacgcatgctcgacgcaagtggggaaaaaatgaacggcagtcatcgcgaccaggggtcttccgcactatcaggggttggcggcatcaggcttcctaacggcaagttgaaatgtgatatttgcggcattatctgtatcggccccaacgtccttatggttcataagcgatcccacaccggagagcgcccctttcagtgtaatcagtgcggggcatctttcactcaaaagggtaacctcctccgccacatcaaactacactccggcgaaaagccattcaagtgccatctgtgtaattacgcatgtagacgacgcgacgcgctgacagggcacttgaggactcactctgtgatcaaggaagagacaaatcattccgaaatggccgaggacctgtgtaagatcggctccgaaattagccgcgcaggccaaacctccaaatag

SEQ ID NO: 191212 - DNA, 1758 bp, Artificial Sequence
  Description of Artificial Sequence: Synthetic coding sequence
atgcacaccccccccgccctgccccggcggttccagggcggcggcagggtcaggacgccagggtcccatagacagggaaaagataatctcgaaagggatccttctggaggttgtgtcccagactttcttccacaggcccaggattccaatcacttcattatggagtctctgttttgtgagtccagcggtgacagcagcctcgagaaagaattcctgggcgcccccgtcgggcccagcgtctctacacccaactcccagcattccagccccagccggagcctgtccgctaatagcatcaaggtcgagatgtacagcgatgaggagtcatcgaggctcctgggcccagatgagaggctattggaaaaagatgatagcgttatcgtagaggatagcctgtccgagcccttgggatactgtgacggatcaggacctgagcctcactcccctggcggtatcaggctccctaatgggaaactcaaatgcgatgtgtgcggcatggtgtgtattggccccaatgtgctgatggtgcataagcggtcccacactggtgagcgaccctttcactgtaaccaatgtggcgctagctttactcagaagggcaatctgctgcggcatatcaaacttcatagtggtgagaagccttttaagtgccctttttgtaattacgcatgtcggcggcgcgatgctctaacggggcatctgcggacacacagtgtatcatctccaactgtaggtaaaccctacaagtgcaattactgtggaagaagttataaacagcaatctacgctggaagaacataaggaaaggtgtcacaactacctgcagtcgctgagtacggaagcccaggctctggctggccagcccggtgacgagattcgagacctagagatggtaccagattcaatgctgcattcctcaagcgagcgtccgacattcatagacaggctggcgaactcactcacaaagcgtaagcggtcaactccgcagaaattcgttggtgagaagcaaatgcgcttctccctttccgacctgccatacgacgtcaacagtggcggatatgaaaaggacgtggagctggtggcacatcattcactagagcctggatttggatcgagtctggcctttgtgggcgctgaacacctgcgtcctctgcgacttcctcccaccaactgtatctctgagcttaccccagtgatctcctctgtgtatactcagatgcagcccctccctggcaggctggaactccccggatcccgggaggcaggagaaggcccagaggatctcgcagatggaggtcctcttctgtacaggcctaggggcccactgaccgaccccggagcttcaccctccaacggttgccaagactctaccgacacagaatccaaccatgaagatcgtgtagctggagtggtttcccttcctcagggaccgccacctcagcccccacctactattgttgttggcagacatagcccagcctacgcaaaagaggatcccaagcctcaggagggattgctgagggggacccccggaccttccaaggaggtattaagggtggtcggggaatctggagaacctgttaaggccttcaaatgcgaacactgccgcatccttttcctcgatcatgttatgtttaccatccatatgggttgtcatggcttccgcgatccttttgagtgcaacatttgcggataccatagtcaagacaggtatgaatttagctcgcatatcgttagaggcgagcataaggtggggtag

SEQ ID NO: 191213 - DNA, 1452 bp, Artificial Sequence
  Description of Artificial Sequence: Synthetic coding sequence
atgtacagcgacgaggagagcagccggctgctgggccccgacgagagactactagagaaagatgatagcgtaatcgtggaggatagcctgagtgaacccttgggctattgtgacggttccggccccgaacctcatagtcccggcggtatccgcttgcccaacggaaagctgaagtgcgatgtctgcggaatggtctgcatcggtcccaacgtgctgatggttcacaagaggtcgcatacgggagagaggccattccattgcaatcagtgtggggcttcttttacccaaaaggggaatcttctgcgtcatatcaagctccatagtggtgaaaagccttttaaatgcccattttgcaattatgcctgccggcggcgggacgctttaacgggccatcttcgtacccattctgtgtccagtccgacagtgggtaagccctacaagtgcaactactgcggcagaagttataagcagcagtccacacttgaggaacataaggagcgatgtcataattacctgcagagtttgtctaccgaggctcaagcgttagctggccagcctggagacgagattcgcgatctggagatggtgcctgatagtatgctgcactcaagctccgagcggcctaccttcatcgaccgcctggctaattcccttactaaaaggaagaggagcacaccgcagaaattcgttggtgagaagcaaatgaggttcagcctgtctgacctaccctatgacgtgaattcaggaggctacgagaaggatgtggaactcgtagcacaccattctcttgaaccagggttcggaagttcattggcctttgttggcgccgagcacctgcgcccgttgaggttacccccgaccaactgtatcagtgagttgactccagtgatcagcagcgtctacacccagatgcagcctcttccggggcgcctcgaactccctgggagcagagaggcgggggaagggcctgaagacctggccgacgggggacccctgctgtatcggccccgcggcccgcttactgatcccggcgcttctccaagtaatgggtgtcaagattcaaccgataccgaatccaatcacgaggaccgcgtggccggagtcgtttccttgcctcagggcccaccgcctcagcctccccctactatcgtcgtcggcagacattcaccggcctacgcaaaggaggatcccaagccccaggaaggactcttgcgtggtacccctgggccgtctaaggaagtgcttcgagtggtaggcgagagcggtgaacccgtgaaggctttcaagtgcgaacactgcagaatcctttttctggatcatgtaatgtttactatacacatgggatgtcacggctttagagatcctttcgagtgcaatatttgcgggtatcattcccaagatcgctacgagttctcttctcacattgtgcgaggggagcataaggtggggtag

SEQ ID NO: 191214 - DNA, 1758 bp, Artificial Sequence
  Description of Artificial Sequence: Synthetic coding sequence
atgcacaccccccccgccctgccccggcggttccagggcggcggccgcgtgcgcacccctggcagccacaggcaagggaaggataacttggagagagacccctccggcgggtgtgtccccgattttctacctcaggcgcaagactctaatcacttcatcatggagtcactgttttgtgagtcctcgggagattcgagcctggagaaagaatttctcggagcccctgtgggccctagtgtgagtacacccaacagccagcattcttctccttccaggtcactgtcggctaattccataaaggtggagatgtactcggatgaggaatctagccggctgctaggtccagacgagagactacttgagaaagatgactctgtgatcgtagaagatagcttaagtgagcctctgggatactgcgatggcagcggtcccgaaccgcacagtccgggcggcatcaggttgccgaacggaaagctcaaatgcgacgtctgcgggatggtgtgtatcggcccaaatgtgcttatggtccacaaacgttcacatacgggcgagcggccgttccattgcaatcagtgcggggcctccttcactcagaagggtaacttgctcagacatatcaaacttcactctggcgagaaacctttcaaatgcccattctgtaactacgcctgcagacgcagggacgccctgacagggcacttacgtactcattcagtgtcatctccaacggtcggtaaaccttacaaatgtaattactgtggacggtcatataagcaacagagcacattagaagaacataaggagcggtgtcataattatttgcaaagcctatccacagaggcccaggcactcgctggacagcccggggacgagatccgggacctcgagatggttcctgattcaatgctacactcttctagtgagcgtcccacattcatcgaccgcttagctaactctctgaccaagaggaaacggagcacaccacaaaaattcgtcggggaaaaacagatgcgcttctccctctctgacctgccatatgacgtcaactctggggggtatgagaaagacgtggaactcgtggcgcaccacagtttggaaccagggttcggttcaagcctcgccttcgtgggagccgagcatctccggccacttcggctgccccctacaaattgtatctccgagctgacccccgttatctctagcgtatacacccagatgcagccccttcccggccgactggagcttcccgggtctcgcgaggcaggggagggaccggaagacttggccgatggaggccccctgctgtaccgtccacgtgggcctctgactgatccgggagctagccccagtaacggctgtcaagactctactgacaccgagtctaatcacgaggatcgagtcgctggagtcgttagcctgcctcaggggcctccaccgcagcctccccccacaatcgttgtaggccgccattccccagcgtatgccaaagaggaccctaaaccgcaggagggccttctgcgggggactcccggaccttccaaagaggttctacgggtggtgggcgaatcaggagagcctgtgaaggccttcaaatgtgagcactgtagaatccttttcctggatcacgtgatgtttacaatccacatggggtgccacgggtttcgtgaccctttcgagtgcaacatttgtggctaccacagtcaagatcgttacgagttctcttcccacatcgttaggggtgagcacaaagttggctag

SEQ ID NO: 191215 - DNA, 33 bp, Artificial Sequence
  Description of Artificial Sequence: Synthetic coding sequence
atgcacaccccccccgccctgccccggcggtag

SEQ ID NO: 191216 - DNA, 1863 bp, Artificial Sequence
  Description of Artificial Sequence: Synthetic coding sequence
atgaacaacttcatcctgctggaggagcagctgatcaagaagagccagcagaagcgtcggacctcacccagcaattttaaagtaagattttttgtactgacaaaagcatcgctggcatatttcgaagatagacatggaaaaaagcggaccctgaagggcagcatagagctaagtcgaattaagtgcgtggaaattgtcaaatctgatatcagcataccatgccactataaatatcctttccaggtggtacatgacaattatctactatatgtgttcgcacccgatagggagtcacgacagcggtgggtgcttgcgttgaaagaggagacccgaaataacaacagcctggtgcctaaatatcaccctaatttttggatggatggcaaatggcgctgctgctctcaactggaaaaactggcaacaggctgcgcccagtacgaccccacaaaaaatgcttctaaaaaaccactccccccaacccctgaggacaaccgaaggcccctgtgggagcccgaggagaccgtagtcatcgctctatatgattatcagactaatgatccccaggagcttgcccttcggcgcaacgaagaatactgtttgctcgatagcagcgagatccactggtggagagttcaggacagaaacgggcacgaaggctacgtcccttcaagctacttagtggagaagtccccaaacaacctggagacctacgagtggtacaacaagagcataagccgggataaggccgagaaactattacttgatacaggtaaggaaggggcttttatggtacgcgacagtagaacggctggaacatacactgtttcagtgttcaccaaggcagttgtgtcagaaaacaacccttgtatcaaacattatcacatcaaagaaacaaatgataatccaaagcgttactacgtggccgagaaatacgtgttcgactcgatcccgctattgattaactatcatcagcataacggagggggcctagtgacgaggcttaggtatcctgtttgctttggccgccaaaaggcaccagttactgctggcctgcgctatggaaagtgggtcatcgatcccagcgaactcacatttgtgcaggagattggatctgggcaatttggcctggtgcatctcggatattggctgaacaaggacaaggtcgccatcaaaacaattagggaaggggcaatgagtgaggaggacttcattgaagaggccgaggtgatgatgaagctgtctcaccccaagctggtgcagctttacggtgtctgtttagagcaggctcccatctgtctcgtgttcgagttcatggagcacggctgccttagtgactatttgcgtacccaaagggggttgtttgctgcagagactcttcttgggatgtgtctcgacgtgtgcgaagggatggcctatctggaagaagcctgcgtgatacacagagatctagccgcacgaaattgtctggttggcgaaaatcaggtgattaaggtatcagactttggcatgactcgctttgttcttgacgaccagtatacatctagcactggcactaagtttccagtgaaatgggcaagtcctgaagtcttctctttttcacgctactcttctaaaagcgatgtctggtcgttcggggtgctgatgtgggaagtgttctctgaggggaagatcccatatgagaataggtccaattcagaggttgtggaagacatcagtacgggcttccgcctctataaacctaggctggccagcacccacgtgtatcagattatgaaccactgctggaaagagcggcctgaggacagaccggcgttctctagattgttacgccagctggccgagatcgcagaaagcggattgtag

SEQ ID NO: 191217 - DNA, 1899 bp, Artificial Sequence
  Description of Artificial Sequence: Synthetic coding sequence
atggagacccccgccgccgccgcccccgccggcagcctgttcccctcctttcttttgttggcttgcggtacactggtggccgctctgctgggcgctgcccaccgactggggctcttttaccaactgctgcacaaagtggataaagcatctgtaagacatggtggagaaaacgtcgctgcagtgctccgtgcacacggagtccgttttatcttcactctagtaggaggtcacatttcaccactattggttgcctgtgagaagttgggcatccgggtggttgacacaagacacgaggttaccgctgtttttgccgcagacgctatggccagactctcgggaacggtcggtgtggcggccgttacagccggcccaggtcttactaatacggtcactgccgttaaaaatgcccagatggcccagtctcccattctcctcttaggaggcgcagccagtacgcttctgcagaacagaggtgccctgcaggctgtggaccagttatccctgtttcggccgctgtgtaaattttgtgtgagtgtgcggcgtgtgcgagatatagtgcctactctgcgcgccgcaatggccgccgcacagtccggcacaccaggtcctgtgtttgtggagctcccagttgacgtactatacccatattttatggttcagaaagagatggtgccagcaaaaccgcccaagggtttggtaggccgagttgtgagctggtacctggaaaactacttggccaatctctttgcaggtgcgtgggagccccagccagaaggtcccctgccactggacatacctcaggcaagccctcaacaggtccagaggtgcgtggaaatcctttctagggccaagcggcccctgatggtgctgggcagccaggctctgttgacccccacatccgccgacaagctgagagcggcagttgagacactcggcgtgccatgctttttgggtggcatggcccgtgggcttttgggacggaatcacccccttcacataagggagaaccgttcagcggctttgaaaaaagcagacgtgatcgttcttgccgggacggtgtgcgacttccggctttcttacggaagggtcctgagccattcctcaaagattattattgtaaataggaatcgtgaagagatgttgttaaattctgacatcttttggaagccccaggaagccgttcaaggggatgtgggcagcttcgtattgaaacttgtggagggtttgcagggccagacctgggcccctgattgggttgaggaactgagagaggccgatcggcaaaaagagcagacctttcgcgagaaggcagctatgccggtagcacagcatcttaaccccgtgcaggtgctgcagctcgttgaagagacgctgcccgacaacagtatcttggtcgttgatggtggagattttgtgggcactgctgcccatctggtccaacctagaggacccttaagatggctggatcccggcgcattcggcacacttggggtaggagccggatttgcgctcggagccaagctgtgccggcctgacgccgaggtctggtgtttatttggcgatggggccttcgggtattcattgatcgaatttgacacctttgtacgccataagatcccggtcatggccttggtgggcaatgatgccggatggacacagataagccgggagcaggtgccctctctagggtctaacgtggcatgcgggctggcctatacagactatcacaaggcagcaatggggctaggcgcccggggactgctgcttagcagggagaacgaggatcaggtcgtcaaagttctgcatgatgctcagcagcagtgcagggacgggcaccctgtcgttgtgaatattttgattgggagaactgacttccgcgatggctccattgctgtctag

SEQ ID NO: 191218 - DNA, 678 bp, Artificial Sequence
  Description of Artificial Sequence: Synthetic coding sequence
atggagacccccgccgccgccgcccccgccggcagcctgttcccctccttccttttattagcgtgcggaacactggtagctgcattgctgggggcagcccataggctcggtcttttttatcaactgctccacaaggtcgataaagcttcagtccgccacgggggggaaaacgtggctgctgttttgagggctcatggggttagattcatcttcacgcttgttggagggcacatcagtcctttgttggttgcatgcgaaaagctaggaatccgtgttgtcgacacgcgtcacgaggtgaccgcagtctttgctgccgatgctatggccaggctgtcaggcaccgtcggagtcgcagctgtcacagctgggccaggtctgaccaatactgtgactgccgtgaagaacgcccagatggctcaatctcctatcctactgctcggaggtgcagcgtccactcttctgcagaaccgcggcgcccttcaggcagtggatcagctgagcctgttccgcccccctcctggctgcgggcagcaccctcattgggaagacggattacctcgctggctccattgctgtattggcccatgtggttcaggacgactcgccgcttttctgcctctggattgcgtgcaactagtgtggtcattgataatagcatgccccggcccgattccttag

SEQ ID NO: 191219 - DNA, 789 bp, Artificial Sequence
  Description of Artificial Sequence: Synthetic coding sequence
atggagacccccgccgccgccgcccccgccggcagcctgttcccctcattccttctgctcgcgtgtggcacccttgttgctgccctgctcggtgctgcccaccgcctaggcctgttttaccagctgctgcataaggtggataaagcctctgttcgccatgggggtgagaacgtcgcagccgtgctcagagctcacggcgtgagattcatcttcacactggtggggggccacatcagtcctcttctagtggcttgcgagaaactgggcatcagggtcgtcgatacccgccatgaggtgactgctgtgtttgcggctgatgctatggccaggcttagtggcactgtgggcgtggcggctgtcacagctggaccaggcctcaccaacaccgtgacggcggtgaaaaacgcccaaatggcacaatcccctatactgttgttgggaggagctgcttccaccctactacagaaccgtggggctttacaggccgtggaccagttgagtctcttccgacccctgtgcaagttttgcgtgagtgtcagaagggttcgggacatagtccctacactaagggctgccatggcagccgctcagtccggaactcctggacctgttttcgttgagcttcctgtcgatgtcctgtatccctattttatggtgcagaaggagatggtgccagccaagcctccaaagggcctcgtcggacgggttgtctcctggtacctggagaactatttagccaacctgtttgctggggcctgggaacctcaaccagagggcccccttccatag

SEQ ID NO: 191220 - DNA, 501 bp, Artificial Sequence
  Description of Artificial Sequence: Synthetic coding sequence
atggagacccccgccgccgccgcccccgccggcagcctgttccccagcttcttactactcgcatgcggcacactggtggcggccctgctgggggccgctcatcggctcggcctcttttatcagctgctgcacaaggttgacaaagcctctgtaagacatgggggcgagaacgtagctgcagttctgagagcgcacggcgttaggttcatctttactttggtgggtggccacatctctccactccttgtcgcctgcgagaagctcggcataagagtcgtggatacccgccacgaggtcaccgctgtgttcgctgcggacgccatggcacggctatctggaaccgtcggggtggctgccgtgactgcgggcccaggattaaccaatacagtgacagcagtgaagaatgcacaaatggctcagtcccccattctgctgctcgggggtgccgcatccacactgctgcagaatcgaggcgccctgcaggctgtggaccaactttag

SEQ ID NO: 191221 - DNA, 621 bp, Artificial Sequence
  Description of Artificial Sequence: Synthetic coding sequence
atggccgccacccggtgcctgcggtggggcctgagccgggccggcgtctggttgctccccccaccagcgcgctgtccacggagagcactgcataaacagaaagacggtacagagtttaaaagtatatattcactcgataagctttaccctgaatctcaaggatctgatacagcatggcgcgtgcctaatggagctaaacaggctgacagtgacatccccctggacagattgaccatttcttactgtaggagtagcggcccaggtggccagaatgtaaacaaggtgaattccaaggccgaggtacgattccacctcgccaccgccgaatggatagccgaacccgtgcgacagaagatcgcaatcacccataaaaacaagataaaccgactgggcgagttaattttgaccagcgaaagcagtcgataccagttcagaaacttagctgattgcctccaaaagatcagggacatgataaccgaggccagtcagacccctaaagagcccacaaaggaggatgtgaagctgcacaggattaggatagagaacatgaatcgtgagcgtctgcgtcagaaacgaatacattcagcggtcaagaccagcagaagggtggatatggactag

SEQ ID NO: 191222 - DNA, 471 bp, Artificial Sequence
  Description of Artificial Sequence: Synthetic coding sequence
atgtgccacagccggagctgccaccccaccatgaccatcctgcaggcccctaccccagctccttcaacaataccaggacctcgcaggggctctggtcctgaaatcttcacctttgatcctttgccggaaccagcagcagcccccgcaggacgaccaagcgcctccagaggccatagaaaaagatcaaggagggtactgtacccaagagtggtcaggagacagctacctgtcgaggagccaaatccagctaagagactgctctttcttctgctgactatcgtattctgtcaaatcctaatggctgaagagggcgtgcccgccccactgcccccagaggacgccccgaacgctgcaagtctggctcctactcccgtttcggctgtcctcgagccattcaatctgacttcagaaccttcggactatgcactggatctctccacattcctgcagcaacacccggctgctttttag

SEQ ID NO: 191223 - DNA, 417 bp, Artificial Sequence
  Description of Artificial Sequence: Synthetic coding sequence
atgtgccacagccggagctgccaccccaccatgaccatcctgcaggctcctacacctgcaccatccaccattcctgggccaaggcgaggctcaggcccagaaatctttacctttgacccactgcccgagcctgccgctgctcccgctggtcgcccctccgcaagccgcggacaccgcaagcgaagcaggcgcgtactctatccacgggttgtcagcattgccgaggtcggaattaggggggttcgctgccccggagttactggcgaacggcccgacagcagagggctcgaccttacatgcttgcttttttgcttgccactgggtcccgcacctgcggcctctaggggaacagaacccagtcaaaaggccagcctttcagctgcccaccatagactactgcctgatccggacggctag

SEQ ID NO: 191224 - DNA, 579 bp, Artificial Sequence
  Description of Artificial Sequence: Synthetic coding sequence
atgtgccacagccggagctgccaccccaccatgaccatcctgcaggcccctactccagcaccttcaactatccctggccccaggaggggctcaggtcctgagatcttcacatttgatcctttgcctgaacctgccgccgcgcccgccggacggcccagcgcatcccgtggccatcgcaaacgtagtcggcgtgttctgccaagcagtggtgaataccgcaggtctggacacagtaggggcgcgctgccctggagtcactggggtactactaggctgcaggggctggaccttacatgtctgttgttctgcctacctctcgtgcgcagacagctacctgtcgaagagccgaatcccgcgaagaggcttctgtttctgcttctgacgattgtgttctgccagatcctcatggcggaggagggagtcccggcgcccctcccacccgaggatgcacccaacgccgccagtctggcaccgactccagtttctgccgtcctcgagccattcaacctgactagtgagccttctgattatgccctggatctgtctacctttctccagcagcacccggctgctttctag

SEQ ID NO: 191225 - DNA, 471 bp, Artificial Sequence
  Description of Artificial Sequence: Synthetic coding sequence
atgtgccacagccggagctgccaccccaccatgaccatcctgcaggcccctacccctgccccatctacaatacctggtccccgcaggggcagcggcccggagatcttcactttcgatcctttaccagagcccgcggcagcccctgccggtcggccttctgccagccgtggacataggaagcgctctcgccgggtcttgtatcccagagtcgttaggaggcaacttccagtggaggaacccaatcccgccaagaggctgttgtttcttctactgactatcgtgttctgccagatcctgatggcagaggagggcgtacctgcgccattaccacctgaggacgccccaaacgctgcgagtctggcgcctacacccgtgagccctgttctcgagccattcaatctgacatccgaaccaagcgactacgccctggacctatcaaccttcctgcaacagcaccctgctgccttctag

SEQ ID NO: 191226 - DNA, 417 bp, Artificial Sequence
  Description of Artificial Sequence: Synthetic coding sequence
atgtgccacagccggagctgccaccccaccatgaccatcctgcaggcccctactcctgccccttcaacgattccaggtccaagacgcggttccgggcccgagatatttactttcgatcctctcccagagccagccgcagcaccagctggcagacctagcgcgagtagggggcaccggaaacgttccagacgggtgctctacccccgggttgtgtcaatcgccgaggttggaatccggggcgtaaggtgccccggcgtgacaggcgaaagacctgactcacgcgggcttgatctcacgtgcttactattctgtctgccgcttggtcccgctcccgccgcctcaagagggacggagccatctcaaaaagcatccttgagcgctgcacaccatcgccttctcccagatcctgacggctag

SEQ ID NO: 191227 - DNA, 417 bp, Artificial Sequence
  Description of Artificial Sequence: Synthetic coding sequence
atgtgccacagccggagctgccaccccaccatgaccatcctgcaggcccccaccccggcccctagtaccatccctggtccacgaagaggcagtggaccagagatttttacctttgatcccctgcctgagcctgcagccgcgcctgctggccgtccttccgcaagtcgcggacatagaaagcggagccgcagagttctttaccctagagtggtctccatcgcggaggtgggaattaggggagttcgatgcccgggcgtgaccggggagaggcctgactcgaggggcctggacctgacctgtctcctcttttgtttgcctctggggcctgctccagcggcctcgaggggtactgaacccagtcagaaggccagtttgtccgcagcacatcaccggctgcttcctgatccagacgggtag

SEQ ID NO: 191228 - DNA, 471 bp, Artificial Sequence
  Description of Artificial Sequence: Synthetic coding sequence
atgtgccacagccggagctgccaccccaccatgaccatcctgcaggcaccgacccctgcaccgtccactattcccggaccccgaagaggatcaggccctgagatattcactttcgacccgctgccagaacctgcggccgccccagccggccgtccatcagcctcacgcggccaccggaagcggtcacgcagagtgctatatcctagagtggtgagacggcaattacccgttgaggagccaaaccccgccaaacgattgctgttcctgctgttaaccatcgtgttctgccaaatactgatggccgaagaaggtgtcccagcacctctgccgcctgaagatgcgcctaatgccgcctctttggctccaactccagtcagtccagtattggaaccatttaacctgaccagcgaacctagcgactatgcactcgacctttccacctttttacaacagcacccggcggccttctag

SEQ ID NO: 191229 - DNA, 417 bp, Artificial Sequence
  Description of Artificial Sequence: Synthetic coding sequence
atgtgccacagccggagctgccaccccaccatgaccatcctgcaggcccctacgcccgcgccttctacgatccccgggccaagaagagggagcggccccgagatcttcaccttcgatcctctgccagagcctgcggccgctcctgccgggcgaccatccgcttctaggggtcaccggaaacgcagccgcagggtgttatatccccgagtagtgtccatagctgaggtgggcatccgcggcgtgaggtgccctggcgtcaccggagaaagacctgactctagaggcttagatctgacttgcctattattctgtctgcctctggggccggctccagcggcctcccgaggtactgaaccaagccagaaagcgtccctcagtgccgcccatcacaggttgttaccagaccccgatggctag

SEQ ID NO: 191230 - DNA, 471 bp, Artificial Sequence
  Description of Artificial Sequence: Synthetic coding sequence
atgtgccacagccggagctgccaccccaccatgaccatcctgcaggcaccaacaccagccccatcaacaatccctggtccccggaggggctctgggccagagatctttacatttgatccactccctgaacccgctgccgcaccggccggaaggccttctgcgtccagaggtcaccggaagcgctcccgtcgagttctttaccccagagtcgtccggcggcagcttcctgtggaagagccaaatccagccaagagactcctcttcctgctgctgaccatcgtattttgtcagatcctgatggccgaggagggcgtcccggcacccttgccaccagaggatgcccccaacgctgcaagccttgctcccactcctgtgagtcctgtgctggaacccttcaatttgacgagtgaaccctctgactatgcactcgacttgagtactttcctgcagcagcaccccgccgccttctag

SEQ ID NO: 191231 - DNA, 417 bp, Artificial Sequence
  Description of Artificial Sequence: Synthetic coding sequence
atgtgccacagccggagctgccaccccaccatgaccatcctgcaggcccctactcccgccccgtccaccatcccgggaccaaggcgcgggagcggccctgagatattcacttttgaccctctgccagaacccgccgctgcacctgcggggcgaccaagcgcctctaggggccatcgaaaaagatccaggagggtgctgtaccctcgagtagtgagtattgcagaggtgggaatcagaggtgtgcgctgtcccggggttaccggggagcgacccgattcacgggggctggacttaacctgccttttgttctgtctgccactgggccccgctccggcggcttctaggggtacagagccatctcagaaggcttcactgagcgccgcccatcatcgtctgctgcctgaccctgatggctag

SEQ ID NO: 191232 - DNA, 471 bp, Artificial Sequence
  Description of Artificial Sequence: Synthetic coding sequence
atgtgccacagccggagctgccaccccaccatgaccatcctgcaggcaccaacaccagccccgtccacaattcccgggccccgtcggggcagtggccccgagatctttactttcgatccccttccagagcccgccgctgcacctgccggccgtcccagcgcttccagaggccatcgcaaacgtagtagacgggtgctttatccgcgggtggtgagacgccaattgcctgtcgaggaacctaatcccgccaagagactgttgttccttctgctgactattgttttctgtcaaatcctcatggccgaggagggggtccctgccccactcccaccggaggacgcacccaatgcagcaagcctggcacccacccctgtgagccctgtgttagagccctttaacttaacttctgaaccctccgactatgctctggacttatcaacttttctccagcagcatcccgccgctttctag

SEQ ID NO: 191233 - DNA, 417 bp, Artificial Sequence
  Description of Artificial Sequence: Synthetic coding sequence
atgtgccacagccggagctgccaccccaccatgaccatcctgcaggcccccacaccagccccatcaaccattccgggtccacgccggggcagcgggccagagatcttcacgttcgatcccttgccagaacccgccgccgcacccgccggtcggccaagcgcttcaagggggcacagaaagcggtcacggcgagtgctctacccacgggtggtttcaatcgcagaggtgggaattcgtggggtgcggtgtcctggagtgaccggtgaacgcccagactcacgaggattggacctgacctgtctgttgttttgtctgcctcttggacctgcaccagcagcatcccgtggtacagagccatctcaaaaggcttcattgtcagcagcccatcatcgcttattacctgatcctgacgggtag

SEQ ID NO: 191234 - DNA, 471 bp, Artificial Sequence
  Description of Artificial Sequence: Synthetic coding sequence
atgtgccacagccggagctgccaccccaccatgaccatcctgcaggctcccacacctgctcccagcacaatcccgggacctaggcgggggtctggccctgagatttttaccttcgaccctcttcctgagcctgcggcagctccagcaggacgcccctccgcaagcaggggccacaggaaacgaagtaggcgggttttgtatccccgcgtcgtccgtcgccagttacccgtcgaagagcctaaccctgccaagaggctgctattcctgcttctgactatcgtgttttgccagatcttgatggccgaagaaggcgttccggcgcccctgcctcccgaggacgcgcctaatgccgcctccctggcacctacaccagtaagccccgtgctagagcccttcaacctcacctcagagccttctgattatgctctggacttatcaacattcctccagcagcaccctgccgcattttag

SEQ ID NO: 191235 - DNA, 249 bp, Artificial Sequence
  Description of Artificial Sequence: Synthetic coding sequence
atggccttcaccctgtacagcctgctgcaggccgccctgctgtgcgtcaacgctattgccgtcctgcatgaagagcgctttctgaaaaacatcggctgggggacagaccaagggataggagggttcggtgaggagccgggcatcaagagccagctgatgaatctcattcgctccgtgagaactgtgatgcgcgtcccgttgatcatcgtgaacagtatagctatcgtgctcttgctactgttcggatag

SEQ ID NO: 191236 - DNA, 984 bp, Artificial Sequence
  Description of Artificial Sequence: Synthetic coding sequence
atggagttcaagctggaggcccaccggatcgtgagcatcagcctgggaaaaatctacaacagtagggtgcagagggggggaatcaaattgcacaagaatttgctggtaagtctggtcctccgtagcgctcgacaagtgtacttgtctgatccttgtccaggactgtacttggccggccctgctggtactcccgcccctccgccgcagcagcaaccaggcgaaccggcggccggaccccctgccgggtggggcgaacctccacccccagctgctcgcgcttcctggcctgaaactgaaccgcagcctgagaggagttccgtgagtgatgccccccgcgttggagacgaggtacccgtcgcgaccgtcaccggagtaggggacgttttccaagggggcgaggcagatgccaccgaggcggcttggtcccgggtcgaaggacccagacaagccgcagccagggaagcagagggcacagccgggggatggggcgtgttcccggaggtcagcagggctgcccgccggccttgtggctgtccactcggaggagaagacccccctggaacaccagctgctacacctagagccgcatgctgttgcgcacctcagcctgctgaggacgaaccaccagctccccctgctgtgtgtccacgaaagcgctgcgccgccggcgtagggggtggccctgcggggtgcccggccccaggaagtactcctctcaaaaagccacgaagaaatctagaacagcctccttcaggaggggaggatgatgacgcagaagagatggaaacagggaatgtggcaaaccttattagcattttcggttcgagcttctctggcctgctgcggaagagcccaggcggcgggcgggaggaagaagaaggcgaagagtcgggccctgaggccgccgagcctgggcagatctgctgtgataagccagtgttacgggatatgaacccctggtccacagcaattgtagctttctag

SEQ ID NO: 191237 - DNA, 420 bp, Artificial Sequence
  Description of Artificial Sequence: Synthetic coding sequence
atggagttcaagctggaggcccaccggatcgtgagcatcagcctgggcaagatctataactcaagagtccagcggggcggcatcaagctacacaagaacctgctggtcagtctggttttaaggtcggccaggcaggtctatctaagcgatccctgtcctggattatatctcgcgggaccagctggcactcctgcgcctccaccccaacagcagccaggggagcctgccgctggccctcctgcagggtggggggaaccgccgccacctgccgcccgggcttcctggccagaaacagagccccagccagaacgatcatcagtgtccgatgctccaagagtgggagacgaggtccctgtggcaactgttacaggagttggagacgtgtttcagggccgcagcgcagctatctctcgatgctag

SEQ ID NO: 191238 - DNA, 546 bp, Artificial Sequence
  Description of Artificial Sequence: Synthetic coding sequence
atggaggccatgaacgtggagaaggccagcgccgacggcaacctgcccgaggttatcagcaacataaaggagaccctcaagattgtctctagaacaccggtaaatatcaccatggccggcgactccggcaatggtatgtccacgttcatctctgctctgcgaaacaccgggcacgaaggtaaggccagtcctcccacagagttagttaaagccacacaacgctgcgcatcctattttagctcacactttagcaatgtcgtgctgtgggatctaccagggaccggttccgcaactacgactctcgagaattacctgatggagatgcagttcaaccggtacgacttcatcatggtggcttccgcccagttcagtatgaaccacgttatgttggccaaaactgcggaggatatgggaaaaaaattttatatagtctggacgaagcttgacatggacctgtctactggagccctgccagaggtgcaactgctgcagattcgagaaaacgttctggagaacttgcagaaggagagagtgtgtgagtattag

SEQ ID NO: 191239 - DNA, 1020 bp, Artificial Sequence
  Description of Artificial Sequence: Synthetic coding sequence
atggccgccgaggacgagctgcagctgccccggctgcccgagctgttcgagaccggaaggcagcttcttgatgaggtggaggttgctactgaacctgcagggagtaggatagtacaggaaaaggtgttcaaagggctggatctgctggagaaagctgccgagatgctgtctcagctcgacctcttttcaagaaacgaggatctagaggagattgcgtcaacggaccttaagtatctcctagtgccggccttccagggagcattaaccatgaagcaggtgaatccctcaaagagactcgaccatctgcagagagcacgggagcacttcatcaactacttaacccagtgccactgttatcatgttgcggagtttgagctcccaaagacaatgaacaattctgccgagaatcacacagccaatagtagcatggcttatccttctctggttgcgatggcttcccagaggcaagctaaaatccaaaggtataaacagaaaaaggaactcgagcaccggcttagcgccatgaagtcagcggtcgagtcaggccaggcagatgatgaacgcgtgcgcgagtattacctgcttcatctccagcggtggattgatattagtctggaggaaatcgagtccattgaccaggagataaagatcttacgtgagcgagactcttctagggaggcctcaacttccaattcctcaagacaggaaaggccaccagtgaaacccttcatcctgacccgcaatatggcccaggcaaaggtgttcggcgctgggtacccctcactgcccaccatgacagtttccgattggtacgagcagcatcgcaagtacggagcacttcccgaccagggtatcgcgaaggccgcaccagaggagttcaggaaggccgctcagcagcaggaagaacaggaagaaaaggaagaggaggatgatgaacaaactctgcaccgtgcccgggagtgggacgattggaaggatacgcatcctcgtggctacgggaacaggcagaacatgggctag

SEQ ID NO: 191240 - DNA, 1020 bp, Artificial Sequence
  Description of Artificial Sequence: Synthetic coding sequence
atggccgccgaggacgagctgcagctgccccggctgcccgagctgtttgagaccggcaggcagctgctggatgaggtggaagtggcaacggagcccgcgggaagccgtatagtgcaggaaaaggttttcaaaggactggacctgttggagaaggcggcagagatgctttcccagctcgacctatttagtcgaaacgaggatttggaggaaatcgcctcaaccgaccttaagtacctgctggtgccagcgttccagggtgctttgacaatgaagcaggtgaatccatccaagcgcctggatcatttgcaaagggcccgagagcacttcataaattatctgactcagtgtcattgctaccacgtggccgagttcgagctgccaaaaaccatgaataacagcgctgaaaaccacacagccaactcctcaatggcatacccctctctagttgctatggctagccagcgacaggccaagatccagaggtacaagcagaaaaaagaactcgaacaccgcctttccgcaatgaagtcagccgtggagtctggccaagccgatgacgaacgcgtaagagagtattacctgttgcaccttcagcgatggatcgacattagccttgaagagatcgagtccattgatcaggaaatcaagattctacgagagcgtgactctagcagggaagctagcacttcaaattctagcaggcaagagcggccgcccgtcaaaccttttatattaacccgtaacatggcacaggccaaggttttcggagcagggtacccaagcctgcccaccatgaccgtttctgattggtatgagcaacatagaaaatatggcgctctgcctgatcaggggattgcaaaagccgcccctgaggaatttagaaaggcggcgcaacagcaggaggagcaagaagagaaagaggaagaggacgacgagcagactctccatcgtgcgcgagaatgggacgactggaaagatacacacccaagaggatatggcaaccggcaaaatatgggctag

SEQ ID NO: 191241 - DNA, 480 bp, Artificial Sequence
  Description of Artificial Sequence: Synthetic coding sequence
atgaagaaccacctgctgttctggggcgtgctggccgtgttcatcaaggccgtccacgtgaaagcccaagaagacgagagaatcgtcctcgtggataataagtgtaaatgcgcccgaattacaagtcgaataattcgaagtagtgaagatcctaacgaggacatcgtcgaacgcaacattcgcattatcgtgcccttaaataatagagagaatatttctgatcctacctctcccctgcgaaccagatttgtctatcacctgtccgacctttgcaagaagtgcgatcctaccgaagtggagctggacaaccagattgtgaccgccactcagagcaatatctgcgacgaggactccgcgaccgaaacttgctacacctacgaccgaaacaaatgttatactgccgtggtgcctctggtatacggtggtgagacaaaaatggtagagaccgctcttacacccgatgcctgctaccctgactag

SEQ ID NO: 191242 - DNA, 213 bp, Artificial Sequence
  Description of Artificial Sequence: Synthetic coding sequence
atgaagaaccacctgctgttctggggcgtgctggccgtgttcatcaaggctgtccatgtgaaggcacaggaggacgagcggatagtgcttgtggacaacaagtgcaagtgtgctcggatcacctcacgaatcatacggagttccgaagaccccaacgaggacatcgtggagagaaatatccggattattgttcctttgaataatcgcgagtag

SEQ ID NO: 191243 - DNA, 480 bp, Artificial Sequence
  Description of Artificial Sequence: Synthetic coding sequence
atgaagaaccacctgctgttctggggcgtgctggccgtgttcatcaaggctgtgcacgttaaggcccaagaggatgaaaggattgtcctggtcgacaacaaatgcaagtgtgctaggatcacctcccggattatcagatcgtccgaggatccaaatgaggacattgtcgagagaaatatacgcatcattgtaccattaaataatcgcgagaacatctcggaccccacatcaccgctcagaacccgcttcgtgtaccacttatccgatctgtgtaaaaagtgtgacccaacggaagttgaactggataatcaaatcgttacagccactcagtcaaatatctgtgacgaagactccgccaccgagacttgttatacttacgataggaacaagtgctatactgctgtagtacccttagtgtatggcggcgaaaccaaaatggtcgaaaccgcgttgacacctgacgcctgttatcccgactag

SEQ ID NO: 191244 - DNA, 528 bp, Artificial Sequence
  Description of Artificial Sequence: Synthetic coding sequence
atgaagaaccacctgctgttctggggcgtgctggccgtgttcatcaaagccgtccatgtgaaaggtagccgggactcgtccgcctcggcaagccgcgtggctggaatcaccgcacaggaggacgagcggattgtgctcgtggacaataaatgtaaatgtgcacgtattacgagtcgcattataagaagtagtgaggatccaaatgaggatattgttgagcgcaatatccgcattattgtaccattgaacaatagggaaaacatttccgatcctaccagccctctgcgcacaagatttgtttaccatctgagtgacctctgtaaaaagtgtgacccaacagaagtcgagctggacaatcagattgtcactgccacccagtcaaatatctgtgacgaagatagtgcaacagaaacatgctacacgtatgacagaaataaatgctatacggcagtcgtgccgctcgtatacgggggagagacaaaaatggtcgaaacagcattaacccctgatgcctgttatcctgattag

SEQ ID NO: 191245 - DNA, 642 bp, Artificial Sequence
  Description of Artificial Sequence: Synthetic coding sequence
atgcggcccggcaccggccagggcggcctggaggcccccggcgagcctggccccaacctgaggcagagatggcccctgctcttgctgggactagcagtcgtcacccacgggcttcttcgccccactgcagcgtcccagagtcgggccttgggccccggcgcacctggtggctcatcaagaagttcacttcgctcgcggtggggacgattcttgttgcagcgtggttcctggacaggccctaggtgctggccccggggatttcagagtaagcacaactctgtaacccacgtgtttggttctggcacccaactgaccgttctctcacagcctaaggcaacaccatcagtcactctgttcccgcccagtagcgaggaacttcaagccaacaaggctacgctcgtctgcttgatgaatgacttctaccccggaatcctaacagtgacctggaaggcagacgggactcctatcacacagggcgtagagatgacgaccccctctaagcagagcaataacaagtatgctgcttcatcatatctctcactcacacctgagcagtggcggtcacggcgatcttactcctgccaagtgatgcacgagggatctaccgtggaaaagacggtggccccagcagagtgttcctag

SEQ ID NO: 191246 - DNA, 255 bp, Artificial Sequence
  Description of Artificial Sequence: Synthetic coding sequence
atgcggcccggcaccggccagggcggcctggaggcccccggcgagcccggcccaaatcttcggcagaggtggcccctgcttctcttaggtcttgcggttgttacccacggattactgcgtccaacagcagcttcccaatctcgcgccctgggtccgggagcccctggcggcagctcacgatccagcctgcgctctcggtggggaagaagcgcccaaggccatcctctggggcactctgtacctgctgtgctttag

SEQ ID NO: 191247 - DNA, 2982 bp, Artificial Sequence
  Description of Artificial Sequence: Synthetic coding sequence
atggccagcgccgccgtggagagcttcgtgaccaagcagctggacctcttggaactcgagcgagacgctgaggtagaagaaaggagaagctggcaggaaaacatcagcctaaaggagctccaaagtcggggtgtgtgcctgctaaaactgcaagtttcctcacagcggacaggactctacggtcggctattagtcacttttgagcccagacggtacggctcggccgccgcgctgccgtcaaacagctttactagtggtgacatagtgggactgtatgatgccgctaatgaagggtcccagttagcaacaggtattctgactagagtgactcagaaatcagtcacggtggcattcgatgagagccacgattttcagctctctctggatagagagaattcttatcggctcctgaagctggctaacgatgttacctataggaggctgaaaaaggcactcattgcccttaagaaatatcatagcggtcccgcatcaagccttatcgaagtgctctttgggagatctgctccatctccagcctctgagatacatccactcactttcttcaatacctgcctggacacatctcagaaggaggccgttcttttcgcactcagccagaaagagctggcaatcatccatggtcccccggggaccggaaagaccacaaccgtggtagagattatcctccaggccgtaaaacaaggcctcaaggtactctgctgtgcaccctcaaacatcgccgtcgataatctcgtggagcgtctggctctgtgcaagcagaggatcctgaggctcgggcacccagcacgcctcctggagtcaattcagcaacacagtctcgacgccgtgctggcacggtcagattcagcccagattgttgcagatataaggaaggatatagaccaggtgttcgtgaagaataagaagacacaggacaaaagagaaaaatctaactttcgaaacgaaatcaaactgttaagaaaggagctaaaagagcgagaagaagctgcgatgcttgagagccttacctcagctaatgttgttcttgctactaatactggggccagcgccgacgggccactgaaactgctgccagaatcttattttgatgtcgtcgtgatcgacgaatgtgcccaggccctcgaggccagttgttggatccccctgctaaaggctaggaaatgcattctcgccggcgatcacaagcagctccctcctactacggtcagccacaaagccgcgctggctgggctcagcttgagcctgatggagagactggccgaggaatatggcgctcgagtggtgaggaccctgactgtccagtataggatgcaccaggccattatgcggtgggcaagcgataccatgtacttggggcagttgacagctcacagctccgtggcgcggcacctgcttagggatctgcctggcgtggcggctaccgaggaaactggggttcccctgctgctggtggacacagctgggtgtggcttgttcgaattggaagaagaagacgaacagtcaaaaggaaaccctggggaagtaagactcgtttccctccatatacaggcactcgtagacgccggcgttcctgcaagagacatcgccgtagtgagtccttataacctgcaggtggatttgctgagacaaagcctggtacacagacatccggagctggagattaaaagcgtggacgggttccaggggcgtgagaaggaggcagtgattctaagtttcgtgaggagcaacagaaaaggcgaagtgggcttcttggctgaagaccgcaggatcaatgttgctgtgacacgagcacgcaggcacgtggccgtgatatgtgattcacgaacagtaaataaccatgcctttctgaagacactcgtcgagtattttacgcaacacggtgaagtgcggactgcgttcgaatacttggacgacattgtgccggagaattatagtcatgaaaatagtcaaggctcgagccacgcagcaaccaagcctcagggtcctgctacgagcacccgaaccggctcccagaggcaggagggcggacaggaggcagcggctccagctagacaaggacgaaagaagcccgcaggcaaatctttagcctcagaagcaccctcccaaccaagtttaaatggtggatcccccgagggcgtcgagtcccaggacggcgttgatcatttcagggcaatgatcgtcgaattcatggctagcaaaaagatgcaactagagttcccaccatccctgaattcccatgacagactgcgggtccaccagattgccgaggaacacggccttcggcacgattcgtcaggcgaaggtaaacgacggttcatcacagtgtccaagagggcgccccggcctagagcagctcttggacctccagccggcacgggtgggcccgctcctttacagcccgttcctcccactcccgcccagacagaacagccccctcgtgagcaaagaggacctgaccagcccgatctgaggacgctgcatctagaaagattgcagagggtaaggagcgcacaagggcagcccgcctcaaaagagcaacaggcttcaggccagcaaaagctgccagaaaagaaaaagaaaaaggctaagggccaccccgctacggacttgccaactgaagaagattttgaggctttagtgtccgctgcagtgaaagcagataatacatgcggattcgcaaagtgcacagccggcgtcaccaccctgggccagttctgtcaactctgttcccgacgatattgcttgtcccatcacctgcccgaaatacacggttgcggagaaagggcccgcgcacatgcgagacaacgaattagccgggaaggggttctctatgccgggagtggcacgaaaaatggatctttagatccagcgaaacgggctcagttgcagcgcagactggacaagaagctgtctgaactgagtaatcagcggacatcacggcgtaaggagcggggcacctag

SEQ ID NO: 191248 - DNA, 1287 bp, Artificial Sequence
  Description of Artificial Sequence: Synthetic coding sequence
atgcaggagctgcacctgctgtggtgggccctgctgctgggcctggctcaagcttgtcctgaaccttgcgactgtggagagaagtatgggtttcaaatcgccgactgtgcttatcgcgacttggagagcgtgccgcctggtttccccgccaacgtgactacattatccctttccgctaacagactacccggccttcccgaaggggcttttcgagaggtccctctcctgcagtccctatggctcgcccataatgaaattcggaccgttgcagccggtgccctcgcttcgctgagccacctgaaatctctggatttgtctcacaatctgatcagcgattttgcgtggagcgacctgcacaacctgagcgcccttcagctgctaaaaatggattctaatgagctgacttttataccccgagacgcattccggtcactgagagcccttcgaagtttacagcttaaccataatagactccacactctcgccgagggtactttcactcctcttacggccctgtcccacctgcagataaatgaaaacccatttgattgtacatgcggaattgtgtggctgaagacatgggcactgaccacagccgtgagcatacctgagcaggataatattgcctgcacatccccgcatgtactcaaggggacaccactgagtagactccccccattaccctgcagtgccccaagtgtccagctgtcgtaccagccatctcaggatggcgctgaactacgacccggttttgtactggcactgcattgcgacgttgacggacagcctgctccgcagctccactggcatatccagatcccctccggtatcgtcgaaatcacatcccctaatgtagggactgacggcagggccttgccgggaacacctgtggcctccagccagcctcggtttcaggctttcgccaacggaagtctgctaatcccagatttcggtaagctggaggagggtacatactcgtgccttgccaccaatgagctggggtcagcagaaagttctgtggatgttgcgctcgcaacgcctggcgagggcggcgaagatacgctcgggcggagatttcacgggaaggctgtagagggaaaaggatgctatacggtcgacaacgaagtgcaacctagtgggcccgaggacaacgtggtaataatctatctgagtagagccggcaatccagaggcggccgtagcagagggcgttcccggacagctacctccaggcctcttgctactgggacagagtctacttctatttttctttctgacgagtttctag

SEQ ID NO: 191249 - DNA, 1287 bp, Artificial Sequence
  Description of Artificial Sequence: Synthetic coding sequence
atgcaggagctgcacctgctgtggtgggccctgctgctgggcctggcccaggcttgtccggagccgtgcgactgcggtgagaaatatggtttccagattgccgactgtgcctatcgtgatttggagagcgttccgccaggcttccctgccaacgtgacaactctgtccctctccgccaatcggcttccgggactccccgaaggggccttccgcgaagtccccctgcttcaaagcttatggctcgcacacaacgagatccgcactgtggccgctggagctctggctagcctctcccacctgaagtccctggacctgagtcataaccttatctccgacttcgcatggtcggatctgcacaacctgagcgccctgcagctccttaagatggactccaatgaattgacctttatccctcgggacgcttttcgttccctgcgcgcccttcggtctctacagctaaatcacaatagactacataccctggctgaaggaactttcaccccactgactgccctgtcccacctccagatcaatgagaatccttttgattgcacatgcggtattgtttggctgaagacctgggcccttacaactgccgtgtccatcccagaacaagacaacatcgcgtgtacaagtcctcacgtcctcaagggaaccccgctctctcgtctaccgcctcttccatgtagtgctccaagtgtccagctgtcctaccagccctcccaggatggagcggaactgcggccaggcttcgtcctggcactccattgtgatgtcgacggtcaaccagctccccagctgcactggcacattcaaattccttctggaattgtggagataacatcccctaacgtgggtactgatggacgcgcacttcctggaactcccgtggccagttctcaacccagatttcaagcgtttgccaacggcagtctcctgatccctgactttggtaagctggaagaaggtacttactcatgcctcgccaccaacgagctgggcagtgcagagtcatctgtggacgtggccttggcgacccccggtgaaggcggtgaggatacattaggaagaagatttcacggaaaagctgttgagggtaagggatgttacacagttgacaacgaagtgcagcctagtggcccggaggataacgtggttattatttacttgtctcgggccggaaaccctgaggctgccgtcgcggagggtgtgccaggacagttaccccctgggcttcttctgttgggacaaagccttttactgttttttttcctcacttccttttag

SEQ ID NO: 191250 - DNA, 444 bp, Artificial Sequence
  Description of Artificial Sequence: Synthetic coding sequence
atgcaggagctgcacctgctgtggtgggccctgctgctgggcctggcccaggcctgccctgagccctgtgattgtggcgaaaagtatggattccaaattgctgactgtgcttacagggatctggagagtgtgcctccaggatttcccgctaacgtcactacattaagcttgtcggcaaataggctgcctgggctgccagaaggagctttccgggaagtgccacttctgcaatccctgtggctagctcacaatgagatccgcaccgtcgctgctggcgccttagcatcactgagccacctgaaatctctagatctcagccacaatctcattagtgattttgcatggtctgacctgcacaacctctcggcccttcagctgctgaagatggattccaacgagctgacctttatcccacgggatgctttcagaagtttgcgcgcctag

SEQ ID NO: 191251 - DNA, 552 bp, Artificial Sequence
  Description of Artificial Sequence: Synthetic coding sequence
atgcaggagctgcacctgctgtggtgggccctgctgctgggcctggcccaggcctgccccgaaccttgtgactgcggtgagaagtacgggttccaaattgctgattgcgcctatagggatctcgaatctgtgcctccaggattccctgcaaacgtgaccaccctctcgctctcagctaaccgcctccccggactgccggagggcgcgttcagagaagtcccgctcttgcagagtctttggctggcacataatgagatcaggactgtggctgcgggtgcgctcgccagtctatcccatctaaagtccctggatctctcccataacctgataagcgattttgcatggagtgatctgcacaacctttcagccctgcagctgttaaaaatggattccaatgagctgactttcattccacgagatgcattccgaagtcttcgagcactgaggtcactacagctgaatcataaccgcttacatacactcgcagaagggacctttaccccattgaccgccctatcccacctgcagatcaacgagaatcccttcgattag

SEQ ID NO: 191252 - DNA, 2238 bp, Artificial Sequence
  Description of Artificial Sequence: Synthetic coding sequence
atgttccccctgcgggccctgtggctggtgtgggccctgctgggcgttgcgggatcgtgtccagagccttgtgcttgtgttgacaagtacgcccatcagtttgctgattgcgcatacaaggaactgagagaagtcccagagggactcccagccaatgtgaccaccctctcattatcagctaataaaattactgttctgcgccgaggagcgttcgctgacgttactcaggtgacctccctgtggctcgcccacaacgaagtgcggactgttgagcctggagcattagcagtactctcacaactcaagaacctggatttgtcacacaattttatttcctcatttccttggtctgacctgcggaaccttagtgcgctgcagctcctcaaaatgaatcacaatagactagggagcctacctcgcgacgccctcggggcactgccagacttgcgcagtctcagaattaacaataacaggctgaggaccctagctcctggcacgtttgacgccctctccgcactcagccacctccagctctaccacaatccttttcattgcggctgtgggctggtgtggctgcaagcctgggccgcctcaacccgcgtgtccctccctgaacccgactctatcgcttgcgccagtccaccggccttacagggcgtgcccgtatatcgactcccagcactcccctgcgccccaccttcagtacacctcagtgctgaaccacctctggaagcccctgggacgcctctcagggcgggtctggcttttgtcctccactgtatcgctgacggccatccaactcctcgactgcagtggcaactgcaaataccggggggcactgtggtattggaacccccagtgctgagcggggaggacgatggtgtgggcgccgaagaaggagagggggaaggtgatggggatttgctcacacaaacacaggcacagacacccactcctgcccctgcctggccagcccctcccgctacccccagattcctggcactcgcgaacggctccctgttggttcccttgctgtccgccaaggaggccggagtttacacgtgccgtgcacataacgagctcggcgccaactctaccagtattagggtagccgtggcggctacagggccaccgaagcacgcccccggcgcaggcggggaacccgacggacaggcccctactagtgagagaaaatccaccgcgaaaggcagaggtaattctgttcttccttcaaaaccagaaggaaaaattaaggggcaggggctcgccaaagtcagtatcctcggcgagaccgaaacagagcccgaagaggacacctctgaaggcgaggaggccgaagaccaaattttggcagacccagcggaagagcagcgatgcggaaatggggacccatccaggtacgtgagcaaccatgcattcaatcagagtgcagaattaaagccgcatgtctttgaactgggcgtgatcgccctggacgtggctgagagagaggcacgcgtacaactgacacccttggcagcccgatggggccctggccccgggggagctggcggggcacctcgtccaggaagacggcctctgcggctgctgtatttgtgccccgctggtgggggggctgcggtccagtggagcagggtagaggagggtgtcaacgcgtactggttccgagggctgcgacctggcacaaattactccgtgtgtctagctctggccggagaagcctgtcacgtccaagtggtgtttagcaccaaaaaggaactcccttccctattggtgatcgtcgctgtttctgtgttcttgcttgttctggccactgtcccactcctaggagctgcatgctgtcatctgctggccaagcaccctggcaagccctaccggctgattcttcgcccccaggcccctgatcctatggagaaacgtatcgccgccgacttcgaccctcgggcatcctacctagaaagcgagaagtcatatcccgccggaggcgaagccggaggcgaagaaccagaagacgtgcagggggaaggcctggatgaggatgcagaacagggagacccctctggcgacctacagagggaggaaagcctggccgcttgcagtctggtggagagccagtcaaaagctaatcaggaagaatttgaggccggcagtgagtatagcgatcgcttgcccctaggggccgaagccgtgaatattgcacaggaaatcaacgggaattaccggcagactgcgggatag

SEQ ID NO: 191253 - DNA, 1005 bp, Artificial Sequence
  Description of Artificial Sequence: Synthetic coding sequence
atgttccccctgcgggccctgtggctggtgtgggccctgctgggcgtggcggggtcctgccccgaaccatgcgcgtgcgtggacaaatatgctcatcagttcgctgattgtgcctataaagaactgagagaggtgcccgagggcctgcccgccaacgttacgactttgtccttatcagccaacaagatcactgtcctgcgccgcggggcctttgcggacgttacccaggttacaagcctgtggctagcccataacgaggtgcgaaccgtggaaccgggcgcacttgccgtgttgtcccagcttaagaacttggacttgtcccataactttatatcgagtttcccatggtccgaccttcgaaacctttctgccctgcagttgctgaaaatgaatcacaacagactgggctcactgccacgagatgctttgggcgcccttcctgatctgcgttcactgcgaataaataacaacaggctggctggagaggcctgtcacgtccaagttgtgtttagtactaagaaggagctaccatctctcctcgttattgtagcagtttccgtgtttctgcttgtgctggctactgtgccattactgggcgcagcatgttgccatttacttgcaaagcatccggggaagccctatagactgatcctgcggccccaagctccagaccctatggagaaacgtattgctgcagattttgatcctagggcgtcttacctcgagtcagaaaaaagctacccagcaggaggcgaagccgggggtgaggagcctgaagacgtacagggggagggccttgatgaggacgctgagcagggcgacccttccggtgatctgcaaagggaggagtcactggctgcatgcagcctagtggagtcccagtcgaaggccaaccaggaggaatttgaagccggcagtgaatattccgatagattgcctttgggcgcagaagccgtgaacattgcacaggaaattaatggtaattaccggcagacagccgggtag

SEQ ID NO: 191254 - DNA, 2238 bp, Artificial Sequence
  Description of Artificial Sequence: Synthetic coding sequence
atgttccccctgcgggccctgtggctggtgtgggccctgctgggcgtcgctggatcgtgtcctgagccatgcgcctgtgtggataagtacgcccaccagtttgcggattgtgcttataaggaacttagggaggtgcccgaagggctgcccgccaatgtgactacactgtcactgagcgcaaataaaataactgttttgagacgcggagccttcgccgacgtcactcaggtcacatcactgtggctggcccacaatgaggtgcgaactgtcgagcccggtgccctcgcggtcctctcacagctgaaaaatttggatctgtcccataatttcatctccagtttcccctggtctgacctgcgaaatttgagcgcccttcaactgctgaaaatgaaccacaacaggctcggctccctccctcgcgacgcactgggcgcccttcccgacctgcggagcctgaggattaacaacaatcgcctaaggactctcgcaccggggacgtttgatgccctgtccgccctgtcccacctgcagctgtatcacaaccccttccactgcggctgtgggctggtgtggctccaggcttgggccgcctccactcgggtaagccttcctgagcccgactccatcgcttgtgcctctcctccagctcttcagggagtgccggtatacaggctgcctgctttaccatgtgcaccaccttccgtacacctctcagcggaaccccccctcgaggcccccggaacaccactgcgggctggcctggccttcgtactacactgcattgccgatggacaccctacccctcgactgcagtggcagcttcagattcccggtggtactgtggtccttgagcctccggttttaagcggcgaggacgacggggtgggcgctgaagaaggagagggtgaaggtgatggagacctcctaacccagacccaggcccagacaccgacccccgccccagcctggcctgccccaccggccacaccgagatttctcgcactggctaacggcagtctgctcgttcctctgctgtccgctaaggaggctggtgtgtacacctgtagagcacataacgaactgggcgctaactcaacttccattcgcgtcgccgtcgcagccactggacctcccaagcatgcaccaggcgcaggaggggaacccgacggtcaggccccaactagcgagaggaagtcaactgctaaaggacggggtaattccgtacttccttccaaaccagagggcaagataaaggggcagggattagctaaggtgagtatcctgggcgaaacagaaacagaaccagaggaggacacatctgaaggcgaggaggcagaggaccagatactcgccgaccctgccgaagaacagaggtgcggaaatggggaccctagccgctatgtttccaatcacgcatttaatcaatcagccgagctgaagcctcacgtttttgagcttggcgtgatagcactcgatgtggctgagagagaggctagagtacagcttacaccgctggccgcacgctgggggcctggaccgggcggcgctgggggagcaccccgccctggccgccgtccccttaggctgttgtacttgtgtcctgccggaggtggggcagccgttcagtggagccgcgtagaagagggggtcaatgcttactggttccgcggcctacgccccgggactaactatagcgtttgcttggcacttgctggagaagcctgtcacgtccaggttgtctttagtactaaaaaggaacttccaagcttgctcgtaatagtggcagtctccgtgtttctcctagtacttgcaactgtacctttgcttggagctgcctgctgccacctccttgcaaagcacccaggtaaaccctataggctgatcctccgacctcaagctccagacccgatggaaaagaggatcgccgcagacttcgaccctagggcctcatatttagaaagcgagaagtcttaccccgccggaggagaggccggaggcgaggaacccgaggacgtccaaggcgaggggctggacgaggacgcagagcaaggggacccgtcaggagatttgcaaagggaagaaagcctggccgcatgcagcctagtggaaagccagtcaaaagccaatcaagaagagttcgaagcgggatccgagtattccgatagactccctctgggcgcagaggccgtgaacattgcccaggagatcaacgggaactaccgtcaaacagcgggatag

SEQ ID NO: 191255 - DNA, 2238 bp, Artificial Sequence
  Description of Artificial Sequence: Synthetic coding sequence
atgttccccctgcgggccctgtggctggtgtgggccctgctgggcgtcgccgggtcctgccccgagccatgcgcttgtgttgacaagtatgcccatcaatttgcggattgcgcgtataaggagctgcgggaagtcccagaaggcttaccagccaatgtgaccacgctgtccctgtccgctaacaaaataactgttttgcgccggggtgccttcgccgacgtcacacaggtgacaagtctctggctggcacataatgaagtgagaaccgtggagcccggggccttagccgttcttagtcagctgaagaacctcgatctctcccacaatttcatctcctctttcccctggtctgatttacgcaacctgagcgcactacaattactgaagatgaaccacaatcgactaggcagtttgcctcgggacgccctcggtgcactcccagatctaaggagccttcgcataaataacaaccgattaaggacattggctcctggaacatttgacgccctctccgctctgtcacacctacagctctaccataaccctttccactgtgggtgtgggctggtctggctgcaggcctgggccgcttcaacacgcgtgtctctgccggagcccgactctatcgcatgcgcctctcctccggcactgcagggggtgccggtgtatcgtctacctgctctgccgtgcgctccaccatcagtgcatctttctgccgagccaccattggaggcccctggcacacctttgagggcaggcctggccttcgttttacactgtattgctgacggacacccgacccccaggctgcaatggcaattacaaattcccgggggtacagtcgtcctggagccaccagtgctttctggagaggacgacggggttggagccgaggagggcgaaggggagggagacggtgacctacttacacagacccaggcgcagactcccactcctgcccccgcctggccggccccgcccgccacgccaaggttcttggccctcgctaacggaagccttcttgtgccgcttctttcagctaaggaagcaggggtttatacatgtcgtgcgcataacgagctcggtgccaacagcacaagcatacgggttgccgtggccgcaacgggcccacccaaacacgccccaggggctggtggtgagcccgatggtcaggcaccaacatcagaacgtaaatcaaccgctaagggaagaggaaattctgttctgccatctaagcccgagggcaaaattaagggacagggcctggccaaagtgtctattcttggcgagacagaaacggaaccagaggaagacacaagcgagggtgaggaggcggaggatcagattctcgctgacccagcagaagagcagcgctgcggcaacggcgatccgtcacggtacgtctccaaccacgccttcaatcagagtgctgagcttaaacctcatgtgtttgagctcggagtgatagctttggacgtggcggaacgtgaggctcgggttcaactgacacccctagctgcgaggtgggggcccgggcctggaggcgctggaggagcaccacgccctgggagacgcccactccgtctcctctatctctgccccgcagggggcggagcagctgtgcagtggtcacgggtggaggaaggagtgaacgcttactggttcagggggcttagacccggcacaaactatagcgtgtgcctcgccttggcgggcgaggcgtgtcatgtgcaagtggtgttcagtaccaaaaaggaactgccctcactgttagtgattgtagccgtatctgtattcttactggtattagcaacagtccccttgctcggcgcagcttgctgtcaccttctggctaaacatccagggaagccatataggctcatattgagaccccaagcgccagaccccatggagaaacgaatcgccgccgattttgaccccagggcaagctaccttgagtccgagaaatcctatcctgccggcggagaagcgggaggtgaggaaccagaagatgtgcagggcgagggcctggatgaggatgcggaacagggagacccctcgggcgacttgcagagggaggagagcctggccgcatgctccctagtcgagtcccagagtaaggccaatcaggaagagttcgaagccggttccgaatacagcgatcggctgccccttggggcagaggcagtgaatattgcccaagagataaatggtaattacaggcagaccgccggatag

SEQ ID NO: 191256 - DNA, 2238 bp, Artificial Sequence
  Description of Artificial Sequence: Synthetic coding sequence
atgttccccctgcgggccctgtggctggtgtgggccctgctgggcgtggccggttcatgtccagagccttgtgcctgtgttgataagtatgcacatcagtttgccgactgcgcctacaaggagctgagagaagtgcccgagggcctacctgcaaatgtgactacgttaagtctgagcgccaacaaaatcaccgtgctgcgaaggggcgcttttgcagacgttacccaagtaaccagcctgtggcttgcccataacgaggtgaggaccgttgagcccggcgcccttgccgtcctctctcagttgaaaaatctcgacctcagtcataacttcatctctagcttcccttggagcgacctaagaaatttgtccgccttacagctgctcaagatgaaccacaaccgcctggggagcctgccccgtgacgcgctgggagcactgccagacctgcgatcattgcgaataaacaacaatagactgcgcaccttagcccctgggacttttgacgcactgagcgcgctctcccatctgcagttgtatcacaacccatttcattgtggatgtggactcgtgtggctgcaggcatgggccgcttcaaccagagtatcattgccagaacccgattccatcgcgtgcgcctccccacccgctctacagggcgtcccagtttatcgcctgcccgccctcccttgtgcacctcccagtgtgcatctgtctgcggaacctcctctggaggcccccggcacccccctgcgtgctggcttagccttcgtgctccattgtatcgcggatgggcatcccactcctcgcctgcagtggcaactgcagatccctggcggtacagtggtgctagaaccacccgtgcttagcggagaagacgacggagtgggtgctgaggagggtgagggggaaggtgacggcgacctgctcacccagactcaggcccagactccaaccccggccccggcatggcccgctccaccagccacaccgaggtttctggctctagctaacggatctctgttagtgccgctcctgagcgccaaggaagccggagtgtacacctgtcgggcccacaatgagctgggtgctaatagcacctcgatacgcgtcgccgtggccgctacgggtccacctaaacacgcccccggcgccggaggcgagcctgacggacaggcccccacgtctgaaaggaaatcgacggccaaagggcgaggtaacagcgtgcttccttccaagccagaaggcaagatcaaaggccagggcctggcaaaagtaagcatcttgggcgagaccgagacggagcccgaggaggacacctcagagggagaggaggcagaagaccagattctggccgaccctgctgaagagcagcggtgtgggaatggcgacccctctcggtatgtaagcaaccacgctttcaaccaatcagccgaactgaagccccacgtattcgaactaggagtcatcgcactggacgttgccgagagagaagctcgcgtccagctgaccccgctcgctgcccgctggggccccggcccggggggagccgggggcgcccctcgacctgggaggcggccacttagactcttatatttgtgccctgccggtggtggtgcagccgtacagtggtcacgcgtggaagagggtgtcaatgcttattggttcagggggctccggcccgggaccaactacagcgtttgtctggcgctggctggagaggcttgtcatgtgcaggtggttttcagcacaaaaaaggaattgcccagtctcttagtcatagtggccgtgagtgtgttcctgctcgttctggctactgtcccactgctaggcgccgcttgttgccacctactcgccaaacacccgggaaagccatatagactaatcctccgacctcaagcgcccgatccgatggagaaacgaattgccgctgacttcgacccgcgcgcttcatatctggaaagtgagaaatcctaccccgctggaggagaggcaggcggagaagagccagaagatgtgcagggtgagggattggacgaggacgccgaacagggagatccatctggcgatctgcagcgggaggaaagtttagcagcatgcagcctagttgagtcacagtccaaggctaaccaggaagagtttgaagccggatcagagtattccgaccgtctgcctctgggcgccgaggcggtgaacattgcacaggaaatcaatgggaattaccgacagaccgcaggctag

SEQ ID NO: 191257 - DNA, 2238 bp, Artificial Sequence
  Description of Artificial Sequence: Synthetic coding sequence
atgttccccctgcgggccctgtggctggtgtgggccctgctgggcgttgccggaagttgccctgagccctgtgcctgtgtggataagtacgctcaccagttcgccgactgcgcttataaagaacttagagaagtcccggagggtctcccggccaatgtcacaacccttagtttgtctgcgaacaagatcacagtgttgagacgcggcgccttcgccgatgttacgcaggtaacaagtttatggctggcacacaatgaagttcggactgttgaaccgggtgcgctagccgtactgtctcagctgaaaaatctggacctgagtcataacttcatttcttcttttccctggagcgatctcaggaacttgtctgcacttcagttactgaagatgaaccataatcggctgggaagccttcctcgcgacgcactcggcgcgcttccagatctccgatctttgcgcatcaacaacaaccggctgcgaacactcgctccagggacattcgatgccctgagtgccttatctcacctgcagctgtatcacaacccctttcattgcggatgtggactcgtgtggctgcaagcctgggcagcatctacccgagtatccctgcccgaacctgattccattgcctgcgcgagccctcccgcactccaaggcgtgccagtgtataggctgccagcccttccttgcgctccgccatcagtgcacctctctgctgaaccaccactggaggcccctggtaccccgctccgggcgggcctcgcattcgtgctccattgcatcgccgatggacaccccactcctaggctgcagtggcaattacagatcccaggggggacagttgtgttagagccaccggtgctgtctggcgaagacgatggggtcggggccgaagaaggtgaaggcgagggtgatggagatctgttgactcagacacaggctcagacccctacccctgccccagcatggcccgctcctccggcaacacctcgcttccttgctctggccaacggctctctgctagtccccctcctaagcgccaaggaagccggagtgtatacatgtagggcacacaatgaacttggtgctaacagcacgtctatccgggttgcggtggccgcaactggtcctcctaaacacgctccgggggccggcggcgagcccgatggtcaggccccaacttctgaacggaagtccaccgccaaggggaggggaaattctgtccttcctagtaaaccagaaggaaagatcaagggccaaggactggccaaggtaagcattctcggcgagacagaaacggagcccgaggaggacacaagcgaaggggaagaggcggaagaccagattttggcagaccctgcagaagaacagaggtgcggcaatggtgatccctccagatacgtcagtaaccatgcctttaatcagtccgctgaactgaaacctcatgtcttcgagttgggagtaatcgccctggacgtggccgaacgtgaagcccgagtgcaactgactcctctagctgcaagatggggacccgggccagggggcgctggaggagcccctcgtcctggccggcgccctcttaggctgctctacctgtgtccagcggggggaggagccgcagtgcaatggtctcgcgtcgaagagggcgtgaatgcttactggtttagaggcctgcgccctggaacaaattattctgtgtgcctggcgctggccggggaagcctgccatgttcaggtggtgttctcaacaaagaaagaactcccatcgttgttagtgatcgtggccgttagtgtgtttcttctcgtcttagcgactgtgcccctgcttggggccgcatgttgccatttgctggccaaacacccaggtaaaccatatcgcctaattctcaggccccaggctccagatcctatggagaagcgaatcgccgctgattttgatccacgggcaagctatctggagagtgaaaaatcctaccctgcgggcggtgaggccggtggggaagaaccggaggacgtgcaaggtgaaggcctggatgaggacgcagaacagggagatccttccggagacttgcagcgcgaggagtcgctggctgcctgttccttggttgagtcacaaagtaaagccaaccaagaagaattcgaggcgggatctgagtattcagatcggcttccactcggagctgaagctgtcaacatcgcccaggaaataaatggcaactacaggcagaccgccgggtag

SEQ ID NO: 191258 - DNA, 4011 bp, Artificial Sequence
  Description of Artificial Sequence: Synthetic coding sequence
atgaccctggaccggcccggcgagggcgccaccatgctgaagaccttcactgttctcctcttctgtatccgtatgagcctgggaatgacaagtatcgtaatggatccccagcctgaattgtggatagagtccaactatcctcaggctccctgggaaaatatcacgctctggtgtaggtctcccagtagaatctctagtaagtttctgctgctgaaggacaagacacaaatgacatggatccgaccctcccacaaaactttccaggttagcttcttaattggcgcgctaaccgagtccaacgctggattatataggtgctgctactggaaagagacaggatggtccaagccctcaaaggtgcttgagctggaagcccctggtcaactccccaagcccatcttctggatccaggcagaaactcccgccctgcccgggtgcaacgtcaacatcctttgtcacggttggctgcaggacctggtattcatgctgtttaaagaaggttacgctgaacccgtcgactaccaagtgcctactgggactatggccatcttttcgattgataatttgactcctgaggacgagggagtgtatatctgtcggacacacatccagatgttgcccaccctgtggtcggaaccatcgaaccccctcaagctagttgtcgcaggactctaccccaaacccacacttacggcccatcctggacctatcatggcacctggggaatctctcaatctccgttgccagggtccaatttacgggatgacctttgctctgatgcgcgttgaagatctggagaaaagcttctaccacaaaaaaactattaaaaatgaggccaatttcttctttcagtccctaaagattcaggacaccgggcactacctctgtttctactatgacgcttcctaccggggttctctactttctgatgtactgaaaatctgggtgactgataccttcccgaagacttggctcttagcccggccatctgcggtagttcaaatggggcagaacgtgtcactgcgatgccgaggcccggtggatggcgtgggcctcgccctgtataagaaaggcgaggataagccactacaattcctagatgccaccagtattgatgacaatacaagcttttttttgaacaatgtgacctactccgatacgggcatttactcatgccattatctgctgacctggaagaccagcatccgaatgccctcacacaataccgtagagcttatggtggtggataaaccacccaaacctagtctctcagcatggccctccaccgtgttcaaactggggaaggctataacactccaatgtcgcgtgagtcatcccgtgctcgagtttagcctggaatgggaagagagggaaacgttccaaaaattttctgtgaatggggattttattatctcaaacgttgacggaaagggcaccgggacttactcttgtagctaccgcgtcgagacacatcctaacatctggagccatcgcagtgaacctctgaaactcatggggcccgctgggtacctgacatggaattatgtgctgaacgaggctatccggctgtcccttatcatgcagctcgtcgctctgcttttagtcgtcctgtggatcagatggaaatgccggcgtttgcgcattagagaagcttggctcctcggaacagcccagggcgttactatgctgtttatcgtgacggctcttctttgctgtggcttatgtaatggagttttgattgaagagaccgaaatcgtcatgcccacaccaaagcccgagctttgggccgagactaacttcccgctggcaccttggaaaaatctaacactgtggtgccgcagcccatcagggtccacaaaggagttcgtgcttctgaaagatggcacaggctggattgctaccagacccgcttctgaacaggtgcgggccgcattcccgctcggcgcacttactcagagccataccggatcctaccattgtcactcctgggaggagatggccgtatctgagccttccgaggcactggaattagtagggactgatatactgccaaagcccgttatttccgcgagcccgaccattcgcggccaggaactgcagttaaggtgtaagggctggctggcgggcatgggattcgcgctatataaagagggcgagcaggagccggtgcaacagttaggggcggtcggcagggaggcatttttcaccattcagaggatggaagacaaggatgagggtaactacagttgccggacacatacagaaaagagaccattcaagtggtctgaaccctccgagcctctcgagctggtcatcaaagaaatgtaccccaaaccattcttcaaaacttgggcttctcccgtggtgacacccggagcccgcgtgacattcaactgctcaacccctcaccaacacatgtctttcatcctgtacaaggacggtagcgagatcgccagctctgaccgcagctgggcttcacccggagcttcagccgctcacttcctgattatctccgtcggcatcggagatggtgggaactattcctgcaggtactacgacttttctatttggtctgaacctagtgaccccgtggagttagttgtgaccgaattttatcccaagcctacacttcttgcccaacccggccctgtagtgttcccagggaaatccgtcattctccgctgccagggtacttttcagggtatgcgtttcgccctgctccaggagggagcgcatgtcccgctccagttcaggagcgtatccggaaactccgccgacttcttgttgcacaccgtcggtgccgaggacagcggcaattatagctgtatatattacgagaccaccatgtctaaccgtggctcttacctgtccatgccgctgatgatttgggtaacagacacattccctaagccttggctgttcgctgaaccatctagtgtcgtgccgatgggacagaacgtcactctctggtgccggggcccagtgcatggcgtggggtacatcctccacaaagaaggggaggctacttcaatgcagctgtgggggtctacgagcaatgacggggcctttccgattactaatattagcggtactagtatggggcgctactcttgctgctaccatcctgactggacctcatccattaaaatccagccctctaacactttggaacttctcgtcactggccttctcccaaagcctagcctactggcgcagccaggcccaatggtcgccccaggtgagaacatgaccctgcaatgtcagggcgagctgccagattcaacgtttgtgctgctcaaagaaggtgctcaagagcccctggagcagcagaggcctagcgggtaccgggccgacttctggatgcccgccgtaagaggagaggatagcggaatctactcttgtgtgtactatctggacagcacgccatttgctgcatcaaaccactccgatagccttgaaatttgggtaacagacaagccccctaaacccagtctgtcggcctggccctctacaatgttcaagctgggcaaagatatcacccttcagtgccgcggaccacttcccggcgtagagtttgtgttggagcacgacggtgaggaggcccctcagcagtttagtgaggatggagattttgtgatcaacaatgtagaaggaaagggtattgggaattattcttgctcataccgtttacaagcataccccgatatctggtctgaaccatcggaccccctggagctggttggagccgctggccctgtcgcccaggaatgcaccgtgggcaacattgttaggtcctctctgatagtggtggtagtcgtggctctgggcgtcgttttagcaattgaatggaagaagtggcccagacttagaaccagagggtcagagacagatggcagagatcagacaatagcactcgaggagtgcaatcaagaaggcgagccaggcacccctgctaacagccccagtagcacttcacagcgcattagcgttgagctccccgtccctatctag

SEQ ID NO: 191259 - DNA, 729 bp, Artificial Sequence
  Description of Artificial Sequence: Synthetic coding sequence
atgaccctggaccggcccggcgagggcgccaccatgctgaagacctttactgtcctgttgttttgtattcgaatgtccttgggcatgacatctatcgtgatggatccccagccagaattatggatagagagtaattaccctcaggccccctgggaaaatatcacgctttggtgtagatcaccatcccggatcagctctaaattccttctcttgaaggataagacccagatgacctggatccgaccgtcgcataagaccttccaggtgtcttttcttattggagcactgacggagtctaatgccgggttatatcgctgctgctactggaaagaaacgggttggtcaaagccctccaaggtcttggagctcgaggcacccgggcagttaccaaagcctatcttctggattcaggcggagactccagccctccctggctgcaatgtaaatattctgtgccatgggtggctgcaggacctggtgttcatgctatttaaggagggctacgccgagccagtggactaccaggtccccaccggcacgatggcaatcttctccattgataatttgactcctgaggacgagggagtctatatctgcagaactcacatacagatgctccccacgttgtggtctgagccatcaaatcctctcaagttggttgtagcaggtggctgtggatatggctgttggcatctggccattgtggtcccaggtattatggcaggatag

SEQ ID NO: 191260 - DNA, 729 bp, Artificial Sequence
  Description of Artificial Sequence: Synthetic coding sequence
atgaccctggaccggcccggcgagggcgccaccatgctgaagaccttcaccgtcctgctgttctgcatcagaatgagtctcggcatgacctccattgtaatggatcctcagccagagctgtggatcgaaagtaactacccgcaggcaccttgggaaaacattaccctgtggtgccgatccccaagccggatcagctcaaaattcctgctgctcaaggataagacccaaatgacctggattagaccttctcacaaaacattccaagtgtcatttctgatcggggcccttaccgaatctaatgcaggtctgtacaggtgttgttattggaaagaaactggttggtcaaaaccttctaaggtgttggaactcgaagcaccagggcagctccccaagcctatcttttggatccaagctgagaccccggcactgcctggatgtaatgtaaacatactgtgccacggctggttacaggatttggtgtttatgctcttcaaggagggttatgctgagccggtcgattatcaagttccgacaggtacaatggcgatcttctccattgataatctgaccccggaggatgaaggcgtttacatctgtcggacgcatatccagatgcttcctactctatggtccgaaccatctaatcctttgaagctagtggtggctggcggatgtgggtacgggtgctggcatctggccattgttgtaccagggattatggcagggtag

SEQ ID NO: 191261 - DNA, 4026 bp, Artificial Sequence
  Description of Artificial Sequence: Synthetic coding sequence
atgaccctggaccggcccggcgagggcgccaccatgctgaagacctttactgtgttactgttttgcatcagaatgagccttggaatgacctccatcgtgatggaccctcaacccgagctctggattgagagcaattacccacaggccccgtgggagaacatcactctttggtgtaggtcaccttccagaatctcttcgaagtttctcttactgaaagataaaactcagatgacatggattaggcctagtcataagacttttcaggtctcctttctcatcggggccctgacagaaagtaatgcaggcttgtataggtgctgctactggaaagagacgggttggtccaagccttctaaagtgctggagctggaggcccctggtcagttaccaaagcctatattctggattcaagccgagacgccagcacttccagggtgtaacgtgaacatcctatgtcatggctggctccaggatctagtattcatgctgttcaaagaaggctatgcagagcccgtggactatcaggttcctacgggaacaatggctatcttttccattgacaatcttactcctgaagacgaaggcgtctatatttgccgcacccatatccagatgcttcccacattatggtcggagccatctaacccattgaaactggtagtagcgggactgtatcctaaacctaccctcacagcgcaccctggaccaataatggcccccggtgaatcgctaaatctgcggtgtcaaggtccaatctacgggatgacttttgccctgatgagggtcgaggaccttgagaaatccttttatcataagaagacaatcaaaaatgaagccaatttcttctttcagagccttaaaatacaggatacaggacattacctgtgtttttactacgacgcctcctataggggctctctgctcagcgatgtattaaagatctgggtcactgacactttccccaagacctggctattagctcggcccagcgccgttgtgcagatggggcaaaacgtcagcctgcgctgtagaggtccagtggatggggtggggctggctctctacaagaagggcgaggataagcctctgcagtttctggatgccacctctatcgacgataataccagcttttttctgaataacgtcacatattcagacacggggatctattcctgtcattacctgctgacctggaagacaagcatccggatgccctcccacaataccgtggaactcatggtcgtagacaagcctccaaagccctctttaagcgcgtggcctagcactgtatttaagcttggaaaagctataacactccagtgtcgggtgtcacatccggtgctcgagttctcacttgaatgggaagagcgagagacctttcaaaaatttagtgtcaatggtgattttatcatttccaacgtcgatggaaaagggactgggacctattcctgttcatatcgggtcgaaactcaccccaatatatggagccaccggtccgagcccctcaagctgatgggccccgccgggtatttgacatggaactatgttttgaacgaagccatccggctgtcgctgatcatgcagctggtggctcttcttctggtggtgctgtggattcggtggaagtgcagaagactgagaatcagagaggcgtggctactaggaacggcacaaggtgtgacaatgctgtttatcgtaacggcgttactgtgttgtgccatctccttcgccggactctgtaacggagtactgattgaagagactgagattgtgatgccgacgccaaaaccagagctatgggcagaaaccaatttccccctggctccgtggaagaacctaaccctgtggtgcaggagcccctcaggcagcactaaggagttcgtgctgctcaaagatggcacaggctggattgctactcggccagcctctgagcaggttagagctgccttcccactgggtgccctgacacagtctcacactggtagttaccattgtcattcatgggaagagatggcagtgtctgagccctccgaggccctggagctggtgggaaccgatatcctacccaagcctgtaatcagtgctagtcccactataagaggacaagaactgcagctgcgctgcaagggctggctggctggcatgggcttcgcactgtataaggagggcgagcaggagcccgtgcaacagctgggggccgtcggcagggaggcctttttcactatccagcgtatggaagacaaagatgaggggaactatagttgtcgcactcatacagaaaagcgcccttttaaatggtccgagccaagcgagcccctggagctggtgatcaaggagatgtatccaaaacctttttttaagacctgggccagtcctgtggtgacacctggcgcccgggtaacgttcaactgctcaaccccccatcagcacatgtcgtttatcttatataaggacggaagtgagatcgcaagcagtgatcgaagctgggcttcccccggcgcaagcgctgcgcatttcttgattatctccgtgggcattggagacggcggcaactattcttgccgttactatgatttcagtatctggagcgagccttctgatccagttgaactggtggtgactgagttttatcccaagcctaccctgctcgcccagcctggaccggttgtgttccccgggaagagcgtcatcctacgctgtcagggtacctttcagggaatgcgctttgcgcttttacaggaaggggcacatgtccccctacagttccgatccgtatctggcaactctgccgatttcctgttgcacaccgtgggagctgaggacagcgggaattactcatgcatatactacgaaaccactatgagtaatagaggaagctacctgtcaatgccattgatgatttgggtaaccgacacctttcctaaaccctggctattcgcagagccctcctcagtcgtgcccatgggtcagaatgtgacactgtggtgtaggggtccagtgcacggcgtgggctacattttacacaaggagggagaagcaacgtccatgcagctttggggatctactagtaatgacggagccttccctatcacaaatatcagcggcacctccatgggcagatattcatgttgttaccaccccgattggacatccagcatcaagattcaacctagcaatacgcttgagctgctggttacgggtctgcttcccaagccttctcttctggcccagcctggacccatggtggccccgggcgagaatatgaccctgcaatgtcagggggagctaccagactctacctttgtcttgctaaaggagggtgctcaggaacctctggagcagcagagaccgtctggataccgggccgacttctggatgcccgctgtcaggggcgaagatagtggaatttacagctgtgtatactatctcgacagcactcctttcgccgcttcaaaccattcagactctctcgagatttgggtaaccgacaagccccctaagccaagcctgtcagcctggccctccacaatgttcaagttagggaaagacattacactgcaatgtcggggaccactacccggcgtggagttcgtgttggaacatgacggcgaggaggcccctcaacagttctccgaggacggggattttgtcattaataacgtggagggaaaaggcatcggcaactattcatgcagctataggcttcaagcttatcccgacatttggtcggaaccatctgatcctttggaactcgtcggcgctgcgggccctgtggcccaggaatgcactgtaggtaatatagtccggtcttcactaattgtggtagtcgtcgttgcattgggggtggttctggcaattgagtggaagaaatggccccggcttcggaccagagggagtgaaacagatggccgggaccagactattgcactagaggaatgcaaccaggaaggtgagcctggtacgcctgctaattccccatccagcactagccagcggatcagcgtggagctgcccgtgccaatttag

SEQ ID NO: 191262 - DNA, 3984 bp, Artificial Sequence
  Description of Artificial Sequence: Synthetic coding sequence
atgaccctggaccggcccggcgagggcgccaccatgctgaagaccttcacggtcctcctcttttgtatactcatggacccacagcctgagctctggatagagtccaactacccccaggccccttgggaaaatatcacactgtggtgcagaagcccgagcaggataagcagtaaatttttactgcttaaggacaaaactcagatgacttggattcggccgtctcataaaacgtttcaagtcagttttctgattggtgccctgaccgagtccaatgcgggcttgtaccgctgctgttactggaaggaaaccggctggtcgaagccttcaaaagtcttagagctagaagctcccggtcagctccccaaacctattttctggatccaggccgagacaccagccctaccaggctgtaacgtgaatattctgtgccacggttggctccaggacctggtattcatgctctttaaggagggttacgcggagcctgtggactaccaggtgcccactgggacgatggcaatattttcaattgataacttgacccctgaggatgagggagtgtacatctgccggacgcacatccagatgctccccactctgtggagcgagccgtctaaccccttaaagcttgtggtggcgggactctacccaaagccgaccctaacagcacacccaggaccaatcatggcccccggtgaatcactcaacttaagatgtcaggggcctatctacggcatgacatttgcattgatgagggtggaggacctggaaaaatcattttatcacaaaaagacgattaagaatgaggccaatttttttttccagtccctgaagatacaagacacggggcattacctctgcttctattacgatgcttcttatcgcggatccttgctttccgacgtgttgaagatctgggttacagatacatttcctaagacgtggctactggcaagaccctctgctgtagttcagatgggtcagaacgtgtcactccgctgtcggggccctgttgacggtgttggtcttgcgctgtataaaaaaggcgaggacaagcctctgcagttccttgacgccacaagcatcgatgataacacatcctttttcctgaataacgtgacttactccgacactggaatttattcatgccattatctcctgacctggaagacaagcatccgaatgccgtctcacaataccgtagagttaatggtcgtggataaaccccctaagcccagcctttcagcctggccttccaccgtcttcaagctgggcaaagctatcacactccagtgtcgtgtcagccaccctgtccttgagttctctctagaatgggaggaacgcgaaaccttccaaaagttctctgttaatggcgattttataatctcgaacgtcgacggcaagggcacaggaacctactcctgctcctatcgcgttgagacacaccctaatatatggagccacaggtccgagcctttaaaactgatggggcctgcaggttacctaacctggaattacgtgctgaatgaggcgattcggctgagcctaatcatgcagcttgtggcgctcctcctcgtggtactgtggatcagatggaagtgcagacggcttcgtatcagggaggcgtggttacttggcacagcccagggggtcaccatgctgtttatcgtgactgctctgttgtgttgtggcttgtgcaatggtgttctgattgaagaaacagagattgtgatgcccacacctaaacccgaattatgggccgagaccaacttcccactcgccccttggaagaatcttaccctatggtgcaggagcccaagcggctccacaaaagaattcgtgctgctgaaagatggcaccggctggattgctactcgcccagcctctgagcaagtaagggccgcgttcccacttggcgctctgacccagtcccacacgggctcctatcactgccactcatgggaggaaatggcagtcagtgagcctagcgaggctctcgagcttgttgggactgatatactgcccaaacccgtgattagcgcctcccctacaatacggggacaagagctgcagctgaggtgcaaagggtggctcgctgggatgggattcgccctatacaaggagggtgaacaggaacccgtgcagcagttgggcgctgtgggcagggaggccttttttaccattcagcgcatggaggataaggacgagggcaattacagttgcagaactcacaccgagaaaagaccctttaaatggtcagagccaagtgagcctctggagctggtgattaaagaaatgtacccaaaacccttttttaaaacctgggccagtcctgtggtcaccccgggcgctagagtgacctttaattgctccactccccaccagcacatgtctttcatcctgtacaaggacggatccgaaattgcttcttcggacagaagctgggctagtcccggagccagcgcagctcattttttaattatttctgtaggaataggcgatggcggcaattattcttgccgttactatgacttttccatctggtccgaaccctccgatccagtggagctggtagtaacagaattttaccccaaaccaacactgcttgcacagccgggaccggtggtgtttcccgggaaatccgtgatactgcggtgtcaggggacctttcaggggatgcggttcgccctgctgcaggagggcgctcatgtccccctgcagtttcgttccgtgagtggcaactctgcggattttttgttgcacacagtcggggccgaggactctggcaactactcatgtatctactatgaaaccactatgtctaaccggggctcttaccttagcatgcctctgatgatttgggtgacagacaccttccccaaaccgtggttgtttgccgagcctagttctgtggttcctatggggcagaacgtgacactatggtgtagaggtccggtgcatggtgtgggttacattcttcacaaggaaggagaggcgaccagtatgcaattgtggggctccacatcgaacgacggcgctttccccattactaatatttcgggaacttcaatgggccgatattcctgttgttatcacccagactggacttcatcaataaaaatacagccgtcgaacaccctggaactgctggtgaccgggttgttgcctaagccgtcactcctcgcacagcccggcccgatggtggcaccgggcgaaaatatgaccctacagtgtcagggtgagcttcctgattcaacatttgtgctgctgaaggagggcgcccaggagcccctcgaacagcagagaccttcaggatatcgggctgatttctggatgccagccgtgcggggcgaggactctgggatttatagctgcgtctactatttggactcaactccatttgcagcttccaatcactcagacagtttagagatctgggtgacagacaagcctcccaagccatcgctgtccgcatggccatcaacgatgtttaaattagggaaggatatcacacttcagtgcaggggtccacttccaggagtcgagttcgtcctcgaacacgacggagaggaagcccctcagcagttttcagaagatggcgactttgtcattaataacgtggagggaaaaggcataggtaactactcatgcagctatagacttcaggcctatccggatatctggagcgaaccctcagacccactcgaactggtgggcgccgccgggccggtcgctcaagagtgcacagtagggaacatcgtcagatcaagcctaatagttgtggtggtggttgcactaggcgtagtgctcgctatagaatggaagaagtggccgcggctaaggacccggggcagcgaaaccgatgggagggaccagactattgcactggaggaatgcaaccaggagggagaacccgggaccccagccaactccccttcatctacgtcccagaggattagtgttgagctccctgtgccaatatag

SEQ ID NO: 191263 - DNA, 3984 bp, Artificial Sequence
  Description of Artificial Sequence: Synthetic coding sequence
atgaccctggaccggcccggcgagggcgccaccatgctgaagaccttcacagttctgttattctgtatactgatggacccccagcctgaactgtggatagagagtaattatcctcaagcaccatgggagaacatcactctgtggtgtcgctccccaagccgaatcagcagcaaattcctgctgttaaaggataagactcaaatgacgtggattaggcccagccataaaacatttcaggtttctttcttgatcggcgcactgactgagtctaatgcaggcctgtataggtgctgttattggaaggagacggggtggagcaaacccagtaaggttctcgaactggaggcacccggccagttacctaagccgatcttctggatccaggcagaaacccctgcgctcccaggatgtaacgtgaatatcttgtgccacggatggctccaagacctggtgttcatgcttttcaaagagggctacgccgaaccagtagattaccaggtgcccacaggaacaatggctatcttctccattgacaaccttacaccagaggatgagggggtttacatatgtcggacacacatccagatgctgccaacactgtggagcgagccctcaaaccccctcaagttggtggtcgcgggcctttacccgaagccgaccttgactgctcacccaggccccattatggcgcctggcgaaagcctcaaccttagatgtcaagggcccatctacggaatgacttttgccttaatgcgggtcgaagatctggagaagagcttctaccataagaagactattaagaatgaggcaaactttttctttcagtcgctgaaaatacaagacactgggcattatctgtgcttctattatgatgcaagttaccgcggaagtctgttaagtgatgttctgaagatctgggtgacagatacttttccaaagacttggttgctcgctcgcccttctgctgtagtccagatgggccagaatgtgagtttgcgctgccgcggccccgtggatggagtcggccttgcgctctacaaaaaaggtgaagacaagccactccagtttctcgacgctacctctatcgacgataacacatctttcttcttgaacaacgtcacgtactcggatactggaatatactcttgccactatctgttgacctggaagacttcgatccgtatgccctctcacaacaccgtcgagcttatggtggtcgacaaacctccaaagccatcacttagcgcttggccgagtaccgtatttaagttgggcaaggccatcacactgcagtgtcgtgtgtctcaccccgtcctggagttttccctcgaatgggaggagagagagaccttccagaagttctccgtgaatggcgatttcatcatttctaacgtcgacggaaaaggcaccggaacgtactcatgttcctacagagtcgaaactcatcccaatatttggagccacagaagcgaacctctgaaactaatgggacctgctggctatctgacctggaactatgtacttaatgaagcaatacggttgtccctcataatgcaactggtcgccctgctcctggtggtcctgtggataagatggaaatgtaggcggctccgaattcgggaggcctggctccttggcaccgcccagggagtgacaatgctgttcatcgtgactgccctactttgttgtggcttgtgtaacggcgtgttaatcgaagagactgaaatcgtgatgccgactccaaagccagagttgtgggcagagactaatttccccctcgcaccatggaaaaaccttaccctttggtgcagatctccatcagggtctacgaaggagtttgttcttttgaaagacggtactggttggatcgccacgaggcctgcgagtgaacaggtccgagccgccttcccattaggggcgcttacccaatcccacactgggtcctaccactgccacagttgggaagagatggcagtgtctgagcccagtgaagcccttgagctggtaggtaccgacatccttccaaaacctgttatatcagcgagccctactatccggggccaggagctgcagctacgttgtaaaggctggctcgccggcatgggcttcgcactctataaagagggcgagcaagaacccgtgcagcagttaggagctgttggaagagaagcatttttcacaattcagagaatggaagacaaggacgaaggtaattattcttgcagaacccatacggaaaagcgtccttttaagtggtcagagccatccgagccgctggagttggtgattaaagaaatgtaccctaaacctttttttaagacttgggcctcaccagttgtcacgcccggagcgcgagtgactttcaattgttctacccctcaccagcacatgtcctttatcctttacaaggacggcagcgaaatagcctcttctgatcgtagttgggccagcccaggtgcttcagcagcgcactttctcataattagcgtcggcatcggcgatgggggcaactacagctgtaggtactacgacttctctatttggtccgaacctagcgatccggtggagctggttgtgaccgaattttatcccaaacctacgctcttagcacagccaggaccagtggtatttcctgggaaaagtgtgattctgcggtgccaggggacatttcagggcatgagatttgcgctgctacaggagggggcccatgttcccctgcagttccgttcagtaagtggcaactccgccgatttcctgctgcatactgtgggtgccgaggacagcgggaactactcctgtatatactacgaaactactatgtccaatcgcggaagttacctgagcatgcccttgatgatttgggttaccgacacctttccaaagccctggctgttcgccgaacctagtagcgtcgttcccatgggccagaacgtgaccttatggtgtcggggacctgtgcatggggttgggtacatcctgcacaaggagggggaagctacatctatgcagctgtggggctcaacttctaacgacggtgcctttcctatcaccaacatttctggtacctctatgggacggtattcatgctgttatcacccggattggaccagtagcatcaaaatccaaccatccaataccctggaacttcttgttacaggactgcttcctaagccttcgctccttgcacaacctggccctatggtggctcccggggaaaatatgaccttgcagtgtcagggggaattgcccgatagcaccttcgtcttattaaaagagggtgcccaggagcctctagagcagcagaggccgagtggatatcgagcagatttctggatgcctgcagtgagaggagaagattcgggcatttattcttgtgtatattacctcgacagtacgccgtttgcagccagcaaccattctgattcactcgagatatgggttaccgacaagccccctaagcccagcctttcagcctggccgtctaccatgttcaaactggggaaggatataactctgcagtgccgcgggcccctgcccggtgtggaatttgtcctggagcacgacggtgaggaagccccccagcagtttagcgaggatggagacttcgtaattaacaatgtggagggcaaagggattggaaactattcttgctcgtataggttacaggcttacccagacatctggtctgagccctccgatcctctggagctcgtgggcgcggcgggacccgtagctcaagagtgtaccgtgggcaatattgtgagatcgtcactcatagtcgttgttgtagttgctctgggcgtcgtgctagctatagaatggaagaagtggcctaggctccgaacacgaggctccgagaccgacggtagagaccagacaatcgccttggaggagtgtaatcaggagggcgaacctgggactccagctaacagcccctcttcaacatcccaaagaatctccgtggagctcccagtgcccatttag

SEQ ID NO: 191264 - DNA, 3645 bp, Artificial Sequence
  Description of Artificial Sequence: Synthetic coding sequence
atgaagtgcttcttccccgtgctgagctgcctggccgtgctgggcgttgtatctgcacagcggcaggtgaccgtgcaggaaggccccctgtacagaaccgaaggctcacatattacaatttggtgtaacgtctccgggtaccaggggccctcggagcaaaacttccagtggtctatttatctgccatcttcccctgagagagaagtgcagatcgtttcaaccatggattcttcttttccttacgccatatacactcagcgtgtgagggggggaaagatctttatagagcgagtgcagggcaactctaccctgcttcatatcaccgacttacaggcaagagacgcaggcgagtacgaatgccacacccctagcaccgacaaacagtactttggcagctatagtgcgaaaatgaacttagtggtgatacctgacagtctgcagacgaccgccatgcctcagaccctgcacagagttgagcaagacccgcttgaactgacctgcgaagtagcgtctgaaacaatccagcatagtcatctttcagtggcctggcttaggcagaaggtcggtgagaagccggtggaagtcatcagtttgtcacgagactttatgctgcactcaagctccgagtacgcacagcggcagagcctcggcgaagttagattagataagctggggcgcactacatttaggctgacaatttttcatctgcagcccagcgaccagggagagttctactgtgaggctgccgaatggatccaagacccggatggatcctggtatgccatgacacgaaagagaagcgaaggtgcagtggtcaacgtgcagcctacggataaggagttcaccgtgaggctggaaacagaaaagaggcttcacacagtcggggaaccggtggaatttcgctgcatcttagaggctcagaacgtccccgatagatacttcgctgttagctgggcgttcaacagctccctcatcgctactatgggtccaaatgctgttcctgtgttgaactcagagtttgcccaccgagaagctagaggccagctcaaagtggcaaaggagtcagactctgtgttcgttctgaagatataccacctcaggcaggaagatagcgggaaatacaactgcagagtgacggaacgggaaaaaaccgtcacaggagagttcatagacaaagagagtaagcggccgaagaatattcctattattgtgttgcccttaactgataactgggttgtgaaagttcctcagcaccatcagttgctctctcagggacatctcgagtcttccatctccgtcgaggtcgctagcaatgcttccgtgatactggagggggaagaccttagattctcttgttccgtgagaaccgcaggacgacctcagggccggtttagcgttatctggcagttagttgacagacagaatcggcgcagtaatatcatgtggctggaccgtgacggcactgtgcagcccggctctagctattgggagcgcagctcctttgggggggtgcaaatggagcaagtgcaaccaaatagcttttccctaggcatctttaactcccggaaggaagatgagggccagtacgaatgccatgtcaccgagtgggtcagagccgttgacggcgagtggcaaattgttggcgaacggcgagcttctaccccgatatctataactgcactggaaatgggctttgcagtgactgccatctctagaacccctggggtgacttattccgattcctttgatctgcaatgcattataaagcctcactatccagcatgggtgccagtctccgtgacatggcgcttccagcctgtgggcactgtcgaattccatgatttggtaactttcacgcgggacggcggagtgcagtggggagatcgctccagcagcttcagaacgagaacagccattgagaaggcagaaagttcaaacaacgtgcgcctgagcatcagccgcgcatctgacacagaggccggcaaatatcaatgcgttgctgagctctggcggaagaactataacaatacatggaccagacttgcagaaaggactagcaacctgctcgaaataagagtcctccaaccagtgaccaaattacaggtctccaagagcaagcggacactgactctggtagagaacaagcctatacaactgaattgctcagtgaagagccagacaagtcagaactcccacttcgcggtgctctggtatgtgcataagccatccgatgccgacgggaaactgatccttaagaccacgcacaactcagccttcgagtacggaacctatgctgaggaggagggactgagagctcgtctgcagttcgagcgccacgtttctggcgggctgttcagcttaactgtgcagcgggcggaggttagtgacagcgggtcctattactgccacgttgaggaatggctcctttcacccaattatgcatggtataagctggccgaggaggtgagtggtcgaacggaagttactgttaaacaaccggacagcaggctcaggttatcacaggcacaaggaaacctgagtgtgctcgaaacgcgacaggtacaattggaatgcgtggttttaaatagaactagcatcacttctcaactgatggttgagtggtttgtttggaaacctaaccacccagaacgtgagactgtcgcacgtcttagccgggacgccacatttcactatggggaacaggcagcgaagaataatcttaaaggacgcttacatctggagtctccaagccccggggtttaccggctcttcatacagaatgtggcggtgcaggattctgggacctacagttgtcacgtggaggagtggctgccatcaccatcgggcatgtggtataagagggctgaggacactgctggccagaccgcattgacggttatgagacctgacgcatctctacaggtcgacacggtagttccaaacgctaccgtcagtgaaaaagctgcattccagctagactgctcaatcgtatctaggagcagtcaggattccaggtttgcagtcgcttggtacagcctgagaaccaaagccggcggcaagcgttcatccccaggattggaggagcaggaggaggagagggaggaagaggaggaagaggatgacgatgatgacgatgaccccaccgaacgaaccgccctcctcagtgtggggccagatgccgtgttcggacctgagggaagcccctgggaaggtcggttacgcttccaaaggctgtccccggtcctgtaccgactcacagtccttcaggcctcccctcaggacaccggcaattactcttgtcacgtggaggagtggctgcccagcccccaaaaagaatggtacaggctaactgaggaagagtccgcacctattggtatccgcgttcttgacacctcgcccaccctgcagagcatcatctgttcaaacgacgcccttttctatttcgtttttttctatcccttccctattttcggaattcttatcatcacgatcttactagtcagattcaagtctagaaattcatctaaaaactccgatggtaagaacggagttcccctcttatggatcaaagagccacacctgaactattcgccgacatgtttagagccccccgtcctgtctatccacccaggggctatcgactag

SEQ ID NO: 191265 - DNA, 3645 bp, Artificial Sequence
  Description of Artificial Sequence: Synthetic coding sequence
atgaagtgcttcttccccgtgctgagctgcctggccgtgctgggcgtcgtctctgcacaacgccaggtgactgtacaagaaggaccactgtataggaccgaaggctcccatatcaccatctggtgtaacgtttcaggatatcagggcccctccgagcagaactttcagtggagcatctatttaccctcttcacccgaaagggaagtgcagatcgtgtcgacaatggactcatcctttccctacgctatttatacacagagagttcgtggcggcaaaattttcatcgagagggtgcaaggcaacagtactctcttacacatcaccgacctccaggcccgcgatgcgggcgaatacgagtgtcatacaccaagtacagacaagcagtatttcggtagttattccgcgaagatgaacctggttgtgatccctgactcactgcagaccacagcaatgccccagactctccacagagtcgaacaggacccactcgaacttacatgtgaagttgcctccgagaccattcagcatagtcatctgtcggtggcctggttgaggcagaaagtgggagagaaaccagtcgaggtcatcagcctctctagagattttatgcttcactcctcctcggagtatgcccaacgccagtctctgggcgaggtgaggctcgataaattgggccgaaccacctttcgtcttaccattttccatctgcagccctccgaccagggggagttttactgcgaggcggctgaatggattcaggacccagatgggtcatggtacgcgatgacaaggaagcgttctgagggggccgtggttaatgttcagcccactgataaggagtttaccgtgcggttggagactgaaaagcgcttacataccgtgggagaaccagtcgagtttaggtgtatactcgaagctcagaacgtccccgaccgctacttcgcggtgtcttgggctttcaatagtagcctgatcgcgaccatggggcccaacgctgtgccagtgttgaactcagagttcgcccaccgcgaggccagaggccagctgaaagtcgctaaagaatctgactctgtgtttgtgctgaaaatctaccatctgagacaagaggattccggaaaatataattgccgtgtgacagaaagggagaagactgtgactggagagttcatcgataaagagtcaaaaagaccaaagaacatcccaatcatcgtgctgccactgaccgacaattgggttgtgaaagtacctcagcaccaccagctactgagccaggggcatttggaatcatccatcagcgtcgaagtggcctccaacgctagcgtgatattggagggagaggacctgaggttttcttgcagcgtacgtactgcgggacgaccacagggaaggttttcagttatctggcaacttgtggatcgacaaaacagaagatcaaacatcatgtggctcgatcgggatggtaccgttcaacccggatcctcatattgggagaggagcagttttggtggagtgcagatggaacaagtgcagcccaactccttttcactgggtatctttaatagtcggaaggaggatgaaggccagtatgagtgtcatgtgacagagtgggtgagggccgtggacggggagtggcaaatcgttggagagcgaagggcttcaacccccataagcatcaccgccctggagatgggatttgcggtgaccgcaatcagtaggactccaggggtaacgtactccgactcattcgatcttcagtgtattatcaagccacattatcctgcttgggtgcctgtctcagtaacctggaggtttcagccggtgggcactgttgagtttcatgatctggtaacttttacccgggacggcggcgtgcagtggggcgaccgatccagttccttcaggacacgcaccgcgatagaaaaggctgaaagctctaacaatgtccgtttgtctatttcccgggcaagcgacactgaggccgggaagtaccagtgcgtggcggaactgtggaggaagaactataacaacacttggacccgactggccgaacgcacgagcaatttgctcgaaatcagagtgctacagcctgtcacaaagctccaggtgtctaaaagcaagcgaaccctcacgctggtggagaacaaaccaatccaattgaactgttctgttaaaagtcaaacctctcaaaatagccactttgccgtgctgtggtacgtgcataagccatcagacgcagatgggaagctgatcctgaagacaacacataactccgccttcgagtacggtacgtatgctgaggaagaaggcctgcgggcaaggttacagttcgagaggcatgtgagcggaggcttgttttcactgactgtccagcgagccgaagtctccgatagcggatcgtattactgtcatgtagaggagtggctgctaagtccaaactatgcatggtacaagctggctgaagaggtctcaggacgcactgaggtgaccgtgaaacaacctgactctcggttgcgcttgagtcaggcccagggcaacttgtccgtattggaaaccaggcaggtacagctcgaatgtgtcgtcctcaataggacctccatcacctcacaacttatggtggaatggttcgtgtggaagccaaatcaccctgaaagggagacagtggcacgcttatctcgcgatgcaacttttcactacggggaacaggccgctaaaaacaatctaaaaggacgcctgcacctcgagtctccttcccccggtgtgtaccggctgtttatccagaatgtggcagtgcaggattccgggacatactcatgccatgtggaggaatggttaccgtctccctccggcatgtggtataaaagagcagaggatacagctggccagacagcgctcaccgtgatgcgccccgacgcctcgcttcaggttgataccgtggtgccaaacgccactgtttcggagaaggcagcatttcagctggactgttcgatagtgtcccgctcatctcaggactctcgctttgccgtcgcttggtatagtctcaggaccaaagccggagggaaaaggagcagcccaggcctagaagaacaggaggaagagagggaagaggaggaggaggaagacgacgatgatgatgatgatcccaccgagcgcaccgctcttctgtctgttggcccagacgcggtgttcggacccgaaggcagcccctgggaaggcagactgcgatttcagaggctttcccctgtgctctacaggctgacagtcctacaggccagcccccaggataccggcaactattcatgtcatgtggaagagtggcttccatcccctcagaaagaatggtatcggttaacagaggaggagtctgcacccatcggaatacgggttttggacacaagccccacattgcagtccattatttgcagtaatgatgcgttgttctacttcgtgttcttctacccgttcccgatttttggcattctgatcatcacaatattgctagttcgttttaagagtcggaattcctccaaaaacagcgatggaaagaacggtgttcctttgttgtggattaaggagccacacctcaactacagccccacctgtctagagcctcctgtactctccatccatcccggcgccatcgattag

SEQ ID NO: 191266 - DNA, 3585 bp, Artificial Sequence
  Description of Artificial Sequence: Synthetic coding sequence
atgaagtgcttcttccccgtgctgagctgcctggccgtgctgggcgtcgtaagtgcccagcgccaggtgacagttcaggaggggcctctctaccgcactgagggttcacatattacgatctggtgtaatgtgagcggatatcagggccccagcgagcagaatttccagtggtcgatttatctgcccagtagccccgagcgcgaagtacagatcgtgtccactatggacagttcattcccttatgctatctacacacagcgcgttcgcggtgggaaaatcttcatcgagcgcgtgcaggggaattccacactcctgcacattacggatctgcaggcccgcgatgcaggagagtacgaatgtcacacgcctagcacggacaagcagtactttgggtcctattctgcaaagatgaacctagtcgtgatcccagacagtctgcagaccactgccatgccgcaaacgttacacagggtagagcaagatcccctggaattgacttgcgaagtggcgtccgagaccatccagcatagtcatttgagcgtggcctggcttcggcagaaggtcggtgaaaaaccagtggaagtgatttcgctctcccgcgatttcatgctgcactctagcagcgaatacgctcagcgacagagcctgggtgaagtccgtctcgacaagctcggcagaacaacattccgcctgactatctttcacctgcagccttcagatcagggtgaattttattgtgaagccgctgaatggattcaggaccctgacgggtcatggtatgcaatgacccggaagcgatccgaaggagcggttgtgaatgtccagcccacggataaagaattcactgtgagactggagactgaaaaaaggctgcacacagtgggtgagccggtggagttccgatgcatattggaggcgcagaacgtcccagaccgctacttcgccgtgtcctgggcgtttaactccagtcttattgcaacaatgggccccaatgccgtgcctgtactgaactcagagtttgcacatcgcgaagcccgcggccagcttaaggtggcgaaagaatccgactctgttttcgtactgaagatctaccacctgcggcaggaggacagtggcaagtacaactgcagagtgacagagcgcgagaaaaccgttactggggaatttattgacaaggagagcaaacgccctaaaaatatccctatcattgttttgccactcaagtcctcgatttccgtggaggtcgcgtcaaatgcatccgtcatcctggagggagaggatctgagatttagctgctccgttaggacggccggaagaccccagggtaggttctccgtgatctggcagctggtggatcgacagaaccgcaggtccaacatcatgtggctggacagggacgggaccgtccaaccaggcagcagttactgggagagatcttctttcggaggagtacagatggagcaagtgcagcctaatagcttctctctcggcatttttaactctagaaaggaggacgaaggccagtacgagtgtcacgtgactgagtgggtgcgtgctgtggatggagaatggcagatcgtaggggagaggcgggcatctacgcccatttcaattaccgcccttgagatggggtttgcggtaacagccatcagccgtactccgggcgtgacatacagtgactcattcgatctccagtgcattattaaaccacattatcctgcttgggtaccagtaagcgttacctggcggttccagcccgttgggaccgttgaatttcacgatctagtgacctttacacgggatggcggcgtgcagtggggtgacaggtcgtctagctttagaactaggacagccatagagaaggctgagtctagcaataacgtgaggttgtccataagcagggcttcggacactgaagctggaaaataccagtgcgtcgccgagctgtggcgcaaaaactataacaatacctggacgcgcctcgctgaacggacctctaacctgctggaaatccgcgtgttgcagcctgtgaccaaattgcaggtgtctaagagcaagcggacacttactttggtggaaaacaagcccattcagttaaattgtagtgtgaaaagccagacatcgcagaatagccattttgctgtcctgtggtacgtccataaacccagcgacgccgatggaaaattgatactgaaaacaacacacaatagtgctttcgagtatggaacctacgccgaggaagaaggtcttagagcccggctacagttcgaacggcacgtgtcgggagggctttttagcttaacagtgcagcgagccgaggtgagcgattccggtagctattattgtcatgtcgaagagtggctactttcgccgaactacgcttggtataaattagctgaagaggtgagcggccgaacagaggttaccgtcaaacaacctgattcccggttaagactttcacaggctcaggggaacctaagtgtgctggaaacccgtcaggttcagctggaatgcgtggtgctaaaccggacctcgatcacctcccaactaatggtggagtggtttgtgtggaaacccaaccaccctgagcgggagacagttgcacggctttcccgagacgcgacttttcattacggtgagcaagctgctaagaacaacctcaagggccgtctccatctagaatcccccagcccaggggtttaccgcctcttcatccaaaatgtggcagtgcaggactcaggcacctacagttgccatgtggaagagtggctccctagcccctccggtatgtggtacaaaagggcagaggatactgccgggcagactgctttaacagtaatgcgaccggacgcctctctgcaggtagatactgtagtccctaacgctaccgtgtctgagaaggcggccttccagctggactgcagcattgtgagtcgctcatcccaagatagcaggtttgccgtggcctggtatagtttacgaaccaaagccggcgggaaaagaagcagcccgggtctggaagagcaggaggaggaacgcgaagaagaggaggaagaagatgacgatgatgacgacgatcccaccgagcgcaccgcgctactatccgtaggaccagacgcagtcttcggccccgaaggctccccatgggagggaagattacgtttccagcggctctctcccgttctctataggctgactgtcttgcaggcatccccccaggacactggtaattactcgtgccacgtggaggaatggttgccatctccacagaaggaatggtatcggctgacagaagaagaaagtgcccccattggtatcagagtcctggacacatccccaaccttgcagtccatcatatgcagcaatgacgcgttattctattttgtgttcttttaccccttcccaatcttcggcatcctgatcatcacaatactgttggtgcggtttaagagtcggaacagttcaaagaatagcgacggaaagaacggggtaccactcctctggatcaaggagccccatctaaattatagcccaacatgcttagaaccgcccgttctctctatccatcccggcgcaatagattag

SEQ ID NO: 191267 - DNA, 726 bp, Artificial Sequence
  Description of Artificial Sequence: Synthetic coding sequence
atgggcaccgccagccggagcaacatcgcccggcacctgcagaccaacctcatattgttctgcgtaggagccgtgggtgcctgtactctatccgtgacccagccttggtatctggaggtcgattacacccacgaggctgtgacaataaaatgtacatttagcgccacaggatgccccagtgagcagccgacttgtctgtggtttaggtacggggcgcatcagcctgagaatttgtgcctggacggatgcaaatctgaagcagataagtttactgtcagggaggccttgaaagaaaaccaggtgagcctgacagtgaacagggtgacgtcaaatgattcagccatctacatttgcggaatcgctttcccttccgtcccggaggcccgagccaagcagacaggaggcgggactactctggtggtgcgggagattaagttactctccaaagagttaaggagcttcttaacagcgctcgtctcgctgctgtccgtgtacgtgacaggcgtttgtgtagcattcattctgctgagcaagtcaaagagcaatcctctccggaataaggaaatcaaagaggactctcagaagaaaaagtcagccaggcgtatctttcaggagatcgcacaagagctgtaccataaacgccatgtggaaacaaaccagcagtctgaaaaggacaacaatacatatgaaaatcgtagagtgctatccaattatgagagaccgtag

SEQ ID NO: 191268 - DNA, 1842 bp, Artificial Sequence
  Description of Artificial Sequence: Synthetic coding sequence
atgggcgccctgcggcccaccctgctgccccccagcctgcccctgctgctgttacttatgctgggcatgggatgctgggcacgcgaagtgttggtccccgagggacccctgtatagagtcgctggaaccgctgtaagtatatcttgtaatgtgacaggctacgaaggtccggcccagcagaactttgagtggttcttatatagaccggaggcccccgacactgctctgggcattgtttccacaaaggacacccagttttcctacgccgtatttaagtcacgagtcgtggccggagaagtgcaggttcagagactgcagggggacgccgtcgtgctcaaaatcgcccgacttcaggcccaggatgccggtatttatgagtgtcatacaccttctacagatacccggtatctgggaagctacagcggtaaggtagagctccgggtcttgccagatgtcttacaggtgagcgctgccccaccgggacccaggggacgccaggcaccaacaagcccaccccgaatgacagtccatgaaggtcaggagcttgccctcgggtgcttggctagaacctctacccagaaacacacacacctggcagtgagcttcggtcgttctgttcctgaggctcccgtgggcaggagtaccttgcaggaagtggttggcatcagatctgacctggccgtcgaggcaggggctccatacgctgagcggctcgctgcgggcgagcttaggttgggcaaagaaggaaccgataggtaccgcatggtggtggggggtgctcaggcgggcgacgcaggcacttaccactgcacagcagccgaatggatccaggaccctgatggctcttgggcacagatcgcggagaagcgggccgttcttgcccatgtcgacgttcaaaccctctctagtcagttagccgtgacagtgggacccggcgaaagacggatcggcccaggcgaacccctggaactgctctgcaatgtgtcaggagcactgccccctgctgggcggcacgctgcatattctgtcgggtgggagatggcacctgccggagcccctggcccgggccgccttgttgcgcaacttgatactgaaggcgtcgggagcctgggtcctgggtacgagggaaggcacatagccatggaaaaggtcgcttcccgaacatatcggcttcgactggaggccgccagaccgggggatgctggcacatacaggtgtctagcaaaggcttatgtcagggggtctgggacccgcctccgcgaagctgcgagcgcacggagccgccctctccccgttcacgttcgggaagaaggcgtggtgctggaagcggtcgcatggcttgcaggcggcaccgtctacaggggtgaaacagcctctctcctgtgtaacataagcgtcagaggcggcccacctgggctccgcctggccgcgtcctggtgggtagaacgccccgaagacggagaactaagcagtgtgcctgcgcagctagtgggtggcgtcggacaggatggcgtcgcagagctcggagttcgccccggaggtggcccggtgtctgtcgaactagtgggcccccgctcccatcgtctgaggttacactctctcggacccgaggacgaaggcgtatatcattgtgctcctagtgcttgggtgcaacatgcagactactcttggtatcaggccggcagcgctcgctctggccctgtgaccgtttacccctacatgcatgctttggatactctgtttgttccccttctcgtgggaaccggagtagcgctcgtcaccggagccactgtcctcggtactatcacatgttgttttatgaagagactaaggaaacgttag

SEQ ID NO: 191269 - DNA, 1581 bp, Artificial Sequence
  Description of Artificial Sequence: Synthetic coding sequence
atgggcgccctgcggcccaccctgctgccccccagcctgcccctgctgctacttttgatgcttggaatgggctgttgggctagggaggttctggtgcctgaaggacctctgtatcgagtcgcagggacggctgtctctattagctgtaacgtgacgggctacgaaggccccgcacagcagaattttgagtggttcctttaccggccggaagcccctgacaccgctctgggcattgtctccacaaaggacacacagtttagttatgcagtttttaagtcacgcgttgtggcgggcgaggttcaggtgcaacgtttgcagggcgatgccgtggtgttgaaaatcgcccgtctgcaggcgcaggatgccggcatctatgagtgtcatacccctagtaccgacaccagatacctgggatcttactccggtaaagtggagctccgcgtgcttccagacgtcctgcaggtcagcgcagcccctcctggaccacgcggaagacaggcccctacctctccccctcgcatgacggtccatgagggacaggagctggctttaggatgtcttgcaagaacgtctacgcagaaacacacccatctcgccgtgtcatttgggcgatccgtccctgaagccccagtaggccggtccactctacaggaggttgttggaattcgctcagacctggctgtggaggcgggcgcaccttatgctgagcggctcgcggcaggagagctgagactcggcaaagagggcactgatcgctaccggatggttgtcggcggagcacaagccggcgacgcaggcacctatcactgtaccgcggctgaatggattcaggaccctgacgggagttgggcccaaattgccgagaagcgggccgtgctggcacacgtggacgttcaaactctttcttctcagctggccgtcactgtcgggcctggtgaaagacggatcggtcctggcgagcctctggagcttctgtgtaacgttagtggtgcgttacctcctgcaggcagacacgctgcgtatagtgtcgggtgggaaatggcccccgcgggggctcctggtcccggacgcctggtagcgcagctggacactgagggtgttgggagcttaggtcccggctatgagggtagacacatagcaatggagaaggttgcgtctaggacctatcgcctacgcttggaggctgctcgccccggagatgcgggcacatatcgatgtctggccaaggcctacgtacggggatccgggacccgcctgcgagaagctgcatcagcgcggagtcgcccgctgcctgtgcacgtccgagaggaaggcgtggtattggaagccgtggcctggcttgccggcggaactgtttatcgcggagagacggcttccttgctgtgcaacatttcagttcggggcggcccacccggattgagaagcgctcgttctggtccagtgacggtttacccttacatgcatgccctcgatacgctctttgtgcctcttctggttggaactggagttgcattggtgacaggcgctaccgtgttgggaaccatcacctgctgtttcatgaagcgactgcggaagcgttag

SEQ ID NO: 191270 - DNA, 1842 bp, Artificial Sequence
  Description of Artificial Sequence: Synthetic coding sequence
atgggcgccctgcggcccaccctgctgccccccagcctgcccctgctgttgctgctgatgctcggcatgggatgttgggcccgtgaggtactggtcccagaagggccactctatagggtcgctggtaccgctgtgagcatctcatgcaatgtgaccggatatgagggccccgcccaacagaactttgagtggttcctctacaggcccgaggctccagatacagccctgggaatagtgtccaccaaagacacgcagtttagctacgccgtatttaagtcaagggttgtggccggcgaggtccaggttcagcgtctgcagggtgacgcagtggtactaaaaatcgcccgactgcaagcacaggatgctgggatttatgagtgtcacacaccctccaccgacacacggtacctgggatcatactcaggaaaggtggaactgcgtgtcttacccgacgtgctgcaggtgtcagctgcaccgcctgggccccgagggaggcaagcccctactagtcccccgagaatgacagtacatgagggtcaggaacttgcactgggatgcctcgccaggaccagtacccagaaacacactcatctggctgtctccttcggacgttcagtgcccgaagcgcccgttggccggtccacactgcaagaggtagtggggattcgctccgatctggccgtagaggccggggctccttacgcggaacggttagccgctggggagctgagactgggcaaggaaggcaccgatagataccgtatggtcgtcggaggggcccaggcgggagacgccgggacctatcactgcacagcggccgaatggattcaggaccctgatggaagttgggcccagatcgccgagaaaagggctgtcctcgcccatgtcgacgtgcagactctgtcgagccagctggcagtgaccgtgggcccaggtgagagaaggattggacccggcgaacccttggaattgctatgcaacgtgtcgggtgccctgccccctgctgggcgccatgccgcatacagcgtcggatgggagatggcccctgcaggtgcccccggcccagggcgcctcgtcgcacagctcgacaccgagggggtgggctcgctgggcccgggctatgaaggccgccatatagccatggagaaggtggcgtcacgcacgtaccggctacgcctcgaggccgcacgtcctggcgacgccggtacatacagatgtctggctaaggcttatgtcagagggagtggcacacgattacgggaagctgccagcgctcggtcccggcctcttccggttcacgtaagggaagaaggcgtggtcctggaggcagtggcttggctggcaggaggcaccgtgtacaggggggagacggcgtccctgctatgtaacatcagtgttagggggggtccacccgggctccggctggctgcatcatggtgggtcgaacgaccagaagacggcgagctgagctcggttcccgctcaactggtgggcggagtaggtcaggatggagtcgccgagttgggagttcgccctggcggcggacccgtgtccgtcgaacttgtgggtccgcggtcgcaccgcctgcgtctgcattcactgggccctgaggatgaaggcgtctatcattgtgctccgtccgcttgggtccaacacgccgactacagctggtaccaagctggaagcgcccgcagcggtcctgttacagtctacccgtatatgcatgcactagacactctgttcgtcccgctgttagtgggaacgggagtggctctggtcacgggggctactgtgctgggaactatcacctgttgtttcatgaaaaggctacggaaacggtag

SEQ ID NO: 191271 - DNA, 906 bp, Artificial Sequence
  Description of Artificial Sequence: Synthetic coding sequence
atgggcgccctgcggcccaccctgctgccccccagcctgcccctgttgctcctgttaatgctagggatgggctgctgggcaagggaagtcctggtccccgaaggtccattgtatcgtgtagctgggaccgcggtcagcatctcttgcaacgtcactggatacgagggccctgcccagcagaattttgagtggttcttataccgcccagaggcccctgataccgccttgggcatagttagcactaaggacacccagttttcatatgcagtcttcaagtctcgcgtggttgctggcgaggttcaagtgcagagattgcaaggcgatgcagtggtgctcaagattgcgcgtctccaggcccaggatgctggcatctatgaatgtcataccccttccactgacacccgatacttaggcagctacagcgggaaggtcgaattgcgggtgcttccagacgtcctgcaggtctcagctgcgccccctggtccgaggggcaggcaggctcctacctctcccccgagaatgaccgtccatgaggggcaggaactggctctgggttgcttggcaaggacaagtacgcaaaagcacacacacttagcggtttcattcggaaggagcgtgcccgaagcccctgtgggtagaagcacactacaggaggttgtgggtattcgctccgaccttgctgtagaagccggagccccatacgctgagcggcttgcagccggtgaactcagactgggaaaagagggcacagatcgatacagaatggtagtcggtggagcccaagccggtgacgctggtacataccattgcacagcagccgagtggatccaggaccctgatggaagctgggctcagattgccgagaagcgagccgtactcgcgcatgttgacgtacaaactctgtag

SEQ ID NO: 191272 - DNA, 2154 bp, Artificial Sequence
  Description of Artificial Sequence: Synthetic coding sequence
atggtgtggtgcctgggcctggccgtgctgagcctggtgatcagccagggcgctgacggccgtggcaagcccgaagtggtctcagtggtcggccgcgcaggagagtccgtggtgctgggatgcgacctcttgcctcccgcaggacgccctccactgcacgttatcgagtggctgcggtttggcttcttactaccaatatttatccagtttgggttgtactcgccacggatcgatccagattacgtgggtagggtaaggctgcagaaaggggcaagcctacagatcgaaggattgagggttgaggaccagggctggtacgaatgtagggtgttcttcctcgatcagcacattccggaagacgacttcgctaacggatcctgggttcaccttaccgtgaactctcccccacagttccaggagacgcctcccgctgtattggaggtccaggaattagaaccagtgacgctgcggtgcgtcgcgaggggaagtccactgccccacgtgacgtggaaactacgcgggaaagacttaggccagggccagggccaagttcaggtccagaacgggaccctcaggattagacgcgtagaacgcggctcgtcgggagtatacacgtgccaggcgtcctctactgaggggtcggccacccatgctacccagctgttagttctaggtccgccggtgatcgtggtacccccaaaaaattccacagtcaacgccagccaggacgtcagtctggcttgccacgctgaagcctatccagctaacttgacatatagttggtttcaagataatatcaacgtgttccacatctcccgcctccaaccccgcgttagaattctcgtcgacggtagtttgcgcttgttagccactcagccggacgacgccggctgctatacatgtgtcccttctaacgggttactccaccccccaagcgcatcggcctacctcaccgtgttgtacccagctcaggtcacagctatgccgccagaaaccccactgccgattggaatgcccggtgtgatccgctgccccgttagggccaaccctccactgctctttgtcagctggacaaaagatgggaaagccctccaactcgataagtttccaggctggagccagggcactgagggatcactgataatcgccctgggcaacgaagacgccttgggggaatactcctgtaccccttataatagcttggggactgcaggaccttcgcccgtgactagggtgctcctcaaggccccacccgccttcatcgagagacctaaagaggaatatttccaggaggtgggtcgggagctcctgattccctgcagcgcccaaggcgacccacctcccgcagcccccccttctccactccccgggcccggcccgctcctgcagtatctcagcctgccattttttagagaaatgaatgtggatggcgattggcctcctctcgaagaacccagtcctgccgccccgccagattatatggacacacggagatgcccaacgtcatctttcctcagaagccctgaaacccccccggtctcacctagggaatctctcccaggcgcagtggttggcgcaggagccacagccgagcccccatataccgcactggccgactggaccctgagggagaggttgctgcctgggctgctcccagcagcccctcgcgggtccctgacctcccagtcctccggtagggggtctgcgagcttcctccgcccaccttcaacggctccctccgccggtggctcttatctcagtccagcaccaggagatacgtcctcttgggccagcggaccagagcgatggccacggcgggagcatgtggtcacggtgagcaaaagaaggaacacaagcgtggatgaaaactatgaatgggactctgagtttccgggggatatggaactcctggaaacccttcaccttggactggccagcagtcggctgcgacctgaggctgagccagaacttggcgttaagactcctgaagaagggtgccttctcaacacagcacacgtaaccggccccgaggccaggtgcgcagccctgagggaggaattcttggcattccgacggaggcgcgacgctacccgggctcgcctaccagcttatcgacagcccgtgcctcacccggagcaagccaccctgctctag

SEQ ID NO: 191273 - DNA, 3492 bp, Artificial Sequence
  Description of Artificial Sequence: Synthetic coding sequence
atggtgtggtgcctgggcctggccgtgctgagcctggtgatcagccagggggccgacggccggggtaagccggaggtagtcagcgttgtggggcgcgcgggcgaaagtgtggtgctcggatgtgacctcctaccacctgctgggcgacctcctctgcacgtaattgaatggctgcgctttggatttcttctccctattttcattcaatttggcctgtactccccaagaattgaccccgactacgttggccgcgtccgcctgcagaaaggggcctccctgcagatcgaaggactgcgggttgaggaccagggatggtacgagtgtagagtattcttcttagaccaacatattccggaggatgattttgccaacggaagctgggtgcatctcactgtcaattcacccccccaatttcaggagactcctcctgcagtccttgaagtccaggagctagaacccgtgacactccgctgcgtggcgcggggctcacccttgccacatgtgacctggaaattgagaggcaaagatttgggccaggggcaaggacaagtgcaagtgcagaatgggacccttcggatcaggagggttgagaggggctccagcggggtatacacctgtcaggcatcatctactgagggcagcgcaacacacgcgacacaactgttggttttaggcccccccgtcatcgtggttcctcctaaaaattccaccgtcaacgccagccaggatgttagtctggcttgccacgccgaagcttatcctgccaatctcacttattcctggttccaggataatattaacgttttccatatttccaggcttcagcctcgcgtgaggatactagtcgatgggtcactcaggctgttggctactcagcctgacgatgcaggttgctacacatgcgtgcccagcaacgggctgctgcatccaccctcagcctccgcgtatttaacagttctttgcatgcccggagtgatcagatgcccggtgcgcgccaatcctccactgctcttcgtcagttggaccaaggacggaaaagccctgcagctcgacaaatttccaggttggtctcaaggaaccgagggtagcttgatcattgccttgggaaatgaagatgctttaggagagtatagctgtacgccatacaacagcctcgggacggccgggcccagccccgtaacccgcgtcttgctgaaggcccctcctgcttttattgagaggcccaaggaggagtactttcaggaagtgggtcgcgaactactgataccatgttccgcccagggtgatcccccccccgtcgtgagttggaccaaagtgggccgcggtctccagggccaagcgcaggtcgacagcaatagtagcctcattctccgccccctcactaaagaggctcacggtcattgggaatgcagcgcttccaatgctgtggctcgtgttgccacaagcaccaatgtctacgtactggggaccagccctcacgtggtgacaaacgtgtcagttgtggcacttccaaagggggcaaatgtttcttgggagcccgggtttgatggaggctacttgcagcggtttagcgtgtggtacacaccgctggcaaagaggcccgatcgtatgcatcatgactgggtttcactggccgtgccagtgggcgctgcccacctgcttgttcccggtctgcagccccacactcagtaccagttttctgtcctagcccagaacaagctcggctccggtcctttctccgaaatcgtattgtcagcgcctgagggcctgcctactacacctgccgcccctggcctgccccctacggaaatccccccccccttgagccctccccgaggcttggtggcagtccggacaccccgcggcgtgttgctgcactgggatcccccagaactcgttcctaagaggctagacggatacgtgctcgaaggccggcaagggtcccagggctgggaggtcctggatcccgccgtggctggcactgagacagaactgctcgtgcccgggctaataaaggacgtcttgtatgagttcagactagtggctttcgccggctcttttgtgagtgatccctcaaacactgcaaatgtgtccacatccggtctggaggtttacccatctcgaacccaactgccagggctgctgccgcagccagtcctagctggcgtcgttgggggagtttgcttcctcggggtcgcagtccttgtcagtatcctggccgggtgcctgctgaatcggcgccgcgccgcccgccggcggcgcaaaagacttcgacaggaccctcccctcatcttctccccaacgggcaagtccgctgccccgagtgctctcggctcagggtctcctgactccgtggccaagcttaagctgcagggctcacccgtacctagcctgagacagtccctcctctggggtgaccccgccggcaccccgtcaccgcatccagacccgccttcttcacgcggccccctgcctcttgagcccatatgtcgcggccctgacggcagattcgttatgggacctacagtggcagcaccccaggagcggtcaggcagagagcaagcggagcccagaactcccgctcaacgcctcgcccggagctttgactgtagcagctcatccccgagtggtgctccccagcctctttgtatcgaagatatatctcccgttgctccgccccccgccgcgccgccctcaccccttcccggtcccggcccgctgttgcagtacctcagcttgcccttcttccgggagatgaatgttgatggggactggcctcccttggaggaaccttctcctgccgctccgccagattacatggacacccgacggtgtcccacatcgtcttttttgcgttccccagagacccctcccgtgagtccacgggaatcgctccccggtgcagtcgtcggggcaggcgcaacggccgaacccccctataccgccctagcggactggactctgagggaacggctgttgcctgggctcctccctgctgccccgcggggctctttaacgtcccaaagctctggcagggggagtgcatccttcctgcgtccaccctctactgctccatcagcagggggttcgtatctgtcccctgctccaggcgatacctccagctgggctagcggaccagagcggtggcccaggcgcgagcacgtagtgacggtaagcaaacgaaggaacacttctgtggacgagaactatgagtgggactcagaattcccaggggacatggagttactggagacgctgcacctcggcctggccagctcacgtttgaggccagaggccgagcccgaactaggcgtgaaaacgcctgaggaagggtgcctgctcaatacagcgcacgtgacaggccccgaggccagatgtgcggctctgagagaagagtttctagcctttagacgcagaagagacgccacgcgggcgcggctgccagcatatcggcagcctgtgccacaccccgagcaagctacgctcctgtag

SEQ ID NO: 191274 - DNA, 3540 bp, Artificial Sequence
  Description of Artificial Sequence: Synthetic coding sequence
atggtgtggtgcctgggcctggccgtgctgagcctggtgatcagccaaggggccgatggccgggggaaacccgaggtagttagcgtcgtgggaagagccggagagagtgtggtcttaggctgtgacctactgccacctgccggtagaccacccctgcatgtgatcgagtggcttcgctttggcttcctgctgcctatcttcattcaattcggactctatagccctagaatcgatcctgattacgtgggcagagttagactgcagaagggcgccagtctccaaatcgagggcctgcgcgtcgaagaccagggctggtacgaatgtcgtgtcttttttctggaccagcacattcctgaggatgacttcgcgaatggcagctgggttcacctgacagtgaatagccccccacaattccaggagacacctccggccgtcctggaggttcaggagctggagcctgtcacactgcgatgcgtggcccggggaagtcctctaccccacgtgacatggaaactgcggggcaaggacttgggccaggggcagggacaggttcaggtgcagaacggcactctgcggattcggagggtggagagaggatcatcgggagtctatacctgtcaagcttcctccactgagggaagcgccactcatgcgacccagctactcgtcctaggaccacccgtaatcgtcgtccccccgaaaaactctacggtgaatgccagccaggatgtctctctcgcctgccatgccgaagcttaccccgcaaacctgacctactcatggtttcaggataacataaacgtgttccatattagtcggctacagcctcgagtgagaatccttgtggacggctccctaagactgctagccacccaacccgacgacgctgggtgctatacgtgtgtcccctccaacggcctgcttcaccctccatcggctagcgcatatttgactgtgttatatccagcccaagtgactgcaatgcctcctgagacgcctctgcccatagggatgccgggagtgattcgatgtcccgtgagagcaaatccccccctgctgtttgtctcgtggacgaaagatggcaaggctctgcagctggacaagttccctggctggagtcagggaaccgagggttctctaattattgccctggggaacgaggacgcactgggcgagtactcttgcactccatacaattccctgggaaccgccggtccaagtcctgtaactcgggtcctgctgaaagcaccacctgccttcatcgagagaccaaaggaggagtacttccaagaggtggggagagagctccttatcccatgttccgcccaaggagacccacctcctgtcgtgagctggacaaaggttggccgtggcctgcagggtcaggcgcaggtggacagcaactcaagtctaatcctgcgccccctgacaaaagaagcccatggtcattgggaatgttcagcatctaacgccgttgcccgggtcgccacatccaccaacgtgtacgtgctgggcactagtccacacgtggtgaccaacgtgtcggtagtcgccctgccaaaaggtgcgaacgtctcctgggagccgggcttcgatgggggttatctgcagcgcttctcggtatggtacacaccattagctaagagacccgataggatgcaccatgattgggtatcactggcagtccctgtaggagctgctcaccttctggtgcctggactccagccccacacacagtatcagttctcggtattggctcagaacaaactaggcagtggccctttctctgagatagtgttaagcgcgcctgaaggactccccacaacccccgctgcaccgggcctgccaccaaccgagattcctccgccgctgtccccgcctcgtggactggtcgcagtgcgcacacctcgcggagtgctcctccactgggaccctccagagttggtccccaaacggctcgacggatacgtcctggaagggaggcagggttctcaggggtgggaggttctagacccagcagtggcggggaccgaaacagagttgctggtgccaggcctcataaaagatgttttatatgaattccggctggtggcgttcgcaggtagtttcgtctccgaccccagtaatacagcaaatgtgagtacatctggtctggaggtgtacccttctcgaactcagcttccaggtctgctgccacaacctgtgctcgccggggtggtcgggggtgtgtgtttcctgggcgtggccgttttggtctcaatattagccggatgcctcctgaataggcgtcgtgctgccagacgaaggaggaaaagactgcggcaggaccctcctctgatcttcagccccacgggtaaaagtgccgctccatccgccctggggagtggctccccagactcagtagcaaagttgaaactccaaggatcccccgtgccttcactcaggcaatcactgttatggggagatcccgccggcacccctagtccgcatcccgacccgccttcctcccgcgggccactccccctggagccaatttgtcgcggtccggacgggagatttgtgatgggtccaactgtggctgcaccccaggaaagatcagggcgggaacaggcggaaccacggacccccgctcagagactggcaaggagtttcgattgttctagttcctctccctcaggagctccgcagcctttgtgcattgaggacataagcccagttgccccaccaccagccgcacctccctcacctctgcccggcccaggtcccctgctgcagtatctgagcctgccgttctttcgggagatgaatgtggatggcgattggcctccccttgaagaaccaagccccgccgcgccccccgattacatggatacacgccgatgtcctacttcatcattcctccgctcacctgaaacgccccccgtttcccctagagagtccctgcccggagccgttgtgggtgccggagctacggcagaaccaccatacacagccctggcggattggaccctacgagaacggctactccccggcttgcttccggcagctcctaggggctcgctgacctcccaaagttcagggaggggatctgcgagtttcctacgacccccctccacagccccttccgcaggtgggtcctatctttcacctgctccgggcgacaccagttcatgggcatcaggaccagaacggtggccacggcgagaacatgtagtgaccgtgtctaagcggaggaatacctccgtggatgagaattacgagtgggactccgagttcccaggggatatggagcttctggagacactgcacctaggtctcgcaagttcccgcctgcgcccagaggccgagcctgagctcggcgttaagacccctgaggagggctgtctcctgaacaccgcgcacgtgacaggcccggaggcgagatgcgctgcactccgggaggagttcttggccttcagaaggagacgcgacgctactcgcgctagactacccgcatatcggcagcccgtgcctcacccagaacaagctacacttctgtag

SEQ ID NO: 191275 - DNA, 4050 bp, Artificial Sequence
  Description of Artificial Sequence: Synthetic coding sequence
atgatctggtacgtggccaccttcatcgccagcgtgatcggcacccgaggcctcgccgcagagggagcccacgggctacgtgaagaacctgagtttgttacagccagggccggggaaagtgtggtgttgcgctgtgacgtcatccatccagtgaccgggcagcccccaccttacgtggtggagtggtttaagttcggagtgcccattccaatctttataaaattcgggtattatcctccccatgtggatcccgagtacgctggtcgagccagcttgcacgacaaagcttctctgaggcttgagcaagtacggtccgaagatcagggctggtacgaatgcaaggtattgatgctggatcagcaatacgacacttttcacaatggcagctgggtgcacttgacaataaatgctccacccacctttacagaaactccaccccaatacatcgaagccaaagagggcggttccattactatgacttgcactgctttcggaaatccgaagcctattgtgacatggctcaaggagggtactctcctgggcgcctctgggaagtatcaggtgtctgacgggagtctcaccgtgacgtcggtttctcgagaagataggggagcctatacatgtagagcatattccattcagggcgaagcagtgcacacaacgcacctcctggtccaggggcctccgttcatcgtctcgccccctgagaacatcacagttaatatctcacaggacgccctgcttacctgcagggccgaggcttacccaggaaatttgacttatacatggtactggcaggatgagaacgtgtatttccagaatgacttaaaactccgtgtgagaatactcattgatggcacattaattatctttcgtgtaaagcctgaggactccggcaagtatacatgcgtgccttccaactccttaggacggtccccttcagcctctgcatatctgacagtgcagtatcctgcccgtgtcctgaacatgccgccagtgatctatgtcccggtggggatccatggctacataaggtgtcctgtggacgccgagcccccggccacagtggtgaaatggaacaaggacgggcggccacttcaagtggagaaaaatctgggatggacactgatggaagatggctctattcgcattgaagaagccaccgaggaagctcttgggacgtacacctgtgttccttataacactctgggcacaatgggccaaagcgccccggcacggctggtcctgaaagacccgccatacttcaccgtgctgccgggctgggagtacaggcaggaggcaggtagggaacttctgatcccttgcgccgcagccggagacccattccctgtcatcacgtggcgtaaggttggaaaacccagtagatccaagcacagcgccctcccgagcggctcccttcagtttagagcactctccaaagaggaccacggagagtgggagtgtgtggcaactaatgttgtgacaagtataaccgcttccactcacctcactgtcattggaactagccctcatgccccaggctcagtacgcgtgcaggtgtcaatgaccactgcgaacgtgagttgggagcccggttatgacgggggttatgaacagacctttagcgtgtggatgaagcgagctcaattcggtccgcatgattggctcagtcttcctgtcccacctggcccctcttggctcctagtagacacactggaacctgaaacagcctaccagttttctgtcctcgcacagaacaaacttggaactagcgctttctctgaggtggtgaccgtgaacacgctggctttccctatcaccactccagagcccctcgttttggtaacaccgcctaggtgtttaatcgccaatcggacgcagcagggagtgctcctctcatggcttcctccagctaaccacagttttccgatcgatcgatacattatggaatttagggtggccgaacgatgggaactcctggacgacggcatcccaggaaccgaaggagagtttttcgcaaaggatctgtcacaagacacctggtacgaatttcgggtgcttgccgtgatgcaggatttgatttctgagccctctaacattgctggcgtgtccagcactgatatcttccctcagcctgatctgaccgaggatggtctggcccgcccagtcctggctggcatcgttgcaaccatttgtttcttggccgccgccatcttgttttcaactttggccgcatgttttgttaataagcagcgcaagcgcaagctgaagcgcaagaaagatccacctctgtcaattacacactgtcgaaaatcccttgagtctcccctgagcagcggtaaggtctcccccgaaagtataagaaccctgcgggccccttccgaaagctcagacgaccagggacagcctgcagcaaaacggatgctctcccctacccgtgagaaggagttgtctctctacaagaagaccaagagggcaattagctctaaaaaatacagtgttgccaaagctgaggccgaggcagaagctacaacaccaatcgagctgatcagccgcggcccggacgggagattcgtcatggacccagctgaaatggagccctccctgaagagccgccggatcgagggattcccattcgcagaagagaccgacatgtacccagagtttaggcagtctgacgaggagaatgaggatcctctcgtgccaacctcagtcgcggccttaaaatcccagcttacacctctgtctagcagtcaggagtcctaccttccaccccccgcgtactccccgagatttcagccacgtgggctcgaaggcccaggaggattagagggtcggctgcaagccactggacaggcacgtccgcccgcccccagacctttccatcacggacagtactacggatacctgtcgtcttctagtcccggggaagttgagccacctcctttttatgtccctgaagtaggctcacccctgtcttcagtgatgtccagtcctcctctgcccacagagggtccttttggccaccctaccatccctgaggaaaacggcgagaatgcctcaaattcaacactgccattaacgcaaactcccaccggcggcaggtcaccggaaccgtggggacgccctgagttccctttcggtggactcgaaacgcccgccatgatgttcccacatcagctgcctccctgcgatgtgcccgagagccttcagcccaaggcaggtctaccaaggggcctgcctcccacctcattgcaagtgccagccgcctatcccggcatactcagcctggaggcccccaaagggtgggccggaaagagtcccggtcggggccctgtgccagctccccctgcggcgaaatggcaggaccgaccaatgcagcctctggttagccagggccagttgcggcacacaagtcaaggaatgggtattccggtgctgccttatccagaaccagcggagccaggcgcacacggggggcccagcaccttcggcttggacactaggtggtatgagcctcagccccgaccccgaccaagtccccgtcaagccaggagggctgagccttctctccatcaggtcgtcttacaaccttcccggttgtcccctcttacacagtcaccccttagttctagaaccgggtcccctgaattggctgcgagagcccgcccacggcctggcctgttgcagcaggccgaaatgtccgaaattaccttacaaccacctgctgctgtaagtttttctcgaaaaagcaccccatccacaggcagccccagccaatcctctagaagcgggagcccctcataccggccggccatgggcttcaccacactggccacagggtaccccagtccaccacctggacctgcaccggcaggcccaggagactccttggacgtctttgggcagacgccgagcccacggaggacaggggaggaattgctgcggccggaaactccacctcccacgctgccgacctccggcaagctgcagagagacagaccggcacccgccacatctccccccgagagagctctgagcaaactctag

SEQ ID NO: 191276 - DNA, 1509 bp, Artificial Sequence
  Description of Artificial Sequence: Synthetic coding sequence
atggcctggcccaagctgcccgccccctggctgctgctgtgcacctggttaccagccggttgtctgtcactgcttgtcaccgtgcagcacacagagaggtatgtgacattgttcgcctcaatcatcctcaagtgtgattacactacatcagcccagctgcaggatgtggtagtgacttggcggtttaaaagcttttgcaaggatcctatcttcgattattactcggctagttatcaggctgcccttagtttgggtcaggatcccagcaatgactgcaatgacaatcagagggaagtcagaatcgtggcacagcgccgaggtcaaaatgagcccgtgctcggcgtcgactaccggcaacgcaagattactatccaaaatagggctgatctcgtcattaacgaggtgatgtggtgggatcatggcgtgtattactgtacaatcgaagctcctggagacacctcaggcgaccccgacaaagaggtgaaactgatcgttctgcactggcttactgtcatctttattatcctgggagccctgctgctgcttcttctcattggcgtgtgctggtgccagtgttgcccgcagtactgctgctgctacatccgttgcccgtgctgccccgctcactgttgctgtcccgaggaggacctatcactacccagctcactccctcaaatgccaatgacccagaccacgaatcagcccccgattgccaatggcgttttggagtacttggaaaaagagctaaggaacctgaatttggcgcagcctcttccacccgacctcaaaggccgctttggccacccttgttcaatgctgagcagtttggggagcgaagtggtggagaggaggattattcacctgcccccattaatccgcgatttaagctccagtaggaggacaagcgattcgcttcaccagcaatggcttacgcctatccccagtcgaccgtgggatttgagggaaggacggtcccatcatcactaccctgactttcatcaggagctgcaggatagagggccgaagtcttgggccttggaaagacgcgagctggacccttcatggtcgggaagacaccgctcttctcgactaaacggatcccccattcactggtcagacagagacagcctctcagatgtgccctcttcttcagaggctcggtggagaccgtcacaccccccgtttcgctccaggtgtcaagaacgaccacgccgccccagtcccagggagagtacccagcgacacggacgtcgcagacgccatcggtcttatagcccccctttaccaagtggtcttagctcctggagctcagaagaggataaagagaggcaaccacagtcgtggcgggctcaccgcagaggaagccacagcccacactggcctgaggagaaacccccgtcctatcgatccttggatatcactcctgggaagaacagccggaaaaagggatcggtggaacggagatccgagaaggacagctctcacagcggcagatcagtcgtgatctag

SEQ ID NO: 191277 - DNA, 1641 bp, Artificial Sequence
  Description of Artificial Sequence: Synthetic coding sequence
atggcctggcccaagctgcccgccccctggctgctgctgtgcacctggctgccagctggctgcctgtctttactggttacagtgcagcacactgagaggtatgtgactctgttcgcttctattatcctgaagtgtgactatacgaccagcgcccagctccaggacgttgttgtcacttggaggtttaaatccttctgcaaagatcccatattcgactactactctgcttcttaccaggctgcgctcagtttgggacaggacccctcaaatgattgtaacgacaaccaacgggaagtgcgaatcgtagcccagaggagaggacagaatgaacctgtgctgggcgttgactacaggcagagaaaaataacgatccagaatcgggctgaccttgtaatcaatgaagtcatgtggtgggaccacggagtttactattgtaccattgaagcccccggggacaccagcggagatccagacaaagaagtcaaactgattgtattacattggcttacagtgattttcattatactcggggccctcctcctcttactactgattggtgtgtgctggtgccagtgttgcccccagtactgttgttgctacattcggtgtccatgctgccccgctcactgctgctgccccgaggaagctctggcacggcaccgctacatgaaacaggcccaagctctgggtccacagatgatggggaaacccctatattggggagctgatcgctcaagccaggtctcctcttacccaatgcatccattgctgcagagggaccttagtctgccatcttcccttcctcagatgcctatgacacagactaccaatcagccacctattgccaatggagtgctggagtatcttgaaaaggagctcaggaacctgaacctggctcagcctctgccccccgatctgaaagggcgctttggacatccctgttctatgctaagcagtttgggaagcgaggtcgttgagaggaggatcatacatctcccgcctctgatcagagacctgagcagctcccgacgcaccagcgatagtctgcaccagcagtggttaactcctataccaagtagaccatgggatttacgcgagggacgttcccaccaccattaccctgacttccatcaagagctgcaggataggggccccaagtcttgggctctcgaacggagggagctggatcctagctggagtgggcgccatcggtctagccgtcttaatgggtccccgatccactggagcgatagagattcgctttccgacgttccctcatcctctgaagcgcggtggcgccccagccatcccccatttcggagccgctgccaggaacgaccccgaagaccgtccccaagagaatctacgcagcggcacggaaggcggcgacgtcaccggtcttactcgccacctcttccctccggactaagcagctggtcatccgaagaagacaaggaaagacaacctcaaagctggcgcgcccaccgtcggggctctcactctccccactggcccgaagagaagcccccgtcttacaggtccctggatataacacccggaaagaacagcagaaaaaagggctcagtcgagaggaggtccgaaaaagatagttcgcacagtggccgctcagtggtcatctag

SEQ ID NO: 191278 - DNA, 639 bp, Artificial Sequence
  Description of Artificial Sequence: Synthetic coding sequence
atggcctggcccaagctgcccgccccctggctgctgctgtgcacctggctgcccgcaggctgcctgtctttgctggtaaccgttcagcataccgaacgttacgttacactattcgcaagcatcatcctgaagtgcgattataccacctctgcacagcttcaagatgtggtggtgacctggagatttaagtcgttttgtaaggaccccatttttgactattatagtgccagttaccaggccgccctgtctttaggccaggatccatctaatgactgctgttgctgtcctgaagaggcattggctagacaccgttatatgaagcaagcccaggccctgggaccccagatgatgggcaagcccctttattggggcgccgaccgctcttctcaggtgtcttcatatcctatgcaccccttgctgcaacgagacctgtctctgccctcaagcctgcctcagatgcctatgacgcaaactactaaccaaccccctatagcaaacggagtcctggagtacctggaaaaagagctgaggaatctcaacttagcgcaacccttaccaccggatctgaagggacgttttggacacccctgttccatgttgtcatccctagggtccgagaatcagatcgaagagttctag

SEQ ID NO: 191279 - DNA, 1374 bp, Artificial Sequence
  Description of Artificial Sequence: Synthetic coding sequence
atggcctggcccaagctgcccgccccctggctgctgctgtgcacctggctcccggccggatgtctgtcactgctagtcaccgtgcagcacacagagcggtatgtgactctgtttgcgagtatcatcttaaagtgcgactataccacgagcgcccaactacaggatgtcgtcgtcacttggaggtttaaatccttctgtaaggatcccatattcgactactacagtgcctcataccaggcggctctctcactagggcaggaccccagcaatgactgcaacgacaaccagcgggaggtccgcatcgtagcacagcgacgcggacaaaatgaaccagtgttgggcgttgattaccgacagcgcaaaattacaatccagaaccctctcgccagacataggtacatgaagcaggctcaggccctggggcctcagatgatgggaaagcccttatattggggggccgaccggagctctcaggtgtcatcttacccaatgcatcctttgcttcagagggatctctccctgccctcttctcttccccaaatgccgatgacccagaccactaatcagcccccaatagcaaacggggtgctggaatacctggagaaagagctgcggaatttgaacttggctcaaccgcttcccccggatctgaagggtaggtttggccatccttgttccatgctctcctcattaggatctgaagtggtcgagcgcaggattattcatttgccccccctcattcgcgaccttagttccagtaggcgcacatcagattcacttcatcagcagtggctgacgcccattccaagtcgcccctgggatctgcgcgagggaagaagccaccatcactaccccgacttccaccaggagctccaggaccgaggtcccaaaagttgggccttagaacgccgtgagctggatccctcttggagcggccgccatcggtcctcccgactcaatgggtcccccattcattggtcagaccgggactctctgtcagatgtgcccagctcctctgaggccagatggcggccgtcacatcctccgttccgctccaggtgtcaggagcggcctaggagaccctctccaagagaatctacgcagcggcatggtcgcaggcgaagacacaggtcatactctcccccattaccttctggattaagtagctggtctagcgaggaggataaggaacgccagccgcagtcctggcgggcacacagacggggatctcacagtcctcactggcctgaagagaaacccccatcctacagatccctggatataacacctggaaaaaactctagaaaaaaaggaagtgtcgaaagaaggtctgagaaggattcttctcacagcggtcgaagcgtggtgatctag

SEQ ID NO: 191280 - DNA, 1545 bp, Artificial Sequence
  Description of Artificial Sequence: Synthetic coding sequence
atggccggcaacatcttctgccccttcgccctgttcttcctgcccatgtcgcgagtgggacatcttcagcactttctgcttttgctcgcactcgggtgtttgagtttgctggtgacagtgcagcatactgagaggtatgttacactgttcgccagcattatcctgaagtgtgattacaccacttcagcccaactgcaagacgttgttgtgacttggaggttcaagtctttctgcaaggatccgatcttcgactattattccgcctcatatcaggcagctctttctttaggccaggatccctccaacgactgtaacgacaaccagagggaggttaggattgtggcacagcgaaggggtcagaatgaacccgtcctgggcgtggactacaggcagagaaagatcactattcagaaccgagcagatctggttattaacgaggtgatgtggtgggatcacggagtgtactattgtacgatcgaagctcctggtgatacatctggcgaccctgacaaagaggtcaaactgattgtgctgcactggctaaccgtgattttcatcatactcggggccttgcttctgctcctgttgattggcgtttgctggtgtcagtgttgtccccagtactgctgctgttacatccggtgcccctgctgtcccgcccattgttgttgccccgaagaggacctctctctcccatccagtctgcctcaaatgccaatgacacagaccaccaatcagccaccaatcgctaatggcgtgctggagtatctcgagaaagaactgagaaatcttaatctcgcgcaaccacttccgcccgatctgaaaggccggttcggccacccatgtagtatgctgtcctcgctggggagtgaagttgtggaacgtagaattatacatcttcctccactgatcagagatcttagttcatctaggcgtacatctgactcattacatcagcagtggctgacacctattccctctcgcccatgggatctgcgtgaagggaggagccaccaccactacccagactttcaccaggaactgcaagatagaggacccaagtcttgggctctggaaaggcgcgaattggacccttcatggtcaggccggcaccgctcaagccgtctcaatggttcacccatccattggtcggatagggacagcttgtccgacgtcccatccagtagcgaggcccgctggcgaccctctcacccacctttccgttcgagatgccaggagagaccgcgaaggccctctccccgcgaatccacacagagacacggacgaaggcggagacataggtcatattcacctcccctgcccagcggactatcgagctggagctctgaagaagacaaggaacgccagccgcaatcgtggagagctcaccgtcgaggatctcactcacctcactggccagaggaaaagcctccgagttacagatcccttgacatcactcctggcaagaatagcagaaaaaaaggaagtgtcgagcgacgtagcgagaaagacagttctcattcaggcaggtcagtagtgatctag

SEQ ID NO: 191281 - DNA, 1800 bp, Artificial Sequence
  Description of Artificial Sequence: Synthetic coding sequence
atggagggccccctgacccccccccccctgcagggcggcggcgccgcagcagttccagagcctggggctaggcagcacccagggcacgagactgcggctcaacgatacagtgcccgccttttgcaggctggttacgagcctgagtccccacgcctcgatttagccacccatcctactactccgaggagtgagctgagctccgtcgtcctgctcgccggagttggggtgcagatggaccgtctgcgtcgggcatccatggccgactacttgatttcagggggcaccggatatgtccccgaagacggcctgactgcccagcaacttttcgctagtgctgacggcctcacatataatgatttcctgatccttccggggttcatcgacttcatcgcagatgaggttgatctgaccagtgcactgactcgcaaaatcactctgaaaacccccctgatttcgtcaccgatggataccgtgacggaggccgacatggccatcgctatggctcttatgggaggcatcggctttattcatcacaactgcacccctgagttccaggctaatgaagtgcgtaaggtgaagaaattcgaacaaggttttataaccgatcccgtcgtgctgagcccttcgcatactgttggtgatgtgttagaggccaagatgagacatggctttagcgggatcccaattactgaaactggtactatgggcagcaaactggtgggcatcgtcacgagcagggacattgatttcctggctgaaaaagatcataccaccctattgagtgaggttatgacaccaagaatcgagttagtggtggctccagctggggtgacgcttaaagaggctaacgagatcctgcagcgctcaaaaaaaggcaagctgcccattgtcaacgattgcgatgagctggtggcgatcatcgctcgcaccgacctcaaaaagaatcgggattatccgcttgctagcaaagacagccagaagcaattactgtgcggcgcagccgttggtactcgtgaggacgataaatacagactggacctactgacacaggccggagtagacgttatagtgttggactcctcccaggggaatagtgtgtatcaaatagcgatggtgcactacatcaaacaaaagtatccccatctgcaggtgattggcggaaacgtggtcaccgctgcccaagcaaagaatctgatcgatgcgggtgtcgacgggctcagggtcggaatggggtgcggttccatttgtatcacacaagaagtcatggcatgtggacggcctcagggaaccgctgtgtacaaggttgctgagtacgcaagacggtttggagtcccgatcatagctgacggtgggattcagactgttggacacgtagtcaaggcgctcgccctgggagcgtctactgtgatgatgggatccctgctcgcagctaccacagaagctcccggagaatacttttttagcgacggggtaaggcttaagaagtatcggggcatgggttccttggatgcgatggagaagtcatcatcgtcccagaaacgttacttctcagaaggtgacaaagtcaagatcgcgcagggcgtaagtgggagtatccaggataaagggagcattcagaaattcgtaccctacctaattgccggcatccaacatgggtgtcaggacataggagctagatccctaagtgtccttaggagcatgatgtactcgggggaactcaaatttgaaaaacgaaccatgagtgcacagattgaagggggagtgcatggcctgcactcttatgagaagagactctattag

SEQ ID NO: 191282 - DNA, 1470 bp, Artificial Sequence
  Description of Artificial Sequence: Synthetic coding sequence
atggccgactacctgatcagcggcggcaccggctacgtgcccgaggatggcctcactgcgcaacaattgttcgccagtgctgacggactaacatataacgattttctcatcttacctggcttcattgattttatagctgacgaggtggaccttacatctgcactgacccggaagatcaccctgaaaacgccactcattagctctcctatggacactgtcactgaggccgatatggcgattgccatggccaaattcgaacaggggttcattactgatccagtcgtgctctcgccttcgcacaccgtgggagatgtgttggaggctaaaatgaggcacggcttctcaggaattccaattactgagacgggaactatgggctctaaactggtcggcattgtgactagccgcgatattgattttcttgcagaaaaggaccataccacactgctgtctgaggtgatgaccccaaggatcgagcttgtagtggcccctgccggagtgacactgaaagaggccaacgagatccttcagcgctctaaaaagggcaaattaccaatcgtgaacgactgcgacgagctggtcgctataatagcaagaacggatcttaaaaaaaatagggattaccctcttgcgtcgaaggatagccagaaacagttgctgtgtggggccgccgttggcaccagagaggacgacaaataccgccttgacctgctaacacaggcgggcgtcgatgtgatagtcttagacagctcccagggtaactcagtctatcagatcgccatggtgcactacatcaagcaaaagtatccacatttacaagtgataggaggtaacgtggtgacagcagctcaggcgaaaaatttgatagatgctggagtagacggtctgcgcgttggaatggggtgtggtagtatttgtattacgcaggaggtcatggcatgcggccgtcctcagggtaccgcagtttataaggttgcggagtatgctagacgtttcggggtgcctatcatcgccgacggagggattcagaccgtcggccacgtagtcaaagccctcgcccttggagcatccactgtcatgatggggtcactcctcgcggcaacaacagaagctcctggagaatacttcttcagcgatggagtgcggttgaaaaagtacagaggcatggggagcctggacgccatggaaaaaagcagctcaagccagaaacgctatttcagcgagggagacaaggtgaagatcgcccagggcgtgtccggatcgattcaggacaagggctccatccaaaagttcgtcccttacttgatcgcaggcattcaacacgggtgccaggacataggcgcacgcagcctgtcagtgttgcgctctatgatgtatagcggagaactgaagttcgagaaaaggacgatgtcagcccagatcgagggcggcgtgcatggtcttcacagctatgaaaagagactctactag

SEQ ID NO: 191283 - DNA, 1692 bp, Artificial Sequence
  Description of Artificial Sequence: Synthetic coding sequence
atggagggccccctgacccccccccccctgcagggcggcggcgccgcagctgtgccagagcctggagctcgacaacaccctggccatgagaccgcagcccaaagatacagcgccagattgctgcaggcaggctatgaacccgaatcaatggccgactatctgatttccggaggaacaggttacgttccggaagacgggcttaccgcccagcagctgttcgcaagtgcagacggtctgacatataacgattttctcattctccctggctttatcgatttcattgccgatgaggtagacctcactagtgcattaacacgcaagatcacactcaaaacccccttgatctcatccccaatggacacagtcacagaggccgacatggccattgctatggctcttatgggaggaatcggtttcatccatcacaactgcaccccagagtttcaggcaaatgaggtccgtaaagtgaaaaaattcgagcagggcttcatcaccgatcctgtggtgctgagcccgtcccacacagtgggagatgtgctggaggccaaaatgagacatggcttctcagggatccctataacggagacaggcaccatgggttctaaactggttggaatagtgacttctagggacatcgatttccttgcagaaaaggatcatacgacacttttgtcggaagtgatgacgccccggatagagctagtcgttgctccagccggagtcactcttaaggaggcaaacgagatactgcagcgaagtaagaagggtaaactccctattgttaatgattgcgacgaattagtggcgattatcgcccgcaccgatttgaagaaaaacagagattaccccctggcgtctaaggattcccagaaacagcttctgtgtggggctgccgtgggaacaagagaagacgataaatatcggttggacttgctgactcaagccggagtcgatgtcatcgtgttggactctagtcaggggaattcagtataccagattgcaatggtccactatattaaacagaagtaccctcatcttcaggtgatcgggggcaacgtcgtgaccgcagcacaggctaaaaacttaatcgacgctggagtcgatggtctgagggtcggcatgggatgcggctctatctgcattacccaggaggtgatggcgtgcgggagaccccagggcactgcagtgtacaaagtcgccgagtatgcaagaaggttcggggttcctataatagctgatggaggcatccagaccgtgggccacgtggtcaaagcgttggcgctgggggcttctacagttatgatgggctcactcctggccgccaccacagaggcacctggcgaatacttcttctccgatggtgtgcgacttaagaagtatcgcggcatgggcagcctggatgcaatggaaaaaagcagctcaagccagaaacgctacttctcggagggcgacaaggtgaagatcgcacaaggagtcagtggctcgattcaggataaagggtccattcagaaattcgtgccttatctgatcgctggcatccagcacggctgtcaggatatcggggcccggagcctgagtgttctgagaagcatgatgtacagcggagaattgaaatttgagaaacgtacaatgagcgctcagattgaaggcggcgtgcacggactgcacagctatgagaagaggctctattag

SEQ ID NO: 191284 - DNA, 1770 bp, Artificial Sequence
  Description of Artificial Sequence: Synthetic coding sequence
atggagggccccctgacccccccccccctgcagggcggcggcgccgcggccgtgcctgagccaggcgcccgtcagcatcctggacatgagacagcggctcagaggtatagtgcccgtctgctgcaggcggggtacgagcctgagtcttgctttttgctagaactatcctcagttgtcttacttgcaggagtaggagttcagatggacaggctgcgacgggcatcaatggccgattatctaatttcgggagggacaggatacgtacccgaggacggcttaacagcacagcagctgtttgcgagtgctgacggattgacatataacgacttcctcatcctgcctggtttcatcgactttattgctgatgaggtggacttgacctcagcattaacacgcaagatcaccctcaagaccccccttatttcctcacccatggacactgtcactgaggccgacatggctattgcaatggctctcatgggcggaatcgggttcatccatcacaactgcacgcccgagttccaggctaatgaggttagaaaggtgaagaagtttgagcagggcttcattacggaccccgttgtcctctctccatcccacaccgtcggagatgttttggaagctaaaatgcgccatgggttttccggcattcccattacagagacaggtactatgggctctaaactggtggggatcgtcacaagtcgggatattgatttcctcgccgagaaggatcacacaactctgctatctgaggtgatgacacccaggattgagctggttgtggcacctgcaggggtcaccctgaaggaggctaatgagattctccaaagatcaaaaaagggaaagcttcccatcgtgaacgattgcgacgaactcgtagcaataatcgcacggacagatcttaaaaaaaaccgcgactatccgctggcctccaaagactctcagaagcagctgttgtgcggcgcggcagttggcacccgcgaagatgacaagtaccggcttgatctcctgacccaagctggggtggacgtgattgtgttagattcctctcagggaaatagcgtttaccagatcgccatggtacactatataaaacaaaaatatccacacctccaggtgattggaggcaatgtggtcaccgccgcccaggctaaaaacctgatcgacgctggagtcgatggcttgcgagtagggatggggtgtgggtctatatgcatcactcaggaggtaatggcctgcgggaggccacaaggaaccgccgtatacaaggttgctgaatacgcaaggcgcttcggggtgcctattatcgcggatggtggcattcagacggtgggacacgtggtgaaagctctcgcgctgggggccagcactgtgatgatgggatccctgctggcagcgaccaccgaagcacccggcgagtatttcttctctgatggagtcagattgaagaagtaccgtggcatgggatccctggatgccatggaaaagagttcgagttctcagaaacggtactttagcgagggtgataaggtgaaaatcgctcagggggtgtctggatccatccaggataagggttccattcagaagttcgttccttatctgattgctggtatccagcatggatgtcaggacattggcgccaggtccctaagcgtgctgcgtagtatgatgtactcaggtgagctaaagttcgagaagaggaccatgtctgcccagattgaggggggtgttcatgggctgcactcatacgagaaacgactctactag

SEQ ID NO: 191285 - DNA, 1593 bp, Artificial Sequence
  Description of Artificial Sequence: Synthetic coding sequence
atggagggccccctgacccccccccccctgcagggcggcggcgccgccgctgttcctgagcccggcgcccggcagcacccgggccatgaaacagcagctcagaggtattccgcacggctgttgcaggctgggtatgagcctgaatccgattttcttattttgccggggttcattgattttatcgctgacgaagtggacctgacgtctgcgctgactaggaagataactctcaagactcccctcattagcagtcccatggatacagttacagaagctgacatggctatcgccatggccctgatgggtggcattggctttatccaccacaattgtacaccagaattccaggccaatgaggtccgaaaggtcaagaagttcgaacagggcttcattaccgacccggttgttctaagcccatctcacacggtgggggacgtcctggaagctaaaatgcgccacggattctctgggataccaattactgagaccgggacaatgggaagcaaactcgttgggatcgtgacttctcgggatatcgattttctggctgaaaaggaccatacgaccctcctcagtgaggtgatgacgccacggattgagttggtggtggccccagccggtgtgaccttgaaggaggccaacgagattctgcagagaagtaaaaaagggaaactccccatcgtcaacgattgcgatgagctggtggcgatcattgccagaacagacttaaagaagaatcgcgactatcctcttgcctccaaggacagccaaaaacagttactctgcggcgcggccgtaggaacacgcgaggatgacaaatatcgcctggacttgttgacacaggccggcgtggacgtcatagtcctcgactcctcccagggcaactccgtgtatcagattgccatggtgcactatatcaaacagaagtatccacacctgcaggtgatcggcggcaatgtggtgactgcggcccaagccaagaatcttatcgacgctggagtggatggcttaagagtgggcatgggttgcggttcgatctgtataacacaagaagtgatggcatgcggccggccccagggcaccgccgtgtacaaagttgctgaatatgcaaggaggttcggcgtaccaatcattgccgacggtggcattcagacagtggggcatgtagttaaagcgctggcattaggagctagcaccgttatgatggggtctttgttagcagccactaccgaagctccgggggaatattttttttctgacggagtgaggttgaagaaatataggggcatgggaagcttggatgccatggagaaatctagctcctcccaaaaacggtacttttctgagggtgacaaagtcaagatcgcccagggggtatctggatcaatccaagataaagggagtatccagaaattcgtgccataccttatcgccggaattcagcatggctgtcaggacattggagctagaagcttgagtgtgcttaggtctatgatgtactcaggcgaattgaaatttgaaaaacggacgatgagtgcccaaatagaaggtggcgttcatggcctgcattcttacgagaaacgcttgtactag

SEQ ID NO: 191286 - DNA, 1701 bp, Artificial Sequence
  Description of Artificial Sequence: Synthetic coding sequence
atggagggccccctgacccccccccccctgcagggcggcggcgccgctgcagtccccgagccgggcgcccggcagcacccaggccacgaaactgctgcacaaaggtactccgctcgtttattacaggcaggttacgaacctgagtctcccagactagatctggccacccatcctactactcccagatccgagctgagctccgtagtgctgctcgcgggcgttggtgtgcagatggaccgccttcgcagggcctccgattttctgatacttcccggctttatagactttatcgccgatgaagtcgaccttacctccgctctcacaaggaagataaccctgaaaacgcccctcattagcagccccatggacacagtgaccgaggctgatatggccatcgcaatggccctcatggggggcattgggtttattcaccacaattgcactcccgagttccaggcaaatgaagtccggaaggtgaaaaagttcgaacagggatttataacggatcctgtggtgctttccccatcccacacggtgggagacgtgctcgaagcaaagatgcgccacggtttttccgggattcccatcactgagacagggacgatgggctctaagttggtggggattgtgacgagtcgtgatattgacttcctggcagaaaaagatcatacaaccctgctcagcgaggtgatgactccgaggatcgagctggtagtagcccccgccggagtgacattaaaggaagccaacgagattctgcagagaagcaagaagggcaagctaccaattgtcaatgactgcgacgaactagttgccattatagctcgtactgacttgaagaagaaccgggactatcctctggcctccaaggactcgcagaagcagctactgtgcggggcagccgttggtacccgagaggacgataaatatcggctggatcttttgacacaggctggcgtggacgttatcgtgttggatagctcgcagggtaactctgtgtaccagatcgctatggtgcactacatcaagcagaagtaccctcacctacaggttatcgggggaaatgtagtgacagccgctcaggcaaaaaatctcatcgatgcgggcgtggatgggctgcgagtcggcatgggctgtggttctatctgtattacacaggaggtaatggcttgtggacggccacagggaactgctgtctataaagtcgcagagtacgctcgccgatttggggttcctattattgctgacggcggcatccagaccgtcggtcacgtggtgaaagccttggccctcggagcatccaccgtgatgatggggtctcttctagccgccaccacagaggctccgggcgagtacttcttcagcgatggagtcagattaaagaaatatagagggatgggatccctggacgctatggagaagtcttctagcagtcagaaaagatacttcagcgagggtgacaaggtgaagatagcccaaggcgtgtctgggtctattcaggataagggcagcatacaaaaatttgtgccttacttgatcgctggtattcagcacgggtgccaggacatcggcgcccggagtctgagcgtcttgaggtctatgatgtattcaggtgagttaaagtttgagaagcgtacaatgagcgcacaaatcgagggaggtgtgcatggactgcacagctacgaaaaaagactgtattag

SEQ ID NO: 191287 - DNA, 1530 bp, Artificial Sequence
  Description of Artificial Sequence: Synthetic coding sequence
atggccgactacctgatcagcggcggcaccggctacgtgcccgaggacggcctcacggcgcagcagctgttcgccagcgccgatgggcttacatataatgacttcctgattctccctgggtttattgatttcatcgcagacgaggttgacctgacttccgcactgactcggaagataacactcaagacacctcttattagcagtccaatggacactgtgaccgaagctgacatggccattgcaatggcactgatgggtggcatcggcttcatccaccataactgcacgcctgaattccaagcgaatgaaaaatttgagcagggattcatcacagatcccgtggtgctctcccccagtcatactgtgggtgacgtgctggaagctaagatgcgtcacggcttctctggaattccaattactgagacaggcaccatgggctccaaactcgtcggtatcgttacatccagggatattgacttcctcgccgagaaagatcacacgacgttgttgtcggaagtgatgacgcctaggattgagcttgttgttgctcctgctggggtgacccttaaggaagctaacgaaatcctgcagaggtcaaaaaaggggaaattgcccatcgttaatgactgtgacgaactcgtagccatcattgcgcgtactgatctgaaaaagaatagagactatccactggcttccaaggacagccaaaagcagctgctctgtggtgcagcagttggcacaagagaagatgacaagtacaggttagatctgctcacacaagccggagttgatgtgatcgtgctcgattcgagccagggaaacagcgtctaccagattgccatggtgcattatatcaaacaaaagtacccccatttgcaggtgatcggcggcaatgttgtgaccgctgcccaggccaaaaacctcatcgacgccggggtggatggcctgcgagtgggtatgggctgcggcagcatctgcatcacacaagaggtgatggcctgtggccgtccacaaggcacggcagtatataaggttgctgaatatgcacggcgctttggagttccgatcatcgcagacggcgggatccagaccgtcggacatgtggtgaaggcgctggccttaggagcttctacggtcatgatggggtcccttttggcagcaacaaccgaggcccccggcgagtacttcttcagcgatggggtaaggttgaaaaagtacagggggatgggctccctagacgctatggagaagagtagtagctcacaaaagcggtattttagcgagggtgacaaagttaagatcgctcagggtgtgtccggttcaatacaggataagggctctatccagaaatttgttccatacctcatagcggggattcagcacggctgccaggacatcggagccagatcgctgtccgtcctaagaagtatgatgtactctggagaactaaagttcgagaaaagaactatgtccgcacagattgaaggcggggtgcacgggctgcactcttatgaaaaacgtctgtactag

SEQ ID NO: 191288 - DNA, 1470 bp, Artificial Sequence
  Description of Artificial Sequence: Synthetic coding sequence
atggccgactacctgatcagcggcggcaccggctacgtgcccgaggatgggctcacggctcaacagctctttgcatcagccgatggactcacttataacgatttcctgattttgccaggctttattgacttcatcgctgatgaggtggacctgacctctgccctgacaagaaagatcacacttaaaacccctctcatctcttctccaatggacaccgtcacagaagcagatatggccattgccatggcaaaattcgaacaggggttcattacagaccccgtggttcttagcccctcccacacagttggggatgtccttgaagccaagatgcggcatggatttagcgggattcccataactgaaacaggaacaatgggctctaagctggtgggcatcgttaccagcagggatattgactttcttgccgagaaagatcacaccacactactgtccgaggtgatgacaccccggattgaactcgtggtggcgccggccggggtgactctcaaggaagctaacgagatcctccaacgctcaaagaaagggaagctccccatcgttaatgactgcgatgagctcgtggccatcatcgctagaaccgatttgaagaaaaatagggattatcctctagcctcaaaggattctcagaagcagttactgtgtggcgccgcggtggggacacgggaggacgacaagtacaggctggatctgcttactcaagccggcgtggacgtgatagtcctcgactcctctcagggaaattcagtctatcagattgccatggtccactatataaaacaaaagtacccgcatctccaggttattggagggaacgttgtgactgcagctcaggctaaaaacctcatagacgctggcgtagatggactgcgggtcggcatggggtgcgggtccatatgtattacccaggaagtcatggcttgcggacgcccccaggggaccgctgtctataaagttgctgagtatgccagaaggttcggcgtgccaatcattgctgacggcgggatccagacagtggggcatgtcgtgaaagccctggctctgggtgcatccacggtaatgatgggatcactccttgcagctaccaccgaggcgcctggagagtatttcttttccgatggagtacgcctgaagaaataccgggggatgggcagcctagacgccatggagaaaagttcttcttcccaaaagcggtacttcagcgagggcgacaaagtcaagattgctcagggcgtgagtggaagcattcaagataaggggtctatacagaagttcgtcccatatctgatcgccgggattcagcatggatgccaagacatcggcgctcggagcctctcagtgctgaggtccatgatgtatagtggagagttgaagttcgagaagcggacgatgagtgctcagattgaggggggagtccacggactacattcctacgagaaacgcctgtactag

SEQ ID NO: 191289 - DNA, 1545 bp, Artificial Sequence
  Description of Artificial Sequence: Synthetic coding sequence
atggccgactacctgatcagcggcggcaccagctacgtgcccgacgacggcttaacagcccagcagctgttcaactgtggcgatggactgacctacaatgacttcttgattctgccggggtatatcgactttactgctgaccaggtggatctgacatctgcattgacgaagaagatcactctaaaaacacctctcgtcagctcaccaatggacacggtgactgaagctggcatggctattgcgatggctcttacgggggggattggattcattcatcacaactgtacaccagagtttcaggcgaacgaagtaagaaaagtgaagaaatatgagcagggctttattaccgatccagttgtactttctccaaaggatcgggtgagggatgtatttgaggccaaagcgagacacggattttgcggcatccccattaccgacaccggtcgtatggggagccgcttggtgggcattatctcaagcagggatattgattttctgaaagaagaggaacacgactgcttcctcgaggaaatcatgacaaagcgcgaggatctggtagtggcgcccgccgggattacgctcaaggaggcaaacgaaatcctgcagaggtccaagaagggaaaactacccatagtgaacgaggatgatgagcttgtagctatcattgccagaacagatcttaagaaaaatcgcgattatcctctggctagcaaagatgcgaaaaagcagctgctgtgcggcgccgccatcggcacgcacgaagacgacaaatatcgattagacctcctggcccaggctggggtggatgttgtcgtcctagactcaagccagggcaattccattttccagattaacatgatcaaatatattaaggataagtaccccaaccttcaggtaattgggggaaatgttgtcaccgccgcccaagctaagaatttgatagatgccggtgtggatgccctccgagttggcatgggatccgggagtatttgtattactcaggaggtgcttgcatgcgggcgccctcaagccacagccgtgtataaggtctcagaatacgctagaaggtttggagttcccgtgattgcagacggcggtattcagaacgtgggacacatcgcgaaggccctagctctgggggctagcacagtgatgatgggatcattgttggctgccaccacagaggcacctggcgagtatttcttttctgacggcattcggctcaagaaatatcggggcatgggaagtctggacgctatggacaaacatctgagtagccagaaccgctatttctctgaagccgacaaaatcaaggttgctcagggtgtttccggggcagtacaggacaagggaagtattcataagttcgtgccttatctgattgcagggatccagcacagctgtcaggatatcggagctaagagcctcacacaggtgagagccatgatgtatagcggggagctcaagtttgaaaagagaactagctctgcccaggtggaaggcggagtccattcgctgcatagctacgagaagcggctcttttag

SEQ ID NO: 191290 - DNA, 1074 bp, Artificial Sequence
  Description of Artificial Sequence: Synthetic coding sequence
atggccgactacctgatcagcggcggcaccagctacgtgcccgacgacggcctgaccgcccagcagctgttcaactgcggcgacggactcacctacaatgattttctgatcctgccaggatatattgactttaccgccgatcaggttgacctcacgtctgctctgaccaaaaaaattacgttaaagacccctctggtttcctcgcctatggatacagtaactgaagcagggatggccattgccatggcccttaccggcggcatagggttcatccaccacaactgcacacccgagttccaggccaatgaagtcaggaaggtaaagaaatacgaacaggggttcatcacagatcccgttgtgctcagccccaaggacagagtacgggacgtatttgaagcgaaagcgcggcatggattctgcggcattcccatcactgacacaggtcgaatggggtctagactggtcggtattataagcagtcgcgatatcgattttctcaaagaggaggaacacgattgcttcctcgaagaaatcatgaccaaacgagaggacctggtggtcgcacccgcaggcatcacgctgaaggaagcaaacgagattttgcagcgctccaaaaaggggaaactccccattgtgaatgaggatgacgagctggtggccatcatcgcacgtactgatttgaagaaaaacagagattatcctctggcgtcaaaagacgcgaagaaacagctgctgtgtggtgccgccatcggcacacatgaggacgacaagtaccggttggacctgctcgcacaagcaggagtagacgtcgtggtgctggacagctcacagggtaactctatatttcagatcaacatgattaagtatataaaggacaaatacccaaatctccaggtcattggaggcaatgtcgtgactgctgcccaagcaaaaaacttgatcgacgcgggcgtggatgctctccgtgttggaatgggatctggctctatttgcattacccaggaggtcctggcgtgtgggaggccacaagccaccgctgtttgtacccagaagcagcaccctcacttccagtag

SEQ ID NO: 191291 - DNA, 501 bp, Artificial Sequence
  Description of Artificial Sequence: Synthetic coding sequence
atgctgcggggcgtgctgggcaagaccttccggctggtgggctacacaatccagtatgggtgcatagctcactgtgctttcgagtacgttggcggggtcgtgatgtgcagtggtcctagtatggagccaactatacagaattcggatatcgtatttgctgagaacttatctagacacttttatgggattcaaagaggcgacatcgttattgccaaaagccctagtgatccaaaaagtaacatttgtaagagggtcataggactggagggagacaagattttgacaacctctccttccgacttttttaagtctcacagctacgtgcctatggggcacgtgtggctggagggcgataacctgcagaatagcaccgactcccgatgttacggtccgattccgtacggtctgatcagagggcggattttttttaagatatggccactgagcgactttgggtttctgcgggcctctcctaacggacacagattttccgatgactag

SEQ ID NO: 191292 - DNA, 324 bp, Artificial Sequence
  Description of Artificial Sequence: Synthetic coding sequence
atgctgcggggcgtgctgggcaagaccttccggctggtgggctacactatccagtacggctgcattgcccattgtgcttttgaatatgtgggcggggtagtgatgtgcagtggccctagtatggagcctaccatacagaatagcgatatagtgtttgccgaaaatctgagccgccatttctacgggattcagaggggcgatattgtgatcgccaaatccccttccgaccctaaatccaatatatgtaaaagagtgataggtctcgaaggagacaaaattcttactacgtctccttcggatttctttaaaagccatagttattag

SEQ ID NO: 191293 - DNA, 291 bp, Artificial Sequence
  Description of Artificial Sequence: Synthetic coding sequence
atgctgcggggcgtgctgggcaagaccttccggctggtgggctacaccatccaatacggctgcattgcgcattgcgccttcgagtatgttggcggggtcgttatgtgcagcggaccgagtatggaacccacgatccagaactccgatatcgtgttcgcagagaatctcagccgacatttctacgggatccaacgcggggacattgtcattgctaagagcccgtccgatccaaagtcgaatatctgcaagcgcgttatcggtctggagggcgataagatactaacgacgtag

SEQ ID NO: 191294 - DNA, 501 bp, Artificial Sequence
  Description of Artificial Sequence: Synthetic coding sequence
atgctgcggggcgtgctgggcaagaccttccggctggtgggctacacaattcagtacggatgcatcgcccattgcgccttcgagtacgtaggaggagtggttatgtgttcgggaccctctatggaacctacgatccagaacagtgacatcgtattcgccgaaaatctgagtcgacatttttacggcatacagaggggcgatatagtcattgcgaaaagtccatccgaccctaaaagtaatatctgcaaacgcgtgattggtctggaaggcgataaaattctcaccacttcgccatcggactttttcaagagccacagttacgtccctatggggcacgtttggctggaaggagacaatctccaaaacagcacagactccaggtgctacggcccaatcccatacggcctgatccggggcagaatattcttcaagatctggcctcttagcgatttcgggttcttacgggcctcaccaaacggtcataggttttctgacgactag

SEQ ID NO: 191295 - DNA, 528 bp, Artificial Sequence
  Description of Artificial Sequence: Synthetic coding sequence
atggcccagagccagggctgggtgaagcggtacatcaaggccttctgtaagggcttcttcgttgccgtccctgtcgcagtcacttttctggatagggtcgcttgcgttgccagggtggagggggcatcaatgcagccttccctgaaccccggaggaagccagagcagcgacgtcgtcctcctcaatcattggaaagtacgtaacttcgaagtgcaccggggagacatcgtgtcactggtctcgccaaagaaccctgagcaaaagatcataaaaagagtcatcgccctcgaaggggacatcgtccgtacgattggtcataagaatcgatatgtgaaagtcccgagggggcacatctgggtggagggtgatcaccatggacatagttttgacagcaactcatttggccccgtgtctcttggcctgctgcacgcgcatgccacacatattctctggccccctgagcgctggcagaagctggaatctgttcttccgcccgaaaggctgcctgtccagcgggaagaggaatag

SEQ ID NO: 191296 - DNA, 528 bp, Artificial Sequence
  Description of Artificial Sequence: Synthetic coding sequence
atggcccagagccagggctgggtgaagcggtacatcaaggccttctgcaagggcttcttcgttgccgtgccagttgcagtcacatttttggacagagtagcgtgtgtggcccgcgttgaaggggcgtcaatgcaacctagcctcaatcccggcggaagtcagagtagtgatgttgtgctgctcaaccactggaaggttagaaattttgaggtgcaccgaggagatatagtaagcctggtgtctccaaagaacccggagcagaaaatcattaagcgggtcatcgcactggagggtgatatagtgagaaccataggccacaagaataggtacgtgaaggttccccgaggccatatttgggtagagggtgaccaccacgggcatagcttcgatagcaattcgtttggccccgtgtccctggggctgctgcacgctcacgccactcacattctatggccgcccgaaagatggcagaaactggagagtgttcttccccctgagaggctccctgtgcaaagagaagaagaatag

SEQ ID NO: 191297 - DNA, 528 bp, Artificial Sequence
  Description of Artificial Sequence: Synthetic coding sequence
atggcccagagccagggctgggtgaagcggtacatcaaggccttctgcaaggggtttttcgttgcagtacccgtagcagtgacgttcctagatagagtggcctgcgttgcccgggtggagggagcgtccatgcagccgagcctcaacccgggtggctctcagagctccgatgtggttcttttgaatcattggaaagtgcgtaacttcgaagtccatcgcggggatatcgtgtctctggtctcacccaaaaacccagaacagaaaattattaagagagttatagccctggaaggcgatattgttcgaaccatcggtcataaaaatcgttatgtaaaggtacccaggggccatatttgggtggaaggagatcaccatggccacagtttcgattctaattcgttcggaccagtgagcttgggactgttgcacgcccacgctacccatatcctctggcctcccgaaagatggcagaaattggaatccgtgctgccaccagaaagacttccagttcagagagaggaggagtag

SEQ ID NO: 191298 - DNA, 333 bp, Artificial Sequence
  Description of Artificial Sequence: Synthetic coding sequence
atggcccagagccagggctgggtgaagcggtacatcaaggccttctgcaagggcttttttgtggcagtccctgtggccgttacttttctggaccgcgttgcctgcgtggcccgggtggaaggtgcctcaatgcaaccaagcctgaaccccggtggcagccagagcagcgatgtggtgctcttgaaccattggaaggtccgaaattttgaggtgcaccggggagacattgtgtccttagtatctcccaagaacccagaacagaagataatcaaacgggtgatcgctctggaaggagacattgtgagggatggcaggaagctgaaaagaatctag

SEQ ID NO: 191299 - DNA, 240 bp, Artificial Sequence
  Description of Artificial Sequence: Synthetic coding sequence
atggcccagagccagggctgggtgaagcggtacatcaaggccttctgcaagggcttcttcgtggcagtcccagtggcagtgaccttcctcgacagagtcgcctgcgtggctcgggtggaaggagcctctatgcaaccctcactcaatcccgggggcagccagagctcagatgttgtcttgctcaaccactggaaggtgagaaattttgaagtccatcgaggtgacattgtcagcctttag

SEQ ID NO: 191300 - DNA, 528 bp, Artificial Sequence
  Description of Artificial Sequence: Synthetic coding sequence
atggcccagagccagggctgggtgaagcggtacatcaaggccttctgcaaaggcttttttgtagctgtaccggttgccgtcacttttttggatagggtggcctgcgtggctagggtcgagggtgcttcaatgcagcctagccttaatcccggcggctcacagagcagcgatgtcgtccttcttaatcactggaaggttcgaaatttcgaagttcatcgcggcgacattgtatctctggttagtcccaagaatccagagcagaagattatcaagagagtaatcgccctcgagggggatattgtgcggaccatcggccacaagaacagatacgtgaaagtgccaagaggtcatatttgggtggagggggatcaccacggccacagtttcgattcaaacagctttgggccagtcagtttagggctgctgcacgctcatgcaacacatatattgtggcctccagaacggtggcagaaactcgaatcagtcctgccacccgaacgactgcctgtgcagcgtgaagaagaatag

SEQ ID NO: 191301 - DNA, 555 bp, Artificial Sequence
  Description of Artificial Sequence: Synthetic coding sequence
atggtgcggaagctgaagttccacgagcagaagctgctgaagcaggtggactttctgaactgggaggtgacagatcataatcttcacgaactgcgtgtgctcaggcgatacagactgcagagaagagaagactacacccgatacaatcagctgagtcgggctgtccgtgaactcgctcgtcgactgcgtgacttacctgaaagggaccagttccgagtgagagcatctgcagcactgttggacaagctttatgcgctgggccttgttcctacgcgaggctccttagaactttgcgacttcgtgactgcaagctccttttgccgtcgccgcctccccacagtgctgctgaaactgagaatggcccaacacctgcaggcagctgtcgcctttgttgagcagggccacgtcagagtgggccccgatgtggttaccgatcccgcattcctggtcactcggtccatggaggactttgtgacttgggttgattcgtccaaaattaagcggcatgttttagaatataatgaggaacgggacgacttcgatctggaggcctag

SEQ ID NO: 191302 - DNA, 555 bp, Artificial Sequence
  Description of Artificial Sequence: Synthetic coding sequence
atggtgcggaagctgaagttccacgagcagaagctgctgaagcaggtagactttctgaactgggaagtaactgaccataatctacatgagctgcgagtcttgcggcggtaccggttgcagcggcgggaggactatacaaggtataaccagctgtctcgagctgtccgcgaactggccaggaggctgcgcgacttgcccgaacgggaccaatttcgagtgcgcgcctccgcggctctcctcgacaaattgtacgccttgggattggtccctaccaggggctctctggagctttgtgacttcgtgacagcatctagtttttgtcggcgcagacttccaaccgttcttttgaagctcaggatggcacaacacctgcaggcagcagtggcctttgtggaacagggacatgtgcgggtgggaccggatgtcgtgaccgaccccgcttttctggtgaccagatcaatggaagacttcgtgacatgggtggactcctcaaagataaagcgccacgtgctagaatacaatgaagagcgcgatgattttgaccttgaggcctag

SEQ ID NO: 191303 - DNA, 96 bp, Artificial Sequence
  Description of Artificial Sequence: Synthetic coding sequence
atggaggacttcgtgacctgggtggacagcagcaagatcaagcggcacgtcttagagtataacgaagaacgcgacgattttgacctggaagcctag

SEQ ID NO: 191304 - DNA, 876 bp, Artificial Sequence
  Description of Artificial Sequence: Synthetic coding sequence
atgctgcggcgggaggcccggctgcggcgggagtacctgtaccggaaagctcgtgaggaggcccagcggagtgctcaagagcggaaggaaaggcttcggcgtgccctggaagagaaccgcttgataccaaccgagctccgtagggaagccctggctctgcagggcagtctagagtttgacgatgccggcggtgaaggcgtaacttcacatgtggatgacgaataccgctgggcgggagtggaggaccccaaggtgatgataactacatcgcgggatcccagttcccgtttaaagatgttcgcgaaagaattgaagctcgtgttcccaggtgcacagcgaatgaaccgcggcagacacgaggtaggtgctctggtgagagcctgcaaggccaacggggtgacagacctactggtagtccacgaacacaggggtacccctgtaggactaattgtctcccacctcccatttgggcccactgcttatttcactctctgcaatgtagtgatgcgtcacgatatcccagatctgggaaccatgtcagaggcaaaacctcatctcatcacacacgggttcagctcccgcctaggaaagcgagtgagcgatattctccgctacttgttccccgtccctaaagacgactcccatagggtaatcactttcgctaatcaggatgattatatttccttcagacatcacgtgtataagaagacagaccacagaaacgtggagctaaccgaggtgggtcccagattcgaactgaagctctatatgattcggttaggtacactggagcaggaggccactgccgacgtggaatggcgctggcacccttacaccaatacagcaaggaaacgagtgttcctgtccacggagtag

SEQ ID NO: 191305 - DNA, 2928 bp, Artificial Sequence
  Description of Artificial Sequence: Synthetic coding sequence
atggacctgaacagcgccagcaccgtggtgctgcaggtgctgacccaagcaactagccaggacacagctgtcctcaagcccgccgaggagcagcttaagcagtgggaaacccaacctgggttctatagcgtactgttgaatatcttcactaatcacacattagatattaacgtgagatggctggcagtgctatattttaagcatggtattgatagatattggcgacgggtggcccctcatgctttgtcggaggaggaaaaaaccaccctgcgggccggcctgatcaccaacttcaacgaacctatcaatcagatagcaacacagatcgccgtattgatcgctaaagtcgccagactggattgtccgaggcaatggccagaactaatccctaccctgatagagtctgtcaaagtccaggacgatcttcgccaacatagggccctgttgacattctaccacgtgacaaagaccctggccagtaagaggctggcagccgacaggaagcttttttatgatcttgcatcagggatttacaattttgcgtgttcattgtggaaccatcatactgatacttttctgcaggaagtaagctcaggtaatgaagccgcaatattatcttcgctcgagcgcacgctcctgagcctgaaggtcctgcggaaactgacagtcaatggcttcgtggagccccataagaatatggaggtgatgggctttctgcacggaatttttgagcgcctgaagcagtttctggagtgctctagaagtatcggaacagacaatgtttgcagagatcggctggagaaaactattattctgttcacgaaggtgctgctggatttcctggaccagcatccattttcgtttactccattaattcagcggtcccttgaattcagcgtcagttacgttttcactgaggtgggcgaaggcgtcacttttgagaggttcatcgtgcagtgcatgaaccttatcaaaatgatagtcaagaactatgcttacaagccttccaaaaacttcgaggactcgtctccagaaacactcgaggcacataaaatcaaaatggcgttctttacatatccgacactgacagagatctgtcggcggctggtgagtcattacttcctcctgactgaggaggaattaacaatgtgggaggaggatccagaggggtttacagtagaggagacaggaggcgatagttggaaatattcgctcaggccatgtaccgaggtgttgttcatcgatatattccacgaatataaccaaacactcacacccgtgctactggagatgatgcagacactccagggcccaacaaatgtggaagatatgaatgccctgttaatcaaagacgctgtctataatgcagtcggactggccgcttatgaactgttcgactccgtggacttcgatcagtggttcaaaaaccagctacttccagagctgcaagtcattcataaccggtacaaaccactgagacggcgcgtcatctggctgatcgggcagtggatcagtgtcaagtttaagagtgatctccgccccatgctttacgaggcaatatgtaatctcctgcaagaccaggatctggtggttaggattgaaaccgccaccaccttgaagctgaccgtggacgattttgaatttcgtacagatcagttccttccttatctggaaaccatgttcacgctgctgtttcagctcctgcagcaagtgaccgagtgtgacacaaagatgcacgtgctccatgttctctcctgtgtaattgagcgcgtgaatatgcagatccgtccatatgtgggatgccttgtccagtatttgcccctgctgtggaagcagtccgaagagcataacatgctgcgctgcgcaatcttgactactcttatccaccttgtgcaagggctgggcgcagactcgaagaatctgtaccccttcctcctgccggtgattcaactatccaccgacgtgagtcagccgccacacgtttacttgcttgaagacggcttggagttgtggctggtgacacttgaaaactccccatgtattactccggagctgctcaggattttccagaatatgtcacctctccttgagctatcctctgagaatttgaggacatgcttcaagataatcaatggatacattttcctgtcgagcacagaattcctgcaaacctatgccgttgggctgtgccaatccttttgcgagttgctgaaggagatcacaacagaaggacaggttcaggtcctgaaagttgtggagaacgctttaaaggtcaaccccatcctcggtcctcagatgttccagccgattctgccatacgtgtttaaggggattattgagggggaaagataccctgtcgtcatgagcacctacctgggcgtgatgggaagagtccttctgcagaatacctcgttcttttcaagcctgttgaatgaaatggcccacaagttcaatcaggaaatggaccagcttctcggtaatatgatcgaaatgtgggttgaccgcatggacaacattactcagcctgagcgccgtaagttgagtgccctggctctactgagcctgttgccatcagataattccgttatccaggacaaattttgtgggataattaacatttccgttgaggggttgcacgacgtaatgactgaagaccccgaaactggaacctacaaggattgcatgttaatgtcacatctggaagagccaaaggtgacagaagatgaggaaccacctaccgagcaggacaagcgcaaaaaaatgctagctctgaaggaccctgtgcacacagtatccctccagcaatttatatacgagaagctcaaggcccagcaagaaatgttgggcgagcaggggtttcagtccttaatggaaactgtggatacagaaatcgtgacccaactgcaggagtttcttcagggcttttag

SEQ ID NO: 191306 - DNA, 3048 bp, Artificial Sequence
  Description of Artificial Sequence: Synthetic coding sequence
atggtgcagcccatcatccacctgggctacgtggtgtacagcctgctgtacctgggctacaaacctgtacagcacgtaactgctttgaacactgtgtctagttgtcataagatggtctctatggacttgaattcagcatccaccgtggttctccaagtgttgacacaggcgacttcccaggatactgcggtgctcaaacccgccgaggaacagctgaagcagtgggagactcagcccggtttctacagtgtattgctcaatattttcacaaatcacacactggacatcaacgtgagatggctcgccgttctctattttaagcatggtatcgatcgatactggcgtcgggttgctcctcatgcgctgtccgaagaggagaagaccaccctaagagcggggttaataactaattttaacgagcccattaatcagattgccacgcaaatcgcggtgctgattgcaaaagttgcgcgcctcgattgcccccgccagtggcctgagctcatcccaaccctgatcgagagcgtgaaagtacaggacgatttacgccagcatcgcgcactgctaacgttctatcatgtcactaaaacgttagcgagcaagagactcgccgccgatagaaaactgttctatgatctcgcctctggaatttacaacttcgcatgtagtctctggaatcaccatacagatacgttccttcaggaagtctcctctgggaatgaggccgccatactgtcttccctggagagaactctactgtctctgaaagtgctgcgtaaactcaccgtcaatggtttcgtggaaccacacaagaatatggaggtcatgggctttttgcatgggatctttgagagactcaagcagttccttgagtgctctcggtccatcggtaccgacaacgtctgcagagaccggctggaaaagactattatcctgtttaccaaggtgctgttggactttttggaccaacacccatttagtttcacacctctcatccagagatctcttgaatttagtgtttcctatgtgtttactgaggtgggggaaggggtcacttttgaacggtttatcgtgcaatgcatgaatctcatcaaaatgatagtaaaaaactacgcctacaagccatcgaagaacttcgaggacagctcacctgaaaccctcgaagctcacaagattaaaatggccttctttacgtaccccactctgactgagatctgtaggcggttggtgtcccactacttcctcctgaccgaggaagagttgaccatgtgggaagaagaccctgagggattcaccgttgaggagaccggaggagactcatggaaatatagtctccgcccctgcacggaggtgcttttcatcgatatttttcacgaatataaccaaacgctcacaccagtcctgctcgagatgatgcagacacttcaaggccccaccaacgtggaagacatgaacgcactgcttattaaggatgcggtttataacgcagtcggattggctgcttatgagctgtttgattccgtggactttgaccagtggtttaaaaaccagctgctgccggaactgcaggtcattcacaaccgatacaagccccttcggcgcagggtgatttggctgattggccagtggatctcagtgaagtttaaaagcgacctacgcccgatgctatacgaggccatctgcaacttgcttcaggaccaggatttggttgtgagaattgagaccgcaactactctcaagctgaccgtggatgacttcgaatttcggacagaccagttcctgccttaccttgagacaatgttcacactactgttccaactactccagcaagtcacagaatgtgacaccaaaatgcacgtcctgcacgtgctcagctgtgtgattgagagagtaaacatgcagatccgtccttatgtcggatgcctggtacagtacctgcccctgctgtggaagcaaagcgaggagcacaacatgttgcgctgcgctattctgacaaccctcattcacctggtgcagggtctgggggccgattctaaaaatctgtatccttttctgctgcccgtgattcaattaagtacagacgtcagccagcccccccacgtgtaccttttggaggacggactagaactgtggctagtgaccctagaaaactcaccctgcattactcccgaactgctacggatattccagaatatgtcaccactacttgaactgtcgtccgaaaatctgaggacttgcttcaagattataaatgggtatattttcctgagcagcacagagtttctgcagacttacgctgttggcttatgccaatctttctgtgagctgctcaaagaaattacaaccgagggtcaggtccaggtgctaaaggtcgtcgagaatgcccttaaggtaaatcccatcctaggccctcaaatgtttcaaccaatcctgccgtacgtttttaaaggtatcatcgagggggagcgataccctgtggttatgagcacctatcttggtgttatgggcagagtactgctgcaaaataccagctttttcagtagcctgctcaacgagatggcacataagtttaaccaggagatggatcagcttctcggcaacatgatagaaatgtgggttgatcggatggacaacatcacccagccagaacgtagaaaacttagcgccctggcactcttaagtctgctgccgagcgacaactccgtgatccaagataagttttgcggcataatcaatatcagtgtggaaggactgcacgatgttatgactgaagaccctgagactggaacttacaaagattgtatgcttatgtcgcacttagaagaacctaaagttacggaggatgaggaaccccccacagaacaggacaagcggaaaaaaatgctggccctgaaagatcccgtgcatacagtgtccttgcagcagtttatatacgagaagctgaaagctcagcaggagatgctgggggaacaaggatttcagagtctgatggagactgtcgataccgagatcgtcacacagttgcaggaattcctgcagggtttttag

SEQ ID NO: 191307 - DNA, 195 bp, Artificial Sequence
  Description of Artificial Sequence: Synthetic coding sequence
atggacctgaacagcgccagcaccgtggtgctgcaggtgctgacccaggcgacatctcaggacaccgccgtgctgaagcccgcagaggagcaactcaaacagtgggaaacccagcccggtttctactctgtcttgctgaatattttcactaatcacacattagatattaacgtccggtggttagctgtactctag

SEQ ID NO: 191308 - DNA, 489 bp, Artificial Sequence
  Description of Artificial Sequence: Synthetic coding sequence
atggacctgaacagcgccagcaccgtggtgctgcaggtgctgacccaggccacctcccaggataccgctgtactgaaacccgctgaggaacagctgaagcagtgggagactcagccaggtttttacagtgtgctgctaaacatctttacaaaccacacgcttgacatcaacgtgcgctggctggctgttctttactttaaacatggcattgaccgttattggcggcgcgtggcaccgcacgcgctgagcgaagaggagaagacaacactccgagctggactaattacgaactttaacgagccgatcaaccaaatcgcaacccagatagcagtgctgatagctaaggtggcgagactggactgcccacggcaatggccagaattaataccaacactgatcgaatctgtgaaggtacaagatgatctccgccaacaccgggccctattgaccttctaccacgtgacaaaaaccctggcctcaaagcgatag

SEQ ID NO: 191309 - DNA, 450 bp, Artificial Sequence
  Description of Artificial Sequence: Synthetic coding sequence
atggacctgaacagcgccagcaccgtggtgctgcaggtgctgacccaggccacttctcaggacactgccgtgcttaaaccagccgaagaacaactgaagcagtgggaaacccagccagggttctactctgtcctgttgaatattttcaccaaccacacactggacatcaacgtgcgctggctagctgtcctgtattttaagcatggaattgatcggtattggcggcgagtggccccccatgccttaagtgaggaagagaagaccaccctgcgggcgggactgattaccaacttcaacgaaccaattaatcagatcgctacccaaattgcagtgctgattgccaaggtggcccgcctagattgccctaggcagtggcctgaactgattcctactttaatagagtcagttaaggtgcaggacgatttacgtcagcatcgcgccctgctctag

SEQ ID NO: 191310 - DNA, 1425 bp, Artificial Sequence
  Description of Artificial Sequence: Synthetic coding sequence
atgatgcagaccctgcagggccccaccaacgtggaggacatgaacgctctgctgataaaagatgcggtgtacaacgctgtgggccttgccgcttacgaactgttcgacagtgtggactttgaccagtggtttaaaaaccagctgctgccagagctacaagtgatccacaaccgctacaagccactccggcggcgagtgatctggctcattggccagtggatttccgttaaatttaagagtgaccttcgccccatgttgtatgaagcaatctgcaacctgctccaggatcaggatttggtggtgcgtatcgagaccgctacaacactgaaactaaccgtggatgactttgaatttagaactgaccagttcctgccttatctggagacaatgttcacactgctgttccagctactccaacaggtcactgagtgtgacacaaagatgcatgtcctgcatgtactgtcttgtgtgatcgagagggtgaatatgcagattaggccttatgttgggtgccttgtgcagtacctgcccctgttgtggaaacaaagcgaggagcacaatatgctgcgctgcgccatcctgaccacactgatccacctagttcaggggttaggagccgactcaaaaaatctgtatccatttttactcccagtgatccagctgtctactgacgtgtcgcagcccccacacgtgtatctcctagaggacgggctggagctctggcttgtgactctcgagaactctccgtgtattacacccgaactgcttcgtatcttccagaacatgagtcccttgctggagctgagttcagaaaatctcagaacctgcttcaaaataataaatgggtatatctttctgtcatccactgaattcctacagacgtacgcagtgggactgtgtcagtcattctgcgaactgctgaaggagattaccacagaggggcaggtacaggtgttgaaggtggtcgaaaatgccctgaaggttaatcccatactcggccctcaaatgtttcaacccatcctcccgtacgtctttaagggaattatcgagggcgagcgataccccgtcgttatgtcgacctatctcggagttatgggccgggttttgctccaaaacacgagcttctttagttctttgctgaatgagatggcacacaagttcaatcaagagatggaccagctgctgggcaatatgattgaaatgtgggttgatcggatggataacattactcagcctgaaagaagaaagttaagtgccctggccctcctctctttgctcccaagcgataatagcgttatccaggacaagttttgtgggatcatcaacatttctgtggagggactgcacgatgtgatgactgaggatccggagacagggacatacaaggattgcatgttgatgtcccacctggaggaaccaaagtag

SEQ ID NO: 191311 - DNA, 3117 bp, Artificial Sequence
  Description of Artificial Sequence: Synthetic coding sequence
atggaccccaacaccatcatcgaggccctgcggggcaccatggaccccgcactgcgtgaggctgccgagcgccaactgaacgaggctcataaatccctgaattttgtgtctacactgctgcagataactatgtctgaacagctcgacctgccagtgcgccaggcaggagtgatttacctcaagaacatgattactcaatattggccagatcgagaaaccgctccaggagatatttcaccctacacaattcctgaggaagacagacattgcatcagagaaaacatcgtcgaagctatcattcacagccctgagctgatccgcgtgcaactgacaacatgtatacaccacatcatcaagcatgattatcccagccgctggaccgcgattgtagataagatcggtttctacctgcagtctgataacagcgcttgctggctaggaatcctgttatgcttataccaattggttaagaattacgaatataaaaagccagaagaacgctcacctctagtcgctgcaatgcagcatttcctaccagtcctgaaagatcgtttcatccagttactttcagaccagagtgatcaaagtgtcttgattcaaaagcagatatttaagattttctacgctctcgtgcagtataccctcccactggagctaataaatcagcagaatctaaccgaatggattgaaattctgaagacggtggtcaaccgagacgttcccaatgagacacttcaggtggaggaagatgatcgccctgagcttccctggtggaagtgtaagaaatgggccctgcacatattggctcgtcttttcgagcgttatgggtctcccggaaatgtctctaaggaatacaatgaatttgcagaggtattcctgaaagccttcgccgttggcgtgcaacaggtcctactcaaagtcttgtatcagtacaaagaaaaacaatatatggcacctagagtgctgcaacaaacactcaactatatcaaccagggggtatcgcacgctcttacatggaagaacctcaagcctcacatccaaggaattatccaggacgtgatcttccctctgatgtgctataccgatgccgacgaagagctctggcaggaggatccatatgaatacatacgcatgaaatttgacgttttcgaggactttatttctcctactacagctgctcagaccctgctgttcactgcttgttcgaagcgaaaagaggtgctgcagaaaactatggggttttgttaccaaatccttaccgagcccaacgcggacccgcgaaaaaaggatggcgctctgcacatgatcggctcactagccgaaatcctgctaaagaagaaaatttacaaagatcagatggaatacatgctgcagaaccacgtcttcccacttttcagcagtgagctgggttatatgagagcgcgtgcgtgctgggtcttgcactatttctgcgaagttaagttcaagtctgaccagaacctccagactgcccttgagctgaccaggcgatgtctgatcgatgaccgagagatgccagtaaaagtggaggccgcaatcgcccttcaagtgctgattagcaaccaagagaaggctaaagaatacatcacaccttttataagaccggtgatgcaggccctgctgcacattattagagaaacagagaacgacgatctgaccaatgtgatccagaaaatgatatgtgaatacagcgaagaagtgactcccattgctgtggaaatgacacaacatctcgctatgaccttcaatcaggtaattcagaccggacccgatgaggaaggttctgatgataaagcggtgacagcaatggggattctgaataccattgataccctcttgtccgtggtggaggatcataaagagataactcagcagctcgaaggcatctgcctgcaggtgatagggaccgtgttgcagcagcatgttctcgagttctacgaggagatattctcactggcccacagtcttacctgtcagcaggtttctccacagatgtggcagctcctacctctggtattcgaagtgttccaacaggacggctttgattactttacggacatgatgcccctgctgcataactacgtgaccgtggataccgacacactgctttccgacaccaagtacctggagatgatctatagtatgtgcaagaaggttttgacaggtgtcgctggagaggacgccgagtgccacgctgcaaaactgttggaggtcattatattacagtgcaagggccggggcatcgaccagtgcatccccttgtttgtcgaagctgccctggagagattgactcgcgaagtgaagacctcagagcttcgcacgatgtgcctgcaagtggctatcgcggcgctgtactataacccacacctgttgcttaatacactggagaacctgagatttcccaacaatgtggagccagtcactaatcattttataacccagtggttaaatgatgttgactgcttcctcgggctccacgatagaaagatgtgtgtgctgggcctctgcgctttgattgatatggaacagattccccaggtactcaaccaggtgtccggccagatcctccccgctttcatcctgctctttaacggcttgaaacgcgcttatgcatgtcatgccgaacatgagaatgactcagatgatgacgacgaagccgaagacgacgacgaaaccgaagaactgggtagcgacgaggatgacatcgacgaggacggacaggagtacttagagatcttagctaagcaggccggggaggacggcgacgacgaagattgggaagaagacgatgccgaggagactgccctggaggggtatagcactattattgatgacgaggacaatcctgttgacgaataccagatctttaaggcaatctttcagacaatccaaaatcgcaatccagtttggtatcaggctctgacccacggacttaacgaagaacagcgcaaacagctgcaggatatcgccaccctggccgatcaacgacgcgccgctcatgaatcaaagatgattgagaagcacggcgggtacaaattcagtgcccccgttgtgcccagcagctttaactttggcgggcccgcgcccggcatgaattag

SEQ ID NO: 191312 - DNA, 3114 bp, Artificial Sequence
  Description of Artificial Sequence: Synthetic coding sequence
atggacctgaaccggatcatccaggccctgaagggcaccatcgaccctaagcttagaattgcagctgaaaatgaattaaaccagtcatataagattattaactttgccccatctttgctccgtatcatcgtttctgaccacgtggagtttccagtcaggcaggctgcagctatttacttgaagaacatggtgactcagtattggcctgatcgggaacctcccccgggagaggccatcttcccctttaatatacacgaaaatgaccggcagcagattcgtgacaatatcgtggaaggcattattaggagtcccgatctcgtccgcgtccaattgactatgtgcctgcgcgccatcattaaacacgatttcccaggccattggccaggcgtggtggacaagatcgactattacttacagtctcagtcatccgcaagttggcttgggagcctcctgtgtctttaccagctagtcaagacatatgagtataagaaagcagaagaacgtgagccgctgataatcgccatgcagatattcctaccacggattcagcagcagattgttcagttactccctgatagttcttattattccgtgctgttgcaaaaacagattctgaaaatcttctatgcactggtgcagtacgcactcccactgcaattagtgaataatcaaacaatgaccacatggatggagatttttagaacgatcattgatagaacagtcccacctgagaccttacacattgacgaggacgatcggcccgagttagtttggtggaagtgcaagaagtgggcactccatatcgtggcaaggctgttcgagaggtacggcagccccggcaacgtgactaaagagtatttcgagttctctgaatttttcttaaagacttatgctgtgggcatccagcaggtactcctgaagattctggaccagtacagacagaaggagtatgtggccccgcgcgttctgcagcaggcattcaattatttaaaccagggtgtggtgcatagtatcacttggaagcagatgaagccgcacatccagaacatctctgaggatgttatcttcagcgtcatgtgttataaagacgaggacgaagaactttggcaggaagatccctatgaatatattagaatgaagtttgatattttcgaagactatgcaagccctacgactgcagctcaaacacttctgtacaccgctgccaagaagcggaaggaggtgctgccaaaaatgatggcattctgttaccagattcttaccgaccccaactttgacccccggaagaaagatggtgccctccacgtgatagggagcctggcagaaatcctcctgaaaaagtcattgtttaaagaccagatggaactcttcttacagaaccacgtttttccgctgctcctgtccaatctcgggtacctcagagcacgaagctgctgggtgctccacgccttctcatctctaaagttccacaatgaattgaacctccggaacgctgttgaattggctaaaaaatcacttatcgaggacaaggagatgccagtcaaggtggaagcagccttggcgctgcagagtctgatctcaaaccagattcaggccaaagagtatatgaaacctcatgtgaggccaatcatgcaggaactcctgcacattgtccgggagactgagaacgatgatgtgacaaatgttattcaaaaaatgatctgcgaatattcccaggaagtggcttctattgccgtcgacatgacccagcatctcgctgaaattttcggcaaagttcttcagtctgacgagtacgaggaagttgaagacaagaccgttatggcaatgggcatcctgcacacgatcgacaccattctgaccgtggtggaggaccacaaagaaatcacccaacagctggagaatatttgcctaaggataattgacctcgtcctgcaaaagcatgttatcgagttttacgaggaaattctgtcacttgcctacagcctcacctgtcatagcatcagtccacagatgtggcagctgctggggatcctatacgaggtgttccaacaggactgtttcgagtacttcacagatatgatgccgctactgcataactatgtcactatcgatacagatacactcctttccaatgcaaaacacctggagattctgtttacgatgtgtcgtaaagtgctgtgtggcgatgctggagaggacgcagagtgccatgccgctaaactgttagaagtgatcatacttcagtgcaaggggagagggatcgaccagtgcattcccctcttcgtccaattggtgctggagcggctgacacggggcgtcaagactagcgagctgcggacgatgtgtctgcaggtagctattgccgccctgtactacaatccggatcttctcctgcacacgctcgagaggatccagcttccacataaccccggaccgattactgtacaattcattaaccagtggatgaacgatacagactgcttccttggccaccacgatcggaagatgtgcatcattgggctcagcatactgctggagctccagaacaggccaccagcagtggacgctgtagtcggacagattgtgccttccatactttttctcttcctcgggttaaaacaagtttgtgcaactcggcagctggttaaccgcgaagaccgatcaaaggctgagaaggccgacatggaggaaaatgaggagattagcagcgatgaagaagagactaacgtaaccgcccaagccatgcaatctaataacggcaggggggaggatgaagaggaagaagacgacgactgggatgaagaggtccttgaggagaccgccttggaaggattctctaccccccttgacctggataattctgtggacgaatatcaatttttcacacaggccctcataacagtacagagtagagatgcagcatggtaccaattgcttatggcgcccttgagtgaggaccagaggaccgctctccaggaagtgtacacgttggcagaacatagacggaccgtcgctgaagctaagaagaaaatcgaacagcagggaggttttacgttcgagaataagggcgtcttgtctgcttttaacttcggaacagtgcccagcaataactag

SEQ ID NO: 191313 - DNA, 2499 bp, Artificial Sequence
  Description of Artificial Sequence: Synthetic coding sequence
atggagagcctgaccctgaagggctacgccctgcccctgcagctggtgaacaatcagacaatgacaacctggatggagatcttccgaacaattatcgatcgtacagtgccccccgagacactgcacattgacgaagatgatcggcccgaacttgtctggtggaagtgtaaaaaatgggcactgcacattgtggctagactttttgaaagatacgggtctccagggaatgtcaccaaagaatatttcgagtttagtgagttcttcttaaagacatatgctgtcgggattcagcaggtcttgctgaagatcctagaccaatacagacagaaagaatacgttgcaccgcgggtgctgcagcaggccttcaattatctgaaccaaggagtggttcattcaattacctggaagcagatgaagcctcacattcaaaacattagtgaagatgtgatcttcagtgttatgtgttacaaagatgaagatgaggagctttggcaggaggacccatatgaatatattaggatgaaattcgacatcttcgaggattacgcaagcccaaccaccgccgcccaaactctgctttatacagctgctaaaaaaaggaaggaagtgctgcctaaaatgatggctttttgttaccagatcctcactgaccccaactttgaccccaggaagaaagacggagctctgcatgttattggcagcctcgccgagattctgttgaagaagtctctgtttaaagaccagatggagctattcctgcaaaaccatgtgttcccactgcttttgagtaatctgggttacttgcgggccagatcatgttgggtcctgcacgccttttcgagtctcaaattccacaacgaactaaatctgagaaacgctgttgaactggctaaaaaaagtctgatcgaggacaaggaaatgcccgtgaaagtggaagccgctctcgcactacagtctcttatctcgaatcaaatccaagccaaagagtatatgaaaccacacgtccggccaattatgcaagagttgctccacatcgtgagagagactgagaatgatgatgtaaccaacgtgatccagaagatgatctgcgagtatagtcaggaagtggcctctatcgcagttgatatgacacagcacctggcggagatctttggcaaggtactgcaatcagacgagtatgaagaagtggaggataagaccgtaatggctatgggcattctgcataccatagatactatactcactgtggttgaggatcacaaagaaattacacaacagctggagaatatttgtctgaggataatcgacctcgtgctgcagaagcatgtgattgaattctatgaggagatcctgtcgctggcttactctctgacatgccacagcatttcaccccagatgtggcagctcttgggaatcctgtacgaagtcttccagcaagactgcttcgaatactttaccgatatgatgcctcttctccacaactacgttacaatcgacaccgataccctgctgtcaaatgcgaagcatctggagatcctgtttactatgtgccggaaagtgctgtgtggagacgccggcgaggatgccgaatgccacgctgccaaactgttagaagtcattattctgcagtgtaagggccgtggaattgaccagtgcatacctctcttcgtccaattggtgcttgagaggttgacccggggagtgaagacatcagagctgaggactatgtgtctccaggtagcaattgctgcactgtactacaaccccgacctgctgttacatactctggagagaatccagcttccgcataatcccgggccaatcacagtgcaatttataaaccaatggatgaacgatacggattgttttttaggacatcacgacaggaagatgtgcatcattgggctgtctatcctgctggaattacagaaccgacctcccgccgtcgacgccgtagttgggcagatcgtcccgtcaatccttttcctgttcctcgggcttaagcaggtctgtgcaacccggcagctcgtgaatagggaagatcgttcaaaagccgagaaggccgatatggaggagaacgaggagatctcctcggatgaggaggaaacgaacgtgactgcacaggccatgcaatctaataatgggcgaggtgaagatgaggaagaggaagacgatgattgggacgaggaggttctcgaagaaaccgcattggaggggttctccactcctttagatctcgacaacagcgtggatgagtaccagttttttacgcaggccctgatcactgtgcaatccagagacgctgcgtggtatcagctacttatggcgcctctatctgaggatcaacgaactgctctccaggaggtgtacacactggcagaacacagacggactgttgccgaggcgaagaaaaagattgagcagcagggtggttttactttcgagaataagggagtcctaagcgcgtttaacttcgggacagtcccctcgaacaactag

SEQ ID NO: 191314 - DNA, 1542 bp, Artificial Sequence
  Description of Artificial Sequence: Synthetic coding sequence
ctgagcagcggccacgagctggccaaggagtacatgaagccccacgtccggcctatcatgcaggagctgttacatatcgtgagggaaaccgaaaatgacgacgtgacgaatgtgatccagaaaatgatatgtgagtacagccaggaggtggcctctatcgccgtggatatgacccagcatttggcagaaatttttggcaaagtcctgcagtcagatgaatatgaagaagttgaggataaaactgtgatggctatgggcattctccacactatcgatactattctgaccgtggtggaggatcataaggagatcacacagcagctagagaacatctgcttaagaataattgatctcgtgctacaaaagcacgtgatcgagttctacgaggaaatcctcagcctggcgtatagccttacctgccatagtatttctccacagatgtggcaacttttggggattttatatgaagttttccagcaggactgttttgagtattttacggatatgatgccactgttgcataattatgtaaccatcgacacagacaccctgctgagcaacgctaagcatctggaaatactctttacgatgtgtaggaaggtgctgtgtggcgacgctggcgaggacgcggaatgtcatgctgccaagctgctggaagtgattatcttgcagtgcaagggtcgggggattgaccagtgtattccgctgttcgtgcagcttgttctcgagcgactgacacgcggggtgaagactagtgagttgagaacaatgtgtcttcaagttgctatcgcagccctatactacaacccagacctcctgctgcacacgctcgaaagaattcagctgccgcacaatcctggccctataaccgttcagtttataaaccagtggatgaacgacaccgactgcttccttgggcatcatgataggaaaatgtgtataatcggcctgtcaatccttcttgaactgcagaataggcccccggctgtggacgccgtcgtcggccagatagtgccttctattctattcttattcctcggcctgaaacaggtgtgtgcgacccgccagctcgtgaaccgggaggataggagtaaggcggaaaaagctgacatggaagagaatgaggagatctcaagtgacgaggaggagaccaacgtaacagctcaggctatgcagtccaacaatggacgcggcgaagacgaagaggaggaggacgatgattgggacgaagaagtcctcgaggaaaccgcactggaaggcttctcaacccccctggacttggataactccgtcgatgaataccagtttttcacccaggccttaatcactgtccaatctcgtgatgcagcctggtaccagttgcttatggctcctctaagcgaagatcaacgcactgcccttcaggaggtgtacactctggccgaacatagaagaactgtggcagaggcaaaaaagaaaatcgaacagcagggggggttcacatttgaaaacaagggcgttctcagcgctttcaatttcggtacggtgccgtccaacaactag

SEQ ID NO: 191315 - DNA, 3546 bp, Artificial Sequence
  Description of Artificial Sequence: Synthetic coding sequence
atgcccgagaaccccgccaccgacaagctgcaggtgctgcaggtgctggacagactaaaaatgaagctgcaggagaagggagatacctcacagaatgagaagctgtctatgttttatgaaacactgaagtcacccctctttaatcagatactcacactgcagcaatctatcaagcagctgaaaggccagctgaatcacattccttccgattgttccgccaacttcgacttttctcggaaggggcttctggtatttacagacgggagcataacaaatggcaatgtgcatagaccctccaacaattctacagtctccgggctttttccatggacacccaagctcggcaacgaggattttaacagcgtgattcaacaaatggcccaggggaggcaaatcgagtacatcgatatcgagcggccaagcaccggtggtctgggattctccgtggtcgctctgcgttcccaaaatcttggaaaagtggatattttcgtgaaggatgtacagcccggcagcgtggccgatcgggatcaaaggctgaaagagaacgaccagatcttagccatcaatcacacccccctggaccagaatattagtcatcagcaagcgatcgcgctcctccaacaaactacagggtctctgaggctgatcgtggcacgcgagcctgtgcacaccaagtcatccacaagcagcagcctgaatgacacaactctcccagaaacagtgtgctggggccatgttgaggaggtggaactgatcaacgatgggtcgggcctgggcttcgggattgttgggggtaaaacctccggcgtggttgtgagaacaattgtccccggcgggctagccgacagagacgggcgcctgcaaacaggcgaccatatcctgaagataggaggcacaaatgtgcagggcatgacctccgaacaggttgctcaggtactcaggaactgtggaaatagcgttcgaatgcttgtggcccgggaccctgctggcgacattagcgttacccccccagctccggccgccttacctgtcgccctgcccactgtggcatccaaaggccctggatccgacagctctctgtttgaaacttataatgtggaattggtacgcaaggacgggcagtcgttgggcattcgaattgttgggtacgtcgggacatcccacaccggggaggcctctggaatctacgtgaaaagtatcattccaggaagcgccgcctaccacaacgggcatattcaggtgaatgacaagatcgttgccgtcgacggcgtgaacattcagggctttgcaaatcacgacgtagttgaggtgctgaggaacgcaggccaagtggtccacctcaccctcgtaagaagaaagacctccagctccacttccccactagagcccccatctgacagaggaactgtggtggagcctctgaaacctcccgcccttttcctgacaggtgccgttgagacagaaaccaacgtggatggcgaagacgaggagataaaggaacggatcgacacgctgaagaatgacaacatacaggcgctggagaagctcgaaaaagttcctgacagtcctgagaatgagttaaaaagtcggtgggaaaacctgctggggcctgattatgaggttatggtggccacgctggacacccaaatcgccgacgatgcagaactgcagaagtactctaagctgctgccaattcatacccttcggctaggcgtggaagtggacagcttcgatggacaccactacatttcatctatcgtgagcggggggcctgttgatactcttgggctcctgcaacctgaggacgaactgttggaagtgaatggtatgcagttgtacggtaagtcccgccgggaagctgttagctttctcaaggaggtgccacctccatttacgctggtctgttgcaggcgtctgttcgacgatgaggcctccgttgatgagcctcgccgaactgagacctctctcccggaaacagaggtcgatcacaatatggacgtgaacactgaagaagatgacgacggcgaactggcactatggagtccagaagttaaaatcgtggagctcgtcaaggactgcaagggccttgggtttagtatcctggactatcaagaccctcttgaccctactagaagtgtgatcgtaattcggtcgcttgtggccgacggcgtcgccgaaagatcaggcggacttttacccggtgatcggttagtgtctgtaaacgaatactgtctcgataatacctctctggccgaggctgtagaaatcctcaaagccgtcccacccggactcgttcatctgggtatttgtaaacctctggtagaggacaatgaggaggaatcatgttacatccttcactcttcctccaatgaggacaaaacagagtttagtggaaccatccacgatataaacagttccttgatcctggaggctcccaagggctttagggatgagccctacttcaaggaagagctggtcgatgagccatttttggatctgggcaaatcctttcactcacagcaaaaggagattgaacagtctaaggaagcatgggaaatgcacgagttcctgaccccacggttgcaagaaatggacgaggaacgggaaatcctggtggacgaagaatacgagctttaccaggatccatctccaagtatggaactatatcccctaagtcacatacaagaggcaacacccgtcccttctgtcaacgagttgcacttcggtacgcagtggctgcacgacaatgaaccatctgagtcccaagaagccagaacgggccgcactgtatactcacaggaggctcaaccctatggctactgtcctgaaaacgtaatgaaggagaacttcgtcatggagtcactgccgtctgtgccttccacagaaggcaactctcagcaggggcggttcgacgacctcgagaatcttaactcgctagcgaaaacatcattggatttggggatgattcccaatgacgttcagggcccaagcctgctcatagacctgcctgtggtcgcacaacggcgcgaacaggaagatctaccgctgtaccagcatcaggccactagagtgattagtaaggctagcgcatacacaggcatgctcagtagtcgttatgcaacagacacatgcgaacttcccgaacgtgaggagggggaaggtgaggagactcccaactttagtcactggggcccacctcgaatagtggaaatttttcgcgaacctaatgtgagtctgggcattagcatcgtcggggggcaaaccgtaattaaacgactgaagaacggtgaagaactaaaggggatctttataaagcaggtgcttgaagactcccctgcagggaaaacgaacgccctgaagaccggcgataaaatcctggaggtaagcggcgtggaccttcagaacgcgagccattccgaagccgtagaggcaattaagaatgcaggaaacccagtggtatttatcgtgcagagtctgtccagcaccccagcgtgggtcactgagcaggactcggtcagcaaaaaaaagaagaatcacgaaggctag

SEQ ID NO: 191316 - DNA, 600 bp, Artificial Sequence
  Description of Artificial Sequence: Synthetic coding sequence
atggtgcagggcggcttccccgagaagatccggcagcggtacgccgacctgccaggggaactacacatcatcgaactggagaaggataaaaacggattggggttgtccctggcagggaacaaagacaggtccaggatgagtatctttgtcgttggcattaaccccgaaggacccgccgccgctgacggtcggatgaggatcggggatgagctgctggaaatcaataaccagatactgtacggtcggtcgcaccagaatgcttccgctatcataaaaaccgccccgagtaaagtgaagctggttttcattcgaaacgaggatgctgtcaatcagatggctgtgacgccgttccccgtgccgagcagtagtcctagctccatcgaggaccagtccggaactgagcccatctcatctgaagaggatggctcggtcgaggtcggcattaagcagctgccagaatcagagtcttttaaactggcggtcagtcaaatgaaacagcaaaaatatcccacaaaggtgtccttctcctcccaggagattcctctggctcccgcatcaagctaccacagcacggacgctgattttacgggttacggatag

SEQ ID NO: 191317 - DNA, 4746 bp, Artificial Sequence
  Description of Artificial Sequence: Synthetic coding sequence
atgcccgagaaccccgccaccgacaagctgcaggtgctgcaggtgctggatcggctgaaaatgaaactgcaggaaaaaggggataccagtcaaaatgagaagctgtctatgttttatgagactttaaaatcaccactattcaatcagatcctcacgttgcagcagtcaattaagcaactgaagggccagcttaatcacattccctctgactgttcagcaaacttcgacttctctcgcaagggtcttctggtgtttaccgacgggagcatcacaaatggaaatgtgcaccgcccaagcaacaactcaaccgtctccggattgtttccgtggaccccgaaactcggcaacgaagactttaatagcgtcattcagcagatggcacagggaagacagatcgagtatatcgatatcgaaaggccctccacaggcgggctcggtttttcggtggtcgcccttaggtctcagaatcttgggaaggtggatatttttgtcaaagacgtacagccaggcagcgtggcggatcgggatcagcgtctgaaggagaacgaccagattcttgccatcaaccatacccctctggatcagaacataagccatcagcaggcgatcgccttactccagcagacaaccggaagtctcagacttattgtggcccgcgagcctgtccataccaagagcagtacatcgtcttcactgaacgacacgactctgcccgagactgtatgttgggggcatgtggaggaggtggagttaattaacgacggctctggtcttggattcggcatcgtggggggcaagacttcaggcgttgtggtacgaaccatcgtaccaggaggacttgctgacagagatggacggctccaaacaggtgatcacatccttaaaataggaggcactaacgtacagggaatgacttccgagcaggtggcacaagtcttaagaaactgcggcaactcggtccgcatgcttgtcgcccgggatcccgccggtgacatttccgtgacaccccctgctcctgccgctctaccggtagccctgccaacagtggccagcaagggtcctggctctgacagttccttattcgaaacctataatgtagagctcgtgcgcaaggatgggcagagcctgggcattcgaatcgtcggatatgtgggaacctcccataccggcgaggccagtgggatctacgttaagagtattatcccaggctcagcagcgtaccacaacgggcacatacaggtaaacgacaaaattgttgcagtggacggggtaaatatccagggatttgccaatcacgatgtggtggaagtgctcagaaatgctggccaggtcgttcatctcactctggttagacgtaagacgtctagttctacctcccccctggaacccccatccgaccgtggtaccgtggttgaacccctcaagcctcccgcattgttcctaaccggagctgtcgaaacagaaacaaacgtcgacggcgaagatgaagagattaaggaaaggatcgacactctcaaaaacgacaacatacaggctctcgagaagcttgagaaggtgccagattctcccgagaacgaactgaagtctaggtgggagaacctattaggccccgactatgaggtcatggtggccaccctggacacccaaatcgcagatgacgctgagctgcaaaagtatagcaaactgctgccgatccacacactgagactgggcgtcgaagttgacagcttcgatggacaccattatatctcaagtattgtgtccggcggaccggttgatacattgggcctccttcagccagaggacgaactgctggaggtcaatggcatgcagctgtacggtaagagcaggagagaggctgtcagctttctcaaggaagtaccccccccgtttacgctggtgtgttgtcgcaggctgtttgacgacgaagcaagcgtagatgagcctcgcagaaccgagacaagcctgcctgaaaccgaggtggaccacaacatggatgttaacacagaggaggatgatgatggggagctggccttgtggtcccctgaagtaaagatagtggaattggtcaaggactgtaaggggctgggcttctccatccttgattaccaggacccactcgatcctacaaggtccgtcatcgtgattagaagtcttgtggcagacggcgttgctgagcgatccggggggctgttaccgggtgaccgcttggtgagcgtgaatgagtactgtctggacaacacatcactggctgaggcagtggaaattctgaaggccgtacctcccggattggtccacctcggaatctgtaaaccccttgtagaagataacgaggaagaatcatgctacattctccacagttcctcaaatgaagacaaaaccgaattcagtgggacgatccatgacattaactcctccctgattcttgaggcacccaaggggtttcgggacgagccctactttaaggaggaactggtggatgaaccattccttgacctgggtaagagctttcactctcagcagaaagagatcgagcaatctaaggaagcatgggagatgcacgagttcctcacgccccggctgcaggagatggacgaagagagagagatcctcgttgatgaagagtatgaactgtatcaggaccccagccccagcatggagctataccctctgtctcacatccaggaggctacccccgtcccttccgtgaatgagctccatttcggaacccagtggcttcacgacaatgagccgtctgagtcccaggaagcgaggacgggtcgtactgtgtattcccaagaggcccagccctacggatattgccccgaaaatgtgatgaaggagaattttgtgatggaaagtcttccatcggtgccttccacagaagggaactcgcaacaaggacggttcgacgatttggaaaatcttaatagtctggcaaaaacaagtctcgatttgggaatgattcctaatgatgtccagggcccctccctgctcatcgatctccccgtggtcgcacaaaggagagaacaggaggaccttcccctctatcagcatcaggccaccagggtgatctccaaggcctctgcttacacagggatgctgagttcacgatatgccaccgacacatgcgaactcccggagcgcgaagagggagagggggaggaaactcccaacttctcgcattggggtccgcctcgcatcgtggagatcttccgagagccaaatgtgagcttggggattagcattgtgggcggccaaacagttatcaaaaggttaaaaaacggggaagagctaaaaggtattttcatcaaacaagttttagaggacagcccggccggtaaaacaaatgctttgaaaaccggagataagatcctggaggtgagcggagtcgacttgcagaacgctagtcattctgaggccgttgaagcaatcaagaacgccggcaaccccgtagtttttattgtgcagtccctgtcgtccacacctagggtcatcccgaacgtacataacaaagcaaacaaaatcactgggaaccagaaccaggatactcaggagaagaaagaaaagcggcagggaactgccccgcccccaatgaagctcccaccaccttacaaggctcttactgacgactctgatgagaatgaggaggaggacgcattcaccgatcagaaaatcaggcagagatacgcagatttaccaggtgagcttcacattatagaacttgagaaggacaagaacggactgggcctgagtctcgcaggcaataaggatcgtagccggatgtctatctttgtagtcggcatcaaccctgaaggccccgccgctgcagacggacgcatgcgaataggagacgagctcttggagattaataaccagatactctacggtagaagccaccagaatgcctcagccataataaagactgccccatcaaaagtcaaactcgtctttattaggaacgaagatgccgtgaatcagatggcagtgacgccttttcccgtgccctcatcaagcccctccagcattgaagaccagagcggaactgaacccatatcgagcgaggaggacggctccgtcgaggtcggaatcaagcagctgcccgaaagcgagtcatttaagctcgcagtctcccagatgaaacaacagaagtatcccaccaaggtgagcttttcttctcaagaaatccccctggcccccgcgtccagttatcactctaccgacgcagacttcacaggctatgggggttttcaggccccgctgagtgtcgatccagccacttgcccaattgttccaggccaagagatgataattgagatttctaagggtagaagcggccttggactgagcattgttggcggcaaggacacacccctgttttggaggctgggatctcctcgagcctggtctcagcacctggtccgcgctttcatgctccaccatccagttaccgaagtcgagggccagaatgctatcgtcatccacgaggtttacgaggagggtgcagccgctagagatggaagactgtgggctggagatcagatccttgaggtcaacggggtcgacctccgcaactcctcacatgaagaagccatcacagccctgcgacagacaccccaaaaagtgcggctggtagtttatagggatgaggctcactacagagatgaagagaaccttgagatctttccagtggacctgcagaagaaagctggccgcggtcttggactgagcattgtgggaaagtag

SEQ ID NO: 191318 - DNA, 5406 bp, Artificial Sequence
  Description of Artificial Sequence: Synthetic coding sequence
atgcccgagaaccccgccaccgacaagctgcaggtgctgcaggtgctggataggctaaagatgaagctccaggaaaagggcgacacctcccaaaacgagaaactgtctatgttctatgagactctgaaatcccccctttttaaccaaatcctcacgctccagcaatctatcaagcaactcaaggggcagctgaaccacattccctccgattgcagcgctaactttgacttcagcaggaagggtcttcttgttttcaccgacgggtctattacaaatggcaacgttcatcgtccaagcaacaacagtactgtcagcggcttgttcccgtggaccccaaagctcggtaacgaagacttcaattctgtgattcagcagatggctcaagggaggcaaattgagtatatcgacattgaaagacccagcactggtggacttggattcagtgtcgtcgctctaaggtctcagaatctaggtaaagtggacattttcgtgaaggatgtacagcctggcagcgtggctgatagagaccagagactgaaggagaatgaccagatcctggccataaatcacacccccctcgaccagaacatctcgcatcaacaggcaatcgcactgctccagcagactacaggttcactgaggctgatcgtggccagagaacccgtccacactaaatcttcgacttcctcttctcttaacgacacaacactcccagaaaccgtatgctgggggcacgtcgaggaagtggagctgattaacgatgggagcggcctgggtttcggcatcgtgggcgggaaaacttctggggttgtggtgagaaccatcgtccctggagggctggccgatcgagatggccgactgcagacgggcgaccatattctgaagataggcggcaccaatgtccagggaatgacaagcgaacaggtggctcaggttctacggaattgcgggaacagtgtgcgcatgctcgtcgccagggatccagccggggatatctctgtaacacctcccgcccctgcagctttgccagtggccttacctactgttgcttcgaaaggccctggttccgattctagtctctttgaaacatacaacgtggagctggtacgtaaggatggccagtccctgggaatccgcattgttggatacgttggcacctctcatactggggaagcctccggtatctacgtcaaaagtataatccctggttctgctgcataccacaatgggcacatccaggttaatgacaaaattgtagccgtggacggcgtgaacatccaggggttcgccaatcatgacgtggtggaagtcctaagaaatgctgggcaggtcgtccacctgacactggtccgtaggaaaacttcatcttctacctctcccctggagcccccctcagaccgcggtacagtggttgagcctctgaagccaccagccctgttcttgacaggagctgtggaaactgagacaaatgtggacggcgaggatgaagaaataaaagaaagaattgatactctcaagaacgacaacatccaagcccttgagaagctggaaaaagtccccgatagccccgaaaatgaactcaaatctcggtgggagaatttgcttggacccgattatgaggtgatggtggcgactttggacacccagatagctgacgacgccgagctgcagaaatatagtaaactcctgcccattcatacattgagattaggggtggaagtggacagcttcgacggccaccactatattagctcaattgtttctggcggcccagtcgatactctgggactccttcagccagaagacgagttgctggaggtaaacggcatgcaactttatggaaagagtcggcgtgaagcggtaagttttctgaaagaagtgccccccccattcacactcgtttgctgtagacggctgttcgacgatgaagccagtgtggacgaaccacgacggaccgaaacctccctccctgaaacggaggtggatcacaacatggatgtcaacaccgaagaagatgatgacggggagcttgccctttggtctcccgaggttaagatcgtggaactggtgaaagactgtaagggtctcggattcagtatcctcgattatcaagatcccctcgaccccacacgctctgtgattgtgattcggtccctggtagctgacggtgtggcggagcggtcaggaggattgttacccggcgaccggctggttagcgtgaatgagtattgtctggataacacttccctggcagaggcagtggaaatcctcaaggccgtcccccctggtctcgtgcacttagggatctgtaaaccactggtagaagataacgaggaggaatcgtgttatatactccatagctccagcaacgaggataagaccgaattctccggtactattcatgatatcaactcatcactcattctggaagccccaaaagggtttcgagacgagccgtatttcaaagaagagttggtggacgaaccattcttagacctcggtaaatcgtttcattcacagcagaaagagatagagcagtcaaaggaagcgtgggagatgcatgagtttctgacccctagactgcaggagatggatgaggaacgggaaattctggttgacgaggaatacgagctctatcaggacccgagcccctcgatggaactgtacccacttagccacatccaggaagccaccccggtaccttcagtgaacgagttacattttgggacacagtggctacatgataatgagccctccgaaagtcaggaggctaggactggtagaacagtgtactcacaagaagctcagccgtatgggtactgtccagagaatgtaatgaaggagaatttcgtgatggagtctctgccgagtgtgccatccaccgagggcaattcgcagcagggcagatttgatgacctggagaaccttaattctctcgcaaagaccagtctggatttgggaatgataccaaacgatgtgcagggaccaagcctgctgattgatttaccagtggtagcgcagcggcgagaacaggaagacctcccgctgtaccaacaccaggccacacgagtgattagtaaagctagcgcctacactggaatgcttagctcccggtacgccacggacacatgtgaactgccggagagagaggaaggagaaggagaggagaccccaaactttagtcactggggaccgccgcggatcgtggaaattttcagggaaccgaacgtgtcccttggcatcagcatcgtgggcggtcagacggtcattaagcggttgaagaacggcgaggaactgaaaggaatcttcatcaagcaagttctcgaagattcccctgcaggtaaaactaacgctctgaaaacaggagataagatactggaggtctccggggtggatttacagaatgcaagtcactccgaagcagtggaagccatcaagaatgccggcaaccccgtcgtgttcatcgtccaaagccttagcagcacgccccgcgtcattcccaatgtgcataacaaagcgaataaaattactggcaaccagaatcaggacactcaggagaaaaaggagaaaaggcagggtacagccccgccccctatgaagcttccccccccatacaaagccctgacagacgactccgacgagaacgaggaggaggacgccttcactgatcaaaagattaggcaaagatacgccgatctccctggagagctgcacattattgagctcgaaaaagacaagaatggcttgggccttagtctggccggtaacaaagaccggagccggatgagtatcttcgttgtgggaataaacccagaaggcccggctgcagcggatggccgaatgcgcattggagacgaactgctcgaaatcaataatcagattctctacggcagaagccaccagaatgcttctgctatcattaagacagcaccgagcaaagttaagctcgtttttataaggaatgaggacgcggtgaaccagatggccgtgacaccgtttcccgtgcctagtagcagcccaagcagtatcgaagatcagtcgggcacagagcccatatcgagtgaggaggatggctctgtagaggtagggatcaaacagctccccgagtcagaaagctttaagctcgccgtcagccaaatgaaacagcagaagtatcctacgaaggtgtccttttcttctcaggagataccactggcacccgcctcgagctaccactccacggatgcagattttacaggttacggggggttccaggcgcccctgtcagtggacccagcgacctgtccaatcgttccgggacaggagatgatcatcgagatttcaaaagggcgaagcggccttggcctttcaatcgtgggagggaaggacacgcccctgaatgccattgttatccacgaggtgtacgaggagggagcagcagcccgggacggtagattgtgggccggcgatcaaattcttgaggttaatggagtagacctgaggaacagttcacacgaggaggctattactgccctgcgccagactcctcaaaaggtccgcttggtagtgtacagagatgaagcccactaccgcgacgaagagaacttggaaatcttccccgtcgacctacagaaaaaggcaggacgggggctgggcctttctatagtgggaaaacgcaacggcagtggcgtttttatctccgacattgtgaaaggcggggccgctgacctggacggccgcttgatacagggagaccaaatactgtcagtcaacggtgaggatatgagaaacgcttctcaggagactgtagcaactattctgaaatgcgctcagggcctcgtccagctggagattggaagacttcgcgcaggcagctggacaagtgcaaggacaacatcccagaactcacagggctcgcaacagtcagcacatagcagctgtcacccatccttcgcccccgtcatcactgggctccagaacttggtgggtactaaacgagttagcgatccaagccaaaagaattcaggaaccgacatggagccaaggactgtggagataaatcgcgagctgtccgacgccctgggaatctccattgcaggggggagaggcagccctctgggtgacattccagtgtttattgctatgatccaagcgtctggggtggcagccagaacccagaagctgaaagtgggagaccggattgtttctattaatggacagccattggatggccttagccacgcggatgtggtgaatcttctgaagaatgcctacgggcggattatcctccaggtggtagccgacacaaacatttcagcgatcgccgctcagctggagaacatgagcaccgggtaccatctggggtcccctacggctgaacaccaccctgaggacactgaggagcagttgcagatgacggccgattag

SEQ ID NO: 191319 - DNA, 4572 bp, Artificial Sequence
  Description of Artificial Sequence: Synthetic coding sequence
atgcccgagaaccccgccaccgacaagctgcaggtgctgcaggtgctggaccgcctcaagatgaagctccaggagaaaggggatacctcccaaaacgaaaaattgtctatgttctatgaaactcttaaatcccctctgtttaaccaaatcctcactttgcagcaatctataaagcagctgaaaggccagctcaaccatatcccttccgattgtagtgccaactttgacttcagcaggaagggactgctagttttcaccgacgggagcattacaaacggcaacgtgcaccggccatccaacaactcgacagtcagcggcctctttccctggacgcccaagctgggcaatgaagatttcaattctgtgattcagcagatggcgcagggaaggcagatcgaatacatcgatattgagcggcctagcacgggaggcctgggatttagcgtggtcgccctgcgctcacagaatctgggtaaggtggacatttttgtcaaagacgtgcagccaggttcagtagctgaccgcgatcaacgtctcaaggaaaacgatcaaatccttgctattaatcatactccattagaccagaacatcagtcaccagcaggctattgcactgctccagcagacaacagggtccctcagactgattgtggcccgggaaccagtccacaccaagtctagtacttcctcctccctcaatgacaccactctccccgaaacagtgtgttggggacacgttgaagaggttgaactaattaatgacggctctggccttggtttcgggattgtaggagggaagactagcggcgtggtggtgcggaccatcgtgccgggaggactcgctgacagagacggcaggctccaaacgggcgatcacatcttgaagatcggaggcacaaacgtccagggcatgactagcgagcaggttgctcaagtactgcggaattgcggtaattccgtgagaatgctggtggcgagggaccccgcaggagatatcagcgtcacaccccccgctcccgccgccttgcccgtggccctaccgacagtagccagcaagggacccggatcagattcctccttgtttgaaacgtacaacgtagagttagtccgaaaggacggacagtccctagggattcggatcgtgggctacgtgggcacttctcatacaggagaggcgtcagggatctatgttaagtcaatcattcccggttccgccgcataccacaacggccacatacaggtcaacgacaagatagtggcagtcgatggcgttaatatacaaggatttgccaatcatgatgtagtggaggtgctcagaaacgccggtcaggttgtgcacctgactctcgttcggaggaagacgagttcttctacaagcccgctggagccccccagcgataggggcacagtggtggagccgctgaaaccacctgccctgtttcttacgggagcagtggaaaccgagaccaatgtcgacggtgaagacgaggagattaaggaacgcatcgacacgttaaagaatgataatatccaagcactcgaaaagcttgaaaaagtaccagattccccagagaatgagctcaaaagtcgttgggaaaacctgcttggtcccgattacgaagtcatggtcgcaaccctcgatactcagatcgccgatgacgcggaactccagaagtatagcaagttattacctattcacaccctccggctcggagtggaggtggactcttttgacggacatcactatatttccagtatagtgtccggtggccccgtggacactcttgggctgctccagcccgaagacgaactgttggaggtaaatggcatgcagctgtatggaaagtcccggcgcgaggccgtgagtttcctgaaggaggttcctccccctttcacacttgtttgctgccgtaggctgttcgacgacgaagcttccgtagacgagcctagacgtaccgagaccagcctgcccgagactgaggtggatcataacatggacgtgaacacagaggaggacgacgatggggaactcgcgctgtggtcccctgaagtgaagatcgtggagttagtgaaagattgtaaaggactgggattctcgattcttgattatcaggacccactcgatcccacaagaagtgtaatagtgatacgatcactggtggctgatggtgtcgccgaaagatctgggggacttctccctggtgatcggcttgtcagcgtgaatgagtactgcctggataatacaagcttggctgaagctgtcgagatcctgaaagctgtgcccccaggactggtgcacttaggcatctgcaaaccgctcgtcgaagataacgaggaagaaagttgttacattctgcatagttctagcaatgaggacaagactgaattttctggtaccattcacgatataaactctagcctcattctcgaggcccctaagggcttcagggacgaaccctatttcaaggaagagctcgtcgacgaacctttcctggatctggggaaatccttccacagtcagcaaaaggagatcgagcaaagtaaagaggcgtgggaaatgcacgaattccttacccctcgcctgcaggaaatggatgaggagcgggaaatccttgttgatgaagagtatgaattgtaccaggaccccagcccgtctatggagctttaccctctgagccatatccaagaggccacgccggttccttccgttaatgaactgcatttcgggacccagtggctgcatgataacgaaccaagcgagtcccaggaggcaagaacaggtcgcactgtctattctcaggaggcacaaccatatggatattgcccagagaatgtgatgaaagagaattttgtgatggagtctttacccagcgtgccttcaacggaaggcaattcccagcagggccgcttcgatgacctagaaaacctgaacagcctggctaagacttctctcgacctcgggatgattcctaacgatgtgcaggggcccagcctgttgattgacttacccgtggttgcccagcgccgggaacaggaagacctcccgctttaccagcaccaggcgactagagtgattagcaaagcgtcagcatataccggtatgctctcctcacgctacgccacggatacatgtgagctgccagaacgggaagaaggggagggggaagagaccccaaatttcagtcactggggacctccaagaattgttgaaatctttagagagcccaatgttagtctcggcatttcaattgtaggaggacagacagtgattaagagattaaaaaacggggaagaactgaagggcatatttattaagcaagtattggaagatagcccagcaggtaagaccaacgctctgaagaccggggacaaaatcctggaagtctctggggtggacttgcagaatgcttcccacagcgaggctgtcgaggccataaagaatgcgggaaatcctgtggtgttcattgttcaaagcctttcgagcactcctagggttattccaaacgtacataataaggccaacaagattacaggaaaccagaaccaggatacccaggagaagaaggaaaaacgccaagggaccgcccctccacctatgaaactcccacctccctacaaagcacttacagacgactccgacgagaacgaggaagaggacgctttcactgatcagaagattcggcaaaggtacgcagacttaccaggggaactccatataatcgaactggaaaaagacaaaaatggattaggcctcagcctggcgggaaataaggaccggagtagaatgagtattttcgtcgtcgggataaacccagaaggaccagccgccgcggacggaagaatgcggataggcgacgaattgctcgagattaacaaccagatactctatgggagaagtcaccaaaatgcttcagctattatcaagacggctccttcaaaggtgaagctggtcttcatacgcaatgaggacgcagtgaaccaaatggcagttactccattccctgtgcccagctctagcccgagcagtatcgaagatcaaagcgggactgagcctatctccagcgaggaggacggcagtgtggaggtaggtatcaagcagctgcctgaatcagagtccttcaagctggcagtgagtcagatgaaacagcagaagtaccctaccaaggtctcattcagttcccaggagattcctctggcccccgcatcgagctaccattcgactgatgccgatttcaccggttatggtggatttcaggctcccctctccgtggatccagccacctgccctatcgtccccggacaggaaatgataatcgaaatttctaagggcagaagcggacttggactcagcatcgtaggcgggaaagatacccccctcgtcaacggcgtggacctgcggaatagcagtcatgaagaggcaatcacagccctgcgccagaccccacagaaggtgagattggttgtgtatagggatgaggcccattacagggacgaggagaaccttgaaatcttcccagtggacctccagaaaaaggccggccgaggcctggggctgtcaatcgtcgggaagtag

SEQ ID NO: 191320 - DNA, 1359 bp, Artificial Sequence
  Description of Artificial Sequence: Synthetic coding sequence
atggtgcagggcggcttccccgagaagatccggcagcggtacgccgatttgcctggagaactgcacattatcgagcttgaaaaggataaaaacggcctgggcttatctcttgccggcaacaaagaccgatcccgtatgagcatctttgttgtaggaatcaacccagaaggtcccgccgccgctgatggccgcatgagaatcggggacgagctgctggaaatcaataatcagatcctgtatggcaggtctcaccaaaatgcctctgctataatcaagacagcacccagcaaggtgaagctcgtctttattcggaacgaggacgccgtaaatcagatggcagttactccctttcctgtgccaagctcaagcccatcaagtattgaagatcagtctggcacagagcctattagctccgaagaggatgggagcgtagaggttgggattaaacaactgccagagagcgagtcattcaaattagcggtctcccagatgaagcagcagaagtaccccactaaagtgtccttttcatcccaagagatccctttggccccggcctcctcttatcactccacggacgctgactttacaggctacggcggattccaggccccactttccgtggatcccgctacctgtccaatcgtacctgggcaggaaatgataatcgaaatcagcaagggacggtcgggcctcgggttatctatcgtggggggtaaggacacacccttattttggaggctggggtctccacgggcctggagccaacacttggtcagggcctttatgcttcaccaccctgtgaccgaggtagaggggcaaaatgcaatcgtcatccatgaagtatacgaggaaggagctgccgctagggacggaagactctgggcaggcgatcagatactcgaagttaacggtgtcgatctccggaattcaagtcacgaagaagccattacggccctgcgtcaaaccccgcagaaggtaagactggttgtttatcgagatgaggcgcattacagagacgaggagaacctggaaatcttcccagtggacctccaaaagaaggcgggcagggggcttggtctctctatcgttggaaaacggaatgggtctggcgtgttcatctccgatattgtcaaagggggagcagccgaccttgacggcagactgatccagggagaccagattctgagcgtcaacggagaggatatgaggaacgcctcgcaggagaccgtggcaacgatcttgaagtgtgcccagggtctggtgcaattagagatcggaagactccgcgcaggatcatggacatcggcccggaccacctcccagaacagccaggtcgtggatggtttttccagcgattag

SEQ ID NO: 191321 - DNA, 594 bp, Artificial Sequence
  Description of Artificial Sequence: Synthetic coding sequence
atggccgtgacccccttccccgtgcccagcagcagccccagcagcatagaagatcaatccggcactgaacctatcagcagcgaggaagacggtagtgtggaagtgggcattaaacaattgcccgagagtgagagcttcaaactggctgtcagccagatgaagcaacaaaagtatccaacaaaagtgtcctttagcagccaggaaatacctctggccccagcttccagctatcattcgacagatgccgacttcaccggttacggcggcttccaggcacccctctccgtggatccagctacatgtccaatagtgccaggacaggagatgatcattgagattagcaaaggaaggtccggcctcgggctgagtatcgtcggagggaaggatacacctctggtgaacggggtcgacttgcgtaattcctctcacgaggaggcaatcacagccctccggcagacaccccagaaagtgagactggtagtttacagagacgaagcccactaccgggatgaggagaatctggaaatatttcctgttgatctccaaaaaaaagcaggtagaggcctggggcttagcatcgttgggaagcgctag

SEQ ID NO: 191322 - DNA, 1236 bp, Artificial Sequence
  Description of Artificial Sequence: Synthetic coding sequence
atgagccccgcccggctgcggccccggctgcacttctgcctggtgctccttctgcttctcgtcgtgcccgccgcatgggggtgcgggcctggccgcgttgtcggctcccgtcgcaggccaccgaggaagctcgtccccttagcgtataagcagttcagtccgaatgttccagaaaaaaccctgggagcatccgggagatatgaggggaagatagctagatcttctgagcgatttaaagagctgacccccaactacaatcctgacattattttcaaggacgaggaaaacacgggtgcagatcgcctgatgacccagaggtgcaaggataggcttaactcactggctatctctgtgatgaaccagtggcctggcgtcaaactgagggtgaccgaggggtgggacgaggacggacaccattcagaggaaagtctgcactacgagggtagggccgtggatattacaacgagcgacagggacagaaataagtatggactgctcgccaggttggccgtggaagctggcttcgattgggtctactatgagtctaaagcccatgtacactgtagcgtgaagagtgagcatagtgcagccgccaagaccggagggtgtttccccgctggagctcaggttcgactggagagcggtgccagagtcgctctctctgcagtgagaccgggcgaccgcgtccttgccatgggtgaggatgggagcccgacattttccgacgtcctaatcttcctagaccgtgaaccacaccggctgcgggcttttcaggttatcgagactcaggacccaccaaggcgcctagcgctgacacctgcccatctgctgttcacagcagataaccacactgagcccgccgctagattcagggcaaccttcgcctctcacgtgcagcccggccagtatgttctggtggccggggtgccaggtctccaaccggcaagggtggccgcggtgagcacacatgttgcactaggggcttatgcccccctcactaaacacggcaccttggttgttgaagacgtggtggcctcatgcttcgctgccgttgcagaccatcatttggcccagcttgctttctggccgctacgcctgttccacagcctggcatgggggtcttggacccctggcgaaggcgtgcactggtacccccagctcctgtatcgtctggggaggctgctgctcgaagaggggagcttccaccccctggggatgtcaggagcgggctcatag

SEQ ID NO: 191323 - DNA, 1212 bp, Artificial Sequence
  Description of Artificial Sequence: Synthetic coding sequence
atggcccacgccatggagaacagctggaccatcagcaaggagtaccacattgacgaggaggttggatttgcccttcctaaccctcaggaaaacttaccagatttctacaacgactggatgttcatagcgaaacacttacccgatttaatcgaatcggggcaacttcgggaaagggtcgagaaacttaacatgctgagcattgaccacttgactgatcacaagtcacaaaggctggcaagattggtgctggggtgtatcaccatggcatacgtgtggggaaaaggccatggcgatgtgcgcaaagtcctgcctcgaaacatcgctgtgccctattgtcagttatctaaaaagctggagctgccccctattctggtgtatgccgattgtgtcctcgccaattggaaaaagaaggatccgaataagcccctgacgtatgaaaacatggacgtcctcttctccttccgtgacggcgactgctctaaaggcttctttctggtgtctctgctggttgagatagcagcagcttccgccattaaagttattccaacagtgtttaaggccatgcaaatgcaggaacgtgatactttgctgaaagcactgttggaaatcgcatcttgcctggaaaaggctctacaggttttccatcagatccacgatcacgtgaatcccaaagcctttttcagtgtgttgagaatctatcttagcgggtggaaaggaaaccctcagctgagtgacgggctcgtgtatgaagggttttgggaggatcccaaggagtttgctggggggtcagcaggacaatcaagcgtgtttcagtgcttcgacgtcctgctgggaatccagcaaactgctggtggtgggcacgctgctcaattcctccaggacatgcgtcgctacatgccaccagcccacaggaattttctgtgttccctcgagagcaacccctccgtgcgggagttcgtgctgagtaagggagatgcagggcttcgcgaagcatatgacgcatgtgtgaaagccctggtaagcctgcgctcataccatctgcagatcgtgacaaagtatatcctgatccccgcatcacagcagcccaaggagaacaagactagtgaggacccgtccaagttggaagccaaaggtacaggcggaaccgacctgatgaatttcttaaaaacagtcaggtcgacaactgaaaaaagcctgctgaaggaaggctag

SEQ ID NO: 191324 - DNA, 237 bp, Artificial Sequence
  Description of Artificial Sequence: Synthetic coding sequence
atggcccacgccatggagaacagctggaccatcagcaaggagtaccacattgacgaagaagtgggttttgcactgccgaatccccaagagaacctccctgacttctacaacgattggatgttcatagcgaagcacctccctgacctcattgagtctggtcaactgcgtgagcgggtcgagaagctcaatatgctgtccattgatcacttgaccgaccacaaaagtcaacgcctgtag

SEQ ID NO: 191325 - DNA, 543 bp, Artificial Sequence
  Description of Artificial Sequence: Synthetic coding sequence
atggcccacgccatggagaacagctggaccatcagcaaggagtaccacattgacgaagaggtcggctttgccctgccaaacccccaggaaaatttgccagacttctacaacgactggatgttcattgccaaacacctccccgacttaattgagtccggacagctgcgcgaaagggtggagaagctgaacatgctcagcattgatcacctgacagaccataagagccagagactggcgaggctggtcctgggttgtatcaccatggcctacgtttggggcaaaggccacggcgacgtgaggaaagtccttcctaggaacattgccgtgccttattgtcagctctccaaaaagctggagttgccacctatcctcgtgtacgccgattgtgtgctagcgaactggaagaaaaaggatcctaataagcccttaacgtatgaaaatatggacgtgctgttctctttcagagatggcgactgcagtaaaggattttttctcgtcagcctactggtggagatcgcagctgcctctgccatcaaagtgtag

SEQ ID NO: 191326 - DNA, 1212 bp, Artificial Sequence
  Description of Artificial Sequence: Synthetic coding sequence
atggcccacgccatggagaacagctggaccatcagcaaggagtaccatattgatgaagaggtcggcttcgctctgccaaaccctcaagaaaacttacccgacttttacaatgactggatgttcatcgccaaacatctgcctgatctaattgagtcagggcaattgcgtgaacgggtcgagaaactgaacatgttgagcattgaccatctcacggaccataagagtcaaaggctggcccggctggttctgggatgtattacgatggcctatgtgtggggcaagggccacggcgatgtgcgcaaagtgctgcctcggaacatagcagtgccctactgtcagctgagtaagaaacttgaacttccaccaatcctcgtgtacgctgactgcgtgctcgccaattggaaaaagaaagaccccaacaagcccctcacttacgaaaatatggatgtcctgttctctttcagggatggtgactgctcaaagggctttttcctagtgtcgttactcgttgaaattgctgccgcatcagcgatcaaggttattccgaccgtctttaaagcaatgcagatgcaggaacgggacactctgctcaaggccctgctggagatcgccagctgtctggagaaagcccttcaagtcttccaccagatccacgatcacgttaacccgaaggcgttcttttcagtgttacggatttacctttctggttggaagggtaatcctcagctatcggatggattggtctatgaggggttttgggaagaccccaaggagttcgccgggggcagcgctggccaaagctcagtcttccagtgctttgatgttctgctgggcatccagcagaccgctggcggaggacacgctgcccagttcctgcaagacatgcgacgctacatgccaccagcccaccgcaatttcctgtgctctttagaatcgaatccatctgtaagggaattcgtgcttagcaagggggacgctggactccgggaagcttatgatgcttgcgtcaaggcacttgttagcctgaggagttaccatctgcagattgtgacaaaatacatcttgatcccggctagccaacagcccaaggagaacaaaacgtctgaggaccctagcaagctggaagctaaagggacaggcggtaccgacctcatgaatttcctgaagacggtgcggagtaccacggaaaagtcattactaaaggagggctag

SEQ ID NO: 191327 - DNA, 144 bp, Artificial Sequence
  Description of Artificial Sequence: Synthetic coding sequence
atggcccacgccatggagaacagctggaccatcagcaaggagtaccacatagacgaggaggtgggtttcgctctgcctaatccacaagagaaccttccggatttctacaacgattggatgttcattgccaaacatctgccttag

SEQ ID NO: 191328 - DNA, 1224 bp, Artificial Sequence
  Description of Artificial Sequence: Synthetic coding sequence
atggagccccaccggcccaacgtgaagaccgccgtgcccctgagcttggaatcctatcacatcagcgaagagtatgggttccttttgcctgacagcctgaaagaattacccgatcattatcgaccatggatggaaattgccaataaactgccacagctaatcgatgcccatcagttgcaggcgcacgtagataagatgcccttacttagttgtcagttcttgaaaggccatcgagaacagcggctggcccaccttgtgttgagcttccttaccatggggtatgtgtggcaagaaggcgaagcccagcctgcagaggtcctgccacggaacttggcactccccttcgttgaagtgtcacgaaacctagggctgcctcccatcctggttcacagtgacctggtcctgacaaactggacaaagaaggatcctgacggctttctagagatagggaacctggagaccattatatctttccctggaggagagtcactgcatggcttcattttggtgaccgccctggttgagaaagaggcagtgcctggtatcaaagctctggtccaggccaccaacgctatcttacagcctaatcaggaagctctccttcaagccctacagcgtctgaggttaagcattcaggatattactaagaccctgggtcagatgcacgactacgtggaccccgacattttctacgcgggaatacgcatcttcctgtcgggctggaaggacaacccggccatgccagctgggttaatgtatgagggagtctcacaagaacctcttaaatactctgggggcagtgctgctcaaagcaccgtactgcatgctttcgacgagttcctgggaatcagacacagcaaggaaagcggcgattttttatatagaatgcgcgattacatgcctccctcccataaggcttttatagaggacatccattcagcaccgagcttgagggactacattctctcctctggccaggatcatctcttgactgcgtataaccaatgcgtccaggccctggccgaactcaggtcataccatataactatggtgactaagtatcttataactgcggcggccaaagcgaaacacggtaaacccaaccatcttccaggacctccacaggcgctcaaggacagaggtaccggaggaactgctgtgatgtccttcttaaagtctgtaagggacaaaacgctcgaaagcatcctgcaccctaggggatag

SEQ ID NO: 191329 - DNA, 1263 bp, Artificial Sequence
  Description of Artificial Sequence: Synthetic coding sequence
atgctgcacttccactactacgacaccagcaacaagatcatggagccccacaggcccaacgtcaagactgctgtccccctgtctcttgagagctaccacatctcagaggagtacggttttctgctgccagactctttaaaagagttaccagaccactaccgaccttggatggagatcgctaacaaacttccccagcttattgacgcccaccaactgcaggctcacgtggataagatgcctttactgagctgccagtttctcaaaggccaccgggagcagcgacttgctcatcttgtgctgtcctttctaactatgggatacgtttggcaggagggggaggctcagcccgccgaggtgctgccacggaacctcgccttgccttttgttgaggtatcccgcaacctcggcttgcctcccattctggtccactccgaccttgtgctgacaaactggaccaaaaaagaccccgatggcttcctcgagattggcaacctagaaacaatcatctctttccccggaggcgaatccctgcatggattcatcctggtcaccgctttggtagaaaaggaggccgtgcctgggattaaggcactggtccaagcgacaaatgccattcttcaacctaaccaggaggccctgcttcaggccttacagaggctgcggttatccattcaagatattactaaaaccctgggccagatgcacgactacgttgatccggatatcttttacgcagggatccgtatcttcctgagtgggtggaaagacaaccctgccatgcctgcaggattgatgtatgagggagtgtcacaagagcctttgaagtatagtggcggatccgcagctcagagcaccgtgcttcacgcctttgatgaattcctgggaattcgccattcgaaggagtctggcgactttctctaccgcatgagggattacatgcccccgagccacaaggcttttatagaggacattcactccgccccatcacttcgagattatattctctcatctggccaggatcatctgttaactgcttataatcaatgtgtgcaagccttggcggagttgagatcctaccacattacaatggtaacaaaatacctgatcacagccgcagcaaaagcaaagcatgggaaacctaaccatctgccggggccaccacaggccctcaaagaccgtgggaccggtggcaccgccgtgatgtcctttttaaagagcgtccgtgataaaactctcgaaagcatcttgcacccccgagggtag

SEQ ID NO: 191330 - DNA, 792 bp, Artificial Sequence
  Description of Artificial Sequence: Synthetic coding sequence
atgaagggcggcttcaccggcggcgacgagtaccagaagcacttcttgcctagagattacctggccacctactattcatttgatgggtcccctagtcctgaggcggagatgctgaagtttaacctggagtgccttcacaagaccttcggcccaggtgggctgcagggggatacccttatcgacattgggtcaggacccaccatataccaggtgttagcggcctgtgattcatttcaggatatcacactcagcgacttcaccgatcggaacagagaagagctggaaaaatggcttaagaaagaaccgggggcatacgactggaccccagctgtcaagtttgcatgcgaacttgaggggaattcggggcgctgggaggagaaggaagaaaagctgcgtgcagctgtaaaaagagtgttgaagtgcgatgtccacctgggcaaccctctggctcctgcagtacttccgctggccgactgcgtgctgacccttctggctatggaatgcgcctgttgctcgttggacgcctatcgggcagccctctgcaatttggcctctcttctgaaaccaggtgggcaccttgtcacaaccgttactctccgcctgccctcctacatggtaggcaaacgcgagttctcttgcgtggctcttgaaaaagaagaggtagagcaagctgtgttggatgctgggttcgacattgagcagcttttgcactctcctcagtcttattccgtgactaatgccgcgaataatggcgtttgtttcattgtggccagaaagaagcccggcccttag

SEQ ID NO: 191331 - DNA, 789 bp, Artificial Sequence
  Description of Artificial Sequence: Synthetic coding sequence
atgaagggcggcttcaccggcggcgacgagtaccagaagcacttcctgcctcgcgactacttggctacttattacagcttcgacggatccccatccccagaagcagaaatgttaaaatttaatttagagtgcctgcacaaaacatttggaccgggactgcaaggggacacgctgattgatataggatcaggcccaacaatatatcaggtgttggccgcctgtgattcctttcaggatattacgctgagtgatttcactgataggaatcgggaggaactagagaaatggctcaagaaagaacctggggcctacgattggactcccgcggttaaatttgcatgtgagctggagggtaacagcgggcgatgggaagagaaagaagaaaaactccgagctgccgtgaaaagagtcttgaaatgtgatgtccatctcggaaatccgctcgcacctgctgtcttaccactggctgactgcgtgttgaccttgctggcaatggagtgtgcatgctgctccctcgacgcatatagagctgcgctctgcaacctggccagtctgcttaagcccggaggccacctggtgacaactgtaacgcttcgcttacctagttacatggtgggcaagagggaattctcttgtgtagccttggagaaggaggaagtcgagcaggctgtccttgatgccggctttgacattgaacagctgctccatagtccccagtcttattccgtgaccaatgcagccaataatggcgtctgtttcattgttgcacgcaaaaagccagggccatag

SEQ ID NO: 191332 - DNA, 600 bp, Artificial Sequence
  Description of Artificial Sequence: Synthetic coding sequence
atgaagagcggcctgtggtacttcttcctgttctgcctgcggatcaaagtgcttacaggtgaaattaacgggagtgctaactatgagatgttcatattccataatggcggtgtacagatactttgcaaatacccagacatcgtgcaacagtttaaaatgcaactgctgaaaggcggccagattctgtgcgacttgaccaaaaccaagggctctgggaataccgtgtcaattaaatcattgaaattttgccactcccagctctctaataattcagtcagctttttcctctacaacctcgaccactctcatgccaattactacttctgtaatctgtctatcttcgatcccccaccctttaaggtaaccctgactggggggtacctgcacatttatgagtcccagctctgctgccagctgaagttttggctgcctattggctgcgccgcctttgtcgttgtctgtatactgggctgcattcttatttgctggcttaccaaaaagaaatatagctcatcagtgcacgaccctaacggagagtacatgttcatgcgagctgttaacaccgccaaaaaaagccggctaaccgatgtcacgctgtag

SEQ ID NO: 191333 - DNA, 507 bp, Artificial Sequence
  Description of Artificial Sequence: Synthetic coding sequence
atgaagagcggcctgtggtacttcttcctgttctgcctgcggatcaaagtgctcactggcgaaatcaatggcagcgcaaattacgagatgtttattttccataacgggggcgtacagatcctgtgcaaatatcctgacatcgtgcagcagttcaagatgcagttgctgaaagggggccaaatcctttgcgatcttaccaaaactaaggggtctgggaataccgtgagcattaagtctctgaaattctgtcatagccagttgagcaacaatagcgtgagtttcttcctttacaatctcgatcacagccacgcgaactactatttctgtaacctctctatctttgatcctcccccctttaaagttacactgactggagggtacttacatatctatgaaagccagctgtgctgccagctgaagttctggttgccgataggatgcgccgcatttgtagttgtctgtatcctggggtgcatcctcatctgctggctcacaaagaaaatgtag

SEQ ID NO: 191334 - DNA, 930 bp, Artificial Sequence
  Description of Artificial Sequence: Synthetic coding sequence
atgcggctgggcagccccggcctgctgttcctgctgttcagcagcctgcgcgctgatacccaggagaaagaagtcagggctatggtgggatcagacgtagagctgtcttgtgcctgtccagaggggagccgattcgatctcaacgatgtctacgtgtactggcagacgtctgagagcaaaacagttgtaacctaccatattccccagaattcctcgctggaaaacgttgattcacggtaccggaacagggctttaatgtcccccgcaggaatgctccgcggggacttctccctcagattgttcaatgtgacaccccaagacgagcagaagttccactgcctggtgttgtcccagtcactcgggtttcaagaggtcctatccgtagaggttacactgcacgttgcagcaaattttagcgttccggtcgtttctgctcctcactctccatcccaggatgaattgaccttcacttgtacatccataaatggatatcctagaccaaatgtctattggatcaacaagaccgataattctctgctggatcaggcgctgcagaatgatacagtcttcctcaacatgcggggcttgtacgacgtggtcagcgttctgcgtattgcaagaaccccttctgttaacattggctgttgtattgagaacgtattactgcaacagaatctgacagtgggttcccagacaggcaacgacataggagaaagggacaagataacagaaaaccccgtgtctacaggcgagaaaaatgcagccacctggtccatacttgccgtgctctgtctcctggtggtggtggcagttgcaattggatgggtttgtcgcgataggtgtctgcaacactcctacgctggagcttgggcagtctcccccgagacagagctcacggagagctggaatctacttctgctcctctcctag

SEQ ID NO: 191335 - DNA, 558 bp, Artificial Sequence
  Description of Artificial Sequence: Synthetic coding sequence
atgcggctgggcagccccggcctgctgttcctgctgttcagcagccttcgagccgccaactttagcgtacctgtcgtgtccgcccctcatagcccatcccaggacgagctgacctttacttgtacttctatcaatggctaccctaggccgaacgtttactggatcaacaagaccgacaacagtctgctggaccaagctctgcaaaatgacacggtatttctcaatatgcgcgggttgtatgatgtcgtgtccgtcctgagaatcgccagaacgccatctgtgaatatcggctgctgcattgaaaacgtcctcttacagcagaaccttacagtaggatcccagactgggaatgatattggggagcgcgacaagattactgagaatccagtgagtactggtgagaagaacgccgccacctggagcattctggctgtcctgtgtctcctggtcgtggtggctgttgccattgggtgggtgtgccgcgaccggtgtttacagcacagttacgccggcgcatgggccgtgtccccagagactgaactgacagggcacgtgtag

SEQ ID NO: 191336 - DNA, 909 bp, Artificial Sequence
  Description of Artificial Sequence: Synthetic coding sequence
atgcggctgggcagccccggcctgctgttcctgctgttcagcagcctgcgggccgatacccaggagaaagaagtcagagccatggtgggctctgacgttgagctgagttgtgcttgtcctgaaggctcacggttcgatttaaacgacgtgtacgtgtactggcagaccagtgagtcaaagaccgtggtgacatatcatatccctcaaaacagctccctagaaaatgtggattcacgttaccggaaccgggcactcatgtccccggctggcatgctgcgcggcgatttttctttgaggctgtttaacgtgactccacaagatgaacaaaagttccattgcctggtcttgtctcagagtctgggctttcaggaagtccttagcgtggaggtaaccctgcacgtggctgccaacttttccgtgccagttgtttccgcaccgcacagtccgtctcaagacgaattgacttttacctgcacctctatcaacggttatcctaggcccaatgtgtattggattaataagacagacaattcactcctggaccaggccctgcagaatgacactgtcttcctcaatatgagaggtctgtacgatgtcgtgtccgtcttgcgcattgccagaactcctagcgtgaacattggctgttgcatagagaacgttctcctccaacagaacctgactgtgggatctcaaacaggaaatgacatcggtgaacgagacaaaataacagagaatcctgtctctactggggagaagaatgccgcaacatggtccatcctggcggtgttgtgcctgctggtggtagtggccgttgccattgggtgggtttgtcgggatcgatgtttacaacacagctatgctggtgcgtgggcggtatctcccgagacagaactaacaggccatgtgtag

SEQ ID NO: 191337 - DNA, 1101 bp, Artificial Sequence
  Description of Artificial Sequence: Synthetic coding sequence
atggtgctgcacctgctgctgttcctgctgctgaccccccagggcggccacagctgccagggcctagagctcgcgcgggagttagtacttgcaaaggtgcgggctcttttcctggacgcactcggcccgccggctgttacccgggaaggtggggatccaggagtaagaaggctcccgcggcgacacgccctcggtggcttcacccatagagggtctgaacccgaagaggaagaagatgtgtcacaggctattctcttcccagccactgatgcaagttgcgaggataagtcggcagcacgcggcctcgcccaggaggctgaagaagggctctttagatatatgtttagaccgtctcagcataccagatcccgccaggtaacctctgctcagttatggttccatacaggcctggaccgacaggggaccgcggcgtccaactcttctgagccgctgctcggtctcttggcactcagccctggcggccccgttgcagtgccaatgagtttgggtcacgctccacctcactgggctgttctccatcttgcgactagcgccctgagccttctcacccatccagtactggtactcctccttagatgtcctctctgcacatgcagcgcccggcccgaagccacacccttcctcgtggcacatactcgcacccgaccacctagcggcggagagcgagcccgtagatctacaccattaatgtcctggccgtggagtcccagtgccctcagactgcttcaaaggcctcctgaggagcctgctgcccatgctaactgccatagagtggctctcaacatttcctttcaagagctggggtgggagcgctggatagtctatcccccatcctttattttccactactgccacggtggctgtggattacacattccacctaatttgtctcttccggtccccggcgccccgcccacaccggcacagccctactccttactgccgggggcgcagccttgctgtgcggcactgcctggcaccatgcgcccactgcacgtacgcaccacttcagatggaggctatagctttaagtacgagaccgtccccaatcttcttactcagcattgtgcttgtatttag

SEQ ID NO: 191338 - DNA, 1281 bp, Artificial Sequence
  Description of Artificial Sequence: Synthetic coding sequence
atgcccctgctgtggctgcggggcttcctgctggccagctgctggataattgttcgctctagccctaccccaggaagtgagggccacagtgctgcccccgactgcccttcctgtgccttagcggctctgccgaaggacgtgcctaatagccagcccgagatggtcgaggccgtgaagaagcatatcctcaacatgctacatttgaagaagcgtcctgacgttactcaacccgtgccaaaggctgcactgcttaacgccattcgtaaactgcatgtgggcaaggtgggcgaaaacggatatgtggaaatagaggacgacattggccgtcgggctgagatgaacgaactgatggaacagacatctgagataataacctttgcagaatccggcacagccaggaagaccctgcactttgagatctccaaagaagggtccgaccttagcgtggtcgaaagggcagaagtctggctctttctcaaagtgccaaaggctaacaggacgcgtaccaaggttacaattcggctgttccaacagcagaagcacccacagggatcgctggatacgggggaggaggcggaagaggtgggattgaaaggcgagaggtcggagcttctactgagcgagaaggtcgtggatgctagaaaaagtacctggcacgtttttccagtttcctcttcaatccagaggcttttggaccaggggaaaagctcacttgatgtgcgtatcgcctgcgagcagtgtcaggaatccggtgcttcactagtgcttcttggtaaaaagaaaaaaaaggaggaagagggggagggtaagaaaaaaggaggaggagagggcggggctggagcagacgaggagaaggaacaatcccatcgcccatttttgatgctgcaggcccgccagagtgaggaccatccacacagaagacggcgccggggcctggaatgtgacggtaaggttaatatctgttgcaagaaacaatttttcgtgagtttcaaagatatcggctggaatgattggatcatcgcccctagcgggtatcacgcaaattattgtgagggggaatgtcctagccatatagccggaacatccgggtcctccctctcatttcactcaaccgtgatcaatcactatcgaatgcgcggtcactcgccgtttgcaaacctgaagtcctgttgtgttcctactaagcttcgcccaatgtcaatgttatattacgacgacggtcagaacatcatcaaaaaagacatccagaatatgattgtggaggagtgcggttgctcttag

SEQ ID NO: 191339 - DNA, 1281 bp, Artificial Sequence
  Description of Artificial Sequence: Synthetic coding sequence
atgcccctgctgtggctgcggggcttcctgctggccagctgctggatcatagttagaagcagcccaacccctggcagtgagggccactccgcagcgcccgattgtcctagctgtgccttggccgcactccctaaagacgtgcccaattcccaacctgaaatggtggaggcagtcaagaagcatattctgaatatgctccaccttaagaaacggcctgacgtgacccaacctgttcccaaggcagctctcctgaacgccatccgcaaattgcatgtgggtaaagtgggtgaaaacggctacgtggaaatagaggacgacattggccggagggcggagatgaacgagcttatggaacagactagtgaaattatcacatttgccgagtctgggacagctagaaagaccctccatttcgagataagtaaagagggaagcgacctttccgttgtggagagggctgaggtgtggctattcctcaaggtgcccaaggccaataggacacgcaccaaggttactataaggcttttccagcagcagaagcacccccagggatcgctagatacaggtgaagaggcagaggaggtcggcctgaagggcgagaggagcgagctgctcctgtctgagaaggttgtggacgcacgcaaatcgacttggcacgtgttccccgtttcttcaagtattcagaggctcctggaccaaggcaagtcatcactggacgtccgaatcgcctgcgagcagtgtcaggagagcggagcttcgctcgtgctgcttggcaagaagaagaagaaggaggaggagggcgagggtaagaagaagggaggtggagaggggggagccggtgctgacgaagagaaggagcaatcccaccgccctttccttatgttgcaggctaggcagtctgaggatcatccacaccggcggagaaggcgcggtctggagtgcgacggcaaagtcaatatctgctgcaagaaacagtttttcgtatcgtttaaagacatagggtggaatgactggatcattgctcccagcggctatcatgccaattactgcgagggagaatgtcccagtcatattgcgggaacgtcaggaagcagcctctctttccatagcaccgtaattaaccactataggatgcggggtcatagcccttttgctaatctgaagtcctgctgtgtccccactaagctccgacccatgagcatgctctattacgacgacggccagaatatcattaagaaggacatccaaaacatgatcgtcgaagagtgcggttgtagctag

SEQ ID NO: 191340 - DNA, 1224 bp, Artificial Sequence
  Description of Artificial Sequence: Synthetic coding sequence
atggacggcctgcccggccgggccctgggcgccgcctgcctgctgctactcgctgcaggatggttgggaccagaggcatggggctctcccaccccacctcccacacccgcagccccgccacccccacccccccctggctcacccggcggatctcaggacacgtgcacgagctgcggaggctttagacgccccgaggagctgggcagagtcgatggagacttcctcgaggcagttaaaaggcacattctttcccgattgcagatgaggggtcggcccaacatcactcacgcggtgccaaaagccgctatggtaactgctctgcggaaactgcacgcgggaaaagtccgagaggacggacgagtcgagatacctcacctggatggccatgcaagtcccggtgctgacggccaggagagagtgtccgagatcataagcttcgccgagaccgacggactggccagcagtagagtcagactgtactttttcatctccaatgaggggaatcagaatctgtttgtcgtccaggcctcactgtggctttatctcaagttgcttccgtacgtattggaaaagggatccagacgcaaggtccgcgtgaaagtctatttccaggagcaggggcatggagacagatggaatatggtcgagaagagggtagacctcaaacggtccggttggcacacctttccactcacagaagcgatccaggctttgttcgaacgcggtgaaagacgactgaaccttgacgtccagtgtgatagctgtcaggaactcgccgtggtacccgtgttcgtcgatcctggtgaagaaagccaccggccctttgttgttgtccaggcccgactgggagattcacgtcacagaatcagaaaaagaggcttggagtgtgacggcagaacaaatctgtgctgtaggcagcagttcttcattgatttccgactcataggttggaacgattggattatcgctcctacgggctattacggaaattactgtgagggcagctgtcctgcatatctggctggtgtaccgggaagtgcgagtagctttcacaccgcagtcgtcaatcagtatcgcatgagggggttaaacccaggaactgtgaattcctgttgcatcccgaccaaactctcaaccatgtccatgctttacttcgatgatgaatataatattgttaaacgggatgtgccaaacatgattgttgaggaatgcgggtgtgcatag

SEQ ID NO: 191341 - DNA, 1059 bp, Artificial Sequence
  Description of Artificial Sequence: Synthetic coding sequence
atgaccagcagcctgctgctggccttcctgctgctggcccccaccaccgtggctacacctcgggccggcgggcagtgcccggcatgcggcggacctaccctggaattggaaagccagcgagaactgctactggatctcgccaaaaggtccattctggataaactgcatctcacacaacgcccaactttgaatcggcctgtgtcccgagccgcattgaggacagctctgcagcatctccacggagtccctcaaggcgccctccttgaggacaacagggagcaggaatgcgagataatttccttcgcggaaacaggcctctcaacaataaatcagaccagattagatttccacttctcgagtgataggacagctggtgatagagaggtgcagcaggccagccttatgttcttcgtacaactaccttctaacaccacttggactcttaaggtccgcgtcttggttctggggccgcataataccaatttaactctggcaacccagtacctccttgaggtagacgctagcggatggcatcagctcccgttagggcccgaggcacaggcggcctgttctcagggacatctaacactagagctcgtcttggagggacaagtggcccagtccagtgttatcctgggcggagctgcccatcgcccattcgtcgctgcccgagttagggtggggggcaaacatcagattcaccgaaggggcattgactgccagggcggaagtcggatgtgttgtcggcaggagtttttcgttgactttcgggagattgggtggcatgactggattatacagcccgaaggatacgcaatgaacttctgtatcgggcaatgtcctctgcacattgcaggcatgcctggaatcgcagcttcattccataccgccgtgcttaatttactgaaggccaatactgcggccggtacgacaggggggggatcttgctgcgtgcctactgcgaggcgcccacttagtctgttgtattacgatagggattctaacatagtgaagaccgacatccccgacatggtagtggaggcctgcggttgctcctag

SEQ ID NO: 191342 - DNA, 1053 bp, Artificial Sequence
  Description of Artificial Sequence: Synthetic coding sequence
atgcggctgcccgacgtgcagctgtggctggtgctgctgtgggccctcgtgcgggctcagggcactgggtctgtttgcccttcctgcggcggctccaagctggcgccacaggccgagcgagctctcgtcctggagttagccaaacagcagattctcgatggtctgcaccttacttcccgcccaagaatcacgcatccacctccccaggccgcactaacgagggccttgcgacgactgcaacccggctctgtcgcgccagggaatggagaggaggtgatctcattcgccaccgtcacggacagtacctctgcttacagctctcttctgacgtttcacctctccactccgcgctcacatcatctctatcacgccagactgtggctgcatgtactaccaactctccctgggacattatgcttgaggattttcagatggggacccagaaggaggcgacagggctcaagaactctcttggctgagcaccatattacgaacctgggatggcacactctcacattaccttcctctggcctcagaggggaaaaaagtggcgtgcttaagctccagctggactgccgacccctggagggaaattccaccgtaacaggccaaccgagacgtctgttggacaccgccgggcatcagcagccgttcctggaactaaaaattcgtgcgaacgaaccgggggccgggcgggcacggaggaggacaccaacttgtgagcccgcaaccccactgtgctgccggcgcgaccactacgtggatttccaggaactgggctggcgcgattggattctccaacctgaaggttatcagctcaattactgttcagggcaatgccctcctcacctagctgggtccccaggaatcgccgcctcctttcactctgcagtcttcagcctacttaaagcaaacaatccctggcctgcgagtacctcttgttgtgtaccgacagcccggcgtccgcttagcctactgtaccttgaccacaacggaaacgtcgtcaaaactgacgtgcctgacatggtcgtggaagcttgtggatgctcgtag

SEQ ID NO: 191343 - DNA, 4062 bp, Artificial Sequence
  Description of Artificial Sequence: Synthetic coding sequence
atgagcagccccatgcccgactgcaccagcaagtgccggagcctgaaacatgcactggatgtgctgtctgtggttacgaaagggtctgaaaaccaaatcaaggcttttctgagctctcattgttacaatgcagcaacaattaaggacgtgttcggccgcaatgccctgcatctcgtttccagttgcggcaaaaaaggcgtgctcgactggttaattcagaaaggggtggaccttctggtcaaggacaaagaatccgggtggacggccctgcaccgctcaatcttctacggccacattgactgtgtctggtccctgctgaaacacggagtgagcctatacatccaagacaaagagggtttgtctgccctggacttggtgatgaaggatcgccctacccatgtggtgtttaagaacactgatccaacagatgtttacacctggggggacaataccaacttcactctgggtcatggatcgcagaactctaagcaccacccagaactggtcgatttgttcagtcggtcagggatctatattaagcaagtggtgctctgtaagtttcacagcgtgtttctcagtcagaaaggacaagtttatacttgtgggcacgggcctggtgggcgcctcggacatggagacgagcaaacgtgcctcgtgcccagactggtggaggggttaaatggccacaattgttctcaggtcgctgctgccaaagatcatacagtcgtactcacggaggacggatgcgtatacaccttcggcctgaacatcttccaccagctgggcatcatacctcccccttcatcctgcaatgtcccacgacagattcaagcaaaatacttaaagggccgcaccattatcggggttgcagccgggagatttcatacagtgctctggactagggaagctgtgtacaccatgggactcaatggcggacagttaggctgcctgctggacccaaacggagaaaaatgtgttaccgcacctcgccaggtgagtgcgctgcaccacaaagatattgccctctctctggttgccgcctccgatggagctactgtgtgtgtgaccacccggggcgacatttacctacttgcggattatcagtgtaagaaaatggcatcaaaacagctgaatctcaagaaagtgctagtgtctggaggacacatggagtacaaggtggacccagagcacttgaaggaaaatggagggcagaagatctgcatcttggcgatggacggcgctggccgcgtattctgttggcggtctgtgaactcatctctcaaacaatgccggtgggcttaccctcgacaggtctttattagcgacattgcgcttaaccgcaacgaaatcctgtttgtcacacaggatggcgaaggctttcggggcagatggttcgaagaaaaaagaaagagcagtgagaagaaagagatactgtcaaacttacacaattcctcatcagacgtctcatatgtgagtgatataaacagcgtgtacgagcgcatcaggttggaaaagctcacattcgctcatcgggctgtatcagtgtctacagatccctccggatgcaattttgccatcctgcagtcagatcccaaaaccagcctgtacgaaatcccagccgtctcttcatcctctttttttgaagaattcggaaaacttctgcgggaggcagacgagatggactccatccatgacgttacattccaggtcggcaatcggctcttccccgctcataaatacatcctggccgtccattccgatttttttcaaaagctctttctttctgatggcaacacatccgagtttacagatatttaccagaaagatgaagactccgcaggttgccatttattcgtggttgagaaagtgcacccagatatgttcgagtacctgttgcagtttatatacaccgatacttgcgatttcctgacccacggattcaaacctcgcatccatctcaacaaaaatcccgaagaatatcagggaacacttaatagtcacctgaataaggttaacttccacgaggacgataaccagaagagcgctttcgaagtctacaagtcaaatcaggcccagacagtgtctgaacgccagaaaagcaaacccaagagctgtaaaaaggggaagaatatcagggaagacgacccagttcgtatgctgcaaacagtcgcaaaaaagttcgatttttctaatctcagcagcaggttggacggcgtgaggtttgaaaacgaaaagatcaacgtgatcgcaaagaataccggtaataagctgaagctgtctcagaaaaagtgctcctttctgtgcgatgtcactatgaagtccgtggatggcaaagagtttccctgccataaatgtgtgttatgcgcacggcttgagtatttccattctatgttgtcaagctcctggattgaagcctcaagctgcgccgctctcgagatgcccatccactccgacatccttaaggtgattctggactatctgtacactgacgaagctgtggttataaaggaatcccagaacgtggatttcatatgctctgtgcttgtggttgcagaccaactattgattacaaggcttaaggagatatgcgaggttgctcttactgagaaacttacccttaaaaatgcagcaatgctgctggaattcgcagccatgtattcagcaaagcagttgaaactgtcctgccttcagttcatcggcttgaacatggccgctctgttggaagcccgttccctggacgtcctctccgacggagtgttaaaggatctgagcgagttttatcgaaaaatgattcccgccatggatcggagggtcatcaccccgtaccaagacgggccagacatctcgtacttggaagtcgaggacggtgatatattcctgaaagaagaaataaatatggaacagaaccactcggagaccatgtttaagaaggctaaaaccaaggccaaaaaaaaacccagaaagagatctgactccagtgggggctataacctctccgatatcatccagagtcctagttccacagggctgctgaaatcgggtaaaactaacagcgtggaaagtctcccagagctgctcacaagcgactcagaggggtcatatgccggtgtggggtcccctcgagacctccaatctcctgatttcacaacaggattccatagcgataaaatagaggcgaaagttaaaccctatgtgaatggtacctccccggtctattctagagaggatctgaagccctgggagaaatcacctatcctgaagatttccgcaccacagcccataccttctaatagaattgacaccacatcatctgcctcttgggtggcaggatctttctccccagtgtcgccccctgtcgtcgatttgcgcaccattatggagattgaggaaagccgtcagaaatgtggagcaacccctaaatctcatttgggcaagaccgtctctcacggagtgaaactgtcccagaagcagcgaaagatgatcgcccttaccacaaaggagaacaactctggtatgaatagtatggagaccgtactgttcacccctagcaaagcacccaaaccggtgaacgcttgggcaagcagcctccacagtgtaagttctaaatctttcagagacttcctgctcgaggaaaagaagagcgttaccagccacagctccggagatcatgtgaaaaaggtgagtttcaagggcatagaaaattcccaggccccaaagatcgtaaggtgtagtacccacggaacacccggccccgaggggaaccatatatctgacctgccattgctggattcccctaatccttggttaagctcatcggttaccgccccaagcatggtggccccagttactttcgcctccattgttgaagaggagctgcagcaggaagccgccttgatcagaagtcgtgagaaacccttggcattaatccagatcgaagagcatgccattcaggaccttttagttttctacgaggccttcggaaatcctgaagagtttgttatcgtggagagaacaccccagggtcccctcgccgtgccgatgtggaataaacacggctgttag

SEQ ID NO: 191344 - DNA, 1386 bp, Artificial Sequence
  Description of Artificial Sequence: Synthetic coding sequence
atgtggcagctgaccagcctgctgctgttcgtggccacctggggcatttctggcacccctgctcctctagactcagttttctcttcctctgaacgagcacatcaggttctgagaatacgcaaacgggcaaacagctttttagaagaattacggcattcaagcctggagagagagtgcatcgaggaaatttgtgacttcgaggaggccaaggagatattccagaatgtagatgacacgctagcgttctggtcaaagcacgtggacggcgaccagtgccttgtgctgcctctcgaacacccttgcgctagcctttgctgtggccacggcacttgcatcgatggcatcggcagttttagttgcgattgccgctccggatgggagggaagattctgccagagggaagtctcgttcctgaactgttctctggataacggaggttgtacccattactgtcttgaggaggtaggctggagacggtgcagttgtgcccccggctataagttgggcgatgatctcctccagtgtcacccggcggtgaagtttccatgtggccgtccttggaagagaatggagaagaaacgcagccacctgaagagagacactgaagatcaggaagatcaggtggacccccgcctcatcgatgggaaaatgaccagacgaggtgactccccttggcaggtggttctgcttgatagcaagaaaaagctggcttgcggtgctgtcctgatccatccatcatgggtgctgacggccgcccactgtatggatgaaagtaagaaactgctggtgagactcggtgagtatgacctgcggagatgggagaagtgggaactggatttggacattaaggaggtttttgtgcaccctaattattcaaaatccactaccgacaatgacatcgcacttttgcacctcgctcaacccgcaaccctcagccagaccatcgtccccatttgcttacccgacagcggcctcgcagaaagagagcttaaccaagcagggcaggagacccttgtaactggatggggatatcactcttcccgggagaaggaagcaaagcggaatcggactttcgtgttaaattttatcaaaatccctgtagtgcctcataatgagtgcagcgaggtgatgtctaacatggttagcgagaatatgctctgcgctggcattctcggggatcgtcaagacgcgtgcgagggggactccggcggacccatggttgccagcttccacggtacttggtttctcgtgggcctggtcagctggggcgaaggctgtggcttactgcataattacggcgtgtacacaaaggtatcccgctacctagactggattcacggccacatacgagataaagaagctccgcagaaatcatgggccccgtag

SEQ ID NO: 191345 - DNA, 405 bp, Artificial Sequence
  Description of Artificial Sequence: Synthetic coding sequence
atgaaggccttcagccccgtgcggagcgtgcggaagaacagcctgagcgatcacagtttgggcatatctcgctccaaaacaccggtggacgatccaatgagtttactgtacaacatgaatgactgctattcgaaacttaaggaactggtgcctagtatcccccagaataagaaggtcagtaaaatggaaatcctacagcatgtcatcgattacatccttgacttgcaaattgccttggactcccacccaactatcgtcagcctgcaccaccagcggccaggccagaatcaagcaagccggactcccttaacgacgctaaacactgacattagtatactcagccttcaggccagtgaatttccatccgagttaatgagtaacgactccaaagctctttgcggttag

SEQ ID NO: 191346 - DNA, 405 bp, Artificial Sequence
  Description of Artificial Sequence: Synthetic coding sequence
atgaaggccttcagccccgtgcggagcgtgcggaagaacagcctgagcgaccacagcttaggaatttcaaggtccaaaactcccgtggacgaccctatgagtctcttatataacatgaacgattgttattctaagctgaaggagctggtacccagcataccacagaataagaaggtatcaaagatggaaatactgcaacacgtgatcgattacatcttggatctccagatcgcattggacagtcacccgaccattgtcagcctccatcatcagaggcctggtcaaaatcaggcctcgagaaccccccttactactcttaataccgacatcagcatcttaagccttcaggcgagcgaattcccaagtgaactaatgagtaacgactcaaaagcgttatgcggctag

SEQ ID NO: 191347 - DNA, 360 bp, Artificial Sequence
  Description of Artificial Sequence: Synthetic coding sequence
atgaaggccctgagccccgtgcggggctgctacgaggccgtgtgctgcctgagcgaacggtccctagctatagccaggggaaggggaaagggcccagctgctgaggaacctctctctctgctggacgatatgaatcactgttactctaggctgcgcgagctggtgcctggcgtgcctagaggcacccagctctctcaggttgaaattctgcagcgagttatagactacatactagatttacaagtggtgctcgcggagccagcgcccggaccccccgacgggccgcacttgccaattcagaccgcagagctgactccagaactggtcattagtaacgacaagcgctccttctgccattag

SEQ ID NO: 191348 - DNA, 486 bp, Artificial Sequence
  Description of Artificial Sequence: Synthetic coding sequence
atgaaggccgtgagccccgtgcggcccagcggccggaaggcccccagcggctgcggaggcggggagctcgctttaagatgtctagctgaacacggacatagcctggggggctccgccgcagcagccgccgccgcggccgcagcgagatgtaaggccgccgaggccgcagctgacgagccagctctttgtctccagtgcgacatgaacgattgctacagccgactgcgtaggctcgtacctactattcctcctaataaaaaggtcagcaaggtggagatcctccagcacgtgatcgattatattttggatcttcaattggcgcttgagacccaccccgcgctgctgagacagcctcccccccctgctccgcctcaccacccggcaggaacttgccccgccgcaccacctcgaacacccctcacagcgctgaacacagatccggccggggctgttaacaaacagggcgactcaattctttgcagatag

SEQ ID NO: 191349 - DNA, 843 bp, Artificial Sequence
  Description of Artificial Sequence: Synthetic coding sequence
atgctgggccagcagcagcagcagctgtacagcagcgccgccctgctgactggggagcgcagcagacttcttacctgttacgtgcaggactacctcgagtgcgtcgagagtctcccccatgatatgcagcggaatgtctctgtcctacgagaactagacaataagtatcaagagacattaaaagagattgacgacgtgtacgagaaatacaagaaggaggacgacctcaatcaaaagaagcggttgcagcagcttctgcaaagagctttgatcaactcgcaagaactgggagacgaaaagattcagatcgttacccagatgttagagctggtggagaacagggcccggcagatggaactgcatagtcagtgctttcaagaccctgccgaatctgagcgcgcatcagataaagctaaaatggattcgagccagccagaacgaagctccaggcgccctaggagacagcggacttctgagagccgcgacctgtgtcatatggctaatggcatcgaagactgcgatgaccagccccctaaagaaaagaagtccaagtccgcaaagaaaaagaaaagatcaaaggccaagcaagaacgcgaggcgtcacctgttgagttcgctatcgaccccaacgagccaacctactgtctttgcaaccaggtaagttacggggaaatgatcggatgtgacaatgaacagtgtcccatcgaatggttccactttagctgcgtaagcctgacgtataagccaaaagggaagtggtattgtcctaaatgcaggggcgacaatgagaaaaccatggacaaaagtactgagaaaaccaagaaggatcggcgatccagatag

SEQ ID NO: 191350 - DNA, 723 bp, Artificial Sequence
  Description of Artificial Sequence: Synthetic coding sequence
atggaccaggacggcgaccagcagctgggccccagccggatcctggcaccccagaccctgaaagaaattgacgacgtgtacgaaaagtacaagaaagaggatgacttgaatcagaagaagcgcttgcagcagttgcttcaacgggctttgatcaattctcaggaacttggcgatgagaaaatccagattgttactcagatgttagagctggtggaaaatcgtgctcggcagatggaacttcatagccagtgcttccaggatcctgctgagtcagaacgggcctctgataaagcgaagatggactcttcacagcccgaacgctcttcacgaagacctcgcagacaacgcacttccgaaagtcgcgatctatgccacatggctaatggaattgaagattgtgatgaccaacccccaaaagagaaaaaatccaagtcggcaaaaaaaaagaagcggtctaaggccaaacaagaacgcgaagcctcccccgtggagttcgcaattgaccctaatgagcccacatattgtctatgtaaccaggtgtcctatggcgagatgattggctgcgacaacgagcagtgccctatcgaatggttccatttttcctgcgtttctctaacatacaagcccaagggcaaatggtactgccctaaatgcagaggggataacgaaaaaaccatggacaaaagcactgaaaagacgaagaaagaccggcgctctcggtag

SEQ ID NO: 191351 - DNA, 1257 bp, Artificial Sequence
  Description of Artificial Sequence: Synthetic coding sequence
atgctgtacctggaggactacctggagatgatcgagcagctgcccatggatctccgcgatcgcttcaccgagatgcgagaaatggatctccaagttcaaaacgccatggaccagttggagcagcgcgtgagcgagttttttatgaatgctaaaaaaaacaagcccgagtggcgtgaggaacaaatggctagtattaaaaaggactattataaggcactcgaagatgccgatgaaaaggtccaactcgctaatcagatatacgacctggtggatcgccatctgagaaaactggaccaggaattggcgaaattcaagatggaacttgaagcagacaatgcaggcatcacggaaattctcgaaagaagaagcttagaactggacacccctagccagcccgtcaacaaccaccacgcgcattcacacactccagtggaaaaacgcaagtacaatcccacttcccaccatactactacagatcatatcccagagaagaaattcaagtctgaggcgttgctgagtactcttactagcgacgcctccaaagaaaataccctggggtgtcggaataataactcaaccgccagcagcaataacgcttataatgttaactcgtcccaaccgctggggagctataacatcggctcactcagcagcggcacgggagccggtgcaatcaccatggcagccgcacaggcagtccaggctacagctcaaatgaaggagggtaggcggaccagctccctgaaagcatcttacgaagctttcaaaaataatgatttccagctaggcaaagaattctccatggctcgtgaaacagtcgggtacagctcctccagtgcactgatgacaactctgacgcaaaatgcctcctcgtctgccgcagattccagatctggtagaaagtctaaaaacaataacaaaagttcttcgcaacaaagcagctcctcttctagcagttcctccttgagtagctgtagcagctcttccacagtcgtgcaggaaatctcccagcaaaccaccgtggtccctgagagcgattccaattcgcaggtggactggacatacgaccccaatgagccccgatactgcatttgcaaccaggtctcttatggcgaaatggtgggctgcgataaccaggattgccccatcgagtggtttcactatgggtgcgtcggtctgacagaggctcccaaaggcaagtggtactgtcctcagtgtaccgctgctatgaagaggagaggctcaaggcacaaatag

SEQ ID NO: 191352 - DNA, 279 bp, Artificial Sequence
  Description of Artificial Sequence: Synthetic coding sequence
atgctgtacctggaggactacctggagatgatcgagcagctgcccatggacctcagggatagattcacggagatgcgggaaatggacctgcaggtgcagaacgctatggaccaacttgagcagcgggtttccgaattttttatgaatgcaaaaaagaacaagcccgaatggagggaagagcagatggcatcaatcaaaaaggattactacaaggccttggaagacgccgatgagaaagtgcagcttgccaaccagatttatgatctgcaacacttctag

SEQ ID NO: 191353 - DNA, 723 bp, Artificial Sequence
  Description of Artificial Sequence: Synthetic coding sequence
atggccaccgccatgtacctggagcactacctggacagcatcgagaacctgccctgcgaactacaacgcaacttccaactgatgcgagaattggaccagcgtaccgaggataagaaggcggaaatcgacattctcgccgcagagtacatctcaacagtgaagactctgagtccagatcagcgggtggaacggttgcaaaagatccaaaatgcttattctaagtgtaaagaatactcagacgacaaggtgcaactcgctatgcagacgtatgaaatggtagataagcacattagacggctcgacgctgacctcgcccggttcgaagccgacttgaaagacaagatggagggaagcgacttcgagtccagcggagggagggggctcaaaaaaggaagaggtcaaaaggaaaaacgagggtcaagaggtaggggacggagaacttccgaggaagacacaccaaaaaagaaaaaacacaaggggggttcagagtttacagataccatcttgagcgtgcacccttcagatgtactggacatgcctgtggatcccaacgagccaacatactgcctgtgccaccaagtgtcgtacggcgaaatgatagggtgtgacaacccggattgtcccattgagtggtttcactttgcgtgcgtcgacctgaccacgaagccaaagggaaagtggttttgccctagatgcgtgcaggagaaacgcaagaaaaaatag

SEQ ID NO: 191354 - DNA, 681 bp, Artificial Sequence
  Description of Artificial Sequence: Synthetic coding sequence
atggccaccgccatgtacctggagcactacctggacagcatcgagaacctcccttgcgaactccagagaaatttccaactcatgagagagctggaccaaagaaccgaggataaaaaagcggaaatcgatatcttggccgccgagtatatatcaaccgtgaaaacactgagtcccgatcagagagtggagagattacagaaaatccagaacgcctattcaaaatgtaaagaatactcagatgataaggtgcagctcgcgatgcaaacttatgaaatggtggataagcatatccggcgccttgacgccgatctagctcgctttgaggcggacctgaaagataagatggagggtagcgattttgagtcatccggaggaaggggacttaagaagggaagaggacaaaaagagaagcgaggctcccggggcaggggacgaagaaccagcgaagaggacactccaaagaagaagaaacacaagggcgggtcggagttcacggacactattctttccgttcaccccagtgatgtgttagacatgcctgtagaccccaacgagccaacctactgcctctgtcaccaggtgagctacggtgaaatgattggttgcgacaatccagactgtcccatagaatggttccatttcgcatgtgtcgacctcacaactaaacctaagggcaaatag

SEQ ID NO: 191355 - DNA, 2265 bp, Artificial Sequence
  Description of Artificial Sequence: Synthetic coding sequence
atgttcagcggcggctgccacagccccggcttcggccggcccagccccgcattcccagccccagggtcacccccccccgccccaagaccctgccgccaggagactggagagcagatcgccatcaagcagtgccgtcaagagttgtctcctcggaacagggagcgttggtgcttggaaatccagattatgcggagactcactcaccccaatgtcgtcgctgcccgagacgtgccggaaggaatgcagaacttggctcctaacgacctccccttattggcgatggaatattgccaaggtggagacctcagaaaatatttaaatcagtttgaaaattgctgtgggttacgggagggcgcaatcctgacacttttgagcgacatagcgagcgccctgcgttatctgcacgagaaccgcattatccaccgagatctcaagccagagaacattgtgctgcagcagggagaacaaaggcttatccacaagatcatcgatttaggctatgccaaggagctagaccagggcagtctttgtacttcttttgtcggtacactacagtatttggctcccgagttgctcgagcagcagaagtacactgttaccgtagactattggtcatttgggacgctggcatttgaatgtattactgggttcagaccttttctcccaaactggcagcccgtgcaatggcacagcaaggtgcggcaaaagtccgaggtggatattgtggtgtcagaggacctgaatggcactgttaagttttcctccagtctaccctaccctaataatttaaacagcgtcctggccgagagactggagaaatggctgcaattgatgctgatgtggcacccgcgacagagggggaccgacccaacgtacggtcccaacgggtgctttaaggccctcgacgacattctaaatttgaaattagtgcatattctcaacatggtcactgggactatacacacctaccccgtgacagaggacgaatcactgcagtccctgaaggcccggatccagcaagacacgggaattcctgaggaagaccaggaactcctgcaagaggccggcttagctctgattccagacaagcccgccacgcagtgtatcagtgacggtaaactcaatgaaggtcacaccctggacatggatctggtgtttctgttcgacaactccaaaattacctatgagacgcaaatatccccaaggccgcagcctgaaagcgtgtcttgcattctccaggaaccgaagcgcaacctggccttttttcagttaaggaaggtgtggggtcaagtatggcacagtatccaaacgttgaaagaggattgtaaccgactgcagcagggccagagggcggccatgatgaatttgctgcggaacaattcatgtttatctaagatgaaaaactccatggccagcatgagccagcagctcaaggccaaactggatttcttcaaaacctccatacagatcgaccttgaaaagtactcggagcagaccgagtttggcatcactagcgataagcttttgcttgcatggagggagatggaacaagcggtcgagctatgcggcagggagaatgaggtcaaactcctggtggagcgaatgatggccttgcagacagatattgtcgacctacaacggtctcctatgggcaggaagcagggcggaacattggatgaccttgaggagcaggcgagagaattgtatcggaggctgcgggagaaaccacgggatcaacgcacagaaggagactcacaggagatggtgagattgttactccaagccatccagagtttcgagaagaaggttcgagttatatacacacagctatctaagactgtggtgtgcaagcagaaggccctggagctgttaccaaaagtggaggaggtcgtttccctcatgaacgaagatgaaaagacggtggtgagactgcaggaaaagaggcagaaagagttatggaacctgcttaagatcgcctgctcaaaggtgcggggcccagtgtccggctccccagatagcatgaacgcctctcggctgagtcagcctgggcagctgatgtcacaaccttccactgcttctaatagcctccccgagccggccaagaaatcggaggagctggtggccgaggctcataatctgtgtactctgcttgaaaatgcgattcaagatacggtgcgcgaacaggaccagagtttcactgccctggactggagctggttacaaactgaggaggaggaacactcttgtctagagcaagccagttag

SEQ ID NO: 191356 - DNA, 963 bp, Artificial Sequence
  Description of Artificial Sequence: Synthetic coding sequence
atgaaccggcacctgtggaagagccagctgtgcgagatggtgcagccatcaggcggtcccgccgccgatcaagatgtgttaggtgaggagagccccctcggaaaaccggccatgctccacctaccgagtgagcagggggctcccgaaaccctgcaacggtgcctggaagagaatcaggagttgcgcgatgcaatccgccagtccaaccaaattcttagagaacggtgtgaagaactcctgcatttccaagcgagtcagagggaggagaaagagtttctaatgtgcaagtttcaggaggctagaaagctggtcgagagacttggtctggaaaagctcgatctcaaacggcaaaaggagcaagccctgagggaggttgagcacctcaaacggtgccaacagcaaatggccgaagacaaagcctcagtgaaagcccaggtgacctccctcctgggagaactgcaggaatcccagagcagactggaggccgcgaccaaggagtgccaggcactggaaggtcgccggaagctcgcccaactgcaagtcgcctaccatcagttgttccaagagtacgacaaccatatcaagtcaagcgttgtgggctcggaaagaaagagagctgacatatacaaggccgatttccaagcagagaggcaggcacgtgagaagctcgctgaaaaaaaagagctactgcaggagcagttagagcaactccagcgcgagtattctaagcttaaagctagctgtcaggagagcgctcgcatcgaggacatgaggaaacgacacgttgaggtctcacaggcacctctaccacccgcgcccgcatatttgagtagccccctggctttgccttcgcagcggagaagtcctccagaggaaccccctgacttttgctgtcctaagtgccaataccaggcccctgacatggatacactccagatccacgtgatggagtgcatagaatag

SEQ ID NO: 191357 - DNA, 1602 bp, Artificial Sequence
  Description of Artificial Sequence: Synthetic coding sequence
atgagcagcgacggcaccatccggcacagcaaggtgcggcagaagtccgaagtcgacattgtagtgagcgaggatctcaatggtacagtaaagttctcctcaagcctgccctatcccaacaacttgaacagtgtactggcagagcggctggagaagtggcttcagctgatgctaatgtggcaccctagacagcgcggtaccgaccccacatacggacctaatggctgcttcaaggccctggatgacatcttaaatcttaaactggtccacatcctgaatatggtcaccggcacaatccacacataccccgtgactgaggatgagtcgctgcagagtttgaaggctcgcatccagcaggataccggaatcccagaggaggaccaggaactgctgcaagaagctggcttagccctgatccctgacaaacctgcaacccagtgtatctccgatggcaagctgaatgaggggcataccctcgacatggacttagtgttcctgttcgacaattccaagatcacttatgagacgcagattagcccacgtccgcagcccgagagcgtgtcctgtattctacaggaacctaagcgtaacttagcattttttcagctccgcaaggtctggggccaggtttggcattcaattcagacactcaaggaggactgtaatcggttacagcaggggcagcgcgccgccatgatgaacctcctgaggaacaatagctgtttatctaaaatgaaaaacagtatggcatccatgagtcaacagctgaaagcaaaactggatttcttcaaaacaagcattcagatcgatctggaaaagtattccgagcaaacagaatttggcataacaagtgacaagctcctgctggcttggagagagatggagcaagcagtggagctgtgtgggcgcgagaacgaggtcaagctcctggtggaaaggatgatggctttgcagacagatattgtagaccttcagcgcagccctatggggagaaaacagggcggaacattggacgacctggaggagcaggcacgcgaattgtataggagattgagggagaagccaagagatcaacgaaccgagggtgacagtcaggaaatggtccgtctgctcctgcaagccatccagagtttcgagaagaaggtgcgcgtgatttacactcagctgagcaagacagtggtatgcaagcagaaggccctagaacttctgccaaaggtagaagaggtagtcagtctgatgaatgaagatgaaaaaacagtcgtacggctgcaggagaaaagacaaaaagagctttggaatctacttaagattgcctgttccaaggtccgcggccccgtcagcggaagccccgactccatgaacgcatcccgtctgtctcagcctgggcaattgatgagccagccctctactgcgtctaacagcctgcccgaaccggctaagaagtctgaagaattggttgccgaggctcataacctttgcaccttgctcgaaaacgctatccaggacaccgtccgtgaacaagaccagtcttttacagcgctcgactggtcatggcttcagactgaggaagaagagcacagctgtctggaacaagcctcttag

SEQ ID NO: 191358 - DNA, 2094 bp, Artificial Sequence
  Description of Artificial Sequence: Synthetic coding sequence
atgagcagcgacggcaccatccggctgacccaccccaacgtggtggccgctagggacgtacccgagggtatgcaaaacctagcacccaacgacctccctctgcttgcaatggagtactgccaggggggcgacctgcggaagtatctaaaccaattcgagaactgttgcgggctgagggaaggtgctattctgaccttgctgagcgacatcgcctccgcgttgcgatatctgcacgaaaaccgtatcatccatcgcgatctgaaacctgaaaatatcgtcctccaacagggggaacagcgcctgatacacaagataattgatttaggttacgccaaggaactggatcagggatcactctgcacctcatttgtgggcacgttgcaatatcttgcccctgagctcctggagcagcagaagtatactgtgacagtagactattggtcttttgggactctggcatttgagtgtataaccggcttcagaccattcctgccaaactggcaacctgtccaatggcactctaaggtgaggcagaagtctgaagtggatatcgtggtgagcgaggatttaaacggcaccgtcaaattctcctcttcgctgccttaccctaacaatctaaattcagtccttgccgagcgacttgaaaagtggctgcaattaatgctgatgtggcacccccgacagcgcgggacagatcccacatatgggccaaacggttgcttcaaggccctggacgacatcctgaatctgaaactcgttcatatcctaaacatggtgactggtactatccacacgtaccctgtcaccgaagacgaaagtctgcagtctcttaaagctcgcatacagcaggatacaggtattccagaggaagaccaagaacttctacaggaagctggccttgctttaatacccgacaaacctgctacacagtgtatctcggacgggaaattaaatgaagggcacaccctggatatggatctagttttcctctttgacaattccaagataacctatgagactcagattagcccaagaccccaaccagaatccgtcagttgtatcctgcaggagcctaaaaggaatttggcattcttccagctgcgcaaggtctggggacaagtgtggcacagtatccagactctcaaggaggattgcaatagacttcagcaaggccaacgggccgctatgatgaatcttcttcgcaacaattcctgtctgagcaaaatgaaaaacagtatggcctctatgtctcaacagctaaaggccaaacttgatttctttaagacaagtattcagattgatctggaaaaatattctgagcagactgagtttgggatcaccagtgataaactactcctggcgtggcgagagatggagcaggcagtggagttatgcggccgggagaacgaggttaagcttcttgtggaacgaatgatggccctgcagaccgatatcgtcgacctacagcggtcccccatggggaggaagcagggagggacacttgacgatcttgaagagcaggcacgcgagctgtataggcgtctgcgggaaaagcccagagaccaaaggaccgagggagatagtcaggagatggtgagattgctgttacaggctatccaaagttttgagaagaaggtgagggtgatttatacccagcttagcaagactgtcgtatgtaagcaaaaggcactggagttattacccaaggtggaagaggttgtgagtttgatgaacgaagatgagaagacagtggtgagactgcaggagaagcggcagaaggaactctggaacctgctcaaaattgcctgctccaaggtgcggggtcctgttagtggcagtccagacagtatgaacgcttctagacttagtcaaccagggcagttgatgagccagccttcaacagcaagtaattccctcccagaacccgccaaaaaatctgaggaactggttgccgaggctcacaacctgtgcaccctgctggagaacgccatccaggacacagttagagagcaagatcaaagttttaccgctcttgattggagttggctgcagaccgaagaggaggaacacagctgtctggagcaggcgtcttag

SEQ ID NO: 191359 - DNA, 2271 bp, Artificial Sequence
  Description of Artificial Sequence: Synthetic coding sequence
atgagctggagccccagcctgaccacccagacctgcggcgcctgggaaatgaaggagaggctcggtacaggtggatttggcaatgtgatccggtggcacaatcaggaaacaggtgaacagattgctatcaaacagtgccgtcaagagctgagcccacgcaaccgagaaaggtggtgtctggagattcagattatgaggagactgactcaccccaacgtggtggccgccagagacgtgcctgaagggatgcagaacctggcccctaacgatcttcccttacttgcgatggaatactgtcagggaggagacctgcgcaagtaccttaaccagttcgagaattgctgtggtttaagggagggcgcaatcttgactctcctgtctgacatagcttcagcattacggtacttacacgagaatcggataatacatcgcgacctgaaacccgagaatatcgtcctccagcaaggagaacagcgcctgattcacaaaattattgacctcggatacgcaaaggaactggatcaaggtagcttatgtacttctttcgtgggcacactgcagtaccttgcccctgaactgctggagcagcagaagtatactgtgactgtggattattggagttttggcacgctagccttcgaatgtattacagggttcagaccttttctccccaattggcagcccgtgcaatggcattccaaagttcgccagaaatccgaggttgacattgtagtttcggaggatctgaacggtacagtgaagttctctagtagtctgccgtatccgaataaccttaactccgtgcttgctgaaagattagaaaagtggctccagctgatgttaatgtggcaccccagacaacgcggaacagaccccacctatgggccaaacgggtgttttaaggctttggatgatattctcaacctgaagctagtgcacatcctgaatatggtgacaggtaccatacatacataccctgtaacagaggatgaatcgttgcagtctctaaaagcacggattcagcaagacacgggcatccctgaagaggatcaagagctgctccaggaagcaggcctcgcactgatccctgacaagcccgccacccagtgtatctctgatggtaaattgaacgaaggtcacacattggacatggacctcgtcttcctcttcgataattcgaagatcacctacgaaactcaaataagccctcgccctcagcccgaaagtgtgtcatgcatcctgcaggaacctaaaagaaacctcgcgtttttccagttacggaaggtatgggggcaggtgtggcactccatccagacgctcaaagaggattgcaatcggcttcagcaaggccagagggctgctatgatgaatctcctcagaaataacagctgtctgtctaagatgaagaattccatggcctctatgtcacaacaactaaaagcgaaactagacttttttaaaaccagcatccagattgacttggagaaatactccgagcagaccgagttcgggattactagcgacaaactgctgctcgcctggagggaaatggaacaggccgtggagctttgcggaagggagaacgaagtgaaactgttggttgaacgaatgatggccctgcaaacagacatcgtggacttgcagaggtcacccatgggccggaaacagggcggcacattagatgatctggaagagcaggctagggagctttaccgacgcctccgggagaaacctagagatcagcgaactgagggagattctcaagagatggttaggctgctgttgcaggctattcagtctttcgagaagaaagtgagagtcatctacacccagcttagcaaaaccgtggtttgtaaacagaaggccttagaactgctccctaaggtcgaagaggtcgtgagtctcatgaacgaagacgaaaagacggtcgttcgcctgcaggagaagagacaaaaggagctctggaatcttcttaaaattgcatgctcgaaagtgagaggcccggtctcaggtagtccggattctatgaatgcaagccgactgtctcagccgggccagctcatgtctcagcctagcaccgcgtcaaacagcctgccagagccggccaagaaatcagaggaactcgtggcagaggcacataatctgtgcacactgctcgagaatgccattcaggacacagtgcgggaacaggaccaatccttcacggccctcgactggagttggctgcaaactgaggaggaggagcattcctgccttgaacaagcatcttag

SEQ ID NO: 191360 - DNA, 3999 bp, Artificial Sequence
  Description of Artificial Sequence: Synthetic coding sequence
atgcggaacctgaagctgttccggaccctggagttccgggacatccagggcccgggaaatccccagtgtttcagcctccgaacggagcaggggaccgtgctgatcggctcagaacatggactgatcgaagtggatccagtgtcccgcgaagttaagaacgaggtgtcactggtagccgagggctttctgccagaggatggcagcggccgaatcgtcggggttcaggacctcctggaccaggagagtgtgtgcgttgccaccgcctcgggagacgttatcctctgtagcttgagcacccagcagttggaatgtgtgggttctgtcgcatccggaattagcgtcatgtcttggagcccggaccaggagctcgtcctgcttgcaactgggcagcagaccctgatcatgatgacaaaagactttgaacctattctggagcaacaaattcatcaggacgatttcggtgagtccaagtttataaccgtcgggtggggaagaaaagaaacccagttccatggatcggaggggagacaagccgcgttccaaatgcagatgcatgagagcgcacttccgtgggacgatcacagacctcaggtgacttggcgtggtgatggccagttttttgccgtgtctgtcgtttgccccgagacaggtgcccggaaggttagggtctggaatagggagtttgccttgcagtcaaccagcgagccagttgccggcctcggaccagccctggcctggaagcccagcggctctcttatagcaagcactcaggacaaaccaaaccaacaagacatcgtgttttttgaaaagaatggtctcttgcacgggcactttacactaccatttcttaaagacgaggtgaaagtgaacgatctgctgtggaatgctgactcaagcgttctggcagtgtggctggaagatctacagagagaagagtctagcatcccgaaaacttgcgtgcagctgtggaccgtaggtaactaccactggtacctgaaacagtcgctgagcttctctacctgtgggaagtctaaaattgttagtttgatgtgggaccctgtcacaccctatcggttacacgtcctctgccagggatggcactaccttgcttacgattggcactggactaccgatcggtcagttggggacaacagtagtgacctgtctaatgtcgcagtgattgacggcaatcgtgttctggtgaccgtgttcaggcagactgtggtccctcccccgatgtgcacgtaccagctgctcttccctcacccagttaatcaggtcacttttctcgcgcatccccagaaatctaacgatcttgcagtgctggacgcaagtaatcaaatttccgtgtataagtgtggcgattgtccttccgctgaccccacggtcaagctgggagcagtgggaggcagcggctttaaggtgtgtctgcgcaccccacatctggagaagaggtataagattcagttcgagaataatgaggatcaagatgtgaacccgctcaagctgggtttattaacttggatcgaggaggatgtcttcctggccgtatctcacagcgaattctcgcccagatctgtgatccaccatctgaccgccgcctcttccgaaatggacgaagaacacggtcagctaaacgtctcatcatctgcggcagtggacggtgtgattatcagcctgtgctgcaactcgaaaacaaaaagcgtggtcctgcagttggccgatgggcaaatctttaagtatctgtgggagtcacccagcttagccattaagccctggaaaaattccggtggtttccctgtacgattcccctacccatgcactcagacagaactcgctatgattggggaggaggagtgtgttcttggcctgaccgacaggtgcagatttttcattaatgatattgaggtggctagcaacattaccagctttgcagtgtacgatgaattcctcctgctaaccactcacagccatacctgccagtgcttctgtttgagggacgcctctttcaagacactgcaggccggccttagctctaaccacgtgtcacacggcgaggtgctcagaaaggtcgagcgagggagtcgcattgtcacggtggtcccccaggacacgaagctggtgttacagatgccacgcggtaatctagaagtagtacaccatcgggcgctagtgctcgcccagatcaggaagtggctcgacaagttaatgtttaaggaggcttttgagtgtatgcggaagctgagaattaatctaaatctgatttacgaccacaaccccaaagtctttctcgggaatgtagaaacattcatcaagcagatcgactccgttaaccatatcaaccttttcttcaccgaactcaaggaagaggacgtcacaaagacaatgtatcccgcgccggtcactagctccgtctatctttcaagggatccggacgggaacaagattgatctggtctgcgatgcaatgagggctgtgatggaaagtattaaccctcataagtactgtctctctatcctgactagtcatgtaaagaagaccacacctgaactcgaaatcgtgctccaaaaagtgcacgagctgcaggggaacgcgccttctgaccccgatgccgtatctgctgaagaggcactgaagtacctgttgcacctcgttgatgttaatgagttatacgatcactcattgggcacctatgactttgacttggtcttgatggtcgccgagaaatctcaaaaggacccaaaggagtatctgccgtttttaaacaccttgaaaaaaatggagaccaactatcagcggttcaccattgataaatatctaaagcggtatgaaaaagctatcggtcacctgtctaaatgtgggcccgaatattttcccgaatgcctgaacctgataaaagataagaatctctacaacgaagcgttaaaactgtacagtcctagcagtcagcagtaccaggatatcagcatcgcctacggtgaacacctgatgcaagaacacatgtatgaaccagctggcctgatgttcgcccgatgcggggcccacgagaaagcattaagcgcatttctgacatgcggcaattggaaacaggctctctgcgttgccgcccagttgaatttcaccaaggatcagctggtcggcttgggaagaactctggccgggaaactggtcgaacaacggaaacacattgacgccgccatggtgttggaggagtgcgcccaagactacgaagaagccgtgcttctgctgttggagggcgcagcttgggaggaggcactgagactcgtctacaaatacaaccgactggacatcatcgagactaatgtcaagccaagtattctagaggcacaaaagaattacatggcttttctcgatagccagacagccactttcagccggcacaaaaaacgcctgctggtggtgcgtgaactgaaagagcaggcacagcaggcaggcctggacgacgaggtaccgcacggacaggagtcagacctgttcagcgagacatcaagtgttgtatctggaagcgagatgtctggcaagtatagtcatagtaacagcaggatttccgctaggtcaagcaaaaatagacgcaaagcagagagaaagaagcacagcctaaaagaaggcagtccactagaagatctggccctgctggaggcactctccgaggtcgtgcagaacaccgaaaaccttaaggacgaggtctaccacattcttaaagtgctatttttgttcgaattcgatgaacaggggcgggaattacagaaggccttcgaagacaccttgcagcttatggagcggagcctgcccgaaatttggactcttacatatcaacagaacagcgccacccccgtactgggccctaattccactgccaatagcatcatggctagctatcagcaacagaagacttccgtgccggttctggacgctgagttgttcatcccgccaaagatcaatcgtagaactcagtggaagctctccctgctggactag

SEQ ID NO: 191361 - DNA, 2952 bp, Artificial Sequence
  Description of Artificial Sequence: Synthetic coding sequence
atgtgggaccccgtgaccccctaccggctgcacgtgctgtgccagggatggcactacctagcttatgactggcactggaccactgacagaagcgtgggagacaactcaagtgacctcagtaatgttgcagtaattgatggcaaccgagtccttgtcaccgtcttccgccagacagtggtgcctcccccgatgtgcacgtatcagctgctgttcccccacccagttaatcaagtaacattcttagctcacccccaaaaatctaacgacctggccgtcctcgatgcttccaatcagatttccgtttacaagtgtggcgactgtccgagcgctgacccgaccgtgaagctgggtgccgtgggaggatccggattcaaagtttgtctgcgtactcctcaccttgagaaacgatataagatccagttcgagaacaacgaagatcaggacgtgaatcctcttaaactcggcctgctgacctggatcgaagaagatgtctttttggccgtgagtcactcagagtttagcccaaggtccgttattcaccatctgactgcagccagctccgagatggatgaggagcacggacagttgaacgtcagtagtagtgccgcagtggacggcgtgatcattagtctgtgttgtaatagtaagaccaaatccgtagtcctgcagctcgctgacggccaaatttttaagtacctctgggagagtccttctctggctattaagccttggaagaatagcggcggctttcccgtgcggttcccttacccatgtactcagaccgagctcgccatgatcggggaagaagagtgtgtactggggctcaccgaccgatgtagattcttcataaacgacatcgaagtggccagtaacataactagtttcgccgtgtacgacgaatttctgttgctgaccacacattcacatacatgccagtgtttctgtctccgagatgcatcattcaagaccctccaggcaggcttaagttccaaccacgtcagtcatggcgaggtcctgaggaaagttgagagaggatcaagaattgtaaccgtggttcctcaggataccaaactggttctgcagatgccacggggcaacctggaggtcgtacaccacagagccctcgttctggcccagatccgcaagtggttggacaagctgatgttcaaggaggccttcgaatgtatgcgcaagctaagaattaacctgaaccttatttacgaccacaaccctaaggttttcctcggaaatgttgagactttcatcaagcagatcgactcggttaatcatattaacctttttttcacagaacttaaggaggaggatgtcacaaagaccatgtacccggcacccgtgacctccagcgtctacctatctagggatccagacggcaataagatcgatctcgtttgtgacgcgatgagggctgtaatggaatcaataaacccacacaagtactgtttatcaatcttaacttctcacgttaaaaaaaccaccccagagcttgaaattgtactgcaaaaggttcacgagttacaggggaacgcgccaagcgacccagatgccgtctccgcagaagaggccttgaagtacctgcttcacttggtcgatgtcaatgaactgtatgaccactccctgggaacgtatgactttgacctcgtgctcatggtagcagaaaaaagccagaaggatcccaaagaatatctccccttcctcaatacattgaaaaagatggagaccaactatcagcgcttcacaatagacaagtatctcaagagatatgaaaaagccatcggccacctcagcaaatgcggccctgaatatttccccgagtgtcttaatcttatcaaggataagaatctgtacaatgaagcattaaaactgtattctccgagctcacagcagtaccaagacatcagtatagcttatggagagcatctgatgcaggaacacatgtatgaacctgctggtctgatgtttgcccggtgcggcgcacacgagaaagcactgtcagcattcttgacctgtggcaattggaaacaagccctgtgcgttgccgcccaattgaacttcaccaaggatcagctggttggactagggcggaccctggccggcaaactcgtggaacagagaaaacacattgatgcggcaatggtgttagaggaatgtgcccaggattatgaggaagcagtcctgttgctgttggagggggcagcctgggaagaagctttgcggctggtctacaaatacaaccgattggacatcatcgagaccaacgtgaagccttccatcctggaggcccagaaaaattatatggctttcttggacagccagacagctactttttccagacataagaagcgcctgcttgtggtcagggaactgaaagagcaggctcagcaagcagggctggacgatgaagtgcctcatggccaagagagcgacctgttttccgaaacatcatccgtcgtctcgggatcagagatgtccgggaagtactctcattccaattccagaatctccgcccgcagctctaagaatcggaggaaagcggagaggaagaagcactcccttaaagagggttctccattagaagatctagcgctgctcgaggctctctccgaagtcgtgcagaatactgagaatctgaaagacgaagtgtaccacatcctaaaggtgctgttcctgtttgagttcgacgaacaggggagggaactgcagaaggcttttgaggatacacttcagctcatggaaaggtccctacccgagatatggaccctgacctaccagcagaacagcgccactccggttctggggcctaactccactgccaattccatcatggcgtcctatcaacagcagaagaccagcgtgcccgtactggacgccgagctgtttattcctcccaaaatcaacagaagaacccaatggaagctcagcctgctggattag

SEQ ID NO: 191362 - DNA, 2151 bp, Artificial Sequence
  Description of Artificial Sequence: Synthetic coding sequence
atgcagagcaccgccaactacctgtggcacaccgacgacctgctggggcagggtgccactgcttctgtgtataaagcccgcaataagaagtccggcgaacttgtggcagtaaaggtcttcaacacgacttcttacctaaggccgcgcgaggtgcaggtccgagagttcgaggtgctgcgtaagctgaaccaccaaaatatagttaagttgttcgcagtggaagagacaggggggagccgccagaaagtgctggtcatggagtattgcagtagtgggtctctcctgagtgtcctggagagcccagaaaatgcattcggcttacctgaggacgagttcctggttgtgttaagatgtgtagttgctggcatgaaccacttgcgtgaaaatggaattgttcatagggacattaagcccggaaacatcatgagacttgtgggtgaggagggccaaagcatttataaattaaccgacttcggggcagcgcgcgaactggatgatgatgagaagttcgtttcagtctacggaaccgaagagtatctgcatcctgacatgtacgagcgtgcagtgctgcggaagccccaacaaaaagcttttggagtaactgtggatctatggagtattggtgtcactttgtaccatgcggcaaccggtagtctccctttcatcccattcgggggaccgcgccgaaacaaggaaataatgtatcgaatcactactgagaaacccgccggtgcgatagctggcgcacaaagacgagagaacggtcctttagagtggtcttatacactccccatcacctgccagcttagcctcggtttacagtctcagctcgttcctattttagcgaacatcctggaggtggaacaggcaaagtgctggggctttgaccaatttttcgctgaaacatctgatattctgcagagggtggtggttcatgtgttcagcttgagccaggcagtgctacatcacatttacattcacgctcacaacaccattgcaatttttcaggaagcagtacacaaacagacgtctgtggctccccggcaccaggagtacctcttcgagggtcatttgtgtgtcttggagccgagtgtatctgcacagcacatcgcccataccactgcgagttcaccgttaacccttttctcgacagccattccgaagggacttgcgtttcgggaccccgccctggatgttccaaagtttgtgcccaaggtcgaccttcaggcagattataacaccgcgaagggagtgttgggggcaggctatcaggccctgaggctggcccgggcgctgttagacggtcaggaactgatgttcaggggactgcattgggtgatggaggtgctccaggccacctgccgccgcactctagaagttgcacgaacttctctcctatatctgagttcatccctcggcactgagaggttcagcagcgtggccgggacaccagagatccaggaactgaaggcagccgcggagctaagaagcaggctgagaacacttgcagaggttttatcccgctgctctcagaacataacagaaacccaagaatcattatcatcactgaatcgtgagctcgttaaatcacgcgatcaggttcacgaggatcgctccatccagcagatccaatgctgccttgataaaatgaacttcatatacaagcagttcaagaaatcgcgcatgcgcccggggctggggtataacgaagaacagattcacaaactggacaaggtgaatttctcgcacttggccaaacgactgctgcaggttttccaggaggaatgcgttcagaaataccaagctagccttgttactcacggtaaacgcatgagagtggtgcacgaaaccaggaaccacttgagacttgtgggatgtagcgtcgcagcttgtaatactgaggcacagggagttcaggaaagcctctctaaactgcttgaggagctctcacaccagctgctacaggaccgagcaaagggcgcacaagctagcccgcctcctatagcaccatatccatcccccacccgtaaagacttgttgctgcacatgcaggaactgtgcgaggggatgaagcttctggcgagtgacctgctagataacaaccgtatcatcgaacgcttgaatagagtgcctgcaccacccgatgtctag

SEQ ID NO: 191363 - DNA, 1896 bp, Artificial Sequence
  Description of Artificial Sequence: Synthetic coding sequence
atggagtactgcagcagcggcagcctgctgagcgtgctggagagcccagagaatgccttcggactgcccgaagacgagttccttgtcgtactgaggtgcgtcgttgcgggtatgaatcatttacgagaaaatggaatcgtgcaccgcgatataaagccagggaacatcatgcgcctcgtaggggaagagggccaaagcatctataagctgacagacttcggtgcagcccgggaactggatgatgacgaaaagtttgtttccgtgtatggcacagaagaatacctacaccccgacatgtatgagagagcagtcctacggaagcctcagcaaaaagccttcggggtcactgtcgacctttggtcgatcggagtgaccctttatcacgcggctaccggttccttacccttcatcccatttgggggaccacgcagaaacaaagagatcatgtacaggattacaaccgagaaaccagctggggctattgcaggagcccaaagacgtgagaacggtccactggaatggtcttatactctgcctatcacctgccaacttagcctcggcctccagtcccaacttgtgcccatcttggccaacatcctcgaagtggagcaggctaaatgttggggtttcgaccaattctttgctgaaactagcgatattttgcagagagtcgtggtgcatgttttttccttgtcccaggccgttctccatcatatttacatccatgctcataatacgattgccatcttccaggaagccgtccacaagcaaacttcagtagcccccaggcatcaggaatatctgtttgaaggccacctgtgcgtgctggaacctagtgtgtcagcacagcacatcgctcacacaacggcaagtagcccattaacactcttttccacagctatacccaaggggctggcattccgggaccccgctctggacgtgcctaaatttgttccaaaagtggatctgcaggccgactacaatactgccaaaggggttctgggtgcaggatatcaagccctgcgcttagctagagctttgctggatgggcaagaactaatgtttcgaggcttgcattgggtcatggaggtgctgcaggccacttgccgccgcaccctggaggtcgctagaaccagtcttctgtatctcagctcctctctaggaaccgaacgattttccagcgtggccggcacccccgagattcaagagctcaaggccgccgccgaacttcgaagtcgactgaggacactggctgaagttctcagtcggtgttcccaaaacattactgagacacaggagtccttaagcagcctcaaccgggaactggtcaagagtcgcgaccaggtacatgaggataggagcatccagcagattcaatgttgtctggacaaaatgaactttatttataagcagtttaagaaaagcaggatgaggccaggactgggttataacgaagaacagattcacaagcttgataaagtcaacttttctcacctcgccaaacggctcctgcaagtgttccaggaggagtgcgtccagaagtaccaagcctccctggtgacacacggtaaacgcatgagagtggtacacgagacgcgcaaccatctgcgcctcgtgggctgcagtgttgcagcatgtaacaccgaggcccagggggtgcaggagtcactctcaaagctactggaggaactctctcaccagctgctgcaggacagagcaaagggcgcccaggcttcgcccccccctatcgctccatatcccagccccacccgcaaggatctgctgctgcacatgcaagagttgtgcgagggaatgaagctactagcttctgatttgctcgacaataataggattattgagagattgaatcgagtgccggccccacctgacgtgtag

SEQ ID NO: 191364 - DNA, 1107 bp, Artificial Sequence
  Description of Artificial Sequence: Synthetic coding sequence
atgaaccggcacctgtggaagagccagctgtgcgagatggtgcagcccagcggcggacctgcggccgatcaagacgtgcttggagaagagtccccactgggaaagcctgcaatgctgcacctgcctagcgaacagggggccccagaaactctacaaagatgtctggaagagaaccaggagctcagagatgccatccggcagtctaaccagatcctcagggaaagatgcgaggaattgctccactttcaagcctcgcagcgggaggagaaagagttcctgatgtgtaagtttcaggaagccagaaagttggtagagcgcctaggactggagaaactggacctcaagcgccaaaaagagcaggcgctgagagaagtggagcacctcaagcggtgccaacagcagatggccgaggacaaggcatcggtgaaggctcaggtgaccagtctgctgggggagctgcaggagtcccagagccgcctagaagctgcaaccaaggagtgccaggctctggaaggccgcagaaaactggcacagctgcaggtcgcctaccatcagctctttcaagagtacgataaccacattaaatccagcgtggtcggatcagagagaaagcggggcatgcagctcgaagacctgaaacaacagctccagcaggcagaggaggccctggtggcgaagcaggaggtaattgataaattgaaagaagaggccgagcagcataaaattgtgatggaaaccgtgcccgttctcaaagctcaggcagacatctacaaagccgattttcaggccgaacgacaagctagagagaagcttgcggagaagaaagaactcttgcaggaacagttggaacagctacagagggagtactctaagctgaaggcctcttgccaggagagcgctagaatcgaggatatgcgaaagcgtcatgtcgaggtttcccaggcccctctgcctcccgctcctgcatatctctcttcccccttggccttaccatcccagcgccggagccccccagaagagccacctgacttctgttgtcctaaatgccaataccaggccccggatatggataccctccagatacatgtgatggaatgtatagagtag

SEQ ID NO: 191365 - DNA, 1260 bp, Artificial Sequence
  Description of Artificial Sequence: Synthetic coding sequence
atgaaccggcacctgtggaagagccagctgtgcgagatggtgcagccctcaggcgggcccgctgccgatcaggacgtcctgggcgaggagtcaccactggggaaacctgccatgctgcatctgccttctgaacaaggggcccccgaaaccctacagcggtgcctggaagagaatcaggagctccgggacgccattcggcagagtaaccagatcctgagagaaagatgtgaggagctcctgcatttccaggccagtcagcgcgaggagaaagaattcctaatgtgcaagtttcaggaagccagaaaattagtggagcggctcggactggaaaagctcgacctcaagaggcaaaaagagcaggccctgcgcgaggttgaacatctgaaacgatgtcagcaacagatggctgaggacaaggctagtgtgaaggcgcaggtgacctcccttctgggagagttgcaggagtcacaatcaaggctcgaggccgccacaaaggaatgccaggctctcgagggcagggcacgggctgctagcgagcaggcccggcagctggaatcggaaagagaggctcttcaacagcagcactcggtgcaggtagatcagttacgaatgcagggacagtccgtggaggccgctctgaggatggaacgtcaggctgcatcagaggaaaagcggaagctggcccaactgcaggtagcttaccaccagttgttccaagagtacgataatcatatcaaatcatccgtggtggggtctgaacgaaaaaggggaatgcagctggaagatctgaaacaacagctacaacaggcagaggaggctctggtggcaaagcaggaggtcattgacaagcttaaggaggaagcagaacaacataagatcgtcatggaaaccgtgcctgtgcttaaggctcaggcagatatctacaaggccgattttcaagccgagaggcaggcacgcgaaaaattagcggagaagaaagagttactccaagagcagctggagcagctgcagcgcgaatactcgaaattgaaggcctcctgtcaagaatctgctagaatagaggacatgaggaagcggcacgttgaagtgtctcaggcccccttacctcctgcccccgcctaccttagttcacctctcgcactaccttctcagcgccgatcgccgcctgaggaaccaccggatttttgctgccctaagtgccagtatcaagctcctgacatggacaccctccagatacacgtgatggaatgtatcgagtag

SEQ ID NO: 191366 - DNA, 1260 bp, Artificial Sequence
  Description of Artificial Sequence: Synthetic coding sequence
atgaaccggcacctgtggaagagccagctgtgcgagatggtgcagccatccggcggcccggcagccgaccaggacgttctcggcgaggaaagcccccttggcaagcccgccatgctccatctgccctctgaacagggagccccggaaactttgcagaggtgtctggaggaaaatcaggaacttcgggacgctatacgccaatccaatcagatactgcgagaaaggtgcgaggagctgcttcactttcaagccagccagcgggaggagaaagaatttttgatgtgtaaattccaggaggccaggaaactagtggagcggctggggcttgagaaactagatctgaaaaggcagaaggagcaggctctccgggaagtggaacaccttaaaagatgtcagcagcagatggcagaggacaaagctagtgtcaaggctcaagtgacaagccttctcggggagctgcaggaaagtcagagcagattggaagcagccacaaaggaatgccaggcactggaagggcgggcaagggcggcatccgaacaggcaagacagctggaaagcgagagagaggccttgcaacaacagcattccgttcaggtggaccagctccgcatgcaagggcagagcgtggaggccgctctccgcatggagcggcaagcagccagcgaggagaagcgaaagctggcccagctgcaggtcgcttaccaccagttattccaggagtatgataaccatattaaatcctccgtagtgggatcagagcgcaaacgagggatgcaactggaggacctcaagcagcagctgcagcaggccgaggaggcgctggtcgccaagcaggaagtgatagataagctcaaagaggaagcagagcagcacaagattgtgatggagactgttcctgttcttaaggcacaggctgacatatataaggcggacttccaagccgaacggcaagcgcgggagaagctggcagaaaaaaaggagttgctgcaggagcaactcgagcagctgcagagggaatattcgaagctcaaagcctcttgccaggagtcagcacgaattgaagacatgcgcaagcgacacgtggaggtttcccaagcaccccttcctcctgcacccgcctatctttcatccccactggccctaccgtcccagagacgttcaccccccgaagagccaccagacttttgctgcccaaagtgtcaatatcaggcgccagatatggatactcttcagatccatgtcatggagtgtatcgagtag

SEQ ID NO: 191367 - DNA, 1260 bp, Artificial Sequence
  Description of Artificial Sequence: Synthetic coding sequence
atgaaccggcacctgtggaagagccagctgtgcgagatggtgcagccatcaggcgggcctgctgccgatcaggatgtgctcggagaggagtctcccctgggcaagcctgcgatgctgcacctgccatccgaacagggagcccccgagacattgcagcggtgtctcgaagaaaatcaggagcttagggatgcaatacgccagtccaatcagatcctgagggaacgatgtgaggagctcttacactttcaggctagtcagcgcgaagaaaaggaatttctcatgtgtaagtttcaagaggcgagaaagctagtcgagcgccttgggctggaaaaactcgatctcaagagacagaaggagcaggctctccgcgaggtggaacatctgaaacgctgccagcagcagatggccgaggataaggccagcgtgaaggcccaggtgacctccttgctaggggagttgcaggaatcacagtctaggttggaagccgcgaccaaggaatgtcaagccctggaaggacgggctcgtgctgcgtctgagcaggctcggcagttggaaagcgaaagggaggccctccaacaacaacactccgtccaggtggatcagctgagaatgcaggggcaatctgtcgaggcagcactccgcatggaacgccaggcagcttctgaagagaaacgcaagctggcacagctccaggtcgcctaccatcaactcttccaggagtacgacaaccacattaaatcttcggtcgtgggtagcgaacggaaacggggaatgcagttggaagacctgaaacagcagttacagcaagctgaagaggctttggtggccaagcaggaagttatcgacaaattgaaggaagaggcagaacagcataagatcgtaatggagaccgtcccagtgttgaaagcgcaggccgatatctataaggctgatttccaggcggaaagacaagcccgagaaaagctcgccgaaaagaaagaactgctgcaggagcagctggaacagctgcaaagggaatacagcaagctcaaggcttcatgccaggaatctgctcgcattgaagatatgagaaagagacatgtggaggtgagccaggccccactccctccagcacctgcgtatctgagcagccctttagctctaccaagccagcgtaggtccccccccgaggaaccacctgatttttgttgtcccaagtgccaataccaggcacccgacatggatacactgcagattcacgtgatggagtgtatcgaatag

SEQ ID NO: 191368 - DNA, 1464 bp, Artificial Sequence
  Description of Artificial Sequence: Synthetic coding sequence
atggccctggtgatccaggtgggcaagctgcggccccgggaggtgcggacgcctcaaaccattaacccctcgctgtttccaagcctgcctgtgaaactttcctctatcatagaggttccgtctggtggcgaaagatgttgctcgagacggaccctggtgtacaaagcccgcgctttctggaagggggcgcctctgccatgttggatgaacaggcatctgtggaaaagtcagctgtgtgagatggtccagccgagtgggggacctgcagctgaccaagacgtcctgggagaagagtcaccactcggtaagcccgctatgctccacctgcctagtgaacagggcgctccagagactctgcaacggtgcctggaggaaaatcaagagttgcgtgatgccataagacagtccaatcagattttgcgagagagatgtgaagagctgctgcacttccaggcgagtcaaagggaggagaaggagttcctgatgtgtaagtttcaagaagccaggaagcttgtggagcgcctaggcctggaaaagctggatctgaaacggcagaaagaacaggcgctgagagaggttgaacacctgaagcgatgtcagcagcagatggccgaggataaggcatccgtgaaggcccaggtaacatcacttcttggtgagttgcaggaatcccaatcccgcctggaagctgcgacaaaggagtgccaggccttggagggccgtgctagagccgcatccgagcaggcaagacaactggagtcggagagggaggcattgcagcaacagcactccgtccaggtcgatcagttgcggatgcagggacaaagtgtggaggccgcgctgaggatggagaggcaggcagcgagtgaagaaaagcgcaagcttgctcagctacaggttgcttaccaccagctgtttcaggaatatgataaccacattaaaagcagtgtggtcgggagcgagcgtaagcgcggtatgcaactggaagacctgaaacagcaacttcagcaggccgaagaagcactagttgccaagcaggaggtgatcgacaaactgaaagaagaggcagaacagcataaaatcgtgatggagacagtacccgtgctgaaagcacaagcagatatctataaagccgacttccaggctgagaggcaagctcgtgagaaactggctgaaaagaaagaactgctacaggagcagcttgagcagttgcaacgcgagtactcaaaactcaaagctagctgtcaagaatcagcccggatcgaagatatgcgcaagcggcacgttgaggtatcacaggctccactgccacccgctcccgcgtacctcagttcccccctggccctgccttcacaacgacggagcccccctgaagagcccccagatttctgctgccccaaatgccagtaccaagcccctgatatggacacccttcagatacacgtcatggaatgcatcgaatag

SEQ ID NO: 191369 - DNA, 621 bp, Artificial Sequence
  Description of Artificial Sequence: Synthetic coding sequence
atgaaccggcacctgtggaagagccagctgtgcgagatggtgcagcccagtggagggccagctgctgatcaagatgttctcggtgaggaatccccactcggcaaacccgcaatgctccacttacctagcgagcagggggctccagagactttgcagcgctgcctcgaagagaatcaggagttgagggatgccatacggcaaagcaaccagatacttcgcgagaggtgtgaagagttgctccatttccaagcttctcagagggaagaaaaggaattcttgatgtgcaaatttcaggaggccagaaagttggtggagaggctcgggctagagaaactcgatctgaagcgacagaaggaacaggcactgcgggaagttgaacatctgaagcgttgtcagcagcagatggccgaggacaaagcctcagtaaaggctcaggtaacctctctcttaggagagttacaagagtctcagagccgcctcgaggcagctacaaaagagtgtcaggctctcgaaggtcgggcacgggccgccagcgaacaggcaagacaactagaatccgagcgtgaagcgttgcagcaacaacacagcgtgcaggtggaccagctccggatgcagggatag

SEQ ID NO: 191370 - DNA, 756 bp, Artificial Sequence
  Description of Artificial Sequence: Synthetic coding sequence
atgaaccggcacctgtggaagagccagctgtgcgagatggtgcagccttccgggggtcccgctgcagaccaggatgtcctcggcgaagagtcccctcttggcaagcctgcgatgcttcacttgccgagcgagcagggggctcccgagacactgcagcgatgcttagaggagaatcaggaactgagagacgctatacggcaaagcaaccaaatcctgcgtgaacgctgtgaagagttactacacttccaggctagtcagagggaggaaaaggaattcctgatgtgcaagtttcaagaagcacgcaaactggtggaaaggctaggcttggaaaagctggaccttaagagacagaaggagcaggctctcagagaagtggagcaccttaaacgatgccagcagcagatggcagaagataaagcctccgtgaaggcgcaagtgacatccttattgggggagttgcaggagagtcagtctcggctggaagccgccaccaaggaatgtcaagccttggaaggcagggcgcgagccgcgtcggagcaggcccgccagttggagtcagagcgggaagcactgcagcagcaacatagtgtacaagtggatcagcttcggatgcaggggcaatcggtagaggcggccctgagaatggagcggcaggcagctagtgaagagaagcggaagctggcccagctccaggttgcctatcaccagctcttccaagagtatgacaaccatattaagtcctccgtagtgggctag

SEQ ID NO: 191371 - DNA, 417 bp, Artificial Sequence
  Description of Artificial Sequence: Synthetic coding sequence
atgaaccggcacctgtggaagagccagctgtgcgagatggtgcagccatcgggcggccccgccgccgatcaggacgttcttggggaagagtcccccttggggaaaccagccatgctgcacctgcctagcgagcagggcgcccctgaaacattgcagaggtgcctcgaagaaaatcaagagctcagggatgccatccgacaatcaaaccagatcctgagagagcggtgtgaggaactcctgcatttccaagcaagtcagagagaagagaaagaatttctgatgtgtaagttccaagaagctcggaagctcgttgaacgacttggtctggagaagctggatctgaagaggcagaaggaacaagctctgcgggaggttgagcatctcaaaaggtgccagcagcagatggctgaggattag

SEQ ID NO: 191372 - DNA, 1257 bp, Artificial Sequence
  Description of Artificial Sequence: Synthetic coding sequence
atgaaccggcacctgtggaagagccagctgtgcgagatggtgcagcctagcgggggacctgccgctgatcaggatgtgctgggtgaggagtcacctctaggcaagccagccatgctgcacttaccctcagagcagggtgccccggagacacttcagcggtgcctcgaagagaatcaggaactcagagacgccataagacagtctaaccagatccttagagaaagatgtgaggaattactgcacttccaggccagtcaaagagaggagaaagagttcctgatgtgtaaatttcaggaagcccgtaaattagttgagaggctgggcctcgaaaagcttgatctgaaacgtcagaaagagcaggccctgcgggaagtggaacacttaaagcgttgtcaacaaatggccgaggacaaagcctccgtaaaagctcaggtgactagcttgctgggtgaactccaggagagtcagagccggctggaagctgccactaaagaatgccaggctctggagggaagggcccgggccgcgagtgagcaggccaggcaactagagagcgagagggaggctctgcaacagcaacattctgttcaggtggaccagctacggatgcagggacaatcggtggaggctgcattgaggatggagcgccaggccgcttctgaagaaaaacggaaactcgcacagctccaggtggcctatcaccagttgtttcaggagtatgataaccacatcaagtccagcgtagtggggtcggagagaaaacgagggatgcagttggaagatctgaaacagcagctgcagcaggccgaagaagccctggtggctaaacaggaagtgatcgacaaattgaaggaggaggccgagcagcacaaaatcgttatggaaacagtgccagtgctgaaggcccaggcggatatttacaaggctgattttcaagctgaaaggcaggcgcgtgagaagcttgccgaaaaaaaagagctgctgcaggaacagctcgagcagctccagagagagtactcgaagttaaaagcctcatgccaggagtcggcacggattgaagatatgcgaaagcgccacgtggaggtgtcccaggcccccctacctcctgccccggcctatctctcaagcccgctggcgctgccttcccagagacgcagccccccggaagagcccccagatttttgctgccctaaatgccaatatcaggccccagacatggataccctgcaaattcacgttatggagtgcatcgagtag

SEQ ID NO: 191373 - DNA, 2181 bp, Artificial Sequence
  Description of Artificial Sequence: Synthetic coding sequence
atgctgcgggcctgccagctgagcggcgtgaccgccgccgcccagtcctgtctttgcggtaagttcgttctacgtcccctgagaccgtgtaggcggtacagcaccagcggatccagcggcctgacaacaggaaagattgcaggagcgggcctactattcgttggaggaggaatcggaggaaccattctctacgccaagtgggactcacatttccgggaaagtgtcgagaaaaccataccctacagcgacaagctgtttgagatggtgctcggccctgccgcatacaacgtgcccctaccaaagaagagtatccagtctggccctttgaaaatctccagcgtttccgaggtgatgaaggagtcaaagcaacctgcctcacagcttcaaaagcagaaaggggacactccagcaagtgctactgcccctaccgaggccgcccagatcatttctgcagcgggcgatacattgagtgtgcccgctccagccgtgcagcctgaggagagtttgaaaaccgaccatcccgaaataggcgaggggaagcccacccccgccttgagcgctctggctaagtcccttgaggacgcgctgagacagactgcctcggtcacgttgcaagccatcgccgcccagaacgcagccgttcaagctgtgaatgctcatagcaatatactgaaagccgccatggacaattcagagattgctggcgaaaaaaagagtgctcagtggcggactgtggagggggctctaaaagagcgtaggaaagctgtcgacgaagcagcagacgctttactgaaagccaaggaagagctcgaaaaaatgaagtcggtgatcgaaaatgcgaaaaaaaaggaagttgccggggccaagcctcacataacggccgcagagggaaaactccacaatatgattgtggacctggacaatgtggtgaagaaggtccaagctgcccagtcggaggccaaggtggtgtcacagtaccacgagttggtggttcaggctcgggatgatttcaagagagagctggattcgatcactcccgaggtgctgccagggtggaagggcatgtctgagtacaatttggccgataaactgtcaaccgatgacctcaacagcctgatcgcccatgcgcataggcggatcgaccagctcaacagggagcttgccgaacagaaggccacagagaaacaacacataacactcgctctggaaaaacagaagcttgaagaaaagcgtgcttttgacagtgccgtggccaaggccttggaacatcatcgaagtgagattcaggcggagcaggatcggaagatagaggaagtgcgagatgccatggagaacgaaatgagaacgcaactacggcgacaagctgccgctcacaccgaccacctgcgagatgtcctccgggttcaagagcaggaacttaaatccgaattcgaacagaacttatcggaaaagctgtcggaacaggaactccagtttcgacgcttgtcccaggaacaggtcgataatttcaccctagatattaacacagcttacgctcggttgaggggaatagagcaggccgtacaatcgcatgctgtggcggaagaagaggcacgcaaggcacatcagctgtggctgagtgtggaggctttgaagtacagtatgaagacaagcagcgctgaaaccccaactatccctctgggtagtgccgttgaggcaattaaggccaattgcagtgataatgagtttacacaggctctgacagccgccatcccaccggaatccctcaccagaggggtgtactcggaagagaccctccgtgcaaggttttacgcagtacagaaactagccaggagagtggccatgattgatgaaactagaaactcgctctaccagtatttcctttcatatttacagtctctccttctgttccctccgcagcagttgaagccacctccagagctctgccctgaagatatcaatacgttcaagttactgagctacgcgtcctattgtatcgagcatggagatctggagctggccgccaagtttgtgaaccaattgaagggtgagtcacgccgagtcgcccaggactggctcaaggaagcccgcatgaccctagagactaagcagattgtggaaatcctgacggcctatgccagtgccgtggggatcggaacaacacaagtgcagcctgagtag

SEQ ID NO: 191374 - DNA, 1119 bp, Artificial Sequence
  Description of Artificial Sequence: Synthetic coding sequence
atgctgcgggcctgccagctgagcggcgtgaccgccgccgcccagtcttgcctctgtggaaaattcgtcctgaggccactcaggccttgccgcaggtattcaacctcagggagttcggggctcactactggcaagatagccggagcaggcttgctgtttgtgggcgggggcatcggcggaaccattctgtacgccaagtgggacagtcacttccgggaatcagtggaaaaaactatcccttattcagataagttatttgaaatggtgctaggtcctgccgcttacaatgtcccgctccccaagaagtctattcagtcaggaccattaaaaatatcgtctgtgtccgaagtgatgaaagagtccaaacagcccgcctcgcaattacaaaagcagaaaggggatacacccgcatccgccaccgctggcgatactcttagcgtacccgcccctgccgtgcagccagaggaatctttgaaaactgaccaccctgagatcggagagggaaagcccaccccagccctgtcagaagcaagcagctcttcaattcgcgagaggccgccagaggaggtcgccgctcgccttgctcaacaggagaagcaggagcaagtgaagattgagtcacttgctaaaagcctagaggatgcgcttaggcaaactgcttctgtcacactccaagccattgccgccataccgcctgagagcctgacccgcggagtttatagcgaagagactcttcgtgccaggttttacgctgtccaaaagctcgccaggagagtagctatgattgacgagacacgtaattctctgtatcaatactttctgtcttatctccagtctctgctgttgttccctccccagcaactaaagccacctcctgaactctgtccggaagatataaacaccttcaagttgttatcctatgctagctactgtattgaacatggcgacctcgagcttgctgcaaagttcgtcaaccagctcaaaggcgagagccgccgagtggcccaggactggttgaaagaggcaagaatgacgctggagaccaagcaaattgttgagatccttacagcctacgcgtctgccgtcgggatcggcaccacacaggtgcagccagagtag

SEQ ID NO: 191375 - DNA, 1980 bp, Artificial Sequence
  Description of Artificial Sequence: Synthetic coding sequence
atgctgcgggcctgccagctgagcggcgtgaccgccgccgcccagtcctgtctctgtgggaaattcgttttgagacccctccggccatgtcgcagatacagcacttccggaagtagcgggcttacgaccggtaagatagctggcgctggactcttatttgtcggtggggggatcggcggcaccattctgtatgcaaagtgggactcccatttcagagagtccgtggaaaagacgattccatacagtgataagctattcgaaatggtactgggacctgcagcatataatgtccccctcccgaaaaaatcaatacaaagcggtccactgaaaatctcttccgtgagcgaagtgatgaaggagtccaagcagcctgcttcacagctccagaagcaaaagggagatactcccgcgtccgctacagcactggccaaaagtcttgaggacgcccttaggcaaacagcaagcgtaacacttcaggccattgctgcacagaacgccgcagttcaggccgtcaatgcgcatagtaacatccttaaggctgctatggacaactccgaaattgccggcgaaaaaaagagcgcacagtggagaaccgtcgaaggggccctgaaggagaggcgtaaggccgtggacgaggcggctgatgctttgttaaaagcgaaggaggagctggaaaagatgaagagtgtcatcgaaaatgctaagaagaaggaggtggcaggcgccaaaccccatattaccgcggccgaggggaagctgcacaatatgatcgtcgacctggacaacgtagtgcaggccagggatgactttaaaagggagctggattctataacaccagaggtgcttcccggatggaagggaatgagcgtttccgatctggccgataaactatccaccgacgacctgaacagtctgatcgcccatgcccacagacgcatcgatcagctgaacagagaactggctgaacagaaggcaactgaaaaacaacatataactttggccctggaaaaacagaaactcgaagagaagagagctttcgacagcgctgtggccaaggcactggaacaccacagaagcgaaatccaagctgagcaggatagaaaaatcgaagaggtgcgcgacgctatggaaaatgaaatgagaacccaacttcgacgccaagccgccgcacacaccgatcatctgagagatgtgcttcgggtgcaagagcaggagttgaaatcggagtttgaacaaaatctgtccgagaagcttagtgaacaggaacttcagttccggaggctcagccaggagcaggtcgataacttcacgctcgacattaacacagcgtatgcccgcttaaggggaatcgagcaggcagtccaaagccatgccgtcgctgaagaggaagctcgcaaggcgcatcagctgtggctttccgtggaggccctaaaatattctatgaagacatcctccgctgagaccccgactatcccactgggctccgcggtcgaggccatcaaggccaactgctccgataatgaattcactcaggcactgactgccgctattccaccagagagcctgactcgcggagtgtactcagaagagacccttcgcgcccgcttttacgccgtccaaaaactggcaaggagggtggccatgatagacgaaaccaggaactccctctatcaatatttcctgtcatacctgcagagtcttcttctgtttcccccgcagcagttgaaacctcctcccgaactttgccctgaggacattaacacattcaaactgctaagttatgcctcctactgtatagagcacggagacttggaactggccgctaagtttgttaaccagcttaagggtgaaagtaggagggtcgcacaagactggctgaaagaggcgcgtatgaccttggagacaaaacagatcgtcgaaatacttaccgcttatgcaagtgctgtgggtattggcacaacacaagtgcagcccgaatag

SEQ ID NO: 191376 - DNA, 2277 bp, Artificial Sequence
  Description of Artificial Sequence: Synthetic coding sequence
atgctgcgggcctgccagctgagcggcgtgaccgccgccgcccagtcctgcctgtgtggaaaattcgttctgcgtcctcttaggccgtgcaggcgctattctacttccggctcatctggattaacgactgggaagatcgccggagctggccttcttttcgtcggtggaggtattggcggcactatactgtatgcaaagtgggactcccattttagggaaagcgtggagaaaactattccctactcagacaagctttttgagatggtgctcgggccggctgcttataatgtgcctctgccaaagaaatcaattcagtccgggccgctaaagattagctccgtgagtgaagttatgaaagagagtaagcagcccgccagtcagctacaaaagcagaaaggggatactcccgcaagcgctaccgcgccgactgaagcagctcaaatcattagcgcggcaggtgacaccctgtcagtcccagctcccgccgttcagccggaggagtccctaaaaacggatcaccccgagatcggagagggcaagcctacacctgcgctgtccgaggaagcctcatcctcatcgattcgtgagcgcccccccgaggaagtggctgcacgactggcacagcaagaaaagcaagagcaggtaaagatcgagtcccttgctaaaagcctcgaagatgcattgcgacagacagcttctgtgacccttcaggcaatcgctgcccagaacgctgcagtgcaagccgtgaatgcccatagtaacatcttgaaagcggcaatggataactccgaaatcgccggcgaaaagaagtctgcccagtggagaacagttgagggtgcactcaaggagcgcaggaaagccgttgacgaggcagctgacgcgctgctgaaggcaaaggaggaattggagaaaatgaagtcggtgatcgaaaatgcaaaaaagaaagaagtagcaggagcaaagccccatatcactgccgcagagggaaagttacataacatgatagtagatctcgataatgtggtgaagaaggtccaagccgcacaatctgaggcgaaagtcgtcagtcagtatcatgagcttgtggtgcaggccagagatgatttcaagcgggaactggactccattacaccagaagtgctgccaggctggaagggcatgtccgtatctgacttggccgacaagctgtcaactgatgacctcaattccttgatcgcccatgctcaccgtcgcatagaccagctgaaccgggaactagccgagcagaaggctacagagaagcaacacatcaccctggccctggagaagcagaagttagaggagaagagagcgtttgactccgcagtggccaaagcgttagagcatcaccggtccgagatccaggctgaacaggatcggaagatcgaagaagtgagggacgccatggagaatgaaatgagaacccaactccggcgccaggctgccgcccacactgaccacttgcgcgatgtcctgagggtgcaggagcaggagttaaagagtgagtttgaacagaacctaagcgagaaattgtctgagcaagagctgcagtttaggagactctctcaagaacaggtggacaattttaccttggacataaatacagcttacgcacgattgcgaggaatcgagcaggctgtccagtcccacgctgtcgccgaggaggaggctcgcaaggcacaccagttatggctcagtgtggaagccctgaagtactccatgaagacgtcgtctgctgagaccccaacgatccctctgggctcagctgtggaggctattaaggcaaactgttcagataacgagtttacacaggccttaacagctgctattccacccgagtccctcacccgcggagtttactctgaagaaacattgagggcccgtttttatgccgtgcagaagctggcaaggcgcgtggccatgatcgacgaaacaagaaactctctgtaccagtacttcctttcttatctgcagtcactcttactatttccaccacagcagcttaagccaccacccgaactgtgcccagaagacatcaatacatttaaacttctaagctacgcgtcctattgcatcgagcatggagacctggagctggccgccaaatttgtaaaccagctgaaaggcgaatccaggagagtggcacaagattggctgaaggaagcccgaatgaccctagagaccaagcagattgtcgagattctcactgcatatgcaagtgctgtgggtataggaaccacgcaggtacaacctgagtag

SEQ ID NO: 191377 - DNA, 2274 bp, Artificial Sequence
  Description of Artificial Sequence: Synthetic coding sequence
atgctgcgggcctgccagctgagcggcgtgaccgccgccgcccagtcttgcctgtgtggtaagtttgtccttcgtcccctccgcccctgtagacggtattccacttccgggtcctccgggctgacaaccggaaagattgcgggagccggactgctcttcgtcggaggagggattgggggaaccatcctctatgcaaaatgggatagtcactttcgggaatccgtggagaaaactattccctatagtgacaagctgttcgaaatggtgttaggtcctgccgcctacaacgtaccactgcccaagaagagtatccaaagtggaccacttaaaataagcagcgtcagcgaagttatgaaagagtctaaacagccagccagtcaattgcagaaacagaagggcgatacacccgcgtctgcgacggctcctacagaagctgcccagatcatttctgccgccggagacaccctcagtgttcccgcccctgcggtacagccagaagagtctctaaagacagatcacccagaaatcggggagggcaagccaacaccagcgctgagcgaggcctcctctagcagcatccgagaacggccacctgaggaggtggcagcaagactggcccagcaagagaaacaggaacaagtgaaaatcgagtccctggccaagtccctggaggacgcactgcggcaaactgcaagcgtaacactgcaggccatcgcggcccaaaacgccgccgtgcaggctgtgaacgcccactccaatatcctaaaggctgccatggataatagtgaaatagccggagagaagaagtccgcccagtggaggacagttgagggggctttaaaggagagacgcaaggcggtggacgaagcggctgacgcacttttgaaggccaaggaagagctggagaagatgaaatcagtgatcgagaatgcaaaaaaaaaagaagtcgccggggccaaaccccacattaccgccgccgaaggtaaactgcacaacatgatcgtcgatctcgacaatgtggtgaaaaaagttcaggccgctcagagcgaagccaaggtggtaagtcagtaccatgagcttgtggtccaagcccgcgatgatttcaagcgtgagctggactctatcactcccgaggtgcttccaggctggaaaggaatgtcagtgtctgacctggcagacaaactgagcacggatgatcttaacagcctgatcgctcatgctcatagacgcatcgatcagctgaaccgcgagctggctgaacagaaggctactgaaaaacagcacatcacactggccctggagaagcaaaagcttgaagagaaaagagcgttcgatagcgccgtagctaaggctctcgagcaccataggagtgaaatacaggcagaacaggatcgcaaaattgaagaggtgagagacgccatggaaaacgaaatgaggacccagctgcgcaggcaggccgcagcccatactgaccacctgcgagatgtactgcgcgtccaagaacaagagctgaaatccgaatttgagcagaacctctcggaaaagcttagtgaacaggagctgcagttccgtcggctgagccaggagcaagtcgataacttcactctggacatcaataccgcgtacgctcgactccgcggtatcgagcaggcagtgcagagccacgcagttgctgaggaagaagccaggaaagctcaccaactatggctgtccgtcgaggcccttaagtacagcatgaagactagtagcgcagaaacaccgaccatcccattggggtctgccgttgaagcgattaaggccaattgcagcgacaatgagttcacccaagccttaactgccgccattcctcccgagagcctgacccggggagtctatagcgaagaaacactcagggcacggttttacgccgttcagaaactggcgaggcgtgtggccatgattgatgagacccgcaacagcttataccagtatttcctgtcatacctgcagtcgctactgctattcccccctcagcagttaaagcccccccccgagttgtgtccagaagatatcaacaccttcaaactactgagctacgcgtcctactgtatcgaacacggtgacctcgaactggctgccaagttcgttaaccagttgaagggagagtccaggcgcgtcgcacaggactggctcaaggaggctaggatgaccctcgagaccaaacagatcgtagaaattctcacggcatacgcctccgcagtcggaatcggcacaactcaagtgcaaccagagtag

SEQ ID NO: 191378 - DNA, 2244 bp, Artificial Sequence
  Description of Artificial Sequence: Synthetic coding sequence
atgctgcgggcctgccagctgagcggcgtgaccgccgccgcccagagctgcttatgcggaaaattcgtgctacggccactgcgcccctgcagacgatacagcactagcggttcatctggcctcacaaccggcaagatcgctggcgccggactgcttttcgtggggggcggaatcggaggtaccattttatacgcaaaatgggatagtcatttcagagaaagcgtggaaaagaccatcccctacagcgataaactgttcgaaatggttctgggacctgctgcttacaacgttcccctgccaaaaaaatccatccagagcggacctctgaaaatctcatcagtgtcagaagtgatgaaggaatccaaacagcccgcctcccagctacaaaagcagaagggggatacacctgctagcgccactgcgggcgacaccttaagcgtgccggctccggctgttcaaccagaggagtcacttaaaacagaccaccctgaaatcggggagggcaaacctacgcccgctctttcggaggaagctagttcatcttccattagagagcgaccccctgaagaggtggcggcgcgattggctcaacaggagaagcaggagcaagtgaagattgagtccctggccaagagtctcgaagacgctttgcggcagactgcctccgtgacgcttcaagccatcgctgcacagaacgctgcggtgcaggcggtgaacgcacatagcaatattctgaaggccgctatggataactccgagatcgccggcgaaaagaagagcgcccagtggagaaccgtggaaggcgctctaaaagaaaggcgcaaggccgttgatgaggcggctgacgccctccttaaagccaaggaagagctagaaaagatgaagtctgtaatagaaaatgcaaagaagaaagaggttgctggggctaagccacacattacagctgctgagggtaaattgcacaacatgatcgtggacttggataatgtggtcaagaaggttcaggccgcacagtcggaggccaaggtcgtttcccaataccacgagctggtcgtccaggccagagatgactttaaacgagagctggactctattaccccggaggtgctgccagggtggaaaggaatgtctgtatccgacctcgccgataagctgtctaccgacgatttgaatagcttgattgcacacgcccacagaaggattgatcaacttaacagggaactagcggagcagaaggcaacagagaagcagcacattactctggcactggagaagcagaaactcgaagagaagcgggcgtttgattcagctgttgccaaagctctggagcaccaccgcagtgagatccaggctgagcaggataggaagatcgaggaggtcagggatgcaatggagaacgagatgaggacccaactgcgccgccaggcagctgctcatacagaccacctgcgggacgtcctgcgggtacaagaacaggagctgaagagcgagtttgaacaaaacttgagtgagaagctgagtgagcaggagttacaattccgacgcctgagtcaagagcaggtggataacttcactctggatatcaatacagcctacgccaggctccggggtatcgagcaggcggtacaaagccacgccgttgctgaggaagaagcccgcaaggcacatcagctatggctaagcgtggaagcacttaagtacagcatgaagacatcttctgccgagacacctaccatcccattaggttcggctgttgaagctatcaaagccaactgcagcgataacgaattcacccaggctctgacagcagccatccctcccgagtccctcacaagaggagtgtatagcgaggaaaccctgcgcgcacgcttctacgccgtacaaaagttagctagaagggtagcaatgattgatgagaccagaaattctctgtaccagtactttctcagttacctccagagtttactgctgttcccccctcagcagctgaaaccgccccccgagctgtgtcctgaggacataaataccttcaagctgctgagctacgccagctattgtatcgagcacggggatctggagctggctgccaagtttgtgaaccaactgaagggagagtcaagacgtgttgctcaggattggttgaaagaggcaagaatgacactggaaaccaaacagatcgtggagatactgaccgcctacgcctcagctgtcggtatcggaactacgcaggtgcagccagagtag

SEQ ID NO: 191379 - DNA, 2244 bp, Artificial Sequence
  Description of Artificial Sequence: Synthetic coding sequence
atgctgcgggcctgccagctgagcggcgtgaccgccgccgcccagagctgcttatgtggcaagttcgttcttcgtcccctccgcccctgtagacgatattccactagcggctcctccggcttgacaaccggcaagattgccggtgctgggttgttgttcgtggggggcggcattggtgggacgattctctatgctaagtgggactcacacttcagggaatcggtagaaaagactattccgtatagtgataaactgtttgagatggttctggggcctgctgcgtacaatgtgccactgcccaaaaagtccattcagtccgggcccctcaagataagctccgtatccgaggtgatgaaagagtctaagcaaccggcctctcagttacaaaagcagaaaggtgacacaccagccagcgcgacggcaggggatacactgtccgttcccgcaccagcagttcagcctgaggagagtctgaagactgatcatccagagataggggaaggcaagcccacccctgccctgtccgaagaagcaagtagctcgagcatccgcgagcggccccctgaggaagttgcagccagactggcccagcaagaaaaacaggaacaggtcaagatagagagtcttgccaaatctctagaggatgccttacgacagactgcaagcgtgaccctgcaggctattgcagctcagaacgccgccgtccaagcggttaatgcacactctaacattctcaaagccgccatggacaacagcgagatagctggggaaaagaaatccgcacagtggcggactgtggagggggccctcaaagaacgccgtaaggctgtcgacgaagctgctgacgcgctccttaaagctaaggaggagcttgagaaaatgaaaagcgtgattgaaaacgcgaaaaagaaagaggtggctggcgccaaaccgcatataaccgcggccgaaggaaaactccacaacatgatcgtggatctggataacgtggtgaaaaaggttcaggctgcccagagcgaagcgaaagtagtgtcacagtatcatgagcttgtagtccaggctcgtgacgacttcaagagagaactggacagcatcacacccgaggtcttacctgggtggaagggaatgagcgagtataatttagcagataaactctccaccgatgacttgaattccttgatagcccatgcccaccgccggatcgaccagctgaatagagaactcgcagagcaaaaagcgaccgagaaacagcacattaccctagccctcgagaagcagaagctcgaagaaaaaagagcttttgactctgccgtcgccaaggcattggagcaccaccgcagcgagatacaggccgagcaggatcgaaaaattgaggaggtcagggatgccatggaaaacgaaatgcgtactcagctgcggaggcaggctgcggctcatactgatcatctccgtgatgttctgagagtgcaggagcaggagctgaaaagcgagtttgagcagaatctgtcagaaaagttgtctgagcaggaacttcagttcaggagactgtcccaggagcaggtcgacaacttcaccctggatattaatacagcctatgcccggctgaggggcattgagcaggcggttcaaagccatgcagtggcggaggaagaggctcgcaaggcacatcaactctggctctctgtggaggctcttaaatatagcatgaagacatcctcggctgagacgcctacgatcccgctcggctccgctgtggaggctatcaaagctaattgtagcgacaatgaatttacccaggcactcacagccgctatccctccggaatcgcttacccgcggtgtatactctgaggagaccctgagggccaggttctatgcagtgcagaagctggcccggcgtgtcgcaatgatcgatgagactaggaactcgctataccaatactttttgtcgtacctgcagtcactcctgttgttccctccgcagcagctgaagccacctcccgagctgtgcccagaggatatcaatacattcaagctcctgagttacgcgagttactgtatagagcatggtgatctggagctggcggcgaaatttgtcaatcagctgaagggcgagagcaggcgggtcgcccaggactggcttaaggaagctcgaatgaccctggagactaaacagattgtggagattctgacggcctacgcttcggcggtcggaataggaaccacacaggtacaaccagaatag

SEQ ID NO: 191380 - DNA, 579 bp, Artificial Sequence
  Description of Artificial Sequence: Synthetic coding sequence
atggaccgggcccaccggctgggccagaccaagcaggtgaccgtgtaccgcctgatatgtaaaggaaccattgaggaacgcattttgcaaagagctaaggaaaagtctgaaattcaacggatggtgatctcaggtgggaactttaaacctgataccctcaagcccaaggaggttgtctcattgcttctcgatgatgaggaactggaaaagaagctgcggcttagacaggaagagaaaaggcagcaggaggaaacgaacagggttaaagaaagaaagagaaaacgggagaagtatgccgaaaaaaagaaaaaagaggacgagctcgatgggaagcggaggaaggaaggcgtgaacctcgttatccctttcgtcccatcggcagacaactccaatctctccgcagatggggacgattcattcatcagtgtggactccgccatgccttccccattctcagagataagcatttcttccgagctgcacacaggtagcatccccctggacgaaagctcatctctcgccccagactccttggtgcgcaaacagggcaagggcacaaacccatcggggggccgctag

SEQ ID NO: 191381 - DNA, 4671 bp, Artificial Sequence
  Description of Artificial Sequence: Synthetic coding sequence
atggccagcgagctgggcgcccgggacgacggcggctgcaccgagctggccaagccgctgtacctgcaatacctggagcgcgccttacggttggatcatttccttcgtcagacaagtgccattttcaaccgaaatatctccagcgacgactccgaagatggtcttgatgatagtaatccactgctgccacaatccggcgatccacttatccaagtgaaggaggagccaccaaattcccttctgggggaaacctccggtgccggctccagtggcatgctcaatacatattccctgaacggagttctacagtccgaatccaagtgcgataagggcaatctgtacaacttctcgaaactcaaaaagagtaggaaatggttgaagtcaatcctcttgtctgatgagagctccgaagcagattcacagagcgaagatgacgacgaggaggagctcaacctgagccgggaggagcttcataatatgctccgactgcacaagtacaaaaagctccaccagaacaaatactcaaaggataaagaacttcagcagtaccagtattacagcgctggtttgctgagtacttatgaccctttctacgaacagcagaggcacctgctgggacctaaaaagaaaaagttcaaagaggaaaagaaactgaaggccaaattgaaaaaagtgaaaaaaaaaagacgccgagatgaggagctttcctctgaagaaagtccgagaagacatcatcatcagacaaaggttttcgccaagttttctcatgacgcaccgccccctggaacaaaaaagaagcatctgagcatcgagcagttaaacgcgagacggaggaaggtgtggctaagcatcgttaaaaaagagctcccaaaggcaaacaagcaaaaagcatcagcgcggaatttgtttctgactaactctaggaaactggcccaccagtgcatgaaggaagtgagaagggctgctttacaggcacagaagaactgcaaagagaccttgcctagagcccggcggcttactaaagaaatgttattgtattggaagaaatacgagaaagtggaaaaagaacaccggaaaagagctgaaaaggaagctctggagcaacgcaagcttgatgaagagatgagggaagccaagagacagcaacggaaattgaacttcctcataactcaaacggaattatacgcacactttatgtctcggaagagagatatgggccacgatgggatccaggaagagattctgaggaaactcgaagactctagcacacagcgccagattgacataggcggcggagtcgtggttaatataacgcaagaggactatgatagcaaccactttaaggcccaggccctgaaaaacgcagaaaatgcttaccacattcaccaggcccgcactcgatccttcgatgaggatgcaaaagagtctagggcagccgccctgagggctgccaataagtctggcaccgggtttggcgagagctacagtctcgcaaatccaagcatccgggccggtgaagacatcccccaacccacgatttttaacgggaagctgaagggataccagctcaagggcatgaactggctcgctaatctctatgaacagggaatcaatggtatacttgctgacgagatgggcctgggcaagaccgtccagtccatcgcactccttgcccacctggccgaaagggagaatatctgggggccctttctgattatcagtccagcgagcacccttaacaattggcaccaagagttcacccgctttgttcccaagtttaaagttctgccctactgggggaacccacacgaccgcaaggttatacggcggttctggtcccagaagaccctctatactcaggatgcccccttccatgtagtcatcacctcataccagctcgttgtccaggacgtaaagtatttccaacgagtaaagtggcaatacatggtgctggatgaagctcaggctcttaaatcatccagttcggtaagatggaaaatcctcctgcaatttcagtgccggaaccggctcctactgactggtactccaatccaaaataccatggccgaactgtgggccctcctacattttatcatgccaacactgtttgacagccatgaagagtttaacgagtggttctcgaaggacatcgaaagccacgccgagaacaaaagcgcaatcgacgagaatcagttgagtaggctccatatgattttgaagccttttatgctgaggaggatcaagaaggatgtggagaacgagctgagcgacaaaatcgagatcctcatgtactgtcagttgacctccagacagaaactcttgtatcaggcgttgaagaataaaatcagcatcgaggacttactccaaagcagcatggggagcacccagcaggctcagaacaccacatcatcactcatgaatttggtgatgcagttccggaaggtgtgcaatcaccccgaattgtttgaaagacaggagacatggtctccgtttcatatttcgcttaagccgtatcatatatctaagttcatttacagacacggccagatcagggtgttcaatcattcccgcgacaggtggctgcgagtccttagcccattcgccccagactacattcagaggtctctgttccatagaaaaggtataaatgaggagagttgcttcagctttctgaggtttatagacattagtccggccgaaatggctaacttgatgcttcaaggcttgcttgcccggtggctcgcacttttcctgtccctgaaggccagctaccggttacaccaactgcgaagctggggagcccccgagggtgagtcccaccaacgttatctgcgaaataaagattttcttctgggtgtgaattttcccctgagctttccaaacctatgcagctgcccactgctgaaatctctggtatttagtagccactgtaaggctgtcagcggctatagcgatcaggtcgtccatcaaaggcgatcagctactagctcactcaggaggtgcctgcttacagaactgccctccttcctgtgtgtggccagcccacgcgtgaccgcggtcccgctcgacagctactgcaatgaccgttcagctgagtacgaacgccgtgtgctgaaagaaggcgggagtctggccgccaaacagtgtctgctgaatggagcgcccgagctcgccgcggactggcttaatcggcggagtcagttttttcccgagccagctggcggactatggagcatcagaccacagaatggttggagtttcattcgcattcccggaaaggagtcacttatcaccgactccggcaagctgtatgcactggatgtgttgctcaccagactgaaatctcagggccacagggtgttaatctacagccagatgaccagaatgattgatttactggaagaatatatggtttatcggaagcatacttacatgagactggatggttctagcaagatttcggagcggcgcgatatggtcgcagacttccagaatcggaatgacatcttcgtatttctcctcagcactagggctggcggtttagggatcaacctgacggccgccgatacagtcattttttacgattcagactggaaccccacagtggaccagcaggctatggatcgggctcatcgcctgggccagaccaagcaggtgactgtgtaccgcctgatctgtaaaggtacgatcgaagaacggatccttcaacgagccaaggaaaagtccgaaattcagcgaatggtgatctcgggaggtaactttaaacctgacaccctcaagccaaaggaagtcgtctctctcctgcttgatgatgaagaattggagaaaaagctgcgcttgaggcaggaggagaagcggcagcaggaagagaccaatcgggttaaggaacggaaacggaagagggagaaatatgccgaaaagaaaaaaaaagaggatgaattggatggcaaaaggagaaaagaaggcgttaatcttgtcattcccttcgtaccaagtgccgataactctaacttatccgccgacggagacgactccttcatcagcgttgattccgctatgcctagtcccttctcggaaatttccatatcaagcgaactgcacaccggcagcatccccctcgatgagagctcatcagacatgctcgtgatcgtcgacgatcctgcctccagcgcaccacagtccagggcgactaacagccccgcctcaatcactgggagcgtgtccgacactgtgaatggaatctcaattcaggaaatgcccgccgcaggacgcggccacagtgcaaggtctcgcggacgcccaaagggtagcggctccacagccaaaggcgccggaaagggccgatcccggaagagcactgcaggatcagctgctgccatggctggggccaaagcaggagctgctgccgctagtgcagcggcgtacgccgcttatgggtacaatgtgtctaagggaatcagtgcaagttcacctttgcagacctcactggtcaggccagcaggcctggccgactttgggccttcgtctgcctcttccccactaagtagtccactgagcaagggcaataatgttcctggaaacccaaaaaatttacatatgacatcttcactcgctcccgattcacttgttagaaaacaggggaaaggaaccaaccccagcggggggagatag

SEQ ID NO: 191382 - DNA, 4671 bp, Artificial Sequence
  Description of Artificial Sequence: Synthetic coding sequence
atggccagcgagctgggcgcccgggacgacggcggctgcaccgagctggcaaagcccctctaccttcaatatcttgaacgcgcgttgcgactcgatcactttcttaggcaaacgtccgccatcttcaaccgcaatatcagcagcgatgactctgaagatggcctagatgactcaaatcctctgctgccacaatcaggagatcctctcatacaggtcaaagaagaaccacccaactctctgctcggagagacaagcggagccggatctagcggcatgctaaatacctactcactgaacggcgtgctccaatctgaatccaaatgcgacaaggggaacctgtataacttttctaaacttaaaaagagccggaaatggctgaagtctatactgctgagcgatgaatccagcgaggctgattcacagagcgaagatgatgatgaagaggaactgaaccttagtcgagaggagttgcacaacatgctacggctgcacaagtataagaagctccatcagaacaaatacagtaaagacaaagaactccagcagtaccagtattactcggccggcctcttaagtacatatgatcccttttatgagcagcagaggcatcttctgggccccaagaagaagaagtttaaagaggagaaaaaactaaaggcaaagctcaagaaagttaagaagaagcgccggagggacgaagaattgtccagcgaagagtcaccccggcgacatcaccaccaaacaaaggtgttcgctaaattttcccacgacgctccccctccgggcaccaaaaagaaacacctttccatagaacagctgaatgctaggagaagaaaagtttggctgtccatcgtcaaaaaagaactgcccaaagccaataagcaaaaggcaagtgcccggaacctctttttaacgaacagtaggaagctggcacatcagtgtatgaaggaggtgcggagggccgcactccaggctcagaaaaactgcaaggagacgctgcccagggctcggagattgactaaagaaatgctactttactggaagaaatacgagaaggttgagaaggaacatagaaagagagctgaaaaggaagccctcgagcagcggaagctggatgaggagatgcgggaggcaaagaggcagcagaggaagctgaacttcctgataacccagaccgagctctatgcacatttcatgtcacgcaaacgggacatgggacacgatgggatccaggaggaaattttgcggaaactggaggattcatctacacagaggcagatcgatatcggcggcggtgtggtggtcaacattacacaggaagactacgactccaatcattttaaggctcaagccctaaagaacgcagaaaacgcttaccatattcatcaggcacgcacaagatcttttgacgaagatgcaaaagagtcacgagccgccgctctgagggccgccaataagtcgggtactggattcggtgaatcatacagtctggcaaatccgtctatccgggcaggggaggatattcctcagcctactatcttcaatggaaagctcaaagggtatcagctgaaggggatgaattggttggctaacctgtacgagcaagggataaatggaatcctcgccgacgaaatgggtctggggaagacggtacagtccattgctctgctcgcccacctggccgaaagggagaacatctggggccctttcctgatcatatcgcccgcctccaccctcaataattggcaccaggagttcacaaggtttgtaccaaaatttaaggtgctgccttattggggtaaccctcacgatagaaaagtgattcgaaggttctggagccagaaaacactctatactcaggatgctccttttcacgttgtgatcaccagttatcagctggtggtacaagacgtaaaatacttccagagagtaaagtggcaatatatggttctggacgaggcccaggccttaaaatcttcttctagcgtgagatggaagatcctactgcaatttcagtgcaggaatcggctcctgctgaccggaacccccatacaaaacactatggcggaactatgggcattattgcactttattatgccaacactgttcgattcccacgaggagttcaacgagtggtttagtaaagatatcgagtcacatgccgagaacaaatccgcaattgacgagaaccagctgtctcgcctccacatgattctgaagcctttcatgcttcggcgcattaagaaggatgtggagaacgaactgtcagataaaatcgagattttgatgtattgccagcttacttcacggcagaagctgctgtaccaagcgctaaagaataagatttctatagaggatctcttacagtctagcatgggctccactcagcaggcccagaacaccacttcctcactcatgaatctggtcatgcaattccgcaaagtctgtaatcatccagaattgttcgagagacaggagacgtggtccccatttcatatctcactcaaaccataccacatttccaagtttatataccggcatgggcaaatccgtgtgtttaaccacagtcgtgaccggtggttgagagtcctgtcacccttcgcccccgactatatccaacgctctttgtttcatcgaaaagggatcaatgaagaatcttgcttttcttttctgcggtttatagatatcagcccggccgaaatggcgaatttaatgctgcagggcctgcttgccagatggcttgctctcttcttgtcgctgaaggcaagctacagattgcaccaattgcgtagctggggagctcccgagggagagtctcatcagaggtacctgagaaacaaggactttcttctgggtgtcaacttccctcttagtttccccaatctttgctcgtgccctctgcttaagtccctggttttttcctctcactgtaaggcagtttcagggtattccgatcaggtcgtacaccagcggcggagtgctacgagctccctgcgcaggtgtctgctcacagaactaccgtcttttctgtgtgtggcatccccacgagtcacggcggtaccccttgactcatactgtaatgacaggagtgcagaatacgagcgaagggtcttgaaggagggaggttcgctcgctgcaaaacagtgcctcctcaacggcgcgccggagctggcagcagattggctgaatcgcagaagccagtttttcccagagcccgctgggggactctggagtattagacctcagaacggctggagctttatcaggatacctggtaaggaatccctcatcaccgacagtggtaagctctatgcgctggacgtgcttctgacccggttgaaatctcagggtcatcgagtactgatatatagtcagatgactagaatgatcgatctcctggaagagtatatggtgtatcggaaacacacttatatgaggctcgatggcagctcaaagatcagcgagcgcagagacatggtcgccgatttccaaaaccgtaacgatatcttcgtgtttcttctgagcacgcgtgccggtggccttggcataaatcttacggccgccgataccgtgattttctacgactcggactggaacccaaccgtggaccagcaagccatggacagagctcacagacttggccagactaagcaggtgacagtctataggttaatctgcaagggcactatcgaagaaagaatccttcagagagcaaaagagaagagcgaaattcaaaggatggttatctccgggggaaatttcaagccagataccctaaagccgaaggaggtcgtgtcactgctactggatgacgaggagctggagaagaagcttagactgaggcaagaagaaaagcgccaacaggaggagactaacagagtcaaagaacggaagcgtaagcgcgagaagtatgccgagaaaaaaaaaaaagaggatgaattagacggcaaacggcgaaaggaaggagtgaaccttgtcatacccttcgttcccagcgccgacaatagtaatctgagtgctgacggagacgacagctttatatccgtcgactccgcgatgccgtccccattctcagagatctccatcagttctgaacttcacactggttctattcccctggatgagtcctcttccgacatgcttgtgattgtagatgacccagcatcctctgcccctcaatcacgagcgactaactctccagcctctataacagggagtgtcagtgatacagtaaatggaatttcgatccaggagatgccagctgccggaaggggacacagcgctcgctcgagggggcgccccaaaggaagcgggagtaccgctaaaggtgctgggaagggacgcagccggaaaagtacggctggatccgccgcagccatggctggggccaaagccggagctgccgctgcctctgccgccgcctatgctgcctatgggtacaatgttagtaaaggcatttctgcttcaagcccgctacagaccagcttggtcagaccggccgggcttgccgacttcgggcctagcagcgcctcaagcccccttagctctcccctgagcaagggtaacaacgtccctgggaaccccaaaaacctacatatgacttcatcactagcccctgatagtctggtgagaaaacagggaaaaggaactaatccaagcggcggcagatag

SEQ ID NO: 191383 - DNA, 585 bp, Artificial Sequence
  Description of Artificial Sequence: Synthetic coding sequence
atggccgccagcctggtgggcaagaagatcgtgttcgtgaccggcaatgctaagaagttagaggaagtagtgcaaatcctgggcgacaaattcccttgcactctggttgcacagaagatcgatctgcccgagtaccagggcgaacctgacgaaattagtatccagaagtgtcaggaggccgttcggcaggtacaggggccggttctggtggaagacacctgcctctgtttcaacgcccttggtggccttcccggaccatacattaagtggtttctggaaaaattgaagccagaggggctgcaccagctgctggccggcttcgaagataaatcggcatacgcactgtgtacgttcgccctttccactggcgatccctcacagccggtaaggctatttagggggcggacttcaggcaggatcgtcgcacctcgtggctgccaggatttcgggtgggacccctgcttccaaccggatggatacgagcagacttatgccgagatgcccaaggcggagaagaacgctgtgtcccaccggttcagggcactgctggagctgcaagaatactttggaagcctcgccgcatag

SEQ ID NO: 191384 - DNA, 462 bp, Artificial Sequence
  Description of Artificial Sequence: Synthetic coding sequence
atggccgccagcctggtgggcaagaagatcgtgttcgtgaccggcaacgccaagaagttagaagaggtgcagggccctgtgttagtcgaagatacctgtctgtgtttcaatgctctcggaggcctacctggcccatacattaaatggttcctcgaaaagctcaaacccgaggggctgcatcagctcttggcagggtttgaggataaatcggcatatgccctatgcaccttcgccctgagtacgggcgatccaagccagccagttcggttatttagagggaggacttccggacgcatcgtagctcccaggggctgccaggacttcggctgggatccatgctttcagccagacggctacgaacagacttacgccgaaatgccgaaagctgagaagaatgccgtgagccatcgattccgtgccctcttagaactacaagagtactttgggtcactagccgcctag

SEQ ID NO: 191385 - DNA, 534 bp, Artificial Sequence
  Description of Artificial Sequence: Synthetic coding sequence
atggccgccagcctggtggtgcagatcctgggcgacaagttcccctgtacccttgttgcccagaaaattgacctgcccgagtaccagggagaacccgacgaaattagcatccaaaagtgtcaggaagcggtcaggcaggtgcagggacctgttctcgtcgaagacacatgcctgtgcttcaatgctctcggaggactcccgggcccatacatcaaatggtttttggagaaacttaagcctgagggcctgcaccagttgcttgcaggatttgaggacaaatcggcctacgctctctgcacatttgccttgtccacaggcgatcctagtcaacccgtgagactcttcagaggtcgcacaagtggccgcatagtggccccacgcggatgccaagactttggttgggatccttgtttccagcctgacggctacgaacaaacatacgctgagatgccaaaggccgaaaagaatgcagtcagtcacagatttagagccctgctggagttgcaggaatactttggaagcttggccgcctag

SEQ ID NO: 191386 - DNA, 8232 bp, Artificial Sequence
  Description of Artificial Sequence: Synthetic coding sequence
atgagcgacaagatgagcagcttcctgcacatcggcgacatctgcagcctctacgccgaaggatccactaacggatttatctctacattgggcctggttgacgacagatgcgttgtccagccagaaaccggcgacctaaataatcctccaaagaagttccgtgattgtcttttcaagctgtgtccaatgaacagatattcagctcagaaacaattctggaaggctgccaagccaggcgccaattcaaccaccgatgcggttctcctgaacaaacttcaccatgccgccgacctggagaagaagcagaatgaaaccgaaaaccgcaagctactgggtaccgtgatccagtacggaaatgtaatccagttgctgcacttgaagtctaacaagtatctgaccgtcaacaaaagactccctgcgttgttggagaagaacgccatgagagtgactttagatgaagcaggcaatgagggctcctggttctacatccagcctttctacaagctcaggagtattggtgacagcgtggtgatcggggacaaggtcgtcttgaacccggtgaacgccgggcaaccactgcacgcttcttcccaccagcttgtcgataaccccgggtgcaacgaggtcaattccgtgaactgtaatacgtcgtggaaaatcgtgctatttatgaagtggtccgataataaagatgacatccttaaaggaggcgacgtggtgagactatttcacgctgagcaagagaaatttcttacttgtgacgagcatcggaaaaaacagcacgtgttcctaaggacaaccgggaggcagtcagcaacatccgccacgagctctaaggcactgtgggaggtcgaggtggttcagcatgacccttgcaggggtggcgcagggtattggaattcactctttcgctttaaacatttggccactggccattacttggccgctgaagtcgaccctgaccaggacgcttctagatcccgtcttcgaaacgcacaggaaaaaatggtttatagtctcgtgtcggtccctgagggcaacgatatcagtagcatcttcgagcttgaccccaccaccctgagggggggcgatagtcttgttccacggaattcatatgtcaggcttcgacatctgtgtactaatacctgggtccacagtacgaatattcccattgataaggaggaggagaaaccagttatgctaaagattggcacatccccagtgaaagaggataaagaggcgtttgctatcgtcccagtgtcacccgcggaggtccgggatctggatttcgctaacgacgcgtctaaggtcctaggatcaatcgctggcaaactggaaaaaggaactataactcagaacgaaaggcggtcagtcacaaaactcctggaagaccttgtctatttcgtgacaggcggtacgaactcagggcaagacgtgttagaagtggtattttcaaagcccaaccgcgagcggcagaaactgatgcgggaacagaatattctgaagcaaatatttaagcttctacaggccccttttacagattgcggtgacggcccaatgctgagactggaagagctgggcgaccagagacacgccccatttaggcacatctgcaggttgtgttaccgcgttctgagacactcacagcaggattaccgtaagaatcaggaatacatagcaaaacagttcggcttcatgcaaaagcagattggatatgatgtgctggccgaagacactatcacagctctgctgcacaacaacagaaaactgctcgagaagcacatcaccgctgccgaaattgacaccttcgtttcactagtccgcaaaaatagggagccacggtttctagactacctgagtgacttgtgtgttagtatgaataaaagtatcccagttacccaggagctaatatgtaaggccgttctgaacccgactaacgccgacatcctaattgagacaaagctagtgttgtcacggtttgagtttgaaggcgtgtcatccaccggcgagaatgcactcgaagccggtgaagacgaggaggaggtgtggctgttttggagggattccaataaggaaataaggtccaagagtgttagggaactggcacaagacgctaaagagggccagaaggaagatcgggacgtactctcctattatcgttatcagttgaacctgttcgcgagaatgtgtttggataggcaatacctggctattaatgaaatcagcggacaactcgacgtggacttgattttgcgctgcatgagcgacgagaacctgccttacgacctgcgagctagtttctgtcgcctgatgcttcatatgcatgtggacagagacccccaagaacaagtgacccccgtaaagtatgccaggctgtggtctgagatcccatctgaaatcgccattgatgattatgattccagtggcgccagcaaggatgaaataaaagagaggttcgctcagactatggagttcgtggaagagtacctgcgtgacgttgtatgccagcgatttccctttagcgataaggaaaagaataaactgacatttgaggtggtaaacctggccaggaatttaatctactttggtttctataatttctctgatctgctccgtctgactaaaatcctcctggccatcctggattgtgtccatgttaccaccatttttcccatttccaagatggccaagggagaagaaaataaaggcaataacgatgtggaaaagttgaagtcctccaatgtcatgcgcagcatacatggagttggcgaactaatgactcaggtggtgctgcgcggtggtggcttcttacccatgaccccgatggcagctgcgccggagggaaacgtgaaacaggctgagcccgaaaaggaagacattatggttatggacacgaagctcaaaatcattgagatcctgcagttcattttgaatgttcgcctcgactaccgcatcagctgccttttgtgcatcttcaaacgtgagttcgatgaatctaacagccaaacgagtgaaacctccagcggaaattccagccaggaggggccatccaacgtcccaggtgcactggactttgagcatatcgaagagcaggctgaagggatcttcggcggatctgaagagaatacacccttagacctagatgaccacggaggccgtacgttcctgagagtgctgctgcatctgactatgcatgactatcctcccctggttagcggcgctctacagctgctgtttcgtcatttctcgcagcggcaggaggtcctccaagctttcaagcaggtgcagctcctggtcacgagccaagacgttgacaattataagcagatcaaacaagacttggaccagttgcgttcgattgtggaaaagtctgagttgtgggtgtacaagggtcagggacccgatgagacaatggatggggccagcggtgaaaatgagcataaaaagactgaagaagggaataacaaacctcagaaacacgaatccacgtcatcttacaattatcgcgtcgtgaaggaaatactaatcaggctgtcaaagctgtgcgttcaggaaagcgcttcagtgcggaaatcgagaaagcagcagcaacgcctactgcggaatatgggtgctcacgctgttgtcctcgaactcctccagatcccgtatgagaaagccgaagacacaaagatgcaagaaataatgcgcctcgctcacgaattcctccagaacttttgcgccggcaatcagcagaatcaggcacttctccacaagcatatcaatctgttcctgaaccctggaatcctcgaggcggtcacgatgcaacatatcttcatgaacaattttcagctgtgctcagagatcaacgagagggtggtgcagcattttgttcactgcattgaaacccatggaaggaacgtacagtatataaagttccttcagacaatcgtgaaggcagagggaaaattcattaagaagtgtcaggatatggtaatggctgagctagttaactcgggcgaggatgtcttggtcttctataatgatcgagcatcattccagacgcttatccaaatgatgcgatccgaacgagaccgcatggacgagaattctcccctcatgtatcatattcacttggtggagttgctcgctgtctgcaccgagggcaagaatgtctacaccgaaatcaaatgcaattctttgctgcccttggatgatattgtcagagttgtcacgcacgaagactgtattcccgaggtgaagatcgcatacattaattttctcaatcattgttacgtggataccgaagttgagatgaaagagatctatacaagcaaccatatgtggaaactgtttgagaacttccttgtcgacatttgccgtgcttgtaataacacaagtgacagaaaacacgcagactctattctggagaaatacgtaacagagattgttatgtccattgttacaaccttctttagctcgccattcagcgaccaatccaccactctccaaaccagacaacctgtcttcgttcagctgctccagggtgttttcagggtctaccattgcaactggctgatgcccagccagaaagccagcgtagaatcctgcattagggtactgtctgatgttgcgaagtctagggccatcgccatccctgtagatctggattctcaggttaacaacctgttcttgaagtcccactctatagtccagaagactgccatgaattggaggctgagcgcgaggaacgcagcacgtcgggatagcgtcctggcagcgtctcgcgactaccggaatattattgagaggctgcaggatatcgtctcggctcttgaagacaggctcaggcccctcgtccaggccgaactgtcagtgcttgtggacgtgctccataggccagaattgctcttccccgaaaataccgatgcccggcggaagtgtgagtctgggggcttcatatgcaaacttataaaacacaccaaacaactgcttgaagagaacgaggagaagctgtgcatcaaggtgctgcagactctcagggagatgatgacaaaggataggggctacggcgaaaaattaatctctatcgatgagctggacaacgcggagttgcctcctgctcctgactcagaaaacgccactgaggagctggagccatccccacccctccgtcaactggaggaccataagaggggagaggccctccggcaggtactcgttaatcggtactacggtaatgtgcgcccatccgggcgccgggagagcttgacctctttcggcaatggccccttgagcgctggcggccccggcaagccggggggcggcggcggaggttctggatcaagcagcatgagtcggggagaaatgtccctggccgaagtgcagtgtcacctcgataaggagggtgcttctaacctggtgattgatttgattatgaacgcctcctcagaccgtgtttttcacgagagcattttgttagccattgccctcttagagggaggtaacaccacaatccagcactcttttttctgcaggcttactgaagataaaaaaagtgaaaaattcttcaaggttttttacgataggatgaaagtggcgcagcaagaaatcaaggcaaccgtcacagtgaatactagcgaccttggtaacaagaagaaggacgacgaagtcgatagggacgctccctcaagaaagaaggccaaggagccaaccacccaaattacagaggaagttcgcgaccaattgctcgaggcctctgcagccaccagaaaggctttcacgaccttccggagggaggccgacccggacgatcactatcagcccggagaaggaacccaagcgacagccgataaggccaaagatgacctagaaatgtctgccgtgatcacaattatgcaacctattctgcgcttcttgcagctactttgtgaaaatcacaatagagacctgcaaaatttcctgagatgccagaacaataaaacgaactacaatctggtctgcgaaaccctgcaatttctggattgcatctgcggctctacaacagggggactgggtctcctcggtctgtacattaacgagaagaacgtcgcactgattaatcagactttggagtcccttacagagtattgccagggtccgtgtcacgaaaaccagaactgtatcgccacacacgagagcaatggcatcgacatcattaccgctctcattctgaacgacatcaaccctttaggcaaaaagcggatggacctggttctggaattgaagaacaatgcttctaaactcctgctcgctatcatggagtctaggcacgactctgagaatgctgaaaggatcctgtacaacatgcgaccaaaggaactggtagaggtaattaagaaagcatacatgcagggcgaggtagagttcgaagacggagaaaatggcgaggatggtgccgcttcgcctcgtaacgtgggccacaacatatatattctcgctcatcagttggcaagacataataaggagctgcagagtatgttgaagccaggaggtcaggtcgatggggatgaagctctggaattttatgctaaacatactgcacagattgaaatcgtcagacttgaccgcacaatggaacagattgtcttccctgtgcctagcatctgtgagtttctcactaaagaatccaaattgcggatttactacactacagagcgcgacgaacaagggtcgaagataaatgatttctttctcagatctgaagacttgtttaacgagatgaattggcaaaagaagctgagggcccagcctgtgctctattggtgtgctaggaacatgtccttctggtcatcaattagtttcaatttggctgtgctcatgaatctcctcgtcgcattcttctatcctttcaagggcgtccgcggagggactttagaacctcactggtctggactgctttggactgccatgctgatatccctggcaatcgtgattgcccttcctaaaccacacggcattcgtgcactgatcgcatccacgatacttcggttgatttttagcgttggcctgcagcccaccctgttcctgctgggcgctttcaatgtttgcaataagatcattttcctgatgtcttttgtgggaaactgtggtacattcaccaggggctacagggctatggtgctggacgtggagtttctgtaccacctactgtacctggttatttgcgctatgggcctcttcgtgcatgaattcttttacagtttgctgctcttcgacttagtttacagggaggagactttattaaacgtgataaaaagcgtaacgcggaacgggcgcagtatcatactcaccgcagtgctggcactaattctcgtctatctcttctcaatcgtgggatacctgttcttcaaggatgacttcatcctcgaagtcgacagacttcctaacgaaaccgcggttcccgaaacaggggagtcgctggcctcagagtttttgttttcagatgtgtgtcgggtcgagtctggagaaaattgcagtagtcctgcaccaagggaagaattggtcccagctgaagaaacagaacaggataaggagcatacatgtgaaaccctgctgatgtgcattgtgactgtgctgtctcacgggctccggtcaggtggtggggtaggtgacgtgctgagaaagccgtcaaaagaagagcccctgtttgctgcgagagtcatctacgatctgctgtttttttttatggtaattatcatcgtcttgaatctgatctttggcgtgatcatagatacatttgccgatcttaggtccgagaagcaaaaaaaagaggaaattctaaagacaacatgttttatatgcggcctggagcgcgacaaatttgacaacaagaccgtcaccttcgaagaacatatcaaggaagaacacaacatgtggcactatctgtgttttatcgtactagtcaaagtcaaggactccaccgagtataccggccctgagagctatgtggcagaaatgatcaaggagcgtaatctagactggtttcctaggatgagggccatgagcttggtaagctctgattccgagggcgaacagaatgaactcaggaacctgcaagagaaactagaatccacaatgaaactggtgacaaacttgtccggtcaactgagcgaactaaaggaccagatgacagagcagaggaagcaaaagcaaaggattgggctgctggggcaccctcctcacatgaacgtgaatccgcagcagccagcctag

SEQ ID NO: 191387 - DNA, 8232 bp, Artificial Sequence
  Description of Artificial Sequence: Synthetic coding sequence
atgagcgacaagatgagcagcttcctgcacatcggcgacatctgctccctatacgccgaaggttccaccaacggcttcatctccacactgggattagtggacgaccgctgcgtggtgcagcctgagacaggcgatctgaataaccccccaaagaaattcagagactgtctttttaaactgtgcccaatgaatcggtatagcgcgcagaagcagttttggaaggcagccaaaccaggcgcaaatagcacaaccgatgcagtgttactcaataaattgcaccatgccgccgacttagaaaagaaacagaacgagaccgagaaccgcaaactcctcgggacggtcatccaatacggcaatgtgatacaattattacacctcaagagcaacaagtacctgaccgtcaataaaaggcttcccgccctgctagaaaaaaatgcgatgcgagttacattggatgaggctgggaatgaaggcagctggttttacatacagccgttttacaaacttagatccatcggagattctgtggtgatcggcgataaggtcgtgctgaaccccgttaacgccgggcagcctctccatgccagcagtcaccagttagttgataaccccggatgcaatgaggtgaactctgtaaattgtaatacgtcgtggaagatcgttctattcatgaaatggtctgacaataaggacgacattttgaagggcggggacgtcgtgaggctctttcatgccgaacaagagaagttcttaacatgcgatgagcatcggaagaaacagcacgtgtttctgagaacgacaggtaggcaaagcgcgacttccgcaaccagtagcaaggctctgtgggaggtggaagtagtccagcatgacccatgtagaggaggagcgggctactggaactccctgttccggtttaagcacttagccaccgggcactatttggccgcagaggttgatcctgacttcgaggaggagtgtctggaatttcagcctagcgtggatcctgatcaggatgccagcaggagtcggctccgcaatgcccaggagaaaatggtgtattctttggtcagcgtaccagagggaaacgatatatcttctatctttgaactcgaccctaccaccttaagagggggtgattccctcgtacctcgtaatagctatgttcgtctgagacacctgtgtaccaacacttgggtgcattcaactaatattcctattgacaaagaagaagagaagcccgtaatgttgaaaatcggcacctcccctgtgaaggaggacaaggaggcctttgccattgtcccagtgtcaccagccgaagttcgagatctagatttcgcgaatgacgctagtaaggtgctcggatctattgctggcaagctggagaagggaacaatcacgcagaacgagcgccgctccgtgacaaaattactcgaggacttagtgtacttcgtgacaggaggaacgaatagtggtcaagacgtgcttgaggtcgtcttctctaagcctaaccgagagcgacaaaagcttatgagagagcaaaacattcttaaacagatttttaagttattgcaggccccctttacggattgcggagacgggcccatgttaaggcttgaggagctgggggaccagcgccacgctccgttcaggcacatatgcaggctgtgctatagggtgttgaggcactctcagcaggattaccggaagaatcaggaatacattgctaaacagttcgggtttatgcagaagcagattggttacgacgtcttggccgaggatacaataactgccctgctgcacaacaatcgaaagctgctggaaaagcacattaccgccgcagagatcgatacctttgtaagcctggtgagaaagaatagggaacccagattcctggactacttgtcggatctgtgtgtgagtatgaataaatctatccccgtgacccaggagctcatttgtaaagccgtcctaaatcctactaacgctgacatactgattgagaccaaactggttctgtcaagattcgaattcgagggcgtgtcatcgacaggcgagaatgcgcttgaggccggcgaagatgaagaagaagtgtggctgttttggagggacagcaataaagaaatccgttccaaaagtgtccgtgagctggctcaagatgcaaaagaggggcagaaggaggaccgcgatgtgctaagctactaccgctaccagctgaacctgttcgctagaatgtgcttggacaggcaatatctggccataaacgaaatctcagggcagttggatgtggatctcatcctgcgatgcatgtcagacgaaaaccttccctacgaccttagggccagtttctgccggctaatgttgcatatgcatgtggatagggatccccaagaacaggtcaccccagtcaaatatgctagactgtggtccgaaatccccagtgagatcgcgattgacgattacgattcatcaggagcctctaaggatgagattaaagaaagattcgctcagaccatggaatttgtcgaggagtatctgcgtgacgttgtgtgccaaaggtttcctttcagcgacaaagagaaaaataagctgacctttgaagtcgtgaacctggcccgcaacctgatttacttcggattctacaacttctcagaccttttgcggctgactaaaatcctgctggctattctcgattgcgttcacgtgacgactatattccctatctccaaaatggctaagggtgaagagaataaaggcaacaacgatgtggagaagctcaagagttctaacgtgatgaggagtatccacggtgtcggagaactcatgactcaggtggttctcagaggaggagggtttctacctatgacacccatggctgcagcccccgaaggaaacgttaaacaggccgagccggagaaagaggacatcatggtgatggacactaagttgaaaataatagaaatcttgcaattcatactgaatgttagactcgattatcgcataagctgcctgctgtgtatatttaaacgggagttcgacgaatcaaactcccaaacatcagaaacgagttctggcaattccagtcaagaaggaccatcgaacgtgcccggcgcactagacttcgagcacatcgaggagcaggccgaaggaattttcggtggctccgaggaaaacacgcctctcgacctcgatgaccacggagggaggacctttctgcgggtgctcctgcacctcaccatgcacgattacccacccctagtttctggcgctctgcaactcctcttcagacacttttctcaacgtcaagaggtgcttcaggcctttaagcaagtacagctgctggtcacttcgcaagatgtggataactataaacaaatcaaacaggatttagatcaacttcgcagtatagtggaaaaatccgagctctgggtgtacaaaggtcaggggccagatgaaacaatggacggcgccagcggcgagaacgaacataaaaagacagaggaaggtaacaacaaaccccagaagcacgagagcacatcctcctataactaccgtgtagtcaaggaaattctcattcgactttctaaattgtgcgtgcaagagtccgcatctgtgcggaaaagcagaaagcaacagcaacggctcttgcgcaatatgggtgcccatgcggttgtactcgagctgctgcagattccatacgagaaggccgaagacacaaagatgcaagaaattatgcgccttgcccacgaatttctccagaatttctgcgcaggcaatcagcagaaccaggcattgcttcacaaacacataaatctgtttctgaacccgggcattctggaggcagtgacaatgcaacacattttcatgaataattttcagctctgctcagagattaatgagcgggtggtgcaacactttgttcattgcattgaaacccatgggaggaatgttcagtacattaagttcctccaaaccatcgttaaagcagagggcaaatttatcaaaaagtgtcaggatatggtcatggctgagctcgttaactcaggagaggacgtgttagtattctacaacgaccgggcatccttccagacgctaatccagatgatgaggagtgagagggatcgcatggacgagaatagccctctgatgtaccatattcacctagttgagctcctggccgtgtgtacagagggaaagaatgtgtacaccgagataaagtgcaattcactcctgcccctagacgacatcgtgcgggtggtaacccacgaggattgtattccagaggttaaaattgcctacatcaacttcctcaaccactgctacgtggacactgaggtagaaatgaaggagatatacacctcaaaccatatgtggaaactgttcgagaatttcttggtggatatttgtagagcttgcaacaatacttcagatagaaagcacgctgactcaattctcgaaaagtacgtgacagagattgtgatgtccatagttaccacgttcttttcatcaccattctctgatcagtctactactctgcagacgcggcagccagtcttcgtgcagcttttgcagggggtgtttagggtctatcattgcaactggctaatgccatcccagaaggcctccgtggaatcttgtatcagagttctgtccgatgtggctaaatctagggctattgctatcccagtggacctggattcacaggtgaataacctattcctcaagtctcactcaattgtgcagaagaccgctatgaattggcgtttgtctgccaggaacgcggctaggcgcgacagtgttctggctgcctctagagattatcgaaacattatcgagcgattacaagatatcgtgtcagcattggaggatcggctgcgtcctctagtccaggccgaactcagcgtcctcgtcgacgttttgcatcgtcccgagttattgttcccagaaaatactgatgctcggagaaagtgtgagtctggtgggtttatatgtaagcttatcaaacatacaaaacaactgctcgaggagaatgaggaaaagttgtgtattaaagtgctccagacactcagggaaatgatgaccaaggaccggggctatggagagaagctaatttctattgacgaactcgacaacgctgagttaccgccagcccctgacagtgaaaacgctacagagaagggcgaagcattgcgacaggtgctggtaaaccggtactatgggaatgtgcgaccatcaggtaggcgtgagtctctgacaagttttggcaacggaccattgtcagccggaggtccagggaagccaggtggagggggtggaggttctggctcctcttccatgagtaggggtgaaatgtctttagccgaggtgcagtgccacctggacaaggaaggagccagcaacctggtgatagacctcatcatgaatgcaagctctgacagggtgtttcatgagtcaatcctgctcgctatagctctgttagagggggggaacaccactatccaacacagctttttctgtcgtctaacagaggataagaagagtgagaagttttttaaagttttctacgatcggatgaaggttgctcagcaggagattaaggcaactgtgaccgtgaatacatcggacctgggaaacaaaaaaaaagacgatgaggtggatcgggacgctccttctagaaagaaggcgaaggaacccaccacgcagatcacggaggaagttcgtgaccagctgctggaggcctccgccgcaaccaggaaggccttcacgacattccggagagaggctgaccccgacgaccattaccaacctggcgagggcactcaagccacagccgataaggcaaaggatgacttggaaatgagcgccgtcatcacgatcatgcagcccattttgcggttcctgcaacttctgtgcgagaaccataatcgcgatcttcaaaacttccttcggtgccagaacaataagacaaactataacttagtgtgtgaaacattgcagttccttgactgtatttgtggctcaacaaccggagggctgggcctgctcggcctctacattaatgaaaaaaacgtggctctgattaatcagacattggagtcactcacagagtattgccaggggccttgtcacgaaaaccaaaactgcatagcaactcacgagagcaatggcatcgacatcatcaccgctctgatattgaatgatattaaccccctgggcaagaaaaggatggacttggtactcgaactcaagaacaatgcctcgaaactccttctcgcaatcatggagtctcgccacgactcagagaatgcagaaagaattctgtacaatatgcggcctaaagaacttgttgaagttatcaagaaagcctatatgcagggagaggtcgagtttgaagacggggagaacggcgaagatggcgctgccagtccacggaatgtcggacataacatttacatcctcgctcatcaactcgcccgccacaataaggagctgcagtctatgctaaagcccggcggacaggtggacggagatgaagcgctggaattttatgcgaagcatacagctcagatcgagattgttcggttggaccgcacaatggaacagatcgtgttccccgtgccctcaatctgcgaattcttgactaaagagtccaaattgagaatttactatacaactgagcgggacgaacaaggtagtaaaattaacgatttctttttgcgcagcgaggatttatttaatgaaatgaactggcaaaaaaaacttcgtgcccagccagtgttgtattggtgtgccaggaatatgtctttctggtccagcatcagtttcaacctcgcggtgttgatgaatctgctggtggccttcttttatccatttaagggcgtgcgtggcggcaccctggaaccgcattggagcgggcttctgtggacggccatgttaatatctctggcgatcgtgatcgcactgccgaaaccccacggcatccgtgccctgatcgcttccacgatcctgcgcctgattttctccgtgggtcttcagccaaccttattcctgttaggagctttcaacgtgtgcaataaaatcatttttctgatgtctttcgtcggaaattgcggcactttcactcgagggtatagggcaatggtgttagacgtcgaatttctataccatctcctctacctggtcatatgcgccatgggactgttcgtgcacgagtttttctactccctcctcctgttcgacttggtctacagggaggagactctgcttaacgtcatcaaatccgtgacacggaacggccgcagcatcattcttacggccgtgctagcgctgattttagtttatctattttctatcgtgggatatttattcttcaaggatgatttcatcctggaggtcgaccggcttcctaatgaaactgctgtgcctgagacaggcgaaagtcttgcatccgagtttctgttctcagacgtgtgcagagtcgaatcaggcgaaaattgctcaagtccagcacccagagaagagttggttcccgccgaagagaccgagcaggacaaagagcacacatgtgagacactgttgatgtgtattgtgactgttttgagccacggtctgcgaagcggcggcggggtgggcgatgtgctccggaagccgagtaaagaagaacctctgttcgcagcgagagtgatctacgacttgctattttttttcatggtaatcatcattgtgctcaatctgattttcggcgtaattattgataccttcgcagatctccgctccgaaaaacagaaaaaagaggaaattctaaagactacgtgctttatatgcggcctcgagagggacaaattcgataacaaaaccgtcacgtttgaagagcacatcaaagaggagcataatatgtggcactacctctgctttatagtgctggtgaaagtaaaggatagcactgagtatacaggccccgagagctacgtagcagaaatgatcaaggagagaaacttagactggtttcctcgcatgagggctatgtccctcgtgagtagcgattcagagggggagcaaaatgagctgagaaaccttcaggagaagcttgaatccacaatgaagctcgtcaccaatctatccggccagttgtcagaattaaaagaccagatgactgaacagcggaaacagaagcagcggattggcttgctaggccaccctcctcacatgaacgttaatccgcagcagcccgcctag

SEQ ID NO: 191388 - DNA, 8277 bp, Artificial Sequence
  Description of Artificial Sequence: Synthetic coding sequence
atgagcgacaagatgagcagcttcctgcacatcggcgacatctgcagtctctacgcagaagggtccaccaacggatttataagcacgctgggactggtggacgatcgatgcgtagtacaaccggagacaggagacttgaacaatcctccaaagaaatttagagactgtctgttcaaactctgccctatgaacagatactcagcacagaagcagttctggaaggccgcgaagccaggggctaattcgaccaccgacgcagttctcttgaacaaactccaccacgccgcggatcttgagaaaaaacaaaacgagactgaaaatcgaaagctcctcggtacagtgattcagtacgggaatgtaatccagttactacatctgaagagtaataaatatctgaccgtgaacaagaggctgccagcccttctggagaagaacgcgatgcgggtcacgctcgatgaggcaggcaacgaaggatcctggttctatatccagcctttctataaactgcggtccatcggcgactccgttgtgatcggcgacaaggtcgtgttaaatccagtcaacgcaggacagccattgcatgccagtagccaccagctggttgataatcccggctgtaacgaagtgaactccgtgaactgtaacacctcctggaagattgtcctgttcatgaaatggtcagacaacaaggacgacatcttaaaaggcggcgacgttgtgcgtttgttccacgctgagcaggaaaaattcctgacttgtgacgagcacagaaaaaaacaacacgtcttcctgcggacaacaggaaggcagagtgccacctctgctacctcttccaaagccctgtgggaggtggaggtggtgcagcatgatccatgcaggggcggagctggatactggaatagcctctttcggtttaagcaccttgctacaggccactacctcgccgcagaggtggaccccgatttcgaagaggagtgcttggagttccagccttctgtggacccagaccaggatgcctcgcgatccagattacgcaacgcgcaggagaagatggtgtacagcctggtgagtgtaccagagggcaacgatatcagttccattttcgagctcgaccccacaacactgaggggcggggacagccttgttccgcgaaactcgtacgtgcgtctccggcatctgtgcacaaacacttgggtccatagcacaaacattccgatagacaaggaggaagagaagccagtgatgctaaagatcggcacatctccagtcaaggaggacaaggaagcgttcgcaattgtccctgtgagcccagcagaagtgcgcgacctcgactttgcaaatgatgccagcaaagttttgggtagtattgctggaaaactggagaagggtaccatcacacagaacgagaggaggagtgtcacaaagctgcttgaggacctggtctatttcgtgaccggcggtacaaactcaggtcaggacgtgcttgaggtggtcttttccaagccgaaccgagagcggcagaaactcatgcgcgaacaaaacatactgaaacagatttttaagctgcttcaggcacccttcactgactgcggcgatggcccgatgctccggctggaagagctcggggaccagcgacatgcccctttcaggcacatatgccgtctgtgttaccgggtgttacgacactcacagcaagactaccgaaagaaccaggaatacatcgcaaaacagtttgggtttatgcagaaacagattgggtacgacgttctggcggaggacacgataaccgctcttctccacaataaccgcaagcttctagagaaacatattaccgcagcggagattgacacattcgtctcccttgtgaggaagaaccgagagcctagattcttggactatctttctgacttgtgtgtgtcgatgaataaaagcatcccagtgactcaggaactaatctgtaaagcagtgctcaacccgaccaacgcagacatccttatcgagactaagctcgtgctgtctagattcgagttcgagggagtgtcaagtaccggggaaaatgccctcgaagcaggcgaagatgaggaagaggtatggcttttttggcgtgatagcaacaaggaaatcagaagtaagtccgtgagggagctggcccaggacgctaaagagggacagaaggaggaccgagacgtgttgtcatattacagataccagttaaacctatttgctcggatgtgtcttgatagacagtacctagccatcaatgagatatccgggcagttggacgtcgatctcatcttacgttgtatgtcagacgaaaatttgccctatgacttgagggcttcgttttgcaggttgatgctacacatgcacgtggatagggatccccaggagcaagtgacccccgtgaagtacgctcgcctgtggagcgagattccatccgagatcgctatcgatgactacgatagctctggcgcttctaaggacgagattaaggaacgatttgcccagactatggagttcgtagaggagtatttgcgcgatgttgtctgccagaggttccctttctccgataaggagaagaataagctgacctttgaggtggttaacctggcaaggaacttgatctacttcggcttttataacttttcggacctgctgaggctgacaaagatcctgctggccatcctcgactgcgttcatgtgactactattttcccaatcagtaagatggcaaaaggcgaagagaataagggaaataatgacgtagaaaaacttaagtcgagtaacgtcatgcggagtatccatggcgttggtgagctgatgactcaggtcgtgcttcgtggcggaggctttctgcctatgacgcccatggccgcagcccctgagggcaacgttaagcaggccgaaccagagaaggaggacattatggtgatggacactaagttgaaaattatcgaaatcctgcagtttatcctgaatgtgcgcctcgactatagaatatcctgcctgctgtgcatcttcaagagggaatttgacgagtccaatagtcagacctccgagacaagcagcggcaattcttcccaggaaggcccctccaatgtcccgggggctctggatttcgaacacatagaggagcaagctgaggggattttcggagggtctgaagagaatacacccctcgatctcgatgatcacggcgggcgaacattcctgcgggtgctcttacacctgacaatgcacgactacccgcccttggtcagcggcgcactgcagctgctttttcgtcacttctcacagcgccaggaagtgctacaggctttcaagcaggttcagttgcttgtcacaagccaagacgtagacaattacaaacagattaaacaggacctagaccagctgaggtctatcgtggagaaaagtgaactgtgggtctataaggggcaaggacctgacgaaaccatggatggagcctccggagagaacgaacacaagaagaccgaagagggcaacaacaaaccccagaagcacgagtcgacctcctcctataattatagagttgtcaaagagatcttaatccgcctgagcaagctctgtgtgcaagagtcagccagcgttaggaaatcccgaaagcagcagcagaggttgctgcggaatatgggagcgcatgccgtcgtgctggagctactgcaaatcccctacgagaaggctgaagataccaagatgcaggagattatgcggctcgcccatgaattcctacagaatttctgcgccggcaatcagcaaaatcaggcccttctacacaagcacataaacttgttcctgaatcccggcatattagaagcagtgaccatgcaacacatcttcatgaataattttcaactatgttctgagattaacgaacgcgttgtacagcatttcgtgcactgcatcgaaacacatggtcgtaatgttcagtatatcaagttcttgcagaccatagtgaaggccgaggggaaattcatcaaaaagtgtcaggacatggtaatggctgaattggtgaactcaggggaggatgtgcttgtgttctacaatgatagggcttctttccaaacacttatccagatgatgagaagcgaacgcgatagaatggatgagaacagtccccttatgtatcatatccatttggtcgagcttcttgcggtttgcaccgagggaaagaatgtttacacggagatcaaatgtaattccctgctcccactagacgatattgtgcgcgtggtcacccacgaggattgtatcccggaggtgaagatcgcgtatattaacttcctcaatcactgctatgtggacaccgaggtagaaatgaaggagatctatacctcgaatcacatgtggaaactttttgaaaactttcttgtggatatttgccgcgcatgcaataatactagtgaccggaaacatgccgatagtatactggagaaatatgtcactgaaatcgttatgagcatcgtgaccacatttttctcaagccctttttctgaccaaagcacaacactgcaaacgcgccaacctgtgttcgtgcagcttctccaaggcgtctttcgagtgtatcactgcaattggctgatgcctagtcagaaggccagcgtcgagtcctgcattcgcgtcttgtccgatgtggctaagtcacgcgccattgccatcccagtggacctggatagccaggttaacaatttatttctgaaaagtcatagcatcgtgcagaagacagctatgaattggaggctgtccgcgaggaacgccgcacggcgggactcggtattggcagcgagtcgcgactatcgaaacatcatcgagaggctgcaagacattgtttctgccttagaggacaggctgaggcctctcgtccaagcggaactaagcgtcctggtcgatgtgttacatagacccgaattactgtttcctgaaaatactgacgcgcggaggaaatgcgagtccggcggcttcatatgtaaactgatcaagcacaccaagcaattactggaggaaaatgaggagaaactgtgcataaaagtcttgcaaaccttacgagaaatgatgaccaaagaccgaggctacggggagaagctgatctctatcgacgagctggacaatgctgaacttccccctgcacctgattctgagaacgctacagaagagttagaaccatcaccgccactgcgccagttggaagaccacaagaggggggaagccctgcgacaggtcctggtgaatagatattacggaaatgtccggccatctggcagacgggaatccctgacatcattcggtaacggcccactgtccgcaggaggtccaggcaagcccgggggtggggggggaggcagcgggtcctcaagcatgtctcgaggagaaatgagcctggctgaagtgcagtgtcacttggataaagagggtgcctcaaatttggtaatcgacctgatcatgaatgcctctagcgatagggtttttcacgaatccatactcctggctattgccctgttggaagggggtaacaccacaatacagcactcgttcttctgccggttgacagaggataaaaagagcgagaagttctttaaagtattctatgatagaatgaaggtcgcacaacaggagattaaggctaccgtaaccgtgaatacttccgaccttggcaataaaaagaaggacgatgaagtagaccgcgatgctccgtcaagaaagaaagctaaggaaccaaccacccagattacagaggaagttcgcgaccaactccttgaggcatccgccgctaccagaaaggcctttacaactttcaggagggaggctgaccctgatgaccactatcagccaggcgagggcacacaggcaactgctgacaaggcgaaggacgacctggaaatgagcgccgtcattaccattatgcagccaatcctgcgcttcttacagttgctttgtgagaaccataatagagacttacagaatttccttagatgccagaacaataagacgaactacaatctggtctgcgagaccctccaatttctcgactgcatttgcggatccaccacggggggcctcggactcctggggctgtatattaacgaaaaaaatgtggccctgattaatcagacactggaaagcttgaccgagtactgccagggaccatgtcatgagaatcagaattgcatcgccacccacgagtctaacggcattgacattatcacagcactgattctgaatgacatcaaccccctaggaaagaaacgcatggatctcgtgctagaactcaaaaacaatgcctcaaaactattgctggcgataatggagagtcgtcatgactcggagaatgcagagaggatcctgtacaatatgaggcccaaagagctggtcgaagtgatcaagaaggcttatatgcagggtgaagtcgagttcgaggacggggagaacggtgaggacggggcagcttccccacggaacgtcggtcataatatctacattttggcccaccagttagcgaggcataataaggagttgcagtccatgctgaagccagggggacaggtcgatggtgatgaagcccttgaattttacgccaaacacactgcccagatcgagattgtaagactggaccggactatggaacagatcgtgtttccggtgccaagcatttgcgaattccttaccaaggagtcaaagctgcgcatttattacacaacagagcgtgacgagcaagggtccaaaatcaatgattttttcctgagatccgaagacctgttcaatgagatgaactggcaaaagaagctgcgcgcacagccggtcctctactggtgcgctagaaacatgagtttctggagctctatctccttcaatctggccgtgctgatgaacctgttagtagccttcttctacccttttaagggggttagagggggcaccttggagcctcactggagtggacttctctggacggcaatgctgatttcactcgctattgtaatagctctgccaaagccacatggaattcgggccttgatcgcttccacaatcctgagattaattttcagcgtcggccttcagccaacactcttccttctcggtgcatttaacgtgtgtaataaaataatttttttgatgtcatttgtcggcaattgtggcactttcacccgaggctatcgcgccatggtgcttgatgtggagttcttgtaccacctgctttatctggtgatctgcgctatgggcctgtttgtgcacgaatttttttatagcttgctgttgtttgatctggtgtaccgtgaggaaacccttctgaatgtgataaagagcgttaccaggaacggaaggtccattatcctgacagctgtcctcgctctcatcctggtgtacctgttctccatagtcggatacctgttcttcaaggatgacttcatcctcgaggtggatcggctccccaatgagacagctgtcccggaaacaggagaaagtttggcgagcgaatttctgttctctgatgtatgccgagtggagagcggggagaattgttctagccctgctcccagggaggagctcgtgcctgcagaggagacagaacaggataaagaacatacctgcgagaccctgctgatgtgtatagtgactgtgctaagtcatggcctgaggtcaggtggaggcgttggcgatgtcttgcgtaagccatctaaggaagagccactgtttgctgctcgcgtcatttacgacctccttttttttttcatggtgattattattgtgctgaaccttatcttcggggtgatcatagacacatttgctgatctgaggtccgaaaagcagaagaaagaggaaattctcaagacaacatgctttatctgcggactggaaagagacaagtttgacaacaagactgtaacgttcgaagaacacatcaaagaggagcacaatatgtggcactacctttgcttcatagtgcttgtgaaggtgaaggattcgaccgaatataccgggcctgagagttacgtcgcagaaatgatcaaggaacgtaacttggattggtttccacgtatgagagccatgtccttggtatcctctgattctgagggcgaacagaatgaactgcgtaacctgcaggaaaagcttgaatctacgatgaagcttgtgacaaatctttccgggcagctgtccgaattgaaagaccagatgaccgagcagaggaagcagaaacaaagaataggtcttctgggacatccaccccatatgaacgttaacccacaacagccggcatag

SEQ ID NO: 191389 - DNA, 8133 bp, Artificial Sequence
  Description of Artificial Sequence: Synthetic coding sequence
atgagcgacaagatgagcagcttcctgcacatcggcgacatctgcagcctgtacgccgaggggtctaccaatggttttatctcaacccttggattggtggatgaccgatgtgttgtgcaaccagagacgggcgacctcaataatccccctaaaaagttccgcgattgcctgttcaaactttgtcctatgaatcgctactctgcacagaaacagttctggaaggcagcaaagcctggcgcgaattcaacaaccgacgcagtccttttgaataaactacaccacgccgcagacttagaaaaaaaacagaacgagacagaaaaccgaaagctgcttggcactgtcatccagtacggtaatgttattcagctgttgcatctaaagagcaataagtatttgactgttaacaaaagactgcccgctcttttggagaagaacgcaatgagggttacactcgacgaggcaggtaacgagggctcttggttctacattcagcctttttataagctacggagcattggagattccgttgttattggggacaaggttgtgttaaatccagtgaacgccggccagcccctccacgcctcatcacaccagctggtggacaatccaggttgtaacgaggttaactccgtgaactgcaacactagttggaagatagttctgtttatgaagtggtctgataacaaggatgatattctaaagggcggcgatgtggtgcgactgttccacgctgaacaagaaaagttcctgacttgcgatgagcaccggaagaaacaacacgtgtttctgcgaactaccggccgacagtctgctacatcagctacgtccagcaaggccttatgggaagtggaggtggtacagcatgatccttgtagaggtggggctggttactggaactctctgtttcggtttaaacatttggccaccggccattaccttgcagccgaagtggaccccgatttcgaagaagagtgcctggagtttcaaccatctgtcgatccagaccaggacgccagccggtccagattacgtaatgcccaggaaaagatggtctattcactcgtgtctgtccccgaaggtaatgacatctcttcaattttcgaactcgatccaactactttgagagggggagatagtctcgtccctagaaattcctatgtgagactgcggcacctatgcaccaatacatgggtgcactcgacaaacataccaattgataaagaagaggaaaagcccgtgatgttgaaaatcggcacgagccctgtgaaagaggataaggaagcattcgctatagtcccggtctctcctgccgaggtaagagacctcgattttgccaatgacgctagtaaagtgctgggaagtatcgctgggaagctggagaagggaacaattactcagaatgagagacggtctgttacaaaacttctagaggaccttgtttacttcgtcaccggggggaccaacagcggtcaggacgtcctcgaagtagtcttctccaagcctaatagggaaagacaaaaactcatgagagagcagaacatcttgaagcagatattcaagctgttgcaggcgccttttaccgactgtggagacggcccgatgctccgcctggaggaactgggagatcagaggcatgcaccctttaggcatatttgcaggctgtgctaccgggtcctccgacattcacagcaagattatcgtaagaatcaagagtacattgcaaaacagttcggattcatgcagaaacagatcggctacgacgtgctggcagaagataccatcaccgcccttctccataataaccggaagctgctggagaagcatattaccgcggccgagattgatacatttgtaagtctcgttcggaaaaatcgagaacccagattcctagactatctctctgatctgtgcgtgagcatgaataagtcaattcctgtgacccaggagttaatttgtaaggcggtgctgaaccctactaacgccgatattcttatcgaaactaagctagtactctcccgattcgagtttgagggagtgtcatctacgggcgaaaatgcactggaggcaggggaggatgaggaagaggtctggctgttttggcgggactccaacaaggaaatccggtcaaaatcagtgcgggaactcgcccaagatgcaaaagagggacaaaaagaggaccgtgatgttctgagctattaccgctaccagctaaatttgttcgcccggatgtgcctggacagacaatacttagcgataaacgagattagtggccagctcgacgtcgatctcattctgagatgcatgagcgatgagaacctcccctacgatctccgggcaagcttttgcagactgatgctgcacatgcatgtggaccgtgacccacaggagcaagtgacacccgtgaagtacgcacggttgtggagtgagattccttccgaaattgccatcgacgattacgacagctcaggagcatccaaagatgaaataaaagaacgatttgcacagaccatggagtttgtagaagagtacctgagggatgtcgtctgtcagagattccccttttctgacaaggaaaagaataagctcacttttgaggtggtgaatttggcccgaaatctgatctattttggattctataacttctctgacctgctgcgccttactaagatacttctggctattctcgactgtgtacacgtaaccacaattttccctatctctaaaatggccaagggggaagaaaataagggcagcaacgtaatgcgttctatccacggagttggcgaattaatgacccaagttgtactccgcgggggagggtttctccctatgacccctatggcagcagcgcctgaagggaatgtaaagcaggccgagcccgaaaaagaagatatcatggtcatggacaccaagctaaagatcattgagatcctgcagttcattctcaacgtccgcttggactataggattagctgtctgctttgtattttcaaacgcgaatttgacgaaagtaattctcaaacctctgaaacatccagcgggaactcgagtcaggagggaccttcaaatgtcccgggcgccctggattttgagcatattgaggaacaagctgaagggatatttggcggatcagaggagaacacacccttagatctcgatgatcatggtggcaggaccttcttacgggtgttactgcacttgaccatgcatgattacccacctctggttagtggggctttgcagctcctcttccgtcatttcagtcaaagacaggaagtattgcaggccttcaagcaggttcagcttctcgttacttctcaggacgttgacaactacaaacaaataaagcaagatctggatcagctgagatcaatcgtggagaagagcgagttgtgggtgtataagggccaagggcccgatgagactatggacggcgcctccggagagaatgaacataagaagacagaagagggtaacaacaagccacaaaagcatgagtccaccagtagttataattaccgtgtggtcaaggaaatcttgattaggctgtcaaagctctgcgtgcaggagagcgcaagtgttagaaagagcaggaagcagcagcagagactcctgcgcaatatgggcgcacatgcggttgttctggagctgctgcagataccctatgagaaagctgaagatacaaagatgcaggagattatgaggttggcacacgaatttctccaaaatttctgtgcagggaaccaacagaaccaggcgcttctgcacaaacatatcaacttatttctcaaccccggcatcctggaagcggtcaccatgcagcatatttttatgaacaactttcaactttgctcagaaatcaatgaaagggtcgttcagcacttcgtgcattgcattgaaacccatggccgaaatgtgcaatacatcaaatttctccagacaatcgttaaagccgaggggaagttcatcaagaagtgccaagatatggtcatggcagagctggtcaactcaggagaggacgttctcgttttttataacgatcgggcttcatttcagaccctgattcagatgatgcgcagcgaacgcgatagaatggatgaaaattccccgctcatgtaccatatccatctggtggagctgctggccgtctgcacggagggcaagaacgtgtacactgaaatcaagtgtaactctctcttaccgctggatgacatcgtgagggtggtgacccacgaggattgcattccagaggtgaagattgcatatatcaattttctgaatcactgttacgtggacactgaggttgaaatgaaggaaatctataccagcaatcacatgtggaaattgttcgaaaactttttagtggatatatgtcgcgcctgcaacaacacatctgatcgcaagcacgcggattccatactggagaagtatgtcacggagatagttatgtcaatagtgaccacgttcttctcatcgccattttctgatcagtcgacaactctgcaaactcgccaaccagtgtttgtccaactgctccaaggggtgttcagagtctatcactgtaattggctaatgccctctcagaaggcctcggtggagtcctgcatcagagtgctaagcgacgtggctaagtccagggcaattgctattccagttgacctcgactcacaggttaataatttgtttctgaagtcccattctatcgttcagaaaacggctatgaattggcggctctctgcgcggaacgctgccagaagagacagtgttctggctgcaagtcgcgattatagaaacattattgagaggctacaggacatcgtttcagccttagaggatcggctgcgcccgctggtgcaggccgaactgtccgtgcttgttgacgtgctgcaccggccagaactcttattcccagagaacacggatgcgcggagaaaatgcgagagcggcggtttcatttgtaagctgattaaacatacaaagcagctcctggaggagaatgaggagaaactgtgtatcaaggtgcttcagacactcagagaaatgatgactaaggaccgcggatacggcgaaaagggcgaggcattaagacaggtcctggttaacaggtactacggaaatgtccggccttccggccgccgggagtccctaacttcctttggaaatgggcccctgtctgccggcggaccaggaaagccaggtggagggggtggtggatcgggatcatccagtatgagccgcggtgaaatgtcactggcggaggtgcagtgtcacttggacaaggagggcgctagcaatctggtcatcgatctgattatgaacgcctctagtgacagggtattccacgagtctatcctgctcgccatcgcgcttttggaaggcggcaatacaactatccagcactctttcttctgccgactgaccgaagacaagaagtccgaaaagtttttcaaagttttctatgaccgaatgaaggtggctcagcaggagatcaaggcaacggtgactgtaaataccagtgacttgggaaataaaaaaaaagacgacgaggtggatcgggacgctccaagccggaagaaggccaaggagccgactactcagataacagaagaagtcagggaccagctgctggaggcctccgctgccacccgcaaggctttcactaccttccggagagaggccgatcccgatgatcattaccagccaggcgagggaacacaggctaccgcagacaaggcaaaggatgacctagaaatgtctgccgtgatcaccattatgcaaccgatcttaaggttcctgcagctactttgtgagaatcacaacagagatctccagaatttcttgcggtgtcagaataataagaccaactacaaccttgtctgtgaaacactccagtttctagattgtatttgtggctccacgacaggggggctgggccttctcgggctgtacatcaatgagaagaatgttgctctcataaaccaaactcttgaaagtctgaccgaatattgccaggggccctgtcatgagaaccaaaattgcatcgctactcatgagtccaacggtattgacattataactgccttaattcttaatgacattaacccattagggaaaaagcgtatggatttagtccttgaactgaagaataacgccagtaaactactactggcaatcatggaatcacggcacgattctgagaacgccgaacgtatcttgtacaatatgcgccccaaagagcttgtcgaggtcatcaaaaaggcatacatgcagggggaggtggagttcgaagacggcgaaaacggcgaagatggggctgcttctcccaggaacgtgggtcacaatatttacatcctagcccaccagttagcccgtcacaacaaagaactgcagagcatgctcaagccgggaggacaagtggatggagatgaggcgctcgaattttatgccaagcataccgcccagatagaaattgtccggttggatcgaacaatggagcagatcgtctttccagtcccctccatctgtgaatttttaaccaaggagagcaagcttcgaatatactatactactgagagagatgagcaaggctctaagatcaacgactttttcctgcgaagcgaagatttatttaatgagatgaattggcaaaaaaaattacgggctcagccagtcctgtactggtgcgctcgcaacatgtccttttggagcagtatttctttcaacttggcagtgcttatgaacttgctggtggcgttcttttatcctttcaagggcgttcgaggaggaacactcgagccccattggtctggtttattgtggactgctatgctcataagtctggccatcgttattgccctgcccaagcctcacggaatccgcgcgctgattgcctcaacaatccttcgactcattttttccgttggactgcaaccgacattattcctgcttggagccttcaacgtgtgcaacaagatcattttcctgatgtctttcgtggggaattgcggcacattcacaagaggataccgtgcaatggtgttggacgtcgagtttctgtatcacctactctatttggtgatctgtgccatgggattgttcgtccacgagttcttctattctcttctgctcttcgatctggtgtatagggaagaaactcttctgaatgtgattaagtccgtcaccagaaatggccgtagcatcatactcaccgctgtgctggctctgattctggtgtacttattctcgatcgtggggtacctgttttttaaggacgatttcattctggaagtcgatagactgcccaacgaaaccgcagtgccagagaccggggaatctctagccagcgagtttctgttttcagacgtgtgtagagtggagagcggtgagaactgtagctctccggcaccacgcgaggagttagtgccggcagaagagaccgaacaggataaggagcatacatgtgaaacattgttaatgtgcatagtcactgtgctgagccacgggctgaggagcggcgggggagtgggtgacgttttacgaaagcctagcaaggaagaacctctgttcgcagcccgcgtgatttatgaccttctgttcttcttcatggttataatcatcgtgctgaatctcatctttggcgtcatcatagacacctttgcagatctccgctcagaaaagcagaagaaggaggaaattcttaaaaccacttgttttatatgtggactcgagcgcgacaagttcgataacaagacagtgaccttcgaagagcacattaaggaagagcacaatatgtggcattatttatgctttatcgtgctggtgaaggtgaaagacagtaccgagtataccggcccggaatcctacgttgctgagatgattaaagagcggaatctcgattggtttccaaggatgagagcaatgagtcttgtctcatccgattctgagggagaacagaacgaattgcgaaatctccaagagaagctggagtcaacgatgaaactcgtgactaacttgtcagggcagctgagcgagttgaaagaccagatgactgagcaacggaaacagaaacagcgcattggtctgcttggtcaccctccccacatgaatgtgaacccacagcaaccagcctag

SEQ ID NO: 191390 - DNA, 8133 bp, Artificial Sequence
  Description of Artificial Sequence: Synthetic coding sequence
atgagcgacaagatgagcagcttcctgcacatcggcgacatctgcagcctgtatgcagagggatctaccaacgggtttatcagcacgctgggtcttgtggacgaccgctgcgtggtgcagcccgagacaggcgatctgaataacccgccgaagaagtttcgggattgcctgtttaaattatgtcctatgaacagatatagcgcccagaagcagttctggaaagcagccaagccaggcgcgaatagcaccaccgacgcagtccttctgaacaagctacatcatgccgccgatcttgaaaagaagcagaatgaaaccgagaatcggaagcttctcggaaccgtgatccagtacgggaatgtcatccagctgctgcatctgaaaagtaataagtatctgactgtcaacaagaggctgcctgcccttctcgagaagaacgctatgagggtgacccttgacgaagccggcaacgaagggagctggttctacatccagccgttttacaaattgcggagtattggtgattctgtggtgattggggataaggtggtgctgaatcccgtaaacgccggccagcccctgcacgcgtcctcacaccagctcgtggacaacccgggctgcaacgaagttaactccgtaaattgcaatacatcttggaaaatagtcctgtttatgaaatggagcgataataaggatgacatcttgaagggcggtgacgttgtgagacttttccatgctgaacaggagaagttcctgacgtgcgacgagcatagaaagaagcagcacgtgtttctgaggactacaggtaggcagtccgctactagcgccacgtccagtaaagctctttgggaagtggaagtggtccagcatgacccttgccggggtggtgccggttactggaactccctgtttcgtttcaaacacctcgctacagggcactatctagcagccgaggtcgaccccgacttcgaggaagagtgcctggagtttcagccatccgtggatccagaccaggacgcctctagaagccggctgagaaatgcccaagaaaagatggtctatagccttgtctctgtccccgaggggaacgatatttcctctatattcgagctggacccgacgactctccgtggcggagactccctggtgcctcgaaattcatacgtgagactgcgtcacctgtgtactaatacctgggtccactctacgaatatcccgatagacaaagaggaggagaagcccgtgatgctgaaaataggcaccagcccagtcaaggaggacaaggaggcattcgccattgtgcctgtcagcccagctgaggttcgtgacctggactttgcaaacgacgctagtaaagtcctgggatccatcgctgggaagcttgagaaggggaccatcacccagaacgagcgccggagcgtgactaaactgctggaggatctagtctactttgtcacagggggcaccaactctggacaggatgtcctcgaagtggtgttcagtaaacctaatagagagcggcagaagcttatgcgggagcagaacattcttaagcagatatttaagctgctgcaggcaccatttactgactgcggcgatggacccatgttgaggttagaagagctcggggaccagcgccacgccccgttcagacacatttgcagattgtgctatcgagtactgagacacagtcagcaggattaccgtaagaatcaagagtacatcgccaaacagtttggttttatgcaaaaacagattggatatgatgtcctggccgaagacaccataacagctttgttacacaataatcggaagctgttggaaaagcacatcaccgccgctgagattgataccttcgttagtttggtccgtaagaatcgggagcctaggttcttagactatctttcagacctatgtgtgagtatgaataaaagcatcccagttacccaggagcttatctgcaaggccgtgctaaatcctacaaacgctgacatcctgattgaaacaaagctggtcttgagcaggtttgaatttgaaggggtgtcgtctactggggaaaatgccttggaggccggagaagacgaggaggaagtgtggctcttttggcgggattcaaacaaagagattcgctcaaagagcgtccgggagctggcacaagacgcaaaagaaggccagaaagaagaccgcgacgtgctcagctattatagataccagctcaacctgttcgcgcggatgtgtctggacaggcaatatctggccatcaacgagatttcaggacagctcgatgtcgatctcatcctgaggtgtatgtccgatgaaaatctcccatacgatctgcgcgcatctttctgccggctgatgctacatatgcacgttgaccgggatccccaagagcaagtcactcccgtgaaatacgctcggctatggtccgagattcctagtgagatcgcaattgacgattatgactcaagcggggcctcaaaggacgaaatcaaggagcggttcgctcagactatggagtttgtggaggaatacctaagggacgtcgtgtgccagaggttccctttttctgataaagagaagaacaagttgacatttgaggtggtgaatctagcaaggaacctcatatatttcgggttttacaatttttccgacttactgagactcacaaaaatacttttagcaattctcgactgcgtgcatgtgactactatcttccccatcagcaaaatggcaaaaggagaagagaacaaggggtccaatgtcatgcgtagcattcacggcgtcggcgagttaatgactcaggttgtcttgaggggcggcggtttccttcctatgacccctatggctgctgctcctgaagggaatgtgaagcaagcggagcccgagaaggaggatattatggtgatggatactaaactcaaaatcatagagatcctgcagttcattttgaatgtgcgcctcgactatcgtatcagctgtcttctgtgcatcttcaaacgagagtttgacgagagtaattctcagacttcagagacttcatccggcaatagcagccaggagggcccgtcaaatgtgcctggggctcttgactttgagcacatagaggagcaagcagaggggatcttcggaggtcggaaagaaaatacaccgcttgatctggacgaccatgggggcagaacctttctaagggttctgctgcatctgacaatgcacgattacccacctttagtgagcggagcactgcagctgttatttaggcatttctcccaaaggcaggaagtgctccaggctttcaagcaggtgcaattgctggttacatcgcaagacgttgataattacaagcagattaaacaggacctggaccagctgcggtccatcgtggaaaagtcggaactctgggtgtacaagggccaaggccctgatgagactatggacggggcgagcggagaaaatgagcacaagaaaacggaagagggcaataataaaccacagaaacatgagtcgacatcgtcctacaattatagggtcgtcaaagagatccttatccgtctgtctaagctctgcgtccaggagtctgcaagcgttagaaaaagccgtaagcaacagcagcgcttactgcggaatatgggagctcacgccgtggttctggaactgctgcagattccctacgagaaagcagaggacactaagatgcaagaaatcatgcggctcgcccacgagttcctgcaaaacttttgcgctggaaaccagcagaaccaggcactcctgcataagcacattaacctgttcttaaatccagggattctggaagccgtgactatgcagcatatatttatgaataactttcaactgtgtagcgagattaatgagcgtgttgtccaacacttcgtccactgcatcgagactcacgggaggaacgttcagtacattaagttcctccagaccatcgtgaaggccgagggaaagttcattaagaagtgccaggatatggttatggccgaattagtaaattccggtgaggatgtgttggtgttttacaatgacagggcatcatttcaaaccctgattcagatgatgcgctctgaacgtgatcggatggatgaaaacagccccctgatgtaccatatccatctggtggaattgctggccgtatgcacggaggggaaaaacgtgtatactgagataaagtgcaatagcctgttgcctctggatgatattgtgcgcgtggtcactcatgaggactgtattccagaggtgaagatcgcctatattaatttcctaaatcattgctacgtagataccgaagtagagatgaaagagatctatacttcaaaccacatgtggaaacttttcgagaactttctggtagacatctgtagggcctgtaataacactagtgatcggaaacacgccgactccattctcgaaaaatacgtcacagagattgtgatgagcatcgtgactacgtttttctctagcccattttccgatcagtcaaccactctgcagacacggcagcctgtatttgtgcagctgcttcagggagtgtttagggtgtatcattgcaactggctcatgccaagccaaaaagcctctgttgagagttgtatacgggtgctgtctgacgtggctaagtcccgtgctatcgctattccagtggacttggattcacaggtcaacaatctctttctcaagtcccactctatcgtacaaaagacggcgatgaattggaggctctcggccagaaacgccgcaaggcgggacagcgtgctggccgcttccagagactaccgtaacattatcgagagactgcaggacatcgttagtgcactcgaagacagactccgcccccttgtgcaggctgagctctctgtgcttgtggacgtactgcacaggcccgaactgctgtttcccgagaacactgatgcacgccggaagtgtgaaagcggaggctttatctgtaagctgattaaacacacgaaacagctccttgaggagaatgaggaaaaactttgtatcaaggttctgcagaccctgcgtgagatgatgaccaaggatcgcggctatggtgaaaagggagaggcgttgagacaggtgttggtgaacagatactacggaaatgtgagaccttcgggtcggcgggagtccctgacgagctttggaaatggaccactttctgctggcggtccgggtaaaccaggtggcggtggcggtggaagtggatcctcaagtatgagtagaggggagatgtcattggccgaagtgcaatgccatcttgacaaggagggggcctcaaacctcgtcatcgacctgattatgaatgcttcatctgacagagtgtttcacgaatcgatcctcctggccatcgcactcctggagggtggaaataccacaatccaacatagcttcttctgtcggttaaccgaggacaagaagagcgagaaattctttaaggtgttttacgacagaatgaaggtggcccagcaggaaattaaggctacggttaccgtgaacacaagcgatctgggcaataagaagaaagacgacgaggttgacagagatgcaccatcaaggaagaaggccaaggagcccacaacacaaataacggaagaagttagagatcaattattggaggctagcgctgctactagaaaagctttcaccacttttcggcgggaagcagacccagacgaccattaccagcctggggagggcactcaggctaccgcagataaagcaaaagacgacttggagatgtctgccgttataactatcatgcagcccatattaagattcctccagcttctctgtgagaaccacaacagagatctgcaaaactttctccgctgccagaacaataaaactaattataaccttgtgtgcgagaccctgcaattcttagattgcatctgcggatccaccacgggtgggctcggactgcttggcttatacataaatgagaaaaatgtggcccttatcaaccagaccctggaatctctgacggagtactgccaaggcccgtgtcacgaaaaccagaattgcattgccactcacgagagcaacggcatcgacatcattacagcacttattcttaacgacattaatcccctgggaaaaaaacgcatggatctggttcttgaacttaaaaataacgcatcaaagctgttacttgccattatggagtcccgtcacgactcggagaacgccgaacggattttatacaatatgcgcccaaaagaattagtcgaagtcatcaaaaaagcttatatgcagggagaagtggaatttgaggacggtgagaatggcgaggatggggctgcgagccctcggaatgttgggcacaatatatatattctggcccaccagctggccaggcacaacaaggaactgcagagtatgctcaagccaggcggccaggttgacggcgatgaagcactggaattctacgcaaagcacaccgctcagattgagatcgtgcggctcgaccgaacaatggaacagattgtgttcccagtgccctcaatatgcgaattcttgaccaaagagtcaaagcttagaatctactacaccaccgaacgcgatgagcaaggcagtaagataaacgacttctttctacgaagtgaggacctgttcaatgaaatgaattggcaaaagaagttgagagcccagcccgtcctgtattggtgcgccaggaatatgagcttctggtctagcataagctttaatcttgcagtgctgatgaacttattggtcgcctttttctatcctttcaagggggtaagagggggcacgctggagccacactggtctggtctactgtggacagccatgctcatttctctggcaattgtgatcgctctgccgaaaccacacggtatacgggcactcatcgcaagcaccatacttcgtctgatctttagcgtcggacttcagccaacactgtttcttctgggggcattcaatgtttgcaataagataatattcctcatgagcttcgtgggaaattgtgggacctttacgcgggggtatagagccatggtcttagacgtagagttcctgtaccaccttctgtacctggtgatttgtgccatgggactcttcgtccatgagtttttttactcgctgttgttattcgacttggtgtaccgagaagaaaccctgctgaatgtgatcaagtctgtgacacggaatgggaggtccattattttgaccgccgtgttagcccttatccttgtatatttattttccatagttggatatctcttctttaaagacgacttcattctggaggtggacaggctgcccaatgaaaccgctgttcccgagacaggagagtccctggcttcagagttcctctttagcgacgtgtgcagagtggaaagcggcgagaactgctccagtccagcaccgagagaagagctagtgcccgcagaagagactgagcaggacaaggagcacacgtgcgaaactctgttaatgtgcattgtcacagtcctgtcacacggccttcgcagcggcggaggcgtgggcgacgtgctgcggaaaccctctaaagaagaacccctttttgcagccagagtcatctatgacctacttttcttttttatggtgataatcattgtccttaacctgatctttggtgttattatcgacacatttgccgatcttaggagtgagaagcaaaaaaaagaagagattctgaaaaccacctgcttcatatgcggacttgaacgtgataagttcgacaataagactgtaacctttgaagaacacattaaagaagagcacaacatgtggcactacctttgttttattgtgttggtaaaagtgaaggactcgactgagtacactggccctgagtcttatgtggccgagatgattaaagaaaggaacttggactggtttcccagaatgagggcaatgtcccttgtaagtagtgattctgaaggggagcagaacgagctgcgcaacctgcaggaaaagctcgagtccacaatgaagctggtgactaacctatcaggacagttaagcgaactgaaggatcagatgacagagcagaggaagcagaaacagagaattggacttttggggcatccccctcacatgaatgtgaaccctcaacaacccgcctag

SEQ ID NO: 191391 - DNA, 3615 bp, Artificial Sequence
  Description of Artificial Sequence: Synthetic coding sequence
caggagcccggccactgccacagccggggccccggccagcccagccaacagcctctttcccaggttccgcagcattgcgccgaagcaatgaactggcggctctccgcgcgtaacgcggcgaggcgggacagcgtacttgccgctagccgggattaccgtaacattatcgagcggctgcaagatatcgtgagtgctctggaggacaggctgcgccctcttgtgcaggcagagctcagcgtgctggtggacgtcttgcaccgcccagagcttcttttccccgagaacacagatgcccgacgaaagtgcgagagtggcgggttcatatgtaagctcattaaacacaccaaacaactcctggaagaaaacgaggaaaaactgtgtatcaaagttctccagactctgcgcgagatgatgacgaaggacagaggttatggcgaaaagttgatctccatagatgaattggacaacgcagagttaccacctgctcccgactcggaaaatgctaccgaggaactggaaccctctccacctctccgccagcttgaagatcacaaacgcggtgaagccttaagacaggtgctcgtcaatcgttactacggaaatgtcaggccttccggacgcagggaaagtctgacatctttcggcaacggccccttgtcagccggagggccgggaaagccaggtggcgggggcggcgggtctggcagctcctctatgagtcgcggggagatgtcactggctgaagtgcagtgccatctcgacaaagaaggcgccagtaatctggtcatcgatctgatcatgaatgcttcgtcagatagagtcttccacgagagcattctgctggcaatcgcactgctggagggcggaaataccaccatccagcactcgttcttctgtagactaaccgaagacaaaaagagtgagaaattctttaaggtcttctatgataggatgaaggtggcgcagcaggagatcaaagctaccgtgaccgtcaatacttcagacttggggaacaaaaagaaggacgatgaagttgacagagacgccccctcccggaaaaaggctaaggaacctacaacacaaattactgaggaagtccgcgaccagctgctggaggctagcgcagcaacgaggaaagccttcaccactttccgacgcgaggctgacccagatgatcactatcaaccgggcgagggaacacaggctactgccgataaggccaaagacgacctcgaaatgagcgcagttataactatcatgcagcccatattgcgcttcctgcaactgctgtgtgagaatcacaaccgcgatctccagaacttccttcgatgccagaacaataaaactaattacaatctggtctgcgagacactgcagtttctagattgtatctgtggaagcacaactggtggactgggcttactcggcttatatattaacgagaaaaatgtcgccctgataaatcaaacgcttgagagcttgaccgagtactgccagggaccctgccacgagaaccagaactgtatagcaactcacgagtctaatggaattgacatcattacagccctgatcctgaacgatattaatcctctcggcaaaaagagaatggatcttgtcttggagctgaaaaataacgcctccaagctcctgctggccatcatggagtctcgacacgactccgagaacgctgagaggattttatacaatatgagaccaaaagaactggtggaagttatcaagaaagcgtacatgcagggagaggtggagtttgaagacggagaaaatggtgaggatggcgctgcgagtccaaggaacgtgggccacaacatctatatcttggcgcatcagctagcgcgccacaataaggagctgcaatccatgttaaagccaggggggcaggtggacggcgacgaagccctggagttttacgccaagcatactgcccagattgaaattgtccggctcgatcgtaccatggagcagatcgtctttccggtcccgagcatttgtgagtttctgactaaggaaagcaagttacgtatttactataccactgaacgagacgaacagggctcaaagatcaacgactttttccttcgttcagaggacctgttcaacgagatgaattggcagaaaaagctgagggcacagcccgtcttgtactggtgtgcaagaaacatgagtttctggtctagtattagttttaacctcgcagttctcatgaatctccttgttgccttcttctatcctttcaaaggggtaagagggggcactctcgagccccattggagcggcttgctttggaccgctatgctcatcagccttgctatagtcattgctcttccgaaacctcacggcatcagagccctaattgccagcactatcctgcgcctcatcttctctgtggggctgcagcctactctgttcttactgggagcatttaatgtctgcaataagatcatttttttaatgtcattcgtgggtaactgtgggaccttcactcgcggttatcgggcaatggtgttagatgtcgagtttctttatcatctcctgtatttggtgatttgtgctatggggctttttgtccacgaattcttttacagtctcctgctattcgacttggtttacagagaggagactttgcttaacgtcatcaagtcagtcaccaggaatggtagaagcattatcctgactgctgtactcgccctcatacttgtgtacctgttcagtatagtgggctatcttttcttcaaggatgacttcattttagaggttgaccgtttacctaacgagacagccgtgcccgagacgggcgaatctctcgcgtccgaattcttgttctcagatgtgtgtagagtagagagcggggagaactgctcatccccagcccccagggaggagctggttcctgcggaagagacggaacaggacaaggagcacacatgcgagaccctcctgatgtgcatcgtgacagtgctcagccacggtctgaggagtggtgggggcgtgggtgatgttttgagaaagccctccaaggaggagcccctgttcgcagctcgagtcatttacgatttgctgttttttttcatggtcatcattatagtgctcaacctgatctttggcgttattatcgacaccttcgctgacttgaggagcgaaaaacagaagaaggaggaaatcttaaagacaacctgtttcatctgcggccttgagcgtgacaagtttgacaataagacagtgaccttcgaggaacacattaaggaggagcataatatgtggcattacctctgctttattgtgctggtcaaggttaaagattctaccgagtacacaggaccagagtcctacgtggccgagatgattaaagagcgcaacctggactggttcccccgaatgcgcgcaatgagcttagtgtcctctgacagcgaaggagagcagaacgagctgagaaacttacaagagaagcttgagtccaccatgaagctggtcactaatctctcagggcagctgtcggaactcaaggatcagatgactgaacagcggaagcagaaacagagaatcggactgttggggcacccccctcacatgaatgtcaacccacaacagccagcttag

SEQ ID NO: 191392 - DNA, 8232 bp, Artificial Sequence
  Description of Artificial Sequence: Synthetic coding sequence
atgagcgacaagatgagcagcttcctgcacatcggcgacatctgctctctctatgcagaaggatctactaatggatttatatccacgctcgggcttgtcgacgacagatgcgtggtgcagcctgaaacaggagatctgaacaatccccctaagaagtttagggattgcctgttcaagctctgtcccatgaataggtattctgcccagaagcagttttggaaagccgctaaacctggcgctaattccaccactgatgccgttctattgaataaactgcatcatgccgctgatctggagaaaaagcagaatgagacagagaatcgaaagcttctgggcactgtgattcagtacggcaatgtcattcagctgctgcaccttaaaagcaataaatacctgactgtcaacaagagacttccagccctgctcgaaaaaaatgccatgagggtcacactcgacgaagccggtaacgaggggagctggttttatatccagcctttttataaattgaggtctatcggagattccgtggtgatcggagacaaggtggttctgaatcctgtaaacgctggccagccactgcatgcatcgagccaccaactggtggacaatcccggttgcaatgaggtgaactcagtaaattgcaataccagttggaaaattgtgttgtttatgaaatggagtgacaacaaggacgacattctgaaggggggagacgtggtccggctgtttcacgctgaacaggagaagtttcttacatgtgacgaacataggaaaaaacagcacgtattccttaggaccacggggagacagagcgccactagtgccacatctagtaaggccctctgggaagttgaggtcgtgcagcacgatccttgtcgcgggggtgccggctactggaatagcctgttcaggttcaaacacctggccacgggccactaccttgctgcagaagtggaccccgaccaggacgcgagccgctcccgcctgcggaacgcccaggagaagatggtttactccctagtgtccgtacccgaaggaaacgatatctctagcatcttcgagctcgatcctactacccttagagggggcgatagtctcgtgcccagaaatagttacgtacgtctgcgccatctctgcacaaatacatgggtgcactccacaaacattccaatcgataaggaagaagagaagccagtgatgctcaaaattggaacctctccagtgaaggaggacaaagaggcctttgccatcgtgcccgtgtcccctgccgaagtaagggacctggactttgcgaacgacgcttcaaaagtgctgggtagtattgccggcaagttggagaaaggcacaataactcagaacgaacgtagatccgtcactaaactgctggaggacctcgtgtatttcgtgacagggggcactaattccggccaggacgtactggaggtagtcttctctaagccaaatcgtgagaggcagaagctgatgagggagcagaatatactaaaacaaatcttcaaacttctgcaggcaccgtttacagactgcggagacggacctatgctaaggctggaggaactgggtgaccagcggcatgctcccttccgacatatctgtagactttgctaccgggtgcttcgccatagtcaacaagactaccgcaagaatcaggaatacatcgctaagcaatttgggttcatgcagaagcaaatcgggtatgatgtgctagctgaggatacaataaccgctctcctgcataacaatagaaagctgttggagaaacacattaccgctgccgaaatagacacttttgtcagccttgtcagaaagaatcgggaaccccgttttctggattatctcagcgacctgtgcgtgagcatgaacaaaagtattcctgttactcaagaactgatttgtaaagctgtgttaaatccaacaaatgctgatattctgatcgagacgaagctggttctatcacgctttgagttcgagggcgtgagttccactggcgagaacgccctggaggcaggggaggacgaggaagaagtctggctgttctggagagatagcaacaaagagattcgctccaagtcagtccgcgaattggctcaggacgccaaagaagggcagaaggaagacagagatgtgctgtcatattatcgctatcagctgaacctgtttgcccgaatgtgtctagatcgccagtacctggctatcaacgaaatcagcggccaactggatgtggatctgatcctgagatgcatgtctgacgagaacctgccctatgacttgcgggcatccttttgtcgccttatgctgcacatgcatgtggatcgtgacccccaggagcaggtgacacctgtaaaatacgctcgcctctggtctgagataccttctgagatcgcaattgatgattacgactctagcggggccagcaaggatgagattaaggaacgcttcgctcagaccatggaatttgtcgaggaatatctgagagatgtggtgtgtcaaagatttcccttcagtgacaaggaaaaaaacaagctgactttcgaggtggtcaacctcgcccgcaatctgatttattttggtttttataacttttcggatctgcttcgcctgactaaaatcctcctggccattttggactgcgtgcatgtgaccacgatattcccaatctccaagatggccaaaggtgaagagaataagggcaacaacgacgttgagaaactgaagtcctcaaatgttatgcgcagcatccacggagtgggcgagttgatgacacaggtcgttctgcggggtggcggatttctccctatgacaccgatggccgccgctccagaaggaaacgtgaaacaagcagagccagaaaaggaggatattatggtgatggataccaaactcaagattattgaaatccttcagttcatcctgaatgttagacttgattatcgaatatcgtgccttctctgtatatttaaaagggagtttgatgagtccaactcccagacctcagagacctcttccggcaactcttctcaggagggcccgagcaacgtccctggggccctggactttgaacatattgaagagcaggcagagggcattttcggcggctccgaggaaaacacacccttggatttagatgatcatggcggccggacattcctgcgggttctgctgcacctgaccatgcacgactaccctcccctggtttccggcgccctgcagttactgttccgccatttttcccagcgccaggaggtgcttcaggcattcaagcaggtgcagttgctagtcacatcacaagacgtggacaactacaagcagattaaacaggatctcgatcagcttcgcagtattgtggaaaagagcgagctctgggtctacaagggacagggacccgacgaaactatggatggggctagtggcgagaatgagcataagaagactgaggaggggaataacaagccgcaaaagcacgagtccacatctagctacaactaccgggtagtaaaagagatccttatccgactgagcaaactgtgtgtccaggaatctgctagcgtgagaaaaagtcgaaagcagcagcaacgtctcctcaggaatatgggtgcacacgccgtggtgctagagttgttacagataccgtatgaaaaagcagaagacacgaagatgcaggaaatcatgcggttggcccacgaatttctgcagaacttctgtgccggaaatcagcagaatcaagccctccttcataagcacattaacctgtttttgaaccctggcattcttgaagccgttacaatgcagcacatcttcatgaacaactttcagctgtgctccgagatcaacgagcgcgttgtgcagcacttcgtccactgcatagagacccatggtcgcaacgtacagtatattaagttcttacagactatcgttaaggccgaaggcaaattcattaaaaagtgccaggatatggtaatggcggaattagtcaatagtggcgaagatgtgctggtgttctacaacgatcgtgcttctttccagaccttaatccagatgatgcggtctgagagggacaggatggatgagaacagcccactgatgtatcatatccacttggtcgaactgttggcagtgtgtaccgaggggaagaatgtgtacaccgaaattaaatgcaacagtctgctcccactcgacgacattgttcgcgtggtcacccacgaagactgcattcccgaggtaaagatagcgtacattaattttttgaaccactgctatgtggatactgaagtggaaatgaaggaaatctacacatctaaccatatgtggaaactgttcgagaacttcctggtagatatttgcagagcatgcaacaatacttccgataggaaacacgctgactccattctggaaaaatacgttaccgagatcgtcatgagtatcgtaacaacgttcttctcatctcctttttccgatcagtccacgacactgcagactcgccaaccggtcttcgtccagctgctgcagggtgtgtttagggtttaccattgcaactggctgatgccctctcagaaggcatcagtagagagctgtatccgcgtgctgagcgatgtagccaaaagtcgcgccatagccattccggtagacctcgacagccaagtgaacaatctgtttctgaaaagccattcgattgtccaaaagaccgccatgaactggagactgtctgcacggaatgctgctcgcagggatagtgtgctcgccgcaagtcgagattaccggaacataatagaaagactccaggatatcgtttcagctctggaggataggctccggcctcttgtacaagcggagctgtctgtgctcgtggatgtactgcatagacctgagctgctcttcccagagaacactgacgcccgtcggaaatgtgaatccggcggcttcatttgcaagctgatcaagcacactaagcagctgttggaggagaacgaggagaaactttgcataaaagtgctacaaaccctgcgcgaaatgatgaccaaagatagagggtatggagagaagctcatatccattgatgagctggataacgcagagctgccgcctgcccccgactcagagaatgccaccgaagaactggagccaagcccccctctgaggcagttggaggatcacaagcgcggcgaagcattgagacaggtgctggtaaaccgatactatggaaatgtgcgtcccagtggacgccgtgagtcacttacatcattcggcaacggtcctctgagcgcgggcggtcccggtaaacccggggggggcggaggtggatctggctcttccagcatgagtcggggcgaaatgtcactggctgaagtccaatgccatctggacaaggagggggcttcaaacctagtcatcgatttgattatgaacgcttcatctgatcgcgtgttccacgagtccatcctgctcgctatagccctcctggaaggaggcaatactaccatccagcactccttcttctgccggttgacagaagataagaagtctgaaaaattcttcaaggtgttctacgatcgcatgaaggtcgcgcagcaggagattaaagcaactgttaccgttaatactagtgacttgggcaacaaaaagaaagacgacgaggtggaccgcgacgcgcctagcagaaaaaaggcaaaagagcctaccacccagataaccgaagaggtgcgcgatcagttgttggaggcaagcgctgccacgcgaaaagcgttcaccacattccggcgagaagccgaccccgatgaccattaccagccaggagaaggtacgcaggccacagctgataaagccaaggatgatctggagatgagtgccgtgatcacaatcatgcaacctatactgcggtttctgcagctcctatgtgaaaaccataacagagatctccagaacttcctcagatgccagaataacaagaccaattataatctggtgtgcgagaccttacagtttctcgactgcatttgtggctccactacaggcggcctaggtctcttgggcctgtatattaacgaaaaaaacgtcgctctaatcaatcagaccctcgagtccctgaccgagtattgtcaggggccctgccacgagaatcaaaactgtatcgctacccacgagtctaatggcattgacatcattaccgccctgatactcaatgacattaacccccttggcaagaaaagaatggatctggttctagagttaaagaacaacgcctcaaagctcctcctcgcgattatggaatctagacatgactcggagaatgccgagcgcatcctctacaacatgagaccaaaggagctcgtggaagtaattaaaaaggcctatatgcaaggggaagtcgagtttgaggatggggaaaacggtgaggatggtgcggcctcccctagaaatgtgggccacaatatttatatccttgcacaccagctggcacgtcacaataaggaactacaatctatgctcaagccaggaggccaagttgatggtgacgaggcactggaattttacgctaagcatactgctcaaatcgagatcgtgcggctggaccggacaatggagcaaatcgtattccctgtgcctagcatctgcgaatttctgacgaaagaatccaaacttagaatttattacacgaccgaacgagacgaacagggttctaaaatcaatgattttttcctgcgatctgaagacctcttcaacgaaatgaactggcaaaagaagctgcgtgcccagcccgtgctgtattggtgtgcaaggaatatgagtttttggtcttctatcagttttaacctcgctgtcctcatgaacttgttggttgcgttcttctaccctttcaaaggagtcagaggcggcaccttggagccacattggtccggactgctgtggaccgctatgctcattagtcttgccatcgtgatagctctgcctaagccccacggcattcgggcactgatcgcatcaaccatcttgagactcatattttccgtgggactgcaaccgactctgttcctgctcggcgcctttaatgtctgcaacaagataatcttcctgatgtcctttgtgggaaattgcggcacttttacacgcggctatagggcaatggttctagacgtggagtttctgtaccacctactttatctggttatttgcgcaatggggctgtttgtgcacgaattcttttacagtctgctgctgtttgacctggtctatagagaagagacgctcctgaatgtgattaaatcagtaacccgcaatggtcgttccataatcctcactgctgttctcgcccttatcctggtgtatctgttcagtattgtcggctacctgttctttaaggacgacttcatactggaggttgaccggctcccaaacgaaactgctgtcccggagaccggggagtcgcttgccagcgagtttctgttcagcgacgtgtgtagagtcgaaagtggcgaaaactgcagctctcccgctcctagggaggaattggtgcccgctgaagagactgagcaagacaaagaacacacctgcgagacgctcctgatgtgcatagtcacagtcttgtcccacggactcaggtctggcggcggggtgggagacgtgctgcggaagccatctaaggaagaacctctcttcgctgcccgcgtgatttatgatctgctgttcttttttatggtgattataatcgtgctcaacctcatttttggcgttatcattgatacttttgcagatctacgctctgagaagcaaaagaaagaagagatcttgaaaacaacttgtttcatttgcggcctggaacgggacaagttcgataataaaaccgtgactttcgaggagcatattaaagaagaacacaatatgtggcactatctgtgttttatcgtgttggtcaaggtgaaggattcgacagaatacacaggaccagagtcctatgtggcggagatgatcaaggagagaaacctcgattggtttccacggatgagagccatgagtctggtgtcttcagattccgagggggagcagaacgagctcaggaatctgcaggaaaaattggagagcaccatgaaacttgtgactaatctcagcggacagctaagcgagctgaaagaccaaatgacagaacagagaaagcaaaagcaacgcatcggccttttgggacaccccccccacatgaatgtgaatcctcaacagccagcgtag

SEQ ID NO: 191393 - DNA, 8088 bp, Artificial Sequence
  Description of Artificial Sequence: Synthetic coding sequence
atgagcgacaagatgagcagcttcctgcacatcggcgacatctgcagcctatacgccgaaggcagcaccaatggctttatctccaccctcgggttggttgacgaccggtgtgtggtgcagcccgaaaccggcgatctgaataatccccccaagaaattccgcgactgcctttttaaactctgtccaatgaatcgctactctgcccagaagcagttctggaaagctgcaaagcccggcgctaattcaactactgatgctgtgttgcttaacaaactgcaccacgctgctgatctagagaagaaacagaatgagaccgaaaacagaaagctcctggggacagtgattcagtacggcaatgttattcagctgctacacctgaaaagcaataagtatttaactgtcaacaagcgcctgcccgctctgcttgaaaaaaacgcgatgcgggtgactctggacgaagctgggaatgaaggctcctggttttacattcagcccttttacaagctccggtcaattggagacagcgtggtgatcggtgacaaagttgtcttgaatcccgttaacgcgggtcagccccttcacgctagcagtcaccaactcgttgacaaccccggatgtaatgaggtgaatagtgtgaattgtaatacctcatggaagatcgttctgtttatgaagtggagcgataataaggacgatatactcaaggggggggacgtggtgcgcctgtttcatgctgagcaggagaaattcttgacttgcgacgagcaccgcaaaaagcagcacgttttcctgaggactaccggcaggcagtctgccactagtgctacctccagcaaagccttgtgggaagtggaggtggtccagcacgacccctgccgggggggagccggatactggaactcactgttccgatttaagcacttggccacaggccactacctggctgccgaagttgaccccgaccaggacgcaagtcgctcacgcttaagaaatgctcaggaaaagatggtctattccctggtgtcagtgccggagggaaatgatatctcctcgattttcgaactggatccaacaaccctgcgaggaggagattctctcgtccctcggaattcatatgtccggttgcggcatctttgcaccaatacctgggtgcactccactaacattcccattgacaaagaggaggagaagcccgtcatgctgaagatcggtacaagccctgtcaaagaggacaaagaagctttcgcaattgtccctgtgagtccagccgaggttcgcgacctagacttcgcgaatgacgcctcaaaagttcttggaagcatcgcggggaagttggagaagggcacgataactcagaacgagcggagatccgttactaagctcctggaagatcttgtttattttgtaacaggtggaactaactctgggcaggacgtcctcgaagttgtgttcagcaaacctaaccgggaacggcagaagcttatgcgggagcagaatatactaaagcagatcttcaagctacttcaggcaccttttaccgactgtggagatggtcctatgcttaggctggaggaactgggagaccaacgtcatgccccttttcggcacatctgcaggttgtgctaccgggtgctcaggcactcacaacaggattaccggaagaaccaggagtacattgctaaacagttcggtttcatgcagaagcaaatcgggtatgacgtcctggcagaggacactataaccgcactgctgcacaacaacaggaaactactggaaaagcacatcaccgccgccgagatcgatacgtttgtgagtctagtgcgtaagaacagggagccccgatttctagactatctctctgatctgtgcgtatctatgaacaagagcattcccgtcacgcaggagttgatttgcaaagcagtactgaacccaaccaacgccgacatcctcatcgagaccaagctggtcctatcacggtttgaattcgaaggtgtctcatccacgggggagaacgcgctggaggcaggggaggacgaggaggaagtctggctcttttggagagacagtaacaaggaaattcgcagtaagtctgttagagaactggcgcaggatgcgaaagaaggccagaaggaagatcgggatgtcctgtcatattaccgctaccaattaaacctgttcgctcggatgtgcctagaccgacaatatctggccataaatgaaataagcgggcagcttgatgtggacttgatcttgcgttgcatgtctgatgaaaatctcccgtacgacctacgagcaagcttctgtcggctgatgttacacatgcacgttgacagagaccctcaggagcaggtcaccccagtaaaatacgcccgtctatggagtgaaattccatcagagatcgctattgatgactatgattcttcaggagcatctaaagatgaaataaaagagcgcttcgctcagaccatggaattcgttgaggaatacttgagggatgtcgtctgtcagcgctttccttttagcgacaaagaaaagaataaactgaccttcgaagtggttaacctcgcgcgcaatctgatctactttggcttttacaacttttcagacctccttaggttaaccaagatcctactcgctattctggactgcgtgcatgttacaaccatatttccaattagtaagatggctaagggggaagagaataaaggctccaatgtgatgcgaagtatccatggtgtgggagagctgatgacccaagtggtgctcagggggggaggattcctaccgatgacccccatggcagccgccccagaaggtaatgtcaagcaggccgagcccgagaaggaggacatcatggtcatggacacaaagcttaaaattattgaaattttgcaattcatcctgaatgtccgcctcgactaccgcatctcctgcctactgtgtatttttaagcgagaatttgacgagtccaacagccagacaagcgagaccagcagtggcaactccagccaggaagggcccagcaacgtcccaggtgcactggatttcgaacacattgaagagcaggctgaaggcatcttcgggggctccgaggagaatactcccctggacctcgatgatcacggcggacggactttcttacgcgtcctgctccacctaacgatgcatgactaccctcccctagtgtccggggctctgcagctcttattcagacacttttctcagcgacaggaggtgctgcaggcgtttaaacaagtacagctgctggtcacttcacaggacgtggacaactacaagcaaatcaagcaggatcttgaccagttgagaagtattgtggaaaagtcggaattgtgggtttacaaaggacaggggccagacgaaactatggatggcgctagtggggagaacgagcacaagaagaccgaagaaggtaacaataaacctcagaagcatgagtctacatcttcctacaattacagggtggtgaaagagatacttatccgtttgtcgaaactctgtgtacaagaatctgcctctgtgaggaaaagccggaaacagcagcaacgactgttgcgaaacatgggtgcacatgctgtggtcttggaactgctgcagattccctacgaaaaagccgaggataccaaaatgcaggaaatcatgcgattggcgcacgaattcctgcagaacttttgcgcaggcaatcagcagaaccaggctctgttacacaagcatataaatctcttccttaacccgggcattttagaagcagtgaccatgcagcatatcttcatgaacaacttccaactttgctcagagattaacgagcgtgtggtgcaacactttgttcattgcattgaaacccacggccgaaatgtgcagtacattaaattcttgcagacaattgtgaaagctgagggcaaatttatcaaaaagtgccaggacatggtgatggccgagcttgtgaacagcggagaagacgttctggtgttctacaacgaccgcgcctccttccagacactgatccagatgatgcggagcgaaagggaccgtatggacgagaattccccactgatgtatcacattcacctcgtcgaactactggccgtgtgcaccgaggggaagaacgtttatactgaaatcaagtgcaacagtctgctacctctcgatgacattgtacgggtggtgactcacgaagattgtattcccgaggttaagatcgcctacatcaacttcctgaaccactgttatgtggacaccgaagtggagatgaaggaaatctacactagtaatcacatgtggaaactcttcgagaatttcctcgtggatatttgtcgcgcatgcaacaatacaagcgacagaaaacacgcagactccatactggagaagtacgtaactgagattgtcatgagcatcgtgacgacattcttcagcagcccctttagtgaccagtccacaaccctgcagactagacaaccagtctttgtccaactgctccagggggtgtttagggtataccactgcaactggctcatgccatcccagaaagcctcggtggaatcctgcatcagagtgctcagcgacgtcgcaaagtcgcgggctatagcaatccccgtggatctggattcacaggtgaacaatctatttctcaagtcacactccattgtccagaagaccgcgatgaattggcgcctgagtgctagaaacgcagcccgccgcgactccgttttagccgcatctcgtgactacaggaatatcattgagaggctgcaggacatcgtgagtgcactggaagaccgcttgcggccgttagtgcaggcagaactgtcagtgctcgtggatgtcctccaccggccggagttgcttttccccgagaatactgatgcacgaaggaagtgcgagagcgggggctttatctgtaaattgatcaaacataccaagcaacttcttgaagaaaatgaagagaagctgtgcatcaaggtgctccagacactgagggagatgatgactaaggaccgggggtatggagagaaaggtgaggctctgaggcaggtcttagttaataggtactacggcaacgtacggccgagtgggagacgcgaaagtcttacatccttcgggaacggcccgctcagtgcgggcgggccaggtaaaccgggaggggggggcggggggtccgggtcgtctagtatgtccaggggcgagatgtccctggccgaggtgcaatgccatctcgacaaagaaggcgcgtctaacctagtgatcgatctgattatgaatgcctcttccgacagggtcttccacgagagcattctcctcgccatcgcccttctagagggcgggaatactacaatccagcattccttcttctgccgactgacagaggataaaaagtccgaaaaattttttaaggttttctacgaccggatgaaagtggcgcagcaggagattaaagctactgtcacagtaaacacttccgatctgggaaacaaaaaaaaggacgatgaagtggatcgggatgccccatctcgcaaaaaagccaaggagcccactactcagataaccgaggaggtgcgcgatcagctgctagaggcttctgccgccacgagaaaggccttcacgacgtttcgtcgagaagccgatcctgacgaccactatcagccaggagagggtactcaggcaacggccgataaagccaaggacgatcttgaaatgagcgccgttatcacaatcatgcagccaatcctgaggttcctacaattgttgtgcgaaaatcataatagagacttacagaactttttgcgctgtcagaacaacaaaacaaattacaatctcgtctgcgagacactgcaattcctagattgtatttgcggctccacaacaggggggttgggtctccttggcctgtacatcaacgaaaagaacgtggccctaattaaccagacacttgagagccttacagaatactgtcaaggcccctgccacgagaatcagaactgcatcgcgactcacgagagtaatggcattgacatcatcacagcactcatactaaatgatattaatccactgggtaaaaaacgtatggatctcgtgctggagctgaaaaacaatgctagcaagctgctgctggctattatggagagtcgacacgacagcgaaaacgcagagcggatcctgtacaatatgagacctaaagagttggtggaggtaattaaaaaagcctatatgcagggcgaagtggaatttgaggatggtgaaaatggcgaggacggagcggcgtctcctcggaatgttggtcacaacatctatatccttgcccatcagctcgcccgccacaacaaagagctgcaatccatgttgaagcccggtggccaggttgatggcgatgaagcgttggaattctacgcaaagcacacagctcagatagagatcgttagacttgatcgcactatggagcagatagttttcccagtgccgagtatatgcgagtttcttacaaaagagtcaaaactgcggatttattatacgaccgaacgggatgagcaagggtccaagattaatgacttctttttgaggagtgaggacctgtttaatgaaatgaattggcagaaaaagctgcgcgcacaaccagtactgtactggtgcgctaggaatatgtcattttggtcttccatctcattcaatctggccgtgttgatgaatcttttggtggccttcttttacccgttcaagggcgtccgaggcggcacactcgaaccacactggagtggccttttgtggacagccatgctcatatccctcgcaattgtgattgcgctcccaaaaccacacgggatacgtgccctgattgccagcaccatattgcggttaatctttagcgtggggttacaaccaacactttttctgctgggtgccttcaacgtgtgcaacaaaatcatctttttgatgtctttcgtagggaactgtggtactttcacacggggctatcgtgcaatggtgttggatgttgaattcttgtatcacctgctgtacctggtcatctgcgctatgggcctgtttgtccatgaatttttctactccctgctattgttcgaccttgtgtaccgggaggagaccttattaaacgtcattaaatccgtcactagaaatggcagatccatcatactgactgccgtactggctctcattctcgtgtacctgttctcaatcgtcggttatcttttcttcaaagacgatttcatcctggaggtggatcgtctacccaatgagaccgccgtgccagaaactggggagagcctggccagcgagtttctctttagtgatgtgtgcagagtcgaaagcggggagaactgtagtagccccgccccccgggaggagcttgtacctgcagaggagacggaacaagacaaagagcacacttgcgaaaccttgctgatgtgtatcgttacggttctgagtcacgggttaagatcaggtggaggagttggggacgttctgagaaagccatccaaagaggagcctctctttgccgctcgagtcatctatgatctgctgttcttctttatggttattatcatcgtcctgaacctgatttttggcgtgattatcgataccttcgcggatcttaggagcgagaagcagaagaaagaggaaatcctgaagaccacctgttttatttgcggactggagcgagataagtttgacaataaaacggtgacctttgaagaacacattaaggaagagcacaacatgtggcactacctgtgctttattgttctggtcaaggtgaaggattccactgagtacacgggtcctgaaagctatgtcgctgagatgatcaaagaacgcaatcttgactggtttcctagaatgcgggccatgtctctggtctcatcggactcagagggggagcaaaatgagctgcgaaacttgcaagaaaagctggaatcaactatgaaactggtaacaaatctgtctgggcaactgtcagaactgaaggaccagatgaccgaacaacgcaaacagaaacaaagaatcgggctgctcgggcaccccccacatatgaatgttaatcctcaacaacctgcgtag

SEQ ID NO: 191394 - DNA, 2166 bp, Artificial Sequence
  Description of Artificial Sequence: Synthetic coding sequence
atgagcgacaagatgagcagcttcctgcacatcggcgacatctgctctctttatgccgagggctcaacaaatggcttcatcagcactttggggctcgttgatgacagatgcgtagtccagccggaaaccggcgatctgaacaatccgcctaagaagttcagagattgtttatttaagttatgccccatgaacaggtacagcgcccaaaagcaattctggaaagctgctaaaccgggtgccaattccactaccgacgctgtgctcttgaataaactgcatcacgccgcggatcttgagaagaaacaaaatgaaaccgaaaacagaaagctgctgggcaccgtcattcagtacggcaatgtcattcagttactacatttgaagtccaacaagtacctgaccgtgaataaacgcctgcctgctctgctcgaaaaaaacgctatgagggtgacattggacgaggccggcaatgagggaagttggttttacattcagcctttctacaaactccggtctattggtgactctgtggtgataggcgacaaggttgttctcaatccagtgaatgccggacagcctctgcacgcctcaagtcaccagctggtggacaatcccggttgtaatgaagttaatagcgttaattgcaacacatcctggaagattgtactgttcatgaagtggagtgacaacaaggacgacatcctgaaagggggagacgtcgtgcgactattccatgccgagcaggagaagttcctgacctgtgatgagcacaggaagaaacagcacgtgtttctgcgaactacaggcaggcagagtgcgacgtcagcaacttcttcaaaggcattgtgggaagtagaagtcgtgcagcacgacccatgcaggggcggcgccggatactggaatagtctgtttcgcttcaagcacttggcaaccggacactaccttgctgccgaagtagaccctgatttcgaagaagagtgtctggagttccagcccagcgtttgcaataaaatcattttcctgatgagctttgtcggcaattgcggcacttttacacgggggtatcgtgctatggtcctggacgtagagtttctgtaccatctgttatacctggtaatttgtgccatgggccttttcgtccacgaatttttttacagcctcctgctctttgacctcgtctatcgcgaagagactttattgaacgtgatcaagtcagtcaccagaaacggccgatcaataattctgacagctgttctggctctgatcctcgtatacctctttagcatagtgggttatctctttttcaaggacgacttcatcctggaggttgataggctgcccaacgagaccgcagtgcccgaaaccggcgaatcactggcaagtgaatttctgttctcagacgtctgcagggtggaaagcggcgaaaactgttcatctcccgctccacgagaggagctagtgcccgcggaagagacagaacaagataaggaacacacctgcgaaacgctcttaatgtgtatcgtcacagtcctgagccacggtctgaggtccggtgggggggtgggcgacgtactgcgaaagccttctaaggaggaacctcttttcgccgcacgggttatctatgacctgctcttcttcttcatggtaataatcatcgttctgaacctgattttcggtgttatcatcgacacttttgctgacctgcgatcggagaaacaaaagaaagaagagatcctgaagaccacatgcttcatctgcggtctcgagcgggacaagtttgataataaaactgtaacatttgaggagcacattaaagaagagcataatatgtggcactatttgtgcttcattgtgctcgtgaaggttaaagactcaacggagtatacggggccggagagttatgtggccgagatgatcaaagagaggaatctggactggttcccaagaatgagagcaatgtccctggtgtccagcgactcagagggagagcagaacgagctgcgcaatttgcaggaaaaattagaaagcactatgaaattagtgacgaatttgagcggacagttatctgagctcaaggaccaaatgacggagcagagaaaacagaagcagcgcattggcctcctcgggcacccacctcacatgaacgtaaacccacagcagccagcctag

SEQ ID NO: 191395 - DNA, 546 bp, Artificial Sequence
  Description of Artificial Sequence: Synthetic coding sequence
atgaccgagaagatgagcagcttcctgtacatcggcgacatcgtgtccctgtatgccgagggcagtgtcaatggttttatttccaccctgggactggtggacgaccgctgcgtggtccaccccgaggccggagacttggccaaccctcccaagaagttccgggattgcctgtttaaagtgtgcccgatgaacagatattctgcacagaagcagtattggaaggctaagcaggctaagcaaggaaaccacacagaggcagccctgctgaaaaaactgcaacacgctgcggaattggagcaaaagcagaacgagagcgagaataaaaaacttctcggcgagatcgtcaagtattcaaatgtcatccagctcctacacatcaagtctaataagtatctgacagtgaataagaggttgcccgcactgttggagaaaaacgccatgagagtgagcctcgacgctgccggcaacgagggctcttggttttacatacaccccttctggaagttgcggtcggagggagataatgatgccagcttctggatttag

SEQ ID NO: 191396 - DNA, 8106 bp, Artificial Sequence
  Description of Artificial Sequence: Synthetic coding sequence
atgaccgagaagatgagcagcttcctgtacatcggcgacatcgtgtcgctttacgccgaaggatccgttaacggtttcatatccaccttgggcttggttgacgaccgctgcgtcgtgcaccctgaggccggcgacctggccaatccccccaaaaagtttagggactgtctctttaaggtgtgccccatgaacaggtattctgctcagaagcagtactggaaagctaaacaagccaagcagggtaaccacaccgaggccgcgctgctgaaaaaactccagcatgccgccgaactcgagcagaagcagaatgagagcgagaacaagaagctgctaggggagatcgtcaaatattcaaatgttatccagctcctccacatcaagtcaaataagtacttgaccgtgaataagcgcctgcctgccttactcgaaaaaaacgcgatgagagtgtcccttgacgcagccggaaacgagggcagctggttctacattcatcccttctggaaactccgctccgaaggcgataacatcgtggtaggcgataaggtggtgttgatgcccgtgaacgcagggcagcctttgcacgcatccaacatcgaactcctagacaatcctgggtgtaaggaagtcaacgccgtgaattgcaatacttcctggaagattactctcttcatgaagtatagctcttacagagaggacgttctgaaaggcggggatgtggtccgattgtttcatgctgaacaggagaaatttctcacttgcgatgagtacgagaagaagcagcatatttttctacgcacaaccctgcggcaaagcgccacatcagcaacttcctctaaagcgctgtgggaaatcgaagtcgttcatcacgatccgtgccgaggaggagccggtcagtggaatagccttttccgcttcaaacacttggctacagggaactatctcgcggccgaactgaatcctgattacagagacgctcaaaatgagggtaaaaatgtcagagatggggtgccgcctacttccaaaaagaaacgtcaggccggtgaaaaaataatgtatactctggtttctgtgccccacggtaatgacatcgccagtctgtttgagcttgacgctactaccttgcagcgtgccgactgcctggtgcctagaaacagttacgtgagacttcgtcacttgtgtaccaacacctgggtcacaagcaccagtatccccattgacaccgacgaagagcgccctgtcatgttaaagattgggacatgtcagaccaaggaggacaaggaggcattcgcgatcgtctctgttccattaagcgaagtaagagacctggactttgctaatgacgcaaataaggtgctggccacaactgtgaaaaaactggaaaatggtactattacacagaatgagaggcggttcgtcacgaagcttcttgaggacctcattttctttgtggccgatgtaccaaacaacggccaggaggtgctcgacgtagtcattaccaagccaaacagagaacgccagaaactaatgagggagcagaacattttggcacaggtttttgggatcttaaaggcacccttcaaagaaaaggccggcgagggtagtatgctgcggctcgaggatctgggcgaccaacggtatgccccgtataaatacatgctgcgtttatgctatagagtcttgcgtcacagccagcaggattaccgcaaaaatcaagaatacatagctaaaaacttctgcgtgatgcaatcccagataggctatgatattcttgctgaagataccattactgctctgctccacaataatcgcaagctactcgaaaagcatatcactgccaaggaaattgagactttcgtgtctcttttgcggagaaatagggaaccaaggtttctcgactatctgtctgatttgtgtgtgagtaacactactgcaatacctgtgacacaggagctcatctgcaagtttatgctgtcgccgggcaacgctgacattctgatccagacgaaggtggtctcaatgcaggcggacaatcccatggagtcaagtatcctatccgatgacattgacgatgaggaagtttggctctactggatcgactccaataaagagcctcacggcaaggcaatccgccacctggcgcaagaagctaaagaggggactaaggccgatctggaagtcctgacatattatcgatatcaactcaacctcttcgcccgaatgtgtctggataggcagtatctggctatcaatcagatctctactcagctgtccgtggacctgattttacgatgcgtgtcagacgaaagcttgccatttgacctccgtgccagtttctgccgtctgatgctacacatgcacgtggatcgcgatcctcaggagagtgtggtaccagtgcgctacgctaggctgtggaccgagatacccactaaaatcacgatccatgagtacgattcaataactgattcaagtaggaacgatatgaaaagaaaattcgctctgacaatggagttcgtcgaagaatatttaaaagaggttgtgaatcagccttttccatttggagataaggaaaaaaataaactgaccttcgaagtcgtccacctcgcccggaaccttatatattttggattttacagctttagcgagttactgagactaaccaggacactgctggccatcctggatattgtccaggctcccatgtcaagttatttcgagcggttgtccaagttccaggatggcggtaacaacgtcatgagaacaatccacggcgtgggtgagatgatgactcagatggtactcagcagagggtcaatttttcctatgtctgtcccggacgtgccaccgtctattcatcctagcaaacaagggagtcccacagagcatgaggatgtgacagtgatggataccaagctcaagatcatagagatcttacagtttattctgagtgtgaggctagattatagaatatcttatatgctgtcaatttacaagaaggagtttggagaggataacgacaatgcggagacgagcgcctccggaagccccgataccttgctgcccagcgccatagtgccagacatcgatgaaattgctgcacaagctgaaacaatgttcgcaggaaggaaagaaaagaatccagttcagctggacgatgagggtggccgcacctttctgcgagtgctgattcacctgatcatgcacgattaccccccactgctgtctggcgctcttcaactgctcttcaagcacttctcacagagagcagaagtgctacaagcttttaagcaggtccagctgctcgtcagcaatcaggatgtcgataattacaagcagatcaaggctgaccttgaccagctgaggctaacagtcgagaagagtgagctctgggtggaaaagtcatccaactatgagaatggggaaatcggggagagccaggtgaagggaggggaggaacccatcgaggaatcgaacatattaagccccgtgcaggatggaaccaaaaagccccagatagattctaataagagtaataattatcgcatagttaaagagattctcattagactgagtaaactctgtgtgcaaaacaagaagtgccgaaatcagcaccagcgcctgctcaaaaacatgggggcccactccgtcgtcctcgatcttttgcagatcccttacgagaagaacgacgagaagatgaatgaggtgatgaatctggctcatacttttctgcagaatttttgcagggggaatccccagaatcaggttttgctgcacaagcacctgaacctgttcttaacccctggtctgctggaagcggagaccatgcgccacatttttatgaataattaccatctgtgtaacgagatctctgaacgagtggttcaacactttgtacactgtattgagacccacggccggcatgtggaatatctccgcttcctgcagacaattgtaaaggccgatggaaagtacgtcaagaaatgtcaagatatggtgatgactgagctgattaatggtggggaagacgttctgatcttctataacgacagagcctcattccccattcttcttcacatgatgtgtagcgaaagagacagaggtgatgagagtgggcccctcgcttaccatattacgcttgtcgaactgctcgctgcctgtaccgagggcaagaacgtgtataccgagatcaagtgcaattctctcctcccactggacgacatcgtacgggtggttacgcatgatgattgcattccggaggttaaaatcgcctacgtgaattttgttaatcattgttatgtggacacagaggttgaaatgaaagagatttatacatccaatcacatttggaagctgttcgagaactttctggtcgatatggcacgagtctgcaacacaaccactgatagaaagcatgccgatatctttttggaaaaatgtgtcacggaatcgataatgaatattgtctctggcttctttaattcacccttttcggataattctacctcccttcagacacatcagcctgtatttatccagctgctgcaatcagcattccgcatctataattgtacctggcccaatcctgcgcagaaggcttctgtcgagtcctgtattaggacccttgccgaggtcgccaaaaatcgtgggatcgctatcccagttgacttggactcacaggtgaacaccctgtttatgaagagccacagcaacatggtacagagggccgccatgggctggagactatcggcccgctccggcccgcgttttaaggaggccctcggcggtccagcctgggactaccgaaatatcattgaaaagttgcaagatgtggtcgctagtttagaacaccaattttctcccatgatgcaggcagagttcagcgttctcgtggatgttctttatagtcctgagctcctgttccctgagggctccgacgctcggatccgttgcggagcttttatgagcaaactcataaaccatacaaaaaaactcatggagaaagaggagaaactctgcataaaaattctacagaccctgagggaaatgttggagaaaaaagattcttttgtagaagagggaaacaccctccgcaaaattctgctcaacagatactttaagggggattatagcatcggcgtgaatggtcacctgagcggtgcttatagtaaaacagcccaagtgggcggatcattcagcggccaggacagcgataagatgggtatcagtatgtctgacatacagtgtctgttggataaggaaggggcgagtgagctggtgattgacgttatcgtcaacacgaagaatgataggattttttccgaaggcatcttcctcggtattgcgttactcgaggggggcaatacccagacacaatactccttctatcagcaactgcacgagcaaaaaaagagcgagaagtttttcaaggttctctacgaccggatgaaggcagcccagaaggagattcgctccaccgtcacggtaaacactatcgacttaggaaacaaaaagagggatgatgacaacgagcttatgacctcagggccccggatgcgagtgcgggacagcacgttgcatctcaaagaggggatgaaaggacagctcactgaagcatcaagcgctacctcgaaggcatactgcgtgtaccgacgagagatggatccagagatcgacattatgtgtaccggaccggaggcaggtaacacggaggagaagtcagctgaggaagtaactatgtcaccggctattgccataatgcaaccgatcctgaggtttttgcagcttttgtgcgaaaatcacaaccgtgaactacagaacttcctgagaaaccagaacaacaagaccaactacaaccttgtctgcgaaaccctgcaatttctagactgcatttgcggctcgacgaccgggggactgggtctgttagggctctatataaacgaaaagaacgtagctctggtcaatcagaatcttgagtcgctcacagagtactgtcaagggccctgccacgaaaatcagacctgtatagctacacacgagtccaacggaatcgatattattatagcactgatcctgaacgacataaaccccctgggaaagtatcggatggacctggtcctccagctaaagaacaacgcaagcaagctgctgttagcgattatggagtcccgtcatgattctgagaacgccgaaagaatcctgtttaacatgaggccacgagaactcgttgacgttatgaagaatgcctataatcagggactcgagtgcgaccatggcgatgatgaaggtggggatgacggcgtgtcgccaaaggacgtcggccataatatatacattttagcccaccagctcgcacgccacaataaattgctgcagcaaatgctcaagccaggatccgatccagatgaaggagatgaggcactgaagtattatgctaatcacactgcccaaattgagatcgtgaggcacgatcgcacgatggaacaaatcgtgtttcccgtacctaacatttgtgaatatctgacccgggaaagtaaatgcagggtcttcaatactacagaaagggatgaacagggaagcaaggtaaatgacttcttccagcaaactgaggacctgtataacgagatgaaatggcagaagaagattcggaacaatcccgcgctcttttggttctcacggcacatcagcctgtgggggtcgattagttttaatctagcagtgtttatcaacttagccgtcgccctgttctatcccttcggcgatgatggggacgaggggaccttatcccccctatttagtgtgctcttatggatcgccgtagctatctgcacaagcatgctttttttcttcagcaagcccgtgggcattcgtccttttttagtgtctatcatgctaagatctatttacactattggcctgggtcccactctcatactactcggagcagccaacctgtgcaacaagatcgtcttcctagtatcgttcgttggtaatcgaggaacatttacacgtgggtatagggctgtcattctggatatggctttcctatatcacgtagcttatgtgctggtctgcatgttggggttattcgtgcatgagttcttctactccttcctgttgttcgacttagtttaccgggaggaaaccctgcttaacgtgatcaagagtgtcactaggaacggaagatctattatactcactgccgtgttggccttgatcctggtctatctattctccattattggctttctgttcctgaaggacgacttcacgatggaagtggataggctgaagaacagaacccccgtcaccggctcacatcaggtgccgacaatgaccctgactacgatgatggaggcttgcgccaaagaaaactgctcacctaccatccccgcctccaacaccgctgatgaggagtacgaggatggcattgagagaacctgcgacactctcctaatgtgcatcgtaaccgttctgaaccaggggctgcggaatggaggcggagtaggagatgttctgagacgaccttctaaggatgagccactgtttgccgctcgggtcgtgtacgacttgttgttttactttattgttatcatcatcgtcttgaacctcatttttggggtgataatagacacgttcgctgatctgagatccgagaaacagaagaaggaggagattctgaagaccacatgttttatctgcggtctggagagagataagtttgataacaaaactgtgtccttcgaggagcacatcaaatccgaacacaatatgtggcattacctgtatttcatcgtcctggttaaggttaaggacccaacagagtacacaggtccagagtcatacgtggcccagatgatcgttgagaagaacctggactggtttccaagaatgcgcgccatgtctttagttagcaacgaaggggacagtgagcaaaatgagatccgttcactgcaagaaaagctggagtctactatgagcctcgtaaaacagctctccggccagttagctgaattgaaagagcagatgactgaacaaaggaagaacaagcaaagactgggattccttggatccaacacacctcacgtaaatcaccacatgccaccccactag

SEQ ID NO: 191397 - DNA, 8016 bp, Artificial Sequence
  Description of Artificial Sequence: Synthetic coding sequence
atgagcgagatgagcagcttcctgcacatcggcgacatcgtgagcctgtacgcggaggggtccgtgaacggctttattagtactctgggattagtggatgatcgctgcgtggtagaacctgctgccggagacctagacaacccgcctaaaaagtttcgggattgtctctttaaggtttgccctatgaatagatactcagctcaaaaacagtactggaaagctaaacagacaaagcaggacaaggagaagatagccgacgtggtcttgctccagaagctgcagcacgcggctcaaatggaacaaaagcaaaacgacaccgaaaacaagaaagtgcacggtgatgtggtgaagtatggcagcgtaatacagttgctgcatatgaagtcaaacaagtatctcaccgtcaacaagagactacccgcactgttggaaaaaaatgcgatgagggtgaccctggacgctacgggcaacgagggctcctggctgttcattcagcccttttggaaactccggtctaatggcgataatgtcgtggtgggcgacaaggttattttaaatcctgtgaatgccggtcagccattacacgcctccaactacgagctgagcgataacgctggctgcaaggaggtcaattctgtgaactgcaatacgtcatggaaaattaatctgtttatgcagtttcgagaccacctggaagaggtcctcaaggggggcgatgtcgtcaggctgttccatgcggaacaagaaaaatttctcacatgcgacgaatacaagggtaagttgcaggtctttcttcggacgacccttaggcagtccgccacatctgcgacttcatctaacgctttatgggaggtggaggtcgtccatcacgatccctgtcgggggggcgccggtcactggaacggattataccgcttcaagcatcttgctacaggaaactatttagccgctgaggagaatccttcctataagggcgacgcttccgatcccaaggcagctgggatgggggctcagggacggaccggtcggcgcaacgctggagagaaaatcaagtactgccttgttgccgtcccccacggaaacgacatcgcctccctgttcgaactggatcctacaaccctccagaagaccgatagcttcgtgcctcggaactcctatgtccggctgcgacacttgtgtacaaatacttggattcagtcaacgaacgtacctattgatatcgaggaagaacgtcctatcagacttatgctaggcacttgtccaacgaaggaagacaaagaagcttttgccatcgtgtctgtgccggtgtctgagataagagatctggattttgcgaacgacgctagtagcatgctggccagtgctgtcgaaaagcttaatgagggcttcatctcccaaaatgacagaagattcgtgatccaactgcttgaggacctggtgttctttgtctctgatgttcctaataatggccagaacgttttagatatcatggtgaccaaaccgaatagggagaggcagaagctgatgagggaacaaaatattctaaagcaggtatttggcattctgaaggccccatttcgggagaaaggaggtgaagggcctttagtcagactcgaggaactgtcagatcagaaaaacgcaccttaccagcatatgtttcgcctctgttaccgggtgttaaggcactcccaggaagattatcgaaaaaatcaagagcatattgcgaagcaattcggaatgatgcagtctcagatcggttatgatatactggccgaagacacgatcaccgctttactgcacaataataggaagttgctggaaaaacatattactaaaacagaggtggagacatttgtcagcctagtccgcaaaaatcgcgagcctcggtttttagattacttgagcgacctgtgtgtgagtaaccatattgccattccagtgactcaggagcttatatgcaagtgcgtgctggatccaaagaactccgatatactcatcagaactgaactgcgcccggtcaaggaaatggcccagagccacgagtacctgagtattgaatatagcgaggaagaagtgtggctcacctggacagacaaaaataacgaacatcacgagaaatcggtacgtcaactagctcaagaggctcgggcaggaaacgctcacgacgagaatgtcctgtcctattatcggtatcagctgaaactcttcgcccgcatgtgtctggatcgtcagtacctggctattgatgagataagccaacagcttggtgtggatcttatcttcttatgtatggcagatgaaatgttgcccttcgacctgcgcgcctcattttgtcacctcatgttacacgtgcacgtcgatagggacccccaggaactcgtgactccagtgaagttcgcaaggctctggaccgagataccaacagcaattacaattaaagactacgactctaacctgaacgcgagcagagacgataaaaaaaacaagttcgccaatacaatggagttcgtggaggactacctcaataatgtggtttctgaagccgtgccttttgcgaacgaagagaaaaataaacttacttttgaggtggtctcactggcgcataacctcatctattttgggttctatagtttttctgagctgttgaggctcaccaggacgttgctgggcatcatcgattgcgtacagggaccacctgcaatgctccaggcttacgaagaccccggagggaagaacgtccgacgcagcatccaaggtgtggggcatatgatgagcacaatggtcttaagcaggaagcagtccgtgttctccgcacccagtctcagcgccggcgccagtgcagccgagccactggacagatctaagtttgaggagaatgaagatattgtcgtgatggagacaaagctgaagatccttgaaatattacagtttatacttaatgtgcgcctcgattacagaatctcatatttgctgagtgtgttcaaaaaggaattcgtcgaagtcttccctatgcaggacagtggagctgacgggacggcacctgcgttcgatagtacaaccgctaacatgaacttggaccggattggtgaacaggctgaagcaatgttcggagtaggcaaaaccagttctatgctggaggtcgatgacgagggcgggcggatgttcctccgtgtcctcattcacttgactatgcacgattatgcgcccctcgtttcaggcgctctccaactcttgtttaaacactttagtcagagacaggaggccatgcatacttttaagcaagtgcagctcctaatcagcgctcaggacgtggaaaactacaaggtcatcaagtccgagctagaccggctgaggaccatggtagaaaaatcagaactctgggtcgataaaaagggttcagggaagggggaagaggtcgaagcgggagcggcaaaagataagaaagagcgacctaccgacgaggaggggtttctccatcccccaggggagaaaagttcggaaaattaccagattgtgaaggggatcctggagaggctcaacaaaatgtgtggcgtcggcgagcagatgcgaaagaaacaacaaaggctcctgaagaatatggacgcccacaaagtgatgctggatctcttacagataccatatgacaagggtgatgccaagatgatggaaattttacgttacacacaccagtttcttcaaaagttctgtgctggtaatcccggcaaccaggccctgctccataaacacctgcatctcttcttaactccaggactactggaagcggaaacaatgcaacatatcttccttaataactatcagctctgctccgagattagcgagcccgtactacagcacttcgtacacctattagctacccacgggcggcatgtccagtacctggatttcttgcacacagtgatcaaagccgagggtaagtacgtgaagaaatgtcaggacatgatcatgacagagctgactaacgcaggcgatgatgtcgtagtcttctacaatgataaggcttcgctggctcatctgctggatatgatgaaagctgctagggatggggtggaagaccactcccccttgatgtaccacatcagtctcgtggacctccttgctgcatgcgccgaggggaaaaatgtttacacagagatcaaatgcaccagcttattgccactggaggatgtcgtttctgtagttacccacgaagattgtattaccgaagtcaagatggcttatgttaacttcgtgaatcattgctatgtggacaccgaggtggagatgaaagaaatctatacgagcaatcatatctggacacttttcgagaacttcaccctggatatggctcgggtttgttctaagcgagaaaaacgcgtggcggacccaacattggaaaaatacgttctgtctgtcgtgctggatacaatcaatgcctttttcagttctccgttctccgagaatagtacttccctgcaaactcatcagaccatagttgtacagttactgcagagcactacccgattgcttgagtgtccatggctgcagcagcaacataaggggtctgtcgaagcgtgtatccgcacactggctatggtggcaaagggcagagctatcttgctgccgatggacttggatgcgcacatcagctcgatgctttcatcaggcgcttcctgcgccgctgcggcgcagaggaacgctagtagctacaaagccactacccgggcttttcctagggtgacacctacggccaaccaatgggactacaaaaatatcattgaaaaactgcaggatattataaccgccctcgaagagcggctcaagccactcgttcaggctgagttaagtgtactggtggatgtattgcactggcccgaactgttgttcctggagggatctgaggcctaccagcgatgtgagtcgggaggttttctgagcaaactcatccagcataccaaggatctgatggaatccgaggagaaactgtgtataaaagtgctcagaaccttgcagcagatgcttctgaagaagaccaagtatggagatagagggaatcagctgcgcaagatgctactgcaaaactatctacaaaacaggaagtccactagcaggggggatctacctgatcctattggaactggtcttgacccagattggtctgccattgccgccacccagtgcagactcgataaggagggggcaacaaagctggtgtgtgacctaatcacatctactaagaatgagaagatcttccaggaatctataggcctggcgattcatctcttagacggcggcaataccgagatccagaaaagctttcacaacttaatgatgagtgacaagaagtctgagcgcttctttaaggtgttacatgataggatgaaacgggcccaacaggaaaccaagtccaccgttgccgtaaacatgaatgatttgggaagccaaccccacgaggacagggagcccgttgatccaaccacaaagggaagagtggcttcctttagcatcccgggatcttctagtcgctatagtctgggtcccagtctgagaaggggccacgaggttagtgagagagtgcagagctccgaaatggggacctccgtcctcatcatgcagcctatcttgcgcttcctccagctcctatgcgagaatcacaaccgggacctgcaaaattttctaagatgtcaaaataataagacaaactataacttggtttgtgagacactccagtttctagatatcatgtgtgggtctactacagggggactgggcctgctcgggctgtatataaatgaggacaatgtgggcctggtgatccagaccctggaaaccctcacggagtactgtcaaggaccttgtcacgagaatcagacttgtattgtcacccatgaatcaaacgggattgatatcattacagcgcttatcctgaacgatatttcccccctgtgcaaatatagaatggacttagtgctccagcttaaagacaacgcatcaaagcttcttctcgcattaatggaatcacggcacgactccgaaaatgctgagcgtattctgatatctctccgtccccaggaactggtggacgtgatcaaaaaggcttacctccaagaggaggagcgggaaaactctgaagtttctccaagggaggtcggacacaacatctatatcctcgcgttgcaactctcacgtcacaacaaacaacttcagcacctgctgaagccagttaagcggatccaggaggaagaagcggagggcatcagcagcatgctgtctctgaacaacaagcaactgtctcagatgctaaagtcatctgcacctgctcaagaagaagaggaagatccgctcgcctactacgagaaccatacgtctcagatagagatcgttaggcaggacagatcaatggaacagatcgtgttcccggtgcccggcatttgccaattcctgaccgaggagacaaaacataggctcttcaccacaactgagcaagacgagcagggatctaaagtttccgatttttttgatcaaagttcattcctgcacaacgaaatggagtggcagaggaaactcagatcaatgccactgatatactggttttcccggagaatgacactgtggggaagcatcagcttcaaccttgccgtgtttatcaatatcatcattgcgttcttttacccttatatggagggtgcttccacgggagtcttggactcaccattgatctcactcctgttctggatccttatctgcttctcgattgcagcactgttcaccaaacggtacagtattcggccactgatcgtcgccctcatcctgaggtcaatctactacttgggcataggccccaccctgaacattttaggtgcccttaatctaaccaacaaaattgtattcgttgtgagctttgttggcaatagaggcacgtttattagaggatataaagcaatggtgatggacatggagtttctctaccacgtgggctatatactgaccagtgtcttgggactatttgctcatgagctgttttatagtatactgctttttgatcttatttaccgtgaagagactctctttaatgtaatcaagagcgtgacacggaatgggaggagcattctcttgactgccctgctggccctgatcctagtgtacctgtttagcatagtggggtttttatttctcaaggacgacttcatcctggaagtggatcggctgcctaacaaccattctaccgctagccctctggggatgccacatggagccgcagccttcgtggacacctgcagcggcgacaagatggactgcgtctctggtctgtccgtccccgaagtcctcgaggaagacagggaattggacagtacagagcgagcctgtgacacactcctcatgtgcatcgtcacagtgatgaaccacggactgcgtaacggcggaggcgttggtgacatcttgagaaaaccctcaaaggacgaatccctattccctgcaagagtagtgtatgaccttctgttcttttttattgtgatcatcatcgtactgaatttgatctttggagtgatcatcgatactttcgcagaccttagatccgagaagcagaaaaaagaagagatccttaagactacttgcttcatctgcgggctcgaaagggacaagttcgataataaaacagtgtcctttgaagagcacataaaacttgaacacaacatgtggaactacttatatttcatagtgctggtgcgggtcaagaacaagactgattataccggaccagagtcatacgtggcccagatgattaagaataagaaccttgactggttccctcgcatgcgggccatgtcattggtgtccaatgagggggaaggtgaacaaaatgagatccggatacttcaggataagctgaacagtaccatgaagctggttagccatctgacggcacagctcaatgaactgaaggagcaaatgacagagcaacgcaaaaggaggcagagacttggatttgtggacgtgcagaactgcataagccggtag

SEQ ID NO: 191398 - DNA, 1326 bp, Artificial Sequence
  Description of Artificial Sequence: Synthetic coding sequence
atgtgcgtgtgccagaccatggaggtgggccagtacggcaagaacgcaagccgtgccggggaccggggcgtgctgctggagccgttcatccaccaggtggggggccattcttcaatgatgcggtatgacgaccacaccgtgtgcaaacctctcatctcccgggaacagcgtttttacgaaagtctgccacctgaaatgaaggagtttacgccagaatataagggcgtggtgagtgtctgctttgaaggggactccgacggttacataaatttggtggcctacccatatgtcgagtccgaaaccgtagaacaggacgatactactgagagagagcagccacggcgaaagcattcccggagaagtctgcatcggagcggttccggaagtgatcacaaggaggaaaaagcgagccttagtctggagaccagcgaaagctcccaagaggcgaagtcccctaaagtggaactgcattctcattcggaagtacctttccagatgttagacggcaactctggactgagtagtgaaaagataagccataacccatggtctttgcgctgtcacaagcagcaactctcgagaatgcggagcgagtctaaggaccggaagctgtacaaatttctcctgttggaaaacgtcgtgcatcactttaaatacccctgtgtgctggaccttaagatgggaacgcgccagcatggcgacgacgcaagcgccgaaaaagccgctcggcagatgagaaagtgtgagcagtctacctctgcaactctgggggtcagggtatgtggaatgcaggtgtaccagctggacaccggacactatctgtgtagaaacaaatactacgggcggggactgtcaatagaagggtttaggaatgccctctaccagtacctccataacggtctagatctccgacgagacctattcgagcccattttgagcaagctccgcggtctgaaagcagtgctggagcgccaggcaagctatagattctactcttcctctctgctcgtcatttacgatggtaaagaatgtcgggcagagagttgcttggataggcgaagcgaaatgcgtctcaagcacttggatatggtactgcccgaggttgctagtagctgcggaccttcgaccagcccttccaacaccagcccagaggcagggccatctagccaacctaaagtggatgtgagaatgatcgacttcgcccacagcacttttaagggattccgagatgatccaacggtgcacgatggaccggaccgcggatacgttttcggtcttgagaaccttatcagcatcatggagcaaatgcgtgacgagaaccagtag

SEQ ID NO: 191399 - DNA, 831 bp, Artificial Sequence
  Description of Artificial Sequence: Synthetic coding sequence
atgctggacggcaacagcggcctgagcagcgagaagatcagccacaacccatggtctctgcgttgccacaaacaacagctgagcaggatgagatcggagtctaaagatcggaagttgtataaatttctcctgctggagaatgtggtccaccacttcaagtacccgtgcgtgctagatttgaagatgggcactcgccagcacggggacgatgcctcagctgagaaggcggccaggcagatgaggaaatgtgagcaatcaacctccgcaaccctgggagtgcgagtgtgcggaatgcaggtctatcaactagacacaggacattacctgtgtcggaacaaatactatggaagggggctgagcatagagggcttccgtaacgccctctaccaatatctgcacaacggtctcgatctgcggagggatttgttcgagcctatcctatctaagctgagggggctaaaggcagttctggagcgacaggcctcttatcgcttctactccagcagtttattggttatctacgacggcaaagaatgtcgagcggagtcctgcttggataggcggagtgagatgagactaaagcatctggacatggtcctcccagaggtcgcctcatcttgcggtcctagtacttcaccaagcaatacaagccccgaagctgggcctagttctcagccaaaagtggacgtacggatgatcgattttgcacattcaaccttcaaaggcttcagagacgatccaactgtccatgatggccccgaccgaggttacgtcttcggtttggagaatttgattagcattatggagcagatgcgggacgagaatcagtag

SEQ ID NO: 191400 - DNA, 831 bp, Artificial Sequence
  Description of Artificial Sequence: Synthetic coding sequence
atgctggacggcaacagcggcctgagcagcgagaagatcagccacaacccatggagcctcaggtgtcacaagcaacaactttcgaggatgcgctcggaaagcaaagaccgcaagctgtacaagttcctacttctcgagaatgtggtccaccacttcaagtatccctgcgttctggaccttaaaatgggtactcgtcagcacggcgacgatgctagtgccgagaaggccgcaaggcagatgagaaagtgcgaacagagcacctctgcgacactcggagtgagggtgtgcggaatgcaggtgtatcaattagatacgggacactacttgtgccgaaataagtactacgggcgcggcctgtctattgaagggtttaggaacgcactgtatcaatatctgcacaatggcctggacctccggcgggacctgttcgagccaatactgtccaagttacgggggcttaaagcggtgctggagaggcaggctagctaccgtttctactcttcaagcctgctggtcatatacgatggaaaggagtgccgagccgagagctgcctcgatcgccggagtgaaatgcgactaaagcatctggacatggtgttgcccgaagtcgcgagctcatgcggcccctctacctctcccagtaacacatccccagaggcaggaccatcgtcacaaccaaaagtcgacgtacggatgatcgacttcgctcactctacatttaaaggattcagagatgaccctaccgtacatgatggcccagatcgaggatacgtgttcggccttgagaacttgatctctatcatggagcaaatgcgagatgagaaccaatag

SEQ ID NO: 191401 - DNA, 1281 bp, Artificial Sequence
  Description of Artificial Sequence: Synthetic coding sequence
atgagccccgccttccgggccatggacgtggagccccgggccaagggtgttctgctagaaccattcgtccaccaggtgggggggcattcctgtgtgctgcgctttaatgaaactacactgtgtaaacctctggtgccacgcgagcaccagttttacgaaacgttgccagctgagatgcgaaagttcaccccgcagtataaaggtgtagtgagcgtaaggtttgaggaggatgaggaccgcaacctgtgcctgatcgcttatcccctcaaaggggatcacggcattgtggatatcgtggataattccgattgcgaacctaagtccaaactactccggtggacaaccaacaagaagcaccacgttctggagactgaaaagacgcctaaagactgggtccggcaacaccggaaagaggaaaaaatgaagagccacaagttggaggaagaattcgaatggctaaagaagagcgaagtgctgtactataccgttgagaaaaaaggcaatatcagctcacaattaaagcattacaacccttggtccatgaagtgccatcagcagcagctgcagcggatgaaggaaaacgcgaaacaccgcaatcaatataagtttatactgctggaaaacctcacttccagatacgaggttccttgtgtgctcgatctgaaaatgggaactcgtcagcatggcgatgacgcttccgaggaaaaggcagccaaccagatccgtaagtgccagcagtcaacttcggctgtgataggcgttagggtgtgtggcatgcaggtgtaccaggccgggtccgggcaattaatgtttatgaacaagtaccacgggcgcaagctttccgtccagggcttcaaagaggcactgttccagttttttcataatggccggtatcttcgccgagagctgctagggcctgtcctaaagaaactcaccgagctgaaggcggtcctggagaggcaagaaagctacaggttctattcttccagcctgctggtcatttatgacgggaaggagcggcccgaggttgtcctcgacagcgacgcagaagacctagaggacttaagcgaggaatctgccgacgagagtgccggagcgtacgcctacaagccaatcggagccagttcggtggacgtccgcatgatagattttgctcacacgacatgccggctttacggcgaagacactgtcgttcacgaagggcaagacgcaggctatattttcgggctgcagtcgctaatcgatatcgtcacagaaattagtgaggagtctggtgagtag

SEQ ID NO: 191402 - DNA, 294 bp, Artificial Sequence
  Description of Artificial Sequence: Synthetic coding sequence
atgagccccgccttccgggccatggacgtggagccccgggccaagggggtgcttctcgaaccctttgtgcatcaggtcggcggacattcttgcgtgctaaggtttaacgagacaaccctgtgtaaacctctggtgccgcgggaacaccagttctacgagacgctgcctgctgaaatgaggaagttcacccctcagtataaaggccagtctcaacgacccctcgtcagctggccgtccctaccacactttttcccctggtctttcccgctctggccacagggctccgtagcctag

SEQ ID NO: 191403 - DNA, 294 bp, Artificial Sequence
  Description of Artificial Sequence: Synthetic coding sequence
atgagccccgccttccgggccatggacgtggagccccgggccaagggggtgctgctcgagcctttcgtgcatcaagttggcggccacagctgcgtgttgagatttaatgaaaccacactgtgcaagccactggtgcccagggagcatcagttttatgagaccctccctgctgagatgcggaagtttacgccccagtacaagggccaatcccagcggcccttagtgtcatggcccagcctgccccatttcttcccatggagcttcccactgtggccccaggggtctgttgcttag

SEQ ID NO: 191404 - DNA, 558 bp, Artificial Sequence
  Description of Artificial Sequence: Synthetic coding sequence
atgagcctgaacctgcccgaggccagcctgctgagccgggccagctggccagaacaggcaaaggagcctcggcgagagggacacaccgataaacagcagaccgaagacgtgctcgccgcaggcctgaggtgtctgccacacctcccagcaatctgtgctcgtaggatgtcacctgccttcagagctatggatgtggagccacgggcaaaaggtgtactgctagaaccattcgtgcatcaagttggaggacatagctgtgttttacgctttaacgagaccacactttgcaaaccactggtccctcgggaacatcagttttacgagacattgcccgcagagatgcgtaagtttaccccccaatacaaagggaaatcccagctgttggaggggctaccacactggaggggagacgttcgcgatagggggcacggcaggccatggcaaccgtccctcgaacctagtttgccccctacactgtgtttcccctccttatcgtcattttcttcatcctggcctagtgcgcagcacttgacgcccagcgtgttcaacccttggtag

SEQ ID NO: 191405 - DNA, 264 bp, Artificial Sequence
  Description of Artificial Sequence: Synthetic coding sequence
atgagccccgccttccgggccatggacgtggagccccgggccaagggcgtcctgcttgaaccttttgtgcatcaggtgggcggtcactcttgtgtcctgagattcaatgagaccactctatgcaaaccactggtgccacgggaacaccagttctatgaaaccctgcctgctgaaatgaggaagtttaccccccagtacaagggggacattagttctcatcagcacggaggtgtttttgtcggagaatggggctccctgttgtag

SEQ ID NO: 191406 - DNA, 567 bp, Artificial Sequence
  Description of Artificial Sequence: Synthetic coding sequence
atgaacctgtgccagagccccttccaggagggctgccagagcctgttagctagctggcccgagcaggccaaggagccacggagggagggtcacaccgacaaacagcagacagaggacgtgctggcggccggtctgaggtgcttgccccacctgcccgctatctgcgcccggcgcatgagtcctgcttttcgggctatggacgtcgagccgcgcgcaaaaggtgtcctgctagaaccatttgtgcaccaggttggtggccacagttgcgtgttgcgttttaatgagacaacactgtgcaaacctctagtgccgagggaacaccaattttatgaaacactgccagccgaaatgaggaaattcaccccacagtacaagggaaagtctcagctgctggagggcctgcctcactggcgcggcgatgtgagagaccgaggacatggacggccatggcaaccatcactggaaccctctttacccccaactctgtgctttccatccctctctagcttctcaagctcctggccatcagcccaacacctgacaccctccgtttttaatccatggtag

SEQ ID NO: 191407 - DNA, 1233 bp, Artificial Sequence
  Description of Artificial Sequence: Synthetic coding sequence
atggtggtgcagaacagcgccgacgccggcgacatgcgggccggcgtccagctggagcctttcctgcaccaggtcggaggccatatgtctgtaatgaaatatgacgagcacaccgtgtgtaaacccctggtgtctcgggagcagcgtttctatgaatccctccccctcgcgatgaaacgtttcaccccccaatataagggtactgtaacagtgcatctatggaaagacagtactggacatctatcactggtggctaatcctgtgaaggaatctcaagagccctttaaagtctccactgaatcagcagcagttgctatctggcagacactgcagcaaactaccggaagcaatggcagtgattgcacattggctcagtggccacacgcacagctcgccaggagcccaaaggagtcccctgcaaaggccctgttgcgttccgagcctcatctcaacacgcccgcgttttccctggttgaagataccaatgggaatcaggtcgaacgcaagtcctttaatccttggggtctgcagtgtcaccaggcgcacttgacacggctgtgctcagaataccctgaaaataagcgccaccggtttttgcttctggagaacgtcgtctctcagtatacgcatccctgcgtcctggacctcaagatgggcacacggcagcatggggatgacgcctcagaagagaagaaagcccgccatatgagaaagtgcgctcaatcgacatctgcctgcctcggagtacggatatgcgggatgcaggtttaccagaccgacaaaaagtacttcttatgcaaagataagtattatggtcggaagctctccgtggaaggatttcgccaggccctgtaccagtttctgcataatggttcccatctcaggcgggagctgttagagccaatcctacatcagttgagagcactgctcagtgtgattaggagtcaatcctcttatcgattctacagcagttctctgctggttatctacgacgggcaggagccacctgaaagagcccccggcagcccccatcctcatgaggctccacaggcggcacacggctcctctccaggaggcttaaccaaagtggatatacggatgatcgactttgcccacaccacatacaaaggctattggaacgagcacaccacttacgatggtccagacccgggttatattttcggactagaaaatctaattaggatcctccaggatatacaagagggagagtag

SEQ ID NO: 191408 - DNA, 1233 bp, Artificial Sequence
  Description of Artificial Sequence: Synthetic coding sequence
atggtggtgcagaacagcgccgacgccggcgacatgcgggccggcgtgcagctcgagcccttcttgcatcaggttggtggacacatgagcgtgatgaagtatgacgaacacacagtctgcaagccactggtatcgcgggaacagaggttttatgagtcgttaccccttgctatgaagcggttcacacctcagtataagggcaccgttactgtgcatctctggaaggacagcaccgggcacctatcattggtcgccaatccagtgaaggaaagccaggagccgtttaaagtttctacagaaagcgccgctgtcgccatctggcagaccttgcaacagactactggttcaaacgggtctgattgtaccttggctcagtggccacatgcacagttagctcgttctcccaaagagtctcccgcaaaagctctccttcggtccgaaccacatttgaacactccagcattttcactcgttgaagacaccaatggtaaccaagtggaaaggaagagctttaacccctgggggctgcagtgccaccaggcccacttaacaaggctctgctccgaatacccggagaataaacggcaccggttcctgctactggagaatgttgtctctcagtacacccacccttgtgtgctggaccttaaaatgggtacgagacagcacggcgatgatgcgtctgaagaaaaaaaagcccgacatatgcgcaagtgtgcccagtccacatccgcctgtcttggcgtgcgaatctgtgggatgcaggtatatcaaactgacaaaaagtattttctgtgtaaggacaagtactacggtagaaagctgtccgtggagggattccggcaagctctataccaattcctgcacaatggttcccatctgagaagagagctgctcgagcctatcttacaccagctgcgggcactcctgtccgttatccggtcccaaagttcctacagattttattcttccagtctcctggtcatttatgatggacaggagccccctgaacgggctccgggatctccacaccctcatgaggctccgcaggcggcgcacggtagctcccccgggggattgaccaaggtcgatattcgcatgatcgattttgcccataccacctacaaggggtattggaacgaacatacaacttacgacggtccagatccagggtatatattcggcttagaaaacttgattagaatcctgcaggatatacaagaaggtgaatag

SEQ ID NO: 191409 - DNA, 1080 bp, Artificial Sequence
  Description of Artificial Sequence: Synthetic coding sequence
atggcccccatgggcatccggctgagccccctgggcgtggccgtgttctgtttgctgggtctgggtgtgctttaccatctgtactcagggttcttagcgggacgtttcagtctcttcggcttgggtggcgaacctggtggcggagccgccggaccagccgccgctgccgatggtggcacggtggatcttagagagatgctggcagtatccgtactggctgccgtacgcggaggtgatgaggtgaggcgagtgagagaaagcaatgtattacacgagaagagcaagggcaaaactagagagggagctgaggataagatgacctcaggagacgtcctctctaatcggaagatgttctacctgttgaaaacggctttccctagcgtgcagatcaacacggaggaacacgtggacgccgccgaccaggaagtcatcctgtgggaccataaaatccccgaagatatcttaaaggaagtgaccactcccaaagaagtgccggccgagagtgtgacagtgtggattgaccccttggacgccactcaagagtatactgaggacttgcgtaagtatgtgaccacgatggtgtgcgtggcagtgaacggtaaaccaatgctgggggtcatacacaaacccttctcagagtacaccgcgtgggcaatggttgacggcgggtcaaatgtgaaagcaaggtcttcctataacgagaaaacacccagaattgtagtgtcaaggagccatagcggcatggtgaaacaggtggcactgcagacctttggtaaccagacaaccattattcccgccggaggagcaggctacaaggtcctcgcactcttggacgtgcccgacaagtcccaggagaaggctgacctgtacatccacgtgacctatatcaaaaagtgggatatctgcgctggaaacgctattctgaaggcgctgggcggtcatatgactaccttgtccggtgaggaaattagttacactggaagcgacggaatagaaggcggcctgttggcgtctatccgcatgaaccaccaggcactggtacggaagctgcctgacctggaaaagaccggccataagtag

SEQ ID NO: 191410 - DNA, 1251 bp, Artificial Sequence
  Description of Artificial Sequence: Synthetic coding sequence
atggccaccgagccccccagccccctgcgggtggaggcccccggcccgcctgagatgagaacctccccagccattgaaagcactcctgagggaaccccgcagccagcagggggtcgccttaggttcctgaacggttgcgtgcccctgtctcatcaggtggcagggcacatgtatggaaaagacaaggttggaattctccaacatccagatgggacagtgctaaagcaactccagcccccgcctcgggggccaagggagctggagttttacaacatggtgtacgccgccgactgcttcgacggagtgctgttggagctgcgtaagtatctgcctaaatactacggaatttggtccccccccacagcccccaacgatctgtatctaaaactcgaggacgtcacacacaagttcaataaaccatgtatcatggacgtcaagattgggcaaaaatcttacgatccttttgcatcttccgaaaaaattcagcagcaagtgtcaaagtacccactcatggaggagattggcttcctcgtgttagggatgagagtataccacgtccattcagactcgtatgaaactgaaaaccagcactatgggagatctctaactaaagagacgattaaggacggcgtctccaggtttttccacaacggctattgcctgcggaaggacgctgtcgccgctagtatccagaaaatcgagaagatcctgcagtggttcgagaaccagaagcagctgaatttctatgcgagctctctgctgtttgtgtacgagggctcttcccagccaaccaccacaaaactaaatgataggaccctggcagaaaagtttctctccaaggggcagctatccgatactgaagtgctggaatacaacaacaactttcacgtgctgagcagtacagctaacgggaaaattgagtctagcgtcggtaaatcattatctaagatgtacgctcgccatcgaaaaatctacacaaagaaacatcactcgcaaactagtctgaaagtggaaaacctggaacaggataacggctggaaaagtatgagccaggagcatcttaatggaaatgttttgtcacagctcgagaaagtcttttatcacctgccaaccggatgccaggaaatcgctgaggtcgaggtgcggatgatagacttcgcgcacgtctttccctctaacacaatcgacgagggctatgtttatggcctgaaacacctgattagcgtgctcagatctatcctggacaattag

SEQ ID NO: 191411 - DNA, 3777 bp, Artificial Sequence
  Description of Artificial Sequence: Synthetic coding sequence
atggccagcgcctgcggcgcccccggccccggcggcgccctgggctctcaggccccatcatggtatcatcgagatctgagcagagcagctgccgaagagttgctcgccagggcagggagagacggttcgttcttggtgcgggattcagagtccgtcgccggggccttcgcactgtgcgtgctctatcagaaacacgtgcacacgtaccggatccttcccgacggggaagatttcctcgccgtccagacatcgcaaggagtcccagtgcggcggttccagaccttgggggagttgatcggtctgtacgctcaacctaatcagggtttagtgtgtgccctgcttcttcccgtagagggggaacgagagcccgatcctcctgacgaccgggatgcgtctgacggagaggacgagaagccccctcttccacctcggtctggaagcacctcaatatctgctcctaccgggccctcctcccccctgcccgcgccagagacacccactgcccctgctgcggagtcagcccccaacggactgtccactgtgtctcacgactacctgaaagggtcttatggcttagatctggaagcagtgagaggaggagcctctcacctcccccatctaacaagaacactcgccacgagttgtagaaggctccactccgaagttgataaagtgctgagcgggctggaaattctctcaaaagttttcgatcagcaatcgagccccatggttacaagactgctgcagcaacagaatctgccccagaccggtgaacaggagttagagagcttggtcctaaagctgtcagtgctgaaagactttttaagtgggattcagaaaaaagctctaaaagctttgcaggatatgagctccaccgcacccccggccccacagcctagtactcggaaggccaagactattcccgttcaggctttcgaggtgaagctagatgtcaccttaggcgacctgactaagatcggaaagtcccagaaattcaccctctccgtagacgtagaggggggccgcctggtactccttcggcggcagcgggatagtcaggaggactggacgacattcactcacgaccgcattcgacagcttattaagagtcagagagtgcagaataaactgggagtggtcttcgaaaaggaaaaagaccgcacacagcgcaaggacttcatcttcgtctctgccagaaaaagagaggcattctgtcagctgcttcagctaatgaagaacaagcactccaaacaggacgaaccagatatgattagcgtcttcatcggcacgtggaacatgggatccgtgccaccacccaagaacgtgactagctggtttacttcaaaagggcttggcaaaacattggacgaggtcactgtgaccatcccccacgacatctacgttttcgggacacaggagaacagtgttggtgatcgagaatggctggacctgctaaggggaggactaaaagagcttaccgatctggactacaggcccatcgctatgcagtccctatggaatatcaaagttgctgtgctggtgaaacctgagcacgaaaaccgtattagccacgtgtcgactagttcagtcaagacaggtatcgcgaacaccttggggaataaaggagccgtaggcgtctcctttatgttcaacggtacatcttttggatttgtcaactgtcacctgacatctggaaacgagaaaaccgcccgaagaaaccagaattaccttgacatcctgcggctgctgtcactcggtgacagacagctgaacgccttcgatatcagcttgaggtttacacatttgttctggtttggggacctgaattataggctcgacatggacatccaggagatcctcaactacatttccaggaaggaattcgagccgttacttcgggttgatcagctcaacttagaaagggagaagcataaagtttttctgcgcttctctgaggaggagatctcgttcccgcctacatacagatatgaaaggggatcccgagacacttatgcctggcataagcagaagccgactggtgtcagaactaacgtcccttcctggtgcgatagaattctgtggaagagctaccccgagacccatatcatttgtaacagttatgggtgcacagatgacatcgttacatctgaccacagccccgtgttcggcacattcgaggtgggagtcacctcgcagtttatttcgaaaaaaggcttgtctaaaaccagcgaccaggcttatatcgagtttgaaagtatcgaggcaattgtgaaaacagcttctagaacgaagttttttattgaattttactcgacatgcctggaagaatataagaagtcattcgagaacgatgctcagtcatcagataatatcaatttcctcaaggtgcagtggtcctccaggcagctgccaacccttaaaccgatcctcgcagacattgagtacctccaggaccagcacctcctgttaacagtaaagtcaatggatgggtacgagagttacggggaatgcgtggttgctcttaagtctatgattgggagcacagcccagcaattccttactttcctcagccatcgcggggaagagactggcaacatccggggatccatgaaagtacgagttccgactgaacgtctcgggacccgagaacgcttgtatgaatggatctcaatcgacaaggacgaagccggggctaaatcgaaagcacctagcgtgtcccgcggcagccaagaaccccgctctgggtcaagaaagccagctttcacggaggcttcctgccccttgtccaggcttttcgaggagcctgagaagcctccaccgactggacggcccccagctcctcctcgcgcagcaccacgcgaagagccccttacgccacggctcaagcctgaaggtgcaccagagccagaaggcgtagccgccccaccccctaagaactcctttaacaacccagcctattatgtcctggaaggcgtcccacaccaacttctgccaccagagccccccagcccagcccgcgcccctgtaccctctgccacgaaaaacaaagtcgccatcaccgtcccagccccacaactgggacaccaccggcatccaagagtcggcgaaggatcgtctagtgatgaagagtcgggcgggactctccctccaccggacttcccacccccgcctctgcccgacagcgctatcttccttccaccatcattagatccgctgccaggcccagtggtgagaggacgaggcggggccgaggcacggggtcccccaccccccaaggcccacccccggcctccactgcctcctggtccatcccccgcatccacgttcttaggtgaggtggcgtccggagacgatcgatcctgtagtgttctgcagatggctaaaacactgtccgaggtggattatgctccagctggcccagctcggtctgcccttctccctggaccactggagctccaacctcctaggggactgccctcagactacggccgcccactcagtttccctcctcctagaataagagaaagcattcaggaggacctcgccgaggaggcgccctgcctgcagggtgggcgtgcctcgggactgggggaagcaggaatgtcagcttggctgcgtgctataggcctcgagagatatgaagaaggactcgttcacaatggctgggacgatctggagttcctttcagatatcacagaggaagatcttgaagaggccggagtgcaggatccagcacacaagaggctgctgttggacactctccagttatctaagtag

SEQ ID NO: 191412 - DNA, 105 bp, Artificial Sequence
  Description of Artificial Sequence: Synthetic coding sequence
atggtgacccggctgctgcagcagcagaacctgccccagaccggcgagcaagaactggaaagtctggtgctgaagctgagcgtgctcaaggacttcctgagctag

SEQ ID NO: 191413 - DNA, 3051 bp, Artificial Sequence
  Description of Artificial Sequence: Synthetic coding sequence
atggtgacccggctgctgcagcagcagaacctgccccagaccggcgagcaggagctagagagcctggttctgaagctgagtgtcctcaaggatttcttgagcggcattcaaaaaaaggccctgaaagctttgcaagatatgtcctccacggcacctccggcgcctcagccttccaccagaaaagctaagacgattccagttcaggcatttgaagttaagcttgacgtgacacttggtgatctgactaaaatcggcaaatcccagaaatttaccctgtctgtggacgtggagggcggcagattagtgcttttgcggcggcagcgagacagccaggaggactggaccaccttcacccacgaccgcatcagacagcttattaaatctcagcgagtgcagaataaactgggcgtagtcttcgagaaggagaaggatagaactcagagaaaggatttcatattcgtctctgcacgaaagagggaggccttctgtcaactgttgcaacttatgaagaacaagcattcaaaacaggacgagcctgacatgatctcagtcttcatagggacctggaatatggggtccgtgccacctcctaagaatgttacttcatggtttacatccaaagggcttggcaaaacattggatgaagtgaccgtgacaatcccacacgacatatacgtctttggtactcaggaaaactctgtaggcgaccgcgagtggctggatcttctcagaggtggactgaaagagcttacagatctcgactaccgtccaatcgcaatgcagtccctgtggaatataaaagtggcggtcttagtaaagcccgagcatgaaaatcggatttctcacgtctctaccagtagcgtcaagacaggtatcgccaataccctcggcaataagggagcagtcggagtcagcttcatgttcaatgggacaagctttggcttcgtgaattgccatctcacttccggcaacgaaaagactgcccgacgaaaccagaattatctggatatcttacggctcctttctcttggcgacaggcagttgaatgcctttgatatctctctgagatttacacacctcttttggttcggggacttgaactacaggctggacatggatattcaagaaatcctgaattatataagtaggaaggaattcgagccgttattgagagtcgaccagttaaatctagaacgcgagaagcacaaagtgttccttcgcttttcagaggaggaaatttccttcccccctacctaccgctacgagagaggtagtagagatacatatgcatggcataagcaaaagcccacaggggtgcgaacaaacgttcccagctggtgtgacagaattttatggaaatcctatccggagacccacataatctgcaacagttatggatgcaccgatgacattgttactagtgaccactcccccgtctttggtacttttgaggttggggtgacctctcaattcatctcaaaaaagggcttatctaagacttctgaccaggcatatatcgaattcgaatctattgaagccattgtgaaaacagccagtaggactaagttctttatcgagttctattctacatgcctggaggaatacaagaagtccttcgaaaacgacgcacagtcctcagataacatcaattttcttaaggtgcaatggagctcgcggcagctgccgacccttaagccaattcttgccgatattgaatatctacaagaccagcacctgctgcttacagtcaaaagcatggatggatacgagtcttatggagagtgtgtggtcgctctgaagtccatgatcggctccactgctcaacagtttctgacgtttctgagccatcggggagaggagacaggaaacatcaggggaagcatgaaagtaagagtgcccaccgagcgcttgggtactcgggagcggctgtacgagtggatctctatcgacaaagatgaagctggtgcaaagagcaaggcaccatctgtgagccgcggttctcaggaaccccggtctggaagcaggaaacctgcttttactgaagcctcttgcccactgtcccgactctttgaagaacctgagaagccacctccaaccggaaggcctcccgccccaccacgcgccgcaccaagagaggaacctttaactccgcgtctgaaaccagagggcgcccctgaacccgagggtgtagccgcccctcctcctaaaaatagttttaataacccagcttactacgtcctggagggagtgcctcaccagttactgccaccggagccccctagtcctgccagagcgcccgtgcccagcgcaacgaagaataaggttgcaattacagtccccgctccccagctgggccatcatcgccacccacgagtgggggaagggagttccagcgatgaggaaagtggtggaaccctcccacctcctgattttccacctccacccctcccagacagtgccatttttctccctcctagtttggaccctttgccaggacctgttgttagaggccgcgggggagccgaagcccggggcccacccccaccaaaggctcaccctaggcccccactacctccaggaccaagtcctgcctcaacttttctgggcgaagtcgcatccggcgacgataggagttgttcagtccttcagatggccaagaccctgtcagaagtcgattatgctcctgcgggcccagcgcgaagtgctctgttgcctgggcctctggagctgcagcctcctcggggactcccctccgattacgggcgacctctgtctttcccccccccacgcatcagggagtccatccaggaggatctggctgaagaggcaccctgtcttcagggcggccgggcgtccggcttgggcgaagctggaatgagcgcctggttgagggccatcgggctagaaagatatgaggaggggctggttcataacggatgggacgatctcgagtttttatccgatatcaccgaggaggacctcgaagaggccggcgttcaggatcccgcacataaaaggttactcctagacacccttcagctcagcaaatag

SEQ ID NO: 191414 - DNA, 69 bp, Artificial Sequence
  Description of Artificial Sequence: Synthetic coding sequence
atggccagcgcctgcggcgcccccggccccggcggcgccctgggctctcaagccccctcgtggtactag

SEQ ID NO: 191415 - DNA, 3051 bp, Artificial Sequence
  Description of Artificial Sequence: Synthetic coding sequence
atggtgacccggctgctgcagcagcagaacctgccccagaccggcgagcaggagctagagtccctggtgttgaaactgtcagttctgaaagattttctgagcggaattcagaagaaagcattgaaggccctgcaggacatgagtagtacagcgccgccggccccccagcctagcactcgcaaagcgaaaacaatcccggtccaggcatttgaggtcaagctggacgttaccttaggggatttgaccaagatcggcaagtcccagaagttcactctgagtgtcgatgtcgaagggggacgcctcgtgctgttgaggcgtcaaagggacagccaggaggactggacaaccttcacccatgatcgcatcaggcagctcatcaagagtcagcgtgtgcagaacaagcttggagtcgttttcgagaaagagaaggaccggacgcagcgtaaggactttattttcgttagtgcccggaaaagggaggctttttgccaacttcttcagctgatgaagaacaaacactctaaacaggatgagccagacatgatatcagtttttatagggacgtggaatatgggatccgtccctcccccaaagaacgtcacctcttggttcacttcaaagggcttgggcaagaccctggatgaagtcacggtgacgattcctcacgatatttatgtgttcggcacgcaggaaaacagtgtaggcgaccgcgaatggctggacttactgagaggtgggctgaaggagctgacggacctggactataggcccatagccatgcagagcctttggaatattaaggttgccgtgctcgttaagcccgagcatgagaaccggatatctcatgtttcgacctcttcagtgaaaaccggcatcgccaacactttagggaacaaaggggctgtcggagtgtcctttatgttcaacggtacaagttttggtttcgtgaattgtcacctcactagcgggaacgagaagactgctcggcggaatcaaaattatctggacatactgaggcttcttagcctcggagatcgacagctcaacgcgttcgacatttccctgaggtttacccatctgttctggtttggagacttgaattacagattggacatggacatccaagaaattctcaactacatctcacggaaggaattcgagcctctcctacgcgtggaccagctcaatctggagagggaaaagcacaaagtgtttcttaggttttcagaggaggagatatcatttccccccacataccgatacgaaagaggaagtagagatacttatgcatggcataaacagaaacccacaggagtgaggaccaacgttccctcttggtgcgaccgcatcctgtggaagagttatcccgagactcatatcatttgcaactcatatggctgtacagacgacatcgtgacaagcgaccactcacctgtgtttggtacatttgaggtcggggtcacctcacagtttatcagcaaaaaggggctctccaaaacatctgaccaggcatacattgagttcgaatccatcgaggccattgtgaagaccgcctccagaacgaagtttttcatcgaattctactctacatgtctcgaggaatacaagaaaagcttcgagaacgatgcacagtcttcagacaacatcaatttcttgaaagttcagtggtcctctaggcagctaccaactttgaaacccatcctggccgacattgagtacctgcaagatcaacatctgttgctcacagtgaagagcatggatggctacgagagctatggtgagtgcgtagtggctctgaaaagtatgattggatccacggctcaacagtttctcacgtttctgtctcatcgcggcgaggagactgggaacattaggggatcgatgaaggtcagagtccctactgagagactcggaaccagggagagactgtatgagtggatatcaatcgacaaagacgaggctggtgcgaaatccaaggcgccctcagtgtccaggggatctcaggaaccaaggtccgggagcaggaaaccggcctttacagaggcttcctgccctctgtcacggctgtttgaggaacctgagaagccaccgccaaccgggcgccccccagccccacctcgagctgccccccgggaagagcccttaacacccagactcaaacccgaaggagctccggagcctgagggtgtggctgcacctccccccaagaatagcttcaacaacccggcctattatgtcctagaaggtgtgccacaccagcttctgccccctgaacctcctagtccagcacgtgctcctgtgcctagtgctacgaaaaataaggtagccattacagtcccagcccctcagctaggccaccaccgtcatccaagggtgggggaaggcagctcatcagatgaggagagcggaggaaccctgcctccccctgactttccaccccccccgttaccagatagtgctatcttcttgccacctagtcttgacccactacccggcccggttgtgcggggtcgagggggagctgaagctagaggccctccaccgcccaaagctcatccacgaccacctctgccaccaggaccctcaccagcatcgacttttttgggggaggtcgcttccggcgatgaccgcagctgttctgtgctccagatggcaaagacgctgtccgaggtagattacgcccccgctggacccgcacgatccgcactgttaccgggcccacttgaactgcagcccccaaggggcctcccaagcgactatggacgtcctctttccttcccccccccaaggatccgcgagtccattcaggaggatttggccgaagaagcaccatgcctccagggcggccgcgcttccgggctgggggaagcgggaatgagtgcatggcttcgcgccattggcctcgaacgctatgaagagggcctcgtccacaatggatgggacgacctagagttcctgagcgatattactgaagaggatctggaagaggctggcgtacaagaccctgcccacaaacgtctgttattggacaccctgcagctctccaaatag

SEQ ID NO: 191416 - DNA, 57 bp, Artificial Sequence
  Description of Artificial Sequence: Synthetic coding sequence
atggccagcgcctgcggcgcccccggccccggcggcgccctgggctctcaggcgtag

SEQ ID NO: 191417 - DNA, 474 bp, Artificial Sequence
  Description of Artificial Sequence: Synthetic coding sequence
atggtgacccggctgctgcagcagcagaacctgccccagaccggcgaacaggagttggagagtttagtgctgaaactcagtgtgttaaaagactttctgagcggaatccagaagaaggccctgaaggccctacaggatatgtccagcaccgccccacccgcaccccagccttccactcgcaaagcaaaaaccatcccagtacaggcgtttgaggtcaagctggatgttacattaggcgacttgaccaagatcgggaaatctcagaagttcaccttatcagtggatgtcgagggcggccggctggttctgctccggaggcagcgggattcccaagaagactggacgacctttactcacgatcgaattagacaactaatcaagtcacaaagagtgcagaataaactgggcgtcgtgttcgagaaagagaaagataggactcagagaaaggacttcatctttgtctccgctcgttag

SEQ ID NO: 191418 - DNA, 1200 bp, Artificial Sequence
  Description of Artificial Sequence: Synthetic coding sequence
atgagcgacatcctgcgggagctgctgtgcgtgagcgagaaggccgcgaatatagcccgggcttgccgccaacaggaagccttgttccagctgctcatcgaggagaagaaggagggggaaaaaaataaaaaatttgccgtggacttcaagacactcgccgacgttctggttcaggaggttattaaacagaatatggagaataagttccctggactggagaaaaacatctttggtgaggagtctaatgagttcaccaacgactggggggagaagattactcttcgtctctgtagtacagaagaggaaaccgccgaactcctgagcaaagttctaaacggaaataaggtggcaagtgaggcactggccagggtggtgcatcaggatgtggcctttacagacccaactctggattcaacagaaattaatgtacctcaagatatcctcggaatatgggtggaccctatcgacagtacttatcaatacatcaagggaagcgccgacataaagtccaatcaaggcatcttcccttgtggcttacagtgtgttacgattctgatcggggtgtatgacattcagacgggtgtcccgctcatgggagtcattaaccagccctttgtttcacgcgatcccaatacactcaggtggaaggggcaatgttactgggggttaagctacatggggacgaatatgcatagcctccagcttaccatcagtagacgaaatggtagtgagacacacactggcaataccggctccgaggctgcttttagccccagttttagtgctgttattagcacttctgaaaaggagaccataaaggccgctctctccagggtttgtggggaccgcatatttggtgctgccggagcaggctacaaaagcctgtgtgttgtgcagggacttgtggacatctacatattctctgaagatacgacctttaagtgggactcatgcgccgcccacgccattctccgagctatgggaggaggcatcgtcgatctgaaagaatgtctagaacggaaccctgagacgggtcttgatctgccacaactcgtttatcatgtggaaaacgagggtgcagccggcgtggataggtgggcgaataagggcggtctgatcgcatacaggtcccgtaaacggctcgagactttcttgtccttgcttgtacagaacctggcgccagccgaaacccacacttag

SEQ ID NO: 191419 - DNA, 1200 bp, Artificial Sequence
  Description of Artificial Sequence: Synthetic coding sequence
atgagcgacatcctgcgggagctgctgtgcgtgagcgagaaggccgccaacatagcccgggcttgccgtcagcaagaggccctttttcaactgctgatagaggagaaaaaagaaggagagaagaacaagaagtttgctgttgactttaagacactggccgatgttctggtgcaggaagtgattaagcagaatatggagaataagttcccgggtctagagaagaatatttttggagaagagagtaatgaattcaccaacgactggggagaaaagattaccttgaggctgtgcagtactgaggaagaaaccgccgaattactctctaaggtcctgaacgggaacaaagttgcatctgaggcattagcacgtgtggttcaccaagatgtcgcgtttaccgaccccaccctggatagcacggagattaatgtgccccaggacattctgggaatttgggttgatcctattgattcaacttaccagtacattaagggctccgccgacattaaatccaaccaaggcatattcccatgcggcttacagtgtgtgacaatcctgataggagtgtacgacatccagacaggtgtacctttaatgggggtgataaatcagccctttgtctctagggacccaaacacccttagatggaaaggccagtgttattgggggcttagctatatgggtaccaacatgcatagcctgcagctcaccataagccgcagaaatggctccgagacccacacgggcaacaccggcagtgaggccgccttttcaccaagcttttcggccgtcattagcactagtgaaaaagagaccatcaaggcagccctttccagagtctgcggcgacagaatctttggtgccgcaggcgctggttataagtccctctgcgtggtccaaggcctcgtagacatctacatcttctctgaagatacaacctttaaatgggactcttgtgcggcccacgctatcttacgcgccatgggaggcggaatcgtggatctgaaggaatgtctggagcgcaatcccgagactggactcgatctgccacaattagtctatcacgtcgaaaatgaaggcgcagccggcgtcgacagatgggccaacaaagggggtcttattgcataccgcagccgcaagaggttagagacattcttgagtttactggttcaaaacttggcacccgccgagactcacacatag

SEQ ID NO: 191420 - DNA, 468 bp, Artificial Sequence
  Description of Artificial Sequence: Synthetic coding sequence
atgagcgacatcctgcgggagctgctgtgcgtgagcgagaaggccgcgaatattgcccgtgcctgtagacaacaggaggcgctgtttcagttgctgatcgaagagaaaaaggagggcgagaagaataaaaagttcgctgtggattttaaaacactggccgacgtgctggtgcaggaggttatcaagcagaacatggagaacaaatttccgggattggagaagaacatctttggcgaggagagtaatgagttcaccaacgattggggcgaaaagataacactgaggctttgctctaccgaggaggaaaccgcagaattgttatccaaagtcctaaacgggaataaagtcgctagtgaagccctggctagggtcgttcaccaggacgtggcattcactgaccccacccttgattccacggagattaacgtgccccaggatatcctgggcatctgggtggaccccatttag

SEQ ID NO: 191421 - DNA, 267 bp, Artificial Sequence
  Description of Artificial Sequence: Synthetic coding sequence
atgagcgacatcctgcgggagctgctgtgcgtgagcgagaaggccgccaacatcgcccgggcctgtcgtcagcaggaggctctgtttcagttactgattgaagagaagaaggaaggtgagaagaacaaaaaatttgctgtggattttaagactctggccgatgtccttgtccaagaggtcattaagcaaaacatggaaaataaattcccaggcctggagaagaacatcttcggagaggaaagcaacgagttcaccaacgactggtag

SEQ ID NO: 191422 - DNA, 639 bp, Artificial Sequence
  Description of Artificial Sequence: Synthetic coding sequence
atgagcgacatcctgcgggagctgctgtgcgtgagcgagaaggccgccaatatagctcgggcgtgcaggcagcaggaagcactgtttcagctgctgatcgaggaaaaaaaggagggcgagaaaaacaagaaatttgccgtggactttaaaactcttgccgacgtcttagtgcaggaagtgatcaaacaaaacatggagaataaatttcccggactcgagaagaatatcttcggcgaggaatccaacgagtttacaaatgattggggggagaagatcacattgcgcctgtgcagtaccgaagaggagactgcagagctcctatctaaagtcctcaacggtaacaaggtggcatccgaggccctggccagagtggtgcaccaggacgtggcatttaccgacccgacactggacagcacagagattaacgttccacaggatattctaggtatttgggtggatcctattgatagcacctaccagtatatcaagggttccgcagatattaagagcaatcaggggattttcccatgcggtctgcaatgcgtgacaatcctgatcggcgtgtatgatatccagactggcgtaccccttatgggcgttatcaatcagcccttcgtttcacgagatcctaacacctag

SEQ ID NO: 191423 - DNA, 30 bp, Artificial Sequence
  Description of Artificial Sequence: Synthetic coding sequence
atgagcgacatcctgcgggagctgctgtag

SEQ ID NO: 191424 - DNA, 642 bp, Artificial Sequence
  Description of Artificial Sequence: Synthetic coding sequence
atgagcgacatcctgcgggagctgctgtgcgtgagcgagaaggccgctaacattgctagagcctgtaggcagcaggaagcccttttccagctgctgatcgaagagaaaaaggaaggcgagaagaataagaagttcgctgtcgactttaaaacattagccgacgtgctcgtgcaagaagtgattaaacagaacatggaaaacaaatttcccgggctggagaaaaacatctttggcgaagagtctaatgaattcactaacgattggggagagaagataactctccggctatgctcgactgaggaggagaccgctgaacttttgtctaaagtgttgaatggaaacaaggtggccagtgaagcactggcaagagttgtgcaccaggacgtggcatttactgaccctacactggactccaccgaaattaatgtaccccaagacatattgggcatctgggttgaccctatagatagtacttatcagtacattaagggtagtgctgatatcaagtccaatcagggaatcttcccctgcggtctccagtgcgtcactattctcattggtgtgtacgacatccaaacaggggttcccctcatgggcgtcatcaatcagccttttgtgtcaagagatccaaatacactctag

SEQ ID NO: 191425 - DNA, 573 bp, Artificial Sequence
  Description of Artificial Sequence: Synthetic coding sequence
atgagcgacatcctgcgggagctgctgtgcgtgagcgagaaggccgctaacatagctagagcctgcagacagcaagaagcactttttcagctgttgatcgaggagaaaaaagagggtgaaaaaaataagaagtttgcggtagactttaagaccctcgccgatgtgctggtccaggaggtgatcaagcagaacatggaaaataagttccccggcctcgagaaaaacatattcggggaggagtcaaatgaattcacgaacgattggggtgagaagatcaccctccgactgtgcagcaccgaggaggagaccgccgagttactgtcaaaggtcttgaacggcaataaggtcgccagtgaagctctcgccagagtcgtccatcaggacgtggccttcaccgatcccaccctcgacagcaccgagatcaatgtgccccaggatattctgggcatttgggttgatcctatcgactccacatatcagtatattaaagggtccgccgacattaagtccaaccagggcatattcccctgtggcctgcagtgtgtgactattctgatcggggtttatgactag

SEQ ID NO: 191426 - DNA, 93 bp, Artificial Sequence
  Description of Artificial Sequence: Synthetic coding sequence
atgagcgacatcctgcgggagctgctgtgcgtgagcgagaaggccgcgaacattgctcgggcgtgtaggcaacaggaagctttgtttcagtag

SEQ ID NO: 191427 - DNA, 207 bp, Artificial Sequence
  Description of Artificial Sequence: Synthetic coding sequence
atgagcgacatcctgcgggagctgctgtgcgtgagcgagaaggccgccaatatcgccagagcttgtagacaacaggaggcactgtttcagctgctaatcgaggagaaaaaggagggcgaaaagaataagaaattcgccgtggactttaaaacattagccgacgtgctcgtacaggaagtgataaagcaaaacatggaaaataagtag

SEQ ID NO: 191428 - DNA, 432 bp, Artificial Sequence
  Description of Artificial Sequence: Synthetic coding sequence
atgagcgacatcctgcgggagctgctgtgcgtgagcgagaaggccgccaacattgctcgggcctgccgccagcaggaagctttatttcagctcctgattgaggagaagaaagaaggagaaaagaacaagaaatttgctgtcgacttcaaaaccctggcagatgtcctggttcaagaagtaattaagcagaacatggaaaacaagttcccagggttagaaaaaaacatcttcggcgaagagtccaatgaatttacaaacgattggggcgagaaaattacgctccgcctctgttcgacagaagaggaaacagctgagctgctgtctaaggtcctgaatgggaataaggttgcctctgaggcgttggcccgggtggttcaccaggatgtcgcctttaccgacccaacactggattcaaccgaaattaacgtttag

SEQ ID NO: 191429 - DNA, 1200 bp, Artificial Sequence
  Description of Artificial Sequence: Synthetic coding sequence
atgagcgacatcctgcgggagctgctgtgcgtgagcgagaaggccgccaacatcgcacgagcatgtcgacagcaggaagctctttttcagctgttgatcgaagaaaagaaggagggcgagaagaataagaaattcgccgtcgattttaagacactggcagatgttctggtccaggaagttattaaacagaacatggaaaataagttccccggactagaaaagaatattttcggagaagaatcaaacgagtttactaacgattggggtgaaaaaatcacactgaggctttgttccaccgaggaagaaaccgctgagctgctatctaaggtcttgaatgggaataaggtggcgtccgaagccctggctagagttgtccatcaggacgtagcatttaccgacccaactcttgactccactgaaatcaacgtccctcaggacatcttgggcatttgggtggaccccatcgattccacctaccagtatatcaaaggatccgctgacatcaagtcaaaccagggcatcttcccctgtgggctccagtgtgtcacgatccttatcggcgtgtatgatattcagaccggagttcctctgatgggggtgataaatcagccttttgtctcccgggatccaaacacgctccgctggaaggggcagtgctactggggcctttcctatatgggaactaacatgcacagcttgcagctgactataagtagaaggaacgggagtgagacccacacaggtaataccggcagtgaggctgctttctccccctcttttagtgccgtgatttcgacttccgaaaaggagaccatcaaggcagctctgagtagagtctgcggagaccggatatttggcgccgctggggccggctacaagtccttgtgtgtcgtgcagggactcgttgatatctacatattctcagaggatacaacattcaaatgggactcttgtgctgctcacgctattctcagggcgatgggaggagggatcgtagatctcaaggagtgcctcgagcggaatcccgagaccgggttggatctaccccagttggtttaccacgtagagaacgagggcgctgccggggtggatcgttgggctaacaagggtggcctaatcgcctacaggagccgcaagcggcttgagacatttctgagcctgctcgttcaaaatcttgctccggccgaaacacacacatag

SEQ ID NO: 191430 - DNA, 2934 bp, Artificial Sequence
  Description of Artificial Sequence: Synthetic coding sequence
atgaccgcccgggagcacagcccccggcacggcgcccgggcccgggccatgcagagggcgtctacaatcgacgttgcagcggacatgctggggctctctcttgcaggcaacattcaggacccagatgagcctattctggagttttcattagcctgctccgagctgcacacaccctctctcgacaggaagcccaactccttcgtcgcagtttccgtgacaacgcctccccaggccttctggactaaacatgcccagacagaaattatcgaaggtactaacaaccccatcttcctgtccagtattgctttttttcaggactcgctaattaatcaaatgactcaggtgaaactctcggtatatgacgtgaaggatagaagccaggggaccatgtacttgctcggcagtgggacatttatcgtcaaggatctcctccaggacagacaccatagacttcatctcacactcaggtccgcagaatccgacagagttggcaacattacagtcatcggatggcaaatggaagaaaaatcagatcagagaccccccgttacaaggtctgtggacaccgttaatggacgcatggtccttccggttgacgagtcgctgactgaggcacttgggattagatccaaatatgccagcctgcggaaggataccctgctgaaaagtgtcttcggaggggccatctgcaggatgtaccgctttcctactacagatggcaaccatctgagaattctggaacagatggccgagtcagtgctaagcttacacgtaccaaggcagtttgttaagctgctgctggaagaggacgctgctcgagtgtgcgagcttgaggagctcggcgagctgtcaccatgttgggagtccttaaggcgccagatcgtcactcagtaccagacaattatcttgacgtatcaggagaacttgactgacctgcatcagtacagaggtccaagctttaaggcttcgtccctgaaggctgataaaaaactcgaattcgttcctactaacctccatatccagcgaatgagagtacaagacgacgggggctcggaccagaactatgatattgtcactatcggagcaccggctgcacactgccaaggatttaaatcaggaggtttgcggaaaaaacttcacaaatttgaggaaacaaagaaacatttcgaagaatgttgcacatcgagtgggtgccaaagtattatttatatcccacaggatgtggtgagggcgaaagagattatagcgcagattaacacactcaaaactcaggtgtcctactatgcggagcgcctgtccagagcggccaaggatcggtctgcaactgggctcgagcggacactggcaattctggccgacaaaactcgacagttggtaaccgtctgtgattgcaagctcctcgccaattcaatccacggactcaacgctgcccgaccagattatatcgcaagcaaagcttcaccaacaagtaccgaagaagagcaggtaatgctgcgcaacgatcaggacaccctcatggctaggtggactggccggaactccagaagcagtctgcaggttgactggcacgaggaggagtgggagaaggtttggctcaacgtcgacaaatccttggaatgcatcatccaaagggtcgataaactactgcagaaggagcgtttacatggagaagggtgcgaggacgtgttcccgtgcgcgggttcctgtacaagcaagaaagggaatcctgattctcacgcatactggatcaggccggaagacccattttgcgacgtgccgtcctccccctgtccttccacgatgccatccacagcgtgtcatccacacctgaccactcattgttcccctccacctgaagagtcaagtcccggcgagtggagcgaagccctctaccccctgttgaccactcttaccgactgcgtcgccatgatgtctgataaggccaagaaggctatggtgtttctgctgatgcaggatagcgctcctaccatcgcaacatacctctcattgcagtaccggcgcgacgtggttttttgtcagacactgacggccctcatttgcgggttcatcattaagctgcgaaactgcctgcatgatgatggattcctgcggcagctctacacaataggcttgctggcgcagttcgaatctttattgtccacctacggagaggagctggccatgcttgaagacatgtccctgggtatcatggatctgcgcaatgtcactttcaaagttacacaggcgaccagttccgcgtccgccgacatgctgcccgtaatcacaggaaatagggacggcttcaatgtaagggtcccgctgccaggaccgttattcgacgcactgccaagggaaatccaaagcgggatgctcttgcgcgtccaacccgtattatttaacgtcggcatcaacgagcaacaaacgctggccgagcgatttggcgacacgtctctgcaggaagtcattaatgtagaatcactggtgcgtctcaattcctacttcgagcagttcaaagaggtgttgcctgaggactgccttcctagatccaggtcacaaacttgtcttcccgagctgctacgttttctgggccagaatgtccatgctaggaagaacaagaacgttgatattctatggcaggcagccgaaatctgccgccggctgaacggcgtgagatttaccagctgcaaatctgcaaaagaccgtaccgcaatgagcgtcactctcgaacaatgtctaatcctccaacacgagcacggaatggctcctcaggtgttcactcaggcactcgagtgcatgcgcagcgaaggttgtcgtcgcgagaatactatgaaaaatgtgggaagcaggaaatacgcctttaattcacttcagcttaaggccttcccgaagcactacaggccacccgagggaacatacggaaaagtggaaacgtag

SEQ ID NO: 191431 - DNA, 2817 bp, Artificial Sequence
  Description of Artificial Sequence: Synthetic coding sequence
atgaccgcccgggagcacagcccccggcacggcgcccgggcccgggccatgcagagagcttctaccatcgatgtcgctgccgatatgcttggcctgtcacttgccgggaatatccaagaccccgacgagccaatactggagttctctctggcttgtagtgaactgcacacgccctcccttgataggaagcccaacagctttgtggctgtgtcagtgaccactcccccacaggctttttggacaaagcatgcccagacagagatcattgagggaaccaacaatcccatttttctgagtagtattgcattttttcaggactcactgatcaaccagatgacccaggtgaagctgtcagtctatgacgttaaggacaggtctcaaggaaccatgtatctgctcgggtcggggacatttatagtgaaggacctgttgcaagatagacaccaccggctccatctgaccttacgtagcgccgagagcgaccgagtaggcaacatcactgtcataggatggcagatggaagaaaaatcagatcaacgcccaccagtaaccagaagcgttgacactgtcaatgggcgtatggtgctgcccgtggatgaatccttaaccgaagcactggggataaggagtaaatacgccagcttgaggaaggacacactgttgaagtctgtattcggtggggcaatctgccggatgtaccgtttcccaaccactgacggaaaccacctgcggattctcgaacaaatggcagaatcggttctcagcctccacgttcccaggcagtttgtcaagttgctcctggaagaggacgccgcaagagtttgcgagctggaagagctgggggaactgtccccttgctgggagtcactgagacggcagatcgttacacaataccaaactatcatcctgacctatcaagagaatctcaccgatttacatcaatacagaggccccagttttaaagcaagtagcctgaaggccgataaaaagctcgaattcgttcccaccaacctgcacatccagagaatgcgtgttcaggatgatggaggatctgaccaaaattacgacattgtgactatcggcgcccccgcagcacattgccagggcttcaagagcggcggactcagaaaaaagctgcataagttcgaagagacgaaaaagcatttcgaggagtgttgtacatcttccggatgtcagagcattatttatatcccccaggacgtggttcgcgccaaggagatcatcgcccagataaacactttgaaaacacaggtttcttactatgctgaacggctgtcacgagccgcaaaggatagatcagcaaccggtctcgagcgcacgctcgcgatactggccgacaaaaccagacagttggtcaccgtttgtgactgcaagctcttagccaattccatacacggcctcaacgcagcacgaccggattacatcgcctccaaagcctctcccacatccaccgaagaagaacaggtgatgctgaggaacgaccaggataccctgatggcgaggtggactggccgcaactcccgctcatcactgcaggtggactggcacgaggaggagtgggagaaagtctggcttaatgtcgacaagtctttagaatgcattatacagagagtggacaagcttcttcaaaaagagagattacacggggaggggtgtgaagacgtgttcccctgcgctggatcttgcacttccaaaaaagactgttctccacctcccgaggagagcagccccggtgagtggtccgaggccctctatcccctcctgaccacattaaccgactgcgtcgccatgatgtccgataaggcgaagaaagccatggtcttcctgctgatgcaggactccgccccaacgatcgctacctatttatctttacagtaccggcgcgacgttgtgttttgccagacactcaccgccttaatttgcggtttcattatcaagctgaggaattgcctgcacgacgacggatttcttagacagctgtataccatcggattgttagcacagttcgagtctctgttatccacttatggagaggagctggctatgctggaggatatgagcctgggaattatggacctgcgcaatgtaactttcaaagtaacccaggccacctcctctgcgagcgcggacatgctccccgtcatcactggaaaccgagacggctttaatgttcgggtgccgcttcccggcccactattcgatgctctgccaagagagatacagtccgggatgctgctgcgggtccaaccagtgttgtttaatgtgggcataaatgaacagcaaaccctggcagagcgcttcggggacacaagcctgcaggaggtgattaatgtggaaagccttgtcagactgaacagctacttcgagcagttcaaagaggtgctgcctgaggattgtctccctagatccagaagtcagacttgcctgcccgagctgttgaggtttttggggcaaaatgtccacgcaagaaaaaacaagaacgtggacatattgtggcaggctgccgaaatctgtagacgtctgaatggtgtgcgcttcacctcctgcaagtccgccaaagatcgcacggccatgagcgtcaccttggagcaatgtctgatacttcagcacgaacatggaatggctcctcaggtgttcacccaagcgctcgagtgcatgaggtcagaaggctgtcgccgagaaaacacaatgaaaaatgttggctcgcggaagtatgcctttaactcgctccaactcaaggcttttcccaaacattacaggcctcctgaaggcacgtacgggaaggtggaaacgtag

SEQ ID NO: 191432 - DNA, 2865 bp, Artificial Sequence
  Description of Artificial Sequence: Synthetic coding sequence
atgaccgcccgggagcacagcccccggcacggcgcccgggcccgggctatgcagcgtgccagcacaattgacgtcgccgccgacatgctcgggttgagcctggccgggaacatccaagacccagacgaaccaatcctagaatttagccttgcctgttccgagctccacactccctcccttgatcgaaaacccaactcttttgttgcagtatcagttacgactccgccccaggctttttggacgaagcacgcacagactgaaattattgagggcacaaacaaccctatcttcctaagctctattgccttcttccaagattcgctcattaatcaaatgacacaggtcaaacttagcgtgtatgacgtgaaagacaggtcccaaggcacaatgtacctgctcggtagtggcacattcatcgtgaaggatttgctgcaagacagacatcatcggctacacctgacattgagaagcgccgagtcggacagggtggggaatatcaccgtgatcggctggcagatggaagaaaaatccgaccagcgcccaccagtcaccaggtctgtggacactgttaacggcagaatggtactgcctgtggatgaaagtctgactgaagcactgggcatccggtctaagtatgctagcctgcgcaaagataccctccttaagtcagtctttggtggcgcaatatgccgcatgtaccgcttccctaccaccgacggaaatcatttaagaattctcgaacagatggctgaatccgttctgtcactgcatgttcctcgacagtttgtgaagttgctgctggaggaggacgctgctagggtatgcgagctggaggaattaggggagctgtccccatgttgggaatccttacgtagacaaatagtaactcagtatcaaactataatcctgacataccaggaaaacctgacggatctccaccagtacaggggacctagctttaaggcctcgtccctgaaggccgataaaaaacttgagttcgtaccgactaacctacacatccagaggatgcgcgtgcaagatgacggggggtctgatcagaactatgatatcgtgaccataggcgcccctgcagcccactgtcagggtttcaagagcggaggactcaggaagaagctgcacaaatttgaggaaacaaaaaagcactttgaagagtgctgcacatcctccgggtgccagagtatcatatacataccccaggatgtggtgcgagccaaagagatcattgcccagatcaacacacttaagactcaggtgagctattacgcagagcgcctgtcacgagccgctaaagaccgatccgcaactggtctggagaggacgctggctatcttggctgacaagacgcgccagctcgtgaccgtgtgtgactgtaaattgctggctaacagtatccatggcttaaacgctgcaagacccgactatattgcttccaaagcttcaccgacaagcactgaggaggaacaggtcatgctaagaaacgatcaggacacactaatggccaggtggactggcaggaacagccgctcatcactccaagtcgattggcacgaagaggagtgggagaaggtctggctgaatgtggataagagtcttgaatgtattatccagagagtggataagcttctgcagaaggagcgcctccacggagaaggttgcgaggacgtgttcccatgcgcgggaagctgcacatctaagaaagactgcagtcctccacccgaggagtcctctcccggagagtggtccgaggcactgtatcctctgctgacaactctgaccgattgtgtagccatgatgagcgacaaagctaagaaagctatggtattcctgctcatgcaggactcggctcccaccatcgctacctacttatcccttcagtatcgacgggacgtcgtattttgccaaaccctgacagctctcatatgtggctttatcataaagctgcgcaactgcttacatgacgacgggtttctcagacagctctacaccatcggtctgctggcacaatttgagtctctcctctctacctatggcgaggaactcgcgatgctcgaagacatgtccctaggcattatggacctacgtaatgtgacctttaaggtgactcaggccactagctctgccagcgcggacatgctccccgtgataacaggaaatagagacggatttaacgtgcgagtaccccttcccggtccactctttgacgctttacctcgagagatacagtccggtatgttactccgggtgcagcctgtcctgtttaatgttgggattaacgagcagcaaaccctggccgaaaggtttggcgacacaagtcttcaggaagttattaacgttgagagtctcgtgcgcctcaatagctacttcgagcaatttaaagaggtgctccccgaggattgtttgccacgctccaggtcacagacctgcttgcccgagctgttgagattcttgggccaaaacgtccacgcgcggaaaaacaagaatgtggacattctgtggcaggcagccgagatttgccgccgtctcaatggggttaggttcacaagttgtaagtcagcaaaggaccgcactgcgatgtctgtgaccctcgaacaatgtcttattttgcagcatgagcacgggatggccccccaggtttttactcaggctttggagtgcatgcgatcaatcggtaccagggaggtggttacgcagaagaatttgtcaggactggtgcctattcgtgacctgcgactggatcctagcctgctctgtagcatccctctcctagccctcagccctaacttgctgatcgtctggctcttcctgtccatagcttacttggtcactaaactgcgctgtaagtag

SEQ ID NO: 191433 - DNA, 2919 bp, Artificial Sequence
  Description of Artificial Sequence: Synthetic coding sequence
atgaccgcccgggagcacagcccccggcacggcgcccgggcccgggccatgcagcgagcaagcacaatcgacgtggctgccgacatgttgggcctttctcttgcaggtaacattcaggaccctgacgaaccaattctcgaattctccctagcctgctcagagttgcacaccccgagtttagataggaaacctaactctttcgtcgccgtcagcgttacaactcctcctcaggcgttctggaccaaacacgcacaaacggagatcatcgagggaaccaacaatccgatctttctatcatcaatcgcattcttccaggactcactgatcaaccagatgactcaagtgaagctgagcgtgtacgacgtcaaggatcggagtcagggcaccatgtacctgttaggctcagggactttcatcgtgaaggacctgctgcaggaccggcatcacagactccatttgactctgaggagcgcagaatcagaccgtgttggtaacataactgtgattgggtggcaaatggaagagaaatcagaccagcggccacccgtcactcgctccgttgacactgtgaatggtcgtatggtgctgccagtcgacgaaagtctgaccgaggctctgggtattaggtcaaagtacgcaagtctgcgcaaggataccctgctcaagagcgtcttcggaggagcaatttgccgcatgtaccgctttccaacaaccgatggcaatcacctgcgtatcctcgagcagatggctgagagcgtgctctctctgcacgtgcctcggcagttcgttaaactgctgctggaggaggacgcggctcgtgtctgcgaactcgaggagctcggagaattatctccctgctgggaaagtctccggagacagatcgtgacgcaatatcaaacgattattctgacataccaggaaaatctgactgatctccatcaatatcgcggaccctcctttaaagcgagctccttgaaggcggataagaagctggagtttgttcctacaaacttgcacattcagaggatgagggtgcaagatgatggcggctcggatcaaaattacgatattgtcacaatcggcgcgccggcagcccactgtcagggtttcaaatcgggagggctaaggaaaaagttgcacaaatttgaggaaactaaaaagcatacctcctccggttgtcagagcattatatatatcccccaggacgttgtcagggccaaggaaattattgctcagataaataccttaaagacccaagtcagctactacgccgagaggttgagtagggccgccaaggataggagcgccactgggctagaaagaacgttggccatcttagcagacaagaccaggcaacttgtaaccgtgtgtgactgcaagctgctcgcgaacagcatccatggcttgaacgctgccagacctgattacatagcttcaaaggcctcccccacatcaactgaggaggaacaagtgatgctgcgaaacgatcaagacaccctgatggccagatggacagggagaaatagccgctcttcactccaagtggactggcatgaggaagagtgggagaaggtatggttgaacgtggataaatctttagaatgtatcattcaacgtgtcgataagctgctccaaaaggaaaggctccatggggaaggctgcgaagacgtgttcccatgcgccgggagttgcacaagcaagaaaggcaatcccgactctcatgcttactggatacgccctgaggaccccttctgcgacgtcccaagttccccttgcccgtccacgatgccttcaacagcttgccacccccacctgaccacgcactgctcaccgcctcctgaagagtcctcaccaggggaatggagcgaggccctgtaccccctcctgacaaccctgactgactgtgtggcaatgatgtctgataaagcaaagaaggccatggtgtttttgctgatgcaggatagtgcccctaccattgccacatacctctccctgcagtacaggagggacgtcgtgttctgccagaccctgacggctttaatctgcggctttattattaaactcagaaattgcctgcacgacgacggcttcctgcgccagttgtacaccattggacttctggcccagtttgaaagtcttctctcgacatatggtgaggaactggccatgttggaggacatgagcttagggatcatggatttgcgtaatgtgacgttcaaggttacccaagcaacttcgtcggccagtgcagacatgctgcccgtgattactggtaaccgggatgggtttaacgtgcgggtgcccctgccaggaccactctttgacgcccttcccagagagatccaatcaggaatgctattacgcgtgcagcctgtcttgttcaatgtgggcattaacgaacagcaaacattagccgagcgattcggcgacacttccctccaggaggttattaacgtagaaagcttagtgcgattgaacagctacttcgaacagttcaaagaggtacttccagaggactgtctccccaggtctcggagccagacatgtcttcctgagctccttagattcctgggtcagaacgtgcatgctcggaagaataagaatgtagatattctgtggcaggcagccgaaatatgtcgtcgcctcaacggagtgcgcttcacatcatgcaagtcagccaaagaccggacagccatgagcgtgaccttggaacagtgtcttattctgcagcatgagcatggtatggcccctcaggtctttacccaggcgctagaatgtatgcgctcggaagggtgtcggcgcgaaaataccatgaagaacgtgggctctcgcaaatacgcatttaattcactgcaacttaaagcctttcccaagcattatcgaccgcctgagggaacctacggcaaagttgagacgtag

SEQ ID NO: 191434 - DNA, 2934 bp, Artificial Sequence
  Description of Artificial Sequence: Synthetic coding sequence
atgaccgcccgggagcacagcccccggcacggcgcccgggcccgggcaatgcagagagcctccacgattgacgtcgcagccgatatgctcggtttgtccctcgccggcaatatccaggatcctgacgaacctattcttgagttctcgctcgcctgctcggagcttcatacaccaagcctcgaccgcaagcccaattctttcgtcgctgtgagcgtcacaacaccacctcaggctttctggaccaaacatgcacagaccgagatcattgaggggaccaacaatcctatctttttgtcgtccatagccttctttcaggacagtctgataaatcaaatgacccaggtcaaactcagcgtgtacgacgtgaaagaccgtagccaaggaaccatgtacctcttgggatcaggaacctttatcgtcaaggacctcctccaagacagacaccaccgactgcacctgacactcaggtctgcagaaagtgacagggtcgggaacattacagtgatcggctggcagatggaagaaaaatccgatcagcggcctcccgtcactaggtcagtggataccgtcaatggtcgcatggtgctccccgtcgacgagtcccttacggaggcattaggcataagatccaagtatgcctcactcagaaaggacaccctgctgaagagcgtattcggcggtgcaatctgcagaatgtataggtttcccacgactgatggcaatcacctgcgaatcctggaacagatggctgagtcggttctctctctccatgtgcccaggcagttcgttaagttgcttctggaggaggatgccgctcgtgtgtgtgagctggaggagctgggcgaactgagcccctgttgggagtcacttcgcaggcaaatcgttactcagtatcagacaatcatcctgacttatcaggagaatctaacagaccttcaccagtatcgaggaccatctttcaaggccagttcactcaaagccgacaagaagctcgaatttgtcccaacaaatcttcatatacagcgcatgcgcgtgcaggatgacggggggtccgaccagaactacgacattgtgaccataggcgctcctgctgcccactgtcagggcttcaagagtggagggttgcggaaaaagctgcataagtttgaggaaacaaagaaacactttgaagagtgttgcacctcttccggctgccaaagcatcatttacattccccaggacgtcgtgcgcgcgaaagaaatcatagctcagattaacacactgaaaacccaggtgtcttactatgcagaacggctgtctagagctgcaaaggatagatctgcaactggcttggaaagaacccttgccattttggcagataagactagacagctggtgaccgtgtgcgattgcaaactgctcgccaattccatccacgggctgaatgcagcacgacctgattacatcgctagtaaagcctctccgacatcaacagaggaagagcaagtgatgctccggaatgatcaggacactttgatggctcggtggacaggacgaaattcgagaagcagcctgcaagtggattggcacgaagaagagtgggaaaaggtttggttaaatgtggacaaatcattagaatgcattattcagcgcgtcgataagcttttgcagaaggagagattgcacggggagggatgcgaggacgtgttcccctgtgctgggtcctgtacgagtaagaagggcaaccctgactcccacgcgtactggattagacctgaggatccattctgtgacgtgccttcttccccatgtcccagcactatgccatcaactgcatgccatcctcacctgaccacccattgctccccccccccggaggaatcatcccctggcgaatggtcagaggcgctatatcccttgctgaccactctgacagactgtgtcgccatgatgtcggacaaggcgaaaaaagccatggtttttctgctgatgcaggacagcgctcctaccatcgcaacatatctaagcctccagtatcggcgtgacgttgtgttctgtcagactctaaccgccctcatttgcggttttatcattaagctccggaattgcctgcacgatgacgggttcctgaggcagctctacaccatcggcttgctggcccagttcgaaagcttattgtctacttatggggaggaactggccatgctggaagatatgtctctaggaataatggatctccgtaatgttacattcaaggtcacccaggccactagcagtgcgtctgcagacatgcttcccgtaataacaggtaacagagatgggttcaacgtacgggttccactacctggcccattgtttgacgcgttgcccagggagatccaatctggcatgctgctgcgggtgcaacccgtactgttcaatgtggggattaacgaacaacagacactggctgagagattcggcgatacatctctgcaggaagtcataaacgtcgaatcgctggtgagactcaatagctactttgaacagttcaaggaagtgctccctgaggactgtctgcctcgcagtcggtcgcagacgtgcttaccagagctgctgaggttcttaggccagaatgtgcacgctcggaaaaacaaaaacgtggacatattatggcaggctgccgaaatctgtaggaggctgaatggcgtgcgattcaccagttgtaagtctgcgaaggatcggacagccatgagcgtgaccctcgaacagtgcttaatcttgcaacacgagcacgggatggctcctcaggtgtttactcaggcactcgaatgcatgcggtccgaagggtgccgaagagaaaacactatgaaaaatgttggaagcaggaagtatgcgttcaacagtctccagctgaaagccttccccaaacactacagaccacccgaaggcacatatggtaaggtggagacctag

SEQ ID NO: 191435 - DNA, 2817 bp, Artificial Sequence
  Description of Artificial Sequence: Synthetic coding sequence
atgaccgcccgggagcacagcccccggcacggcgcccgggcccgggccatgcagcgcgcatctaccatcgacgtggcagccgacatgcttggactatcattggcaggcaatattcaggaccctgatgagcctatcttggagttctccttggcatgttccgagcttcacacgcctagcctcgatcgcaagccaaatagctttgtcgcagtgtcggtgacaacaccgccccaagcattttggacaaaacacgcccagacagagatcatagaggggaccaacaacccaatattcctaagttccattgcgttttttcaggattcgctgatcaaccaaatgacgcaggtgaagctgtctgtgtacgacgtgaaagatcgcagccaagggactatgtacctgctaggctccggcacgttcattgttaaagacctgttgcaagatcggcaccatagactacaccttactctgcgctccgccgagtcagatcgggtgggcaacattaccgttatcggatggcaaatggaggaaaagagcgaccagcggcctccagtgacaaggtctgtcgataccgttaacgggagaatggtattacccgttgatgaatcattgacagaggctctcgggattcggagcaaatacgcttccctgcggaaagatacccttctcaaaagcgtctttgggggagccatctgtcgtatgtacaggttccccactacagatgggaatcatctccgcatcctcgagcaaatggctgaaagcgtcctgtctctccacgtcccccgccagtttgtcaagctgctgctggaggaggatgctgcccgtgtgtgcgaactggaggagttgggggagctttccccatgttgggaatcgctcaggaggcagatcgttactcaataccaaacaatcatactcacttatcaggaaaacctgaccgatctgcaccagtacagaggaccgagttttaaggcgtcttccttgaaagctgataaaaaactggaattcgttcccacaaatctgcacattcaaaggatgagagtgcaggatgatgggggatcggatcagaactatgatattgttactatcggcgctcccgcggcccattgtcagggctttaagagcggagggctgagaaagaagcttcacaagttcgaggagaccaaaaagcagcaagaggagagccgtaccagcagtggatgtcagtccatcatttatatacctcaggacgttgtgcgggcaaaggagataatcgcccaaatcaatacattgaagacgcaggtgtcctactacgctgagaggctctctcgtgctgccaaagatcgatcagccaccggattagagagaacccttgcaattctggcagataaaacgaggcagttggtaactgtgtgtgactgcaagctccttgctaattcaatccatggactcaacgcggctaggcccgattatatagcctctaaggcatcacctacgtctacagaagaggagcaggtcatgctcaggaacgaccaggatacactgatggctagatggacagggaggaatagtcggagctccctgcaagttgattggcatgaggaggagtgggagaaggtgtggctgaacgtggacaaaagccttgagtgtattatacagcgagtggataagctgctgcagaaagagcggctgcatggcgagggttgtgaagatgttttcccatgcgcaggttcttgtacgagtaaaaaggattgcagtcctccacctgaggaaagttctcccggagagtggagcgaagccctttatccattactcacaaccctgactgattgtgtagctatgatgagcgataaagccaagaaggcaatggtgttcctcctaatgcaggacagcgcgcccacaattgctacctatctgtctctgcagtacaggagagacgtggtcttctgtcagacactcactgcgctcatttgcggcttcataattaaactcaggaattgtctccatgatgacggctttctgcggcaactctacaccattgggctgctggctcagtttgagtcgctgttgtcaacatacggcgaggaactagcgatgctggaagacatgtccctgggtataatggacctccgaaacgtgacattcaaagtcacacaggcaacctcctctgcgtcagccgatatgttgccggttattaccgggaatagagacggtttcaatgtcagagtgcctctgccaggacctctgtttgatgctctgcctcgagaaattcaatcggggatgttactgagagtccagcccgtgctgttcaatgtgggaataaacgagcaacagacactcgccgagcggtttggagacacctccctgcaagaggtaatcaatgtggagtccctagtacgcctgaattcttactttgaacagtttaaggaagtgttgcccgaggattgtctgccaagaagccggtcccagacttgtctccctgagcttctacggtttctcggccagaatgttcatgcccggaaaaacaagaatgttgatatcctgtggcaggccgccgaaatttgcaggagacttaatggcgtcaggtttacatcctgtaaatccgccaaggacaggacggcaatgtctgtgacacttgagcagtgcctgatcctacagcacgagcacggcatggctccacaagtgttcacacaagccctggaatgtatgcgcagcgagggttgccggagggaaaataccatgaagaacgttggctctcgcaagtacgcctttaatagtctacaactgaaggccttcccgaagcactatcgtccccctgagggcacttatggcaaagttgaaacatag

SEQ ID NO: 191436 - DNA, 3021 bp, Artificial Sequence
  Description of Artificial Sequence: Synthetic coding sequence
atggagggccagagcagccggggcagccggcggcccggcacccgggccggtctcggctctttgcccatgccgcaaggtgttgcccagactggtgcgccgtcaaaagtggatagctctttccagctgccggccaaaaagaatgctgcactgggtcccagcgagcctcggttagcattagccccagtgggccctagagccgccatgagcgctagtagcgagggtccacgcttggctttagcatcacctcgaccaatcctggccccgttgtgtaccccggaagggcagaagacagctacagctcaccgaagttcttctctggcccctacgagcgtagggcagctggtgatgtccgcctcggctgggcctaagccccctcccgccaccactgggagtgttcttgcacctacctcactcggcctggtgatgcctgccagcgcagggccccggtctccacctgttactctgggacctaacctcgcccccacgtcaagggatcagaagcaggaaccgccagcctccgtgggtcccaagcccacattggctgcgtccggtctgagcctggccttagcctcagaagaacaaccaccagaattgcctagcactccatccccggttccatcccccgtgctgtcccccacacaggaacaagctttggctccagcctccaccgccagcggggccgcaagtgtgggccaaacgtctgcacgtaagcgtgatgctccggccccgaggccactgcctgcctcagagggtcacctccagccacccgcgcagacttcaggacccaccggttcacctccgtgtattcaaacctctcccgacccgcggttatccccttcatttagggctcgcccagaggccctgcatagcagtccagaggatcccgtgctgccacggcctccccagaccctcccacttgacgtgggccagggcccctccgagccaggaacccactctcccggcctgctgtccccaaccttccggcccggcgccccttctggacagaccgtcccccccccactacctaagccccctagatcaccctcgcgcagtccatctcactctcccaatcggtccccctgtgtgccccccgcccccgacatggccctaccccgtttggggacacaaagtacaggccctggaagatgtttgagccctaatctacaggcacaggaggcaccagcacccgtgaccacttccagctccacgagcacgctgtcttcgagcccttggagtgctcagccgacctggaagtccgatccaggatttcggattacagttgtcacatggaacgttggtacagcaatgcctcccgatgatgtgacaagcctcttacatcttgggggaggcgacgacagtgacggcgccgatatgatcgcaatcggactgcaggaggtgaattcaatgctcaataagcggttgaaggacgcactctttaccgatcagtggtcggagctgtttatggacgctttaggccccttcaactttgtgcttgttagctccgtgaggatgcagggggtcattctgcttctttttgctaagtactatcatcttcccttcctgcgagacgtccaaacggactgcactcgaacaggattgggaggttattggggcaacaagggaggcgtttcagtgagattggcagcttttgggcatatgctctgctttctcaactgtcaccttcctgcacatatggacaaggccgagcaacgcaaagataactttcagaccatccttagtttacaacagttccaaggcccaggggctcagggcattctcgatcatgacctggttttctggttcggcgatctgaacttccgcatcgagtcctatgatttacatttcgtaaagtttgccatagactcggaccagcttcatcaactgtgggaaaaagaccagttgaatatggctaagaatacttggcctatcttaaaaggatttcaggagggtcctttgaactttgcaccaacatttaagtttgatgtggggacgaataaatacgacacgtcagcaaagaaacgcaagccagcctggaccgacagaatcttgtggaaagttaaagccccaggcggcggaccgtcgccatcagggcgaaagtcccatcgcctgcaggtgacgcaacattcttacaggagccatatggagtacaccgtatcggatcacaaacccgtagccgctcaattcctgctgcagtttgcatttcgtgatgacatgcctttggtaaggctggaggttgccgatgaatgggtgcggccggaacaggcagttgtgagataccgtatggaaactgtgtttgcacggtcctcttgggactggatcggactctacagggtggggtttcgccactgtaaagactacgtggcctacgtctgggccaagcatgaggacgtggatggaaatacatatcaggtaacattctccgaggaatcccttcctaaagggcatggggactttatcctcgggtattacagtcacaatcatagtatccttatcgggatcacggagccttttcagatcagtctgccctcttccgagctggcttcctcttcaacggatagtagcggcacctccagcgaaggggaggacgattcaacactggagcttctggcccccaaaagccgtagcccaagccccggcaagtctaaacgccatcgcagtcggtccccaggtctcgcacgctttcctggattggccctgagaccatccagtagagagaggcgaggagcaagccgctctccatcccctcagtcaaggcgactttcacgggtcgcccctgatcgaagcagtaatggttcatcgaggggatcgtcagaagagggcccgagcggcctgccaggcccctgggctttcccacccgcggtcccgagatctctcgggctcttaccggctctcagacttgagaccgtggacccaggaggaggcggcagctggggccccgacagggaagcactggctccaaattcgctatctcctagtcctcaaggacaccgcggtctggaggaaggtgggctcgggccatag

SEQ ID NO: 191437 - DNA, 1920 bp, Artificial Sequence
  Description of Artificial Sequence: Synthetic coding sequence
atggccctgccccggctgggcacccagagcaccggccccggccggtgtctgtcaccgaatctgcaggcccaggaagcacccgctccagtcaccacgtcttccagtactagcaccctgtcaagcagcccgtggtcagcgcagcctacttggaagtctgaccccggatttcgcattacagtggtaacgtggaatgtgggcaccgctatgcctcctgacgatgtaaccagcctgttgcatctgggggggggagatgattctgatggggctgacatgattgccataggactccaagaggtgaacagcatgctgaataaacgcctcaaggacgcgctgtttaccgaccagtggtcggagctcttcatggacgcacttggcccattcaactttgtgctagtaagcagcgtgaggatgcagggggttattttgctgctattcgccaagtactaccatctgccgttcttgagagatgtgcagactgactgtacacggacaggattgggggggtattggggaaacaaaggaggggtgtctgtgcggctggcagcattcgggcatatgttatgtttcctcaattgtcacctgcccgcccacatggacaaggcagagcagcgtaaagacaacttccagaccatcttgagcctccaacagtttcagggcccgggggcccagggtatactcgatcacgacttggtgttctggtttggtgatctcaattttaggatcgagagctacgacttacattttgtcaaatttgctattgatagcgaccagctccatcagctgtgggaaaaagaccagctgaacatggccaaaaatacatggcctatccttaaaggattccaagagggacccctgaacttcgcccctactttcaaattcgacgtcgggacgaataaatatgatacttccgcaaagaagaggaagcccgcctggaccgacaggattctttggaaggtgaaagcacccggcggggggccaagcccctccggtcggaagtcccacaggctccaagttactcagcactcctacagatcccacatggagtataccgtttctgaccataagccggttgcagcccaatttctcctgcagttcgcctttcgcgacgacatgcccctggtccgactagaggtcgccgatgagtgggttcgcccagagcaggccgtggtgagatacagaatggaaactgtgttcgcccgaagttcatgggactggatcgggctgtatagggttggcttcagacactgcaaggactacgtagcttatgtttgggcgaaacacgaagacgtggacgggaatacataccaggtcacctttagcgaagagtcattgcctaaaggccatggagattttattctgggctactatagccataaccactctatcctcattgggattaccgagccgtttcaaatctccctacctagcagtgagctggcaagttcatccactgatagctctgggacttctagcgagggtgaagatgactctaccctggagctgcttgcgcccaagagccgttccccttcgccaggcaaaagtaaacgccaccgctcccggtctcctggtttagctaggtttcccggactggccctgcgacctagcagtagagagcgccggggcgcatcccgctcaccatcaccccaaagccgacgcctgtcccgtgtagccccggatcggtccagcaatgggtcctcccgtggatcctctgaggaggggccttccgggctccctggcccctgggccttcccccccgctgtacctagatccttgggcctgctccccgcgttacgcttagaaaccgtggaccccggcggaggcggttcttggggacccgaccgtgaggctctggccccaaacagcttgtctcctagcccacaaggacatagaggcctcgaggagggaggcctaggcccatag

SEQ ID NO: 191438 - DNA, 1917 bp, Artificial Sequence
  Description of Artificial Sequence: Synthetic coding sequence
atggagggccagagcagccggggcagccggcggcccggcacccgggctggcttgggaagcctgcccatgccacagggcgttgcacagactggtgctccgagcaaagttgatagttcatttcagttaccggccaagaagaatgccgccctgggtccttcggagccccgaatcaccgttgttacctggaatgtggggacagccatgccacccgatgacgtgactagtctcctgcacttgggcggaggcgatgactcagatggggcagacatgatcgctataggattgcaggaggtcaattctatgctcaacaagaggctcaaagatgccctgttcaccgatcagtggtccgaactgtttatggatgccctgggcccttttaactttgtactcgtgagttcagtgagaatgcagggcgtgattctgctcttgtttgcgaagtactatcatctcccgtttttgcgagacgttcaaactgactgcactcggaccggcctcggaggatattgggggaacaaggggggggtgtccgtgcgtttggcggcttttggccatatgctctgtttcctcaactgccatctccctgcacacatggataaggctgaacagcggaaagataactttcagaccatcttatcactgcagcagtttcagggccctggcgctcagggcatcctcgaccacgatctcgtgttctggttcggtgatttaaactttcggattgaaagctacgatttgcattttgtcaaattcgcaatcgattccgaccaactacatcagctgtgggagaaggatcagctcaatatggcaaaaaacacttggcctatccttaagggattccaggaaggaccactgaattttgccccaacttttaagttcgacgtaggcacaaataagtatgacactagcgcgaagaaacggaagcccgcgtggacggaccgcattctgtggaaggtgaaggccccgggtgggggtcccagcccaagtggaaggaaaagccatcgactgcaggtcactcagcactcataccgatcacacatggagtataccgtgtctgaccacaaacctgtggcagcgcaattccttctgcagttcgctttccgcgatgatatgcccttagtgagattggaggttgcagatgaatgggtcagacctgagcaggctgtagtgcgctataggatggaaacagtcttcgcaagaagctcctgggattggatcggcctatatagagtcggcttcaggcactgtaaggactatgtggcttacgtttgggccaaacacgaagatgtagatggaaatacctaccaggtcaccttttccgaggagtcccttcctaagggccacggagattttatattaggctattacagccacaatcactccatcctaatagggatcactgagcccttccaaatcagcctgccctcgtccgagttagctagcagctccacagattcttctggcacctccagtgaaggagaggatgactccacactagagctcctagctcctaagagcaggagtccaagccccggcaagtcgaaaagacacagatctaggtcccccgggcttgcccggttcccgggccttgccctccgcccatcttctagggaacgccgcggcgcaagccgttcaccctcccctcagtctagacgactttccagggtggcaccagaccgcagctcaaacggaagctcccggggcagctcagaggaaggccctagcggactgccagggccttgggccttccctcctgccgtcccacggtcactagggctcctgcctgcccttcggcttgagactgtggaccctgggggaggtgggagctggggacccgaccgcgaggcgctagcccctaactcactctctccttcccctcagggccaccgtggtctggaagaagggggcctgggtccctag

SEQ ID NO: 191439 - DNA, 1920 bp, Artificial Sequence
  Description of Artificial Sequence: Synthetic coding sequence
atggccctgccccggctgggcacccagagcaccggccccggccggtgtctgagccccaatttgcaggcccaggaagctccagctcccgtgactacctctagctcaactagcactctgagttcatcgccgtggtccgcccagcccacttggaaatccgacccaggtttcagaatcacggtggtgacttggaatgtaggcaccgccatgcctccagacgatgtgactagcctgctgcacctcggaggcggcgatgatagcgacggcgccgatatgatcgccatcgggctacaggaagtgaacagcatgctcaacaaaaggctgaaggacgcccttttcactgatcagtggtcagagctgttcatggatgcacttgggccttttaattttgtgctagtgtccagtgtgaggatgcagggggtcatcctgctcctgttcgcaaaatattaccacctgcccttccttcgcgacgtgcagaccgactgcacaaggactgggctgggcggctactggggtaataagggcggcgtgtccgtccgactggccgcttttggccacatgctctgttttctgaactgtcacctccctgctcacatggacaaagcagaacaacggaaggataatttccagacaatcctctccctgcagcagtttcagggtccaggggctcagggcatactggatcatgacctggttttttggttcggggatttgaattttcgtatagaaagctatgacctccactttgtgaagtttgcgatcgatagcgaccagctgcaccagctttgggagaaggatcaattgaacatggccaagaatacctggcctatactgaaaggattccaggaggggcccctgaactttgcccctacattcaagttcgacgtgggaactaataaatacgacaccagtgctaagaaacggaaacccgcatggacagatcgaatcttgtggaaagtcaaagcccctggggggggcccatcgccaagtggccggaagtcacacagactgcaagtgactcaacacagctataggtcccatatggaatacacagtgtcagaccataagcctgtggctgcacagttcttgctgcagttcgcattcagggatgacatgcccctggttaggctggaagttgcggatgagtgggtgagacccgaacaggctgttgtccgttaccggatggagaccgtatttgctcgaagctcctgggattggatcggcctctacagggtgggctttcgtcactgtaaggattacgtggcctatgtgtgggcaaagcacgaagacgttgatggtaatacctatcaggttaccttttcagaagagtctctgcccaagggccatggagatttcattctaggatattactcacataatcacagtatcctgattggcatcaccgagccgtttcagatttctcttccaagcagcgaattagctagctcttctacagactcttcggggacgtcctccgagggcgaggacgactccaccttagagctactggcgcctaagagcaggtctccatcccccggaaagagcaagaggcaccgaagccgatcccccggactggcccggttccccggtcttgctcttcgcccatcttcgagagagagaaggggtgcaagtaggagcccgagcccgcagtctcggcggctgtctcgggtagcacctgatcgaagctcaaatggaagctcacgggggtcttctgaggaaggcccctctggcctgcccggaccatgggcgtttcctcccgcggtgccccggtctctagggctccttccagctcttcgcctggagacagttgacccaggcggtggagggtcctgggggccagaccgggaagccctggctccgaactccctgagtccatctcctcagggccatcgaggtctggaggaaggtgggctgggcccttag

SEQ ID NO: 191440 - DNA, 2820 bp, Artificial Sequence
  Description of Artificial Sequence: Synthetic coding sequence
atgagcgccagcagcgagggcccccggctggccctggccagccccaggcccatcctcgccccactttgcaccccagaaggccagaagactgccactgcacatcgcagtagctctctagctcccacttccgtagggcagctggtgatgagcgcatcagccggccctaaacccccaccagctactactggctctgtgctggcacctaccagtctgggattagtgatgcccgccagcgctggcccgcggtctccaccggtgacccttggcccgaacctggcaccaacatctagagaccagaagcaggaaccacctgccagtgtgggccccaagcctaccctggcggcatccgggttgtctttggcactggcttccgaagaacagccacctgaacttcctagcacaccctcccccgtgcccagccccgtcctgagccctacgcaggagcaggctctggcccctgccagtacggccagcggggcagcaagcgtggggcaaacaagtgcgagaaagcgagacgcaccggcccctaggccactccctgcttcagaaggacacctccaacctccggcacaaacatctggccccacaggatctcccccttgcatccagacttctcccgacccacggctgtccccatcctttagggcaagacccgaggcactgcattcaagcccggaggatcccgtgctgccacggccaccacagactttgccattagacgtcgggcaaggcccctcggagcccggcacgcactctccaggactgctttcacccacgttccgcccaggcgccccaagcggtcagacagtgcctccccccttaccaaagccacctaggtcaccctcgcgatcaccaagtcattcaccaaataggtcaccctgcgtaccacctgctccagatatggcccttcctaggctggggacccaatcaacgggcccaggccggtgcctgtccccgaacctccaggcccaggaagctcctgctccggtcacaaccagttcttcaacctccactttaagtagctccccctggtcagcccaaccaacctggaaaagcgaccccgggttccggataactgtcgtaacctggaacgtaggaaccgcaatgcctccggacgacgtcacctccctgctccatctaggcggcggggacgactctgacggggcggatatgatcgccattggtctgcaggaggtcaatagcatgctgaacaaacgcctcaaggacgcactgttcacagatcagtggtccgagctgttcatggacgccctcggtccattcaatttcgtgttagtttcctcagtgcgcatgcaaggagtgatattgttattattcgcgaagtattaccacctaccctttttgcgagacgtgcaaactgattgcacacggacaggcctaggaggatactggggaaataaaggcggagtgtctgtgcggctggccgcattcggacatatgctgtgcttcttaaactgtcatttgccagcccacatggataaggccgagcagcgtaaagacaacttccaaaccattctaagcctccaacagttccagggtcctggggcccagggcatcctggaccatgatcttgtattctggtttggcgatctcaactttaggatcgaaagctatgaccttcacttcgttaaatttgctatagattccgaccagctgcatcaattgtgggagaaggatcagctgaatatggcaaaaaatacctggcccatcctaaaggggttccaagagggtcccttgaatttcgccccaacattcaaatttgatgtcggcacaaacaaatacgatacgtccgccaaaaagcggaagcccgcttggactgatagaatcttatggaaggttaaggcccccggtggcggcccatcgccttccggtcgcaagtctcatcggctccaggtcacccaacacagctaccgctctcacatggaatacacggtctcagaccacaagcccgtggccgcacagttccttctgcagttcgccttcagggacgacatgcccttggtgcggctagaggtggctgatgaatgggtgcgacctgagcaggcggtggtgcgatacagaatggaaactgtattcgctcggagcagctgggattggattggactgtatagagtcggattccggcattgcaaagattatgtcgcttacgtgtgggctaagcacgaggacgtagacggcaacacgtaccaggtcacgttctcggaggaatccctgcccaagggccacggcgattttatcttgggctactacagccacaaccacagtatcctgatcggaattacagaacctttccaaatcagtctgccatcaagtgagctggcttcgtctagtacggactctagtggcaccagctccgaaggcgaagatgactccacacttgaactgctggcgcctaagtccagatctccatcgccgggtaagtccaagaggcacagaagcagaagtcctggactggctcgcttccctggacttgccctacggccatccagccgtgagcgcaggggcgcgtcccgaagtccttcgccacagagtaggcgcctctctcgagtggctccagacagatcatcaaatggcagttcccgggggtcatccgaggaggggcccagtggtttgcctggaccctgggcgttccccccagctgtccctcgatcgctaggcctactcccggctcttcggttggagacagtcgatccaggaggcgggggctcttggggtccagatcgcgaagctctggccccaaatagtctgagcccctcacctcagggccatcggggcttagaagagggggggctgggaccctag

SEQ ID NO: 191441 - DNA, 3534 bp, Artificial Sequence
  Description of Artificial Sequence: Synthetic coding sequence
atggtgccctgctggaaccacggcaacatcacccggagcaaggccgaagagcttcttagtaggactggcaaagacgggagttttttagtgagggcctccgagagcatttcacgcgcatatgctctgtgcgtcctgtaccgcaattgcgtgtatacttaccgaatccttcccaacgaagatgacaagttcaccgtccaggccagcgagggggtgtctatgcgctttttcaccaagctcgaccagctgatagaattctacaaaaaggagaacatggggcttgtcactcatcttcagtatcccgtccccctcgaggaggaagacacaggggacgaccctgaagaggacaccgtcgagtctgtggtgagccctccggagctcccccctagaaacataccactgacagcatcctcgtgcgaggcgaaagaggtgcctttctcaaatgaaaaccctagggcaactgaaactagtcgcccaagtctcagcgaaaccctttttcagcgcctgcaaagcatggataccagcggcctgcctgaagaacacctcaaagctattcaggactatctgtcaactcagttggcgcaggatagtgagtttgtcaagacgggcagttcatctcttccccatctgaaaaaactaactacccttctctgtaaagagttgtacggccagatgctgcgaacggtgcccggaattgggaaagtgaaggaggaggaccacgtgcctggagaggccaacccaataaacatggtgtctaagttgtcccagttgacaagcttactgtcctcaatcgaagacaaggtaaaggcacttctgcatgaaggcccagaaagcccgcacaggccatcccttattccccctgtgacgtttgaagtgaaagctgagtcgctgggtatccctcaaaaaatgcaactgaaagttgacgtcgaatcaggaaaactgataattaaaaaaagcaaggacgggtcagaagacaagttttactcccacaaaaaaatcctgcagcttattaaaagccaaaaattcttgaacaagttagttattctggttgaaactgaaaaagaaaaaattctgagaaaggaatacgtattcgctgatagcaaaaagagagaaggtttctgtcagctcctccagcagatgaagaataagcactcggagcagccagagcccgatatgataacaatcttcatcgggacttggaatatgggcaacgcccctccacctaaaaagatcacgtcctggttcttgagcaagggacagggaaagactcgggacgattcggcggactacatcccacacgatatttacgtgattggaactcaggaagaccctctgagcgagaaagaatggttagagatcctcaagcattcgctgcaggagataacctctgtaacctttaagactgttgcaatccatacactgtggaacattcggatcgtggtcctagcaaagcctgaacatgaaaacaggatctcccacatatgtacagacaacgttaaaactggtattgcaaataccctgggaaacaagggagccgtgggcgtgtcattcatgttcaacgggacaagcctcggatttgtaaactctcacctgacttcaggttcagagaagaagttgcgacgtaatcagaactacatgaatatactcaggttcctcgcccttggcgataaaaaactctccccgtttaatattacacacaggttcacacatctgttctggttcggggacctgaactacagggtcgatctcccaacatgggaggcggagactatcattcagaagatcaagcaacagcaatatgctgacctgttaagtcacgatcagcttctcacagaacggcgagagcagaaggtctttctccacttcgaagaagaagaaatcacctttgcccccacatatcgatttgagaggctgactcgggataagtacgcatacactaagcagaaggccaccggtatgaaatataatctacctagttggtgtgaccgcgtcctatggaagtcttacccccttgtccatgtcgtatgtcagagttacgggtcgacctccgacataatgacgagcgaccatagccctgttttcgcaacattcgaggctggagtgacttcccagtttgtttccaagaacggccccggaaccgtagattcacagggacagatagagtttctccggtgttacgctaccctgaaaacgaagagccagacaaagttttacctggagtttcactcttcttgcctggaaagctttgtaaagtcgcaagaaggggagaatgaggaagggagcgagggagaactggtcgtgaagttcggcgagactcttcccaaactgaagcccattatcagcgaccctgaatatcttttggaccaacatattctgatctccatcaaaagcagcgacagtgatgagtcttacggcgagggatgtatagcccttaggctggaggccaccgagacccaactgcctatatacactcctttgacccatcacggggaactgactgggcactttcaaggagagattaagttacagactagtcaagggaaaacccgggagaagctgtacgactttgtcaagacagagagggatgaatcgagcggccccaagacactgaaatcgctgacgtctcatgacccaatgaagcaatgggaagtcaccagtcgcgcccctccgtgctctggttcctctataacagaaataattaatcctaattacatgggcgtcggccccttcggccctcctatgcctctgcatgtcaaacagacactgtctccggaccagcagcccacagcttggtcatatgatcagcctcccaaggactcacccctgggcccatgtagaggggagtccccacccacaccaccaggccagccccccatctcccccaagaagtttttaccctccacagctaataggggcctcccaccgcgcacgcaagagtctaggcctagcgacctgggcaaaaatgccggtgatactctgcctcaggaagacctgcccctcacaaagcccgaaatgtttgaaaaccccctgtacggcagtctttcaagttttccaaaacctgctccaagaaaagaccaggagagtcctaagatgccccggaaagagccacccccgtgtcctgagcccggaatcttgtccccgagcatcgtgctgacaaaagcacaggaagccgaccggggcgaagggccggggaaacaggttcccgcacctcgcctgcggagcttcacctgctcctcctccgcagagggcagggctgccggcggcgacaagagtcagggtaagcctaagacccctgttagctcccaggcccccgttccagccaagcgcccaattaaaccgtctcgctccgaaatcaaccagcagacacctcctacgccaacccccagaccccccttgccagtgaagtctcctgcagtgttacatctacagcatagcaaaggccgagactaccgcgataatacagaattgccccaccacggcaagcacagacctgaagagggtcctcccggacctctcgggagaacagcaatgcaatag

SEQ ID NO: 191442 - DNA, 2433 bp, Artificial Sequence
  Description of Artificial Sequence: Synthetic coding sequence
aagcgggagggcttctgccagctgctgcagcagatgaagaacaagcactccgaacagccagagcccgatatgataacaattttcatcgggacctggaacatgggtaatgcccccccccctaagaaaattacaagctggtttctatcaaagggtcagggcaagacccgagatgacagcgcagactacatccctcatgatatttatgttatcggcactcaagaagatccactgtcagaaaaagagtggctggaaatactcaaacacagtctccaggaaattacgtctgtgacctttaagacggtcgccattcacacactgtggaacatcagaatcgtcgtgctggccaaacccgagcacgaaaatagaatcagccatatttgtactgacaatgtaaaaactggcatcgccaacaccctgggaaataagggtgccgtgggcgttagctttatgtttaatggaacttctttggggttcgtgaactcacatctgacgtccggatccgaaaagaagctccgtcggaaccaaaactatatgaatatcctgcggtttctcgcactgggcgataagaagctctctcccttcaatattactcaccggttcacccaccttttctggtttggggatctcaactatagggtggacctgcccacatgggaagccgagaccattattcagaagatcaagcagcagcagtacgccgatctgctgagtcacgaccagctgttaacagagcggcgcgagcaaaaagtgttcctgcatttcgaggaggaagagattactttcgcccctacctatcgcttcgaacggctgacaagagacaagtatgcgtatacaaagcaaaaagcgactggaatgaaatacaatcttcccagttggtgtgatagggtgttgtggaagtcctatccgctggtgcacgtcgtctgtcaatcttatggctccacatccgatattatgacatccgatcatagtcctgtttttgccacctttgaggccggggtgacatcacagtttgtgtcaaaaaatgggcctggaacagtggatagtcagggtcagattgaattcctgaggtgttacgccacactgaaaaccaaatcacagactaagttctatctagagtttcactccagctgtctggaaagtttcgtcaagagccaggagggcgagaacgaggagggcagcgaaggcgagctggttgtgaaattcggggagaccctccccaaactaaagcctattatatctgaccctgagtacctactggaccagcatatccttatctctatcaaatctagcgactccgacgagagttacggcgagggctgtatcgcactgagacttgaggccaccgagactcagcttcccatttacaccccattaacccatcatggcgagctgaccggccacttccagggggagataaagctacagaccagtcaggggaagactcgcgaaaagctgtatgatttcgtaaagacagagcgcgacgagtcttccggccccaagacattgaaaagcctcacttcacacgaccctatgaagcagtgggaggttacgtctcgcgctcctccctgttccgggagctcaattacggaaatcattaatccgaactacatgggagtggggcctttcgggccgcccatgcccctgcacgtgaagcagactttaagccccgatcaacagcccacagcttggagttacgatcaacctccgaaggacagtcctctgggtccgtgtcgcggcgagagcccgcccacccctccaggtcaaccccctattagcccaaagaagtttctgccaagcacagccaaccgtggcctgccaccccgaacacaggagtcacggccttcagacctggggaaaaatgccggcgacaccttgcctcaggaagacctccccctgactaagcccgagatgttcgagaaccccttatacggaagtctgagctccttccccaagccagccccgcggaaagaccaggaatctcccaaaatgccaaggaaggaacccccgccatgtcctgagcctggaattttaagtccatctattgtcttgaccaaagcgcaggaagcggacaggggggagggccccggaaagcaggtgcccgccccgcggctgcgatccttcacctgttccagttctgccgagggaagggctgcggggggcgacaagtcccagggtaagccaaagacacctgtgtccagccaggcccccgttcccgccaagcgtccaatcaagccctccagaagtgaaattaatcagcagacccctcctacaccaaccccaaggccgcctctgcccgtcaagtccccagctgtgcttcacttacagcactctaaagggagagactacagagataatacagagctgccacaccatggaaaacaccgaccagaggaaggtccgcccggaccactgggtagaacagcaatgcagtag

SEQ ID NO: 191443 - DNA, 666 bp, Artificial Sequence
  Description of Artificial Sequence: Synthetic coding sequence
atggtgccctgctggaaccacggcaacatcacccggagcaaggccgaagagctcctctcacgcaccggcaaggacgggtcctttcttgtgcgggcttcggagagcatttcacgcgcatatgccctgtgcgtactctatcggaattgcgtgtacacgtaccggattcttccaaacgaggacgataaattcaccgtgcaagcttccgagggagtctcaatgcgttttttcacaaagctggaccagcttatagagttttacaaaaaagaaaacatgggactggtgacccatcttcagtatccagtgcctctggaggaggaggatacaggcgacgacccagaagaagataccgaaagtgtggtgtcacccccggaactcccaccccgcaacatccccctaacagcgagttcttgtgaagcgaaggaggtccctttttcaaatgagaacccccgcgcaaccgaaactagccgccctagtctttccgagaccttatttcagcgactgcagagcatggataccagcggtctacccgaggagcacctgaaagccatacaagattacctatcgacccagctggcccaggacagcgagttcgtgaagaccggcagcagctctctacctcaccttaagaagctgacgacattactctgtaaggagctgtatggctag

SEQ ID NO: 191444 - DNA, 2433 bp, Artificial Sequence
  Description of Artificial Sequence: Synthetic coding sequence
aagcgggagggcttctgccagctgctgcagcagatgaagaacaagcactctgaacagcccgagcctgatatgattacaatattcattgggacctggaatatgggcaatgccccacctcctaaaaaaatcacgtcatggttcctatctaaagggcaggggaaaaccagagacgattcagcagactatattccccatgacatctatgtcatcggtacacaggaggatcccctctctgagaaggagtggcttgagatcctgaaacactccctccaggaaattacctccgttacattcaagaccgtggcgattcatacactctggaatattcgaatcgtggtccttgccaagcccgaacatgagaatagaatttcccacatctgtaccgacaacgtgaaaacaggaatcgctaatacactgggcaataaaggtgcagtcggcgttagctttatgttcaacggaacgagtctgggtttcgtgaactcacatctaacatcagggtctgagaaaaagttgagaaggaaccaaaattatatgaacatacttcggtttctagcgcttggggataaaaagctcagtccctttaacatcacacacagatttacccacctcttttggttcggtgaccttaattacagagtcgaccttccgacgtgggaagcagagaccattatccagaagatcaagcagcagcagtacgctgatctcctcagccacgaccagctgctcactgaacggcgtgaacagaaagtgttcttacatttcgaggaagaggaaataacatttgcacccacgtaccgattcgagagattaacacgggacaaatatgcttacaccaaacagaaggcaactggaatgaaatacaatttaccgagctggtgcgatcgtgtgctttggaagtcataccccctcgtgcatgtcgtttgccagagctatgggagcacctcagacattatgacttccgatcacagccccgtgttcgcaaccttcgaggccggggtgactagtcagttcgtgtccaaaaacggacccggcacggtcgactcccagggacaaatagagttcttacgctgttacgctaccctgaagactaaatcccagaccaagttctatctcgagtttcacagcagttgtctcgagagcttcgttaagagccaggagggggaaaatgaggagggatccgagggcgagttagtggtcaagtttggcgagacattgcctaaattgaagcctatcattagtgaccctgagtaccttctggaccagcacatcctgatatcaatcaaatccagcgatagcgatgaaagctatggtgagggttgcattgcattgagactggaggcaaccgagacacagctgcctatttatactcccctgacccatcacggcgaactgacaggccacttccaaggtgagataaaactgcagacctcacagggtaagactagggaaaaactctacgatttcgttaagactgaacgcgatgaatcgtcggggccaaagacgttgaagtcccttactagccatgaccctatgaagcagtgggaggtgaccagtagggcacccccttgcagcggctcctccatcactgagatcataaatccaaactacatgggcgtcgggccattcgggcctccaatgcccctccacgtgaagcagaccctgagtcctgatcagcaacccactgcgtggtcatacgatcagcccccaaaagatagtccactcggtccttgcagaggcgagtcccctccaacccctcctggacagccccctataagtcctaagaagttcctcccctccaccgcaaacagaggacttcctcctaggacccaggaaagcaggccatcagacctcggtaagaacgctggagacacactcccccaggaggatctgcccttaactaagcctgagatgtttgagaatccactgtacggtagtttatcttctttccccaagcctgctcctagaaaagaccaggaatccccaaagatgcctcgtaaagaacctcccccttgtcccgagcctggaatactgtcaccatccattgtccttacgaaagcgcaggaagctgaccgcggcgaggggcctggtaagcaggtcccggccccccgactaagatcatttacctgctcttcttccgcagaggggcgggcggccgggggagacaagagtcaaggcaaacccaagacacccgtgtcttctcaagcaccagtgcccgctaagcgtcctattaagccctcccgctcagagataaatcagcagactcctccgactcccacacctcgaccaccactgcctgtgaagagcccggccgtcctgcatctacagcatagcaagggaagggattatagagacaataccgaactcccccaccacggcaagcacaggccagaagagggcccccccggaccccttggccgaactgctatgcaatag

SEQ ID NO: 191445 - DNA, 2433 bp, Artificial Sequence
  Description of Artificial Sequence: Synthetic coding sequence
aagcgggagggcttctgccagctgctgcagcagatgaagaacaagcattcggagcagcctgaaccagacatgattacaattttcatcggcacgtggaacatgggaaatgcccccccccccaaaaagataacttcttggttcctgtctaaaggacagggaaagaccagagatgacagcgccgactacatccctcatgatatctatgtcattggcactcaggaggatccacttagtgaaaaggaatggcttgagatcctcaaacattcacttcaagagatcacctcagtcaccttcaaaacagtggccattcacaccttatggaacatacggattgtggtattagctaagccggagcatgagaatagaattagtcatatctgcactgataacgtgaaaacaggcattgcaaataccttggggaataaaggtgctgtgggcgtttccttcatgtttaacggtacatctctcggttttgtgaattctcacctcacatctggatccgagaaaaaacttcgcaggaatcagaactacatgaacattttgcggttcctcgctctgggagataagaagctttccccattcaacatcactcatagattcacccatctgttctggtttggggatctgaactacagagtcgatctgcccacatgggaggccgagacgattattcagaagattaagcagcagcaatatgcagatctgctgagccacgatcagcttctcaccgagaggcgggagcagaaggtgttcttgcactttgaggaagaagaaatcacttttgctccgacttaccgcttcgaacggttgaccagggataagtacgcttatacaaagcagaaggccactggcatgaaatataatctccccagctggtgcgaccgagtgctctggaagagctacccacttgtccacgttgtctgccagtcttatggaagtacaagtgacattatgactagtgatcactccccagtgttcgcaactttcgaagccggagtcacgagccaatttgtaagcaagaatgggcctggtacggtagatagtcagggtcagatcgaatttctgcgttgctatgcaactctgaaaacaaagagtcagactaaattctatctggagttccattcgtcatgcctagaaagctttgtaaagagccaagaaggcgaaaacgaggagggctccgaaggggagttggtggtcaaatttggagagaccctgcctaaattaaagcccattatctccgacccagagtacctcctggaccagcacattcttatctctatcaaaagcagtgactctgacgaatcctacggtgaaggatgtattgcactgaggctggaagcaaccgagactcagctccctatctacaccccactgactcaccacggggaacttacagggcacttccagggcgagatcaagctgcagaccagccagggaaagactcgggaaaagctctatgacttcgtgaagacggaaagagacgagtcaagtggccccaagaccctgaagtcacttacctctcacgatccaatgaagcagtgggaggttactagtcgcgcacccccctgtagcggttcctcaatcactgagatcataaaccccaattacatgggtgtcggccccttcggccctcccatgcccttacacgtcaaacagactctctcccccgaccagcaacctacagcctggtcttatgatcaaccgccgaaagattctcccctcggtccatgccggggcgagtcccctcccaccccccccggccagccacctatatcccctaaaaagtttctcccgtccactgcaaacagggggctgccacctcgcacccaggagtctcgcccatccgacctaggaaagaatgctggtgacactctgccccaggaggacctccctctgaccaagcccgaaatgttcgagaaccccttgtacggctccttgtccagcttcccgaaaccggcaccccgaaaagatcaggaatcacccaagatgccaagaaaggaacccccgccctgtcccgaaccaggtattttgtccccatccattgtgctgacaaaagctcaagaggccgatcggggggagggtcccggtaaacaggtgccagccccccgacttagatcttttacttgtagttccagtgcggaaggacgcgccgccggcggggacaagtcccaaggaaaaccgaaaactcccgtgagctcacaagctccggtgcctgctaaaaggcctatcaagccttctcgctccgagatcaaccagcagacccccccgacacctactccgcgccctcctctcccagtgaagagtccagccgttctccatttgcagcactctaaaggccgcgattaccgggataataccgaactgccacatcacggaaagcaccgacccgaagaaggcccaccagggcccctggggaggaccgccatgcagtag

SEQ ID NO: 191446 - DNA, 2826 bp, Artificial Sequence
  Description of Artificial Sequence: Synthetic coding sequence
cggccccaggtgcccggcgaggccaaccccatcaacatggtgagcaagctgagccagctaacctcactgctaagttcaatcgaagacaaggttaaagcgctgttgcatgagggacccgagtccccccaccgcccttcccttataccacctgtcactttcgaggtcaaggccgagagccttggaatcccccagaaaatgcaattgaaggtggatgtggagagcggtaaactgatcattaaaaagtcgaaagatgggtccgaagacaaattctattctcataagaaaatcctgcagttaattaagagtcagaagtttctgaacaagcttgtgatcctggttgagaccgagaaggagaagatcttgaggaaggaatacgtatttgccgatagtaagaagcgcgaggggttttgtcaactattgcagcagatgaaaaacaaacattccgaacagccagagccagatatgattaccatctttatcgggacttggaacatggggaacgcacctccacccaaaaagatcactagctggtttctgtctaaggggcagggcaagactcgcgatgactccgcggattatattcctcacgacatctacgtgataggaactcaggaggaccctctttctgaaaaggaatggcttgagatcctcaagcatagcctgcaggagattacctcagtaactttcaagaccgtggcgattcacacactgtggaatatccgtattgtggtgcttgctaagccagaacacgaaaatcgcatcagccacatctgtacagataacgtgaagaccggaattgccaacaccctgggtaataaaggcgccgtcggagtgtccttcatgtttaatgggaccagcttagggttcgtgaatagccatctcacatccgggtcagaaaagaaactgagaaggaatcagaattacatgaatatattacgcttcctcgcactgggggacaaaaagctttcccccttcaacatcactcatcgcttcacccatctcttttggttcggggaccttaactatcgagtggatctccctacttgggaggctgaaactataattcaaaaaatcaagcagcaacaatatgcagacctattatcccacgatcaactgctgacagagcgcagagaacagaaggtattcctgcactttgaggaagaggaaataactttcgcgcccacctatcggtttgagaggctaaccagggacaagtatgcctatactaagcagaaggctaccgggatgaaatataatctgccatcctggtgtgatcgtgtactctggaagagttaccccctggtacatgtggtgtgccagagttacggatctacctcagacattatgacctctgatcattccccggtttttgcaaccttcgaggccggggtcacatctcagttcgtgtccaaaaacggccctggcactgttgacagtcaggggcagatcgagttcctccgatgctatgcaacactaaagactaagtcgcaaaccaaattctacctggaattccattctagctgtttagaatcatttgtgaaaagccaggagggagagaacgaggagggatcagaaggagaactggtggtgaagttcggcgaaactttgcccaagctgaagcccattatcagcgatccggagtacttgcttgatcagcacatcctcatctctatcaaaagcagcgactctgatgaatcttacggagagggctgcattgccttgcgtctggaggccaccgagacccagctgcccatttatactcccctgacccatcacggagaacttaccgggcactttcagggcgagattaagctgcagaccagccagggcaagacacgagaaaagctctatgactttgtgaagaccgagagggacgaatctagcgggcccaagacattgaaatcactgacatcgcatgatcctatgaagcagtgggaagtaacaagcagggctcccccatgtagcggcagctctatcacagaaattattaatccaaactatatgggggtaggtccttttggccctccaatgccactccacgtcaagcaaactctgagtcctgaccagcagcccaccgcctggagctacgatcagccacccaaggacagccccctgggcccatgcagaggcgagtctcccccaaccccacctggccagccacccatttccccaaaaaagttcctcccaagtactgccaatagggggcttcctcccagaacccaggagagccggcccagcgacctgggcaagaacgctggcgataccctgccacaggaggacttgcctctgacaaagcctgagatgttcgaaaatccgttgtacgggtcactctcttcattccctaagccggcgcctagaaaggatcaagagagccccaagatgccgagaaaagagcccccaccttgccctgagcccgggatcctgtccccgtcgattgtcttgacaaaagcccaggaggccgacagaggggaagggcccggtaagcaggtgcccgcacccaggttaaggagcttcacttgttcaagtagcgcggaaggccgcgccgccggaggggacaagtcccagggaaagcccaaaacacccgtgagctctcaggcaccagtgcccgccaaacggcccataaaaccctcacgctccgaaattaatcagcagacaccgcctacacctactcctcgcccacccctcccagtgaaatcacccgccgtgttgcacctgcagcactccaagggaagagactatagagacaataccgaattgccccaccacggaaagcaccgccccgaagaaggaccaccaggccccttgggccggactgctatgcagtag

SEQ ID NO: 191447 - DNA, 669 bp, Artificial Sequence
  Description of Artificial Sequence: Synthetic coding sequence
atggtgccctgctggaaccacggcaacatcacccggagcaaggccgaggagctattgtctcgcacagggaaagatggctcctttttagtaagagcctccgagtctatcagccgtgcgtatgccttatgcgtactatacagaaattgcgtatatacttatcggatacttcctaacgaagacgataagttcacggtacaggcctcagagggggtgtctatgcgcttttttaccaagctggaccaactgatcgagttttataagaaggagaatatggggctggtcactcacctgcagtacccggttccactggaagaggaggatacgggcgacgaccccgaagaagacacagtcgaatctgtggtttctccacccgaactgccaccgcgaaatatccccttaacagcatctagttgtgaggccaaagaagtgccattttctaacgaaaacccgcgcgccaccgaaacatctagaccttctctctcagaaacgcttttccagcgtttacagagtatggacacttctgggctaccggaggaacatctgaaagctatccaagactacctatctacccaactcgcccaggattctgagtttgtaaagaccggatcctcatcattgcctcacctcaaaaaactgaccaccctgctttgtaaggaactgtatggatag

SEQ ID NO: 191448 - DNA, 2826 bp, Artificial Sequence
  Description of Artificial Sequence: Synthetic coding sequence
cccccccaggtgcccggcgaggccaaccccatcaacatggtgagcaagctgtcccaactgacaagtcttttaagctcaatcgaagataaagtgaaagctcttctccacgaggggcccgaatcaccacatcgaccatccctgatcccccctgtgacttttgaagtgaaggctgagtcgctgggcatcccgcagaagatgcagttaaaggttgatgtggagtcaggtaagttgatcatcaaaaagagcaaagacgggtccgaggacaagttttactcccacaagaagattctgcagctaattaaatcccagaagttcctgaataaactagtcatcctcgtcgagactgagaaagaaaaaatcctcagaaaagaatatgtgttcgcagacagtaagaaacgggaaggattttgccagctgctccagcaaatgaagaacaagcactccgagcaaccagaaccagatatgattaccatctttattggcacctggaatatgggcaacgcccctcctccgaagaagatcactagttggtttttgtccaaaggccagggcaagactcgcgacgacagcgccgattacattcctcatgatatatatgtgatcgggacacaggaagaccccctaagcgaaaaggagtggctggagattcttaaacacagtctgcaggagattactagcgtgacatttaaaacagttgctattcacaccctgtggaacatcaggatcgtcgtcttagcaaagccagagcacgaaaaccgtataagccatatttgtactgacaacgtgaaaacaggaatagccaatacattgggcaacaagggagccgtcggggtgtcattcatgttcaacggcacgtctctcggttttgttaatagccacttgacctcgggatctgagaaaaagctgcgcagaaatcagaattacatgaacatactgaggtttctcgcacttggtgacaagaagctttcccctttcaacattacacatagattcacacatctcttctggttcggcgacctcaattatagggtggacctgccgacgtgggaggcagagactattatccaaaagatcaaacaacaacagtatgcagatctgcttagtcacgatcagctactaactgaacggagggagcagaaggtttttctccactttgaagaggaggaaattacatttgccccaacatatcggtttgagcgtctgacgcgggacaagtatgcttacaccaaacagaaggccaccggtatgaagtacaacctcccgtcatggtgtgatcgcgtgctctggaaatcttatcctcttgtgcacgtggtctgtcaaagttacggatcaacaagcgacatcatgacatcagaccacagtcctgtgttcgccacgtttgaagcgggggttacatcgcaatttgtatctaagaatgggcccggtaccgtagattcacagggacagattgaattcttaagatgctacgccacccttaagacaaaatctcagacaaaattttacctggagttccacagttcttgcctggagtccttcgtgaagagtcaagagggtgagaatgaagaaggctccgaaggggagctggtcgtcaagtttggcgagacgcttcctaagcttaagcctattatctcagatcctgagtatctgctggatcagcacatcttaatttcgatcaaaagtagcgactcggacgaatcttatggcgaaggatgcattgccctgagactcgaggctaccgagactcagttacctatctacacgcctctgactcatcacggtgagctgacagggcacttccagggagaaattaaattgcagacatcacagggcaagaccagagaaaagttatacgattttgtcaaaacagagagagatgagtcaagtggccctaagacactgaagtctctaacatcacacgaccctatgaaacagtgggaagtaacatccagggctcccccctgctcaggttcaagcattaccgagatcatcaacccaaactacatgggcgtgggtccgttcgggccacccatgccgctacatgtgaagcagacgttgagtcccgaccagcagccgacagcttggagttacgaccaacctcccaaagacagccctctgggcccctgccggggcgaatcccctcccacaccccccgggcagccaccgatctcacccaagaaatttctgccaagtacagctaataggggtctgcccccaagaactcaagagagcaggcccagtgatttaggcaagaatgctggagacacactgccccaagaagacctaccattgacaaaaccagagatgtttgaaaaccccctgtatggctccttatccagctttcccaaacccgcacccaggaaggaccaagaatcccctaagatgccccggaaggaacccccaccgtgtccggaacccgggatcctctcaccttcaattgtgctcacaaaggctcaggaagccgaccgcggcgagggcccaggcaagcaagtacccgctcctagactgcggtctttcacatgtagctccagcgctgagggccgagctgctgggggggacaaatcacagggaaaacccaaaactcctgtttcgagtcaagcccccgtgccagccaagagacctataaaacctagtaggtctgagatcaatcaacaaacaccaccaacgcctaccccccggccacctctccctgtcaagtcccctgccgtgcttcacctgcagcattctaaaggtcgggactacagggataacaccgagctgccccaccacggaaaacatcgaccagaggagggcccccctggccccctggggcgaactgcaatgcagtag

SEQ ID NO: 191449 - DNA, 1791 bp, Artificial Sequence
  Description of Artificial Sequence: Synthetic coding sequence
atggtgccctgctggaaccacggcaacatcacccggagcaaggccgaagagctcttgagcaggacaggcaaagatggaagcttcctggtgagagcatccgagagtatttctagggcatacgccctgtgtgtgttatatcgaaactgcgtatacacataccgaatcctccccaacgaagacgataaattcactgtgcaggcttctgagggtgttagcatgaggttttttacaaagctggaccagctgatcgaattctacaaaaaagagaacatgggcctggtcacccatctacaatatccggtcccactggaggaggaagataccggagatgaccccgaggaggacactgtcgaaagcgtcgtgagcccgccagagctcccgcctcggaacattcctctcacagcgagctcctgcgaagccaaagaggtgccgttctccaatgaaaacccgcgtgcaactgagacgtctcgccccagcctgagcgagacactattccaacgtctgcagtctatggacacatcaggcttacctgaagagcatttaaaagcgatccaggattacctctcaacccaactagcccaagatagtgagtttgtcaaaacgggcagttcttcattgccacaccttaaaaaactcaccactcttctctgcaaggaactctacggctactgcctggaagtgctgcttagctacccgctgtctctgttatcccaagtgcctggtgaggctaacccgattaacatggtatccaagttgtcacaactcacatccttgctgagcagcatagaggacaaagtcaaagctctcctgcacgagggaccagagtcgccacaccgtcctagtttgatccctccagtcaccttcgaggttaaagctgagagtttaggcatcccacaaaaaatgcagctgaaggtagatgtagaatcaggcaaactcatcataaagaaaagcaaggatggcagtgaagataaattctacagtcataaaaagatactgcagctgatcaaatctcagaagtttttaaataagctcgtgatcctggtggagaccgagaaggaaaagatacttagaaaagaatacgtttttgccgactcgaagaaaagggagggcttttgccaattgctgcagcaaatgaagaacaagcattcggagcagccagaacccgacatgatcacaatctttatcgggacttggaatatgggcaatgctcctcctcctaaaaagataacctcatggtttctcagcaagggtcaggggaagaccagagacgatagtgcagattatattcctcacgatatttatgtgataggaacccaagaggatcccttgagcgaaaaggagtggctggagattctgaaacatagtctgcaggagatcacatctgtaaccttcaaaaccgttgcaatccataccctgtggaatattcgcatcgttgttctcgctaaacccgagcacgagaatcgaatttcacatatctgtactgataacgtcaaaactgggattgccaacacgctgggtaacaaaggggcagtaggcgtgtcctttatgtttaatgggacctctctgggcttcgtcaactctcatctcacctcgggcagtgagaaaaagctgagaaggaaccagaactatatgaacattttgcgcttccttgccttgggggacaagaagctgagcccctttaatatcacccacaggtttacgcacctcttctggttcggggacctcaattaccgtgtagatcttccaacctgggaggccgagaccatcatccagaagataaagcagcaatag

SEQ ID NO: 191450 - DNA, 837 bp, Artificial Sequence
  Description of Artificial Sequence: Synthetic coding sequence
tgacagaagaactggctgcgggagttctaccaggtggtgcacacccataaacctcactttatggctctgcactgtcaggagttcggtggcaagaactacgaggcaagtatgagccacgtggataagtttgttaaggaactgttgtcatctgatgctatgaaggaatataatagggctcgagtgtacctggacgaaaactacaaaagtcaggaacacttcactgcactggggtctttttatttcctccatgagtcgctcaagaacatctatcagttcgatttcaaggcaaaaaaataccgaaaggtcgctggaaaggagatctactctgatactctcgagagtacccccatgctggaaaaggagaagttcccacaggattatttccccgaatgcaaatggagccgaaaaggcttcatcaggacacgctggtgtattgccgactgtgcttttgacctagtaaatattcatctcttccacgatgccagcaaccttgtggcgtgggaaacttccccgagcgtgtactctggtatccgccacaaggcgctcgggtatgtcctggataggatcatcgaccagcggttcgaaaaggtctcttattttgtgttcggggacttcaatttccgtcttgattcaaagtcagttgttgagctgctagagtttgataaggaactaagtgtgttcaaagaccggctgtacgagctcgacatctcttttccgccttcatacccgtacagtgaggacgctcgccaaggcgagcagtatatgaacactcggtgccccgcttggtgcgaccgcatcctcatgtccccatctgctaaggagctggttctgagatag

SEQ ID NO: 191451 - DNA, 1164 bp, Artificial Sequence
  Description of Artificial Sequence: Synthetic coding sequence
atggccggcaaggccgccgcccccggcaccgccgtgctgctggtgactgcgaatgtgggcagcctcttcgatgacccggagaaccttcagaaaaattggctacgagagttttatcaagtcgtgcatactcataagccacacttcatggcattgcattgccaggaattcgggggaaagaattacgaggcctctatgagtcatgtggataagttcgtgaaagaattactcagcagcgacgccatgaaggagtataaccgggccagggtgtatctcgacgagaactacaaatcccaggagcacttcacagcactcggctccttttattttttacatgaatctctcaagaacatctatcaatttgatttcaaagccaaaaaatatcggaaagtggctggcaaggaaatctatagcgacacactcgaaagtaccccaatgctggagaaggagaaatttccacaggactatttccctgaatgcaaatggagtagaaaaggtttcatcagaacccggtggtgtatcgctgactgcgcctttgatctggtcaatattcaccttttccacgatgcttctaatctggtcgcctgggagacctctcctagcgtttacagcgggatcagacacaaagccctcggatatgttctggatcggatcatcgaccagaggtttgagaaagtttcctactttgtttttggggacttcaacttccggcttgacagcaagtccgttgtagagaccttgtgcacgaaggcgacaatgcagacggtgcgggcagcggacacgaatgaggtggtcaagttgatattcagggaatcagacaacgatagaaaggtcatgctgcaactcgaaaagaaattgttcgattacttcaatcaggaagtgtttagggacaacaacggaaccgccctgcttgagttcgataaggaactgtccgttttcaaagacaggctctacgagttggatatatcatttccaccctcgtacccttactctgaggacgccaggcagggggaacagtacatgaatactcgctgtcccgcatggtgcgatcgtatcttaatgagtcccagtgctaaggagctggtcttgagggtctcagtgtgctgtccctcacccggccaccgcggcatgtggtcggcagggtccggactcgctcagccttggtag

SEQ ID NO: 191452 - DNA, 1239 bp, Artificial Sequence
  Description of Artificial Sequence: Synthetic coding sequence
atggccggcaaggccgccgcccccggcaccgccgtgctgctggtgacagccaacgtcggatccctcttcgatgatcccgaaaacctccaaaaaaattggttgagagagttttatcaagtggtgcacacccacaaacctcacttcatggctctccattgtcaagagttcgggggtaaaaactacgaagcaagcatgagccacgtcgataaattcgtgaaagagctgttaagctcagatgcaatgaaagagtataatcgggcgcgggtgtacctggacgagaactacaagtctcaggagcactttaccgcacttggaagcttctattttctccacgaaagtttaaaaaacatctatcagttcgacttcaaggcaaaaaagtaccgcaaggtggctggaaaggagatttattccgacacactcgagtctactcccatgctggaaaaggaaaaattcccccaggactactttcccgagtgtaaatggtctcggaaggggtttataagaacaagatggtgcatagccgattgcgcctttgatttagtcaatattcatttgtttcacgatgccagtaacttagtggcttgggaaacaagcccttccgtttattccgggattcggcacaaggcccttgggtacgttttggatcggataattgatcaaagatttgagaaggtgtcttattttgttttcggagattttaacttcaggctggatagtaagtcggtggtggagactctctgcacaaaggcgacaatgcaaaccgtcagagccgctgatactaacgaagtagtgaaactgatcttccgggaaagcgataatgacagaaaggtgatgctgcagttggaaaagaagctgttcgactactttaaccaggaagtattcagggacaacaacggcaccgctctgctggagttcgacaaggagttgagtgtgttcaaggatcgcttatacgagcttgatatctccttcccaccatcctacccttactccgaggacgcacggcagggcgagcagtacatgaataccaggtgtccagcctggtgcgatcgcatacttatgtccccttccgccaaggaactggtgctgagatctgaatccgaagagaaagtggttacctatgaccacatcgggcccaatgtgtgtatgggcgatcataagccagtttttctggctttcagaattatgccaggtgctggaaagcctcatgcccacgttcacaagtgctgcgtggtacaatag

SEQ ID NO: 191453 - DNA, 558 bp, Artificial Sequence
  Description of Artificial Sequence: Synthetic coding sequence
atggccggcaaggccgccgcccccggcaccgccgtgctgctggtgactgccaacgtaggatcacttttcgacgaccccgagaacctccaaaaaaattggcttagagaattctatcaggtggtccacactcataaacctcacttcatggcgctgcattgtcaagagttcggaggcaaaaactatgaagcttccatgtcccatgtcgataaattcgtgaaagagcttctatcctcggacgccatgaaagaatataacagagctcgagtttatctggacgaaaattataaaagccaggagcattttacagctctcgggtccttctatttcttacacgaatccctgaagaatatttaccagttcgacttcaaggctaaaaaatacagaaaggttgccggaaaagagatctacagcgacactctggagagtaccccaatgctcgagaaagagaagttcccccaggattactttccagaacgccacgttccacacacctccctggaagcgctcctcatccttcacgaggaccctcagcttcccgacccacacttaccactctag

SEQ ID NO: 191454 - DNA, 1068 bp, Artificial Sequence
  Description of Artificial Sequence: Synthetic coding sequence
atggccggcaaggccgccgcccccggcaccgccgtgctgctggtgactgcgaatgtcggtagcctgttcgacgaccccgagaatctacaaaaaaattggctgcgagaattctaccaggtagtccacactcacaagccccactttatggccctgcactgccaggaattcggtggtaagaactacgaagccagcatgagccatgttgataaattcgttaaagaattgctcagctctgatgctatgaaggaatacaacagagctcgagtgtatctggatgaaaattataagtcacaggagcactttacagctcttgggtccttttattttttgcacgaaagcttgaagaatatctaccagttcgatttcaaagcaaagaaataccggaaggttgccggcaaagagatttacagcgacaccctggagagcaccccaatgttggagaaggagaagttcccacaggattactttccagagtgtaaatggtctaggaaggggtttataaggacgagatggtgcattgccgattgcgcattcgacttggtaaacattcatctgtttcacgatgctagcaacctggtggcttgggagacttctcccagcgtttactcggggatccgacacaaggccctggggtatgtgcttgacagaatcatagaccaacgctttgagaaagtatcttacttcgtgtttggggacttcaatttccggctagacagcaaatctgtggtggagctcttggagttcgataaggagctgtccgtattcaaggacagactgtatgagctggatatctcatttccgccatcatacccctattctgaagatgcacgccaaggtgagcagtacatgaacacgaggtgcccggcatggtgtgatcgcatcttgatgagcccatccgcaaaggagctggttctcaggagtgaatctgaggagaaagtggtgacctatgatcacatcggacctaatgtatgcatgggagaccacaaaccagtttttcttgcatttcggatcatgcctggcgccggaaagccacacgcccacgtccacaagtgttgtgtggtgcaatag

SEQ ID NO: 191455 - DNA, 417 bp, Artificial Sequence
  Description of Artificial Sequence: Synthetic coding sequence
gtgaccgccaacgtgggcagcctgttcgacgaccccgagaacctgcaaaaaaactggcttagagagttctatcaggccttgggcagtttctactttttgcacgaaagcttaaagaatatctaccagtttgattttaaggccaagaagtaccgtaaggtggccgggaaggagatatactctgatacactcgagtcaacgccaatgctcgagaaggagaaattcccccaggactacttccccgagtgcaagtggtcacgcaaagggttcatccgaaccagatggtgtattgccgactgcgcgtttgacctggtcaacattcatctgttccacgacgcctctaaccttgttgcttgggagacctcgccctccgtgtatagtggaattcgccacaaggcactgggctatgtgctggactag

SEQ ID NO: 191456 - DNA, 990 bp, Artificial Sequence
  Description of Artificial Sequence: Synthetic coding sequence
atgaaggagtacaaccgggcccgggtgtacctggacgagaactacaaatctcaggaacactttaccgctttgggctccttttattttctgcacgagagtttgaaaaatatataccaatttgatttcaaagccaaaaagtacagaaaggtagcgggcaaagaaatttatagtgacactctggagagtacccctatgttagaaaaagaaaaatttccgcttctcccaagggtacagatggtcaagaaaaggttacaccccgacgaggtgatcgcggattgtgcctttgatctggtgaacattcacctcttccatgacgcgagcaatctcgtagcatgggaaacaagtccatccgtgtactccgggataagacacaaggcactcggttatgtgctggaccggatcattgatcagagattcgaaaaggtatcttactttgtctttggcgactttaacttccgcctcgacagtaaatccgtcgtagaaacgctttgcacaaaggctaccatgcagactgtcagggctgcagatacgaatgaggtagttaaactaatttttagagagtcggataacgatcgcaaggtcatgttacagctagaaaagaagctgtttgactatttcaatcaagaagtctttagggacaacaacggaaccgcccttctggagtttgacaaagagctgtccgtattcaaagaccgtctgtatgaactcgatattagcttcccaccctcctacccttatagcgaagacgcccgacagggagagcagtacatgaatacccggtgtcccgcgtggtgcgaccggattcttatgagtccgtccgctaaggaattggtgctgcgctctgagtcagaagaaaaggtagttacctatgaccacattggtcccaatgtgtgtatgggcgatcacaagcccgtctttctagcctttagaattatgccgggagccggcaaacctcacgcacacgtgcacaagtgttgtgtcgtccaatag

SEQ ID NO: 191457 - DNA, 315 bp, Artificial Sequence
  Description of Artificial Sequence: Synthetic coding sequence
ctggacatcagcttcccccccagctacccctacagcgaggacgcccgtcagggggaacagtatatgaatactcgttgcccggcttggtgcgatcgcatcctgatgtctccctcagcaaaagaactggtgctgcggtccgagagtgaggaaaaggtcgtgacatacgaccacattgggccaaatgtctgcatgggcgaccataagcctgtatttttagccttcagaatcatgccgggtgctggtaaacggtgccagcgccacgagaggaccctgagggagccgccatgctcaaggggccccaatactcattcttag

SEQ ID NO: 191458 - DNA, 546 bp, Artificial Sequence
  Description of Artificial Sequence: Synthetic coding sequence
gccgccgcccccggcaccgccgtgctgctggtgaccgccaacgtgggctcactctttgatgaccctgaaaacctccagaaaaactggttgagggaattctatcaagtcgttcacacccataagccacacttcatggcactgcactgccaagagttcggaggcaaaaattatgaagccagcatgagtcacgtagacaaattcgtcaaggagctcctgtcctcagacgccatgaaagagtacaacagggccagagtgtatctggatgagaattataagtcccaagaacatttcaccgcgctcgggagtttctatttcttgcacgagtcattgaagaacatttatcagtttgatttcaaagcaaagaagtacaggaaggtcgcaggcaaagagatctactccgatacactggaaagtacccccatgctggagaaagaaaagttccctcaggattatttcccagagcgacacgtacctcacacctctctcgaggctttgctgattcttcacgaggaccctcagctgccagaccctcatttgcccttatag

SEQ ID NO: 191459 - DNA, 459 bp, Artificial Sequence
  Description of Artificial Sequence: Synthetic coding sequence
atggccggcaaggccgccgcccccggcaccgccgtgctgctggtgacagccaatgtgggttccctttttgatgatcccgagaatttgcagaaaaactggctgcgcgagttttatcaggccctcggttcgttctattttttacatgaatctcttaaaaatatctaccagtttgacttcaaagctaagaaatatagaaaggtggctggaaaagagatctattcagacacacttgaatccacgcctatgcttgaaaaagaaaagttcccacaggactatttccctgaatgcaagtggtcaaggaagggatttatccggacccggtggtgcatcgctgactgtgcctttgacctcgtcaatattcatctgttccacgacgcttccaatcttgtggcatgggaaacatctccaagtgtttacagtggcattaggcacaaggcactggggtacgtcttagactag

SEQ ID NO: 191460 - DNA, 1935 bp, Artificial Sequence
  Description of Artificial Sequence: Synthetic coding sequence
atgcccagcaaggccgagaacctgcggcccagcgagcccgccccccagccaccggaggggcggacactacagggacaactccccggtgcaccccctgcccaaagggccggttcccctcctgatgccccaggcagcgaatcgccggctctggcgtgttccacgcctgctaccccgtccggcgaagacccccctgcccgcgctgcgcctatcgccccccgacctccagcaaggcctaggttagaaagggctctctcattagacgataaaggttggaggaggcgtcggtttcgggggtcacaggaggacttggaggccagaaacggcaccagcccaagcagaggtagcgtacaaagcgaggggccgggcgcacccgctcactcctgcagcccaccctgcttatcaacatccctgcaggaaatccccaagtcacgaggcgtgctgtcatctgagcggggttccccgagctccggtggaaatcctctgtctggggtggcatcatcttctcccaaccttcctcaccgcgacgccgctgtcgccggctcttctcccaggttgccaagcttgttaccccctcgacccccccccgctctgtctctggatatcgccagtgacagtctgcggacagcaaataaagtcgacagcgatttggctgactataaattgcgggcgcagccgctacttgtgcgcgctcacagctctctgggccccggtcgcccacgcagcccactggcttgtgacgattgctcactacgcagcgcgaaatcatcgttctccctcttggctcctattcgcagcaaagacgtcaggagccgcagctacctggaggggtccctgttggcctcaggagcactgctcggagcggatgagctcgcacgctattttccagaccggaacgttgccctgtttgtagctacgtggaacatgcagggccagaaagagttacctccctctttagacgaatttctccttcccgctgaagccgactacgcacaggacttgtatgtgattggagtgcaggaaggctgttccgacaggcgggagtgggaaacaagactgcaagaaaccctcggtccgcattatgtgctcctttcgtccgcggctcacggagtgctgtatatgagcctgttcatacggcgggacttgatctggttttgcagtgaggtggaatgttcgaccgtaaccactagaatagtaagtcagattaaaaccaagggtgcgctgggaatatccttcacgttttttggaacatcctttcttttcataacctcccatttcacaagcggagacggcaaagtggctgagcggctactggattatacccgcaccgtgcaggcgttagtgctgcctcggaatgtgcctgacaccaacccctacaggagctcagcggccgacgtaaccaccagattcgacgaggtgttctggttcggcgactttaatttcagactttctggtggtagaaccgtagtcgatgcactcttatgtcagggcctggtggtagacgtcccagcactgcttcaacacgatcagctcatccgtgagatgaggaagggatcaattttcaaggggttccaggagcctgatattcactttctgccctcctacaagttcgacattggaaaagatacctacgactccactagtaagcagcgaaccccgtcttacaccgatcgagtactttatcgcagccggcacaagggcgacatctgtccggtcagctattcgtcttgccctgggatcaagacaagcgaccatagacccgtatatggtctttttagagtgaaagtgaggccagggcgagacaacatccccctagccgcagggaaattcgatcgggaactctacttattgggcattaaaagaaggatttccaaggagatacagcgccagcaagcattgcagtcccaaaactcaagcaccatttgttcagtgtcatag

SEQ ID NO: 191461 - DNA, 960 bp, Artificial Sequence
  Description of Artificial Sequence: Synthetic coding sequence
atggaccagagcgtggccatccaggagaccctggccgagggcgagtactgcgtaatcgctgtgcagggggtattgtgcgaaggggattcacggcagagccggctgttggggttggttagatatcgtttagaacatgggggacaagagcacgctctgttcctgtacacacatcggcgaatggccatcaccggcgatgatgtatctctcgaccagattgtgcccgtgagtcgcgatttcaccttggaggaagtcagcccagatggcgagctgtacatcctagggagtgacgtaactgttcagctcgatacggccgaactatccctggtttttcaactgccctttggatctcagacacgaatgttcttacacgaagtcgccagagcctgccctgggttcgattccgctacccgcgacccagagttcttatggctcagtcgttatcgctgcgcggagctcgaattggaaatgccgacaccccgtgggtgtaatagcgccctcgtcacatggcctggctatgcaacaatcggcggggggcggtacccaagtaggaaaaagcggtggggcctggaggaggctcgcccccagggcgcgggcagcgtcctgttctggggaggagccatggagaaaactggtttccgcctgatggaacgtgcccacggagggggttttgtgtggggcaggagtgcccgggacggacgtcgagatgaagagttggaagaggctggacgagaaatgagtgctgccgctggctcacgagaacggaacactgctggctccgctggcggtgggaaactcggctggggtgcgggaccaggggcagccgttcgcccagcgcttggctgggcaggctcagccgtctggccagtggatgcgaggggtgaggaccagtctccggggggaccactagaggccgggacacttgggcaaaaattttgcgacgttctgttgaggagggcctag

SEQ ID NO: 191462 - DNA, 2982 bp, Artificial Sequence
  Description of Artificial Sequence: Synthetic coding sequence
atggaccagagcgtggccatccaggagaccctggccgagggcgagtactgcgtgatagccgttcagggcgtgctctgtgaaggcgacagtcggcagagccgtctgctagggctggtgagatacagactggaacatgggggccaagagcatgcgctctttttgtatacacatcggagaatggctatcacaggcgatgacgtgagtctcgaccagatcgtgcccgtctccagagattttacgctggaagaggtgtcaccagacggggagctgtacatactggggtccgacgtgaccgtccagctggatactgctgaacttagcttggtgttccagcttccattcggaagtcaaacgcggatgtttctgcatgaagtggcccgggcgtgcccaggatttgactctgctacacgggacccagagtttctgtggctctcccggtaccgatgcgcagagcttgagttagaaatgccaactcctagagggtgcaattccgctctcgttacctggcccggatacgccaccataggcggaggccggtacccttctcggaaaaaaaggtgggggttggaggaagctagaccacagggcgccggatctgtgctattttggggaggggccatggagaagactggatttcgtttgatggagcgggcccacgggggaggatttgtttggggtcgctctgcacgcgatggtcgacgtgacgaggaactggaggaggcagggagggagatgtccgccgccgctggctccagggagcgcaacactgcaggaggctccaattttgacggcctgcgtccgaacggaaagggcgtcccaatggatcagagttcccggggacaggataagcctgaatctctacagcccaggcaaaacaaaagtaaatctgaaattacagatatggtgcgctcaagcaccattaccgtgtctgacaaagcccacattttatccatgcagaagtttggcctacgggacacaattgtgaaatcccacctgcttcagaaggaggaagattacacatacatccaaaatttcaggttttttgccggcacctacaacgttaacgggcagtcacctaaggaatgcctgcgcctgtggctttctaacggcattcaggcgcctgacgtttattgcgtggggttccaggaactggatctaagtaaagaggcctttttcttccacgacacgcccaaggaggaggagtggttcaaagcagtgtctgaggggcttcacccagatgccaaatatgctaaagtgaagttaatcaggctggttggaataatgcttctgctgtatgtcaagcaggagcatgccgcttacatttccgaagtagaagcagagaccgtcgggacaggtatcatgggcagaatgggtaacaagggcggcgtggccatccgctttcagttccacaatacaagcatttgcgtggttaatagccatttggcggcccacatcgaagagtacgaaaggagaaaccaggattataaagacatttgctctcgcatgcaattctgtcagcctgacccatccctgcctccactgaccatatcgaatcatgacgtaatcctgtggctgggagacctgaactacaggatcgaagaattagatgtggagaaagtcaaaaaacttatagaggaaaaagattttcagatgctgtacgcctacgatcagctgaaaattcaggtggccgcgaaaactgtctttgaggggtttacggaaggcgaactgacctttcagcctacatacaaatacgacactggatccgatgattgggacacctcagaaaagtgccgcgcccccgcctggtgcgacaggattctgtggaaggggaaaaatatcacacagctgtcctatcagagtcacatggcactgaagacttctgaccacaagccagtctctagcgtgttcgacatcggtgtgagagtcgttaacgacgagctatacagaaaaacacttgaggagattgttcggtctcttgataagatggaaaatgcaaacatcccttccgttagcttgtctaagcgcgagttctgttttcagaatgtcaaatacatgcagctaaaggtcgaatccttcactatccataatgggcaggtgccatgtcactttgagttcataaataagcctgacgaggagtcctactgcaaacagtggttgaacgccaatccctcgaggggcttcctgcttcctgactccgacgttgagattgatttggagctctttgtgaataaaatgaccgctacaaagctaaactcgggcgaggacaaaattgaggacattctagtgctccatctagaccggggcaaggattacttcctgtccgtttccgggaactacctgccaagttgtttcggcagtccaatccatacgttgtgttacatgcgtgaacccattctggacctgccccttgagacgatatcggagctgactcttatgcccgtttggactggtgatgatggcagtcaattagattctcccatggaaattcccaaggagctctggatgatggtcgattacctgtataggaatgctgtccaacaggaggatctgttccaacagcccgggttgcgctctgagttcgagcatatcagggactgtctggacactggaatgattgacaatctttccgccagcaaccactcagtggcagaggccctcttacttttcttggaaagcctgcccgaaccagttatctgctacagtacataccacaactgtctggagtgcagtggcaattatactgcaagcaagcaggtgatatctacactgcctatcttccacaaaaatgtgttccactacttaatggccttcctgcgagaactactcaaaaacagtgctaaaaaccacctggatgagaacatattggccagtatatttggatcccttttgttgagaaatcccgcagggcaccaaaaactggatatgacagagaaaaagaaggcccaagaattcattcatcagtttctgtgcaatccactttag

SEQ ID NO: 191463 - DNA, 2742 bp, Artificial Sequence
  Description of Artificial Sequence: Synthetic coding sequence
atggaccagagcgtggccatccaggagaccctggccgagggcgagtactgcgttatcgctgtacagggcgttctctgcgagggcgattctaggcagagccggttgctggggctcgtgcgctaccgtctcgagcacggtggccaggagcacgccctctttctgtatacacataggcgcatggctattacaggcgacgacgtatctctggaccaaattgtacccgtgagcagagatttcacactcgaggaagtgtctcctgacggcgagctgtacatccttgggtctgacgtgactgttcagctcgacactgccgagctgtcacttgtcttccagctacccttcggatctcagacccgtatgttcctccatgaggtagcccgggcgtgccctgggttcgactccgccacccgggaccccgaatttctttggttgagccgctataggtgcgcagagttggagctggagatgcccacacctcgtggctgcaatagtgctctggttacatggcctggctacgcaaccatcggtgggggagggtcaaatttcgatggactgcgaccgaatggtaagggagtgcccatggaccagagtagcagagggcaggataagcctgagagcttgcagcccaggcagaacaagagtaagtctgagataactgacatggtacggtcttctaccatcacggtgagcgataaggcccacatcctcagtatgcagaaattcggcttgagagatactattgtgaaatcccatctgctgcaaaaggaagaggactatacctacattcaaaatttccggttttttgccggtacatataatgttaacggccaaagtcccaaggaatgtctccggttgtggctttcaaatggcattcaggccccagacgtgtactgtgtggggtttcaggagctggacctttccaaggaagccttttttttccacgatacccctaaggaagaggaatggtttaaggccgtcagtgaagggctccatccagacgctaagtacgctaaggtgaagctgatacggctcgtgggtattatgctactcctgtacgttaagcaggaacatgctgcctatatttccgaggtagaagctgaaactgtgggaaccggaataatgggtcgcatgggcaataaaggaggtgttgccattagatttcagtttcataatacctctatatgcgttgtgaatagccacttagctgctcatattgaggagtacgaacggcggaaccaggattataaggacatctgttctcggatgcagttctgtcagcccgacccaagcctgcctcccttaactatcagcaatcatgatgttattctttggctgggggaccttaattaccggatcgaagaactggatgtggaaaaagtgaaaaaactgatcgaggaaaaagactttcagatgttgtacgcttatgatcagttaaagatccaggtggctgcaaagacagttttcgagggatttacagaaggggaacttacgtttcagccaacctataagtacgacactgggagcgacgattgggacacttcagaaaagtgtcgggctccagcatggtgcgaccggatcctgtggaagggcaagaacattacccagctgtcctatcagtctcatatggcactaaaaacctctgatcacaagcctgtttcctccgtcttcgatatcggagtgcgcgtggttaatgatgaactgtaccgcaagacactggaggaaatcgttcgctccctggataagatggagaacgccaatatcccatccgtatcactgtccaagcgcgagttttgctttcagaacgtgaaatacatgcaactgaaagttgagtcattcaccattcacaacggacaggtaccttgccattttgagttcattaacaagcctgatgaggaatcgtattgcaagcagtggctgaatgccaatccctcaaggggtttcctcttgcctgacagcgatgtggaaattgacctggaactgttcgtgaacaaaatgaccgcgaccaagctcaatagtggagaggacaaaattgaggatatcctggtgctccacctggacaggggcaaggactacttcttatccgtcagcggtaattacttgccttcctgcttcggaagccccattcacaccctgtgctatatgcgcgaacccatcctggacctccctctggaaaccatctcagagctgaccctaatgccagtgtggactggggacgatggttcccagcttgattctccaatggagatacccaaggaactgtggatgatggtcgactatttatatcgaaacgcagtccagcaggaggatctctttcaacaacctggactaaggtcggagtttgaacacatcagggactgtttagataccggcatgatagataacctgtcggccagcaaccactcagtggcagaagccctgctgctgtttctggagagcctgcccgagcccgtcatctgttactccacctaccacaactgtctcgagtgctctggcaactacacagcttccaagcaggtgatctctaccttacctatctttcacaagaatgtttttcactaccttatggcattcctgagagagctgctgaaaaacagtgccaaaaatcacctggacgaaaacatcctggcatccatttttggctcgctgctgctgcgcaatccagccggacaccagaaactggacatgacagagaaaaaaaaagcacaagagttcattcatcagttcctatgcaatcccctctag

SEQ ID NO: 191464 - DNA, 2982 bp, Artificial Sequence
  Description of Artificial Sequence: Synthetic coding sequence
atggaccagagcgtggccatccaggagaccctggccgagggcgagtattgcgttattgctgtgcagggagtcctgtgcgagggcgacagccgtcagtccaggttgctggggcttgttaggtatcgcttggagcacgggggacaggagcatgccctctttctgtatacccatcgccggatggcgatcactggagacgatgtgagcctggaccagatagtacctgtgtcgcgggatttcactctggaggaggtctcacccgacggcgagttatatattctcggctccgatgtcaccgttcagctagataccgcagagctgagtctggtctttcagttacctttcggcagccagactagaatgtttcttcacgaagtggcaagagcatgtccaggcttcgactcagctactcgagatcctgagtttctctggctttcacgctacaggtgcgccgaactcgaacttgagatgcctaccccacgagggtgcaactctgccctggtgacgtggccaggatacgccactatcggaggcggtagataccctagtcgcaaaaagagatggggccttgaggaggctagacctcaaggagccgggagtgtgctgttctggggtggagcaatggagaaaacaggattcaggctcatggaaagggcacacggcgggggcttcgtgtggggacgaagcgcacgcgatgggaggagagatgaggagctcgaggaggccggccgcgaaatgtccgcagccgcggggagtcgcgagcgcaataccgctggggggagcaattttgatggtctaagacctaacggcaagggagttccaatggaccagtccagtcgtggccaggataaacctgaaagtctccagcccagacagaataagagcaaatcagagataaccgacatggtgaggtcatctacaatcacggtctcagacaaagcacacattctttctatgcagaaatttgggctcagggatactatcgtgaagagtcatctcctccagaaggaggaggactacacatacattcagaacttccgtttctttgctgggacctacaatgtgaatgggcagagccctaaggagtgcctgcggctgtggttgagcaacggcattcaggctcctgacgtgtactgcgtgggttttcaggaactggacctctctaaggaggcatttttctttcatgatacccctaaagaggaggaatggtttaaggccgtatcggagggacttcaccccgatgcaaaatacgctaaagtcaagctcatccggctcgttggaattatgttgttgctgtacgtgaaacaggaacatgccgcctatataagcgaggtggaggctgaaactgtcggaaccgggattatgggtaggatggggaacaagggcggagtggcaatacggtttcagtttcataatactagcatttgtgtggtcaactcccacctggccgcacacatagaggaatacgagcgcagaaaccaggactacaaggatatctgctcaaggatgcagttttgccagcctgatccatctcttccccccctgacgatctcaaaccacgatgtcattctgtggttaggggacctgaactatagaattgaagagctggacgtggagaaggtgaaaaaactgatcgaggagaaagacttccaaatgctttacgcgtacgaccaacttaagattcaggtggccgctaaaactgtgtttgaaggattcaccgaaggagaactgactttccagcccacttacaaatacgacacagggagcgatgattgggacacttctgagaagtgtagagcccccgcctggtgcgaccggatcctgtggaaaggaaagaatattacacagctgtcttatcagagccatatggctttgaaaacatctgaccataagcctgtctcctctgtcttcgacattggtgtgcgggtggtcaacgacgaattgtaccgcaagaccctggaggagatagtgaggagcctggataagatggagaacgccaatataccctccgtttctctgtctaaacgcgagttctgtttccaaaatgtaaaatacatgcagctcaaagtggagtcttttacgatccacaacggtcaggtaccttgccacttcgagtttattaataaacctgatgaggaaagttattgtaaacagtggctaaatgccaatccttccaggggctttctcctccccgattcagacgtggagatcgaccttgaactgtttgttaacaaaatgacagccaccaaactgaattccggtgaggataaaatcgaggacatcctggtgctccacttggatcgtggcaaggactacttcctgagcgtttcagggaattatctccccagttgtttcggtagtcctatacacacgctgtgttacatgcgcgagcctatcctcgatctccctcttgaaaccatcagcgagctgacactgatgcctgtctggaccggcgacgacggaagccagctggatagtcctatggaaatacctaaagagttatggatgatggtggattatctttatcgcaacgccgtgcagcaggaagacttatttcaacaacctgggctgaggtccgaattcgagcacataagggactgcctggacaccggaatgatcgacaaccttagcgcaagtaaccattccgttgctgaggccctgctgctctttttagagagcctgcctgaacctgttatttgttactcaacttaccacaactgcctagagtgttctggtaattacaccgccagcaagcaagtaatttccaccctaccaatctttcataagaatgtgtttcactacctgatggcctttctgagagaactgttgaagaattcggctaagaatcatctggatgaaaatatactagccagtatcttcggatcactacttttacgcaatcccgcaggccaccagaaattagacatgacagaaaagaaaaaggcacaggagtttatacatcaatttctgtgcaaccccctgtag

SEQ ID NO: 191465 - DNA, 2250 bp, Artificial Sequence
  Description of Artificial Sequence: Synthetic coding sequence
atgagcgccgccgccggcagccgggagcggaacaccgccggcggctctaacttcgatgggctccggccaaatggcaagggcgtcccgatggaccagagttctcggggacaggataaacctgagtcacttcagccaagacaaaacaagagtaagagtgaaatcacagatatggttcgatcctcaacaatcacagtgtcagataaggcccacatactgtctatgcagaaattcgggttgagagacacgatcgtgaaaagtcacctgttacagaaagaggaagattatacttacatccagaattttcgcttctttgctgggacctacaatgtcaatggacagtcacctaaagaatgtctacgcctctggttaagtaatgggatccaagcccccgacgtgtactgcgtaggtttccaggagctcgacctaagcaaggaggccttcttttttcacgatacccccaaggaagaagaatggtttaaagcagtcagtgaagggctgcatcctgacgccaaatacgccaaggttaaactcatcaggcttgtggggattatgctgctgttgtatgtgaaacaggaacatgcagcctacattagtgaggtcgaggccgagacggtgggcaccggaatcatggggcgaatgggcaataaggggggcgtggcaattcgtttccagtttcacaacacctctatctgtgtagttaacagtcacctcgccgctcacattgaggagtatgagagaaggaatcaggactacaaggatatttgctccagaatgcaattttgtcagcccgatccatcccttccacccctcactatcagcaaccacgacgtgattctgtggcttggagacttaaattataggatcgaggaacttgacgtagagaaagtaaagaaattgattgaagagaaagatttccagatgctgtatgcttatgaccagctcaagattcaggttgctgcaaagacggtgttcgagggatttactgaaggagaactcacatttcagcctacctacaagtatgacacagggtccgacgattgggacacaagtgaaaagtgccgcgctccagcctggtgcgacagaatcctgtggaagggaaaaaacatcacacaactatcctaccagtcgcatatggctctcaagacatccgaccataagcccgtgtcgagcgtgttcgacatcggcgtgagagtggtcaatgatgagttgtaccgaaaaaccctagaggaaatcgtgcggtcactcgacaaaatggaaaacgccaacataccaagcgtgtccttgagcaagcgggagttttgcttccagaacgtcaagtacatgcagctgaaagttgaaagcttcacgatccacaacggacaggtgccatgtcatttcgaattcatcaacaagcccgatgaggaatcctattgtaagcagtggcttaatgcaaacccgagccgaggctttctgctcccagattctgatgttgagattgatctggagctgttcgttaacaaaatgactgccacaaagctaaacagtggggaagataagattgaagatatcttagtgctgcatctggacagaggaaaagactatttccttagcgtcagtggaaattacctcccttcatgctttggcagccccatccacacactctgttatatgagagagccaatactggacttacccttagaaaccatcagtgagctgactctgatgccagtgtggaccggtgacgatggcagtcagcttgattcccccatggagatccccaaggagctgtggatgatggtggattacttataccgaaacgctgtgcagcaggaggatttgtttcaacagcccgggctgagaagcgagtttgaacacattagagattgtctcgacacaggtatgattgacaacctgtccgcctctaatcatagtgttgccgaggcactcctgttgtttctggaaagcctccctgaacccgtgatatgttattcgacttaccacaactgtctggagtgttcaggcaactacaccgcctctaagcaggtcatctccaccctacctatctttcacaagaatgtgttccactacctcatggcgttccttagggaattgctcaagaactccgcaaaaaaccatttggatgagaacattctggccagcatttttggtagtctactgctcagaaaccccgccggacatcagaaactggacatgaccgaaaaaaagaaggcccaggaattcatccatcagtttttgtgtaaccccctgtag

SEQ ID NO: 191466 - DNA, 2487 bp, Artificial Sequence
  Description of Artificial Sequence: Synthetic coding sequence
atggaccagagcgtggccatccaggagaccctggccgagggcgagtactgcgtcattgcggtgcagggggtcttatgcgaaggtgacagcagacagtctcgacttctgggcctcgtgcggtatcggctggaacacgggggtcaggagcatgccctttttctttacacgcatagacgtatggccattactggcgatgacgtctctctcgaccaaattgtgcctgtttcacgtgatttcacgcttgaagaggtgagccctgatggagagctttatatcctggggagcgacgtgacagtccagcttgacacagctgagctctctctggtctttcagctgccttttggctcccaaaccaggatgttcctccacgaagtcgccagggcttgccccggctttgacagcgccaccagggatccggagtttttgtggttgagccgttatcgctgcgccgaactggagctggaaatgcccacaccccggggatgcaattccgcgctcgtgacgtggccaggctacgccaccatcggcggaggaagatacccttcacgtaagaaacgttggggtctggaggaggccagacctcaaggagctggatccgtcttgttttggggaggagctatggaaaagacagggttcaggctcatggaacgagcccatggcgggggcttcgtttggggaaggtccgcaagggacggtagaagggatgaagaactcgaggaggccggacgcgagatgtcagcagcggccggcagccgggaacgcaacacagccggaggctctaattttgacggcttacgaccaaacgggaaaggggttccgatggaccagagttcccggggtcaggataaacctgaatcgctgcagccacgccagaacaagtccaaatccgagatcacagacatggtgcgcagcagcaccattactgtgtctgacaaagcccacatcttaagtatgcagaagttcggcttgcgtgacactattgttaagtcccatcttttgcagaaagaggaagattacacctacatccagaattttcgattcttcgctgggacctataatgtaaatggccaatctccgaaggagtgtctcaggctgtggctgagcaatggtattcaggcgccagatgtttactgtgttggttttcaggaactggacctgagcaaagaggcatttttctttcatgatacaccaaaagaggaagagtggttcaaggcagtcagtgaggggctgcatcctgatgccaagtacgcaaaagtgaagcttatccgactcgttggcattatgctactactttacgtgaagcaagagcatgctgcgtatatatctgaagtcgaagctgagactgtaggcactgggattatgggacgcatggggaacaagggcggggtggccattaggttccagtttcacaacacatccatttgtgtggtcaattctcatcttgctgcgcacatcgaggaatacgagagaaggaaccaggattataaggatatttgctcccgcatgcagttctgccagccggatcctagtctgcctccgctgacgatctctaaccacgacgtaatcctctggctcggcgacctgaactacagaatcgaggagctggatgtggagaaggttaagaagttaattgaggagaaggattttcaaatgctgtacgcctacgatcagctaaagatccaggttgcagctaagaccgtcttcgaagggttcacggagggggagctcaccttccaacctacgtacaaatatgacacgggcagcgacgattgggataccagcgagaaatgtcgagctccggcttggtgcgaccgcattctctggaaaggcaaaaatatcacacagcttagttaccaatctcacatggcactgaaaacctctgaccataagccagtgtcttccgtctttgatatcggtgtacgcgttgtgaacgacgagttgtacagaaaaactctggaagagatcgtgagaagtctcgataagatggagaatgctaacatcccatcggtgtccttgtccaaacgggagttttgtttccagaatgtgaagtacatgcagctgaaagtggagagctttaccattcacaacggccaggttccctgccattttgaattcataaacaagccagatgaagagtcgtactgcaagcagtggctgaacgccaatccatcccgtggcttcctactcccggattcagacgtcgaaatagacttggaactttttgtcaataaaatgaccgctacgaaactcaatagtggcgaagataagatcgaagacatccttgtattgcatttggacaggggtaaggattatttcttaagcgtgagtggtaattacttaccaagttgtttcgggagccctattcacactctctgttatatgcgggaacctatcctcgacctccccctggaaacaatatcggagttgttggcatacctggcagcctactgtttcgagacacagctcgttacgaaaagtttgatttag

SEQ ID NO: 191467 - DNA, 528 bp, Artificial Sequence
  Description of Artificial Sequence: Synthetic coding sequence
atgcagaagttcggcctgcgggacaccatcgtgaagagccacctgctccaaaaagaagaagactacacatacatacaaaattttcggttcttcgcaggcacctataatgtcaatggccagagtcccaaggaatgtttgcggctctggctaagcaacgggattcaggcccccgatgtgtactgcgttggttttcaggagctcgacctgtccaaagaagcctttttttttcatgacacgccgaaggaggaggagtggttcaaggcggtgagtgagggccttcatccagacgccaagtacgccaaagttaagctcatccgcctggttgggatcatgcttctgctctatgtcaagcaggagcacgccgcctacattagtgaggtcgaagctgagactgtgggcaccgggatcatggggaggatgtgcgatctggtggccggcggcccccaactgcaggaccgcagagctgggtgcgggaagtccgagaaagcacatagacgtgaagggcttagcaacgcagtgtgcatttag

SEQ ID NO: 191468 - DNA, 834 bp, Artificial Sequence
  Description of Artificial Sequence: Synthetic coding sequence
atggccgacccctggcaggagtgcatggactacgccgtgaccctggcgaggcaggcaggcgaggtagtgtgcgaagctatcaagaatgaaatgaatgtgatgctgaaaagcagcccagtggatcttgtcaccgccacagaccagaaagttgagaagatgcttataagtagcatcaaggagaagtacccttctcactcattcattggggaagaaagtgtggccgcaggcgaaaaatccatcctgacagataatcctacctggattatagacccgattgacggcactacaaacttcgtccaccgcttcccttttgttgcagtttccatcggtttcgccgtgaacaagaagatcgagttcggagtggtctatagctgtgttgagggaaagatgtacactgcaaggaaaggcaagggcgcattttgcaatggccagaagctgcaggtgtctcaacaagaggacatcacaaaaagcttgctggtgactgagctgggatcttctcgtacacccgagacagtccgtatggtactctctaacatggaaaaactgttctgtatccccgtgcatgggatccgcagtgttggcacagccgccgtcaatatgtgcctggtggccacgggaggtgcagatgcctactacgagatgggcatacattgttgggacgtggccggtgctggcatcatagtcaccgaagcaggaggcgtcctgatggatgtaaccggcggaccttttgatttgatgagtagacgcgtgattgccgccaacaacagaattctcgccgagcgaatagccaaagagatccaggtaatccccctgcagcgtgatgacgaagactag

SEQ ID NO: 191469 - DNA, 597 bp, Artificial Sequence
  Description of Artificial Sequence: Synthetic coding sequence
atggccgacccctggcaggagtgcatggactacgccgtgaccctggcacggcaggccggggaagtggtgtgcgaagccattaaaaacgagatgaatgtgatgctcaagtcatctcctgtcgacctggtcacagccaccgatcaaaaggtagaaaagatgctcatttcctctatcaaggagaagtacccgtctcactcatttatcggagaagaatccgtagccgcaggggaaaaatcaatcctaacagacaatcccacctggataattgacccaatagacggcactactaacttcgtccatagatttccattcgtggccgtttctattggcttcgcagtaaacaagaaaattgagtttggtgtagtctacagctgcgttgagggaaagatgtacacggcgcggaaggggaagggcgccttttgcaacggacaaaaactgcaggtgtctcagcaagaaggatccggtgtgctggagcaacagctattgatttgtgctctgtggcaattggccgaacaaatgcatatcatgaaatgggagtttaccgccggcatgttgcaggaacttgctctcctacttcttaagctggtggcttgctag

SEQ ID NO: 191470 - DNA, 1011 bp, Artificial Sequence
  Description of Artificial Sequence: Synthetic coding sequence
atgggccagcggcccggccccgtgctgcccgccgtggccgtgctgggacaggtggccaagcgaaaagtggcttggctattgcgctggaaagctgtgacccgcacagagacagcagggaactcctctggcgtatatggttttggaaaaatgaagatttttgttaagtacttccagaaaatggctgacccttggcaagaatgcatggactatgcggttacactggccaggcaggcaggcgaagtggtatgcgaagccattaagaacgaaatgaatgtgatgctgaaaagcagcccagtggatctcgttacagccactgaccagaaagtggaaaaaatgttgatctcctcaataaaggaaaaatatccttcccacagctttatcggagaggagagtgtggctgccggagagaaatccatccttaccgacaaccccacttggataatcgacccgattgacggtactaccaattttgtgcatcgcttcccattcgtcgcggtatcaatagggttcgccgtcaacaaaaagattgagttcggtgtggtttattcatgcgtggaagggaaaatgtatactgcccgcaaaggtaagggcgcattttgcaacggccagaagctgcaagtgtcccaacaggaagacataacaaaaagtctgctcgttactgaattggggtctagccggacccccgagaccgtccggatggtgctgagcaatatggaaaaactcttctgtattcctgttcatgggattaggtctgtggggactgcagcagtaaatatgtgcctggtggctacaggaggtgcagacgcctattacgaaatgggaatccattgttgggatgttgccggggctggtatcattgttactgaagccggcggcgtgctaatggacgtgacagggggccccttcgatctcatgagcaggagggtgatcgcagccaataacagaatacttgccgagcgaatagccaaggagattcaggtcattcccctgcaacgggatgatgaggactag

SEQ ID NO: 191471 - DNA, 462 bp, Artificial Sequence
  Description of Artificial Sequence: Synthetic coding sequence
atggccgacccctggcaggagtgcatggactacgccgtgaccctggctcgtcaggccggcgaagttgtctgtgaggctatcaaaaacgagatgaacgttatgcttaaatcatcgccggtcgacctggtcacggccacggatcagaaggtggagaagatgttaatttcatccattaaggagaagtatcccagccacaggttccccttcgttgctgtgagtattgggttcgccgtgaacaaaaagattgagttcggggtagtgtactcgtgcgtggaagggaagatgtacacagctaggaaaggcaaaggggccttttgcaatggccaaaagttacaggtcagccagcaggaagacatcactaaaagccttcttgtaaccgaactgggaagctccagaacaccggagacggtgcgcatggttcttagtaacatggaaaaattattttgtatcccagtgcattag

SEQ ID NO: 191472 - DNA, 636 bp, Artificial Sequence
  Description of Artificial Sequence: Synthetic coding sequence
atgggccagcggcccggccccgtgctgcccgccgtggccgtgctgggccaagtggcaaagcggaaggtggcgtggttgctgcgttggaaggcagtgactcgtacagagacagccggaaactcctctggcgtatatgggttcggtaaaatgaaaatctttgttaaatacttccagaagatggccgacccttggcaggaatgcatggactatgcagttactcttgcacgccaggcgggagaggttgtctgcgaggctattaaaaacgaaatgaatgtgatgttaaagagctcccccgttgacctggtgacggcaaccgaccagaaggtggaaaagatgctcatcagcagtatcaaagagaaatatccttctcattcctttatcggagaagagagtgtggctgccggggagaaatccatcctcacagacaaccccacatggattatcgatccaatcgacgggactactaacttcgtgcataggtttccctttgtggcagtttctatcggattcgctgtgaataaaaagatagaatttggagtcgtgtatagttgcgtggagggcaagatgtacacagcaaggaaagggaagggcgctttctgcaatgggcaaaaactgcaggtgtcccagcaagaatag

SEQ ID NO: 191473 - DNA, 867 bp, Artificial Sequence
  Description of Artificial Sequence: Synthetic coding sequence
atgaagcccagcggcgaggaccaggccgccctggccgccggcccctgggaggaatgcttccaggccgcggtgcagctggcgctgagagccggccagatcatccggaaagctctgactgaggagaagagagtcagtaccaaaacttcagccgctgacctcgtgactgagacagaccacctggtggaggatttaatcatcagcgagctacgcgagcgctttccaagccatcgattcatcgcagaggaggccgccgcaagtggagcaaagtgcgtattgacacactcacctacctggataattgacccaattgacgggacttgtaacttcgtccatcgcttcccaaccgtcgccgtgagcataggcttcgccgttaggcaagaactggaatttggggtcatctatcactgtacagaggagaggctctacacggggagaaggggtagaggcgccttttgtaacggacagaggttaagagttagcggggagacagatctgagcaaggctctcgtgctgaccgagataggaccaaaaagagatcctgccaccctgaagctttttttaagcaatatggagaggctgctgcatgcaaaagcccacggcgtgcgggtgattgggtcaagcactctggctctctgtcacttggcctcaggcgccgccgacgcatactaccagtttggcctccattgttgggacctcgcagcagcaactgtcatcatcagagaggctggtggcattgtgatcgatacttctggtggtccactcgacctgatggcttgcagagtagtggctgcatccacacgagaaatggcaatgctgattgcgcaagccctccagaccatcaactacggccgagacgacgaaaagtag

SEQ ID NO: 191474 - DNA, 258 bp, Artificial Sequence
  Description of Artificial Sequence: Synthetic coding sequence
atgaagcccagcggcgaggaccaggccgccctggccgccggcccctgggaagagtgcttccaggcagccgtgcagctggcccttcgcgcagggcagatcattagaaaagctcttaccgaggaaaaacgtgtatcgaccaagacctccgccgctgatctcgtgacagaaaccgatcatctagtggaggacttgatcatcagcgagctgagagaaagatttcccagtcaccgctctcccttctccctggtgcatatgtag

SEQ ID NO: 191475 - DNA, 1071 bp, Artificial Sequence
  Description of Artificial Sequence: Synthetic coding sequence
atgctggagcagatccggcgggacatccgggacttccggagcagcgccgggctggataaggtgattgtcctctggacagcaaatacggagcggttctgtgaggtgatacccggtctcaacgacacagccgaaaacctattgagaactattgaacttggcctggaagtgagccctagcacactgtttgcagtggcctctattttagagggttgcgcattcttgaatgggagtcctcagaatacactggtgccgggcgccctggagctcgcctggcagcatcgtgtgtttgtgggcggggatgactttaagagcggacaaaccaaagttaagagcgtcttggttgatttcctgataggttccggtctgaaaactatgtcaatcgtgtcttacaatcatctggggaacaatgatggcgagaacctctctgctccactgcagttccgctctaaggaggtctccaaatctaatgtggtggacgacatggtccagtctaaccccgtgttgtataccccaggcgaagagccggaccactgtgtggttattaagtatgttccgtacgtcggcgattccaagcgcgctctagatgaatataccagtgagctcatgctaggcggtactaacacactggtgttgcacaacacctgcgaagattctcttctggcagcacctatcatgcttgacctggcccttctgacagagctgtgccagagagtgagcttctgtactgatatggatcctgaacctcagacatttcaccctgtgctgtctctcttgagtttcctgttcaaggcccctcttgttcccccaggcagccccgtggtcaacgccttgttcaggcaaagaagctgcatcgagaacatcctgcgggcttgcgtcgggctgccaccccagaatcacatgcttctggaacacaaaatggaaaggccaggaccctccctgaagagagtggggccagtggcagcaacgtatcccatgctgaacaaaaaaggcccagttcccgccgcgaccaatggttgtacgggtgatgcgaacggccacctgcaggaggaaccaccaatgccgacaacctag

SEQ ID NO: 191476 - DNA, 1677 bp, Artificial Sequence
  Description of Artificial Sequence: Synthetic coding sequence
atggaggccgccgcccagttcttcgtggagagccccgacgtggtgtacggccccgaagcgatcgaagcccagtatgaatatcgcacaactcgggtaagtcgcgaaggaggagttttgaaggtacatcccactagtacaaggttcacattccgcacagctcgccaggtgccacgactcggagtgatgctggtgggctggggaggcaacaatgggtctaccctaacagcagccgtcctggccaaccggctacgcctgtcctggcccacacggagtggaaggaaggaggcaaattactacgggtcactgactcaggcaggcacagtgtccttgggcctggatgctgagggtcaggaggtctttgttccattcagtgccgtattgcccatggtggctccaaatgacttagtattcgacgggtgggatatctctagcctgaatctggctgaagccatgcgcagagctaaggtgcttgattgggggctccaggagcagctgtggccacacatggaagcactgcgaccaagaccatcagtttacattccagagttcattgcggcaaaccagagtgccagagccgacaatctgatcccaggcagtagagcccagcaactggagcagattcggcgtgatattagagattttcgaagtagcgccgggctggacaaggtgatcgtcctgtggacagcaaacacggagaggttttgtgaagtgatccccggtctgaacgacacggcggagaatcttcttaggaccattgagctgggcctggaagtgagtccttctacactgttcgcagtggcaagtattctggaaggctgcgcctttctaaatggctccccccagaatacgctcgtgccaggcgcattagagctggcttggcagcaccgggtctttgtgggtggggatgatttcaagtctggccagactaaagtcaaatccgtgcttgttgatttcttaatcgggagtggcctgaaaaccatgtctattgtctcatacaaccatctgggcaacaacgacggagagaatctgtccgctcctctgcagttccggtccaaagaggtgtctaagtcgaacgtggtggacgacatggtgcagagcaatccagtgctgtacaccccaggggaagagcccgatcattgtgtcgtaataaagtacgtcccatacgtgggagactctaagcgagccttggacgagtacacaagcgagctgatgttgggaggtactaatacactggtgctgcacaatacttgcgaagattcactcttggccgccccgatcatgctggatctggctctactgacggagctttgccagcgagtatccttttgcacagacatggatcccgagccacagaccttccatcccgtgttgagcttgctcagcttcctgttcaaggccccacttgttccacccggctcccccgttgtcaatgctcttttccgccagagatcttgcattgagaacattctgagggcctgcgtgggactgccccctcagaaccacatgctcttagaacataagatggagcggccaggcccttcacttaagcgcgttgggcctgtggccgccacctacccaatgctgaataagaagggtccggttccagccgcaacgaacgggtgtacaggcgatgccaacggacatctccaggaggagccgcctatgccgactacttag

SEQ ID NO: 191477 - DNA, 1515 bp, Artificial Sequence
  Description of Artificial Sequence: Synthetic coding sequence
atggaggccgccgcccagttcttcgtggagagccccgacgtggtgtatggtcccgaagctatcgaggcccagtatgagtatcggacaacaagagtgagcagagaaggtggggtgctgaaggaggcaaactactatgggtccctgacacaagcgggcacggtgtccctggggcttgacgcagaaggacaggaggtattcgtccccttctcggccgtcttaccaatggtggcccccaatgacctggtttttgatggatgggatatctcttcactaaatctggccgaggccatgagacgggccaaggtgctggactgggggctccaggaacagctgtggccgcacatggaggctctgaggccacgtcccagcgtctacatccccgaattcattgccgccaatcagtctgctcgggccgacaatctgatccctggctccagagcccaacaacttgagcagattcgccgagacatccgagatttccgcagttccgctggtctggacaaggtcattgttttgtggacagctaatactgagcgtttttgtgaggtgattccaggtttaaatgacactgctgagaacctgttaagaacgatcgaattggggctcgaagtgtctcccagcacgctgttcgccgtggcctctatcttagaaggttgcgccttcctgaacggcagcccccagaacaccttagtacccggagccttggaactcgcttggcaacatcgggtttttgttggtggtgacgatttcaagagcggccagaccaaggtgaagtccgtgctggtcgattttttaattggaagcgggctgaaaacaatgagcattgttagttataaccatttgggcaacaacgacggcgagaaccttagtgcccccctgcaatttcgctccaaagaggtcagtaagtctaatgtggtggatgatatggtacaaagcaatcctgtcttgtacacgccaggagaagagccggaccattgtgtggtaattaaatacgtgccctatgtgggcgactctaagcgagcccttgatgaatacacctctgaactgatgctcgggggtacaaacacactggtactgcataacacttgtgaggattccctactcgccgcccctattatgttagatcttgcactgctgactgaactctgtcagcgcgtttctttttgtaccgatatggatccggaaccccagacctttcaccccgttctatcccttctctcattcctcttcaaggcgccgttagtgccgcctggctccccggttgtgaacgccctattcaggcagcgatcttgtattgagaatattctcagggcctgcgtggggctgcccccgcagaatcatatgctcctggaacacaaaatggagaggccaggtcctagtctcaagagggtgggcccagtagccgcaacttatcctatgctgaacaagaaaggtccagtgcccgccgccaccaatggttgtacaggggatgctaacgggcacctccaagaagagccccccatgcctacgacatag

SEQ ID NO: 191478 - DNA, 1227 bp, Artificial Sequence
  Description of Artificial Sequence: Synthetic coding sequence
atgcggcgggccaaggtgctggactggggcctgcaggagcagctgtggcctcacatggaggctctccggcccagaccctctgtgtacatccctgagtttattgcagctaatcagtctgcacgcgcagacaacctcattcccggatcgcgcgcccagcaattggaacaaatccgtagagacatcagggatttcaggtcatccgccgggctggataaagtgattgtgctgtggacagctaacaccgaacgcttttgcgaagtcatacccggcctcaacgataccgccgaaaacttactgagaacaatagagttgggattggaagttagtccctctactctctttgccgttgcaagcattcttgaagggtgcgcctttctgaacggcagcccgcagaatacattggtgccaggagccctagagctggcttggcagcaccgagttttcgttggcggagatgatttcaagagtggccaaacaaaggtgaagtcagtactggtcgactttctcatcggatccggccttaagacaatgagcatcgtatcctataatcatctgggtaacaacgatggcgaaaatctgtcggctcccctgcaattccggtccaaagaagtcagcaaaagcaacgtcgtggatgacatggttcagtccaatcccgtcctgtatacccccggtgaagagccagatcactgtgttgtgattaaatacgtcccctacgtcggggattcaaagcgcgctttagacgaatatacgtctgaactcatgttgggcggcactaatacacttgtgctacataatacatgcgaagacagcctccttgctgcacccattatgctggatctggcgctgctaactgagctttgccagcgggtttcattctgcacggatatggacccagaaccacaaacttttcaccctgtgctctcgctcttatccttcctgttcaaggcccccctggtgccccccggcagcccagtggttaacgccctctttcgccagaggtcatgcatcgagaacattttgagggcctgcgttgggctcccgccacagaatcatatgctcctcgaacacaaaatggagcgccccgggccaagtttgaaaagggttggcccagtcgccgccacttacccgatgctgaacaagaaggggccagtgcctgcggctacgaatgggtgcaccggggacgcaaatgggcatctccaggaggaacctccaatgccaacaacctag

SEQ ID NO: 191479 - DNA, 1386 bp, Artificial Sequence
  Description of Artificial Sequence: Synthetic coding sequence
atgaccctgcccggcggccccaccggcatggcccggcccggcggcgcccgaccctgttcccctggtttggagcgcgcgcccagacggtccgtcggggagttgcgactgctgttcgaagctcggtgcgccgctgtggcggccgccgctgcagctggtgaaccacgcgctagaggggcaaagagacgcgggggacaggtcccgaacgggctgcccagggcaccccccgcccctgtcatcccacagcttaccgtgactgctgaggagcctgatgtgccgcctacctcaccagggcctcccgagagggagcgggactgtttgcccgctgctgggtcctcccacttacagcagccccgacgacttagtacctccagcgtctcttcaaccgggtcgtcctcattactggaagactcagaagatgacttactgtctgattcagagagtcgtagtcgaggcaacgtgcagctggaggcaggggaggatgtagggcaaaagaatcactggcaaaaaatccgtaccatggtcaacttgcctgttattagcccatttaagaaacggtacgcttgggtgcagcttgccggccacacaggcagttttaaagcagccggcacgtctggactgattctgaagcgctgctcggagccagaaagatactgcctagctcgccttatggcagacgcactacgaggctgtgtgccggcttttcacggagtggtcgaacgcgacggcgaatcttacctacagctacaagacttgctggacggatttgacggcccttgtgtcctggattgtaagatgggagttaggacgtatcttgaagaggagctaactaaagccagagaaagaccaaagctcaggaaagatatgtataaaaagatgcttgccgtggaccccgaggcacctacagaggaggagcacgcccagagagccgtaacgaagcccagatatatgcagtggagagagggtatctcatcctcaaccaccctgggattcaggattgaggggatcaaaaaggccgacgggagttgtagcaccgattttaagactaccagatctcgcgaacaggtgctaagggtgttcgaggaatttgtacagggagatgaggaggtccttaggagatatctgaatagactgcagcagattagagacacactggaagtgtccgaattctttcggaggcatgaagtaattggctcttctctgctgttcgttcacgatcattgccatcgcgccggcgtgtggctaattgacttcggcaaaaccacccctctgcccgacggccaaatcctagatcaccggagaccttgggaggaaggcaacagagaggatggataccttctgggtttagacaatctgataggcatcctggcctctttagctgagcggtag

SEQ ID NO: 191480 - DNA, 2841 bp, Artificial Sequence
  Description of Artificial Sequence: Synthetic coding sequence
atggccgtgtactgctacgccctgaacagcctggtgatcatgaactctgctaacgagatgaagagtggcgggggccccgggccttctggaagcgagaccccaccacctccccgccgagccgtgctctcaccaggatctgttttttcccccggtcgtggagcctccttcctatttcctccagcggagtcgttgtctcctgaggaacccaggagtccgggcgggtggcgatcagggaggaggcgccttaactctagtagtggttcaggttccggatcaagcggctcttccgtatcttcaccgtcctgggcaggccggttgcggggggaccgacagcaggtagttgctgccggcacactgtcaccccctggacccgaagaggccaaacgtaagttgcgcattttgcagagggaattgcagaatgttcaagtgaatcagaaggttggcatgtttgaggcccacattcaggcccagagctccgccattcaagccccccggtctcctcgcctggggcgagcacggagcccgtccccctgcccattccgttccagctctcagccaccagggcgtgtgttggtgcagggcgcaagaagcgaggaacggcgcacaaaatcatggggcgagcagtgccctgagacctccgggaccgacagcggccgcaagggggggccttccctttgttcaagccaggtgaaaaaagggatgcctcctctgcctggtagagcagctcccaccgggtcggaagcccaaggccccagcgcctttgtcagaatggaaaagggtatacctgctagcccacgttgcggctctcctaccgccatggaaatcgataaacgtgggtcacccacaccgggcacccgatcttgtttggcccctagcttaggcttgtttggtgcctctctgacgatggccactgaggtggcagcccgcgtcacctcgaccggtccccatagacctcaggatctggccctgacagagcccagcggacgggcccgcgagctcgaagatttacaaccccctgaggcgctggtggaaaggcaaggccagtttctcggcagcgagaccagtcccgccccggaacgggggggcccaagagacggagagccgcccggcaagatgggcaaggggtatttaccctgcggcatgccaggatccggtgagcccgaggtcggtaaacggcccgaagaaaccaccgtgtcagttcaatctgcggagtcttcagacagtctgtcatggtctcgtctaccaagggcgctagcctctgtaggccctgaagaggcgcgcagcggcgctccagtggggggaggccgatggcagctgtcagaccgggtcgagggagggagcccaactctgggtcttcttggcggaagcccatccgcacaacccgggactggcaatgtagaagcaggcattccctctggacgcatgctcgaacctctgccctgttgggatgcggccaaggatctcaaagaacctcagtgtcctcctggcgatcgggtgggagtgcaaccaggcaactcacgcgtgtggcaggggacaatggaaaaagcggggctcgcatggactagaggcaccggcgtgcagtcggagggcacctgggaatctcagcgtcaggacagcgatgctttgccaagtcctgaattgttgccccaggatcccgacaagcctttcctacgcaaggcttgttcccccagtaacattccggccgtgatcatcacagatatgggtacacaggaagacggtgccctggaagaaacccagggaagtccccgggggaatctgccattgcgcaagctcagctcgtcttccgcttcgtccaccggctttagctcgagctatgaagatagcgaggaggacatctcttccgaccccgagcgcacgctggaccctaatagcgccttcctccatacactggatcagcagaaaccccgcgtcagcaagagctggcgcaaaatcaagaacatggtgcattggagcccattcgtgatgagctttaagaagaagtatccgtggattcaactcgcagggcacgcgggctcttttaaagcagccgctaatggtcggattcttaagaagcactgcgaatctgaacagagatgtctggatcgtctgatggtcgatgtgctgagacctttcgtgcccgcttatcacggcgacgttgttaaggacggcgaacggtacaatcaaatggacgaccttttggctgacttcgatagcccctgtgtgatggattgtaagatggggattcgaacctaccttgaggaggagctgacgaaggcaagaaagaaaccaagccttcgcaaagacatgtaccagaagatgatcgaggtggatccagaggcaccaactgaggaggagaaagcacaaagagcagtgacgaaaccgagatatatgcagtggcgggaaacgatttccagtacggctactctgggctttcgaattgaaggaatcaagaaggaagacggcactgtcaatcgggattttaagaagacgaagacacgggagcaagtgaccgaggctttcagggaatttaccaaggggaaccacaacatcttgattgcttatcgtgaccggctcaaggctatcaggacaaccctggaagtgtccccattcttcaagtgccacgaggtcatcggaagctcactgttattcatccacgataaaaaggagcaagccaaggtctggatgatcgatttcggcaagacgactcccttgccagaaggccaaacactgcagcacgatgtgccctggcaggagggtaatcgcgaggatgggtacttgagcggcctgaacaacctggtcgacatcttgaccgagatgtctcaagacgcccctctggcatag

SEQ ID NO: 191481 - DNA, 1935 bp, Artificial Sequence
  Description of Artificial Sequence: Synthetic coding sequence
atggccgtgtactgctacgccctgaacagcctggtgatcatgaacagtgccaatgagatgaagtccggggggggccctggcccatcaggttccgaaactcccccccctccgaggagggctgttttatccccaggctccgttttttcccccggccggggggcaagcttcttgttcccacctgctgaatctctttccccggaggaaccacgttctcctgggggctggagatctgggcgccgccgacttaacagctcctccggatccggctccggaagttccgggagttctgtaagctccccgagctgggctggcagactaagaggggaccgccagcaggtggtagccgccgggactctaagtccacctggaccagaggaagctaaaaggaaactaaggatcctacagcgggagcttcagaacgtgcaggtcaaccagaaagtgggaatgtttgaggctcatattcaggctcaaagctctgcaatacaagcccctcgatctccgcgactgggaagggctcggtctccatcaccatgtcccttcagatcttcttcccagcccccagggcgcgttctggtacagggagcccgttccgaagaaaggagaactaagtcctggggagaacagtgtcctgaaacttctgggactgacagcggcagaaaaggcgggccgtccctgtgtagtagccaggtgaagaaaggaatgcccccactcccaggccgggctgcgcccacgggatcagaagctcagggcccctcagctttcgtccgtatggagaaagggatcccagccagtccaaggtgcgggtctccaaccgccatggaaatcgacaaaagaggaagtccgacaccaggcacgcgttcatgcctggctccctccctcggtctctttggcgcctctctaacgatggctacggaggtagcagctagggtcactagtacaggaccccatcgtcctcaagatttagcactgaccgagccctcagggcgggctcgcgagctggaagatttgcagcccccagaagcgctcgttgagagacaggggcagtttctgggctccgagaccagccccgcacctgaacgcggcgggccaagagatggcgagccacccggcaaaatgggtaaaggatacttaccttgcggcatgcccgggtcaggggaacctgaggtgggaaaaaggcctgaggagacaacggtttcagtccaatccgctgagtcatcagacagccttagctggtctaggctccctagagcattagcttcagtgggacccgaagaagcgaggagcggcgctcctgtcgggggaggtcgttggcagctgagcgacagggttgaaggtggatcacccacccttggattgttgggagggtctccttcagcacagcccggtacaggcaacgtcgaagctggtattccttccgggcgtatgctagagccactgccttgctgggacgctgccaaggacctcaaggagccacagtgtcctcccggagatagggtgggagttcagcctgggaattctcgggtatggcagggaactatggagaaagcaggtctggcatggactcggggtacaggcgtgcagagtgaaggcacctgggagtcccagaggcaggatagcgatgcgctgcctagcccagaactgttgccacaggatcccgacaaaccatttctgaggaaggcctgttccccctctaacatacccgccgtgatcatcacagacatgggaacacaggaggatggtgctctcgaggagacccaagggagcccacgtggaaacctccctttgcgcaagctgtcttcttccagcgcctcgagtactgggttctccagtagttatgaagatagcgaggaggatatctcatccgatccagagcgcacacttgaccccaacagcgcttttcttcatacgctggaccaacaaaagcccagggtttag

SEQ ID NO: 191482 - DNA, 2841 bp, Artificial Sequence
  Description of Artificial Sequence: Synthetic coding sequence
atggccgtgtactgctacgccctgaacagcctggtgatcatgaactcagcaaatgaaatgaaatcaggcggggggccaggaccaagtggaagcgaaacacctcctccgccccgacgagccgtgctttctccaggctctgtgttttctcctggccgtggtgcctctttcttattcccacctgcggaatcgctgagtcctgaagaacctcggtcacccgggggttggcgttccgggaggaggcgcttaaattctagctctggcagtgggtccgggagctctggatccagtgtgtcgtcacctagttgggctggacgcctgaggggcgaccgtcagcaagttgtcgctgccggtacactgagtccccccggcccggaagaagccaagagaaagctgcggattctgcagcgcgagctacagaacgtccaggtgaatcaaaaagtgggaatgttcgaagcacacatccaggcccagtccagcgccattcaggctccccgttcaccacgcctgggtcgggccagatcacctagcccctgtcctttccgctcatcgagccagcctccaggacgggtgctggtccagggagctagaagcgaggaacgccggacaaagtcttggggtgagcagtgtccggaaacctccggcaccgatagcggtagaaaaggaggcccctctctgtgctcaagccaggtcaagaaaggaatgccgccgctgcccggcagagcggcccctactggctcagaagcccagggtccctccgcctttgtacgcatggaaaaggggattccagcctcacctcgctgtggttcccccacagccatggaaattgacaaaaggggctcacctacacccgggacacgctcttgtctcgctccctcactaggactgttcggcgcctccttgacaatggccaccgaggtcgccgctagggtcacgtcaaccggcccccatcgaccacaggatttggctctaacggaacctagtggccgcgcacgtgagctcgaggatttacagcccccagaagcgctagtcgaacgccagggtcagtttctgggcagcgagactagtcctgcccccgagagaggcggaccacgtgacggagagccccctgggaagatggggaaaggctatttaccatgcggcatgcccggctctggtgaaccagaagtcgggaagcgcccagaggaaactactgtcagcgtgcagagtgcagagtccagcgatagccttagctggtctcggctcccccgggccctggcatcagtggggcctgaggaagcaagatccggagcaccagtcggcgggggtagatggcaactatccgaccgcgttgaggggggaagcccaacccttggcctcctcggcggatccccctctgcccagccaggaacgggaaatgttgaggcaggaatcccgagtggcaggatgttggaacccctcccatgttgggatgccgcaaaagatctgaaagagccgcagtgtccccctggtgaccgggtgggggtgcagcctgggaatagccgggtgtggcaaggcaccatggagaaggctggcctggcatggaccaggggaacaggcgtgcagtcagaaggaacttgggaaagtcagaggcaggactccgatgcattgccaagcccagagctactgccacaggatccagataaaccattcctccgcaaggcctgctctccttccaatattcccgctgttatcatcactgatatggggactcaggaagacggggcactggaagagacccaaggttccccccggggaaacctgccgctgcgcaagttgtccagttcttctgctagcagtacaggattttcatcgagctacgaggattcagaggaggacatatcgtctgatccggagaggaccctcgacccgaactccgcctttctgcatactctcgatcagcaaaagccacgggtaagtaagtcttggcgcaagattaaaaacatggtgcattggtccccttttgtaatgtcatttaaaaagaagtacccatggattcagctagccggccatgcggggtcattcaaggctgcagctaatggacggatcctgaaaaagcattgcgagtcagagcagcgctgtcttgacaggctcatggtggacgtactgaggccattcgtacctgcctatcacggcgacgtggttaaggatggcgagagatacaaccagatggatgacctgctggccgactttgatagtccctgtgtgatggattgcaaaatgggaatacggacgtatttggaggaggagcttacaaaagcccgcaaaaagccctccctccggaaggatatgtaccagaaaatgatagaggttgatcccgaggctcctacagaagaagaaaaagcccaaagagccgtaaccaagccccgttacatgcagtggcgggagaccatttcttctacagcaacactcgggttcaggattgagggcatcaagaaagaagatgggactgtaaatagagattttaagaagacaaagaccagggagcaggtgactgaagcttttcgcgaattcaccaaggggaaccacaacatcctcatcgcatacagggaccgtctgaaggctatacgcaccactctcgaggtgagcccgttctttaagtgccatgaagtaatcgggagttctctgctctttatacacgataagaaggaacaggcgaaggtgtggatgattgattttggtaagaccactccactcccagagggccagacactccagcacgacgtgccctggcaagaggggaatcgtgaggacggctatttgtccggccttaacaatctggtggatatactgacagaaatgtctcaagacgctcctctggcctag

SEQ ID NO: 191483 - DNA, 2052 bp, Artificial Sequence
  Description of Artificial Sequence: Synthetic coding sequence
atgcggcggtgcccctgccggggcagcctgaacgaggccgaggccggcgctcttccagcagcggctcgtatgggactggaagccccccggggaggcagacgtaggcaaccaggtcagcagaggcccgggcccggagcaggagcacccgcaggccggcctgagggtggtggaccctgggcccgaacggaaggctcaagtctgcacagcgaaccagagagggcagggcttggtcccgcccctgggacagagtcaccccaggcagaattttggaccgatggtcaaactgaacctgctgctgctgggcttggcgtcgagacagagaggcccaaacagaagacagagcctgaccggagcagtctacgtacacatctcgaatggagctggtctgaactggaaacaacctgtctgtggacggaaacaggcactgacgggctttggaccgacccccacaggagcgacctgcaattccaacctgaagaagcatccccctggacacagcccggcgttcacggcccttggacagaacttgagactcacggatcacagacccaacccgaacgggtaaagtcctgggcagataacctctggactcaccagaatagttcctccttgcagacacacccagaaggcgcctgtccctccaaggaaccatccgccgatggctcctggaaggagctgtacactgatgggagtcgcacgcagcaggacatagaggggccctggactgagccgtacacggacggctctcagaagaaacaggatacagaggcagcacgtaagcaaccagggacagggggtttccagatccagcaagatacggatggttcttggacacagcctagcacggacggcagccaaacagccccaggcaccgactgcttactcggcgagcccgaagatgggcccctggaagagcccgaacctggcgaattgctgactcatctatacagtcatctgaagtgttcacctctctgtcctgtacctagactgattatcactccggaaactcctgaaccagaggctcagcccgtgggaccaccctcaagggtggaaggaggatccggggggttttcttcagcgagctctttcgacgagagcgaagacgatgttgtggccggaggcgggggtgcttccgatcccgaggacaggagtggttctaagccgtggaaaaagttgaaaactgttcttaaatacagcccctttgttgtctctttcagaaaacactacccatgggtccagctatctggacacgccggcaactttcaggcaggtgaagatgggagaatactgaaacgcttttgtcagtgtgagcagcgtagcttggagcaactaatgaaggatccactgcggccctttgtgccggcctattacggtatggtcctgcaggacggccagacctttaaccagatggaagaccttttggcggacttcgaggggccatctatcatggactgcaagatggggtctcggacatatttagaggaggagctggtgaaggctagggaaagacccagaccgcgcaaagacatgtacgaaaaaatggtggctgtggaccctggagctccaacgccagaggagcacgcacagggcgccgtgactaaaccccgctatatgcagtggcgggaaactatgtcgtctacttcaacattggggttccgaatcgaggggatcaagaaagccgatgggacttgcaatacgaacttcaagaagacccaggccctcgagcaagtgaccaaggttctggaggatttcgtggacggtgaccacgtcatcctgcaaaaatatgtagcctgcctcgaagagctgcgagaggccttggaaatttctcctttctttaaaactcatgaagtcgtgggttccagtcttttgttcgtacatgaccacacaggcctggccaaggtgtggatgatagattttggcaagactgtcgccctaccagatcaccagactttgtcccatcgtctgccttgggccgaaggcaatagggaggatgggtacctgtggggcctagacaacatgatatgcctgctccaggggttggctcagtcatag

SEQ ID NO: 191484 - DNA, 1740 bp, Artificial Sequence
  Description of Artificial Sequence: Synthetic coding sequence
atgcggcggccccccggcaacggcgaggccgccagcgagggccccgggggctggggcctttggggagtacaggagtcccggcggctgtgttgtgccggccatgataggtgcaaacaggccctgctccaaatcgggattaacatgatggctctgcccggcgggcgacatcttgattccgtaaccctccccggccagcgactgcacctaatgcaggtcgatagtgtgcagaggtggatggaggatctgaagcttatgaccgaatgtgaatgcatgtgcgttctgcaggcgaaaccaatttccctagaagaagacgcgcagggcgatctgattctggccgggggccccgggcctggagatcctcttcagctgttgctgaagcggggatgggtgattagcacagaattgaggagaatcggccagaagctcgcccaggatagatgggctagggttcactcaatgagcgtgcggctgacatgtcacgccaggtcaatggttagtgagtatagcgccgtaagccgaaactctctgaaagaaatgggtgagatcgagaaactgctgatggaaaaatgcagcgagctgtcggctgtgactgagcgctgtctccaggtggagaacgaacatgtgctgaaatcaatgaaggcgtgcgtatccgagacgttgagcatgctgggtcagcacttcggtcagttgctggagctggcgctaactagagaagtgcaggctttagtgagaaaaatcgatgcctcagacaatatttataccacagagtctactacggggaatctcttttctctcacccaagaaggagcgcctctctgtcggatcatcgcaaaggagggcggggtcgtggcgctgtttaaggtatgccgccaggactctttcaggtgtctctaccctcaggccttgcgcaccctggccagcatatgctgcgtggaagagggggttcaccagctcgaaaaggtagacggagtgctgtgcctggcggatatcttaacagacaattcacactctgaagccactagagccgaagcggctgcggtcgtcgcccaggtcacctcaccgcatctcccggttacacagcacctgtcgagtttcctggaatccatggaggagatcgtaacagccttagtgaagctgtgtcaggaggcaagcagcggagaggttttccttctggcttctgccgcccttgccaatatcaccttcttcgacaccatggcctgcgaaatgcttctgcaactcaacgcgattcgcgtgctgctggaggcgtgttctgataagcagcgggtcgacacaccgtataccagggatcagatcgtaaccattctggccaacatgagtgttctcgaacagtgcgctagcgatattatccaggagaacggtgtgcagttgattatgggaatgctgtcagagaaaccccggagtggtacccctgcagaagtcgccgcctgtgaaagggtgcagcagaaggcggccgtcacgcttgccaggctgagcagggacccagacgtggctagggaagccgtgaggctcagttgtatgtcccgccttattgagctgtgcagatcaccatctgagagaaatagttctgatgccgtccttgtggcctgcctagccgcattgcggcggttggcaggcgtttgcccagagggactgcaggattcggattttcagcagcttgttcagccacgactcgtggattctttcctgctttgctcaaacatggaagagtcctttgtgtag

SEQ ID NO: 191485 - DNA, 1599 bp, Artificial Sequence
  Description of Artificial Sequence: Synthetic coding sequence
atgatggccctgcccggcggccggcacctggacagcgtgaccctgcccgggcagagactccaccttatgcaggtggattctgtccagagatggatggaagatctgaagctgatgaccgagtgcgaatgtatgtgcgtgctccaggctaagccgataagcctggaggaagatgcgcagggggatttgattcttgcaggaggcccagggcccggagatcctctgcagcttctcctcaaacgcggctgggtcatcagtaccgagttgcgcagaatcggtcagaagctggctcaggaccgatgggctagagtccattcaatgagtgtaaggttgacatgccatgcccgcagcatggtgtccgaatacagcgctgtgtcgcgtaactcattgaaggagatgggggaaatcgagaagctgctgatggagaaatgttctgagctgagcgccgtaaccgaacggtgcctgcaggtcgagaatgagcacgtcctgaagtccatgaaggcatgcgttagtgaaaccctgtcaatgctaggccagcattttgggcagctgctagaattagccctgacgcgcgaagtgcaagccttggtgcggaaaattgacgcttcagacaacatttacaccacagaaagcacaacgggcaatctgttttccctgacgcaagagggcgccccactctgccgcatcatcgccaaagaggggggggtggtggcgctctttaaggtgtgtaggcaagattccttccgatgcttatatccccaggccctgcggaccctggcttccatctgctgcgttgaagagggcgtacatcagttggaaaaagtagacggggtgctgtgtctagccgatatactcactgacaattctcactcagaagctacgcgcgccgaggcggctgctgtggttgcccaggtcacgtctccacacctcccggtgacccagcacctctctagttttctggagtcaatggaagagatcgtaaccgcactcgtcaagctgtgtcaggaggcatcaagcggggaggtgtttcttctggcttctgccgccctagccaacatcacgttctttgataccatggcctgcgaaatgttactacagctgaacgccatcagagttctgctcgaggcatgctctgacaagcaaagggtggatacaccatacacccgtgaccaaatcgtcaccattctggccaatatgtctgtacttgagcagtgcgcatcagatattattcaggaaaacggagtccagctgatcatgggtatgctgtcagagaagccccgatcgggaacaccggcagaggtcgccgcctgcgaacgagtgcaacaaaaagccgctgtcaccttggccaggctcagtagggaccctgacgtcgcgagagaggcagttagactgagctgcatgtctcgcttgattgagttatgtcgatctccctctgaaaggaactccagcgatgctgtactggtcgcctgtttggccgcactcaggaggctggccggcgtgtgcccagaaggcttgcaggactcggattttcagcaattagtgcagcctcgcctggtggactctttcctgttgtgtagcaatatggaagaaagttttgtctag

SEQ ID NO: 191486 - DNA, 927 bp, Artificial Sequence
  Description of Artificial Sequence: Synthetic coding sequence
atgatggccctgcccggcggccggcacctggacagcgtgaccctgcccggacagagactgcacctgatgcaggtcgattctgttcagagatggatggaagacctgaagctgatgacagagtgtgaatgcatgtgcgtcctccaggcaaaaccgatttcacttgaggaagatgcccagggggacttaatactggccggaggaccgggcccaggggatcccctgcagttactactcaagcgcggatgggtcatatccactgaactgcggcgaattggccagaagctggcgcaagacagatgggctcgggtacatagcatgagcgttcgtctcacctgccacgctagatccatggtctccgagtattcagccgtgtctaggaactcacttaaagagatgggggagatcgaaaaacttttaatggagaaatgctctgaactgtcggcggtgaccgagagatgtctacaggtggagaacgagcacgtgctcaagtccatgaaggcgtgcgtttctgagacacttagcatgctgggacagcattttgggcaactgctcgaactggccctaactagagaggtgcaggtggaatctcatagcgtcactagattagagtgtagcggcgccatttctgctcaatgcaacctgagactgttgggtagctctgactcacctgcttctgcaagtcaggccctcgtgcgcaaaatcgatgcctctgataatatttacaccactgaatccactacaggcaacctgtttagcttgactcaggaaggggcgcctctatgtcggatcattgccaaggagggcggcgttgtggccttatttaaagtctgtcggcaggattcttttcgctgtctatatccccaggcgctaagaacgctagcctctatttgttgtgtggaagaaggcgtccaccagttggagaagtag

SEQ ID NO: 191487 - DNA, 1473 bp, Artificial Sequence
  Description of Artificial Sequence: Synthetic coding sequence
atgatggccctgcccggcggccggcacctggacagcgtgaccctgccgggacagcgcctccatctcatgcaggtggactcagttcagcgctggatggaggacctgaagctcatgactgagtgcgagtgcatgtgcgtgctgcaggccaagccaatatcacttgaagaagacgctcagggcgatttgattctggcaggtggacctgggcccggcgacccactgcagctgctgctcaaaagaggctgggtgatctccaccgaactgaggaggattggccagaaactggctcaggatcgctgggccagagtgcattcaatgtccgtgagattgacttgtcacgccagaagtatggtgtctgaatatagcgctgtctccaggaactccctgaaagaaatgggcgaaattgaaaaactgctcatggagaagtgctccgagctttcagcagtgaccgaaaggtgtctgcaggtggaaaacgagcacgttctaaaaagtatgaaagcttgcgtctcagagactttgagcatgctggggcagcattttggtcaattgcttgagctcgcgctaactcgtgaggtgcaggcgctcgtgaggaagattgatgcttccgacaatatttacactaccgagtccaccacgggcaatctcttctcactaacacaggagggcgccccattatgtcggataatcgctaaagtggacggtgtactgtgcctcgccgatatcttaacggataactcccacagcgaagccacaagagcagaagccgccgcggttgtcgcccaggtgacctctccgcatttaccagtgacccagcatctgagcagttttctggagagcatggaggagattgtgactgcgctggtcaagctgtgccaggaggctagttctggtgaagtatttctcctggcgtctgcagcgctagccaatattactttctttgataccatggcatgcgaaatgcttctgcaactgaatgctattcgggtattgctggaggcttgctctgacaaacagcgtgttgacacgccctacacccgagaccaaattgttacgatactggcaaacatgtccgtgctcgagcagtgcgcttctgacatcatccaggaaaatggagtgcaactgatcatggggatgctcagcgaaaaaccacggtcaggcacacccgccgaagtagcagcttgtgaacgagtgcaacagaaagcggctgtcacccttgcacgcctgtccagggatcctgacgtagcccgcgaagctgtgcgcctgtcttgcatgagccgcctgatcgagctttgtaggagcccctctgagcggaacagttccgatgccgttctggtggcatgcctggctgcattgaggaggctggctggcgtgtgtcctgagggactccaggactctgattttcagcagctggtgcagccaagactggtcgatagctttttgctgtgttccaacatggaagagagttttgtgtag

SEQ ID NO: 191488 - DNA, 1473 bp, Artificial Sequence
  Description of Artificial Sequence: Synthetic coding sequence
atgatggccctgcccggcggccggcacctggacagcgtgaccctgccaggccaaaggttacatctgatgcaagtcgactctgtacagcggtggatggaggatcttaaactgatgaccgagtgtgagtgtatgtgcgtcctgcaggcaaaaccgatctcgctcgaggaagacgcacagggcgacctgattcttgctggcggcccaggccccggagaccctctacagctgctcctgaaacgcggctgggtaatatcgacagaacttcgacgaatcggacagaagctcgcacaagatcgatgggcccgcgtccacagtatgagcgtgcgactgacttgccatgcgaggtccatggtgtcagagtacagtgcagtcagccgtaacagcctgaaagagatgggtgagatagagaaactgcttatggaaaaatgtagcgagctttcggccgtgaccgaacgctgtctgcaggtggagaacgagcatgtactgaaaagcatgaaagcttgtgtttctgagactctaagcatgctcggacagcactttggccagcttttagaattggccctcactagagaggtccaggctctggtgcggaagatcgacgcttcggataacatttatacaaccgagtctactacgggtaacttattttccctgactcaggagggagcgcccctatgtaggattatcgccaaagtggacggcgtgctttgccttgcggatatcctgacagataactcccattcagaggcaactagggcggaggcagccgcagtagttgctcaagtaacaagtccccatctgcctgtgactcagcatctgtctagtttcttggagtccatggaagagattgtgaccgcgcttgtgaagctctgccaggaggcaagcagtggggaggtgttcctcctggctagcgccgctctggcaaacatcacctttttcgacactatggcctgtgaaatgctgctacagttgaacgccatccgagtgttgctggaggcatgctccgacaaacaacgagtggacaccccttatacccgcgatcaaatcgtaaccatcctggctaatatgtcggtgctagaacaatgcgccagcgatataatccaggagaatggggtccagctgatcatggggatgttatctgagaagccgcgaagcgggactcctgcggaagttgcagcttgcgagagagtgcagcagaaagctgccgtcacgctggcacgattatccagggaccccgacgtggctagagaggcggtgcgcctgtcatgcatgtcgcgcctgatcgagctatgccggagcccttctgagcgcaattcctccgacgccgtgctagtggcgtgtctggcggccttgagacgtctggctggtgtttgccccgaagggctgcaagattctgactttcaacagctggtgcagcctcggctggtggactcatttctcctgtgttctaatatggaggaatcattcgtctag

SEQ ID NO: 191489 - DNA, 1599 bp, Artificial Sequence
  Description of Artificial Sequence: Synthetic coding sequence
atgatggccctgcccggcggccggcacctggacagcgtgaccctgcctggccagcgcttacatctcatgcaggtggactctgtgcaaagatggatggaggacctgaagttgatgactgaatgtgaatgcatgtgcgtgctacaggcaaaaccaattagcctcgaagaagacgcccagggagacttaatcctggcaggcggcccgggacctggcgatcctcttcagctattgctcaagagaggctgggtgatctcaaccgagctccgacgcatcggtcagaaactggcccaggacaggtgggctcgcgtccattcaatgtcggtccgcctaacatgccacgcacgctccatggtctccgagtactctgcagtatctagaaatagccttaaagaaatgggggagatcgaaaaactgcttatggaaaaatgcagcgaactcagtgctgtcaccgagcggtgtctgcaggtagaaaatgaacacgtgctgaaatcaatgaaggcatgtgtctccgagacactctccatgttgggacagcactttggccagctactggagctcgcgctgaccagagaggtgcaggccttggtgcgaaagatagacgcctctgacaatatctatactacagagtcgacaactgggaaccttttttctctcactcaggagggtgcacccctgtgtagaattatcgctaaggaaggtggcgtggtagccctatttaaggtttgccggcaggattcatttcgttgcttataccctcaggcactgaggacattagctagtatatgctgcgtggaagagggggtgcatcaactagagaaggtcgacggcgtgctatgccttgctgacatcctgactgacaatagtcatagcgaggcgactcgagcggaggcagcggccgtggttgcccaggtgaccagcccccacttacctgtgactcaacacctgtcctctttccttgagagcatggaggagattgtgacagccctggtgaagctatgtcaggaggcgtcctccggtgaggtatttctgctggcctctgcagctctggcgaacatcaccttctttgacactatggcgtgcgaaatgctgctccagctaaatgctatccgagttctgctggaggcttgttcagacaagcagcgcgttgacacaccctacactagagaccagatcgtcactatcctggccaatatgtcagtgctcgagcagtgtgcctccgacatcatccaggaaaatggagttcaactgataatggggatgctatccgagaaacccagatctggaacacccgccgaggttgcagcatgtgagcgggtacagcagaaagccgccgtcacccttgctcgtctgtccagagatcccgacgtcgcaagagaggctgttagactatcctgtatgtcccgtctaattgagctgtgcaggagtccaagcgaacggaactccagcgacgccgtgttggtggcctgtcttgcggcattgagacgcttggctggagtgtgcccagaaggcctccaggatagcgactttcagcaactcgtccagccccggttagtcgactcattcctcctgtgttcgaatatggaggaatcatttgtttag

SEQ ID NO: 191490 - DNA, 834 bp, Artificial Sequence
  Description of Artificial Sequence: Synthetic coding sequence
atgccccggctgcacgaccacttctggagctgcagctgcgcccactctgcacggcggaggggcccccctcgggcgtcagccgctggtctggctgcgaaggtgggcgaaatgatcaacgttagcgtatctgggccttccctgctagccgcccatggggctcccgacgccgaccctgcccctcgaggccgctccgccgctatgtctgggccagaaccaggctccccttatccgaacacctggcaccatcgtttgctccaaaggtccctggtgcttttttcggttggggtggtcttggcgctggtgttaaacctcctacagatacaaaggaacgtaacactgttcccagaggaggtcatagctacaatcttctcaagcgcctggtgggtccctccctgttgtggaacggcagccgccgtcgtcggtttgctatacccttgcatcgattcacacttgggggaaccacataaattcaagagggagtgggcgtctgtaatgcgctgtatcgcagtctttgtagggataaatcacgcatctgccaagctggatttcgccaacaatgtgcagttgtccctaactctggcagcattatccctgggcttgtggtggacattcgaccgcagccgctccgggctcgggctggggatcactatagcattcctggcaacattgattacgcagtttctagtctataacggagtttatcagtataccagccccgatttcctgtacataaggtcctggctcccctgcattttctttagcggaggcgtgaccgtgggtaacataggaaggcagctggctatgggtgtgccagaaaagcctcacagcgattag

SEQ ID NO: 191491 - DNA, 537 bp, Artificial Sequence
  Description of Artificial Sequence: Synthetic coding sequence
atgccccggctgcacgaccacttctggagctgcagctgcgcccactctgctagacgacgcggaccgcctagggcttctgccaaacttgactttgccaataacgttcagctttccttgaccctcgccgccctgagcctgggattgtggtggacattcgaccggtcacggtcaggcctggggctggggatcacaatcgcctttcttgcaacactcatcacccagttcctggtgtacaatggggtctatcaatatactagccccgacttcctctacatccggagctggctgccatgtatattcttcagcggaggagtcacagtgggaaatatcgggagacagttggccatgctgatccctttttgcgaagagctgaatctgaagactacttggctgtttcacaagactcgttccaactatagggtgttccttaagtcaccaatcgtaattgagagctcgaagccaccaatcctgagggcacgtaagatcctcgaggaaaacctcacagtggactacgacaaagattatttattttcatag

SEQ ID NO: 191492 - DNA, 372 bp, Artificial Sequence
  Description of Artificial Sequence: Synthetic coding sequence
atgccccggctgcacgaccacttctggagctgcagctgcgcccactctgccagaaggcgcggcccacctagagccagtgctgcaggtcttgcggctaaagtgggcgagatgatcaacgtgtcggtttctggtccctctctgctcgccgcccatggggctccagatgccgatccagcaccgcgcggcagatccgctgccatgagtggcccggagcccgggagcccatacccgaacacctggcatcacaggcttctgcagcgctccctggtgttgttttctgtcggcgttgttctagcgctcgtgcttaatcttctccagattcagagaaatgtgaccctcttcccagaggaggtaattgccaccattttttag

SEQ ID NO: 191493 - DNA, 495 bp, Artificial Sequence
  Description of Artificial Sequence: Synthetic coding sequence
atgccccggctgcacgaccacttctggagctgcagctgcgcccactctgctaggcggcggggcccacctagggcctccgccgcggggttggctgctaaagtgggcgagatgatcaacgttagtgtgagtggtcccagcctgctggcagctcacggcgcgccagatgctgacccagctcctcggggccggtccgcggccatgtccggtcctgaaccgggttccccttacccaaatacatggcaccatagactgctgcagcggagtctggtgctgttttccgtcggagtggtactcgcactggtactcaacctgttgcaaatccaacggaacgtgacactcttccctgaagaagtaattgccactatcttttccagcgcatggtgggtgcccccgtgctgtggaacagcagccggcatccacccgcagatttccagtatcttcgttctcgggagcttggtctatttctcacaagaggcctcccggtggggcacctag

SEQ ID NO: 191494 - DNA, 678 bp, Artificial Sequence
  Description of Artificial Sequence: Synthetic coding sequence
atggccgagggcgagaccgagagccccggccccaagaagtgcggcccctatatctcctccgtcacttcccagagcgtgaatctcatgatccggggagtagttctgttcttcataggggtgtttctcgccctcgtgctgaatcttttgcagattcagcgaaacgtgactctgttccctccagacgtgatagcctcaattttctcttccgcttggtgggtgccaccatgctgcggtaccgcgtcagccgtcatcggactgctgtacccatgcattgaccgacatcttggcgaacctcacaagtttaaacgagaatggtcctctgtgatgagatgcgttgcggtgttcgtcgggatcaaccatgcctctgcaaaggtggatttcgataacaatattcagctctcactgacattggcggccctgtctatcggactttggtggactttcgatcggtcccgcagcggtttcggtctgggagtgggtatagcattccttgccacggtggttacccagcttctcgtgtacaatggtgtttaccagtatacgtcccctgacttcctctatgtgcgaagttggctgccctgtattttttttgcggggggtatcaccatgggtaatatcggacgccagctggcaatgtatgaatgcaaagttatcgccgagaagagtcatcaagaatag

SEQ ID NO: 191495 - DNA, 4149 bp, Artificial Sequence
  Description of Artificial Sequence: Synthetic coding sequence
atggccaccggcggccggcggggcgccgccgccgcccccctgctggtagccgtcgccgcattactgctgggagcagcagggcatttatatcctggagaggtctgtcctggaatggacatccggaacaacctgactcgtctgcatgagttggagaattgtagcgtgatcgaaggccatctgcagattctgctgatgttcaaaacccggcctgaagacttccgcgatctcagttttccaaagctgatcatgataaccgactatctactcttgtttcgcgtgtatggtctcgagagccttaaggatctttttcctaaccttacagtgatcaggggctctcgcttgtttttcaattacgccctggtgatcttcgaaatggtgcacctgaaggagctgggtctctacaatctcatgaatataactcgaggaagcgtgcgtatcgagaaaaacaatgaactgtgctacctggcaacaattgattggtctaggattttagacagcgtggaggataattatatagttttgaacaaggacgacaatgaggagtgtggagacatctgccctggcactgctaaaggcaagacaaattgtccggcaacagttattaacggacaatttgtggaacggtgctggacgcattcacactgtcagaaggtttgtcccaccatttgtaaaagccacggctgtaccgctgaaggcttgtgttgtcacagcgagtgcctgggaaattgctctcaaccagacgacccaacaaaatgtgtggcatgtagaaatttctaccttgatggacggtgcgttgaaacatgcccaccgccttattatcatttccaggactggaggtgtgtgaatttttcgttctgtcaggacctccaccacaagtgcaagaactcacgcaggcagggatgccaccagtatgttattcacaacaataagtgtatccccgaatgcccttccggctatacaatgaatagttctaatctgttatgcaccccttgtctgggaccctgccccaaagtttgtcacctgctggagggcgaaaaaaccattgatagtgtcacttctgcacaggaactccgggggtgtacggtcatcaatggcagccttatcatcaatatccgaggaggtaataaccttgcagcagagcttgaggccaacctcggcttgatagaagaaattagcggatacctgaaaattcggaggagctacgccttggtctccctgtcttttttccggaaattgcgattgatcagaggggaaactctcgaaatcggcaattactccttctacgccttagacaatcaaaacttgagacaactatgggattggtccaagcacaacctgacaatcacccagggtaaattgttctttcactacaatccaaagttgtgtctctctgagatccataaaatggaagaggtttcgggtacaaagggtagacaggaaaggaacgatatcgctctgaagacaaacggcgaccaggcaagctgtgagaacgagctcctgaagttcagctatattcgcaccagcttcgataaaattttattgaggtgggaaccttactggcctcctgacttccgggatctgctgggattcatgctgttttataaagaggctccctatcagaacgtcaccgaattcgacggtcaggacgcctgcggttcgaactcatggacggttgtggacatagatccccccctccggtctaacgatcctaaatctcagaatcaccctggctggctgatgcggggtttaaaaccttggacgcagtacgctatattcgtgaaaactttagttacgttttccgacgagcgtagaacttatggcgctaaatccgatataatttatgtacagactgatgctactaacccatctgtgcctcttgacccgataagcgtatctaactcatcctctcagatcatcctcaaatggaagccaccctcagatcccaacggcaatataacacattacctggtcttttgggaacgccaggctgaggactctgaattatttgaactcgactactgtctgaaggggctgaaactgcccagtcgcacttggagcccgccttttgagtccgaagactctcagaaacacaaccaatccgagtacgaggatagcgccggcgagtgctgttcctgtccaaagaccgacagccagatactgaaggagctcgaagaatctagcttccgcaaaacatttgaagattatcttcataatgttgtgtttgtcccgaggaaaacctcatcaggtacaggtgcagaagacccaagaccctctaggaagcgacggtcattgggggatgtgggcaatgttacggtagccgtccctactgtcgccgcatttcccaatacttctagcacttctgtgccgacttcgccggaggaacatcgcccctttgagaaggtcgtgaataaagagagccttgttatctcaggtcttaggcacttcaccggatacagaattgagctgcaagcttgtaaccaggatacacccgaggagaggtgtagcgtggccgcctacgtgagcgctaggacaatgcccgaagccaaagcagatgatatagtaggcccagtaacacatgagatcttcgagaacaatgttgttcatctcatgtggcaggagccgaaagaacctaacggcctcatcgtgctgtatgaggtgtcgtatcggcgatacggagacgaggagttgcacctgtgtgtgagccgcaagcactttgccctcgaaagaggctgtcggctgcgaggtttgtcacctggaaattatagcgtcaggatccgagctacgtccctcgctggtaatggctcctggacagaacctacatacttctatgttaccgactatctggacgttcccagcaacatcgccaaaatcattatcgggccactgatcttcgtattcctgtttagcgtcgtcatcggcagtatctatttatttctgcgcaagagacagccggacggacctctggggcctctatatgccagctccaatcccgaataccttagtgcatccgatgtatttccttgttctgtgtatgtgccagacgagtgggaagtctcacgcgagaagatcactctactacgagaacttggccaggggtctttcggcatggtgtatgagggaaacgcgcgcgacatcatcaagggagaggcagaaacgcgagttgcagtcaaaacagtaaacgaaagtgcctctttacgcgagaggattgagttcctcaatgaggcctccgtcatgaagggtttcacctgccatcatgtcgtacggttattgggagtggtatctaaaggtcagcccacactcgtggttatggagctgatggcgcatggcgatcttaaatcttacctgagatctctgagacctgaagccgagaataacccgggtcgccctcctcctacgctccaggaaatgatccaaatggcagcagaaattgctgatggcatggcctacttgaacgcaaagaagttcgttcaccgggatttagcagcaagaaactgcatggtcgcccacgacttcacggtgaagatcggagattttggcatgacacgcgatatatatgagaccgattattaccgcaaaggtggaaaaggactgctgccagtgcgttggatggcaccagagagtttgaaagatggcgtctttacaacgagctctgacatgtggtccttcggcgtcgtgctgtgggagatcacaagcctggcagagcagccataccaaggtctatccaatgagcaggtgcttaagtttgttatggatggcggatacctggatcaacctgataattgccccgagagagtcacggatctgatgcgtatgtgctggcagtttaatcctaagatgcgcccgacattcctcgagattgtgaacctgctgaaagatgatctgcatccgagcttcccagaggtcagcttttttcattcggaggaaaacaaggcccctgaatccgaggaattagaaatggagttcgaggatatggaaaacgtgccacttgatagatctagccattgccaacgtgaggaagccggggggcgtgatggaggcagcagcttgggcttcaaacgcagctatgaggagcacatcccttacacccacatgaatgggggcaagaaaaatggaaggatcttgaccctgccaaggagcaacccaagttag

SEQ ID NO: 191496 - DNA, 4113 bp, Artificial Sequence
  Description of Artificial Sequence: Synthetic coding sequence
atggccaccggcggccggcggggcgccgccgccgcccccctgctggtggccgtggcagccctgctactcggcgcagccggacacctttatcctggggaggtctgtccagggatggatatacggaacaaccttacacgtctccatgagctggagaactgctccgtcatcgaagggcacctccagatcctgctgatgtttaagactcgccccgaagattttcgcgacctgagcttcccaaaattaataatgattaccgactatctgctcctcttccgggtgtatggcctggagagtttaaaagacctatttccaaacctgacagttattcgggggagcagactgttttttaattacgctctggtcatcttcgagatggtccatttaaaagagcttgggctctacaatcttatgaacatcactcggggtagcgtgcgtattgaaaagaataacgagctttgttatctggctaccattgattggtcaagaattctggatagcgttgaagacaattacatcgttctgaataaagacgacaacgaggaatgcggagatatttgtcccggaacggccaaggggaaaaccaattgtccagccactgtcatcaatggccaattcgttgagagatgttggacccattcacattgtcagaaagtgtgtcctactatttgtaaatcacacggctgcacagccgagggtctctgttgccattccgaatgtctcggaaattgctcgcagcctgacgatccaacgaagtgtgtcgcttgtagaaacttttacctcgatggacggtgtgtcgaaacttgcccccccccatattatcacttccaggactggcggtgtgtgaatttttccttttgccaggatcttcaccataaatgtaaaaatagcaggcgtcaggggtgccatcagtatgtaatccacaataataagtgtataccagaatgccccagtgggtacactatgaactctagtaacctgctatgcactccctgtttgggtccttgcccgaaggtctgccacctgttggagggggagaagacaatcgacagtgtgactagcgcccaagaattgcgtgggtgtaccgtcatcaacggctccctaattattaatatccgagggggcaataacttggctgccgagcttgaggctaacctgggtctgatcgaagaaattagtgggtatctgaagataagaaggagttatgcgctggtcagccttagtttctttaggaaactcaggttgattaggggagagacacttgagatcgggaattactcgttttatgccctggataatcagaacctgcgccagctgtgggactggtcaaaacacaatttaacgattacccagggaaagttgttcttccactataacccaaaactctgtctgtctgagatccacaagatggaagaggtgtcgggcacgaaaggacgacaggagaggaacgatatagcgctaaaaaccaatggagatcaagcttcctgcgaaaatgagctgctgaagttttcctacattcggacttcttttgacaaaatcctattacggtgggagccttattggccccccgatttccgggacctgttgggcttcatgctgttttataaggaagccccttatcagaatgtaacagaatttgacgggcaggatgcctgcggttctaacagttggactgtcgtcgatatcgatcccccccttcgctcaaatgaccctaagtcacaaaatcatccagggtggctgatgaggggcctgaagccttggacccaatatgccatctttgtgaaaactctcgtgactttctccgacgagagaaggacatacggcgccaagagtgacattatttatgtgcaaaccgatgccaccaatcctagtgtgcccctcgatccaatttctgtcagcaatagttcttcgcagatcatcctgaagtggaagcccccgagcgatcccaatggcaacatcacccactacctggtattttgggagcgccaggctgaagactctgagctctttgagctcgactattgtctgaagggcctaaagttgccctcaagaacctggagtccccccttcgagtctgaggattcccagaaacacaaccagtctgagtatgaggacagtgccggtgaatgctgctcatgcccaaaaaccgattctcagatcctgaaggaactggaagagtctagttttcgaaaaactttcgaggattacctgcataacgtagtgtttgtgcctcgaccctctagaaagaggcgctctctaggagacgtgggtaacgtgacggttgccgtgccaacagtagccgcctttcctaatacatcatcaacgagcgtgcctactagccctgaggagcaccgccccttcgagaaggtagtgaataaagagtccctggtgatctctggtcttcgacactttacgggatatagaattgagctgcaggcatgcaatcaggataccccggaggagagatgtagtgtggctgcctacgtgtccgcccgcactatgcccgaagcaaaggccgacgatattgtcggccccgtgacacacgagatttttgaaaataatgtagtgcatctgatgtggcaagaacctaaagagccaaatggactgattgtcttatacgaggtatcctatcgtcggtatggggacgaggagctgcacctgtgcgtgagtagaaaacacttcgcacttgaaaggggatgtagacttcgagggctcagtccgggaaactattcagtgaggattagagctacttcacttgctggcaacggctcctggaccgagccaacctacttttatgtgacggactatctggacgtgccgagcaatatcgcaaaaataataattggacctcttattttcgtgtttctgttcagtgtggtgatcggaagcatctatctatttctcagaaagcgccagcccgacggccctctcggccccttatacgcatctagcaacccagagtacttatctgcctccgatgtcttcccctgcagtgtttatgttcctgatgagtgggaggtatcacgtgagaaaataacactgctgagagagcttggtcagggtagcttcgggatggtctacgagggaaatgcccgcgatataatcaaaggagaggccgagacgagagttgctgtgaagaccgtgaatgaatctgccagcctacgggagagaattgaattcttgaatgaggcaagcgtgatgaagggtttcacttgccaccacgttgtacgcctgttgggtgtggtcagcaaagggcaacctactctggtagtgatggagctgatggcccatggggacttgaagagctacttgcgaagcttgagacctgaggctgaaaataacccgggacgtcctccccctacacttcaggagatgatccagatggccgcagaaatcgcagacggtatggcatacctcaacgcaaagaagtttgttcacagagacctagccgcccggaactgcatggtggctcacgattttacagtgaagattggtgattttggcatgacaagggacatatatgagacggactactaccgcaaaggaggaaagggattactccctgttaggtggatggcgcccgagtcattaaaggatggggtcttcacgaccagctccgacatgtggtcgtttggtgtggtgctgtgggagattacaagccttgccgaacaaccttaccagggcctgtctaatgagcaggtgttgaagttcgtcatggacggaggatacctggaccagcccgataattgtcccgaaagggttacagatctaatgcgcatgtgctggcagtttaatcctaagatgagaccaactttcctcgagattgtgaacctcctgaaagatgacttgcatccctcctttccggaagtaagcttttttcatagtgaggaaaacaaggccccggagagcgaggagcttgagatggagttcgaggacatggaaaacgtgcctctggaccgttcctctcactgtcagcgggaagaggcaggtggcagggacggcgggtcatccctgggctttaaaaggagctatgaggagcatattccttacacccatatgaacggaggcaaaaaaaatggccgaattttgactctgcccagatccaatcctagttag

SEQ ID NO: 191497 - DNA, 252 bp, Artificial Sequence
  Description of Artificial Sequence: Synthetic coding sequence
ccctaccagaacgtgaccgagttcgacggccaggacgcctgcggctctaattcctggacggttgtggacatcgacccgcctctgaggagcaacgaccccaagtctcaaaaccatcccggctggttaatgagagggctcaagccttggactcagtacgcaatatttgtcaagacactggtaacatttagcgatgaacggcggacctatggagcgaagtcggacataatctatgtccagaccgacgcaacatag

SEQ ID NO: 191498 - DNA, 4017 bp, Artificial Sequence
  Description of Artificial Sequence: Synthetic coding sequence
atggccagccccccccggcacggcccccccggccccgccagcggcgacggtcccaatctcaataacaataacaacaacaacaaccattcggtgcgcaaatgtggctatcttcggaagcaaaagcacggacacaaaaggttcttcgttcttagaggcccaggggccggtggtgatgaagcaaccgctgggggggggtctgcccctcagcccccccgcctcgaatactatgagagcgaaaagaaatggcgatcaaaagccggtgcccctaagcgcgtgatcgctttggactgttgtctgaacattaataagagagccgatgccaagcacaaatacctgatcgccctgtacacgaaggatgagtactttgcagtagccgctgagaatgaacaggaacaagaaggctggtatagagcactgactgatttggtttccgagggtcgcgccgcggcaggggacgccccgccggcagccgccccagccgcctcttgcagcgccagtctgccaggcgcattgggtggctcggcaggagctgcaggcgccgaggattcctacggtctcgtggcacccgcgactgcggcctacagggaagtgtggcaggtcaatctcaagccaaaggggctggggcagtccaagaacctgacaggtgtgtatcgtctttgcctgagtgcccgaaccatagggtttgtcaagctcaattgcgagcagccttctgtgactctgcaactgatgaatatccggcgttgtggacacagtgattcattcttcttcattgaggttggccgctctgcagtgacgggaccaggtgagttgtggatgcaggctgatgatagcgttgtggcgcagaatatacacgaaacgatccttgaagctatgaaggccctcaaggaactgttcgagttcaggcccagatctaagagtcagtcttctggatcatccgctactcatccaatttcagtgccgggcgctaggagacaccatcatttggtgaaccttcccccatcacaaactggcctggtgaggaggagccggaccgactcactggctgcgaccccccccgccgccaagtgttccagttgcagagtgcgaaccgccagcgaaggtgatggaggcgccgcggctggggctgctgctgctggggcaagacctgttagcgtagccggcagccctctgtctccgggtcccgtccgggcgcctttgagcaggtctcatactctgagcggcggctgtggcggacgcggatcaaaagtggccctcctgcccgctggcggtgctctgcagcactctaggtccatgagtatgcccgtggcccattcccctcccgctgccaccagtccgggtagcttaagcagttcctctggtcacgggtcaggtagttatccaccacctccgggcccacatccgccactgccccaccctttgcaccatgggccagggcagcgccctagctcgggatctgccagcgcctccggatccccctctgatcccggttttatgtcgcttgatgagtatgggagctcaccgggagacctgcgtgcattctgcagtcatcgaagtaatactcctgaatccatagcagaaacacctcccgcaagggatggtggggggggaggcgagttctatgggtacatgacaatggatcgcccattatcccactgtggcagaagttaccggagagtgtcaggggatgcagcacaggacctagatcggggcttgcgaaagcggacatattcattgactacccccgctcgtcagaggcccgtgccacagccatcaagtgcgtccttggatgagtatacattaatgcgggcaactttttctggcagtgccggcagattgtgccccagctgtcccgccagcagccccaaggtagcttaccacccttatccggaagattacggggatatagagatcggctcgcaccggtcttcttcctcgaatctgggagccgacgacggttatatgccgatgaccccgggcgccgcccttgccggttccggatcgggaagctgtcgctccgacgattacatgccaatgagtccagcttctgtctccgccccaaaacagattctgcaacccagggccgccgcagcagccgcagccgccgtaccgtcagccggaccagctggaccagcccccacatcagccgctgggaggacctttcctgctagcggggggggatacaaggcttcttcccctgccgagagttccccagaagatagcggttacatgaggatgtggtgcggaagtaaactgtcaatggagcacgccgacggtaagcttttgccgaatggcgattacctaaatgtcagtccgtccgacgccgtgaccacgggcacaccccctgattttttctcagcagccctccatcccggcggcgagcccttaaggggagtgcctgggtgttgctattctagcctgccacgatcgtacaaagctccatacacttgcgggggggactccgaccagtacgtcttgatgagctccccggtgggtaggatcctggaggaagagaggctcgaaccacaggccactcccgggccttcacaggcggcgtcagcctttggcgccggcccgactcagcccccgcatccagttgtgccctccccagtgcggccgtctgggggacgacccgagggttttcttgggcagagaggacgggctgtgagaccaacacgcttgagtctagaggggctgccttctttgccttctatgcacgagtacccactgccccccgagccaaaatctcccggcgaatacatcaacattgactttggggaacctggagcccgactctctcctcctgctcctccactcctcgcaagtgcggctagttcaagttctctgttatctgctagctccccagccagctctctcgggagcgggacaccaggcacgtctagtgactccaggcagaggtcccctttgagcgattatatgaatctggatttcagctcgcccaagtcacccaaacccggcgctccttcgggtcatccagtcgggagcctggacggcctgctttccccagaagcttcatctccttatccccccttgcctcctcgcccttctgccagcccctcatccagcctgcagccaccaccccctcctccggctccgggtgagctgtacagactgccccctgcaagcgctgtggctactgcccaaggaccaggcgccgcgtcaagtttaagttctgacaccggcgataatggggactatactgaaatggccttcggagtcgctgctacaccgccgcagcctattgcggcccctccgaagcccgaagccgccagggtggcctcacccacatcgggcgttaaaaggctgagtctgatggaacaggtgagtggcgtggaggccttcctccaagcctcccagcctccggatcctcaccggggcgcaaaagtgattagagccgatccccagggcggacggaggcgccactcctcggaaaccttttcttccacaaccacagtgactcccgtctcacctagcttcgcccacaacccaaagagacataatagcgcctcagtggaaaatgtgagtctgaggaagtcaagtgaggggggggtgggtgtgggtcccggcggcggcgacgaaccacccacatcccctcgccaattgcaaccggctccccccttagcaccccaaggcagaccatggactccaggacagcctggcgggctcgtaggatgtccaggctctggaggttccccaatgcggagagagacgtccgcgggctttcagaatgggctcaactatatcgctatcgacgtgcgtgaggaaccaggcctgcctccacagcctcagcctccccctccccctctgccacagcctggtgacaaaagttcttggggcagaactagatctttggggggactgatctcggccgtgggcgtgggaagcactgggggcgggtgtggcggtcccggaccaggcgcactcccccctgcgaatacctacgcttcaattgactttctctcacaccacctgaaagaggcaaccattgtcaaagagtag

SEQ ID NO: 191499 - DNA, 3894 bp, Artificial Sequence
  Description of Artificial Sequence: Synthetic coding sequence
atggccgtgcccagcctgtggccctggggcgcctgcctgcccgtgatcttcctctctcttgggttcggcttggatacagttgaggtttgtccctccctggatattagatccgaggtggccgaactgcggcaactggaaaattgctccgtggtcgaaggccacctgcaaatattgctgatgttcacagccacaggtgaggactttcgtggattgagtttcccgcgtctgacacaagtgactgactatctgctgctgttccgcgtgtatggactggaatctctgcgggatttgttccctaatctcgctgtgattaggggaacacgactgttcctagggtacgctttagttatctttgagatgccacacctgcgtgatgtggctcttcctgctctgggggccgttttacgcggcgcagtcagagtggagaaaaatcaagaattgtgccacctgagcaccatagattggggcctgttgcagccagctccaggggcaaatcatatcgttgggaacaagctcggcgaggagtgcgctgatgtctgtccaggtgtgcttggagcagctggggaaccttgcgctaagaccacattttccggacatactgattatagatgttggacgtctagccactgccagcgcgtttgcccctgcccacacggaatggcttgtactgctaggggagagtgttgccatactgagtgccttgggggttgcagtcagcccgaggatccccgggcatgcgtagcctgccgacacctctactttcagggcgcctgtctgtgggcttgcccccctggtacctatcaatatgagtcatggagatgtgtgactgcagagagatgtgcgagtcttcattctgtgccaggccgcgcttcaacatttgggattcaccagggatcatgcctggcacagtgcccgtctggatttacacgtaactcctcttcaattttctgtcataagtgtgagggcctctgtccaaaagagtgcaaagtcggcacaaagaccattgatagcatacaagctgctcaggatctcgttgggtgcacgcacgtggaaggttcattaattctgaatctgcgtcaaggctacaatcttgagcctcaactgcagcacagtctgggtctcgtggagaccattaccggtttcttgaagatcaaacattcgttcgctctggtctcgctgggctttttcaagaatctgaagctgatccgcggagacgccatggttgacggaaactatacactgtatgtactcgacaaccagaaccttcagcagctgggttcatgggtagcggccggcttgactattcccgtgggaaagatctactttgcttttaaccccagactgtgcctggagcacatctaccgcttggaggaggtcaccggcacccgaggcaggcaaaataaagctgagatcaatccccgcaccaatggggatagagccgcgtgccagactcgcaccttgcggtttgtcagcaacgtgacagaagctgatcgcattctgttgcgatgggaaagatacgaaccgctggaggccagagacctcctgagtttcattgtgtactacaaagagagtccctttcagaacgcaacagaacacgtcggtcctgatgcctgcggcacgcaaagctggaacctgttagatgtggagttgcctttgagcagaacgcaagagcccggggtaactctggcctcactgaagccatggactcagtacgcggtcttcgtccgcgcaatcaccctcactactgaagaagattccccacatcagggcgcccagtcacccatcgtctacttgcgtaccctcccagctgctccaactgtaccacaggatgtcatttcaacctctaattcttcttctcatctgctagtccgctggaaaccccctacccagagaaatgggaatctgacctactacctcgtgctttggcaaagactagccgaggacggggacttgtacctgaatgattattgccatcggggattaagactgccgacatcaaacaatgacccacggtttgacggggaagacggagacccagaagcagagatggagtctgattgttgtccctgtcagcatccgccccctggtcaggtactcccgcccctggaggcccaggaagcatcattccagaagaagtttgagaatttcctacataatgccattacaatcccgatcagtccttggaaagtgacatctatcaataagagccctcagcgggacagcggccgacatcgtagagcggccggccccctgcgacttgggggcaattcatctgactttgaaatccaggaagataaggtgcctagggaacgggccgtgctctctggcttgcggcacttcacagagtaccgaatcgacattcatgcgtgtaaccacgcagctcacactgtagggtgctctgccgccacttttgttttcgccaggacaatgcctcatagggaagccgacggaatccctggcaaagtggcatgggaggcctcttccaagaactcagttcttctcaggtggctggagcccccggatccgaatgggctgatcctcaagtacgagataaagtaccggcggttaggagaggaagccacagtgctgtgcgttagcaggttaaggtatgccaaatttggtggtgtgcacttggcactcttgcctcccggcaactactctgctagggtccgggctacttctctagctgggaacggaagctggacagatagcgtagcattctatatactcgggccagaagaggaggacgctggaggactccatgtgttgctgacagccactcccgttggattaaccctattaatagtgctcgcggctctagggttcttctatggcaagaaacggaatcgcactttatacgcttcagtcaaccccgagtacttctctgcatccgacatgtacgtgccggacgagtgggaggtgccacgggagcaaatctctatcattcgcgagctgggccagggatccttcgggatggtttacgagggtctggcgcgggggctcgaggccggagaggaatccactcccgtggctttgaaaacggtgaatgaactggctagcccccgcgagtgcatagaattcctaaaggaagctagcgtcatgaaagcttttaaatgccaccacgtcgttagactgctgggtgttgtttcccagggccaaccgaccctggttataatggagctgatgacgagaggtgaccttaagagccacctgcggtcactgaggcccgaagccgagaacaaccctgggttacctcagccggcgcttggcgaaatgatccagatggctggagagatagccgatggcatggcttacctggcggccaacaagttcgtccatagggatctggcagcacgaaattgtatggtgtcacaggattttacagtgaagataggcgacttcgggatgacgcgggatgtctacgaaaccgactactacaggaagggcggcaaggggttactgccggtgaggtggatggcgccagaaagcctcaaggacggcatctttacaacccatagtgatgtatggtcatttggggttgtactctgggagatcgttaccttggcagaacagccatatcaaggcttgtcaaatgagcaggtgttgaagtttgtaatggacggaggcgtgctggaagaactagagggttgtccgctacagcttcaggagttaatgtcaaggtgttggcaaccaaacccaagattgagaccgtcatttacgcacattttggattccattcaagaagagctacgcccatcattccgcctcttgtcattttattatagccccgaatgcaggggggcgaggggttcgcttcccaccacggacgcggaacctgattcgagccctacaccgcgcgactgtagtccgcagaatggcggacctggacattag

SEQ ID NO: 191500 - DNA, 3060 bp, Artificial Sequence
  Description of Artificial Sequence: Synthetic coding sequence
atgcggtaccggctggcctggctgctgcaccccgccctgcccagcaccttcagaagtgtgctcggcgctcggctccccccccccgaaaggctatgcggatttcagaaaaagacctattccaagatgaataaccctgcaatcaagaggatcggaaatcacatcactaaatcacctgaggacaagcgtgaataccggggcttggaacttgcaaacggaattaaagtcctgcttatctctgaccctacgacagataagtccagtgcagcgttagatgtgcatattggcagtttgtccgacccccccaacattgctgggctctctcacttttgtgagcatatgctgttccttggaacaaagaagtatccgaaggagaacgaatactcccagttcctttcagaacacgcaggaagcagcaatgccttcacctctggtgagcatacaaactattacttcgatgtgtctcatgaacacttggaaggagcacttgatcgctttgctcagttcttcttgtgcccactgtttgacgagagttgcaaggacagagaggtgaatgcagtggatagtgaacatgaaaagaatgtcatgaatgatgcctggagactgttccagctcgagaaagccaccgggaacccaaagcacccattctcaaaatttggcacagggaacaagtatacgctggaaacccgacccaatcaggaagggatcgatgtgagacaggagctgctgaaattccacagtgcttactactcctctaaccttatggctgtgtgcgttctgggtagagaaagcctggacgacttgacaaacctcgttgtgaagcttttttccgaagtggagaacaagaatgtaccactccccgagttcccagagcacccttttcaggaagaacacttaaaacagctctataagatagtccccatcaaagacatccgcaacctgtatgtgactttccctataccagacctgcagaagtactataaaagtaatccagggcattacctgggccatctaatcggacatgagggccctgggagccttctgtctgagctgaagtcgaaaggttgggtaaacacgctcgtgggtggccaaaaagaaggtgcccgtgggttcatgttttttatcataaatgtggacctgactgaagagggcctgctgcacgtcgaagatatcatactacatatgttccaatacatccagaaacttcgcgccgaagggccacaggagtgggtgttccaggaatgtaaggatctgaacgcggtagcatttcggtttaaggacaaggaacgccctcgtggatacacgagcaagatagccgggatcctgcactattatcccctcgaggaagttctaaccgccgaatatctgcttgaagagtttcggccagacctgattgagatggttttggacaaacttaggcctgaaaatgtgcgcgtcgctattgtgtccaaaagctttgaaggcaagactgatagaaccgaggagtggtatggcacccaatacaagcaagaggcaatccccgatgaagtaatcaaaaagtggcagaatgcagatcttaacggaaagtttaagttgcctacgaagaacgagtttattccaacgaacttcgagattcttccactggagaaagaggctactccataccccgccctcattaaagatacagccatgtcaaagttatggtttaaacaggatgacaagttcttccttcccaaggcatgtcttaatttcgagttctttagtcctttcgcttatgtcgatcctctgcactgcaatatggcctacctttatttggaattgcttaaggatagcctcaacgagtacgcgtatgcagcagaactggcaggcttgagttatgatctgcagaatactatttacggcatgtacctctctgtgaagggatataatgataagcagccaatccttctgaaaaaaataatagaaaagatggccacctttgaaattgacgaaaaacgttttgaaataatcaaggaggcttatatgagatcactcaacaattttagagcagaacagcctcaccaacacgccatgtattacttgcggctccttatgaccgaggtcgcgtggaccaaggacgaactgaaagaagccctggatgacgtcaccctcccaagattgaaggcgttcattccacagctgctcagcagactacacattgaagctcttctgcacggaaatatcaccaagcaggctgcccttgggatcatgcagatggtggaggacacgttgatcgagcacgcccacacaaaaccactactgccttcccaattggtgcggtacagagaagtgcagctccccgatcgtgggtggtttgtgtaccagcagaggaacgaggtccataataattgcgggattgaaatttactaccagacagatatgcaatccaccagcgagaacatgttcttagaactcttctgtcagatcatttctgaaccatgctttaatactctgcgcaccaaagagcaactcgggtacatagtgtttagcggccctcggcgcgccaacggcattcagggcctcaggtttatcatccagtcagaaaagccaccacactatctcgagagtcgggtcgaggcattcctcattacaatggagaagtcgatcgaggacatgaccgaggaggctttccaaaaacatatccaagctctagcaatccggcgtctcgacaagcccaagaagctttcagctgaatgcgccaagtattggggtgaaattatttcacagcagtataattttgatcgggacaacacggaggtcgcatacttaaagaccctgacaaaggaggatattataaaattctacaaagagatgcttgccgtcgatgccccccggaggcataaagtatccgtacatgtgctggcacgggaaatggacagttgtcccgtggtgggggagtttccttgccaaaacgatatcaatctgtcccaggcccctgctcttccacagcccgaagtaattcaaaatatgaccgagtttaaacggggtctgcctctatttccccttgtgaaaccacacatcaacttcatggccgcaaaactgtag

SEQ ID NO: 191501 - DNA, 1395 bp, Artificial Sequence
  Description of Artificial Sequence: Synthetic coding sequence
atgagcaagctgtggttcaagcaggacgacaagttcttcctgcccaaagcttgccttaactttgagttttttagcccatttgcttacgtcgacccattacactgcaatatggcctacctgtaccttgagctcctgaaggacagcctgaatgagtacgcttatgctgcggaactggccggattatcatatgatctgcagaacaccatctacggcatgtatttgtccgtcaaaggctataatgataagcaacccatcctgctcaaaaaaatcattgagaaaatggcaacctttgaaattgatgaaaaaaggtttgaaatcatcaaagaagcctacatgcgatccctgaataacttccgtgctgagcagccccaccagcatgccatgtactatctgcgcctgctgatgactgaggtggcatggaccaaagatgaacttaaagaggccctcgacgacgtgacacttccaaggctcaaggcttttatcccccagcttctatctcgactccatatcgaagccctgcttcatggcaacatcaccaagcaggcagcattgggcattatgcaaatggtggaagataccttaatcgaacatgcccacacaaaacccctgttgccaagccaattagtgcggtatagggaagtgcagctccccgaccgcggctggtttgtataccagcaacgtaacgaggtccacaacaactgtgggatcgagatctattatcagactgacatgcagagtacttccgaaaacatgtttctggagctgttctgccagatcattagcgagccgtgtttcaacacactgcgtacaaaagagcagctcggttacatcgtatttagtggaccaaggcgcgcgaatggcattcaggggcttcggtttataattcagtcagaaaaacctccccactatctcgaatcaagagtcgaagcgttcctgattacaatggagaagtcaatcgaagatatgacggaggaagcttttcagaagcatattcaggccctcgcaatccggcggcttgataagccgaagaagctgagcgccgagtgtgctaaatactggggcgaaataatatcacagcagtacaatttcgaccgggataacacagaggtcgcttacctcaagacactcaccaaggaagacataataaaattttataaagaaatgctggcagttgacgctccccgtaggcacaaggtctccgtccacgtgctggctcgggagatggattcatgtccagtggtcggcgagttcccatgccaaaacgacatcaacctgtcacaggccccagctctgccacaacctgaggtgatccagaacatgaccgaatttaaaaggggactgccactctttcctcttgttaaaccgcatatcaatttcatggccgcaaaactgtag

SEQ ID NO: 191502 - DNA, 774 bp, Artificial Sequence
  Description of Artificial Sequence: Synthetic coding sequence
gagttcatcatccggggcggccgggtgcccagccactgcctgcacttttcaagatcttttcagaaaaaaacctacagtaaaatgaacaacccagccatcaagaggatcgggaatcatattacaaagtcgcccgaagataagcgcgagtataggggacttgaactggctaacggcatcaaggtcttgttgatttcagatcccaccaccgataagagcagcgctgcactggatgtgcatatcggcagcttgagcgatccccccaatatagctggtttgtcccatttttgtgaacacatgctattccttggcaccaagaaatatcccaaagaaaacgagtattcgcagtttctcagcgagcacgctggctcatcaaatgcgttcacttccggggagcacacaaattactactttgatgtgagtcacgaacacctggagggagccctggaccgcttcgcccagtttttcctgtgccccttattcgacgagtcttgtaaagatcgcgaggtcaatgcagtcgacagcgaacacgaaaagaatgttatgaatgatgcgtggaggctttttcaattggaaaaggccaccggaaatccaaagcacccgtttagtaaattcgggactggaaataagtataccctggagactaggcccaatcaggaaggaatcgatgttagacaggagctgctcaaatttcattctgcctactactcgtcaaacctcatggcggtatgtgtccttggccgcgagtccctcgacgatctcaccaacctcgtatag

SEQ ID NO: 191503 - DNA, 396 bp, Artificial Sequence
  Description of Artificial Sequence: Synthetic coding sequence
atggacccccggctgcccgcctgggccctggtgctgctgggccccgctctggtctttgctcttggccctgcaccaacacccgagatgcgcgaaaagctgtgtggccaccattttgttagagccctggtgcgggtatgtggcggcccgcgctggtcgacggaagcccgtcggcctgctaccggaggtgacagagaactgctgcagtggttagaacgcagacacttactgcacgggctggtcgcagattccaatttgaccctgggtcccggcctgcagccgctgccacagacttcgcaccaccacagacaccacagggctgcagccactaacccggctcgttattgttgtctgagcggctgtacgcagcaagacttactgactctgtgtccctactag

SEQ ID NO: 191504 - DNA, 474 bp, Artificial Sequence
  Description of Artificial Sequence: Synthetic coding sequence
atggacccccggctgcccgcctgggccctggtgctgctgggccccgcgcttgtgttcgccctggggccagctcccactcccgagatgcgggagaagctgtgcggccatcacttcgttagagccctggttcgggtttgtgggggtccgcgctggtctacagaggctagaagacccgccaccgggggggatcagagggaaagccattcagttagtcaagctggtctgaagctgcttagttcatcaaaccctccaactctgacgtttcagagcgttggcattagtgacgtctcatgctattcaggctggcgggacgacatctgctcaatgggctggtggcccaccgtgatttcgaggtgggacctggcctgctccccttgtccgaggccactaaccatcacggcaaccactgtacaactccctccgactctgcacgccactgctgcttctgtggctgtgccaaacaagacttgctag

SEQ ID NO: 191505 - DNA, 420 bp, Artificial Sequence
  Description of Artificial Sequence: Synthetic coding sequence
atggccagcctgttccggagctacctgcccgccatctggctgctgctatcccagctcctgagagagagcttggcggcagagctcaggggctgtggacctcgctttggcaaacacctgctgtcctactgccctatgccggagaagaccttcacaaccacccccgggggctggcttctcgagagtggaaggcccaaagaaatggtgtctacctctaacaataaggacggacaagccctggggaccacgagtgagttcatcccgaatctttctcccgaactgaagaagcctctctccgaaggacagccttcccttaagaaaattatactgtctaggaaaaagagatccggacgccataggtttgatcctttttgctgcgaggtgatctgtgacgatggaacatcagtgaagttgtgtacctag

SEQ ID NO: 191506 - DNA, 408 bp, Artificial Sequence
  Description of Artificial Sequence: Synthetic coding sequence
atgaagggcagcatcttcaccctgttcctgttcagcgtgctgttcgccatctccgaggtccgatccaaggaatccgtgcgcctgtgcggcctcgaatacatacggactgtgatatacatctgtgcatcaagcaggtggagaaggcaccaggagggcattcctcaagctcagcaggccgaaactggaaatagctttcagttgccccataaaagggagttttcagaggaaaaccccgcacagaacctgcctaaagtcgacgcatctggggaggatcggctctggggcgggcagatgcccaccgaggaactgtggaaaagtaaaaaacactccgtgatgagtaggcaggatctccagactctctgctgcacagacggttgtagcatgaccgacctaagcgccttgtgctag

SEQ ID NO: 191507 - DNA, 642 bp, Artificial Sequence
  Description of Artificial Sequence: Synthetic coding sequence
atgccccggctgctgcggctgagcctgctgtggctgggcctgctgctggtgcgcttcagcagggaactgagcgatatctctagtgctcgcaagctgtgcggaagatatctcgtgaaagagatagagaagttatgcggccatgcaaactggtcacagttccgttttgaggaggagactccattttcacgactcatcgctcaagccagtgagaaggtagaagcctactccccctaccaatttgagagcccgcagaccgcgagtcccgcgcggggacgtgggacaaatcccgtgtccacgagttgggaggaagcagtcaattcatgggaaatgcaatctctcccagaatacaaagacaagaaaggatatagccccctaggtaagacaagagaattcagcagcagtcataatatcaacgtgtacatacacgaaaacgcaaaatttcaaaaaaaacgccggaacaaaatcaagaccctgtcaaatcttttctggggccatcacccccagagaaagcgtaggggttacagtgaaaagtgctgtctcaccggatgtactaaagaggaactgtcgattgcctgtttgccttacattgattttaagaggctgaaggagaagaggtcctctctcgttacgaagatctactag

SEQ ID NO: 191508 - DNA, 1734 bp, Artificial Sequence
  Description of Artificial Sequence: Synthetic coding sequence
atgaacaagctgtacatcggcaacctgaacgagagcgtgacccccgccgacctagaaaaagtattcgctgaacacaaaatttcctattccggtcagtttttggttaagtccgggtacgcatttgtcgactgtcctgatgaacattgggcgatgaaggcaatcgagacctttagcgggaaagtggaactgcagggcaaacggctggagatcgagcacagtgtcccaaagaagcagcgctcaagaaagatccaaattcgtaacattcctccccaactgagatgggaagtgcttgactctctattggctcagtacgggactgtagaaaattgtgagcaggtgaataccgaaagtgaaacggccgtggtgaatgtgacttatagcaacagagagcagacccgacaggccatcatgaaactgaatgggcaccaactcgaaaatcacgccctgaaggtatcctatattcctgacgagcagatagcccagggacccgaaaacggccgtagggggggctttggctctcgcggccaaccaagacagggaagccccgttgcagcaggggcacctgcaaagcagcagcaggtagatatccctctgagactgctggtccctactcagtatgtgggcgccatcataggaaaggagggcgccacgatccgaaacatcacaaagcagacacagtccaaaatcgacgtgcatcggaaagaaaacgcaggggccgccgaaaaagccatttctgtccacagtaccccggaagggtgctcctccgcatgcaaaatgattctggaaatcatgcacaaagaagctaaggacacgaaaacagccgacgaggtaccactgaaaatacttgctcacaacaatttcgttggaagactgattggaaaggagggccgcaacctgaagaaggtggagcaggatacagagactaaaatcaccatctctagcttgcaggatttaaccctgtacaatcccgagagaaccattacagtcaagggggcaattgagaattgctgtagagcagagcaggagattatgaagaaagtccgggaggcatatgaaaatgatgtagctgccatgagcctccagagccatctgatccctgggctaaatctcgctgcagtagggctgttccccgcttcctccagcgccgtcccccctcctccgtcctcagttaccggcgccgcgccgtactccagtttcatgcaggcccctgaacaagagatggttcaggtgtttattccagcccaggccgtcggcgcaataattgggaaaaagggacaacacataaaacagctgtccaggtttgcctccgcatcaatcaaaatagcccccccagaaactcctgattcaaaggttagaatggtgattatcactggccctccagaagctcagttcaaggcccaggggaggatctacggaaaattaaaggaggagaatttcttcggtcctaaggaggaggtgaagttggagacccacattcgcgtgccagccagtgctgctggacgcgtgataggcaaggggggaaagactgtgaatgagttacagaatctcacagccgctgaagtcgtcgtgccgcgggaccagacacccgatgagaatgaccaggttatcgtgaagattataggtcacttttatgcaagccagatggcccagcgcaagattagggacatattggcgcaggtcaagcagcagcatcagaagggccagagcaatcaggcccaggccaggcgcaaatag

SEQ ID NO: 191509 - DNA, 1317 bp, Artificial Sequence
  Description of Artificial Sequence: Synthetic coding sequence
atgaacaagctgtacatcggcaacctgaacgagagcgtgacccccgccgacttggagaaagtattcgcggaacataaaatctcttactccgggcaatttctcgtgaagagcgggtatgcctttgtagactgtcccgatgaacattgggctatgaaggctatcgaaacctttagcgggaaggtcgagctgcagggaaagcggctggaaattgagcattctgtgccaaagaaacagaggtccaggaagattcagattcgcaacattccacctcagttacgctgggaagttctggatagccttttggcccagtacggaactgtggagaactgcgagcaggttaacaccgaaagcgaaacagccgtggtgaacgtcacatatagcaatcgtgaacaaactcgccaggccgacgaggtccctcttaagatactggcccacaataacttcgtcgggaggctgattggcaaggagggccgaaacttgaagaaggtcgagcaggatacggagaccaagattacaatctcttctcttcaggatctgactctgtacaatcctgagagaaccatcaccgtgaagggcgctatcgaaaattgctgtagggctgagcaggagattatgaagaaagtacgagaggcttatgaaaatgatgttgccgccatgtctctgcagagccacctgattcccggcctgaatttggccgccgtgggcctattccccgctagctcctccgcagtgccccctccgccgtcgtcagtcaccggcgccgcaccttattcctcattcatgcaagcccctgagcaggagatggtacaagtgtttatccctgcccaggccgtcggcgcaattatcgggaagaaggggcagcacatcaagcagttgtcaaggtttgctagtgctagcattaaaatcgcaccacccgagaccccggatagtaaggtcaggatggtaataatcacgggcccacctgaggcccagttcaaggcccagggacgaatatacggtaaactaaaggaagaaaattttttcggacccaaggaggaagtgaagcttgaaacccatatccgcgtcccagctagtgccgccggaagagtgattggtaagggaggaaaaactgtcaacgagctgcagaatctcacagctgctgaggttgtggtgcctagagatcagaccccggacgagaatgaccaggttattgtgaagataattggccatttctatgcatcacagatggcccagcgaaaaatccgggacatattggctcaggtgaagcagcaacatcagaaggggcaatctaaccaggctcaggccagacggaaatag

SEQ ID NO: 191510 - DNA, 1671 bp, Artificial Sequence
  Description of Artificial Sequence: Synthetic coding sequence
atgatgaacaagctgtacatcggcaacctgagccccgccgtgaccgcggacgatttgagacaactgtttggcgaccgaaaacttccactggcgggacaggtattgctgaagtccggatacgcctttgtcgactatcccgaccagaattgggccattcgtgccatcgagaccttgagtggaaaggtggaactgcatgggaagattatggaagttgactactcggtgagcaagaagttgcgctcacgcaagattcagatcagaaacattcctccccatctgcaatgggaggtactggatggcctcctcgcccagtacggaacagtagaaaatgtggaacaggtgaataccgatactgaaaccgccgtggtaaatgtgacttacgcaacccgggaggaggccaagattgctatggagaaacttagtgggcatcagtttgaaaactattctttcaaaattagttacattcccgatgaagaggtctcatccccttctccccctcaacgcgctcagagaggcgaccattcttcaagggagcagggtcacgctcctggaggaacatcgcaagctaggcagatcgattttcccctacggatcttggtgccaacacagtttgtgggggccattatcggcaaggagggtctgacaattaagaatatcacaaagcagacacagtcgagggttgacattcaccgtaaagaaaacagcggagccgcggagaaacctgtgactatccatgctacacccgagggcacttctgaagcctgccggatgatcctggagatcatgcagaaggaagcagacgaaacaaagttggccgaggagattcccttgaagatcctggctcacaatggcctcgtggggaggctgatcggcaaagaggggaggaatctaaaaaagatcgagcatgagaccggaaccaaaattacgatcagctctctacaagatctgtctatttataatcctgaacgcactattacagtgaagggtacagtagaggcctgtgcctccgccgagatcgaaataatgaaaaagcttcgtgaggcttttgaaaacgatatgctagctgtgaacacacattcaggctatttcagctccctttatccccaccatcagtttggcccctttcctcaccaccacagctatcccgaacaggaaattgtgaacttatttatacccacacaggcagtcggtgctataattggcaaaaagggtgctcatatcaagcagctggctagatttgcaggagcctctattaagattgccccagctgaaggcccagatgtgagcgaacggatggtgattatcacaggacccccggaggcccagttcaaagcacagggacggatctttggcaaactaaaggaggagaacttcttcaatcctaaggaagaagtcaagctcgaggcacacatccgggtccctagctcaaccgccggacgggtgatagggaagggggggaagaccgtgaatgaactgcagaacttgacctccgcagaagtgattgttccccgggaccagaccccagatgagaacgaagaggtgatcgtccggattataggtcatttcttcgccagccaaactgcacaaagaaagatccgcgagatcgtgcagcaggtgaagcagcaagaacagaagtatccccaaggcgtggcttcccagcgttcaaaatag

SEQ ID NO: 191511 - DNA, 1800 bp, Artificial Sequence
  Description of Artificial Sequence: Synthetic coding sequence
atgatgaacaagctgtacatcggcaacctgagccccgccgtgaccgctgacgatttgagacaactgtttggcgatagaaaattgccacttgcaggtcaagtgctgctgaagagcggatacgcctttgtggactaccctgatcagaactgggctattagggcaatcgaaactcttagtgggaaagtggagctgcatggcaagatcatggaggtggactactccgtgtctaagaagttgaggtcgcgaaaaatacaaattcgtaacatccctccacacttgcagtgggaagtattggacggattactagcgcaatacggtaccgtagaaaacgtggaacaggtgaacaccgacaccgagaccgccgtcgtgaacgtcacatacgccacacgggaggaagcaaagattgccatggaaaaactttccggtcaccagttcgagaactattcatttaagatatcctatattccagacgaggaggtgagttcccccagccctccccaacgggcccaaagaggagaccactcttccagggaacagggacatgctcccggggggacaagtcaggccagacagatcgattttcctctcaggattctggtgcctacccagtttgtaggagcaatcatcggaaaagaaggccttacgatcaagaatatcactaaacaaacacagtcccgcgtggatatccacaggaaggagaactctggtgcagccgaaaagccagtcaccatccacgccactccagagggcacctcagaggcttgcagaatgattttggaaattatgcagaaagaggcggatgagacaaaactagctgaagagatcccactcaagattctggcccacaacgggctggttgggcgcttaattggcaaagaaggaaggaatctcaagaagattgaacatgaaactggaacaaagatcacaatttcatctttgcaagacctttcaatctacaatcctgaacgtacaataacggtcaaaggcacggtagaggcttgcgccagcgccgagatcgaaattatgaagaaactgagagaggccttcgaaaacgatatgcttgcggtcaaccagcaggcgaacctcatccctggtctgaatctcagtgcactcggaatcttcagtacaggactcagcgtactctcaccacctgctgggccaaggggcgctccacctgccgccccttatcatccatttactacccattccggctacttttcttcactttatccacaccaccaattcggaccattcccacaccaccacagctaccccgagcaggaaatagtaaatttgtttataccgactcaagctgtgggggccatcattggaaagaagggagcccacatcaaacagctcgcaagattcgcgggggcgtccatcaagatagcgcctgctgaagggcccgatgtgtccgaaaggatggtgattatcactggaccacctgaggcgcagtttaaggctcaggggcgtatattcggcaaactgaaggaggaaaattttttcaacccaaaagaggaagttaaactggaagcacatatacgcgtgccttcttcaacagctggcagagtgatcggcaagggtggtaaaaccgtgaatgaactccagaatctgacaagcgcagaggtgatcgtccccagggatcagactcccgacgagaatgaggaggtcatagtgaggattatcggtcattttttcgcaagtcagactgcccaacggaagattcgcgagattgtgcagcaggtcaagcagcaggaacagaagtaccctcaaggagtggcctcccagcgctccaagtag

SEQ ID NO: 191512 - DNA, 1629 bp, Artificial Sequence
  Description of Artificial Sequence: Synthetic coding sequence
atgttcagctgccccggccactaccacgtggacggcttcctgaaccccgggtccaggaagatccagatcagaaatattcccccacacctgcaatgggaggtgctggacgggctgctggctcagtatggcactgttgaaaacgttgagcaggtcttcgccttctctcttgtgaacacagatacggagacagccgtcgtgaatgttacctatgccacccgggaagaggctaagatcgccatggagaagctgagcgggcatcaatttgaaaactactccttcaagattagctatatccctgacgaggaagtttcctcaccgagccccccacagcgcgcccagagaggcgaccactcatcacgtgaacagggacatgcaccgggcggcacttctcaagcgcggcaaatagacttcccccttaggatacttgtgccaactcagtttgtgggcgctataatcggcaaagagggactcacaatcaaaaatatcaccaaacagacccagagtcgcgtcgacatccaccggaaggagaattctggggccgcagagaagcccgtgaccattcatgccacacccgagggcactagcgaggcctgcaggatgatcctcgaaatcatgcagaaagaagcagacgaaacaaagctggcggaagaaattcctctgaagatcctggctcataacgggctagtgggaagactaatcggcaaggaaggaaggaacctgaagaagatcgaacatgaaactgggaccaaaattactatctcttcgctgcaggacttgagcatttacaacccggaaaggactataaccgtaaaagggacagttgaggcttgcgccagcgcagagattgagataatgaaaaaactcagggaggcttttgagaacgacatgctggccgtcaatcagcaagccaacttgataccgggacttaacttgagcgctctgggtattttctctacaggcctatctgtactgtccccacccgctggcccacgaggagctccacccgccgccccataccatcccttcacaacacacagcggttatttttccagcctgtaccctcaccaccagtttggccccttccctcatcaccacagttaccccgaacaagaaatcgtgaacctttttatcccaacccaggctgtgggggccatcattggtaagaagggggcacacattaaacaactagctcggtttgccggggcttccataaagatagctccagcggaggggccggacgtgtccgagcgcatggtgattataacgggtcccccggaggctcagtttaaggcccaaggcaggatatttgggaaactgaaggaggagaacttctttaacccgaaagaggaagtcaagctggaggctcacattagggtcccttccagcaccgcagggcgggtcattggaaaaggtggaaaaaccgtcaatgagctgcaaaacttaaccagtgctgaagtaatcgtgcccagagatcagaccccggacgagaatgaagaggttatcgtgcgcatcattgggcacttctttgcctcacagaccgcacagaggaaaattcgggaaattgttcagcaagtgaagcaacaggagcagaagtatccacagggcgtcgcaagccagcgttccaaatag

SEQ ID NO: 191513 - DNA, 1740 bp, Artificial Sequence
  Description of Artificial Sequence: Synthetic coding sequence
atgaacaagctgtacatcggcaacctgagcgagaacgccgccccctcagatctcgagtcaatattcaaagacgctaagattccggtgtcaggcccctttctggtgaagacgggttatgcctttgtggactgccccgacgaatcttgggcactgaaagcaattgaggccctctccggaaagattgagcttcatgggaagccaattgaagtagagcatagtgttcctaaacgtcagcgtatcagaaagctacagattcggaatataccgcctcatctgcaatgggaagtacttgatagcctgctggtgcagtatggggtggtcgaaagttgtgagcaggtaaacacagactccgagacggctgtagtgaatgtgacatacagttctaaggaccaggccagacaggccctggacaaattgaacggctttcagttagagaacttcacactcaaggtcgcctatattccagatgaaatggccgcccagcaaaatcctctgcagcagccgcgagggcgcagggggctgggacagaggggctccagtagacagggttcccctggcagtgtctccaaacagaaaccctgcgatcttcctctgaggctgctcgtccctactcaattcgtcggggctattattgggaaggaaggggccacaataagaaatatcaccaagcagacgcagtcaaagatagatgtacatcggaaggaaaacgcaggagctgccgagaagtccatcacgatcctttcaacccccgagggcactagtgcagcctgtaagtccatcttagagattatgcataaggaagcccaggacattaaattcaccgaggagatccccctcaagattctcgcccataataacttcgtggggaggctcattggaaaggaaggccgaaatctgaagaagatagagcaggataccgatactaagatcacgatttcacccctgcaggaattgacattgtataatcctgagagaactattacggtgaaaggcaatgtagagacctgcgccaaggccgaagaggagatcatgaagaaaattagagagagctatgaaaatgacattgccagcatgaatctgcaggctcatttgatccccggactgaatcttaacgcccttggactgttccctcctacctctggaatgcctccacccacatctgggccaccttcggccatgactcccccctacccccaattcgagcagtctgagactgaaaccgtccacctgttcattccggccctgtctgttggagccatcatcgggaaacagggacagcacatcaagcagctgtcccggtttgccggagcaagtatcaaaatcgcaccagccgaagcccccgacgcaaaggtgcggatggtaatcataacagggcccccagaggcgcagttcaaggcccaaggtagaatatacggaaagatcaaagaggaaaacttcgtaagccctaaggaggaggtcaaactcgaggcacatattcgcgttccttccttcgccgccggccgcgtgatcgggaagggcggaaagactgtcaacgaactacagaacctttcatccgcggaggttgtggtcccacgagatcagactcctgatgagaatgaccaagttgtggttaagataacagggcatttctatgcatgccaggtcgcccaaagaaaaatccaggaaattctgacacaggtcaagcagcatcagcagcagaaagcactgcagagcgggccaccccagtcccggaggaaatag

SEQ ID NO: 191514 - DNA, 7476 bp, Artificial Sequence
  Description of Artificial Sequence: Synthetic coding sequence
atgggcgccgccgccggccggagcccccacctgggccccgcccccgcgagaagaccccagcggagtcttctgctcctccagttgctgctgctggtcgctgcgcccgggtccacccaagcccaggcagcaccttttcccgagctgtgcagttatacctgggaggccgtcgacactaagaataatgtactgtataaaataaatatttgtggctccgtggatattgtgcagtgtgggccaagctctgccgtctgcatgcatgacctgaaaactcgaacatatcacagcgtgggggattccgtcctccgctcggctaccaggtcattactggagtttaataccaccgtaagctgcgatcaacagggaaccaatcacagagtgcaaagctccatagctttcctctgcggaaagacactagggacaccagaatttgtgaccgccaccgaatgtgtgcattacttcgaatggcgaacaacggctgcatgtaaaaaagacattttcaaggccaacaaggaagtgccttgttacgtgttcgatgaagaacttcgaaagcatgaccttaatccactgatcaaattgtcgggggcatacctggttgacgattcagaccccgacacttcactgttcataaatgtgtgtcgcgacattgatacattgcgtgatccagggtcacagctgcgcgcctgcccccccggcaccgctgcctgccttgtcagaggtcaccaagctttcgatgtcggtcaacctagagacggactcaagctggtgcgtaaggataggctggtgttatcttacgtacgagaggaggccggcaagctggacttctgcgacggccactcacctgccgtgactattactttcgtatgcccatctgagcggcgggagggtacaattcccaagctgaccgctaagagtaactgccgttacgagatcgagtggattacagaatacgcctgccacagagactatctggaatccaaaacctgctctctttcaggcgagcagcaggatgtcagcattgacctgactcccctggcccagtcgggcgggagtagctacatatcagacggaaaagagtatctcttctatcttaatgtatgcggcgaaacggaaatccagttctgcaacaagaagcaggctgccgtgtgccaagtaaaaaaatccgatacatcacaagtaaaggccgctggcaggtatcataaccaaaccctccgctacagtgatggagacctcacccttatttactttggcggagacgaatgttcttcaggatttcaaagaatgagcgtcatcaatttcgagtgcaacaaaacagctgggaacgacggcaaggggaccccagtctttacgggtgaagtagactgtacctattttttcacgtgggatacggagtacgcttgcgtgaaagaaaaggaagatctgctttgcggtgccactgatggaaaaaaaaggtatgatctcagtgccctagtacgacatgccgagccagagcagaattgggaggcagttgatggctcccagaccgaaacagagaagaagcatttcttcatcaatatttgccatcgcgtcctccaggagggtaaggccaggggctgcccggaagacgccgctgtgtgcgccgtggataaaaacgggagcaagaaccttggtaaattcatctcttctcccatgaaggaaaaaggcaacatacaactctcttattctgacggggatgactgcggtcacgggaaaaaaattaagactaacatcaccctggtttgcaaacccggcgacctggaatctgcaccagttttaaggacttctggcgaaggtggctgtttttatgaatttgagtggcatactgcggcagcctgtgtgctctcaaagacagagggggagaattgtacagtattcgatagccaagccgggttctccttcgatctgagcccgcttacaaagaaaaacggcgcctataaggtggaaacaaaaaagtacgacttttatatcaatgtctgcgggcctgtttccgttagcccttgccagcccgattcaggcgcttgtcaggttgcaaaatccgatgaaaagacttggaacctgggtttgagcaatgctaaactgagctattacgatggcatgatccaactgaactatcgggggggaaccccatacaataatgagaggcacactccaagggccactctgatcaccttcttatgcgatagagatgccggcgtggggttcccggagtatcaggaggaggacaatagcacttacaactttagatggtacaccagctacgcctgtcccgaggagcctttggaatgtgtcgtgaccgacccaagcactctggagcagtatgacttgagttccttggcaaagagcgagggcggcctcggcggaaactggtatgcaatggacaactcaggcgagcacgtaacttggagaaaatactacatcaacgtgtgtcgcccactaaaccctgttcccggctgtaaccggtacgccagcgcctgccagatgaaatacgaaaaggatcaaggaagcttcactgaagtggtgagcatctctaacctgggcatggcaaagactggccccgtggttgaggacagtggcagtcttctgctcgaatatgtgaatggatctgcctgcaccaccagtgacggcagacagacaacatacactactaggatccatctggtctgttcccgagggcggctgaatagccaccccattttttccttaaactgggaatgcgtggtaagtttcctgtggaatactgaggcggcctgccccattcagaccaccactgacaccgaccaggcctgcagcataagggaccctaactccggctttgtgtttaatttaaaccccctgaactcttcacagggctataatgtgtccgggatcggcaagatctttatgtttaatgtctgcggcaccatgcccgtatgcggtacaattcttggaaaaccagccagcggatgcgaagctgagacccagaccgaggagctgaagaattggaaaccggccagaccggtcgggatcgagaagtcgttgcagttaagtacggagggcttcatcactttgacctacaagggaccactttctgccaaggggacagctgacgcctttattgtgcgcttcgtttgcaatgacgacgtttatagcggacctctgaaatttctgcaccaagatattgactccggacagggaattcgcaacacatatttcgaattcgagaccgcactggcctgtgtccctagcccggttgattgtcaggtgaccgacctagccggcaatgaatacgacttgacagggctgtcgacagtcagaaaaccttggacggcagttgacaccagcgtggatggcaggaagcgcactttctatctctccgtgtgtaacccgttaccctacatcccgggttgccagggatcggcagtgggcagttgtcttgtgagcgagggcaacagctggaacctaggcgtggtgcagatgtctccccaggctgctgccaatggaagcctcagcataatgtacgtgaacggagataaatgtggcaaccaacggttcagcaccaggatcacatttgagtgtgctcagatctcaggcagccctgccttccagctccaggacggttgcgagtacgtgttcatctggaggaccgtcgaagcctgcccagtcgtgcgagtggagggagacaactgcgaggtgaaagaccctagacacggaaatctctatgacctgaagcccctggggcttaacgataccatcgtctctgctggagaatatacctactactttagggtatgcggtaagctgagctccgacgtttgccctacttccgacaaatcaaaagttgtaagttcttgccaggagaaaagggaacctcaagggtttcataaagtcgccggcctccttactcaaaagctaacgtacgagaacgggctgctgaaaatgaattttaccggcggagacacctgccataaggtgtaccagagatctactgccatattcttctattgcgatagggggacgcagcggcccgtgtttctcaaagagacttcagactgttcgtaccttttcgagtggcgcacccagtacgcctgccccccctttgacttgacggagtgctcgtttaaggacggtgccggtaattcttttgacctgtcttccctgtctaggtatagtgacaactgggaggctattaccggaacaggcgatcctgagcattatctgattaacgtgtgcaagtctcttgccccacaggctgggaccgagccatgcccacctgaagccgccgcttgtcttttaggtggctccaagcccgtgaacctagggagagtccgcgatggccctcaatggcgtgatgggattatcgtccttaaatacgtagatggggacctatgccctgacggaatcagaaagaagagcacaacgatccgttttacgtgctctgagtctcaggtcaacagccgtcccatgttcatttcagcagtcgaggattgcgagtatacgttcgcttggccgaccgctactgcttgccctatgaagagtaacgaacacgatgactgccaggtgaccaatccttccacaggtcatttattcgacctgtccagcctttccggacgggctggatttacagcggcctacagtgaaaaaggactagtgtacatgagtatttgcggagagaacgagaactgtccgcctggcgttggcgcttgctttgggcagaccagaatttctgtgggtaaagccaacaagaggctgagatatgttgatcaagtgcttcagttggtgtacaaggatgggtccccatgccccagcaagtctgggttgtcttataagtccgtcatctcattcgtttgtagaccggaggctcgtcctactaatcgacctatgctgatctccctggacaagcaaacatgtactctgttttttagttggcatacccctctcgcctgtgagcaggcaacagaatgcagcgtgcgcaacggcagctcaatcgttgatttgtctccactgatacaccgcaccgggggttacgaggcatatgatgagtccgaagatgatgcctccgacactaaccccgacttttacatcaacatatgccaacctctgaatcctatgcacggagtgccctgtccggcaggggcggcggtgtgcaaggtgccaattgatgggccgcccatcgacatcggccgcgtggctgggcctcccattctgaacccaattgctaacgaaatttacctgaattttgaatcgtcaaccccctgcctggccgacaaacactttaattacacatcgctgattgccttccactgcaaacggggagtgagcatggggacacctaagctgcttagaacgtccgagtgtgatttcgtgttcgagtgggaaacaccagtcgtctgccctgacgaagtgagaatggatggttgtacactgacagacgagcaactgctttattcattcaacttaagctctcttagcactagcactttcaaagtgacacgggactctaggacttattccgtgggagtgtgcacttttgccgtggggccggagcaggggggctgcaaagacggtggagtgtgcctgctgagcggaactaaaggggcttccttcggccggttacagtctatgaaattggactataggcaccaagacgaggccgtcgtccttagctacgtgaatggtgaccgttgtcccccggaaaccgacgacggcgtcccatgtgttttcccatttattttcaacggtaaatcttatgaggagtgtatcatagaaagccgggcaaaactctggtgttccactaccgcagattatgacagagatcacgaatggggattctgccggcactctaattcttaccgaacctcatcgatcatcttcaaatgcgacgaggacgaagatataggtagacctcaagtgttcagtgaggtgagagggtgcgacgtcaccttcgagtggaagacgaaggtagtgtgtccacccaagaagctcgaatgcaaatttgtgcaaaagcacaaaacctacgaccttagactcctctcttccctgacaggctcttggtcacttgtgcataatggcgtttcctattatattaacttatgccagaaaatctacaagggaccgttaggttgttctgagagggctagtatctgtagaagaacaaccactggcgacgtgcaagttctgggactggtgcatacacagaaactgggagtgatcggtgataaggtcgtggtaacatattcgaaaggctatccgtgtggaggcaataagactgcaagttccgtcattgaactcacctgtactaaaacggtgggtagacccgctttcaaaaggtttgatatcgacagttgtacatattatttctcatgggatagccgggccgcgtgcgctgtcaagccccaagaggtccagatggtcaacgggaccattacaaacccaatcaacggcaagagtttttctctaggggacatttactttaagctgttcagagcatcaggcgacatgcgcacaaatggggacaattatctttacgaaatccagctgtcctccatcacctccagtcggaatccagcttgcagcggcgctaatatctgccaagtcaagcctaacgaccagcactttagcaggaaagtgggcacgtccgataagactaaatattatctgcaagacggggacctagacgttgtgttcgcctctagttctaagtgtggcaaggataagacgaaatccgtatcatctaccatctttttccattgcgacccactggtggaagatggaatcccggaattttcacacgaaaccgctgattgccagtatctcttctcttggtacacctcggcagtctgccctctgggcgtcggctttgactctgagaaccctggagacgacggtcagatgcacaagggcctttcagagaggagccaggccgtgggcgcagtgctctctcttctcctggttgccctgacttgctgcctgttggctctgttactatacaagaaggagcggagggagaccgtcatctccaaacttaccacttgctgccgcagatcaagcaacgtttcctataagtacagcaaggttaataaagaagaagaaacggatgagaacgagactgagtggttaatggaggagattcagcttcctcctcctaggcagggcaaggaggggcaggaaaacggccacattaccacgaagtctgtcaaagccctctccagtctccacggcgacgaccaagacagcgaagatgaggtcttgacgatccccgaggtgaaggtgcacagcggaaggggagcaggcgctgaaagctctcatcctgtacgcaatgcccagagcaacgctctacaagagcgcgaagatgatcgcgttgggttagtgcgaggcgagaaggcccggaagggcaagagctcaagcgcgcagcagaagacagtctcatcaaccaaactggtatcgtttcatgatgacagtgacgaggacctgctgcatatctag

SEQ ID NO: 191515 - DNA, 780 bp, Artificial Sequence
  Description of Artificial Sequence: Synthetic coding sequence
atgagcgaggtgcccgtggcccgggtgtggctggtgctgctgctgctgacagttcaggttggcgtcacggccggagcgccttggcagtgtgcgccttgtagcgccgaaaagctggccttgtgcccccccgtgagcgcctcatgtagcgaggtcacgcgttcagctggttgtggatgctgtcctatgtgcgccttgcctttgggcgctgcatgtggtgttgcaacggcaagatgcgccagaggcctgtcctgcagggcacttcccggggagcaacagccccttcacgctcttacaagaggtcagggggcttgtgtgcaggaatcagacgccagtgcaccgcacgcggccgaggctggatcacccgaaagcccagagagcacggagataaccgaagaggaactgttggacaatttccacctgatggcgccttcagaagaggatcactccatcctctgggatgctatcagcacttacgatgggtctaaagccctgcatgttacaaatatcaagaagtggaaagagccatgtaggatagagttgtatagggtagttgagtccctggcaaaagcccaggaaacaagcggggaagagatttccaaattttatctcccaaactgcaataagaacggcttctaccacagtcggcagtgtgagacaagcatggacggagaggcaggactctgctggtgtgtctatccatggaacgggaaacgcatccctggtagtcctgaaatccggggtgatccaaactgccaaatctacttcaacgtgcagaactag

SEQ ID NO: 191516 - DNA, 777 bp, Artificial Sequence
  Description of Artificial Sequence: Synthetic coding sequence
atgctgcccctgtgcctggtggccgccctgctgctggccgccggccctggcccaagcctcggggatgaagccatccactgccccccttgtagtgaggagaaactcgcgaggtgtcggccaccagtgggctgcgaagagctggtgcgggaacccggatgcgggtgctgcgctacatgtgcactgggactgggaatgccatgcggcgtctacaccccacgttgtggatccggcctgcgttgctacccaccccgcggcgtcgaaaagcccttgcacacgctcatgcatggccagggcgtgtgcatggaacttgccgagattgaagctatccaagagtccctccaaccctctgataaggatgaaggggaccatcctaacaatagcttcagcccctgttccgcacatgatcgcaggtgcttgcagaaacactttgctaaaattcgagaccgaagcacttccggggggaaaatgaaagtgaatggcgccccaagagaagatgcacggcccgtaccccagggaagctgccagtctgagctacaccgggcccttgagagacttgccgcatcccagagcaggacacacgaagatctgtacattattcccatccctaactgcgaccggaatgggaactttcacccaaaacagtgtcaccccgctttagacgggcagcggggaaaatgctggtgcgttgacagaaaaactggcgttaagctgcccggggggcttgaaccgaagggggaactagattgccaccaactcgccgattcgttcagggaatag

SEQ ID NO: 191517 - DNA, 477 bp, Artificial Sequence
  Description of Artificial Sequence: Synthetic coding sequence
atggagctggccgagatcgaggccatccaggagagcctgcagcccagcgacaaggatgagggagaccatcctaacaattcatttagtccctgttctgcacacgatcgaagatgcctgcagaagcactttgctaagatcagagaccggtctactagcgggggcaagatgaaggtgaacggagcccctcgcgaagacgcacgcccagtgcctcagggctcctgccagtcggaactccaccgcgctctggagcggttggctgcgtctcagagtagaacacatgaagacctctacatcatcccaattccgaactgcgaccgtaatggcaacttccatccaaagcagtgtcaccccgcgctggatgggcagcgaggaaaatgttggtgtgttgacaggaaaactggtgtgaagttaccaggagggctggaacccaagggggaactcgattgtcaccagttagcagattctttccgggagtag

SEQ ID NO: 191518 - DNA, 849 bp, Artificial Sequence
  Description of Artificial Sequence: Synthetic coding sequence
atggagcggcccagcctgcgggccctgctgctgggcgccgccggcctgctgctgcttctgttgccgcttagttccagcagttcgtctgacacttgcggcccctgcgagcctgcatcttgtcctccactacctcctttgggctgcctcctcggagagacgagggacgcctgtggctgctgccccatgtgtgcccgaggcgagggtgaaccatgcggtgggggtggtgctggtcggggctactgcgcccccgggatggagtgcgtcaagagccggaaacggaggaagggtaaagccggagcagcagccgggggcccaggggtatcaggcgtctgtgtctgcaaatctagatatcctgtgtgcgggtctgatggcacaacttatccttcaggttgtcagctcagggccgcgtcacagagggcagaaagtcgcggggagaaggccattacccaagttagcaaaggaacctgcgagcagggcccatccatagttactccgcctaaagacatctggaacgtcactggcgcacaggtctacctcagttgcgaagtgattggcatcccaacgccagtgctaatttggaacaaggtcaagcgcggacactatggcgtgcagaggactgagctcctgcccggggatagggataatctagcaattcagactcggggaggtcctgagaagcatgaggttaccgggtgggtactggtctcccccctctccaaagaggatgccggggagtacgagtgtcatgcatccaattcacagggacaggccagtgcgtctgccaaaataaccgtggtggacgcactgcacgagatccccgtgaaaaaaggagagggagccgaactctag

SEQ ID NO: 191519 - DNA, 840 bp, Artificial Sequence
  Description of Artificial Sequence: Synthetic coding sequence
atggagcggcccagcctgcgggccctgctgctgggcgccgccggcttgctcctattgcttctgcccttgagttcctcctctagttcggacacgtgcggtccatgcgagccagcctcatgcccaccactaccacccctgggatgcctgcttggagagaccagggatgcctgcggatgttgtccaatgtgtgctcgtggagagggagaaccgtgcggcggcggaggtgcgggcagagggtactgtgctcccggcatggagtgcgtaaaaagtcgaaaacgccgaaagggaaaagccggcgccgcagcaggcggacccggtgtttcgggcgtttgcgtatgtaagtcaaggtatcctgtctgtggttccgacgggaccacctaccccagcgggtgccagcttcgggcagctagccagcgcgctgagtcaagaggcgagaaggccatcactcaggtgagcaaagggacatgcgagcagggtccgtctatagtaacacctcccaaggacatttggaatgtcaccggcgcgcaggtatacctctcttgtgaagttatcggtattcctactccggtccttatctggaacaaagtcaagcggggacattacggagtccagagaactgagctgctgcctggtgatagggataatctagctatccagacccggggcggcccagaaaaacatgaagtcaccggatgggttcttgtcagcccactatcgaaagaggacgccggggaatatgagtgccatgcctccaacagccagggccaggccagcgcatcggctaagatcacggttgtggacgccctacacgaaatcccagtgaaaaagggtactcagtag

SEQ ID NO: 191520 - DNA, 393 bp, Artificial Sequence
  Description of Artificial Sequence: Synthetic coding sequence
atggagaccctgggcgccctgctggtgctggagttcctgctgctgtcccctgtcgaagcccagcaggccaccgagcacagactgaagccttggctcgtgggcttggctgccgttgttggcttcttgtttatcgtatacctggttttgctcgctaatcgcctttggtgttctaaggctagagctgaagacgaggaagagacgacctttcgcatggagtcaaatctgtaccaggatcaatcagaggacaaacgcgaaaaaaaggaagccaaggaaaaggaagaaaagagaaagaaggagaaaaagacagccaaagagggcgaatccaatttggggttggatcttgaggagaaagagcctggagaccatgaaagggctaaatccacagttatgtag

SEQ ID NO: 191521 - DNA, 1932 bp, Artificial Sequence
  Description of Artificial Sequence: Synthetic coding sequence
atggccctgcggaaggccggcgacctggagccccagttcacccccgaacgccgctttaggctttgttggtaccaagctcattctggtcgcgctctcctgggcccaccaccacaggctagtccgcccgcagggggactagccctcgcacttttgttgctgtcttgggtcgcgctagggccaagaagtcttgagggcgctgacccagggacacccggcgaggcagaggggccagcatgtcctgccgcttgcgtctgcagttatgacgacgacgccgacgagttaagtgtgttctgctcatcaagaaatctcacccgacttccagacggggtaccaggaggcacacaggcgctttggctggacggtaacaacctttccagcgtgccgcccgccgcctttcagaacctatcctccctcggctttctgaacctgcagggcgggcagctggggtcgctggaacctcaggcattattagggttggagaatctgtgccacttgcacttggagcgaaaccagctgaggtctctggccctcgggaccttcgcccatactcctgccctggcgtctctcggccttagtaataatcgactgagtcgtctcgaagacggactcttcgagggcctgggttctttgtgggacctgaacctgggatggaacagcctcgcagttctgcctgacgccgcattcaggggcctaggttccctgcgtgagctagtactggctggtaatcgcttagcctatctgcagccagctctgttttcgggcctcgcagaactacgggaactggatctgtctagaaatgctctcagagccattaaagccaacgtcttcgttcagctgccacgattgcagaaactctacctggaccgcaacctgattgcagcagtcgccccgggcgcatttttaggactcaaagccctcagatggttggatctgtctcacaacagggtcgctgggctgctggaagatacgttccccgggttgttagggctccgggtgttgagactctctcacaatgctatagcgtctctgaggcctaggacctttaaagatctccacttccttgaagaactccagcttggacataacaggataagacaactggccgagcgctcttttgaggggctcgggcaactggaggtgctgacactggaccataatcagctacaggaggtaaaagctggggctttcctgggactaacaaatgttgcggtcatgaacctgtccggcaattgtctgaggaacctgcctgaacaagtgttcaggggccttggaaaactgcactccctccacctcgaaggcagctgcctgggaaggatcaggcctcatacattcacaggactgtcaggccttcgtcgtttgttcctcaaggataacgggctggtcggaatcgaggagcagtctctctggggactggccgagcttttagaactggacctaacttctaatcagctcacccacttaccacacagactgttccaaggcctgggcaaactggagtacctgctcctctctaggaaccgacttgccgagctacccgctgacgcccttggaccattgcagcgagctttctggctcgacgtaagccacaatcgcctggaggcactccccaactccctgctcgcccctctgggtcgtttgaggtacttatctctcagaaataattccctgcgaacatttacaccccagccacccggcctggaaaggttgtggctagaggggaacccatgggattgtggttgccctctcaaggctttacgggactttgccttacaaaacccctctgctgtcccccgctttgtgcaagctatctgcgagggggacgactgccagccacccgcctacacctacaataatatcacgtgtgcatccccccctgaagtcgtcggcctggatctcagggatctgagcgaggcccattttgcaccttgctag

SEQ ID NO: 191522 - DNA, 1533 bp, Artificial Sequence
  Description of Artificial Sequence: Synthetic coding sequence
atgccccggggcttcctggtgaagcggagcaagaagagcacccccgtgtcctatcgggtccgcggcggggaagatggagaccgcgctctgctgctaagcccttcttgcggtggggctagagcagagcctcctgcccccagcccagtacctgggcccctgcctccacctcctccagccgaacgggcccacgccgcgctcgctgctgccctcgcctgtgcccctggacctcagcctcctccgcagggcccccgagccgcacacttcggcaatccagaagccgcccaccccgcccctctatacagccctacccggccagtgtctcgagaacacgaaaaacataaatacttcgagagatccttcaacctcgggagccctgtatctgccgagtcttttccaacccccgccgctctgctaggcggaggcggtggtggcggagcctcaggcgccgggggaggaggcacctgtgggggcgacccattactgttcgcacctgcagagcttaagatgggcaccgccttttccgctggagcagaggctgccaggggccccggtcctggcccccccctgccacccgcggccgccctcagacccccaggcaagagaccacctcccccgaccgccgcagagccaccagccaaggctgtcaaggctccgggagcaaagaagccaaaggctattaggaaactccactttgaggacgaggttactaccagcccggtcctcgggctgaagattaaagagggacctgtggaggcccccaggggccgcgctgggggggcagcccggcccctgggggagtttatctgccagttgtgtaaagaagagtacgcagatccctttgctttagcccagcacaaatgctcaaggattgttagggtggaatacagatgccccgaatgcgccaaggtattctcgtgtcccgccaacctcgcttctcatagaaggtggcacaagcctcggcctgcaccagccgccgcacgggctcccgagccagaggccgctgcgagagccgaggccagagaggctcccgggggcggcagcgatagggacactccatctcccggaggtgtgtcagagagcggctccgaggatggcttatatgagtgtcatcactgtgctaaaaaatttcgacgccaggcttatctgcgtaagcatctgttagcccaccatcaggccctgcaggccaagggcgctccccttgcacccccagccgaagatttattggccctgtatccagggcctgacgaaaaggcaccacaggaagcggccggcgatggggaaggcgctggcgttctgggcctgagtgcaagcgcagagtgtcatttgtgccccgtgtgcggtgagtcctttgccagcaagggtgcacaggaacggcatctccgcctcctgcacgcagctcaagtctttccatgcaagtactgccccgcaacattctacagtagccctggactgacacggcatatcaacaagtgtcacccctccgaaaatcgccaagtgatactgcttcaggtgcctgtaaggccagcctgctag

SEQ ID NO: 191523 - DNA, 1701 bp, Artificial Sequence
  Description of Artificial Sequence: Synthetic coding sequence
atgccccggggcttcctggtgaagcggaccaagcggaccggcggcctgtaccgcgtccggctggcagagcgagtattcccccttttaggcccccagggcgcacctccctttctggaggaagctccatctgcaagcctcccaggggctgagcgggccaccccccccacaagagaggaaccaggtaaaggactcactgcagaggctgctagggaacaaagtggaagcccctgcagagccgcaggcgtgtcacccggcactgggggtagagagggcgcggaatggcgtgccggaggccgggaaggtcccggcccctcaccatccccaagcccttcgcccgcaaagcctgccggtgccgaactgcggcgcgcatttcttgagaggtgcctgtcaagcccagtgtccgcagagagttttcctggcggtgccgcagctgtggcagcgttcagctgtagcgtggccccggccgcggcacctacgccaggggaacaatttctgttgcccctgcgagcgccatttcccgaaccagcacttcaaccagatccagcacctcttagtgccgctctgcagtctcttaagagagccgccggcggcgagaggcgtggaaaggcccccaccgattgcgcctctgggcctgcagcagcaggtatcaagaaaccaaaggctatgcgtaagctttcttttgcggacgaagtaactactagcccagtgcttggtctaaaaataaaagaggaagaaccaggagctccttcacgaggcctggggggctctcgcactcccctgggcgagttcatttgccagctgtgtaaggagcagtatgctgatccattcgcactggctcagcacaggtgtagtagaatcgtacgcgttgagtacaggtgccctgagtgtgataaagtgtttagctgtccagccaatctcgccagccatagaagatggcacaaacctcgcccagctgcagccaacgcagccacagtgagctccgccgacgggaagccccccagttctagcagttcatcctctcgggattctggagctattgcatccttccttgcggagggtaaagagaattctcgaattgaaagaaccgcagatcagcatccacaagccagggactcttctggcgcagatcagcaccctgacagcgccccgcggcagggcttgcaggtattgactcacccagagcctccactcccccaaggcccgtatactgagggcgtgctgggcaggagagtgcctgttcctgggagtactagcggcggacgggggtcggaaattttcgtttgcccctattgccacaaaaagtttcggcggcaggcctacctgcggaaacacctgtccactcatgaggccgggtctgcccgtgccttggcacctggcttcggctctgaacgaggagcacctctggcctttgcatgcccactgtgtggggcacattttccaacagcggatatccgggaaaaacacagactgtggcacgctgtcagagaggagttgctgctgcccgctctggctggagctccgcccgagaccagcggcccaagcgggccaagtgacggatccgctcaacagatattctcttgtaaacattgtccatccacattcttttcctctcccggactgacccgccatataaacaaatgccacccgagtgagagtagacaagtacttttgctgcaaatgcctttacggcccggctgctag

SEQ ID NO: 191524 - DNA, 792 bp, Artificial Sequence
  Description of Artificial Sequence: Synthetic coding sequence
atggtgaagatcgccttcaacacccccaccgccgtgcagaaggaggaagccagacaggacgtggaggcacttctctctaggacggttaggacacaaattctaactggaaaggaattacgcgttgcaacacaagagaaggaggggagctcgggaaggtgcatgcttaccttgctgggtctatcgttcattctggcaggcctcattgttgggggcgcttgcatttataagtattttatgcctaagagtaccatataccgtggggaaatgtgctttttcgactcagaagatccagccaactctctccgcggcggagagcccaatttcctgcccgtcaccgaggaggccgacattcgagaggacgacaatatagcaatcattgatgtgccagtgcctagcttctcggactctgaccctgctgcgattattcacgattttgaaaaggggatgactgcatacttggatcttctgctgggcaactgctaccttatgcctttaaacacctctattgtcatgccacccaaaaacctggttgagctattcgggaaattggcttccggaaggtacctaccacaaacgtacgtcgttcgcgaggacttagtggctgtcgaagaaattagggatgtaagcaacctgggcatttttatctatcagctctgcaataacaggaagtctttcaggctaagacggcgtgacctgctgctcgggttcaataagcgcgctattgacaagtgctggaagatacggcactttcctaacgaattcatcgtggaaactaagatctgtcaggagtag

SEQ ID NO: 191525 - DNA, 660 bp, Artificial Sequence
  Description of Artificial Sequence: Synthetic coding sequence
atggtgaagatcgccttcaacacccccaccgccgtgcagaaggaggaagcaagacaggacgtggaagccctgttatcacgcactgtgcggactcagattctaacagggaaatctaccatctatcggggcgagatgtgctttttcgattccgaagaccccgcgaattcactacgaggtggggaacctaatttcctgccagtgaccgaggaggcagatatcagagaggacgataatattgctataatcgacgttcctgtgccctccttctccgatagcgatccagccgccatcattcatgattttgagaaaggaatgacggcatacttggacctattactgggcaattgctatctgatgcccctcaatacatccatcgtaatgcctccaaagaatctggtggaactgttcggcaaactggcctctgggaggtacttacctcaaacatacgttgtgcgggaggacctggttgctgtcgaggaaatcagagacgtgtccaatcttggcatcttcatctatcaactctgtaataatagaaagtctttcaggcttcggcgcagggatttgctgctgggctttaataagcgtgcaatcgataagtgctggaaaattcggcatttccctaacgagtttatcgttgagaccaagatctgtcaggagtag

SEQ ID NO: 191526 - DNA, 801 bp, Artificial Sequence
  Description of Artificial Sequence: Synthetic coding sequence
atggtgaaggtgaccttcaacagcgccctggcccagaaggaggccaaaaaggatgagcctaaaagtggtgaggaggcattgattatccccccggacgccgtggctgtcgattgcaaagacccagatgatgttgtgcctgtgggacagaggagggcctggtgctggtgtatgtgctttggactggcgtttatgttagctggagtgattctgggaggggcatatctgtacaagtactttgccctccaaccagacgatgtgtactattgcggtatcaaatatatcaaagacgacgtaattctcaacgagccttctgcggatgcgccggccgccctttaccagaccatcgaggagaacataaagatttttgaagaggaagaggtcgagttcatttcggtccctgtccctgagtttgcagatagcgaccccgcaaatatcgtgcatgatttcaacaagaagttgaccgcatatctggacctaaatctggataagtgctacgtgattcccctgaataccagcatagttatgcctccacgaaacctgcttgagttgctaataaatatcaaggctggcacttatttaccacaatcttatcttattcacgagcatatggtgattactgatcgcatcgagaatatcgaccatctcggattcttcatttatagactttgtcacgacaaggaaacctacaagctgcaacgtagggaaactatcaagggaatccaaaagcgagaggcctcaaactgcttcgctatccgtcatttcgagaataagttcgccgtggagactctgatttgttcttag

SEQ ID NO: 191527 - DNA, 693 bp, Artificial Sequence
  Description of Artificial Sequence: Synthetic coding sequence
atggtgaagatcagcttccagcccgccgtggccggcatcaagggcgacaaggctgacaaggcatctgcctctgcacctgctcctgctagcgctactgaaattctgctgaccccagcccgagaggagcagcctccccaacaccggtctaagagaggtggctcagtcggaggggtgtgctacctctcaatgggaatggtagtgctgctgatgggtctggtgttcgcgtccgtatacatttatcgctatttttttctcgcacagctagctcgggataatttttttaggtgtggcgttttatatgaggactcgctgagctctcaggtgagaacgcagatggagttggaggaagatgttaagatttatttagacgagaactacgagaggataaacgtgcccgtgccacagttcggtgggggtgatccagcagacattatccatgatttccaacgtcgcggcacatatctccctcagacatatatcattcaggaagagatggtcgtgaccgagcatgtgtcagacaaagaggcactgggaagtttcatatatcatctgtgtaacggaaaagatacgtatcggctgcgcaggcgggctacacggcggcgaattaataagcgtggagccaagaattgtaacgcaattcggcacttcgagaatacattcgtggtggagacactgatatgcggggtggtatag

SEQ ID NO: 191528 - DNA, 804 bp, Artificial Sequence
  Description of Artificial Sequence: Synthetic coding sequence
atggtgaagatcagcttccagcccgccgtggccggcatcaagggcgataaggccgacaaggcatcagccagcgcccccgcacccgccagtgcgactgagatcctgctgacccccgcccgtgaagagcaacctccccaacatcgcagcaaacgcgggggaagcgtagggggtgtgtgctatctgtcaatgggcatggtagtattattgatgggccttgtctttgctagtgtgtatatctaccgctacttttttctggcacagcttgctcgtgataacttcttccggtgtggcgtgctgtacgaggacagtttaagctctcaagttcgaactcagatggagctggaggaggacgtcaagatttacctggatgaaaattatgaacgaattaacgtgccagtcccacagtttgggggaggcgacccagctgacattatacacgacttccagagaggactcacagcttaccacgacatttctctggacaagtgctatgtcatcgagctgaacaccacgatcgttttgccgccacgcaacttttgggagcttcttatgaacgtgaaaagaggcacctatttgcctcagacatatattatccaagaggagatggtcgtcacagaacatgtgtccgacaaagaggcactaggtagttttatctaccacttatgcaacggcaaagatacttacagactgaggcggcgagcaacacggagaagaattaacaaacgaggcgctaaaaactgcaatgccatccggcatttcgaaaacacgttcgtcgtggagaccctgatctgcggcgtggtatag

SEQ ID NO: 191529 - DNA, 663 bp, Artificial Sequence
  Description of Artificial Sequence: Synthetic coding sequence
atggtgaagatcagcttccagcccgccgtggccggcatcaagggcgataaagccgacaaagccagtgcctcagctcccgccccggcgtccgcaactgagatcctcttgacccctgctcgccttgcgcgggacaatttttttcgatgtggagtactgtatgaggacagcctgagcagccaggtacgtacccagatggagctagaagaggacgttaagatctatctcgatgagaactatgaacgcattaatgtacccgttcctcagtttggtggaggagaccctgcagatataattcatgacttccagcgtggattgacagcttaccatgacatttccctcgacaaatgttatgttatcgaacttaacactaccatcgtactgcccccccgaaatttctgggaactgttaatgaacgtgaagagggggacatatctccctcaaacctacattattcaggaagaaatggtggtgacagaacatgtaagcgataaggaggccttaggcagctttatctaccacttgtgtaacggaaaagacacttacagacttcgtcgtagagcaactagacggaggattaataaaagaggcgctaagaactgcaacgcgattagacactttgaaaacaccttcgtggtagaaaccctgatctgcggggttgtgtag

SEQ ID NO: 191530 - DNA, 543 bp, Artificial Sequence
  Description of Artificial Sequence: Synthetic coding sequence
atggtgaagatcagcttccagcccgccgtggccggcatcaagggcgataaagcggataaggcctcagcttccgccccggcacctgcaagcgccacggaaatccttttaactccagcgcgagaggagcagcccccccagcacaggtccaaacggggagggtctgtgggcggtgtgtgttacctgtctatgggcatggtggtattgctgatggggttggtgtttgcaagtgtctatatatatcggtacttcttcctggcccaattagctagagacaacttctttaggtgtggtgtcctctacgaggactccctgtccagtcaagtgaggacccagatggaactggaagaggacgtcaagatttatctggatgagaactatgagaggatcaatgtgcctgtgccgcaatttggcggcggagatcctgccgatataatccatgatttccagcgaggattgactgcttaccacgacatctccctggataagtgctacgtgattgaattgaatactacgattgtgctgccaccaagaaatttctggtag

SEQ ID NO: 191531 - DNA, 1839 bp, Artificial Sequence
  Description of Artificial Sequence: Synthetic coding sequence
atggccgccgccggccggctgcccagcagctgggccctgttcagccccctgctggctggccttgccttgttaggggtgggccctgtgcccgcccgcgcactgcacaatgttactgccgagttgttcggagcagaggcttgggggactttagcagctttcggggacttaaactcggacaaacagaccgatttattcgtgttacgcgagcgcaatgacctcatagtgtttctggcggaccaaaacgcgccttacttcaaaccaaaggtcaaggtctcgttcaagaatcattctgcacttatcaccagcgtcgttccgggggactacgacggcgatagtcaaatggatgttctactcacctacctccccaaaaactacgcaaagagcgagttgggtgccgtgatcttctggggccaaaatcagacattggacccgaacaacatgaccatcctgaataggacttttcaggacgaaccactcatcatggattttaacggcgacctgatcccggacatttttggaattacaaacgagagcaatcagcctcagatcttgttgggcgggaatcttagttggcatcccgccctgactacaacctccaaaatgcggatccctcacagtcacgctttcatagacttgacggaagattttacagccgacctattcctgactactctaaacgccacaacgagcacttttcagttcgaaatctgggaaaatttggacgggaacttctctgtgagtacaatactggagaagccacagaacatgatggtggtcggtcagagtgccttcgcagactttgatggggatggccatatggaccatttattgccgggatgtgaggacaagaattgtcaaaagtccacgatatacttggtgcgatctggaatgaaacaatgggtgcccgtgctgcaagatttcagcaataaggggacactctggggcttcgtgccttttgtagacgaacagcagcctacagaaattcctattccgatcaccctgcacataggggattacaacatggacggctatccggatgctctggtgattttgaagaacactagtgggtccaatcagcaggcctttcttcttgagaacgtgccatgtaataacgcttcatgcgaggaagcgagacgcatgtttaaggtgtattgggagcttaccgacctgaaccagatcaaggacgctatggtagcaaccttcttcgatatttacgaggacggcatccttgacattgtggtattatccaaaggatataccaaaaacgatttcgcaattcacacgttgaaaaataactttgaggccgatgcgtatttcgtgaaagtgattgtgttatctgggctgtgtagcaatgactgccctcggaaaataacaccctttggagtgaaccagccagggccctatatcatgtatactacagtggacgcaaacggctatctgaagaacggtagtgccggacagctcagtcagtcagcccaccttgctctccagctgccctacaacgtcctgggtcttgggcgcagcgctaacttcctcgaccacctgtatgtgggcattccccggccatcaggagaaaagagtatacgcaaacaggagtggacagctatcattcccaatagtcagttgattgtgattccttacccccacaacgtcccgagatcatggtccgcgaagctctacttaacacccagcaatatcgtcttgctgactgcaatcgctttgataggcgtttgtgtattcattctggccattattggcatcctacactggcaggaaaagaaggcagatgacagagaaaagcgccaggaagcacaccgcttccattttgatgctatgtag

SEQ ID NO: 191532 - DNA, 819 bp, Artificial Sequence
  Description of Artificial Sequence: Synthetic coding sequence
atggacggctaccccgacgccctggtgatcctgaagaacaccagcgggtcaaaccaacaggcatttctgcttgagaatgtgccatgcaacaacgcctcatgtgaagaggctagacgtatgtttaaagtgtactgggagttaaccgatcttaatcaaataaaagacgcgatggtcgccacattcttcgacatctacgaagatggcatcctggacatcgtggtgctgtcgaagggctataccaaaaatgattttgccatccacaccttgaaaaacaacttcgaggcagatgcctatttcgtgaaagtcatcgtgctgagcggattgtgctctaacgattgcccgaggaagatcactcccttcggcgtgaaccagcccgggccctacatcatgtatacaacagtagatgctaacggctatctgaagaacggttccgctggccaactctctcagtccgcccacctcgctctgcagctgccctacaatgtgctgggcctgggtcgcagtgcaaactttctggatcatctgtacgttggcatccctcgcccttccggtgagaagtctattagaaagcaagagtggaccgctattatccccaatagccaacttattgtcatcccttatccccacaatgtgcccaggtcttggagcgcaaaattatacctgaccccgtccaacattgtgctgctgaccgctattgcgttaattggtgtttgtgtctttattctggctatcattggaatcttgcactggcaagagaagaaggccgacgatcgggagaaaaggcaggaggcccatcgtttccattttgacgccatgtag

SEQ ID NO: 191533 - DNA, 1074 bp, Artificial Sequence
  Description of Artificial Sequence: Synthetic coding sequence
atgatggtggtgggccagagcgccttcgccgacttcgacggcgacgggcatatggaccacctgctacccgggtgtgaagataagaactgtcaaaagtcaaccatatatctcgttcgctccggcatgaagcagtgggtgccagtcctgcaggactttagcaacaaagggaccttgtggggattcgtgcctttcgtggatgaacagcagccaaccgaaatccctattccgatcacactccacataggggactacaacatggatggatacccagatgccctggtgattttgaaaaataccagcgggtctaaccagcaggcatttctgctggagaacgtgccttgcaataacgccagctgtgaggaagcgcgacgtatgtttaaagtgtactgggagctgacagatcttaatcagataaaagatgcaatggttgcgacctttttcgatatctatgaggacggtattctcgatatcgtggtcctcagtaagggctatacaaagaatgacttcgcgatccacacactgaagaacaactttgaagccgacgcatactttgtcaaggtgatcgttctcagtggcctctgcagtaatgattgcccccgtaaaattacaccatttggcgtcaatcagccggggccatacattatgtacaccaccgtggacgccaacgggtaccttaagaatggctcggctggccagttgagccagagtgctcaccttgccctgcagttaccatataatgtacttggcctagggagaagcgccaactttttagaccatctctacgtgggcatcccaagacccagcggggagaagtccattcgcaaacaggaatggacagcaatcatcccgaatagccagctcatcgtcatcccctaccctcataatgtaccccggagttggagtgccaaactttatcttacaccctcaaatattgtactgctaacagccatcgcactgataggggtctgtgtgttcattctggccattatcggaattttgcactggcaggagaaaaaggcagacgatagagagaagcggcaagaggcacaccggttccactttgacgcaatgtag

SEQ ID NO: 191534 - DNA, 1395 bp, Artificial Sequence
  Description of Artificial Sequence: Synthetic coding sequence
atggacgtgctgctgacctacctgcccaagaactacgccaagagcgagttaggcgccgtgatattctggggccaaaatcagacactggaccctaataatatgaccatcctcaacagaaccttccaggatgagcctctcatcatggatttcaatggcgacctgatccccgatatcttcgggataacaaacgagtccaatcaaccccagattcttctgggaggcaacctctcctggcatccggccctaactacgaccagcaaaatgcggattccccacagtcacgcctttatcgacctcacagaagattttaccgccgaccttttcctaaccacgttaaatgcgactacgtcaacatttcagttcgaaatttgggagaacctggatggaaacttctccgtatccactattttagagaaacctcagaacatgatggtagtaggccagagcgcctttgctgactttgacggagatggtcatatggatcacctgctgcccggctgtgaagacaagaactgccaaaaatccaccatttatttagtacgatccgggatgaagcagtgggtgcccgtactgcaggacttcagtaacaagggaaccctttggggtttcgtccctttcgtggacgaacagcagccaactgagattccaataccaatcactctccatataggcgactacaacatggacggatacccagatgccttagtgatcctgaagaatacatcagggagtaatcagcaggcttttctgctggagaatgtcccttgcaataacgcttcatgtgaggaggctcggcgaatgttcaaagtctactgggaactgacagacctaaatcagataaaagacgctatggtagcaacgttcttcgacatctacgaggacggaattctagacattgtggtgttgtcgaagggttacacaaaaaatgactttgccatccacacactgaagaacaattttgaggctgacgcttacttcgtaaaggtcattgtcctctccggactttgcagcaacgattgcccaagaaaaataacacccttcggagtgaaccagcctgggccctatattatgtatacaaccgtggatgcgaacggctacctgaaaaacggatccgccggccaactgtcccagagtgcccatctagccctgcagttaccatacaacgtgctcggattaggccgcagcgctaacttcctcgatcatctttacgtaggaatcccacgcccgtcaggggagaagtcgatacggaaacaggaatggacagccatcatccctaacagccagctcatcgtaatcccatacccacacaatgtgcctcgcagctcccatcgctgtttatgcttccacctgggcaacaattggcactttacactggctggcaaagagtcaaggtag

SEQ ID NO: 191535 - DNA, 1044 bp, Artificial Sequence
  Description of Artificial Sequence: Synthetic coding sequence
atgagcctgctgtgccggaacaagggctgcggccagcacttcgaccccaataccaatctacctgacagctgctgccatcatcccggggttcccatcttccacgacgccctgaaagggtggtcttgctgcaggaagcgcactgttgacttttcagagttcctgaacatcaagggatgcacaatgggtcctcactgtgcagagaaactgcccgaggcacctcagcctgaaggccctgccacttctagtagcctgcaggagcagaagcccctgaacgtcattcctaaaagcgctgaaaccttacgaagagagcgtccaaagtcagagttaccactaaagttgctccctctgaacatctcacaggcactggagatggccctcgaacaaaaagagctggatcaagaaccgggcgctgggctggattctctcattcgcacaggatcgtcatgtcagaaccccggttgtgacgccgtctaccaggggcctgagagcgacgccacaccttgtacttaccaccctggggcgcccaggttccatgagggtatgaagtcctggagctgctgcgggatccaaacgctggactttggcgcatttctcgcacaaccaggttgccgcgtgggccggcatgactggggaaaacaattgccggcctcatgccgccatgattggcaccaaactgactcccttgttgttgtgactgtctatggacaaattcctctccccgcttttaattgggtgaaagcaagccagacagagcttcacgtccatatcgtcttcgacggaaaccgagtgttccaggcacaaatgaagctttggggggtcatcaacgtggagcagtcaagtgtgttcctgatgcccagccgagtcgagatttccctcgtgaaggccgaccccggcagctgggcacagctggagcacccagacgccctggctaagaaagccagggcaggcgtggttctagagatggacgaagaggagtctgatgatagtgatgatgatcttagttggaccgaagaggaagaggaggaagaggccatgggtgaatag

SEQ ID NO: 191536 - DNA, 990 bp, Artificial Sequence
  Description of Artificial Sequence: Synthetic coding sequence
atgagcaccgacagctgctgccaccaccccggcgtgcccatcttccatgacgccctgaaggggtggtcttgctgtcgaaagcgaaccgtggattttagcgagttcctcaatattaagggctgtaccatgggaccacactgcgcagagaaacttcctgaagccccccagcccgagggcccagctacttctagttcactgcaagaacagaagccattgaatgtgatccctaagagcgccgaaactctgagacgcgagcgacccaagtcagaacttcctctgaagctgctcccactgaacattagccaggctttagaaatggcgttagaacagaaagaattggatcaggagcccggagccgggctggactcactgattcgcacgggctcatcctgccagaaccccggttgcgatgccgtctaccaggggcccgaatctgatgctacaccgtgcacttaccatcctggggctcctagatttcatgagggcatgaaatcttggtcatgctgcgggatacagaccctggactttggtgcctttttggctcagcccggttgtagggtgggtaggcatgactggggaaagcagcttccggcttcatgccgccacgattggcaccagacggactcgctggtcgtagtgaccgtgtatggtcagatcccactcccagccttcaattgggtcaaggcttcacagactgagctccatgtgcacatcgtgttcgacggtaacagagtgttccaggcacagatgaaactgtggggggttattaacgtggaacagagctccgtgtttttaatgccatctagggtcgagatttctctggtgaaagccgaccctggttcctgggcccagctggagcatcctgacgcattagccaaaaaggcacgcgctggggttgtactcgagatggacgaggaggagagcgatgacagcgatgacgatttgtcatggaccgaagaggaagaggaagaggaggctatgggggagtag

SEQ ID NO: 191537 - DNA, 603 bp, Artificial Sequence
  Description of Artificial Sequence: Synthetic coding sequence
atgttccggaagggcaagaagcggcacagcagcagcagcagccagtccagcgagatcagcacaaagtccaagtctgtagactcatccctcggcggcctaagcagaagcagcacggtggcttctcttgacacagactctacaaagagtagcggacagagcaataacaattctgatacatgcgctgagttccgtattaaatacgtgggggctatcgagaaactgaaattgtccgaagggaaaggattggaagggccccttgacttgatcaactatatcgacgttgcccagcaggacggaaagctgccctttgtcccaccagaggaggaatttatcatgggcgtttcaaaatacggtattaaggtgtctacatctgaccagtacgacgtgttgcaccggcacgccctgtacctcattatacgcatggtgtgctatgacgacggtcttggcgctggcaagtcactccttgcactgaaaacaacagacgcctcgaatgaagaatatagtctgtgggtgtatcagtgtaattcacttgaacaagctcaggccatctgcaaggtgcttagcacggcttttgactccgtgctgacaagtgaaaaaccctag

SEQ ID NO: 191538 - DNA, 603 bp, Artificial Sequence
  Description of Artificial Sequence: Synthetic coding sequence
atgttccggaagggcaagaagcggcacagcagcagcagcagccagtcctccgagatcagtaccaaatctaagtctgtggacagcagtctcggagggctctcccgctcctccaccgtagccagtctagatactgattctactaaaagcagcggtcagagcaataacaacagcgacacctgcgctgaatttaggataaagtacgtgggcgccatcgagaaactgaagctgagcgaaggaaagggtctagaaggacccctcgatctgatcaactatatcgatgttgcccagcaagatggcaagttgcctttcgtccccccagaagaagagttcattatgggagtcagcaagtatggtattaaagtttccacatctgatcaatacgatgtcctccaccggcatgccctgtatctaattatccggatggtttgctacgatgatggtctaggggcaggtaagtcactcctggcactcaagactaccgacgcaagcaatgaggagtattccctttgggtgtaccaatgcaattctcttgaacaggcgcaggccatctgcaaagtgttgagcacagccttcgattctgtattaacctctgagaagccatag

SEQ ID NO: 191539 - DNA, 255 bp, Artificial Sequence
  Description of Artificial Sequence: Synthetic coding sequence
atgttccggaagggcaagaagcggcacagcagcagcagcagccagtcctcagagatcagtacaaagtccaaatcagtcgattcaagtctggggggcctctccagaagcagtactgtagcgtcactcgataccgactccaccaaaagtagcggccaatccaataataactctgacacttgcgccgagttcaggattaagtacgttggagccatcgaaaaactaaagttaagtgagggaaagggactggagggatag

SEQ ID NO: 191540 - DNA, 291 bp, Artificial Sequence
  Description of Artificial Sequence: Synthetic coding sequence
atgttccggaagggcaagaagcggcacagcagcagcagcagccagtccagcgaaatttctacaaaaagcaagtccgtcgattcttcactgggcggcctgtctcgcagtagtacggtcgcctcactggacacagactctactaaatcgtcagggcagtctaacaacaattccgatacatgcgccgaattcaggatcaaatacgttggcgcgatcgaaaagttgaaactgagcgagggaaaagggctggagggcccgctggacctgatcaattatatcgatgtggctcagtag

SEQ ID NO: 191541 - DNA, 261 bp, Artificial Sequence
  Description of Artificial Sequence: Synthetic coding sequence
atgttccggaagggcaagaagcggcacagcagcagcagcagccagtcttcagagatcagtactaaatccaaatccgtggacagcagcttgggggggctcagccgatccagcaccgtggcttctcttgacactgattcgaccaagtccagtggccagtccaacaacaactcagatacgtgcgccgaatttagaattaaatacgtcggggcaatcgagaagttaaaattgtccgaaggaaagggactggaggggcctctctag

SEQ ID NO: 191542 - DNA, 411 bp, Artificial Sequence
  Description of Artificial Sequence: Synthetic coding sequence
atgttccggaagggcaagaagcggcacagcagcagcagcagccagtccagtgaaattagcactaagagcaaatctgtggactcatctctgggagggttatcgagaagcagcacagtggcctcactggacacggatagcactaagtcctctgggcaaagcaacaacaatagcgacacctgcgcggagttccgaatcaagtacgtcggcgcgattgagaagctgaagttgagtgaaggaaagggtctcgaggggccattagacctgattaactacattgatgtggcccagcaggatgggaagctcccgtttgtgcctcccgaagaggaatttatcatgggcgtgagcaaatacggaattaaagtatcaacaagcgatcaatatgatgttctgcacagacacgccttatactag

SEQ ID NO: 191543 - DNA, 345 bp, Artificial Sequence
  Description of Artificial Sequence: Synthetic coding sequence
atgttccggaagggcaagaagcggcacagcagcagcagcagccagtcttcagaaatctcaacaaagagcaaatctgtggattcctcacttggcggcctttcaaggagctcgacagtcgcgagcttggacacagattcgacaaaatcttccggccaaagcaataataacagcgatacatgtgcagaatttagaattaagtacgtgggcgcaattgagaagctgaagctttccgagggtaagggcctggagggcccgctcgacctcataaactacatcgatgtcgcacagcaagacggtaagctgcctttcgtgccacctgaggaagaatttataatgggggtgtag

SEQ ID NO: 191544 - DNA, 198 bp, Artificial Sequence
  Description of Artificial Sequence: Synthetic coding sequence
atgttccggaagggcaagaagcggcacagcagcagcagcagccagtcctcagaaatctcaacaaagtcaaagagcgttgacagttcactgggcggattaagcaggagctccacggtcgctagcctggacactgactctacaaaatcatctggacagtcgaacaataattcagacacatgcgccgaatttcgcatttag

SEQ ID NO: 191545 - DNA, 453 bp, Artificial Sequence
  Description of Artificial Sequence: Synthetic coding sequence
atgttccggaagggcaagaagcggcacagcagcagcagcagccagagctccgaaatctcaacaaaatcaaagtctgtggattcctccctcggtggtctgtcccgatcatctaccgtggcctccctcgatacggattccacgaagtcatccgggcagtctaacaataatagcgacacttgtgctgaatttcggattaagtacgtgggcgcgattgagaagttgaaacttagcgaaggcaagggtttggagggtccgttggacctcattaattacatcgacgtcgctcagcaggacggaaagttgccctttgttcctccagaggaggagttcattatgggggttagcaagtacggaatcaaggtctccacctctgatcagtacgaacaggctcaggcaatttgcaaggtgctgagcaccgcgtttgattctgtcctgacctccgagaagccctag

SEQ ID NO: 191546 - DNA, 534 bp, Artificial Sequence
  Description of Artificial Sequence: Synthetic coding sequence
atgcccgtgaagcggagcctgaagctggacggcctgctggaggagaattccttcgatccaagtaaaatcactaggaagaagtctgtgatcacgtactcaccgactaccgggacctgtcagatgagtctatttgctagtcctaccagctccgaggaacagaagcaccggaacgggctgtccaatgaaaaacgaaagaaacttaaccacccaagcctcacagagagcaaggaatccactacaaaagacaatgatgaatttatgatgctgctgagcaaagtggagaaactctcagaagagatcatggagatcatgcagaacctcagcagtatacaggctctggaggggagtagggagcttgaaaatttgatcggtatttcttgcgcctcacacttcctgaagcgcgaaatgcaaaagacaaaggaactgatgacaaaggtgaacaaacagaagctgttcgagaagtccacagggctgccacataaggctagcagacacctagactcttatgaatttctcaaggccattttgaactag

SEQ ID NO: 191547 - DNA, 513 bp, Artificial Sequence
  Description of Artificial Sequence: Synthetic coding sequence
atgcccgtgaagcggagcctgaagctggacggcctgctggaggagaattccttcgaccccagtaagatcacaaggaagaagtccgttataacctacagtcccacgaccggaacttgtcagatgtctctcttcgcatctcccacttctagcgaggagcagaagcatagaaacggactgagtaacgagaagcgaaaaaaattgaatcaccccagcctgaccgagagcaaggaaagtacaacgaaggataatgacgagtttatgatgttgttatctaaagtggagaaattgtcagaagaaattatggaaattatgcaaaatctatcctcaattcaggccttagaaggctccagggagttggaaaatttgatcggtatatcctgtgcatcccacttcctaaaaagggaaatgcagaaaactaaggagctgatgactaaagttaacaaacagaaactattcgaaaagagcactggccttcctcataaaggtcaacctcagatgtctcaacctctctag

SEQ ID NO: 191548 - DNA, 651 bp, Artificial Sequence
  Description of Artificial Sequence: Synthetic coding sequence
atgcccttcgcccccgtggcccaggcccgggtgcagtggcacgacttccggtcgttgcaacacctgctccctgcttttaaaaggttttcctgtttgtcactgggtagttcttgggattacagcgtaaagagatcattaaagctggacgggctgcttgaagaaaactcattcgatccgagcaagattacgagaaaaaaaagtgtaattacttatagccctacaacaggaacctgccagatgtctctcttcgcaagtcccacgtctagcgaagagcagaaacatcgaaacgggttgtccaacgagaaacggaaaaagctgaaccatcctagccttaccgagtccaaagagagtactacgaaggataacgatgagtttatgatgctgctttcaaaagtcgagaagttaagtgaagagatcatggaaatcatgcaaaacctaagttccattcaagctctggaaggctcgcgtgagttggaaaatctgataggcatctcatgtgctagccacttcctgaagagggagatgcaaaaaacgaaagaattgatgacaaaagttaacaagcagaagctattcgaaaagtccactgggctcccccacaaggcctcacggcacctggacagctatgagttcctgaaagcaattctgaattag

SEQ ID NO: 191549 - DNA, 3540 bp, Artificial Sequence
  Description of Artificial Sequence: Synthetic coding sequence
atggccccccggccccgggcccggcccggcgtggccgtggcctgctgttggctcctgacggtggtgctgaggtgctgcgtgagcttcaacgtggacgtgaagaattccatgactttcagtggccccgtggaagacatgtttggatatactgtgcaacagtacgagaacgaagaggggaaatgggtcctcataggttctcctctcgtgggccagcctaaaaataggacgggggacgtttataagtgtccagtgggccggggcgaatcactgccttgcgtcaagttggatctaccggtaaacacttccataccgaatgtgactgaagtgaaggaaaacatgaccttcggttccacactggtgactaacccgaatggcggctttctcgcctgtggccccctgtatgcctacagatgtgggcatctgcactacaccactggcatttgctcagacgtctccccaacatttcaggtggtaaatagcatcgcccctgtgcaggagtgctctacacagctggatattgtgatagtgctggatgggtctaatagcatatatccttgggatagtgtgactgctttcttgaacgatctgctggagcgtatggacattggccccaagcagacccaggtgggcatcgttcagtatggggagaacgtcacacatgaatttaatctgaataagtattcttctaccgaggaagtcctggtggccgccaagaaaattgtgcagagggggggaaggcagacgatgacagccttgggaatcgatacagcaaggaaggaagccttcacagaagcccggggagcccggcgaggcgtgaaaaaagtgatggtcattgtcaccgatggagagagtcacgacaaccataggctgaaaaaagtcattcaggattgtgaggacgagaacatccaacgcttcagcatcgccattttgggttcctacaatcgcggcaatctgtccaccgaaaagtttgtggaggaaatcaagagcatcgcaagtgagccaactgagaaacactttttcaatgtttcggatgaattggccctggtgaccattgtaaagacactcggtgaacgaatttttgccctggaagctactgccgaccagagtgccgcctcattcgagatggagatgtctcagactggattctctgcccattactctcaggattgggtgatgctgggcgctgttggagcttacgactggaatggcacagtagtgatgcagaaagccagccagatcattatcccccgcaataccaccttcaatgtagaatctacaaaaaaaaacgaaccactggcttcctacctgggatacactgtgaatagtgctactgcgtcctccggcgacgtgctgtatatcgctggacaaccaagatacaaccacactggacaggtcattatttaccgcatggaggatgggaacattaaaattctgcagactttgtccggcgagcagatagggagttacttcggctcaatcctgaccaccactgacatcgacaaagattctaatacagatattctcctcgtaggtgcacctatgtacatgggaaccgaaaaagaggaacaaggcaaagtatacgtatatgcactgaaccaaacacggtttgagtaccagatgagcctggagccaataaaacaaacctgctgctcctccagacagcataacagttgcaccaccgaaaacaagaatgagccgtgcggcgcccggttcggcacagcaatcgcagccgtgaaggatctcaatctggatggcttcaatgatatcgtgatcggcgcacccctcgaagacgaccacggtggagcagtgtatatctaccacggctcaggcaaaaccatccgaaaggaatacgcccagcggatcccctccggtggcgatgggaagacattgaaattctttggccagagcatacatggggagatggacctgaatggtgatggtctgacagatgttacaattggaggacttggaggcgcagcactcttctggtctagagatgtggccgttgtaaaagtgacaatgaatttcgaacctaacaaggtaaatattcagaagaagaactgtcatatggagggcaaagaaactgtctgtatcaatgcaactgtgtgcttcgacgtaaagcttaaatcaaaggaggacactatctacgaggccgatcttcagtatcgggtgacccttgatagcttgagacagatctctaggagctttttttccggaacacaggagcgcaaagtgcagaggaatatcaccgttaggaaaagcgaatgcaccaaacactccttctatatgcttgacaagcatgactttcaggacagcgtgaggattacgctggacttcaatctcaccgatcccgagaatggccctgttttagatgactccttgcccaacagtgtgcacgagtatattccctttgccaaagactgtgggaacaaagaaaaatgcatctctgacctgtctcttcatgtcgcgaccactgagaaagaccttctgatcgtgcggtcccaaaatgacaagtttaatgtgagtctgaccgtcaaaaatacaaaagatagcgcatataatacaagaacaatagtccactatagccccaatctggtgtttagtggaatcgaagcaatccagaaggactcttgcgaatcaaaccacaatatcacctgcaaagtgggctatcccttcctccgacgcggtgaaatggtgacctttaaaatcctgttccagtttaacactagctatcttatggaaaatgtcacgatttacctgtccgcgactagcgattctgaagaacccccggagactttaagcgataacgttgtcaacatatcaatacctgttaagtatgaggtcggattgcagttctattcatctgcaagtgagtaccacatttccatagccgcaaacgagaccgtccctgaggttattaacagtactgaggacattggaaatgagattaacattttttaccttatccgcaagtcgggcagttttcccatgccagagctgaagctcagtatcagcttcccgaatatgaccagtaatggatatccagtgctttatcccaccgggctgagttcatcagaaaacgcaaactgtcgcccccatattttcgaagacccgttctctattaactcaggcaagaagatgacgacttcaacagaccatctgaagcgcgggacaattctggattgcaatacttgcaaatttgccactataacgtgtaacctcacttcctctgacatcagccaggtgaatgtctccttgatcctgtggaaacctacattcataaagtcctattttagctcactgaatcttactatccggggcgaactcaggtcggaaaacgcttcactggtcctttccagttccaaccaaaagagggaactggctatccagatctccaaggacggactgcctgggcgagttcctctgtgggtgatcctcttgagtgctttcgctggccttctgctgctgatgctcctcatccttgctttgtggaagatcggattttttaagcggccactcaaaaagaaaatggagaagtag

SEQ ID NO: 191550 - DNA, 3567 bp, Artificial Sequence
  Description of Artificial Sequence: Synthetic coding sequence
atggacctgccccggggcctggtggtggcctgggccctgagcctgtggcctggatttaccgacacgttcaatatggataccagaaagcccagggtcattcccggctcccgcacagctttttttggttacaccgtacagcaacacgacatcagtggcaataaatggctcgtggtgggggcgcccttagagacgaatggttatcagaaaacaggggacgtctacaaatgtccggttattcatggaaactgtaccaaactcaacctgggtcgagtgacgctgagtaacgtgtctgagcgtaaggataacatgagactgggtttgtccctggctactaatccaaaggataattcatttcttgcttgctcacctctatggtcccacgagtgcggctcctcatattataccactgggatgtgctcgcgcgtcaatagcaattttcgcttttccaaaaccgtcgccccagccttacaacggtgtcagacttacatggatattgtcatagtactggacgggtccaactcaatctacccctgggtggaggtgcaacatttcctgatcaacatcttgaaaaaattttatattggtcccggtcaaattcaagtgggcgtggtccagtatggcgaggatgtcgtgcacgagtttcacttgaacgactaccgctctgtgaaggacgtggtcgaagcagcaagccatattgaacagagggggggcaccgagaccaggaccgccttcgggattgaattcgctagaagtgaggcatttcagaaagggggcagaaagggggcaaaaaaggtaatgatcgtcatcactgacggggagtcccatgattcgcccgatctggagaaggtgatacaacaaagcgagcgcgataatgtaacaagatatgccgtcgcggtcctgggatactataaccgcagaggtatcaaccctgaaacctttctgaacgaaattaagtacatcgcttccgatcctgatgataagcattttttcaatgtgacggatgaggctgccttaaaagatatagtggacgcgctcggggacaggatcttttcactcgaagggacaaacaaaaatgagacttcatttgggctggagatgtctcagaccggattctcatctcacgttgtggaggacggcgttctgctcggtgcagtcggagcctacgattggaacggagcagtgctgaaggaaaccagtgctggtaaagtcatccccctgcgtgagagttacctgaaggaattcccagaggagctcaaaaatcacggggcctacctcggctacaccgtgaccagtgtcgtttcctcccgacaggggcgcgtgtacgtggctggagctccccggttcaatcatacaggaaaagtcatcctgttcacaatgcacaataacaggtccctgactatccaccaagcaatgcgcgggcagcaaataggctcatatttcgggagcgagatcactagtgttgatatcgacggagatggagtcactgatgtgctcctcgttggagctcctatgtatttcaacgaaggtcgagaacgcggaaaggtgtatgtgtatgagctacgtcagaatctgtttgtttacaatgggacactaaaagattcacacagttaccagaatgcccgatttggcagctctatagctagcgtgagggacctgaatcaggacagttataacgatgtagtcgtgggcgctccactcgaagacaatcacgctggggctatttatatttttcacggctttcgagggtctatattgaaaactcctaaacaacgtataaccgcatccgagcttgcaactggactacaatattttggatgtagcatccacggacagctggatctcaacgaggatggcctgatcgatctcgcggttggggcactgggcaacgccgtaattttgtggagcagaccagtggttcaaattaacgcgtcactccatttcgagccgagtaagataaatatcttccacagggactgtaaaagaagtggtagggacgcaacgtgcctcgctgcttttttgtgttttactccgattttcctggccccacactttcagactaccaccgtaggcatccggtacaatgcaaccatggacgagcggaggtatacaccccgtgcacacctggatgagggcggggacagatttacgaaccgagcggtgctattgtcttctggacaggaattgtgcgagaggattaattttcatgtgctggataccgctgactacgtgaaacccgttacattctctgtcgaatatagcctcgaagaccctgatcacgggcctatgctggatgacggttggcccactaccttaagagtctcggttccattttggaacggttgcaacgaggatgaacactgtgtccctgacctggtgcttgacgcccgcagcgacctcccaaccgcgatggagtattgccagcgggttttacggaagcccgcccaagactgctcggcctataccctgtcctttgataccacagtgttcattatcgaaagcacgcggcagagagtcgctgtggaggctactctggagaaccggggagagaacgcctactctactgtcctaaatatttcccagtccgccaacctacagtttgcttcattgatccaaaaggaagacagtgacgggtcgatcgaatgcgtgaacgaggaacggcgcctgcagaagcaagtttgcaacgttagttacccattcttccgggccaaggccaaggttgcctttcgcctagatttcgaattttcaaagagcatctttttgcatcatcttgagattgaacttgctgcaggatcagattctaatgagcgcgacagtacgaaagaggacaacgttgcccctctgcggtttcacttaaagtacgaggcagacgtactgttcacacgatcaagtagtttgagccattacgaggtgaagccgaacagctcactcgaaaggtacgatggaatcggaccgccgttctcgtgcattttccgaatccagaatctgggactcttcccgatccatgggatgatgatgaagattaccatcccaatcgcgacacggagtggaaataggctgctaaagctccgagactttctgacggatgaagcaaatacgtcatgcaacatttgggggaattccacagagtacagaccaacgcccgtcgaggaggatctgaggcgtgcgccgcagctgaaccactccaattcggacgttgtaagcattaattgcaatatcaggctagtgcccaatcaggaaattaattttcacctacttggtaacctgtggctccggagcctcaaggccctgaagtacaagtccatgaaaatcatggtgaacgctgctctccaacggcagtttcactcaccctttatcttccgcgaggaggatccctcccgccagatagtgttcgagatcagtaaacaggaggattggcaggttcctatctggatcatcgtgggatctactctaggaggcctcctgttactggccctgcttgtgttggccttgtggaagctaggttttttccgctccgcacgtaggagaagggaacctggcttagaccctaccccaaaggtgcttgagtag

SEQ ID NO: 191551 - DNA, 3570 bp, Artificial Sequence
  Description of Artificial Sequence: Synthetic coding sequence
atggacctgccccggggcctggtggtggcctgggccctgagcctgtggccaggttttacggacactttcaatatggacacccgtaagcccagggtgatcccaggctctaggacagctttcttcgggtatactgtccagcagcacgatatctcaggaaataagtggctcgtggtcggagcgcccctagagaccaatggataccaaaagaccggcgacgtttacaagtgtcccgtaatacacggaaactgtaccaagttgaacctagggcgagtcacgctgtctaacgtatcagagcggaaggataatatgcgactcgggttgagcctggcgacgaaccctaaggacaactcatttttggcgtgctccccactttggtcacacgagtgtggcagttcctattataccaccggcatgtgctctagggtgaattccaattttcggttttctaagaccgtggcgcctgcactgcaacgctgtcagacctacatggatattgtcattgtgttggacggctccaattccatatatccatgggtagaggtgcagcacttcctcattaacattctcaaaaaattttatataggtccaggtcagattcaggtgggcgtcgtgcagtatggcgaggatgtcgtgcatgaattccacttgaatgattaccgcagcgtcaaggacgtggtggaggctgcctcacatattgagcaaaggggagggactgagacaagaactgcatttgggatagagtttgcccggtctgaggcttttcagaaaggagggaggaagggagctaagaaagttatgatagtcattactgacggggagtcacacgactcccccgatctggagaaggtaattcaacagtctgaacgggataacgtgacgcgatatgctgtggctgtgctggggtattacaatcgcaggggaattaaccctgaaacattcctgaatgaaatcaagtacatcgcttcagaccctgatgataaacattttttcaacgtgaccgacgaggctgcactaaaagacatagttgatgccctcggagaccgaatctttagcttggagggaacaaacaagaatgagacttctttcggactggagatgtcccagactgggttctcctctcacgtggttgaggatggggtgttacttggtgcagtgggcgcctatgattggaacggtgcagtcctaaaggagacgtccgccgggaaggtgattccacttagggaatcatatctgaaggagtttcccgaagaactgaagaaccacggagcctatctgggctacacagtgacgtccgtggtgagttcaaggcagggaagggtgtatgtggctggcgctccaaggttcaaccacaccggaaaggtcatcctgtttactatgcataataataggtccttgaccattcaccaggcaatgcgcggccagcagatcggatcttacttcggtagtgagataactagcgtggacattgatggtgatggggtgactgacgtgttgcttgtaggtgctcctatgtatttcaacgaggggagggagcgtgggaaagtctacgtttatgagttacgccagaacctctttgtatacaacgggacgcttaaggactctcatagctaccagaacgctcggttcgggtcgtcaattgcaagtgtgagagatcttaaccaagattcctataatgatgttgttgtgggcgctccgttggaggacaaccacgccggcgctatatacattttccacgggtttcgtgggtctatcctgaaaacaccaaaacagagaatcactgcgtcagaactggccaccggtctgcaatactttggatgctctatacacggccaattggacctaaatgaagacggcctcatcgacctggctgtcggggcgctgggcaatgctgtgattctctggtctcgccccgtggtgcagattaacgccagcctgcactttgagcctagcaagattaatatcttccatcgtgattgcaagaggagcggccgcgatgccacttgtctcgctgccttcctttgcttcacccctatattcttggcccctcactttcagactaccacggtggggattcgttacaatgccacgatggatgagaggagatacacgcctagagctcacttggacgagggcggcgatcggttcaccaaccgtgcagtgctgctgagttcaggccaggagctttgtgagagaatcaatttccatgtgttggatacagccgactatgtgaaaccggtgacattttccgtggaatatagcttggaagatcccgatcacggtcctatgcttgatgacggctggccgacaaccctgcgcgtctctgtcccgttttggaatggctgtaacgaagacgagcattgtgtgccagatcttgtccttgatgcacgcagcgacctaccaacggccatggagtattgtcagagagttctgcgtaagcccgcacaggactgcagcgcatacaccctgtcttttgatactactgtcttcataatagaatctacccgacaacgtgtagccgtcgaggccaccctcgagaaccgaggcgagaacgcatatagcacagtgcttaatatctcccagtccgccaatctacagttcgcctcactgatccagaaggaggactctgacggaagcattgagtgtgtaaacgaagagagacgcctacagaaacaggtgtgtaacgtcagttaccctttttttagagcaaaggccaaggtagccttccgacttgacttcgagttcagcaagagtatctttctccatcatctggagattgaactggctgccgggagcgacagcaacgagcgagactccacaaaggaggataacgtggctcccctgcgtttccatcttaagtacgaagcagacgtcctgtttacccgaagttcaagcctgagtcactacgaagtaaagcccaactcttctctggaacgatacgacggaatcggaccaccattttcctgcatcttcagaatccagaatctcgggctgtttcccatccacggaatgatgatgaaaataaccattcctatcgcaactagaagcggtaatagactcctcaagctgagggactttctcactgacgaagttgcaaacacctcctgtaacatttgggggaatagcaccgagtacaggccaaccccagtggaagaagatctgagacgcgcaccccagctcaatcactctaactctgacgtggttagtatcaattgtaatattcggctcgtgcctaaccaagaaatcaacttccaccttttgggaaatctgtggcttcggagcctcaaggccctgaagtataagagcatgaagataatggttaatgcagcccttcagcggcaatttcacagcccctttatattcagagaagaggatcccagtaggcagatcgtctttgaaatctcaaagcaggaggactggcaggtcccaatctggattatagtagggtccaccctcggggggctgctcttacttgccctgctggtgttggcactgtggaagctcggattttttagaagcgcacgaagacgccgggagcccgggttagatccaacccccaaggtcctcgaatag

SEQ ID NO: 191552 - DNA, 2472 bp, Artificial Sequence
  Description of Artificial Sequence: Synthetic coding sequence
atgagccagaccggcttcagcagccacgtggtggaggacggcgtgctcctgggcgcagtgggtgcatacgactggaatggcgcagtactgaaggaaaccagtgcaggcaaagtgatcccactgcgcgagagctacctgaaggagttccctgaggagctaaaaaaccatggcgcatacttaggctacacagtcacttctgtggtgagcagccgacagggaagggtgtacgtggcaggagctcccaggttcaatcacacgggtaaagtaatcttgtttacaatgcacaataatcgcagcctgacaattcaccaagcaatgcggggacagcagatcggctcttacttcggttctgaaatcaccagcgtggacattgatggcgatggagtgaccgacgttctgctcgttggtgctcctatgtattttaacgaaggaagggagcggggcaaagtttatgtttatgagcttcgacagaacttgttcgtgtataatgggaccctgaaagacagccactcttatcagaacgcaaggtttggaagctcaattgcttcagtccgggacctcaaccaagacagctacaatgatgtggtcgttggcgcccccctggaggacaatcatgccggtgccatctatatttttcatgggttccgggggagcattctgaagacccccaaacagaggatcaccgcatccgagctggccacaggactgcagtatttcggctgttcaatccacggacagctggacctaaatgaggatggcctcattgatctggccgtgggagcactcggaaatgcggtcattctttggagtcgccccgttgtgcaaatcaatgcatcactccactttgaacccagtaaaatcaatatcttccaccgggactgtaagagatccgggcgggacgcaacctgcttagcggcgttcttgtgcttcacccctatattcctggcccctcattttcagactaccaccgttggcattcgatacaacgccactatggacgagcgtaggtatacacccagagctcacctggacgagggaggggacagatttaccaatagggctgttctgctgtctagcggacaagagctgtgcgaaaggatcaatttccacgtcctcgacaccgcagactatgtaaaaccagtgacattcagtgtggagtattcactggaggaccctgatcatggacccatgttggacgatggctggcccacaacgctaagggtgtcagtgcctttttggaatggctgtaacgaagatgaacactgcgtgcccgacctggtgctggacgcccgcagtgacctgccaactgccatggaatactgtcagcgcgtgctgcgtaagccagcacaagactgttccgcctataccctctcttttgacacgacagtgtttattatcgagagcacaagacaacgagtcgccgtagaggcaaccctggagaatcggggcgaaaatgcctattccaccgtgctcaatattagccaatcagctaaccttcagttcgccagcttaattcagaaggaggattctgacggctctatagagtgcgttaacgaagaacgccgcctgcagaagcaggtctgcaacgtttcctatcctttctttagggcgaaagcaaaagtcgcattccgacttgactttgaattttctaaatcaattttcctgcaccacctggaaatcgaattagccgctgggagcgacagtaatgaacgggactctacgaaggaagacaacgttgcgccccttagatttcacttgaagtacgaagcagacgttctattcacgagatcgtcttcactgtcgcactacgaagtgaagccaaattcctcgctggagaggtacgacgggattgggccaccgtttagctgcattttccggatacaaaaccttggacttttccccatccacgggatgatgatgaaaatcacaatccctatcgctacgaggagtgggaatagactcctcaagttaagggacttcctgaccgatgaagctaatacaagttgtaacatctgggggaactcaaccgagtatcggcccacccctgtcgaggaagatctgcgccgggccccgcagttgaatcatagcaactcagatgtggtgagcatcaactgcaatattagactcgtccccaatcaagagattaacttccatctgctgggtaacctgtggttacgatctctcaaggcgctcaagtacaaaagcatgaagataatggtcaatgccgcattgcagcgtcagtttcacagcccttttattttcagggaagaggacccttcaagacagatagttttcgaaatcagcaagcaggaggattggcaagtgcctatctggatcattgttgggtcaaccctgggcggcctactgcttctggccctgctggtgctcgccctgtggaaactcggcttttttcgcagcgcacgccggcgcagggagccaggcctcgaccccacccccaaagtactggagtag

SEQ ID NO: 191553 - DNA, 1953 bp, Artificial Sequence
  Description of Artificial Sequence: Synthetic coding sequence
atggacctgccccggggcctggtggtggcctgggccctgagcctgtggcctggttttactgataccttcaacatggacactcggaagccacgcgtgattcctggctcacggaccgcattcttcggctatactgtgcaacaacacgatatcagtggaaataaatggttagtcgttggcgccccgctcgagacaaacgggtatcaaaagaccggcgacgtatacaagtgccctgtcatccacggcaactgcaccaaactcaacctgggaagagttacactctcgaatgtgagcgaacgtaaagataatatgcggctgggcctatctctggcgacaaaccccaaggacaattcttttctcgcatgctctccgctgtggtcgcatgagtgcgggtcatcctattacaccaccggcatgtgctcccgggtgaactcaaacttccggtttagcaagactgtagcccccgcactccaaagatgtcagacgtatatggacatcgttattgttctggacgggagcaattccatctatccctgggtcgaagtgcagcacttccttattaatatccttaaaaagttttatattggacccgggcagattcaggtcggcgtcgtacagtacggtgaggatgtggtgcatgaattccaccttaacgactatcgcagcgtgaaagacgtagtggaggcggcctcgcatattgaacaacgcggcgggaccgagacccgaaccgccttcggcatcgaattcgcacgctcagaagctttccaaaagggcggacgtaagggggccaagaaggtaatgatcgtgatcactgatggagagtctcacgactcaccagatcttgagaaggtcattcagcaatcagaacgcgacaatgtcactcgttacgcagtcgctgtgcttggatattataataggaggggcatcaacccggaaacatttctgaatgaaatcaaatacatagcttctgatcctgacgataagcacttcttcaatgtcacagatgaggctgccctgaaggatatagtagatgctcttggagatcgtattttttcactggagggcaccaataagaacgagacctcttttggtttagaaatgagccagacgggtttctcgtctcacgtggtcgaagacggggtcctgctgggagctgtgggtgcctacgactggaacggagccgttctgaaggaaacctccgctggcaaagttatccctctccgagagtcctaccttaaggaattccctgaggagctcaagaaccatggggcctacttgggctacacggttacgtccgtggtgagcagtagacaagggcgagtgtatgttgcgggagccccccgatttaaccatacaggaaaggttattctgtttaccatgcacaacaatcggagtctgaccattcaccaggcgatgcgtggccagcagatcggaagttactttggcagcgaaattacaagcgtggatatcgacggcgatggcgtgacggatgttctgttggtgggagctcccatgtattttaacgagggtagagaacgggggaaggtgtacgtctatgagttaagacaaaatctgttcgtgtataacggcacccttaaagactcccattcctaccagaacgcccgctttgggtctagcatcgctagcgtgcgcgatttaaaccaagatagttacaacgatgtggttgtcggtgcccctctggaggataatcatgccggtgccatttatatatttcatggcttccgaggctctatcttgaagaccccaaaacaacgaatcactgctagcgagctggcgacaggactgcagtatttcgggtgctctatacatggccagttggatctgaatgaggacggactgatagacttggccgtgggagcactcggtaacgcagtgattctctggactcccccccccaaatgctggagcgaggctcctgaggaaacattaagttag

SEQ ID NO: 191554 - DNA, 3546 bp, Artificial Sequence
  Description of Artificial Sequence: Synthetic coding sequence
atgggccccgagcggaccggcgccgcccccctgcccctgctgctggtccttgccctgtctcaaggaatcctgaattgttgtctggcctataacgttggactccctgaggccaagatcttttcagggccttcgtccgagcaattcgggtacgccgtacagcaatttattaacccaaaaggcaactggctgttagtcggcagcccctggtctggttttccagagaatcgcatgggagacgtctataaatgccccgtcgatttgtcaacggccacatgtgaaaagcttaacctacagacgtctacctcgatcccaaacgtaaccgagatgaaaacaaatatgtccctcggcttgatcctgacccggaacatggggacgggcggtttcctcacttgcgggccactgtgggcccaacaatgtgggaatcagtattacaccactggagtgtgcagcgacatcagccctgatttccaactgtcagctagtttctctcccgctacccagccttgcccctccctgatcgacgtggtcgtggtttgtgacgaatcaaactccatctatccgtgggacgccgtaaaaaatttcctggaaaagttcgttcagggactcgacatcggacctacgaaaacccaggtgggtctaattcagtacgccaataatcccagagttgtctttaatctgaacacctacaagactaaggaagagatgatcgtcgctaccagtcagacatcccagtacggtggcgacctcaccaatacattcggcgctattcaatacgcaagaaagtacgcatattctgccgcttctggcggacgaagatcagccactaaggtcatggtcgtcgtcacggacggagaaagtcacgatggctctatgttgaaagccgtgatcgatcagtgtaatcatgacaacatcctccggttcggcattgctgtcctcgggtatctcaataggaacgcactggacaccaagaacttgatcaaagagatcaaggccattgcttcaattccaaccgaacgctacttttttaatgtgtccgacgaggcggcgctcctagagaaggctgggacacttggcgaacagatcttcagcatcgagggcaccgtgcaaggtggtgacaactttcagatggaaatgagtcaggtgggcttttccgccgattactcgtcccagaatgatattttaatgctcggagccgtgggcgcattcggctggagcggaaccatcgtgcagaagaccagccatggacaccttatcttcccgaagcaagcatttgaccagatcttacaggatcggaatcattcctcttacctaggctacagcgttgctgcgatcagcacgggagaatccacccattttgtggctggtgcaccacgcgccaactacaccggccagattgtgctgtatagcgtgaatgagaacggcaacatcaccgtgatccaggcacataggggtgatcagattgggagctacttcggcagcgttttatgttctgtcgatgtggacaaggatacgatcaccgacgtcctgctggttggcgccccaatgtatatgtccgacctgaaaaaggaggaggggcgcgtgtaccttttcacaatcaaagagggcattctggggcagcatcagtttctggagggtccagaagggatcgagaatacccgcttcgggtccgccatcgctgcgctgtcggacatcaacatggacggctttaacgacgtgattgtgggatccccgctggagaaccagaactcgggagccgtctatatctacaacgggcaccaggggacaatccgcacgaaatactctcagaaaatccttggatcagacggggcttttagaagccatcttcagtatttcgggcgttcattggacggatatggcgaccttaacggagattctatcactgatgtgagtattggcgccttcggccaagtggtgcaattgtggtcccaatccatcgccgatgtggccatcgaagcctcgttcacaccagagaaaatcactctcgtcaataagaatgctcagatcatcttgaaattgtgtttctccgctaaattcagaccaactaagcagaacaatcaagttgccatcgtctataacatcaccctggacgccgatggattttcatcaagggtgacatccaggggcctcttcaaagagaataatgagcgatgcctgcagaaaaatatggttgtgaatcaggcccagtcttgtcctgaacacatcatttacattcaggaaccgtccgacgtcgtaaatagcctggatcttagagtggatatctctctggaaaatcctggtacgagccccgcgctggaagcctatagtgagactgcgaaggtattttctattcccttccataaggactgtggagaggatggattatgtatctcggacttagtactggacgttcgccagattccagccgcacaggagcagccctttatcgtgtccaatcaaaacaaacgactcactttctctgttacactgaaaaacaagcgcgagagtgcctacaatacagggattgtggtggacttctccgagaatctgtttttcgcctccttctctttgccagtcgacggaaccgaggtgacttgccaggtagctgcttcgcaaaagtctgtcgcgtgtgacgttgggtacccagcgctgaagagagagcagcaagtgacgtttactatcaactttgacttcaacctgcaaaacctgcagaaccaggcaagcctgagtttccaggccctgagtgaaagccaggaagagaataaagctgataacttggtcaatctcaaaattcctcttctctacgacgctgaaattcacctgacaagatctacaaatataaatttctatgagatcagttcagacggcaacgtacccagcatcgtccacagcttcgaggatgttggacccaaattcatattctctctcaaggtgaccacaggtagcgtgcctgtttctatggcgacggttattatacacatcccccaatacacaaaggaaaaaaaccctttaatgtacctcactggagtgcagaccgataaggcaggcgatattagctgcaatgcggacatcaatccgctgaagatcggccagacgtcatcatccgtaagttttaagtcagaaaactttagacatacaaaggagctcaattgccgtacggcatcttgttccaacgtgacgtgctggctgaaagatgtgcatatgaaaggagagtacttcgtgaatgtcaccacaaggatatggaacggtaccttcgcctcatccacttttcagaccgtccagctgaccgccgccgcagaaattaatacatataatccagagatctatgtgattgaagataacacagtgactatacccctgatgatcatgaagcccgatgaaaaggctgaggttcccacaggagtcattatcggctcaataatagctggcatcctactgctgctggcccttgtggcgatcttatggaagcttggcttctttaaaaggaagtatgaaaagatgactaaaaatcccgatgagatcgacgagaccaccgagctgagcagctag

SEQ ID NO: 191555 - DNA, 2448 bp, Artificial Sequence
  Description of Artificial Sequence: Synthetic coding sequence
atgggccccgagcggaccggcgccgcccccctgcccctgctgctggtgttggctctatcacagggcatcctgaattgttgtctcgcctataacgtcggtctacccgaagcaaagattttttcgggcccctcttccgagcagtttggctacgccgtccagcagtttatcaatcctaagggcaactggctccttgtgggtagtccatggtctggtttcccagagaatcggatgggagacgtttataagtgtccagtggacttgtctactgctacttgcgaaaagctgaaccttcagacctcaactagtattcccaacgtcacagaaatgaagacaaatatgtctctcgggctcattctcacgcgtaatatgggcaccggcggctttctgacatgcggtcccctttgggcgcagcaatgtggcaaccagtattataccaccggcgtgtgtagcgacatttctccggacttccagctgtctgcaagcttttctcccgccacacaaccatgccccagtctcatagatgtcgtagtggtttgtgacgaatccaactcgatttatccatgggacgctgtcaagaacttcctggaaaagttcgtgcagggcctggacataggaccaaccaagacacaggtgggcctaatacagtatgcaaataacccaagagttgtcttcaacctcaatacttataagacgaaggaagaaatgatagtggctacaagtcagacctcacagtacggcggcgacctgacaaatactttcggggccatacagtacgcacgcaaatacgcatacagtgccgcctcagggggtagacggagtgcgacaaaggttatggtggtggtaacggatggcgagtctcacgacgggtcgatgttgaaagctgtaatcgaccagtgtaatcatgataacatcctgcgattcggcatcgcagtgctcggctacctaaatcgaaacgccctcgataccaagaatctgataaaggagattaaggccatcgcctctatacctacagagagatatttcttcaatgtgtctgacgaggcggctctgctggagaaggcaggtacccttggagaacagatttttagcattgagggaacggtgcaaggtggcgacaactttcagatggaaatgtcccaggtagggttcagtgctgactacagcagccagaacgatatactcatgctcggtgccgtgggagccttcggttggagtggcaccatcgtgcaaaagacgtctcacggccacctgatctttcctaaacaggcctttgatcaaatcttacaggaccgtaaccatagctcctatctgggatacagtgtggctgccattagtactggcgagagcacacactttgtcgcgggggcgccacgagcaaactacacaggccagatcgtgctatacagtgtcaacgaaaacgggaacattactgtgatacaggcgcatcgaggtgatcagatcggctcctacttcggctccgtcctgtgctccgtcgatgtggacaaagataccattactgacgttctcctggttggtgctcccatgtatatgtctgacctaaagaaggaagaaggaagagtatatctcttcactataaaagagggaattctgggtcagcaccagttcttagaaggaccagagggaatagagaatactagatttgggtccgcaatcgccgcccttagtgacataaatatggatgggttcaacgacgtcatcgtcggctcaccactggagaatcagaacagtggggcagtatacatctataatggccaccagggaacaattaggacgaaatactctcaaaaaatacttggcagcgatggagcctttcggtcccaccttcagtacttcggccggtctctcgatggttatggcgatctaaacggcgacagcattactgatgtgtccatcggcgctttcggacaagtagtccagctgtggtcccagtctatcgctgacgtcgctattgaggcaagcttcactcccgagaagattacactcgtgaacaagaacgcccagatcatcttgaaactgtgcttttctgccaagttcagacctacaaaacaaaataatcaggttgctatcgtgtataacattaccctagatgctgatggatttagctctcgggttacctcacgagggcttttcaaagaaaataatgagcggtgcctccaaaagaacatggtggtcaaccaggcgcaatcatgccccgaacatattatctatatacaggaaccaagcgacgttgttaattcactggacctgcgcgtcgacatcagcctcgaaaaccccggcactagccccgctctggaggcctacagcgagaccgcaaaggtctttagcatccccttccataaggactgcggggaagatggcctatgcatttccgacctggtcttggacgttcgccagataccagcggcacagttaatgggacaaaaatag

SEQ ID NO: 191556 - DNA, 1926 bp, Artificial Sequence
  Description of Artificial Sequence: Synthetic coding sequence
atgggccccgagcggaccggcgccgcccccctgcccctgctgctggtcctggccctctcccaggggatcttgaattgctgcttggcctataatgttggactgcctgaagccaagatattctccggtccttcctcggaacagttcgggtacgccgtccagcaatttataaaccccaaggggaattggttgctcgtgggatctccatggagcggtttccctgaaaatcgaatgggtgatgtgtataaatgtccagtagatctttctaccgctacctgtgagaaattgaacctgcagacatctaccagcattccgaacgttactgagatgaaaaccaatatgtcattaggtctaatcctcacccgaaacatggggaccggtggcttcctgacttgtggcccattatgggcacagcagtgcggcaatcagtactacacaacaggagtctgttccgatatatctcctgacttccagctctctgcctccttcagcccggccacccagccttgtcccagtctgatcgacgtggtggtggtgtgtgatgaatccaactccatttacccgtgggatgctgttaaaaatttccttgagaagttcgtgcagggtttggacattgggccaaccaaaacacaggtaggacttatacagtacgccaacaacccccgggtggtatttaaccttaacacctataagacaaaagaggaaatgatcgtggctacatctcagaccagccaatacggcggggatctgacaaataccttcggcgcgatccagtatgcccggaagtacgcctactccgccgccagcggcgggcggcgcagtgccacgaaagtaatggtggtggtgaccgacggggaatcccacgatggcagtatgcttaaggcagttattgaccagtgtaatcacgacaatatcttgcgattcggcatagccgtgctaggatacctcaacaggaacgctctggataccaagaaccttattaaggagattaaggctatagcatctattccaactgaacgctattttttcaatgtgagtgacgaggcagctctgctggagaaggccgggactctgggagagcagatcttttcaatcgagggcaccgtgcagggaggcgacaacttccagatggaaatgagccaggtgggctttagcgctgactatagcagccagaacgacatcctaatgttaggggctgttggggcgttcggctggagtggtaccatcgtacaaaaaacctcccacggacacctgatcttccctaagcaagctttcgatcagatcctccaggatcggaaccactcctcctatttaggatattccgtcgcggcaatttctactggcgaatcaacccatttcgtggctggagcccccagagcaaactatacaggacagatagtcttgtacagcgtgaatgagaatggcaacataaccgtgattcaggcccatcggggggaccagatcgggtcctacttcggctctgtgctgtgcagcgtcgacgttgacaaggataccattactgacgtgctcctggtgggtgcccccatgtatatgagcgaccttaagaaagaagaggggagggtctacctgttcactattaaggagggaatattggggcagcatcagtttctggaaggtccagaagggatagagaacacaaggttcggttccgcgattgcagccctgagcgacatcaatatggatggtttcaatgacgtgatcgtaggttccccactcgaaaatcaaaattctggggcagtgtacatatataacggtcaccagggaaccattcgaacaaagtactcccagctcctatgcacaatcatatcgtgccaaacctgtagtttccggaagagctgggatccaatggagccattaggggctatctcctcaaccctcggtgggccatggatggcaatggagatatag

SEQ ID NO: 191557 - DNA, 2829 bp, Artificial Sequence
  Description of Artificial Sequence: Synthetic coding sequence
atgggccccgagcggaccggcgccgcccccctgcccctgctgctggtgctggccttgtcacagggcatcctgaactgctgcctagcctacaacgtgggcttacctgaggcaaagattttttctggtccatcaagcgaacagttcgggtacgctgtgcagcaatttatcaatcctaagggcaattggctgctcgtggggagtccatggagtggttttcctgaaaacagaatgggcgatgtttacaaatgtcctgtcgatctgagtacagcaacctgcgagaaactcaatctccaaacctcgacctccattccaaacgtaactgagatgaagacgaacatgtccctcggtttaattcttactagaaatatgggaaccggcggattcctcacctgcggaccactgtgggcacagcagtgcgggaatcagtattacacaacaggcgtttgttcagacatctcacccgactttcaactgtcagcaagtttctcgcccgccacacaaccctgtccctcccttattgacgttgtagtggtatgcgacgagagcaattctatttacccttgggacgctgtgaaaaactttctggagaaatttgtccagggactcgacatcggccctactaaaacacaggtcggcctaattcagtatgctaataatcctcgtgttgtgttcaatctgaacacgtataagacaaaagaagagatgattgtggctactagccagacctctcagtacgggggagacttaactaacacctttggcgcgattcagtacgctcgtaagtacgcgtattcagctgcaagtggaggccggcggtctgccactaaagtcatggtagtcgtgaccgatggagaaagccacgatggatctatgctcaaggctgtgatcgatcaatgcaaccacgacaacattttacgcttcgggatcgcagtactggggtatctgaaccgaaacgccttggatacaaaaaacctcataaaagagatcaaagccatcgcgtcgatccctactgagcggtactttttcaacgtaagcgatgaggccgctctcctggaaaaagctgggaccttgggcgagcagatattctctatagagggtactgttcagggcggcgataactttcagatggagatgtctcaggtgggattttccgctgactattccagtcagaatgacatcctcatgctgggggccgtcggagctttcggttggagcggcacgattgtgcagaaaacgagtcatggacacctgatcttccccaagcaggcttttgatcaaattcttcaagaccgaaatcacagctcatatcttggatacagtgttgccgctatctctactggcgaatcaacgcatttcgtagcaggcgccccaagagcgaattacacaggtcagattgtcttgtacagcgtgaacgaaaatggaaatatcacggtcattcaagcccaccgtggtgaccaaatcggctcctactttggcagcgttttatgcagtgtcgacgttgacaaggatacaattacagatgtgcttcttgtgggggctcctatgtacatgagcgatctgaagaaggaggagggacgagtctacttattcactatcaaagaggggatcctgggacaacatcaattcctggagggacccgaggggatcgaaaacacccggtttggcagcgcaattgccgccttgtccgatattaatatggacggcttcaatgacgtcattgtggggagcccactcgaaaatcagaacagtggagccgtttacatctacaatggacaccaggggaccatcagaactaaatacagccaaaaaatattaggctcggacggagcgtttagatcccacctccagtacttcggccgcagtttggatggttatggagatctgaacggcgactcaataaccgatgtgagcattggcgccttcggccaggtggttcagctttggagccaaagcatagctgatgtagctatcgaagcgtctttcacgccggaaaagattacgcttgtgaacaagaatgctcagatcatattgaaactctgctttagcgcaaagtttcggcctaccaaacagaataatcaggtagctatcgtttataatattacactcgacgcagacggcttctcgagccgggtgacgtccaggggtctctttaaggagaacaatgagagatgcctacagaaaaatatggttgttaaccaggcccaatcctgcccagagcacatcatctacattcaagagccgagcgatgtagtgaacagtctggacctgcgagtggacatcagcctagagaaccctgggacctcccccgctctggaggcatactccgaaactgctaaggtgtttagtatccccttccacaaagactgtggtgaggacggactgtgtattagcgatctggtgttagacgtaaggcaaattcctgctgctcaggaacagccgtttattgtctccaaccagaacaaaagacttacattttctgtgactttgaagaataagcgtgagtcagcctataatacaggaattgtggtggatttctctgagaatcttttcttcgccagtttttctcttcctgtggacggaacagaagtcacatgccaagttgctgcaagtcagaaaagcgttgcatgtgatgtgggttatcctgctctgaaaagggaacagcaggttacattcaccataaattttgacttcaacctgcagaacttgcaaaatcaagcaagtctgtcgttccaggccctgtcagaatctcaggaggaaaacaaggccgataacctcgtgaatctgaagattcccttgctgtacgatgctgaaatacaccttacccgatag

SEQ ID NO: 191558 - DNA, 3120 bp, Artificial Sequence
  Description of Artificial Sequence: Synthetic coding sequence
atggcccgggccctgtgccccctgcaggccctgtggctgctggagtgggtcttattgttgctgggtccttgtgctgcccccccagcgtgggccctcaatctcgatccagtgcagcttacgttttatgctggccccaatggatctcaattcggcttctccctggactttcacaaagacagtcacggtcgggtggccatcgttgtgggcgccccacgcactctaggcccctcccaagaggaaactggcggtgtcttcctttgcccttggcgggctgaaggcgggcagtgtccgtccctcctgttcgatttacgcgacgagacacgcaacgttgggtctcagacactgcaaacctttaaggcccggcagggtttaggcgcatcagtcgtcagctggtccgatgtgattgtggcatgcgcgccttggcagcattggaacgtcttggaaaaaacagaagaagcagaaaagactcctgttggctcatgcttccttgcacagccagaatcaggaagacgtgcggaatacagtccgtgtagaggaaatactctcagccggatctatgtcgagaacgatttctcgtgggacaagcgttactgcgaggcgggcttctcttccgtagtgacccaagccggagagctcgtactcggggctccaggcggttactacttcttagggctcttagcccaggctccagtcgccgacatttttagtagctatcgtcccggaatcctgctgtggcatgttagctcacagagtctctccttcgactcctccaatcctgaatactttgatggctactgggggtattcggtggcagtgggggagttcgatggagatctcaacactactgaatatgtcgtcggggctcccacatggtcctggactctgggagcggtagaaatcctggattcctactaccaacggcttcaccggctgcgaggagagcagatggcctcttattttggccactcagtcgccgtcactgatgttaacggggacggccgtcacgaccttctggtgggcgcacccctatatatggagtccagggctgacagaaaactcgccgaagttggcagggtctatcttttcctgcagcccagagggccgcatgccctgggcgccccctcccttctcctgaccggtacccaactctatgggcgttttgggagcgccattgcacctctgggtgacctggatagggatggttacaatgacattgcggtggccgcaccttatggaggcccaagcggacgcggccaggtcctcgtgtttctgggacaatcagaaggcctgcgatccagacctagtcaggtcctagattccccttttcccaccggcagcgcttttggcttttctttaagaggggccgtggacattgatgacaatggttatcctgatctaattgtgggcgcctatggggcaaatcaggttgctgtatatcgagcccaacccgttgtgaaagcctctgttcagctgctagtacaggacagtttaaaccccgcagtcaagtcttgtgtgctgccgcagacaaaaacacccgtgtcatgctttaatatccagatgtgcgtgggtgccaccgggcataacattccgcagaaactgtcactcaatgccgagctacagctggaccgtcagaagcccagacagggcagacgtgtactcctgctgggctctcagcaggcaggtacaacacttaaccttgaccttggtggcaaacacagccctatctgccacaccacaatggcattcctcagagatgaggcagactttcgagataagctcagtccaatcgtgttgagtctaaatgtcagcctgccgcccaccgaagctggaatggctcctgcggtcgtgctgcacggtgatacccatgttcaggagcagactcgcattgtgctcgactgtggagaggatgatgtgtgtgtgcctcaactccagctgaccgccagcgttaccggaagccctttactggtaggagctgataacgtcttggaactccaaatggatgctgccaacgagggcgaaggtgcatatgaagctgagctggctgtccacctgccacagggagcccattacatgagggccctctcaaacgtggaaggcttcgaacgcttaatttgcaaccaaaagaaagagaatgaaacccgggtggtcctctgcgagctgggcaaccccatgaagaagaatgcccagattggaattgccatgttggtgtcagttggcaacctagaagaggccggagaaagcgtgagctttcagctgcagattcggtctaaaaattcccagaatcccaatagtaagattgttttgctcgacgtgcctgttagagccgaggcccaggtggaactgcgtggcaactccttcccggcatcgctcgtggtcgccgcagaagaaggggagcgcgagcagaacagcctggatagctgggggcctaaagtggaacacacctacgagctgcacaacaatgggcccggcaccgtcaacgggttgcatttgagcatccacttacctgggcaatcacagccaagcgaccttctgtacatcctggacattcagccgcagggggggctccagtgttttccgcagcctccagtcaatcctctgaaggtggactgggggttgcccatcccatcgcctagccccatacaccccgcgcatcataaacgcgataggcgacaaatctttctgccagaaccagagcaaccttcgaggctccaggatcccgtgttggtcagttgtgactcggctccatgtaccgtggttcaatgcgacctgcaagaaatggcgagaggccagcgtgccatggtgactgtgttagcctttctctggctccccagcctttaccagaggcctcttgaccagtttgtactgcagagtcacgcttggtttaatgtatctagccttccatacgccgtaccacccctgagcttgcctcgaggcgaagcccaggtgtggacccagcttcttcgggccctagaggaaagagctataccaatctggtgggtcctggtgggggtactggggggtctccttctactaaccattttagtgcttgctatgtggaaagtaggcttctttaagcgcaaccggcccccacttgaagaggatgacgaggaaggggaatag

SEQ ID NO: 191559 - DNA, 3018 bp, Artificial Sequence
  Description of Artificial Sequence: Synthetic coding sequence
atggcccgggccctgtgccccctgcaggccctgtggctgctggagtgggtgctgctgctgctggggccttgtgcggccccaccggcatgggccttaaatttagatcctgttcagcttaccttctatgccgggccaaatggatcgcagttcggcttctccctcgatttccataaagattcccacggtcgggtcgccattgtcgtcggcgctcctcgtacactcggaccatctcaggaggaaacaggcggcgtgtttctgtgcccctggagagccgagggggggcagtgccctagcctgctgttcgatcttcgcgacgagactagaaatgttgggtcacaaaccttgcaaacttttaaggcccggcaaggacttggagcatcagtcgtctcatggagcgatgtgattgtggcgtgtgcaccatggcagcactggaatgtcttggagaagactgaggaagcagaaaaaacccctgtcggtagctgctttctggctcagccagagagtggaaggagagccgaatattccccttgtcgtggtaatacactcagtcgaatttatgtggaaaatgacttttcatgggacaaacggtactgcgaggctggcttcagcagcgtagtgacacaggccggagagctggtcctcggtgccccaggtgggtattacttcctgggactgttagcacaggcacccgtagccgacatcttctcctcttacagacccgggattttgctgtggcatgtgtcgtcccagtccctttcctttgacagctccaatcccgagtatttcgatggctactggggatactctgttgccgtgggtgagttcgacggagatcttaatactacggaatatgtggtgggagctccaacctggtcttggactctgggagccgttgagatcctggatagttattatcagaggttacatcggctacgcggggagcagatggcatcgtactttgggcatagcgtcgctgtgacggacgtcaatggcgacggccggcacgacctcctcgtgggggcccctctgtatatggagagtcgtgccgatagaaagctcgctgaagtagggcgggtgtacctttttctgcagcctcgaggcccacacgctctgggtgccccaagcctcctgctgacaggaacccagctttacggacgcttcgggagcgctatagcacccctcggtgatctagaccgggacggatataatgacatagctgtagcagcaccatacggaggcccgagcggtcgagggcaggtcctcgtcttccttgggcaaagtgagggactgcggtcccggccctcgcaggtccttgactcacctttcccaaccggatctgctttcggtttcagtctgcgtggggccgtcgatattgacgacaatggatacccggatttaattgtgggggcctacggcgccaaccaagtcgcagtatatagggctcagccagttgtcaaagcctctgtgcagctcctggtccaagactcactgaatcccgccgtgaagtcatgtgttcttccccagactaaaactccagtgagttgcttcaatattcaaatgtgtgtgggcgctacaggccacaatattccacagaagctgtcattgaatgcagagttacagctggacaggcaaaaaccacgccagggacgcagagtgttactactcggatcccaacaggcagggactacacttaacctggatcttgggggcaagcattctcctatttgccacaccactatggctttccttcgagatgaagctgacttccgggacaaactgtccccaattgtgctgagcctcaacgtttcactgcccccaaccgaagccggcatggccccggccgtagtcctccacggcgacactcacgtccaggagcagactagaatagtactggactgcggcgaggatgatgtgtgcgttcctcagcttcagctgaccgcttccgttacgggatcgcctttgttagtgggcgcagataatgtgctggagctgcagatggatgctgcgaacgaaggagagggcgcctacgaagcagagctcgccgtccatctgcctcagggcgcccattatatgagagctctgagcaacgtcgagggctttgagcggctcatttgcaatcaaaaaaaggaaaacgagaccagagtcgtcctctgtgagctagggaatcccatgaagaagaacgcacagataggaattgcgatgttagtctctgtgggaaacctggaagaagccggggagtccgtaagctttcaactccagattcgatctaaaaacagccagaatcccaactcaaaaatcgtactgctggatgtgcctgttcgcgctgaggctcaggtcgagttgaggggcaacagcttccctgcaagcttggtggtggcggccgaagagggcgaacgcgagcagaatagcctggacagttggggccccaaagtggaacatacctacgaactccataacaacgggcctggcactgtgaacggcctacacctgagtatccatttgccaggccaaagtcagccgtcggacttactttatatcctagacatacagcctcagggaggcctgcagtgcttcccgcagcccccagtgaatcccctgaaggtggactggggtttgcctattccatctccaagtccgattcacccagcgcaccataagcgggatagacgacagatcttcttgcccgaacccgagcaacccagtcgactgcaggaccccgtgctggtgagttgcgattcagcgccttgcacagttgtgcaatgcgacttgcaggaaatggcacggggacagcgcgcgatggtaaccgtgcttgcattcctgtggctaccgtcgctctaccaggtgtggacacagttgctgagggccctggaagaacgggcgatccccatatggtgggttctcgtgggcgtcctgggcgggctgctccttttgactatcctcgtactcgccatgtggaaggtcggatttttcaagcgaaatcgtcctcctctggaggaggacgatgaggagggagaatag

SEQ ID NO: 191560 - DNA, 660 bp, Artificial Sequence
  Description of Artificial Sequence: Synthetic coding sequence
atggccagctacttcggccacagcgtggccgtgaccgacgtgaacggggacgggcgtcacgatctcttggtcggcgctccgctgtacatggaatcccgagccgaccgaaagctcgccgaagtgggaagggtttatctgttcctacagccacgcggcccccacgccctgggtgccccgtccctactgttgacaggcactcagctttatggaaggttcggctctgcaattgcacctctgggcgatcttgaccgggacggctacaacgatatagccgtggctgcaccctatggggggccctctgggcgcgggcaggtactggtttttctaggacaatccgaaggcctccgatctaggcctagccaggtgttagactccccctttcctaccgggtccgcattcgggttttccctacgcggcgcggtcgacatcgatgacaatggatatcctggtgcactcgattgtctacaactggagatgccgaaaaaaggaccatggactttcgcaggttcagccaaacggcacggtcagggcctgatgcctggacttgtcagtcactacggcctcccggaggggttgggtgaaaccagctccggtggtggaggtgttggcaacccttgggaggacgagatgagaataccttgtcctaaccgacagttctag

SEQ ID NO: 191561 - DNA, 3201 bp, Artificial Sequence
  Description of Artificial Sequence: Synthetic coding sequence
atgggccccggccccagccgggccccccgggccccccggctgatgttgtgtgccctagctcttatggtggctgcaggcggatgtgtcgtaagcgcctttaatctggacaccaggttcctggtcgtgaaagaggcagggaatcctgggtcacttttcggatatagtgtggcgttacacaggcagacagagcggcagcaaagatacctactgctcgccggagcccctcgcgagctcgcagtgcctgacggatatactaatcgcacaggcgcagtgtatctttgccctctgaccgcacataaggacgactgcgagcgtatgaacattaccgtgaagaacgaccctggtcaccacatcatcgaggacatgtggctgggagtcaccgtcgcctcacaaggtcccgccgggcgggtgctggtgtgcgcgcatcgctacacccaagtactgtggagcgggtcagaggaccagaggagaatggtcggaaagtgttacgtcagaggaaatgacctggagttagactcatccgacgattggcagacctatcataacgagatgtgtaactctaacacagattacctggagacaggcatgtgccagcttggcacaagcggcggcttcactcagaacacggtgtacttcggcgctcctggcgcttacaattggaaaggcaactcatacatgatacagcgtaaggaatgggacctgtctgagtacagctataaagatcctgaggatcagggcaatctctacattgggtacacgatgcaggtgggaagttttatcctgcaccccaagaatattactatagtcacgggcgctccgcgacacagacacatgggcgccgtttttctgcttagtcaagaagccgggggggacctacggagaaggcaggtcctggagggaagtcaggtcggggcttatttcggcagtgctattgcactggccgacctgaacaacgatggctggcaagatctgctggtgggcgccccgtattatttcgagcgtaaagaggaagtcggtggtgctatatatgtgtttatgaatcaggccggaactagtttccccgctcatccctctttgctactccacggccctagcggcagtgccttcggtctgtcagtggcgtccattggggacatcaaccaggatggcttccaggatattgcggtaggtgctcccttcgaagggctggggaaagtttatatataccacagtagcagcaagggcttgttgcgacaaccacagcaggtaatacatggggagaagctcggcctgcctggcctggctacctttggctattccctgtcaggccagatggatgttgacgagaacttttacccggatctgttggtggggtccctgtccgatcatattgttttgctgagggcgcggcccgttattaatattgttcacaagacactggtgccccgacccgccgtgttggacccagcactgtgtactgccacaagttgcgttcaggtggaactatgcttcgcctacaatcaatccgccggaaatcctaattaccggcgtaacataacccttgcttacacccttgaggccgacagagacagacgcccccccaggctgagattcgccggatctgagtctgcagtttttcatggctttttctccatgcctgagatgcgctgtcagaaactcgagctcctgcttatggataatttacgggacaagttgcgacccataattatctcaatgaactattctttgcctctccgcatgccagacaggcccagactgggcttgcggtcactggatgcttatccgatcctgaatcaggcccaggctctagaaaatcacacagaggtccagttccagaaggagtgcggtccagataataaatgcgaatctaacctgcaaatgcgagccgcctttgttagcgagcagcaacagaaattaagtcgtcttcagtacagtcgcgatgttcgcaaactcttgctatccataaatgttacgaacacacggacgagtgagcggagtggggaggatgcacacgaggccttgttgactctggtggtacctccagccctgctgctgtcttccgtgaggccccctggcgcctgccaagccaatgaaaccatcttctgcgaacttgggaacccgtttaagaggaatcagcgcatggaactcctgattgccttcgaagtgattggcgtcactctgcacacacgtgacctacaagtccagctgcagctttcaaccagcagccaccaggataatctgtggcctatgattctgaccctgctcgttgattatacactgcagacctcactaagcatggtgaatcacaggctgcagtctttcttcggcggcacagttatgggggagagcggcatgaaaacagtggaggatgtcggctcccctctcaagtacgaatttcaagtgggccctatgggagaggggctggtgggcctcggcaccctggttcttggcttggagtggccatacgaggtgagcaacggcaaatggttgctgtatcccacagagatcaccgtgcacgggaatggctcctggccttgcaggcccccgggcgatttgattaacccactgaacctgaccttgtccgatccaggtgatcgtccaagcagcccccagaggcggaggcgccagctggacccgggcggcggccagggcccgccccccgtgaccctggccgccgctaagaaggcgaaaagcgaaacagttctaacatgcgcaacaggccgcgcccactgtgtatggcttgaatgccctataccggacgccccggtggtgacaaatgtaacggttaaggcccgtgtttggaacagcacctttatagaagactacagagacttcgatagggttagggttaatggttgggctacactttttcttcggacgagcatcccaacaattaacatggaaaataaaaccacctggttcagcgtggacatcgacagcgagttagtggaagaattaccagccgagatcgagctgtggctggtgctggtcgccgtgggcgctggcctgttattactgggcctgattattttgctgttatggaaatgtgacttcttcaaaagaactagatattaccaaatcatgccgaagtaccacgcggtcagaattcgtgaggaggagcgctacccaccacctggcagcactctccccaccaagaagcactgggttacttcctggcagacacgcgaccagtattattag

SEQ ID NO: 191562 - DNA, 3156 bp, Artificial Sequence
  Description of Artificial Sequence: Synthetic coding sequence
atgggccccggccccagccgggccccccgggccccccggctgatgctatgcgcactggccttgatggtcgcagctggcggctgcgttgtatctgctttcaatctggatacaagatttctggtggtcaaggaagccggcaacccagggagcctgtttggctattccgtcgcgcttcacaggcagaccgaaaggcagcagcgatacctcctgcttgccggggctcccagggaactggctgtcccggacgggtatacaaaccggacgggcgccgtgtacctctgtccattaactgcacacaaggacgactgcgagagaatgaacattacggtgaagaatgaccctggccatcatataatagaagacatgtggctcggcgtgaccgtggcttcacaaggccctgccggtagggtgttagtctgtgctcacaggtatacccaggtgttatggtcagggagtgaagatcagcgaaggatggtggggaaatgctacgtcagaggcaacgacctagagctggactcctcggacgattggcaaacatatcacaatgagatgtgcaattccaatactgactacctggaaacagggatgtgccagctcggtacttccggaggttttacccagaacactgtgtatttcggcgcccccggggcctataactggaaaggcaacagttacatgatccagagaaaggagtgggatttgtctgagtattcttataaagatcccgaggaccaaggcaacctttatataggctacaccatgcaggtcggaagtttcattctgcaccccaagaacattacaattgtgactggcgctcctcggcatcgtcacatgggggctgtctttcttctttctcaggaagccggcggtgatctgcgccgcaggcaggtgttggagggctcacaggtcggagcctatttcgggtccgcaattgcgttggctgacctgaataacgacggctggcaggacttactcgtaggagccccttattactttgagcgcaaggaggaagtggggggcgctatctatgtctttatgaaccaggccggtactagtttccctgcgcatccctccctgttgttgcatggaccgtccggaagtgcatttgggctgagtgtggcatccataggagatatcaaccaggacggctttcaagatattgcggtcggcgccccctttgaaggattaggcaaagtttacatctaccacagctcctctaagggtctgttgagacagccccagcaggtgatccatggcgaaaagctggggctacctgggttggcgacatttgggtacagtctgtccgggcaaatggatgttgacgaaaacttttacccagatcttttggtcgggtctctgagcgatcacattgtcttgcttagagcccggccggtgatcaatatcgtgcacaagacccttgtacccaggcctgcagtgctagacccagctctctgcaccgctacaagctgcgtccaggtcgagctttgctttgcttacaatcagtccgccggcaatcccaattacagaaggaatatcaccctcgcttacacactggaagcagatcgcgatcggaggccaccgaggttacgattcgcgggttctgagtctgccgtgttccacgggttcttttcaatgcccgagatgcgttgccaaaagctcgagttactgctgatggataatctccgtgacaagcttagacctataattatcagtatgaactactctctgccactgcggatgccggatcgtccaaggctagggctgaggtccctcgacgcttaccccatcttgaatcaggcccaagccctggaaaaccacacagaagtacagtttcagaaagaatgtggtccagacaacaagtgtgagagcaatcttcagatgcgagctgctttcgtgtctgagcaacagcaaaagttaagtcgcttacagtattctagggatgtaaggaagttgctgctgagtattaacgtcacaaatactcgtacaagtgaacggagcggcgaagatgcacatgaggcacttcttactctggtggttcccccagccctgctgctaagttctgtccgacctcctggagcctgccaggctaacgaaaccatattttgcgagctgggaaatcctttcaaaagaaaccaaagaatggagctgttaatcgcgtttgaggtgatcggcgttacccttcacacacgggatttacaggtgcagctgcagctgtcaacctcatctcaccaggataacctgtggcctatgatactgacgctccttgtcgactatacgcttcagaccagcctgagcatggtcaaccaccggttgcagagctttttcggtggtactgtgatgggcgagtcaggtatgaagacagtcgaggacgttgggtcacccttgaagtacgagtttcaggttggaccgatgggcgagggcctcgtcggtttaggcacgcttgtgctaggacttgaatggccatacgaagtgtccaacgggaagtggctgctctatccaacagagataaccgtccacgggaatggcagttggccttgcagaccaccaggggacttaatcaaccctctcaacctcaccctgtcagacccaggggacagaccgtccagcccccagaggaggaggcggcagctggatcccggggggggacaggggcctcctcctgtgaccctcgcggccgcgaaaaaggctaaatccgaaacagtcctgacctgtgccactggtagagcccactgtgtgtggctggagtgcccaatcccagacgcacctgttgttacaaacgtcactgtgaaggctagagtgtggaactcaacatttattgaggattatcgggatttcgatagagtgagagtgaatggctgggccactctctttctgagaacctctatcccgactattaacatggagaataagacaacctggttttcggtagacattgatagtgagttagtcgaagagctgcctgccgaaatagagctgtggcttgtgctggtggctgtgggcgcgggtctgttgctgcttggcttgatcatacttctgctgtggaaatgcggattctttaaacgcgcgcgaacaagagctttatacgaagcgaagcgtcaaaaggccgagatgaagtcgcagccaagcgaaacagaacggttgaccgatgattactag

SEQ ID NO: 191563 - DNA, 3114 bp, Artificial Sequence
  Description of Artificial Sequence: Synthetic coding sequence
atgctgtgcgccctggccctgatggtggccgccggcggctgcgtggtctcggcatttaatttagacacacggtttttagttgtaaaagaagcggggaacccagggagtctgtttggctactctgtggccctccataggcagacggagcggcaacagagatacttgcttttagccggcgcgccccgggagttggccgtccctgatggttataccaatcgcacaggcgctgtgtacctgtgtccccttactgctcacaaggatgactgtgaacgcatgaatattacagtaaagaatgacccagggcaccacataatcgaggacatgtggcttggcgtcaccgtcgcttcccagggccccgctggtcgtgtgctggtgtgcgcccaccggtatacgcaggttctctggtctggatccgaggatcaacgacgcatggtcgggaagtgttacgtgagagggaatgacttggaattggactcctctgatgattggcagacttatcacaacgaaatgtgtaactcaaacacagattacctagaaacaggcatgtgccagttgggtactagtggcgggttcacacagaacactgtctattttggtgcccctggcgcatataactggaaggggaactcatacatgatacaaaggaaggagtgggacctgtctgagtattcctacaaggacccagaagaccaagggaatctttacataggctataccatgcaggttggatcctttattctacaccccaaaaacatcaccatcgtgactggggctccccgccacagacacatgggtgcagtcttcctgcttagccaagaagccggaggcgacctgcgcaggcggcaagttctggagggctcacaagtgggagcctattttgggtccgccatcgctctcgctgatctcaacaacgacggctggcaggatctactggtaggggccccatattacttcgaaaggaaagaagaggtgggcggagcaatttacgtattcatgaatcaagctgggacctctttcccggcgcatccaagcctgttacttcacggtccatctggctccgcattcgggctcagtgtagctagcatcggagacatcaaccaggatggctttcaggatattgctgtgggcgccccatttgaaggcctgggcaaggtgtatatatatcactcctcatcgaagggtctgctgcggcagccccagcaggtaattcacggcgaaaagctaggattgcctggactggctacatttggttattcactctccggtcagatggatgtggacgaaaacttctatccagacttactggtcgggagcctcagtgaccatattgtgctcttaagggcccgcccagtgatcaatatcgttcataaaacgctggtccctcgtccagcagttctcgaccccgctctgtgcaccgccacaagctgcgtccaggtggaactgtgcttcgcatacaatcagtctgctggcaacccgaactacaggagaaatataaccttagcatatacactcgaggctgaccgagataggcggccaccccggctgcgtttcgcagggtccgaaagcgccgtattccacggctttttctccatgccagagatgaggtgtcagaaactggaattattactgatggataacctcagggataagctgcggccgataataattagcatgaattacagcctgccgttacgcatgccagaccgtcccagactgggtctgcggagcttagacgcctatcccatccttaatcaagcacaggccctagaaaaccataccgaggtgcaatttcagaaagagtgtgggccagataataaatgtgagagcaacctgcagatgcgcgccgctttcgtctcagagcagcaacagaagctctcccgactccagtatagccgtgatgtgagaaaactgctgctgtcaattaacgttacgaacacacggacctccgaaaggtccggagaagacgcacacgaagctcttctgaccctggtggtgcctccggcattgctcctgagctccgttcgacctcccggggcttgtcaagcaaacgagacaattttttgtgaactaggcaaccccttcaagcgcaaccaacgcatggagttacttatcgcattcgaagtgattggggttactcttcacacgcgggacctacaggtgcagttgcaactctccacgtccagccaccaagacaatttatggcccatgatactcaccctgctcgtggattatacactgcagaccagcctatcaatggttaaccatcgcttgcaaagctttttcggtgggacagtgatgggcgagtccggtatgaaaactgtggaggatgtggggagccctctgaaatacgaatttcaggtgggacctatgggcgaaggactggtgggtctgggtaccctggtattaggcttggagtggccatacgaggtgagtaatggcaagtggcttctgtacccaactgagataaccgtgcatggcaacggatcatggccctgtaggccccctggtgacctgataaacccactgaaccttacactctcggacccaggagacagaccgtcctccccgcagaggcgaagacgacaacttgatcccggggggggccaaggacccccccctgttaccttggcagccgctaaaaaagcaaagtcagagaccgtgttgacgtgcgcaaccgggcgcgcccattgtgtgtggcttgagtgcccaattcccgatgcacccgtcgtgaccaacgtgaccgtaaaggctagagtctggaacagcaccttcatcgaggattacagagactttgacagggtgcgggtgaatggatgggccaccttgtttctccgaacaagtatcccaaccatcaatatggagaataaaacaacatggtttagtgtcgatattgattcggagctcgtggaggaacttcctgctgagattgaactctggctggttctggtcgcagtcggagctgggctgcttctgctgggcctgattatattgctgttatggaagtgtggattctttaagcgggcccgaacccgggccctctacgaagcaaaacggcagaaggccgagatgaagagccagccaagcgagaccgaacggctcaccgacgactactag

SEQ ID NO: 191564 - DNA, 885 bp, Artificial Sequence
  Description of Artificial Sequence: Synthetic coding sequence
atgatccagcggaaggagtgggacctgagcgagtacagctacaaggacccagaagaccagggaaatctatatatcggttatactatgcaggtgggatccttcatcctgcatcctaagaatattactattgtcaccggtgcaccgaggcatcgccacatgggcgcggtgtttctgttgagtcaagaggccggaggcgatctcagacgccgccaagtgttggagggtagccaagtgggcgcctattttggatctgctatcgccttagctgatctcaataacgacgggtggcaggacctcctggtgggcgcaccttactattttgagcgaaaggaggaggtcgggggcgccatctacgtattcatgaatcaggccgggaccagttttcccgcccacccatcactgctacttcacggcccatccggatccgccttcggacttagcgtggccagcattggagatattaatcaggacggcttccaggatatcgcagtaggggctcctttcgaaggcttgggcaaggtgtacatatatcacagcagctccaagggtcttctacgccagccccagcaggtgatccacggagagaaattagggttgcccggactcgcaacttttggatacagtctgagcggacagatggacgtagacgagaatttctatcccgatttgctggtcggtagcctgtccgaccacatagtgctgttaagggctcgaccagtaattaacatcgtgcacaagacgctggtgccacgccctgcggttctggaccccgctttatgtacggctacatcctgtgttcaagttgagctttgcttcgcctataaccaatccgctggaaaccccaattatcgaagaaacatttcggagtgctggggtgcggcttag

SEQ ID NO: 191565 - DNA, 3108 bp, Artificial Sequence
  Description of Artificial Sequence: Synthetic coding sequence
atgggcggccccgccgccccccggggcgccggccggctgcgggccctccttctggctctagtggtcgccgggatccctgccggagcctataacctagatccccagcgccctgtccacttccagggccctgccgatagcttctttggatacgcggtgttggagcacttccatgacaacaccaggtgggtgctcgtgggagcccccaaagccgactccaagtatagccccagcgtcaagtcacccggcgccgtttttaaatgtagggtgcacaccaatcctgatcgacgatgcacagaactggacatggccaggggaaagaaccgcgggacatcttgcggtaaaacctgccgggaagatcgagacgacgagtggatgggcgtgagcctggccagacaacccaaggctgatgggagggttcttgcatgtgctcaccgctggaagaatatctattacgaggcagatcatatcttgcctcatggcttctgctacatcattccgagtaatctgcaagctaaggggagaactctaattccctgctatgaagaatataaaaaaaaatacggtgaggaacatggcagctgtcaggccgggatagccggattcttcacagaagagctagtggtcatgggcgccccaggtagcttttattgggccggaacaattaaggtgctgaacttaaccgataatacatatctcaagctgaacgatgaggttatcatgaacagacggtatacgtatctcggttatgcggtcaccgccggacattttagtcatccaagcacgatcgatgtggtgggcggtgctccacaagataaggggatcggtaaagtgtacatctttcgggccgaccgaagatctggaacactgatcaagatctttcaggcttcaggaaagaagatgggtagctactttgggtctagcttgtgcgctgtggacctgaatggcgacggcctgagcgatctgctggtgggagcaccaatgttctcagagatcagagacgagggccaagtgaccgtatatattaatcgcggtaatggggctttggaagagcagttggcgctcacaggagacggggcctataatgcacactttggcgaaagcattgcgtccttggacgatttggataacgatgggtttcccgatgtagctattggagctccgaaggaggacgattttgctggggcagtgtatatttaccatggggacgcgggcggcatagtgccccagtacagcatgaagctgagtggccaaaagatcaatcctgtcctgagaatgttcggtcagtcgatcagcggcggcatcgacatggacggtaacgggtaccctgatgtgaccgtgggagctttcatgagcgattccgtggtgctcctaagagcaagaccagtaatcacagtggacgtgtccatattccttcctggctccattaatatcacggcacctcagtgtcatgacggccagcagccggtgaattgcctgaacgtgactacttgctttagctttcacggaaagcacgtcccgggcgaaataggactgaactacgtacttatggctgacgtggcaaaaaaggaaaaaggccagatgccccgcgtctacttcgtgctgctgggggaaacgatgggtcaagtgactgaaaagctacagctaacctacatggaagaaacatgccggcactacgtcgcacacgtcaaaagaagggtccaagatgttattagtccgatagtttttgaggctgcttattctctcagtgaacacgtgactggcgaggaagagcgggagctccctcctctgaccccagtccttaggtggaagaagggccaaaaaattgcccaaaagaaccagacggtgtttgagcgtaattgccggtccgaggattgtgcggctgatctacagttgcaaggtaagctcttgcttagcagcatggacgagaagacattatacctcgctctcggggctgtgaagaatatttccctgaacatcagcatctctaaccttggcgacgatgcgtacgatgccaatgtgtccttcaatgtgagcagggagttattcttcattaacatgtggcagaaggaagaaatgggtatttcctgcgagttactcgaatcagattttttaaaatgctccgtgggatttccattcatgcgcagtaaatcaaagtacgaattttccgtgatcttcgataccagccacttgtcaggggaagaagaggttctctcttttattgtgaccgctcagtccggaaataccgagagatcagagagcctgcacgataatactctggttctgatggtacccttgatgcacgaggtggataccagtataaccggtattatgtcgccgacgagtttcgtatatggtgaatctgtggatgccgccaattttatacagctagacgatctggagtgccatttccagcctataaacattacgctgcaagtgtataacacggggccctcaactctcccaggctcctctgtctcaatctcctttcccaacaggttatcttctggcggggccgagatgttccatgttcaagaaatggtcgttggccaagagaagggcaattgcagcttccaaaaaaaccctacgccttgtattattccacaagagcaggaaaatatcttccacactatcttcgccttcttcaccaagtcgggacgcaaagtgctcgactgtgagaaaccaggcatatcatgtctcacagcgcattgtaatttctctgccctggccaaagaagaatcacgaacaatcgacatctacatgctactcaacacagagatactgaaaaaagattcttcgtccgtcattcagttcatgtctcgagcaaaagtgaaggtagaccctgcactccgggtcgttgagatagcccacggcaaccccgaggaggttaccgtggtttttgaggccctacacaacttggagccaagagggtatgtggtgggatggattattgctatttcgctcctagtgggcatactaatattcttgctgctggccgtgctgctttggaagatggggtttttccgacggagatacaaggaaatcatcgaggctgagaaaaaccgcaaggagaacgaagattcttgggattgggtgcagaaaaaccaatag

SEQ ID NO: 191566 - DNA, 696 bp, Artificial Sequence
  Description of Artificial Sequence: Synthetic coding sequence
atgtgccagcccccccccaccgcccccggcagctggcccgtggcccgcccttgtacagaatccgtcgggcgcacccacactcagcgcgtgcctgcaagctgctgggcccgggccggacgatcatctcgccaatcccccacccctcgacagtttgctctgatgcagtacagtaacctgctgaaaatccatttcacattcacacagtttcgaacttctcctagccaacagtctttggtggaccctattgtccagctgaagggcttaacctttactgctaccggtattttaacagtggtgactcagctcttccatcacaagaatggggccagaaagagtgccaagaagatattaattgtcatcaccgatggccaaaagtacaaagatccacttgagtacagtgacgtgatcccccaggcggagaaggccggaatcattcggtatgctattggggtcaggctcttctttacccctgccccgggaagcgcttgtatatcctttagatgctctgccgcgggattgatcctgttagggtgtctgtccgcagctggggggacacgcttccccggtacacactgccaggctggcgccgagtatcatcagctatccgctagtgccggcccacgggtgcaaggagggcagttgtgcagcccttggcagcatcccgaagcagccgcaggagaggacttgtgcagttag

SEQ ID NO: 191567 - DNA, 3486 bp, Artificial Sequence
  Description of Artificial Sequence: Synthetic coding sequence
atgaccttcggcaccgtgctgctgctgagcgtgctggccagctaccatggcttcaacctcgacgtggaagagcccaccatcttccaagaagatgctggggggtttggccagtcagtcgtgcaatttggcggaagcagactcgtggttggcgccccattggaggtggtggccgctaaccagaccgggcgcctgtatgattgtgcggcagccaccggaatgtgccagccgatccccttacacatccgcccagaagccgtgaacatgtctctcggactgacactggcagcctccaccaacgggagtcggctgcttgcctgtggtcctactctgcatcgggtgtgtggggagaattcctattccaagggtagttgtctgcttctaggctcccgatgggaaattatccagactgttcccgacgccactccagagtgtcctcaccaggaaatggacattgtctttcttattgatggcagcgggtctatagatcaaaacgactttaaccaaatgaaaggtttcgtgcaggcagtgatgggacaatttgaggggaccgacacgcttttcgcactgatgcagtactctaaccttctgaagattcattttaccttcacacagttcagaacttccccaagccagcagtccctggtcgatccaattgtccagctcaagggcctgaccttcaccgccactggcatcctaacagttgtgacacagctgttccaccataagaatggcgctcgaaagtctgccaagaaaatcttgatagttatcacagatggccagaagtataaagaccccctagaatattccgacgtgataccccaggcagagaaagctggaattatcaggtacgcaatcggagtgggtcacgcctttcagggcccaactgctcgccaggagctaaatacgattagtagcgctccacctcaagaccacgtcttcaaggtggacaacttcgctgctctgggttccatccagaaacagcttcaagagaagatctacgcagtagaaggaactcaatctcgagcgtcatcatctttccagcacgaaatgtcccaggagggattttctaccgctcttactatggacgggctgtttctcggggcggtaggaagcttctcttggtcaggcggcgccttcctctatccccccaatatgtctccaacttttattaacatgtcgcaggaaaacgttgacatgcgagattcctatctggggtattctacggagctggcgttatggaaaggggtccagaacctcgtactcggtgcgccacggtatcagcacaccgggaaagcggtcatctttactcaggtctcccggcagtggcgaaaaaaggctgaagtgacaggcacccaaatcggcagctatttcggggcctccttgtgtagtgtggatgtggatagcgatggatccaccgatctcattctgatcggtgcgcctcactattacgagcagacacgaggcggacaggtttctgtatgccccctgcccagagggagggtccaatggcagtgtgacgcagtgctgagaggtgaacaaggtcatccctggggcaggttcggtgcagccctgacagtccttggagacgtcaatgaggacaagctgatcgacgtcgccattggggccccaggtgaacaggaaaaccggggggctgtatacctgttccatggcgctagtgagtccggaataagtcctagccattctcaacgaatagcctcgtcccagctctcaccacgactgcagtatttcggtcaggctctgtctgggggacaggacctcacccaggacgggctgatggacctcgccgtgggagctaggggtcaagtcctcctgctgagatcactgccggttctcaaagttggagtagccatgaggttctcacctgttgaagtggctaaagcggtgtaccgttgttgggaagagaaaccaagcgctctcgaggcgggggatgctacagtatgtctcaccattcagaaatccagcctggaccagctgggcgatatccaatcatctgtgagatttgacctcgcactggacccgggcagactcacgtccagagctatctttaatgaaactaagaatccaacacttacaaggaggaagaccttaggcctcggcatccactgcgaaactctcaaactgctcctgccagattgcgtggaagacgtggttagccctataattctgcaccttaactttagcctggtgcgagagccaatcccaagtcctcagaatttacgccctgttttagctgtgggaagtcaggatttgttcacagctagccttccttttgaaaagaactgcggtcaggatgggctgtgcgaaggcgatctaggcgtcacattgtccttctctggactccagaccctcacagtcggctcaagcctggagcttaatgtcattgtgacagtctggaacgcaggcgaggattcctatggtaccgtggtgtccctctattatcccgccggattgagtcaccgaagggtctccggcgcgcagaagcaaccacaccagtccgccctgaggcttgcttgtgagactgtgcccaccgaagatgagggtctgcggagctctagatgcagcgttaaccacccgatttttcacgaggggtcaaacggcaccttcatcgttactttcgatgtgtcttataaagcgacgctcggcgataggatgcttatgcgagcatccgcctctagtgagaataataaagcatccagctcaaaggctaccttccagctggaacttccggtgaagtatgccgtgtacactatgatctccaggcaggaggaatccactaagtacttcaatttcgcaacaagcgacgagaaaaagatgaaagaagccgaacacaggtaccgggtaaataatctgtctcaacgggacctggcaatttccatcaatttttgggttcccgtcctgctgaacggagtggctgtttgggacgttgtgatggaagccccatctcagtcactgccttgtgtgtctgaaaggaagcccccgcaacactccgattttctaacacagatcagccgctctcccatgctcgactgctccattgcagactgccttcagtttcgctgtgatgtcccaagtttcagtgtgcaggaggagctagattttacactgaagggcaatctcagctttggctgggtaagggaaactctccagaaaaaagtgttggtggtgagcgttgcggagattacgtttgacactagcgtttactctcaactacctgggcaggaagcgttcatgagagcgcaaatggaaatggtgttagaggaagatgaagtctacaatgctataccaatcattatgggctcaagcgtgggcgccctgctgctgctggccctgatcacagccacactctacaagctcggctttttcaaacggcactacaaggagatgctggaagataagcccgaggacactgccacgttctccggagacgattttagttgtgtggcacccaatgtcccactgagctag

SEQ ID NO: 191568 - DNA, 3534 bp, Artificial Sequence
  Description of Artificial Sequence: Synthetic coding sequence
tgcgccctgagccccaccttccacttccccagcacccggtgcagcgggatgaccttcggtactgtgctcctgttaagtgtcctcgcctcgtatcacgggttcaacctagatgtagaggagcccaccatttttcaggaggatgctggaggctttggtcaatccgtcgttcaatttgggggctcgaggctcgtggtgggcgcccctctggaggtggttgcagctaatcagaccggaaggctgtatgattgtgcggcagccacaggaatgtgccaacctattcctctgcatatccgaccagaagcagtcaatatgagtctcgggctgactctcgccgcgagcactaatggaagcaggctgttagcctgtggcccaactctgcatagggtgtgtggcgaaaacagctactccaaaggcagctgcttgctgttgggctcacggtgggaaataatccagacggtccccgacgccacccccgagtgtccgcaccaggaaatggatatagtgttcctgattgacggctcggggtctatcgaccagaatgacttcaaccagatgaaaggctttgtgcaggccgtcatgggacagttcgaggggacggacaccctgttcgctctaatgcaatactccaatctgctgaagatccatttcacgttcacccagttcaggactagtccaagccagcagagtctcgtggacccaattgttcaattgaaaggactgacgtttactgccaccggaatcttgacagtcgtaacacagttgtttcaccataagaatggtgccagaaaatctgccaagaagattctgatcgtgatcacggacggacagaagtataaagaccccctagaatactccgacgttattccccaagcagagaaggcgggtatcattagatatgcgattggtgttggtcatgcatttcaggggccaacggcacgccaggagctgaacacgatcagctctgccccaccccaagatcacgtcttcaaggtggacaacttcgcggccctgggcagtatccagaagcagctgcaggagaaaatctatgccgtggagggtacccagagtcgcgccagttcatcctttcagcacgaaatgtcccaggagggattcagcactgctctgacgatggatgggctgtttctcggggcggtcggcagcttcagttggtcaggaggggccttcctgtacccaccaaacatgtcccctactttcataaacatgagccaggaaaacgtggacatgagggattcctatctgggttactccacggaactggcgttatggaaaggggtgcagaacctcgttttgggtgcaccaaggtaccagcataccggaaaagccgtgatcttcacacaagtttcacggcagtggcgaaaaaaagccgaagtgacaggcacccagatcggcagttatttcggagccagcctgtgttccgtcgacgttgacagcgacggcagcaccgatctgatcttgatcggcgctcctcattactatgaacagacgaggggtggccaggtgtctgtgtgccccctgccaagaggtagagttcagtggcagtgtgacgccgtcctgcgaggcgaacaaggccatccctggggccggttcggcgcagccctgaccgtactgggtgatgtgaacgaggacaagttgatcgatgtggccataggagcccctggtgaacaggagaacagaggcgctgtatatctcttccatggtgcaagtgagtcgggaattagccccagccacagccagcgcatcgcaagtagccagctttcgccacggcttcagtactttggacaggccctctcgggaggtcaggacctgacccaggacgggctgatggacctcgcagtgggggcacgtggccaggtacttctgctgagatctctgcctgtgctcaaggtgggggtggccatgcgcttctcaccagtagaggtggcgaaagctgtgtatcgttgttgggaagagaaaccttccgccctggaggccggtgatgccaccgtgtgtctgaccattcagaaatctagtctggatcagctgggggacatccagagctctgtccgcttcgaccttgccctagatccggggcgcctgactagcagagccatatttaatgagaccaaaaaccccactctaacccgacggaaaacattgggcctggggattcattgcgaaacactcaaattactcctccctgactgtgtggaggatgtggtgagccccattatcttacacctcaattttagtcttgtaagggagccaataccctcgcctcagaaccttcggcccgtgctagccgtgggaagccaagatttatttacagcatcactcccattcgaaaaaaattgcggccaggacggactgtgcgagggagacttgggtgtgaccctttcattcagcgggctccagacactgaccgtgggatcttcactagaactcaatgttatagtaactgtgtggaacgccggggaggacagttacggaaccgtggtctctctatactacccagccgggctgagccataggagggtgtctggcgcgcagaagcagccccaccagtccgcactcaggctggcctgtgagactgttcccacggaagatgaaggcctgagatcctcacgatgctcagttaatcatccgatttttcatgagggctccaatgggactttcatcgtgacgtttgacgtatcttacaaagctacgctgggcgatagaatgctgatgcgggcatccgctagctccgagaacaataaggcttccagctctaaggctacctttcaactggagttgcccgtaaagtatgcagtgtacacgatgatctcacgtcaggaggaatccactaaatatttcaacttcgccacaagcgacgagaagaagatgaaagaagccgaacaccgctatagagtgaacaatctgagccagagggatttagcaatcagcataaacttctgggtacccgtgctgctgaacggcgtggccgtttgggatgtggtgatggaagccccctcgcagtccctcccttgtgtgtccgagaggaaacctccacagcacagcgactttctgacccagatctccagatcccccatgctggattgttcgatcgctgactgcctccagttcagatgtgacgttccttccttttccgtgcaggaagaactggatttcacgttaaaaggaaaccttagtttcggatgggtgcgggaaacattgcagaaaaaggtgttagtggtgagtgtggctgagatcacatttgatacttcagtttactcccaactacccggacaggaagcttttatgcgggctcagatggaaatggtgctggaagaagacgaagtctacaatgccatcccaataattatggggagctccgtgggcgctttacttttgctggcgttaatcaccgcgactctctacaaactggggttttttaaacggcattataaagaaatgttggaagataaaccagaggacactgccaccttctccggcgatgacttttcctgtgtggcacccaacgtacctcttagttag

SEQ ID NO: 191569 - DNA, 3513 bp, Artificial Sequence
  Description of Artificial Sequence: Synthetic coding sequence
atgaaggacagctgcatcaccgtgatggccatggccctgctgagcggatttttttttttcgccccggctagtagttataacctcgatgtccgaggagctcgcagtttctctcccccgcgcgccgggcgccatttcggatacagggtcctacaggtcggcaatggggttatcgtcggagccccaggcgaaggcaactcaacaggatctttataccaatgtcagtcaggcacgggccattgtttgcctgtcaccctgcgtggaagcaactatacctcaaaatatctcggtatgaccttggctacagaccccactgatggaagcatcctagcctgcgatccggggctcagtaggacctgcgatcagaatacatacctgtcaggcctgtgttatctctttaggcaaaacctgcaggggcctatgctgcaaggtaggccaggctttcaggaatgtatcaagggaaatgttgaccttgtttttctcttcgatggcagtatgagccttcagcctgacgagtttcagaagattctcgatttcatgaaggacgtgatgaagaagctgtctaatacttcataccaatttgctgcggtacagttctcgacatcttacaaaacggaattcgacttctccgattatgtaaaacgaaaggatcccgacgctctgctcaaacacgtcaaacacatgctgctgttgacaaataccttcggtgccatcaattacgttgccacggaggtgtttcgggaggagttaggtgcaaggcctgatgcgacaaaagtactcataataatcacggatggagaggcaactgacagcgggaacattgatgccgccaaggatattatacgctatatcatcggaatcggaaagcatttccaaaccaaggaaagtcaggaaactctccacaaatttgcatctaaacccgcctccgagttcgtcaaaatcctggatacattcgagaagctgaaggacttatttaccgagctgcagaagaagatttacgtaatagaaggaacttcaaaacaggatctaacatcattcaatatggagctgtctagctccggaatctctgccgacctgagccgaggccacgctgtggtgggggcagtgggggctaaagattgggcgggcggttttctggacctcaaagccgatttgcaagatgacactttcataggtaacgaaccacttactcccgaagtgcgcgcaggctacctcgggtacaccgtgacctggctgcccagccggcagaaaaccagtctcctggcctctggagcaccacgttatcagcacatgggacgagtactcctctttcaggagccacagggcggaggtcactggtcccaggtgcagacaattcatggtacccaaattgggagctattttggtggtgagctctgcggtgtggacgtggatcaggacggtgaaacagagttgctgctaatcggggcacccctcttctatggtgagcagcgcgggggacgagtttttatctaccagagacgccagcttgggtttgaagaggtttccgagctacagggggatccagggtatcctctgggacggtttggtgaagctatcacagctctgactgatattaacggcgacggccttgttgacgtcgccgtcggcgcgcctctggaagagcaaggggctgtttacatttttaatggcagacatggcggattgtccccccagccatctcagcgcatcgaggggacgcaggttctttcaggaattcaatggtttggacgaagtattcacggagtgaaggatctggaaggcgacgggcttgctgatgtagcagttggcgcagagtcccagatgattgtgctatcctctcgacctgtggttgacatggttactctgatgagcttctcccctgctgagatccccgtgcatgaggtggagtgctcttatagtacctccaacaagatgaaagaaggtgttaacattacgatctgtttccagattaagtctctgattccccagtttcagggacgcctggtggccaatttgacgtacaccctgcagctggatggccataggacacgccgccgtggtttgttccctggggggaggcacgaacttagaagaaatatcgccgtcactacctctatgtcttgcacagacttcagtttccatttcccagtgtgtgtccaggatctgatcagtcccatcaacgtgtcccttaacttctcattgtgggaggaggagggaacaccccgcgatcagagggcccaggggaaagatattccacctattctgcggccatctttacatagcgagacttgggaaattcctttcgaaaaaaactgcggtgaagacaaaaaatgcgaggccaacctcagggtgtcattctcccctgcccgttcccgtgctctccggctgacagccttcgcttcactctccgtcgaactatcactgtctaatctcgaggaggatgcctactgggtgcagctggatctccattttccccctggactcagtttccggaaggtcgaaatgctcaagccacatagtcaaatcccagtgtcctgcgaggagctaccggaagagagccgcctgctttcccgcgcactgtcatgcaatgtgtcgagtccaatttttaaggcaggacattctgtggctttacagatgatgttcaataccctcgtgaactctagctggggcgattccgttgaactgcacgctaacgtgacctgcaataacgaggattctgatctacttgaggataactccgcaaccacaatcatccccatcctctatcccataaatatcctaatacaggaccaagaagacagcaccctctacgtgtcttttacccctaaggggcctaaaattcaccaggtgaaacacatgtaccaggttcgcatacagccatcaatccatgaccacaacattcccacactagaggcagtagtcggagtgcctcagccaccgtccgaaggacccatcactcaccaatggtctgtgcagatggagcccccggtgccgtgccattacgaggatctagagaggctgcccgacgcagctgagccatgcctcccaggcgctctgttccggtgtcccgttgtgttcaggcaggagatcctggtacaggtgattggaaccctggagttggtcggagagatcgaggctagctctatgtttagcctctgttcatctctaagcatatcatttaacagtagtaagcacttccacctatatggcagcaatgcctcactggcccaggtagtgatgaaggtcgatgttgtttatgaaaaacagatgctgtacctgtacgtgttaagcgggattggcgggctgctgctgctgctgttgatctttatcgtgctctacaaggtcggcttctttaagagaaacttaaaggagaaaatggaggccggtagaggcgtccctaacggcatcccagctgaggatagcgagcaactggcgagcggccaggaggcaggagacccgggctgcctgaagccgttacacgaaaaggattccgagtcaggaggtggcaaagactag

SEQ ID NO: 191570 - DNA, 3261 bp, Artificial Sequence
  Description of Artificial Sequence: Synthetic coding sequence
atgaaggacagctgcatcaccgtgatggccatggccctgctgagcggcttcttcttcttcgcacctgccagctcatataatctggacgtgcgaggggcgaggtctttctctcctcctagggccgggcgccattttggctacagagttctccaagtcgggaacggagtgattgtgggtgcccctggcgagggcaactctaccggttccttgtatcagtgccagagcggaactgggcactgcctgccagtgaccttgcgaggcagcaactatacaagcaagtatctcggaatgaccctggctaccgaccccaccgacggatcaatcctctttgccgctgtgcagttttctacatcatataagactgaattcgacttcagtgattacgtgaagagaaaggaccccgacgccctgcttaagcacgtcaaacacatgctgctcctgacaaacacttttggagctattaattatgtagctactgaagtgttccgagaggagctgggagcccgaccagatgccactaaggtgttgattattattactgacggagaggctaccgactcaggtaacatcgacgctgcaaaggatatcatccgctatatcatcgggattggcaagcattttcaaactaaggaatcccaggaaacgctgcacaagttcgcatccaaacctgcttcggagttcgtaaagatcctggacactttcgagaaattaaaggacctgtttaccgaactccaaaagaaaatttacgtcattgagggcacttccaagcaggatctaacttcttttaacatggagctctcgagtagcggaatctctgctgacttatctagagggcatgctgtggtaggcgcagtgggcgcgaaggattgggctggggggtttcttgacctaaaagctgatctccaggatgatacttttatcgggaatgagcctctaactcccgaagtgcgtgccggttacctggggtacacagtcacttggctccctagccgccagaagacctctctgttggcctctggcgccccgcggtaccagcacatgggtagggtgctcctgtttcaggagccccaaggcgggggccattggagccaagtccagactattcatggcactcagattgggtcgtactttgggggcgagctgtgcggagtggacgtggaccaagacggcgagacagaactgcttctgattggcgcccctctcttctatggcgagcagcggggtgggcgtgtgttcatctatcagagaaggcagcttgggttcgaggaagtatcagagctccaaggagatcctgggtacccactgggtcgctttggagaggccattacggccctgacagacattaatggggacgggctcgtagatgtcgcggtgggtgccccactggaagagcagggcgccgtttacatctttaatggtaggcacggcggcctttcgccccagcctagccaaagaatcgagggtacccaggtgctttccggaattcagtggtttggcaggtccatccacggagtgaaagacctcgaaggcgacgggctggccgacgtggcggtcggcgcggagtctcaaatgattgtgcttagctcccggcctgtcgtggacatggttacactgatgtctttttcccctgctgagattccagtgcatgaagtggaatgtagctatagcactagtaacaaaatgaaggaaggtgtgaacatcaccatctgttttcagatcaaatcgctgatcccgcagttccagggtcgcctcgtcgctaaccttacttacactttgcaactcgacggccatcgaaccagacgccgagggctgttcccaggcggaaggcacgaattgcgtcgcaacatcgcagttacaacctctatgtcttgtacagacttctcttttcattttccggtgtgcgtgcaagatctgatcagtccaatcaatgtatccctcaatttttccctatgggaagaagaggggactcccagggatcagagggctggtaaggacattccgccaatcctgaggccatccttgcacagtgaaacgtgggagatcccgttcgagaagaattgtggcgaggacaagaagtgtgaggccaatttgagggtgagcttcagcccggctaggtcgcgtgcgctccgcctcaccgccttcgcctctctatctgtcgagttaagcctcagcaatcttgaggaagacgcatactgggtgcagctggacctacacttcccgcccggacttagcttcaggaaggttgaaatgctgaaaccacacagccagatccccgttagctgtgaagaactcccagaggagagcaggctactctcccgcgcactcagctgtaatgtcagcagccctatcttcaaagccggacacagtgttgcattgcagatgatgtttaacacgctcgtaaacagcagttggggtgactccgtagagctccatgctaatgtcacctgtaataacgaagatagtgacctcctggaggacaatagtgcgaccaccatcatacccattttgtacccgattaacatattgatccaggatcaagaagacagtaccctttatgtctctttcacaccgaagggcccaaaaatccaccaggtcaaacatatgtaccaggtccgtatccagccgagtattcatgaccataatatcccaacactggaagctgtcgtcggcgtacctcagccaccgtcggaaggcccaataactcaccagtggtctgtccagatggaacccccagtcccatgccattacgaagatctggagcggctcccggacgctgcagagccatgcctgcccggagcactgttcagatgcccagtggtgttcagacaggagatactggttcaagttatcgggaccctcgagctggtcggagagatcgaggcgagcagcatgttctccctgtgtagctccctgtcaatctccttcaactctagcaaacacttccacctgtatggaagtaacgcaagcctagctcaggtggtgatgaaagtagacgtagtatatgaaaagcagatgctttacttatacgtacttagcggaatcggtggacttctgctgctgttgctcatttttattgtactctacaaggttgggtttttcaaacgtaacctaaaggagaaaatggaagcgggaagaggagttcccaatggcattcctgccgaggactctgaacaattggctagcggacaggaggccggcgaccctggatgcttaaagccactccatgagaaggattctgagtctggcgggggaaaagattag

SEQ ID NO: 191571 - DNA, 1215 bp, Artificial Sequence
  Description of Artificial Sequence: Synthetic coding sequence
atgaaggacagctgcatcaccgtgatggccatggccctgctgagcgggttcttcttcttcgcacctgcgtctagttacaacctggatgtgcgcggggcgaggtctttttccccccccagggcgggtcggcattttgggtacagagtactgcaaatcaagtcactgattccgcagttccaaggaaggctggtagcgaacttgacttacaccctccagctggacggtcatagaactaggcggcgtggtctgttccctggcgggcggcacgagttgagacgcaacattgccgtgacgacgtccatgagctgcaccgacttttctttccacttcccaatgatgttcaataccctggttaacagttcttggggcgactctgtggaacttcacgcaaacgtgacctgcaataatgaagactccgaccttctcgaagacaacagcgctactactatcatcccaatcctttacccaattaacattctaattcaggatcaggaggattccaccttgtacgtgtcattcacaccgaaagggcccaaaatccaccaagtgaaacatatgtatcaggtgcgcatccagccatcaattcacgaccacaatatcccaacactcgaagcagttgtcggagtgccgcagcccccctcggaggggcccatcacccatcagtggagtgtgcagatggaacctccggtcccgtgtcactatgaagatctggagagactgcccgacgctgctgagccctgccttcctggagcactgtttcgctgtcccgtggtgttccgccaggagatcctggtgcaggtgattggtacactagaactagtgggagaaatcgaggcttcttcaatgttcagtttatgttctagcctttctatctctttcaatagttcaaagcattttcacctttacggaagcaacgctagcctggcccaagtggtgatgaaggtagacgttgtgtatgaaaagcagatgctgtacttgtacgtactgtcaggcataggaggactcctcctactgttgttaatatttatcgtgctgtataaagttggattcttcaagcggaacctgaaagaaaagatggaagcagggcggggcgtgccgaatgggattccggccgaagatagtgagcagctcgcctctggacaggaggccggtgacccagggtgtctcaagccactgcatgagaaggacagcgaatccggaggcggtaaagactag

SEQ ID NO: 191572 - DNA, 489 bp, Artificial Sequence
  Description of Artificial Sequence: Synthetic coding sequence
atgaaggacagctgcatcaccgtgatggccatggccctgctgagcgggttcttcttctttgcgcctgcttcctcatataatctggacgtccggggcgctcggtcttttagtcctcccagggcaggtcggcattttggatatagggtgctgcaggtcggaaacggggttattgtgggggcaccgggagagggtaattcgacgggctctctataccagtgccagtctggaaccggacactgcctgccagtaacccttagggggagcaactacacctcaaaataccttggaatgactctggctaccgatcctaccgacggttccatcttagcatgcgacccaggcctcagtcggacctgcgaccagaatacctatctgagcggactgtgctatctgttcagacagaatctacaggggccaatgttacaaggcaggcccggcttccaggtttgttgttgcagtgtgtttcacaagctgcaaaatcggatatag

SEQ ID NO: 191573 - DNA, 3459 bp, Artificial Sequence
  Description of Artificial Sequence: Synthetic coding sequence
atggccctgcgggtgctgctgctgaccgccctgaccctgtgccacggttttaatctggacaccgaaaacgcaatgacattccaggaaaatgcccgggggttcggtcagagcgtggttcaactacagggaagcagagtggtagtgggggccccccaggagattgtggctgcgaaccagagggggtcattatatcagtgcgactatagtaccgggtcttgcgagccaattagattacaggttccagtggaggctgtgaacatgagcctgggactctcactggcggccaccacttcccccccccagctgttagcatgcggccccaccgtccatcagacttgctctgagaacacctatgtcaagggcctctgttttctgttcggtagtaatctgcgccagcagcctcaaaagtttccggaggcccttagaggatgccctcaggaagatagcgatattgccttcctgatagacggatccgggtcaatcatcccacatgactttagaaggatgaaggagttcgtgagcaccgttatggagcagcttaaaaagagcaagaccctcttctccctgatgcaatacagtgaggagttcagaatccacttcacttttaaggagtttcaaaacaatcctaatccacggtctcttgtgaaaccaataacacagttgctcggcaggacgcataccgctacaggcatacggaaggtggtgcgagagctgttcaacattaccaacggcgcccgaaagaatgcattcaagatcctggtggttatcactgacggagagaagttcggagatccactcggctatgaggatgtgataccagaggcggatagagaaggggtaatccgttatgttatcggggtgggtgatgccttcaggtctgaaaagagccgtcaggaactcaacaccatcgccagcaaacccccccgcgatcacgtatttcaggtgaataatttcgaagcactcaagactatccaaaatcagctgcgcgagaagattttcgctattgaaggtacacagaccgggtccagctccagtttcgagcatgaaatgtcccaagaaggtttctctgcagctataactagtaatggcccgttattaagtactgtgggttcctacgattgggcagggggagtctttttatataccagcaaagagaaaagtacttttatcaacatgactcgggtggactccgatatgaatgacgcatatctcggatacgcggctgccatcatactccgcaatcgagtgcaatctctggtcctcggggcaccacgctatcagcacataggccttgttgctatgttccgccagaacacaggcatgtgggaaagtaatgccaatgtgaagggaacccagattggagcttacttcggcgcttccctctgctcggttgacgttgactcaaacggttccactgatctggtcctgatcggagccccccactattatgagcagacccgaggcgggcaagtctccgtgtgtcccttgccaaggggcagagccagatggcagtgcgacgctgtcctgtacggcgaacagggacaaccatgggggaggttcggcgccgctttgacagtgcttggggacgtaaacggcgataaactgaccgacgttgccatcggcgccccaggcgaagaggataataggggcgcagtgtacctttttcacggcacttctgggtccggcatatcgccctctcattcacagcgaattgccggctctaagttgtcaccacggctccagtacttcggacaatcactatctggcggccaggatcttacaatggacggccttgtggatctcacagtgggagctcagggccacgtactgttgcttcgatcacagccagtgctcagggtgaaggccatcatggagttcaacccaagagaagtggcacgtaatgtattcgaatgcaacgatcaggtggtaaagggcaaagaagccggtgaggtgcgagtctgccttcatgtgcagaaatccacccgggaccggcttagagaaggacagatccagagcgtggtgacctatgacttggctctagactctggccgtccacactctcgcgccgttttcaacgagacaaaaaactctacccgccgtcagactcaagttctgggcttgacacagacgtgtgagaccctgaagttacagctccctaattgcattgaggaccctgtgtctcctattgtgttgcgcctgaacttttcacttgtgggtactccgctgagcgctttcgggaacttgcgtcccgttctggcagaggacgcgcagcgcctttttaccgcattgtttcctttcgaaaaaaattgtggcaacgacaacatttgtcaggatgacctgtccataacctttagctttatgagcttggactgcttggtggtggggggaccccgggagtttaacgtcaccgtcaccgttcggaatgacggcgaggattcttatagaacacaggtcacattttttttcccgctggatctctcttaccgcaaagtgtctacactgcagaatcagcgctcccaacgatcatggaggttagcttgcgagagcgcctcatccacagaggtgtcaggggcacttaagagcacaagttgtagcataaatcaccccatttttcctgaaaacagcgaagtgacatttaacatcaccttcgacgtggacagcaaggcttccttgggaaataaactccttttgaaagcaaacgtaacaagcgagaacaatatgcctaggactaacaaaacagagtttcaactcgagctgcctgtgaagtatgccgtctacatggtcgttacatcgcatggtgtatctactaaatacctcaactttacggctagcgaaaacacttctagggttatgcagcaccaatatcaagtgtcaaatttgggccagcgatcgttgcctatctctctcgtgttcttggtacctgtgcgtcttaatcagacagtgatatgggacaggccccaagtcacctttagcgagaacctgagcagtacctgtcatacaaaagagaggctgcctagtcacagtgacttcctggcagaactgagaaaagctcctgtggtgaattgttcgattgcggtctgccagcgtatccaatgcgacattcccttcttcggcattcaggaggagtttaacgccactttgaaaggtaatctcagtttcgattggtatattaaaacgtcccataaccatcttttgattgtgtcgacagccgagatactattcaatgacagcgtgtttaccctgttacctggtcagggggcttttgtgaggagccaaactgagacgaaggtcgagccttttgaagtgcccaacccattaccactgatcgttggtagcagcgtcggaggactgctgcttctggcactaattaccgccgccctgtacaagttaggcttcttcaaaagacaatacaaggatatgatgtccgaaggaggcccccccggcgcagaacctcaatag

SEQ ID NO: 191574 - DNA, 3462 bp, Artificial Sequence
  Description of Artificial Sequence: Synthetic coding sequence
atggccctgcgggtgctgctgctgaccgccctgaccctgtgccacggtttcaacctggatacagagaatgccatgacctttcaagagaacgctagggggttcggccagtccgtcgttcagctccagggatcacgggtggtggtgggggcccctcaggagattgtagctgctaatcaaagggggtctctctatcagtgtgattactcaacgggatcatgtgagcctattagactgcaggtgccagtggaagccgtaaatatgtccttgggactcagcctggctgcaactaccagcccccctcaacttttagcttgtggcccgacagtgcaccaaacctgtagcgaaaatacatacgtcaaggggctgtgttttctgttcggctccaacctgcggcagcagccgcaaaaattcccggaagctcttcggggatgcccacaggaggactctgatatcgcttttttgattgacgggtccggttctattatacctcatgactttcggcgcatgaaggagtttgttagtaccgttatggaacaactgaaaaagagtaaaacgctcttttctctgatgcaatattcagaagaattccgtatccactttacatttaaggagttccaaaataatcccaacccaaggtccctggtgaaaccaattacccagctgttgggccggacacatacggctacgggaatacggaaggtggtgcgcgagctgttcaatatcaccaatggcgctcggaagaatgcatttaagattctcgtggtgatcactgatggagagaagttcggtgatcctctgggttatgaggatgttattccagaggccgaccgggagggagtgatacgctacgtgattggcgtaggagacgcatttcggtccgaaaaatcccgccaggagctgaatacaattgcatctaagccccccagggatcatgttttccaggtgaacaacttcgaggccctgaaaactattcaaaaccagctccgtgaaaaaatattcgccatcgagggtacacagaccggatcctcaagttctttcgagcatgaaatgtcgcaggagggtttctccgccgccatcacgtccaatggtcccctcttatcaacagtgggtagctacgactgggctgggggggtattcctctatacatctaaggagaaatctacttttatcaatatgacccgcgttgattccgacatgaacgacgcgtaccttgggtatgccgcggctattattcttcgtaatagagtgcagtctctcgttctgggcgccccaagataccagcacataggcctggttgcaatgttccggcagaacactggtatgtgggaatccaatgccaacgtgaaaggaacccagattggagcctacttcggagccagcctgtgctccgttgatgtggacagcaacgggtctaccgatctggtcctcataggtgccccacattattacgagcagacaagaggaggacaggtgtcggtgtgccctttgcccaggggccagcgagcccgctggcagtgcgatgccgtcctctatggggaacagggacagccatggggacgattcggggctgcattgacggtgttaggtgatgtgaacggagataagctcaccgatgtcgcaataggggcgccgggggaggaagataaccgcggagcagtatacctgtttcatgggacttctggctccggcatctcgccatctcattcacaacggatcgcagggtcgaaattatccccaaggctgcagtacttcggtcaaagcctctctggtggtcaggatctgacgatggatggcctggtcgatctgactgttggcgcccagggacacgttctgctcctgcgatcacagcctgtcttgcgtgtgaaggctattatggagtttaaccctagggaggtggccagaaacgtatttgagtgcaatgaccaggtcgtcaagggcaaggaagccggagaagttcgtgtttgccttcatgtacaaaaatcaacacgggatcgcctgcgagaagggcagatccagtctgtggtcacatacgatttggcgctggactcaggcagaccacatagtcgagccgtattcaatgaaaccaagaatagcaccaggaggcagacccaggtactcggccttacccagacttgcgaaacactgaaattacaactcccaaactgcatcgaggatccagtgtctcctattgtgctgcgcctgaatttctctcttgtgggcacaccactgtccgcgtttggcaatctgcgccccgtgctggcagaggatgcacagagattgttcacagccttgtttccctttgaaaaaaattgcggaaacgacaatatttgccaggatgatttgtccatcacgttcagttttatgagccttgattgtctcgttgttggcggccctagggagtttaatgtgacagttaccgtgagaaacgacggcgaggacagctaccgcactcaagttaccttcttctttcccctcgacctctcgtatagaaaggtatctacactgcaaaaccagcggagccagaggtcatggagactcgcgtgtgaaagtgcttcctcaaccgaagtgagtggtgccctgaaatccaccagctgctccattaaccatccaatctttccagagaattctgaggtaacgtttaatataacgtttgacgtcgattccaaggcatcgctgggaaataagctattactgaaagctaacgtgacttcagagaacaatatgcccaggacaaataagacggagttccaattggagctaccggtaaaatatgctgtatacatggtggttactagccatggagtttctactaagtatctcaacttcactgctagcgagaatactagccgagtcatgcagcatcagtaccaggtgagcaaccttggccagcggtccctgcctattagccttgtgtttcttgtgccggtgcggcttaatcaaactgtgatctgggataggccacaggtgactttttccgagaacctgtcaagcacttgccacacaaaggaaaggctgcccagtcactccgactttctggctgagctccgtaaggccccagtcgtcaactgcagcatagctgtttgccagaggattcagtgtgacatcccatttttcggtatccaggaagaattcaacgccaccttaaagggcaatctgtctttcgactggtacatcaagaccagccataatcatttgctgatcgtcagtacagccgagatcctctttaacgactctgtttttactctgctgccagggcaaggggctttcgtgcggtcgcagactgaaaccaaggtcgagccctttgaggtgcctaatcccctgccactcatagtcggtagttcagtaggcggtctgcttcttctagctctgattacagccgctctctacaaactcggtttctttaagcgtcagtacaaggatatgatgagcgagggcggcccacccggagccgaacctcaatag

SEQ ID NO: 191575 - DNA, 3492 bp, Artificial Sequence
  Description of Artificial Sequence: Synthetic coding sequence
atgacccggacccgggccgccctgctgctgttcaccgccctggccacttccttggggttcaaccttgacacggaagaacttaccgcttttcgtgtcgatagcgccggctttggtgactccgtagtgcaatatgctaactcatgggttgttgtaggagccccgcagaaaataacagcagccaatcagacaggaggtctgtaccagtgcgggtacagcaccggcgcttgtgagccaataggactgcaggtcccaccggaagccgtcaacatgtctctgggactttctctggccagtacaaccagcccatcccagctgcttgcttgcgggcccactgttcatcatgaatgtggaaggaatatgtaccttaccggactttgctttctgctgggccctacccagcttacacagcgcttgccagtgtcaagacaagaatgtcctaggcaggagcaggacatcgtttttttgattgatgggtccggcagtatctcctccaggaactttgcgaccatgatgaactttgttcgtgctgtgatttcacagttccagcgcccttctactcaattcagcctgatgcagttttccaacaagttccagacacactttacttttgaggaattccgccggagctccaaccctctgtccctgcttgcaagcgtgcaccagttgcagggcttcacttacacagccacagccatccagaacgtcgtacaccgactctttcatgctagttatggcgcccgccgtgacgccgccaaaattcttattgtcataacggacggcaaaaaagaaggcgacagcctcgattataaagacgttattcctatggccgatgctgcaggaattatcagatatgcgatcggagtgggcttggcctttcaaaacaggaatagctggaaagagcttaatgacattgccagcaaacccagtcaggagcacatcttcaaggtcgaggattttgatgctctgaaggacattcagaatcaactcaaagagaaaatctttgccatcgagggcacagagaccacctctagcagttccttcgagctggagatggcccaggaaggattctccgccgtttttactcctgacggcccagtactgggagcagttggaagttttacctggagtggtggtgccttcctttaccctccaaatatgagcccgacgtttataaatatgtcccaagagaacgttgacatgcgcgacagctatttggggtactcaactgagctcgcgctctggaagggtgtacagagtcttgtgctcggggcccccaggtaccaacacaccggcaaggcagtgattttcacacaggtgtcacggcagtggcgcatgaaggctgaggtgaccggtacccaaatcggctcctactttggagcatcactgtgtagtgtcgacgttgactccgacggcagtaccgatctagtgctcataggggcgccccactactatgagcaaaccaggggaggtcaggtaagcgtgtgtcctctgccccgcggctggaggagatggtggtgcgatgctgtgctttacggggaacaaggacacccgtggggccggtttggcgctgctctcaccgtgttaggtgacgtgaacggggataaattgaccgatgttgtcataggtgcgccaggcgaggaggagaaccggggcgcagtctatttatttcacggcgttcttgggccatctatttcaccatcacactcccagagaatcgccgggagccagttatcaagccggcttcaatacttcggtcaggccttatccggaggccaagaccttacgcaggacggtctcgtggatctggccgtgggcgctcgtggacaggttttgctcctgcgcacaaggccggtgttgtgggttggagtcagcatgcagtttattcctgcagagattcctcggtcagctttcgaatgcagagagcaagtggtgtcggaacagactttggtacagtccaatatttgcctgtacatcgacaaacgctctaagaatctacttggctcaagagacctgcaatcatcggtaacactcgacctggccctggaccccgggaggctgtcacctcgggcaacgttccaagaaactaagaatcggagcctatcccgagtgagggtgttgggcctcaaagctcactgtgagaacttcaaccttcttctgccctcctgcgttgaagatagtgtgacccccataactctgcggctcaactttacccttgtggggaagcctctgttggcctttcggaatcttagacctatgttagccgctgatgctcagcggtattttaccgctagtctgccattcgagaagaattgtggggctgatcatatatgtcaggataacctgggcataagctttagtttccccggcctaaagtccctcctcgtgggttcaaacctggagcttaatgctgaggtaatggtctggaatgatggagaggactcctatggcactactataacattctctcatccggcgggcctttcctatcggtacgtcgcagaagggcagaaacaaggccagctgagatccctgcacctgacctgtgacagcgcaccagtggggtcccaggggacctggagcacaagctgcagaataaaccatctgatcttcagaggaggtgcacagattaccttcctggcaacgtttgatgtgagccccaaagctgtcttgggtgaccgcctattgctgacagcaaatgtgagttccgagaacaataccccacggacctccaagacaacctttcaattggagctgccagttaagtatgcagtgtatacagtggtcagttcacacgagcagttcaccaaatatctcaacttttctgagagcgaagaaaaggagtctcatgtggcaatgcaccgctaccaggtgaataatctgggtcagcgagatctcccggtttccatcaacttttgggttcccgtcgagctgaaccaggaggccgtttggatggatgtggaggtgtctcatccgcagaatcctagcctgaggtgttccagcgagaagatcgcaccacctgcctccgactttctcgcacatattcagaagaaccctgtgctcgattgttctatcgcgggatgcctccgattcaggtgcgacgtccctagtttcagtgtgcaggaagagctggactttaccctgaagggaaacctgagctttggttgggtcagacaaatacttcagaagaaagtctcagtggtctctgttgcagagataacatttgatacttctgtgtattcacagttgcccggccaggaggcattcatgcgggctcagacgacgaccgttctggaaaagtataaggtgcataatcccaccccgttgatagtgggctcaagtattgggggcctactgcttttagctttgattaccgcagtgctatataaggtaggtttctttaaaaggcaatacaaagaaatgatggaggaagccaatggccagattgcgcctgaaaatgggacccagacaccttcaccaccctcagaaaagtag

SEQ ID NO: 191576 - DNA, 5469 bp, Artificial Sequence
  Description of Artificial Sequence: Synthetic coding sequence
atggccggcccccggcccagcccctgggcccggctgctgctggccgcactgatctctgtcagcctgtcgggcaccttggcaaatcggtgcaagaaggccccggttaagtcttgtaccgaatgcgtaagagttgataaggactgcgcctactgcaccgatgagatgtttagagatagacggtgtaacacacaagcagagctgttggctgctggctgtcagcgggaatccatcgtggtgatggagtcatcattccaaattacagaggagactcaaattgacactactctaagacgcagccaaatgagcccccagggattacgagtcaggttaagaccaggtgaggagcggcatttcgagctcgaagtcttcgaacccctcgaaagtcctgttgacttgtacattcttatggatttcagcaatagcatgagtgacgacctggataacctgaagaaaatgggccaaaacctcgcaagagtcctatctcagttgacatcagattataccattggattcggaaaattcgtggacaaagtgtccgttccccagaccgatatgagacctgagaagcttaaagagccatggcccaacagcgaccctccattttctttcaagaacgtaatcagcttgaccgaagacgtggacgaattccgaaacaagctccaaggggaacgaatttcaggcaatcttgatgcgcccgaggggggatttgacgcgattttacaaaccgctgtctgcacgcgggacattggctggcgacccgacagcacccacctgttagtattttctactgaatcagccttccactacgaagctgatggggctaatgtgttggccggtattatgtctaggaacgatgaacggtgccatttggacacaaccggcacctatacccagtatagaacacaggactatcctagcgttcccaccctggttcgtctccttgctaagcataacattataccaatcttcgctgttactaactacagttattcatattacgagaagcttcatacctatttccctgtctcatcccttggcgtgctgcaggaggatagcagcaacatcgtcgagctccttgaggaggcatttaatcggattagaagtaacctggatatcagagccctggacagcccaaggggcctgagaacagaagtgacttctaagatgttccagaaaacccgcacaggctccttccatataagaagaggagaagtaggtatctaccaagtccagttaagagccctcgagcatgtcgatggcactcacgtgtgtcagctgccggaagaccaaaaagggaatattcacttgaagcctagtttttctgatggactcaaaatggacgcgggcatcatctgcgacgtctgtacatgcgagttgcagaaggaggtgcggagcgctcggtgctcttttaacggagatttcgtctgtggccagtgtgtctgttccgaaggatggtccgggcagacctgtaactgcagcacaggaagcctctccgatatccagccctgcctgcgcgaaggcgaggataaaccatgttccggccgaggggagtgtcagtgtggtcattgcgtctgttatggtgagggcagatacgaaggacagttttgtgaatacgacaattttcagtgtccgcgtacttctgggttcctgtgcaacgacagaggtaggtgctctatgggacagtgcgtgtgtgaaccaggttggactgggccatcgtgcgactgccccctatctaacgccacatgtattgacagcaatggtgggatctgtaatggccggggccattgcgagtgtggaagatgccattgccaccagcagagcctgtacacagatacaatctgcgaaatcaattatagtgcaatccaccctggcctctgtgaagacctgcgctcatgtgtgcagtgtcaggcctggggcacgggcgagaaaaaggggaggacctgtgaagagtgcaattttaaagtgaagatggtggacgaactgaagcgcgctgaagaagtggtggtgcggtgctccttccgagacgaagacgatgattgtacatactcctatactatggaaggggatggcgcccctggaccgaactcaaccgtgctggtacacaaaaagaaagattgtccccccgggtccttttggtggctgattccactccttctgttgctcctgcctctgcttgctctgctcctgttgctgtgctggaagtactgtgcctgttgtaaggcctgtctggcgctgctgccctgctgcaatcgtggacatatggtgggcttcaaggaggatcattacatgttaagggaaaacttaatggcatccgatcaccttgacactcccatgcttagatcaggcaatttaaagggaagggacgtagtcaggtggaaagtaactaataatatgcaaagaccaggcttcgccacgcacgctgcctccattaatcccacagaattagtgccctacggcctctccctcaggttggcacggctgtgcaccgagaacttgctcaagcctgatacgagagaatgcgcccagctccgacaggaggtggaggaaaacttgaatgaggtgtacaggcagataagcggcgtccataagctccagcagacgaagttccgtcagcagcccaacgcaggcaaaaagcaagaccacacgattgtggacactgtgctgatggcccctcgcagcgctaaacccgccctgctaaaacttaccgaaaaacaggtggaacaacgagcattccatgacctgaaggtggccccaggatactacactttgacagcagaccaagacgcacgcggaatggtagaattccaagagggcgtcgaattagtggatgtaagagtccctctgtttatccggccagaggatgacgacgagaagcagttgttagtcgaggctattgacgtgccagccggtactgctactctaggtcgcaggttggttaatatcaccatcattaaagaacaggcgcgggacgtggtgagttttgagcaacctgagttctccgtgtccagaggggaccaggtggccaggattcccgtaattcgcagagtgctggatggggggaagtctcaggtgagttatcggacccaggacggtactgcacagggaaacagggactacattcccgtggagggcgaactgctgtttcagcctggggaggcctggaaagaactgcaggtgaaactcctggagctccaggaggtcgatagcctgctacggggacgccaggtacgtaggtttcacgtccagctcagcaaccccaagttcggcgcacatcttggacagcctcatagcacgacaataatcatacgcgaccccgacgaactcgaccgcagttttacgtcccagatgctgagttcccaaccccctccacatggcgatctgggagcaccacagaacccaaacgctaaagcggctggatccagaaaaatacattttaattggcttccccctagtggcaaacctatggggtatcgggttaaatattggatacagggagacagcgaatctgaggcccacttgttagacagcaaggttccgtctgtcgagctcactaacctttatccttactgcgactatgaaatgaaggtgtgtgcatatggggcccagggagagggcccctattcctccctggtttcctgtaggactcaccaggaggtaccttcagaaccaggtcggttagcatttaacgtcgtttcctccaccgttacacagctcagctgggccgagccagccgagactaacggagagatcacggcgtacgaggtgtgctacggtctggtgaatgacgacaatcgccccatcggaccaatgaagaaagtcctcgtggacaatccgaaaaaccgaatgctcctgattgagaacctccgcgagtcacagccctaccgctatactgttaaggccagaaacggagcgggttgggggcctgagcgcgaagccatcattaacctggccacccagccgaagagacccatgagtatcccaatcatccccgatattcccatagtcgatgctcaaagcggcgaagattacgattcattcctgatgtacagcgatgatgtgcttcggtctccttcaggatcacagcgcccaagcgtctcagacgataccgggtgtggttggaagtttgagccattgcttggagaggaactggatcttaggagagtgacttggcggctcccacccgaacttataccgcggttaagtgccagctccgggcgtagtagcgatgcggaggctcctcacggccctccggacgacggaggagccggaggaaaagggggaagccttcccagaagcgccacccctggtcccccaggcgaacacctcgtgaacggtcggatggatttcgcatttcctgggagtactaacagtctccaccggatgactacgaccagtgcagcagcttacggtacacatctgtccccacacgtgcctcaccgggttctgtccaccagctctaccctcaccagggattacaattctctgacccgctcagaacacagccatagcacaacactgcctcgagattatagcactcttacctctgtgagctctcacgactctagactgacagccggggttccagacaccccgacgcgccttgtcttttcggctctgggacccacttccctccgcgtttcctggcaggagccccgatgtgagcgacctctgcagggctactctgtggaataccaactgctgaacggcggagaactccaccgcctgaacatcccaaaccctgcccaaacttctgtcgtggttgaagatctgctcccaaatcactcttacgttttcagagtcagagcccagtcccaggaaggatgggggcgtgaacgggagggcgttattaccattgagtcccaagtccaccctcagtcccctctatgtcctctcccaggctcggcatttaccctgtctacccctagcgcccccggacctctcgtcttcactgctctgagtcctgattccctacagctcagctgggaaagacctcgacgccccaacggcgatattgtggggtatctagtcacttgcgagatggcccagggcggaggaccagccacagctttcagagtggacggggattcccctgaatcaaggctcactgttccgggcttatctgagaatgtgccctacaaattcaaggtgcaggcccgcacaacggagggatttgggcccgagcgagaaggcattatcacaattgaatctcaggatggagggccattcccacagctcggatcacgggcagggctgttccagcaccctttgcagagcgaatattcttcgattactacaacgcacacatccgccactgaaccctttctggtggacggattaacactaggagcccaacacctcgaggccggaggatccttgacgaggcatgtgacacaggaattcgtcagtaggacgctcactacttcgggcaccctttcgacccatatggatcagcaattctttcaaacgtag

SEQ ID NO: 191577 - DNA, 5418 bp, Artificial Sequence
  Description of Artificial Sequence: Synthetic coding sequence
atggccggcccccggcccagcccctgggcccggctgctgctggccgcattaatttccgtctcactctccgggactctagccaatcgttgtaaaaaagcccctgttaaatcatgcacagagtgtgtcagggtggataaggactgtgcctattgcacagacgaaatgttccgtgaccgccgctgcaacacacaggccgaactgttagcagccggctgccaacgtgagtccatcgtggtgatggagagttcctttcagattaccgaggagacgcagattgacacaaccctgaggcgcagccagatgtcaccccaggggttacgggtccggttgcgtcccggtgaggaaaggcattttgagctcgaggttttcgagccattagaatccccggttgatctgtacatcttgatggacttcagtaactccatgtccgatgacttggataatctaaaaaaaatgggccagaaccttgctagagtgctttctcagctgacttccgattacactatcgggtttggcaaattcgtggacaaagttagcgttccccagacagacatgcgccccgagaagctcaaggagccctggcctaactccgaccctcctttctcttttaagaatgttatctccctgactgaggatgtggatgagtttcggaacaagttgcagggcgaaagaattagcggcaatctggacgcccctgagggcggattcgacgcgatcctacagaccgccgtctgcactcgcgacatcggatggcggcccgattcaactcacttgttggtcttctccacagagagtgctttccactatgaagctgacggggcaaatgttctggcgggtatcatgagtcgcaacgatgaacggtgtcacctcgacacaaccggcacctacacacagtacaggacacaagattatccctcagtgccaaccttggtgcgccttctcgcaaaacataatatcattccgatatttgccgtgacaaactatagctactcctattatgagaaactgcacacttatttccctgtgtcttcactcggcgtgttacaagaagactccagcaatattgtggaattgctggaagaggctttcaatcgcatacgcagcaacctggatatccgggcactcgactctccccggggactgcgtaccgaagttacgagtaagatgttccagaaaacacgcactggcagctttcatatcagaagaggcgaggtaggcatttatcaagtgcagctacgggcattggagcatgtagacggtactcacgtgtgtcagctcccggaagatcaaaaaggcaatattcacttaaagccgtcattttcagatggactgaaaatggacgcggggatcatatgcgatgtgtgtacttgcgagctccagaaggaggtgaggagcgcacgctgtagcttcaacggggattttgtatgtggacagtgcgtgtgtagtgaaggctggtccgggcaaacttgcaattgttctacgggcagcctgtccgacatacaaccttgcttgagagaaggagaggataagccctgctccgggagaggggagtgccagtgcggacactgcgtctgttacggggaggggcggtatgagggtcaattttgtgagtatgacaattttcagtgccctaggacgagtggctttctctgtaacgacaggggccgctgcagtatgggacagtgtgtgtgcgagcctggctggactggccctagctgcgattgtcccctgagcaacgccacatgtatagacagcaacgggggcatctgtaacggccgtggccattgcgaatgtgggagatgccactgccatcagcagtctctttatacggatactatttgcgagatcaactacagtgccatccatcctggtctgtgcgaggatttacgcagttgcgttcagtgccaagcgtgggggactggagaaaaaaagggtagaacatgcgaagagtgcaattttaaggtgaaaatggtagacgagcttaagagggccgaggaggtggtggtgagatgcagcttcagagatgaggacgatgactgtacatattcctacaccatggagggcgatggtgcccctgggcccaactccaccgtcttagtccacaagaaaaaagattgtccccccgggtctttttggtggctgatacccctacttctgttgctcttgccattgttggctcttctgttactgctgtgctggaaatactgtgcttgctgtaaagcatgtctggcactactaccatgttgtaaccgcggccacatggtgggttttaaggaggaccattacatgctgcgagaaaatctgatggccagtgatcacttagacaccccgatgttaagaagtggaaacctgaagggaagggacgtcgtgaggtggaaggtgaccaataacatgcaacggcctggattcgcgacccacgcggccagcattaatcccaccgaactcgtaccctacggtctgtcattgcgactggccagactgtgcaccgagaaccttctcaagcccgatacccgcgagtgtgcccaactgagacaggaggtcgaggagaatctgaacgaggtttacagacagattagtggggtccataaactgcagcagactaagtttaggcagcagccaaacgcagggaaaaagcaggatcacacaattgttgatactgttctcatggctccaagatcggccaagcctgcgctcctcaaactgactgagaaacaagtggagcagcgggcctttcatgatcttaaggtagccccaggctattatacacttaccgcggaccaggatgcgcgaggcatggtggagtttcaggagggcgtcgagctggttgatgtgcgggtgcccctttttattagaccagaggatgatgatgaaaaacagttgttggtagaagccatcgacgtcccagccggaaccgccactttgggccgtcgcctggtgaatatcacaataattaaggaacaagcccgagatgtcgtgtcctttgagcaaccagagttctcagtgtctcgcggcgaccaggttgctaggattcctgttattcggcgcgttttagacggtgggaagtcacaagtatcttacagaacccaagacggtactgctcaaggaaacagggactacataccggtcgagggagaacttctcttccagccaggagaagcttggaaggaactgcaggtaaaactgttggaattacaggaagttgacagccttctacgaggaagacaggtgagaaggttccacgtccagttatccaaccctaagttcggagcacatcttggacagccacattcaacaactatcatcatccgggatccagatgagttggacagaagttttacatcccagatgctgtcgtcacaacctccaccacacggagatcttggtgcacctcagaacccaaatgctaaggcagcagggtcgaggaaaattcactttaactggttgcctccgtccggtaaacccatgggatatcgagtgaaatactggatccaaggcgattccgagtctgaggcgcatctgctggattcaaaggttcctagtgtggagctcactaacctctacccctactgcgattatgagatgaaggtctgtgcctatggcgcacagggggaggggccctatagctccctggtgtcttgtcgaactcaccaggaggtgcctagtgaaccgggaaggctagccttcaatgtggtgtcctcaactgtgactcagctctcctgggccgagcccgccgaaactaatggagaaatcaccgcctatgaggtatgctacggacttgtcaacgacgataacaggccgataggccccatgaagaaggttctggtggacaatccgaaaaatagaatgctgctcattgaaaacctcagagagtctcaaccctatagatacaccgttaaggctagaaacggcgccgggtgggggccagagagggaagcgataatcaacttggcaacccagccaaaacgccccatgtcaatcccgattatccccgatatcccaattgtggacgcccagtcaggagaagactacgattctttcctgatgtattctgatgatgtcttgaggagtcccagtggctctcaaaggcctagcgtatcagatgataccgaacacctcgtgaatgggaggatggatttcgcttttcccggctcaaccaacagcttgcataggatgactactactagcgctgctgcttatggaacacatctaagtcctcatgtgccacaccgggtcctctctacaagctcaacactgacccgtgattacaattcactcacaagaagtgagcactctcacagtaccacactgcctagagactactcaacacttacttcggtttcttcacatggattacctcctatctgggagcatggacggagtcgactacccctcagttgggcattaggctccaggtcccgtgcccaaatgaaaggttttccccccagccgcggcccccgtgattccatcatcctggcaggcaggcctgctgccccctcatggggtcctgactctaggctgactgccggcgtgcctgatacccccactcgtctggtcttctctgccctgggaccgacatctctcagagtgagttggcaagagcccagatgcgagcggcctcttcaaggctactcagttgagtatcaactgctgaatggaggagagctccaccgccttaatatccccaatcccgctcaaactagtgtggttgttgaggacctgttaccaaaccactcgtatgtgtttcgggtgagagctcagagtcaggagggctggggaagagagagggagggcgtgattacgattgagtcccaagtacacccgcaaagcccactgtgcccgctgccagggtctgcctttacactgtccacaccttctgcccccggccctctcgtgttcactgccctgagccctgactcactgcaactcagctgggaaaggccgaggcggccaaacggggacattgtcggctatctagtaacctgcgaaatggcccagggagggggtcccgcgaccgcttttagagtggacggcgactcgcccgagtcaaggctgactgtgcccgggttgagcgagaacgtgccatacaagttcaaagtgcaagcgcgcaccaccgaagggttcggccccgagagagagggcattataaccatcgaatcacaagatgggggtccctttccgcagcttggtagcagggccgggctgttccagcacccactacagtcagaatacagcagtatcaccacgacccacacatccgcaacagagcccttcttggtggacggcctaactttaggggcgcagcatcttgaagccggcggctctctgacccggcatgtgacccaggaattcgtcagccgaaccttgacaacctcaggcacactgtcgacacatatggatcagcagtttttccagacctag

SEQ ID NO: 191578 - DNA, 5418 bp, Artificial Sequence
  Description of Artificial Sequence: Synthetic coding sequence
atggccggcccccggcccagcccctgggcccggctgctgctggccgccctaatcagtgtgtctttgtctgggaccctcgctaatcggtgcaagaaagcgcccgtgaagtcatgcacagagtgcgtaagagttgacaaggattgtgcatattgtaccgacgaaatgtttcgggacaggcggtgtaatacacaggcagaactgctggcagcaggatgccaacgcgagagcatagtcgttatggagtcctcattccagattacagaggaaacacagatagacaccactcttagacgatctcagatgtctccacaaggcctcagggtacggctccgccctggtgaggagcgacactttgaactggaggtgtttgagccccttgagtctcctgtggatttgtacatactgatggacttctccaattccatgtccgatgacctggacaacctgaaaaagatggggcaaaacctggcccgggtgttaagccagctcacttctgactataccatagggtttggaaaatttgtggacaaggttagcgttccacagaccgatatgcgaccggagaagctgaaagaaccatggcccaacagcgatccgcctttctccttcaagaacgttatctccttaactgaggacgtggacgaattccgaaacaaactgcagggtgagagaatttccgggaatctcgatgctcctgaaggcggcttcgatgccatactgcagacggcggtctgtacgagggacataggctggcgccccgattccacgcatctgctggttttctcaaccgagagtgcattccactacgaagcggacggggccaatgtactggctgggatcatgtctcgcaatgacgagcgctgtcacctcgataccacgggaacatatacccagtaccgaactcaagactaccccagtgtgcccacattggtgcgattactggctaaacataatattatacccatctttgctgtgacaaactattcatattcatactacgagaagctccatacgtatttcccagtaagcagcttaggagttttgcaggaggatagttccaatatagtagaattgctggaagaggcatttaacagaatcagatctaatttagacatacgcgccctggattcgccacgaggccttcggaccgaggtaacaagtaagatgtttcagaagacgagaaccggcagctttcacattagacggggagaggttggtatttaccaggtccagctgcgggcgctggaacacgtcgatggaactcacgtatgtcaactgcccgaagatcagaaaggaaatatccacttgaaaccgtccttcagcgatggccttaagatggatgctggcatcatatgtgacgtgtgtacatgcgaactgcaaaaagaagtgcggtctgctagatgctcgttcaatggtgactttgtctgcggacagtgcgtttgcagtgaaggctggagtgggcagacatgtaactgttccacgggatcactgagtgatatccagccatgtcttcgcgaaggcgaggacaagccgtgctccggccggggcgaatgccagtgcggccattgcgtatgttacggggagggcagatacgaagggcaattctgcgaatacgacaacttccagtgccctagaacgagcggatttctttgcaatgacaggggccgctgctctatgggccaatgcgtatgtgagcccggatggaccggaccttcttgcgactgtcctcttagcaacgcaacatgcatagacagcaatggcggcatttgcaatggaaggggccattgcgaatgcggacgttgtcattgtcatcaacaatctctctataccgacaccatttgtgagataaactacagtgccatccacccgggtctctgtgaggatctgcgctcctgcgtgcaatgccaggcctggggtaccggagagaagaaagggcgtacttgcgaggagtgcaatttcaaggtgaaaatggtggacgagcttaagcgcgcagaagaagtggtggttagatgttccttccgcgacgaagacgatgattgtacctactcctataccatggagggagatggggccccaggccccaattcaaccgtgctagtccacaagaaaaaagactgtcctcccgggtcattctggtggctaattcccctgcttttactgctgctgccgctgttagcacttctgctgctcctttgctggaaatactgtgcatgttgtaaggcctgcctcgccctgctaccttgttgcaaccgcgggcacatggtgggattcaaggaggaccattatatgctaagggaaaatttgatggcaagtgaccacctcgatactcctatgcttcgctcaggtaatttaaagggccgcgatgtggttcggtggaaggtgacaaacaatatgcaaaggcccgggttcgccactcacgcggcctctataaacccaaccgaattggtaccatacggactgagcctaaggctggcgcgtctgtgcacagaaaacctactgaaacctgacacccgggagtgcgcacagctgagacaggaggtcgaggaaaatctgaacgaggtgtacagacagatcagcggggtccataagctgcagcagacaaagtttaggcagcaacccaatgccgggaagaagcaggaccacacgattgtggacacagtgctgatggctcctcggtcagccaagccggccctgctgaagctgaccgagaagcaggttgagcaaagagcttttcatgacctcaaggttgcgccgggatactacaccctgaccgctgatcaggacgctcgaggcatggtggagttccaggaaggggtcgagctggtcgacgtgcgggtcccactgttcattcggccagaagacgacgatgagaagcagctactcgtcgaggcgattgatgtgccagccggcaccgcaacgcttggtaggagactggtcaacattaccattattaaagagcaggccagagatgtcgtgtccttcgagcagcccgagttctctgtgtctcgaggggaccaggtggcaaggattcccgtgatccgacgagtactcgacggcggaaagtcacaggtgtcctatagaactcaggacggaactgcccaaggcaaccgggactacatccctgtggagggagagcttctattccagcctggggaggcctggaaggaattgcaagtgaaactgttagagctgcaagaggttgatagccttttgcgcggaaggcaggtgcggcggtttcatgtacagctctctaacccgaagttcggtgcccaccttgggcaaccacattcaacgaccataataattcgtgatccggacgagcttgatcggtcatttacatcacagatgcttagcagccagcctcccccgcacggggacctgggcgctcctcagaatcccaacgccaaggccgccggttccagaaagatccactttaattggctgcccccatcgggcaagccaatgggttatagagtgaaatactggattcagggcgactccgagagcgaagctcacttgctggactctaaggtgccgagcgtggagctgaccaatctctatccctactgcgactacgagatgaaagtgtgtgcctacggcgcccagggggaagggccgtactcctccttagtcagctgccgaacccaccaggaggtgccttctgagcccggccgactggccttcaatgttgtgagcagtacagttacacagctgagctgggctgagcctgccgagaccaacggggagattaccgcatacgaggtgtgctacgggttagttaatgacgataacaggccaatcggccccatgaagaaggtactcgtggacaatccaaaaaaccgaatgctactgatagagaatcttagagagtctcagccatataggtacacggtgaaggcccgcaatggtgccgggtggggcccggagcgcgaagccataattaatctagcaacccaacctaagaggcctatgtcaatcccgattatccccgacattccaattgtcgatgcacagagtggtgaggattacgattcatttctgatgtattcagatgacgttctaaggtcacctagcggttcccagagaccaagtgtatcagacgatactgaacaccttgtgaacggccggatggacttcgcatttcccggctccactaattctttgcaccgaatgacaacaaccagcgcagcagcatacgggacccatctaagtcctcatgtaccccaccgggtactgtctactagctccaccctgaccagggactacaactccctcacgcggtctgaacactcccatagtacgacactgccaagggactactccaccctgacaagcgtatcaagccatggccttccacctatctgggagcacggaagatcacgcctgccgctttcttgggcccttggttctagatcgagggcacagatgaaaggtttccccccctcaaggggccccagagactctatcatactggctggcagaccagcagcaccttcttggggcccagatagccgtttaacggcaggcgtgcccgacacccctactagattagtgttcagtgccctaggccccacaagcctgcgggtctcctggcaggagccccgatgtgaacgcccactgcagggctatagtgtcgaataccagttactgaacggcggtgaactgcatcgcctgaatattcctaacccagcccagacatcagtcgtcgtggaggacctacttcccaatcatagttacgtttttcgggtgagagcacagagccaagagggatggggccgtgagcgggagggagtcataaccatcgagagccaagtacacccccagtcccctctttgtccattgcctgggagcgctttcaccttgtcaacgccctccgcccctgggcccctggtgtttaccgctcttagtccagactcgctccagctgtcttgggaaagaccccggcgcccaaacggagacatcgtgggctacctcgtcacctgcgaaatggcacagggaggcggtcccgccactgcgtttcgtgtcgacggcgattcccctgagagcagactgacggtcccggggttgagcgaaaatgttccatataaatttaaggtgcaggcccgcaccacagaaggttttggccctgaacgagaagggattatcacaattgaatcacaggacggggggcccttccctcagctcggaagcagggctggcctcttccagcacccactgcagtctgaatattcctccatcaccacaacacatacatccgccaccgagcctttcctggtcgatggattaactcttggcgcccagcatctggaggctgggggaagcctaacccgtcatgtgacacaggaattcgtgagccggacgttgacaacttctggcaccctctcaactcacatggatcagcagttcttccagacttag

SEQ ID NO: 191579 - DNA, 1932 bp, Artificial Sequence
  Description of Artificial Sequence: Synthetic coding sequence
ggcggcatcgaggagacccagatcgacaccaccctgcggcggagccagatgagcccccagggattgcgggtgaggctgaggccaggggaagagagacacttcgagctggaggtgttcgagcctttggaatcaccagtagacttgtatattctgatggattttagtaattccatgtcagatgatctggacaacctgaaaaagatgggccagaatctagccagagtcttgtcacagcttacatctgactacacaatcgggtttggtaaattcgtggacaaggtgtccgtgccgcagacagatatgcggcccgagaagctgaaagaaccatggcccaactcagaccctccgtttagcttcaagaatgtcattagtctgacagaggacgttgacgaattccggaacaaacttcagggagaacggatctctggcaacctcgacgcccccgaaggcgggttcgatgcaatcttgcaaaccgccgtgtgcaccagggacatcggatggagacccgactccacccaccttctggtgtttagcaccgagtctgccttccactatgaggcagatggggctaacgtgctcgctggtattatgtccagaaatgatgagcgctgccatctggatacaacgggaacttacactcagtaccgcacgcaggattatccatcagtgcccactctagttaggctactggctaagcacaacatcattccaatctttgccgtgaccaactactcttacagttattacgaaaagctccacacttacttccctgtctcatctcttggcgtgcttcaggaggactcatcaaatatagtagagctgctcgaagaggcctttaatcgtattagaagcaatctcgatattcgtgctctggattcccctagaggacttcggaccgaggttaccagcaagatgtttcagaagacaaggactggctcattccacatccgccgaggagaggtcgggatctaccaggttcagctccgagccctcgagcacgtggatggcacacatgtgtgtcagctgcccgaagaccagaagggaaacattcacctgaaacctagtttcagcgatggactgaagatggatgcaggaattatttgcgatgtgtgcacttgcgagttgcagaaggaggtgagatccgcccgctgctcattcaatggtgattttgtgtgtggccaatgtgtatgctcagagggctggtctgggcagacctgcaattgtagtaccgggagccttagtgatatccagccttgcctccgagagggtgaagataagccttgcagtggtaggggagagtgccaatgtggacactgcgtgtgctatggtgaaggccgatatgaggggcaattttgtgagtacgataacttccaatgtcctagaacaagcggattcttgtgcaatgacagggggcggtgcagcatgggccagtgcgtgtgcgaaccaggatggacaggcccgtcctgcgactgccctcttagtaatgcaacctgcatcgatagcaatggcggcatatgcaacggccggggccactgcgaatgcggccggtgtcattgccatcaacagagtttgtacacagacacaatatgtgagatcaattacagcgccatacaccctggtctttgcgaggatctgcgatcctgcgtgcagtgtcaagcctggggcactggcgagaaaaaaggcagaacctgcgaggagtgtaatttcaaggtgaaaatggttgacgagctgaagagggccgaagaggttgtagttcggtgcagctttcgagatgaagacgatgattgcacctactcttacacgatggagggcgatggagcaccaggacccaacagcacagtgctggtgcacaagaaaaaagactgccctcctgggagcttctggtggctcattcccctcctactacttctactacctctgctggcactttag

SEQ ID NO: 191580 - DNA, 2367 bp, Artificial Sequence
  Description of Artificial Sequence: Synthetic coding sequence
atgggcatcgagctgctgtgcctgttcttcctgttcctgggccggaacgatcatgtccagggcggatgtgcactggggggagccgagacctgtgaagactgtctcctcatcggtcctcagtgcgcctggtgcgcccaggaaaattttacgcatcctagcggagttggtgaaagatgcgacacgcccgccaacttactagctaagggatgccagttgaactttattgagaatccagtaagccaggtcgaaatactcaaaaataagcctctgtcagttggacggcaaaagaactcttcagatatcgttcaaatcgccccccagtccttgattttgaaactgcgaccaggaggagcccagaccctgcaggtgcacgtgcgccagaccgaggactacccggttgatctgtattatctgatggacctgagtgcctctatggacgatgatctgaacacgataaaagaactaggctcccgcctgagcaaggagatgagtaagcttacctccaatttcagactcggatttggctctttcgtcgagaagccagttagccccttcgtcaagacgacacccgaggaaatagccaacccctgctcaagtatcccatatttctgtctccctaccttcggcttcaagcacattctacctcttaccaatgatgctgagcgtttcaatgagatagtcaagaatcagaaaatttctgcaaacattgacacgccagaaggcggattcgacgcaattatgcaggcagctgtgtgtaaggagaagatcggctggcgcaatgattcactgcacctgctggttttcgtctccgatgcagattcccattttggaatggactctaaattggcaggaatagtgatacccaacgatggactgtgtcacctggactccaagaacgagtattccatgtccacagtcctggagtacccaaccattggccaacttattgacaagttagtccagaataacgtattactaatcttcgccgtgacacaggaacaggtacatctgtacgagaactacgctaagctcattcccggggccaccgtgggactcctccagaaagacagcggcaacatcctgcagctgatcatatctgcctatgaggaactgagatcagaagttgaacttgaggtgctgggcgacaccgagggcttgaacctaagctttaccgctatctgcaataacggcacactgtttcagcaccaaaagaagtgttcccacatgaaagtcggggatacagctagcttcagcgtgactgtcaatattcctcattgcgaaagacgctctcgccacataattatcaaacccgtaggtcttggcgacgctctggaactgctggtcagtccagaatgcaattgtgattgtcagaaggaggtcgaagtaaactcaagcaaatgccaccacggcaacggtagctttcagtgtggagtgtgtgcctgccatccaggacacatggggcctcgctgtgagtgcggggaggacatgctaagcacagattcctgcaaagaagcccctgaccacccatcttgttccggcagaggcgattgctactgcgggcagtgtatttgccacctctcgccctacggcaatatatatgggccttattgtcagtgtgacaactttagctgcgtgcgacacaagggccttttatgtggaggcaacggcgactgcgactgtggtgagtgtgtctgtagaagcggctggaccggtgagtactgtaattgtacaacttccacggatagctgtgtgagcgaggatggggttttgtgcagcggacgaggggactgcgtgtgcggtaagtgcgtgtgtaccaatccaggcgcgtccggcccaacttgcgagaggtgtcctacatgtggcgacccttgcaatagtaagcgaagctgtatcgaatgccacttgagcgcagccggccaggctagagaagagtgcgtggacaaatgcaagctggctggggctactatttctgaagaagaggattttagcaaagatggcagcgtgagttgcagcctccagggagaaaacgagtgtctgattactttcttaataaccaccgacaatgaaggcaaaacaatcatacacagcataaatgagaaggattgtccaaaacccccgaacattcctatgataatgctcggtgtcagtctagctattctgctgatcggtgtggtgctgctgtgcatttggaagttactggtgtctttccatgaccggaaagaagtagcaaagttcgaagcggagcgatctaaggctaaatggcagacgggaaccaatccgctgtataggggctctaccagcaccttcaaaaacgtgacttataaacaccgagagaaacagaaagtcgacctcagcaccgattgttag

SEQ ID NO: 191581 - DNA, 2367 bp, Artificial Sequence
  Description of Artificial Sequence: Synthetic coding sequence
atgggcatcgagctgctgtgcctgttcttcctgttcctgggccggaacgaccatgtccaaggaggatgtgccttagggggtgctgagacatgcgaggattgcctgctgatcggcccccaatgtgcttggtgcgcacaggagaatttcactcaccccagcggggtaggggagcgctgtgatacccccgccaatttactggccaaaggctgccaactcaactttatcgagaaccctgtctcacaggtggaaatactcaagaataagcctctctccgtcgggcggcaaaagaattcaagcgacatagtacagattgctcctcagagcctaatcctgaagcttcgtcccggcggggcccaaacattgcaagtgcatgtgcgacagaccgaggactaccctgtagatctgtattaccttatggatctttctgcctctatggacgacgacctgaacactatcaaggagttgggcagcaggctctctaaagagatgtcaaagctgaccagtaatttccggttagggtttgggtctttcgtagagaagcctgtgagcccattcgtgaagactacacccgaggagatagccaatccttgcagctccattccttatttttgcttgcctacttttgggttcaagcacatcttgccactgacaaacgatgctgaaaggtttaacgagatagtcaaaaaccagaagatctcagcaaatatcgacacacccgaaggagggtttgacgcaataatgcaggcggctgtttgcaaggaaaagattggatggagaaacgatagcctccatttactggtattcgtcagtgatgccgatagtcatttcggaatggatagcaaactggcaggcatcgtgatcccaaacgacggcctgtgtcacctggattcgaagaatgaatacagtatgtctaccgttctcgaatatcccactattggtcaactcatcgacaagctcgtgcagaataacgtgttgctaattttcgccgtgactcaggaacaggtgcatctatacgagaactatgccaaattaatacctggtgcgacggtgggacttttacaaaaggatagtggtaatatccttcaattgattatctctgcatatgaggaactgagatcggaggttgaactcgaggttctcggcgacaccgagggcctgaatctgtcattcaccgcgatctgtaataatggcaccctattccagcaccagaagaaatgtagccatatgaaggtgggcgacaccgcgagtttcagcgtcaccgtcaatattccacattgtgagagacgctccagacatataattataaagccagtgggtttaggtgacgcgttggaacttctggtgagccctgagtgcaactgcgattgtcaaaaggaggtggaagtgaatagctccaagtgtcaccatggaaacggatcattccagtgtggcgtctgcgcgtgtcaccctgggcatatgggcccccggtgtgagtgtggagaagacatgctgagcaccgatagctgtaaggaggccccagaccatccatcttgttccggcagaggcgattgctattgtggccagtgcatttgtcatttatccccctatggcaatatttacggaccatattgccaatgcgataacttcagttgtgttcggcacaagggacttctctgtggagggaatggcgattgtgattgtggggagtgcgtgtgccggtccggttggacgggagagtactgcaactgtactacctcaaccgacagctgcgtgtctgaggacggcgtactgtgcagcggacggggcgactgcgtctgcggcaagtgcgtctgtacaaatccaggagcctctggccctacatgtgagagatgtcccacttgtggcgacccctgcaattccaaaagaagctgtatagagtgccacctgtcggcggcgggtcaggccagagaggagtgcgtcgataagtgcaaattggccggtgccacgatcagtgaagaagaggatttctcgaaagatggcagcgtgagttgtagtttgcagggtgaaaacgaatgtttaataacattccttataaccaccgacaacgagggcaaaaccattatccacagtatcaacgaaaaagattgtccaaaacctcctaatatccctatgattatgttaggcgtgtcgctggctatcctcctaatcggcgtggtcttgctgtgtatttggaagctacttgtcagttttcatgataggaaagaagtggccaagtttgaagccgagcgcagtaaggctaaatggcagactggcaccaacccgctgtatcgcgggtctacttccaccttcaagaatgtgacatacaaacatcgggaaaagcagaaggtggatctcagtactgactgttag

SEQ ID NO: 191582 - DNA, 2397 bp, Artificial Sequence
  Description of Artificial Sequence: Synthetic coding sequence
atggtggccctgcccatggtgctggtgctgctgctggtgctgagccgcggtgagtccgagctggatgctaagatcccttctactggagacgctacagagtggaggaatcctcacctgagtatgcttggctcttgtcagcccgctccttcttgtcaaaaatgcatattaagccacccgtcgtgcgcctggtgtaagcagctcaatttcacggcatctggagaggctgaagcccggcgatgtgcacgtcgggaagaactgctggcaaggggctgtccactagaagagctagaagaaccaaggggccagcaagaggtcttgcaggatcagcctctctcccagggcgcaaggggggaaggcgctacacagttagccccccaacgagttcgagtgacgctccgcccaggcgaaccacaacaattgcaggtgcgcttcctgagagctgaggggtaccccgtagacttatattatctcatggatctgagctattccatgaaagatgacctggagagggtccggcagctggggcacgcactgcttgtccggctgcaagaagtaactcattccgtgaggatcgggtttggtagttttgtggacaaaactgtcctgccttttgtttcaacagtccccagcaaacttagacacccgtgcccgactcggctggaacgatgccagtcaccattctcgttccatcacgtgctctctctgaccggcgatgcgcaggccttcgagcgggaggtgggcagacaatctgtatccggcaatctggactctcccgagggggggttcgacgccatcctccaggctgccctatgtcaagagcagataggctggcgcaacgtgtctaggctgctggttttcactagcgatgatacattccacactgcaggcgacggcaaacttggggggatctttatgccttccgacggtcactgtcacctggatagtaatggcctatattctcgctctaccgaatttgattacccatccgttgggcaggtcgcccaggctctcagtgcagcaaatatacagcctatctttgccgtgacctccgcggccttgccagtgtatcaggagctgagcaagctgatccctaagtccgcggttggggaactctccgaggacagtagcaatgtcgtccagttgataatggatgcttacaattccctgagctccacagttactctcgagcattcttctctccctccgggcgtccacattagctacgagagccagtgtgagggtcctgagaaaagagaaggcaaagccgaggatagaggtcagtgcaatcacgttagaataaatcagaccgttactttttgggtctccttgcaggccactcactgcctcccagaaccacatctgttgcgcctgagagccctaggcttcagcgaggaactgatcgtggaactacacacactctgtgattgtaactgcagtgatacccaaccccaggcacctcactgcagtgacggacagggccatcttcaatgtggtgtgtgttcctgtgccccaggtcggctcggacgcctctgcgaatgcagcgtggccgagctcagttcaccagatctggaatcaggttgcagagccccaaatgggacagggcccctctgctctggaaagggacattgtcagtgcgggagatgtagctgcagcgggcaaagctctggtcacctgtgcgaatgtgatgacgcatcctgcgagaggcacgagggcattttgtgtggcggcttcggtcgatgtcagtgcggggtatgccattgtcatgcaaatcgtaccgggagggcctgcgaatgctctggcgatatggactcctgtatttctcctgagggtggcctttgttcgggccacggaaggtgtaaatgcaacagatgtcagtgcctggacggctactacggggccctctgcgaccagtgcccaggctgtaagacaccgtgtgaacggcatcgcgattgtgcagaatgcggagcgttccggacaggccccctggccacgaactgcagcacagcatgtgctcacactaacgtgaccctcgctctggctcccatactcgacgatgggtggtgtaaggaacggacccttgacaaccaacttttcttctttttggtggaagacgacgcccgaggcacagtcgtacttcgggtgcgcccgcaggagaagggggccgatcatacccaggctatcgtactgggctgtgtgggcggcatcgtcgctgtgggcctgggcctggttttggcgtacagactgtcagtggagatctatgataggcgggaatattcaagattcgagaaggaacagcagcagctaaattggaaacaggactccaatcccctctacaagagcgcaataacaactaccatcaacccgagattccaggaggcagactcacctactctttag

SEQ ID NO: 191583 - DNA, 1953 bp, Artificial Sequence
  Description of Artificial Sequence: Synthetic coding sequence
atggtggccctgcccatggtgctggtgctgctgctggtgctgagcagaggtgaatctgaactggatgctaagatcccatccactggggatgcaacagaatggcgtaacccacacctttccatgctgggttcttgtcagccagcccctagttgtcaaaagtgcattctgtctcacccctcttgcgcctggtgcaaacagctgaacttcacagctagcggcgaagccgaggctagacgttgcgccagaagggaggaacttctagcccgtggctgcccccttgaggagctcgaggaacctcgtggtcagcaggaagttctgcaggatcagcctctgagccaaggcgcccggggagagggggcaacccagctagcccctcagcgggtgcgcgtcacactgagacctggagagcctcagcagctccaagtgcgcttcctgagggccgagggctaccccgttgacctttactatctgatggatctcagctactcgatgaaggacgatctggaacgggtacgccagctcggtcacgcccttctggtgcggcttcaggaggtcactcattccgtgcgtatcggctttgggagcttcgtggataagacagtactcccctttgtgtcaacagtgccttcgaaacttaggcacccctgcccaacccgtctagagagatgtcaatctcctttttcctttcaccatgtgttgtcgttaaccggagacgcccaggccttcgagcgagaagtagggcgccaaagcgtgtctggaaacttggatagcccagagggcgggttcgacgctatcctccaggccgcattatgtcaggaacagataggctggcggaacgtgagtaggctgttggtatttacttccgacgatacgttccataccgccggcgatggcaagctcggcggcatctttatgccaagcgatggtcactgccatttggatagtaatggcctttactcaaggagcactgagtttgattacccctctgtaggccaggtcgcgcaggctctgtcagccgccaatatacagccgatatttgcagtgacatccgctgccctaccagtgtaccaggagctaagcaaactgattccaaagtccgcggtcggtgagctgtctgaggatagcagtaacgtcgttcagttgatcatggatgcctacaatagcttgagctccacagtgacgctggagcattcttctttgccaccgggggtgcatatctcctatgagtctcagtgtgaggggccggaaaaaagagaggggaaggcagaggatcgcggccagtgtaaccacgttagaatcaatcagactgtaaccttctgggtctctctgcaggcaacccactgcctgccagaaccgcacttgctcagattgcgtgcactgggcttcagcgaggagctcattgttgaacttcatacactttgcgattgtaattgcagcgacacccaaccacaagctccccactgtagcgacggtcagggccatctgcagtgcggtgtttgtagagattgtgcagagtgcggggcgttccggaccggtccactagccaccaattgtagtactgcctgcgcacacacaaacgttactcttgccctggctcccatcctggatgacggctggtgcaaggagaggacgctggacaaccagttgtttttcttcctggtggaagatgatgcccgtggcaccgtggttcttcgtgtgcgcccgcaagaaaaaggagctgaccatacacaggccattgttctcggctgtgtggggggcatcgtcgcggtgggacttggactggtgctcgcctatcggctatcagtcgagatttatgaccgccgtgaatattccagatttgaaaaagaacagcagcaactgaattggaagcaggatagcaatcctctgtacaaaagcgccatcactacaaccatcaaccctcgcttccaggaggctgatagccctaccttgtag

SEQ ID NO: 191584 - DNA, 2397 bp, Artificial Sequence
  Description of Artificial Sequence: Synthetic coding sequence
atggtggccctgcccatggtgctggtgctgctgctggtgctgagccggggcgagagcgaactcgacgctaagattccatccactggcgatgccaccgagtggcgcaacccacacctcagtatgctgggtagctgccagccagcccctagctgtcaaaagtgtatattgagccaccccagctgtgcttggtgtaaacagctgaacttcaccgcatccggcgaagccgaagccagaaggtgcgccaggagggaggaactgcttgcaagggggtgccctctggaggagttggaggagcctcgtggccagcaggaggtcctccaggaccagcctctttctcaaggggcccgtggagagggtgctacccagctcgcccctcaacgcgtccgcgtgacacttcgacctggggagccacagcagctgcaggtacggtttcttcgtgcagaaggctatcccgtggacctttactatcttatggacctcagctactctatgaaggatgaccttgagcgcgtgcgccagctgggccacgcactgctcgttcgtttgcaggaggttacacattcagtgcgcatcggttttggcagctttgtggacaaaactgtcttgcctttcgtgtccacagtcccgagtaaactccgacacccttgtcccacaaggctggagagatgtcagagcccattcagctttcatcatgtgctctccctgactggcgacgcccaggcatttgagcgagaggtgggaagacaatccgtgtcaggcaacctggatagtcccgagggggggttcgatgccatactgcaggccgcactatgccaggagcagattggttggaggaacgtttctagactgctggtcttcacatcagacgacacatttcatacagccggagatggaaagctcggaggcatatttatgccttctgacgggcactgccatctggacagtaacggtctgtactcacggtcaaccgaattcgattaccctagtgtgggtcaggtggctcaggcactgagcgctgccaatattcaaccaatatttgctgtgacctctgctgcacttccagtgtatcaagaactgagtaaactgattcccaagtcagcggtgggagaactgtctgaggactcatcaaatgtcgtgcaactgatcatggacgcgtacaacagtctttcatcaactgtcaccctggagcacagttctctgccaccaggtgttcacatcagctatgagtcccaatgtgagggccccgagaagcgggagggaaaagccgaggatcggggccagtgtaaccatgtccggattaaccagactgtaactttttgggttagcttacaagccacccactgcctgccggaacctcacctgctccgtctgagagcccttgggttctcggaagagctcattgtggagttacataccctctgcgactgcaattgttcagacacacagccgcaggccccacactgcagcgatggacagggacatctgcagtgcggagtgtgttcctgtgctcccgggcgcctgggacgcctgtgcgaatgcagcgtcgccgagctcagctcgcccgatctggagtccggatgtcgggcaccaaatggtactgggccgttgtgcagtggcaagggtcactgtcaatgcgggagatgctcttgctccggtcaatcctctggtcatctgtgtgaatgtgatgatgcctcttgtgagaggcacgagggcatattgtgcggaggctttggtaggtgccagtgcggcgtgtgtcactgtcacgcaaataggacaggccgggcttgcgagtgttccggggatatggacagctgcatcagtcccgagggtggactgtgctctgggcacgggcggtgcaaatgtaaccggtgtcagtgcctggatgggtattacggggctctgtgtgatcagtgcccggggtgtaagaccccgtgtgagaggcacagggactgtgccgagtgtggcgcgtttcgaacaggaccactggccacaaactgcagtaccgcctgcgctcatactaacgtaacattagcactggcgcccatattagatgatggatggtgtaaagagcgcactttggataatcagctgtttttctttttggtcgaagatgatgctcggggcactgtggtgctgcgcgtgcgtccccaggaaaaaggcgccgatcatacccaggcaatcgttctgggctgtgtgggcggcatcgtggcagtgggcctgggcttggttcttgcatacaggcttagcgtcgaaatttatgaccgccgcgagtactctcgatttgagaaggagcaacagcaactgaattggaagcaggatagcaacccactttacaaatctgctatcaccacaacgatcaaccccagattccaagaagctgatagcccgactttgtag

SEQ ID NO: 191585 - DNA, 1206 bp, Artificial Sequence
  Description of Artificial Sequence: Synthetic coding sequence
atgaacctggtggccgtgatgggcgccttcaacaagggccacggcaaatgcgactgtggaaaatgtaagtgcgaccaaggatggtacggggatgcctgccagtatcccacgaattgcgatctgacaaaaaagaaatcgaaccagatgtgtaaaaactctcaggacatcatatgttccaacgcagggacgtgtcattgtgggcgctgtaagtgcgacaattctgacggctccggccttgtatacggcaaattctgtgagtgcgatgacagggaatgcatagacgacgagaccgaagaaatctgtggcgggcacggcaaatgctattgtggcaactgctactgcaaggccgggtggcacggtgataagtgcgaattccagtgcgacatcaccccttgggagagtaagaggaggtgtacctccccagatggcaaaatctgttctaaccgcggaacttgcgtatgcggtgagtgcacgtgtcatgacgtggacccaacaggagactggggagatatacacggcgatacttgtgagtgcgacgagagagactgtagagccgtgtatgaccgttactccgacgatttttgctccggccatggacaatgcaactgcgggcgctgcgactgcaaagcgggctggtacgggaagaaatgcgaacacccccagtcctgcactctctcggcggaagaaagcatacgcaagtgtcagggaagttcagatctcccatgctccggacgtggcaaatgtgagtgcggcaaatgtacctgttaccctccaggggacagaagagtctatggtaagacatgtgagtgtgatgaccggaggtgcgaggacctggatggagtcgtgtgtgggggccacggcacctgcagctgtggtaggtgtgtgtgcgaacggggctggttcgggaaactgtgtcagcacccacggaaatgtaatatgacagaggaacagagcaagaacctgtgtgagtctgccgatggcatcctgtgctccggcaaggggtcatgtcactgtgggaaatgtatatgttctgcagaagaatggtatatcagtggcgaattctgcgattgtgacgaccgagactgcgacaagcacgacggccttatctgcacggggaacggtatttgttcatgtggcaactgtgagtgctgggatggttggaacgggaatgcttgtgagatttggctgggttctgaatacccctag

SEQ ID NO: 191586 - DNA, 1485 bp, Artificial Sequence
  Description of Artificial Sequence: Synthetic coding sequence
atgcggccccccggcttccggaacttcctgctgctggccagcagcctgctgtttgccggcctgtctgctgtgcctcaatcctttagtccctcactgagatcctggccgggggctgcctgcaggctaagtcgtgccgagagcgagagacggtgcagggcccctgggcagccacccggcgccgctctctgtcatggacgtggaagatgtgactgcggggtgtgcatttgccatgttaccgagcctggcatgttctttgggcctctgtgcgagtgccatgagtgggtttgtgagacttatgacggctcaacctgtgctggccatggaaaatgcgactgtgggaagtgcaagtgtgaccaaggctggtatggagacgcgtgtcaatatcccaccaattgcgacctgacaaagaagaagtcaaaccaaatgtgtaagaattctcaagacattatatgctcaaatgctgggacatgtcattgtggaaggtgtaaatgcgataacagcgacgggagcggactagtgtacggtaagttctgtgaatgtgatgacagagagtgcatagacgatgaaaccgaggaaatttgtggtggacatggtaaatgctattgcggcaattgctactgcaaggctggatggcacggtgacaaatgtgagttccagtgcgatatcactccctgggagagtaagagacggtgcacttctcccgatggaaagatttgcagcaacaggggaacttgtgtatgcggggagtgtacttgccatgatgtggatcccactggcgattggggagatattcatggagacacctgtgaatgcgacgagcgggactgcagggccgtctatgatcggtacagcgacgacttctgtagtggacatggtcaatgcaactgcggtcgctgcgattgcaaagcggggtggtatggaaagaagtgcgaacatcctcagagctgtacactctctgctgaagagtctatccgtaagtgccagggatcttcagatctcccctgctctgggcgtgggaagtgtgaatgcggcaaatgtacctgctatccccctggcgatcgaagagtgtacggcaagacctgcgagtgcgatgatcgccgttgtgaggatctggatggcgtggtgtgtgggggacacgggacatgtagctgcggacgctgtgtttgcgagagagggtggttcggaaagctctgtcagcatcctaggaaatgtaacatgactgaggagcagtccaagaatctgtgcgagtctgccgatgggatactttgtagcggaaaaggctcttgccactgtggaaagtgcatttgcagtgcagaagagtggtatatctcgggagaattttgcgactgcgatgacagggattgcgacaaacacgatgggcttatttgcacagggaatgggatctgttcctgcggaaactgcgagtgttgggacggctggaacggaaacgcatgcgaaatctggcttggaagcgaatatccctag

SEQ ID NO: 191587 - DNA, 1209 bp, Artificial Sequence
  Description of Artificial Sequence: Synthetic coding sequence
atgagcggctgcgcccggcccaccaccggcgcccccgtgcaggccatggtctccgtaacgggtaagtgcaagtgtgatcaagggtggtacggagacgcctgtcagtaccccactaactgcgacctgaccaaaaagaaatccaaccaaatgtgtaagaacagtcaggatattatttgtagtaacgccggcacctgccattgcggaaggtgtaagtgcgataacagcgatggatccggactggtctatggtaagttttgcgagtgcgacgacagggagtgtatcgacgatgagaccgaggaaatttgtggaggacatggcaagtgctattgcggtaattgctactgcaaggcgggctggcacggcgacaagtgtgaattccaatgcgatatcaccccctgggaatcaaaacgaagatgcaccagccctgacgggaagatctgttcgaaccggggaacttgcgtttgcggtgagtgcacatgtcatgacgtggacccgactggagactggggcgatatccacggagacacctgtgaatgcgatgagagagattgccgggccgtgtatgaccgctattcggacgacttttgttcaggccacggccagtgcaattgcggacgctgtgactgcaaggctggttggtatggtaagaagtgcgagcatccacaatcctgcaccttgtcggcggaggagtccattagaaagtgtcagggttccagcgacctcccttgctctgggcgtgggaagtgcgaatgtggcaagtgcacttgttatcccccaggggatcgacgggtctatggcaagacgtgtgagtgcgatgaccgccggtgcgaggatctggacggagttgtctgtggcggccacggaacttgctcttgcggcagatgcgtttgcgagcgcgggtggttcggcaaactgtgccagcacccacgcaagtgtaatatgacagaggaacaatctaaaaacctgtgtgagagcgccgatggtatcctgtgcagtggaaagggtagctgccattgcgggaaatgtatctgttcagccgaggagtggtacatatcaggggaattctgcgattgtgatgatagagactgcgacaagcacgacggattgatctgtacaggcaatggcatatgtagttgcgggaactgtgagtgttgggacggttggaatgggaatgcctgtgagatttggctgggctctgagtacccatag

SEQ ID NO: 191588 - DNA, 1062 bp, Artificial Sequence
  Description of Artificial Sequence: Synthetic coding sequence
atgtgcaagaacagccaggacatcatctgcagcaacgccggcacctgccattgtggcagatgtaaatgtgataattctgacggatctggacttgtgtacggcaaattttgcgaatgcgatgatagagaatgcatcgatgacgaaaccgaggaaatttgcggtggccacggtaagtgctattgcggcaattgttattgtaaagccgggtggcatggggataaatgcgagtttcaatgcgacatcacaccatgggagtctaaacgcaggtgcacctctcccgacggtaagatctgttccaatcgaggtacatgcgtgtgtggcgagtgtacctgtcatgacgttgacccaaccggcgattggggtgacatccacggagacacatgtgagtgcgacgaaagagactgtcgtgcagtgtacgataggtatagtgacgacttttgcagcggccatgggcagtgtaactgtgggagatgcgactgtaaagcaggttggtatggcaagaagtgcgagcatcctcagtcatgcactctctccgcagaagagtcaatcaggaaatgccagggaagttctgatctgccatgcagcgggcgaggcaaatgcgagtgcgggaaatgcacatgttatcctccgggcgatcgccgggtctacgggaaaacatgcgagtgcgatgaccgtaggtgcgaggaccttgacggggtagtgtgtggggggcacgggacctgcagctgcggacgttgcgtttgtgaacgaggatggtttggcaaactttgtcaacacccaaggaagtgtaacatgacagaggagcagagtaagaatctctgtgaatctgccgatggcattctgtgttctggcaagggtagctgccactgcggaaagtgtatttgcagtgctgaagaatggtatatatctggagaattctgtgactgcgacgatcgcgattgtgacaaacacgatggactgatctgcactggaaacggcatctgcagttgtgggaattgcgaatgctgggacggctggaacggtaacgcgtgtgagatttggctgggttccgagtacccttag

SEQ ID NO: 191589 - DNA, 1062 bp, Artificial Sequence
  Description of Artificial Sequence: Synthetic coding sequence
atgtgcaagaacagccaggacatcatctgcagcaacgccggcacctgccattgtggacgctgtaagtgcgataatagcgatggatccggcctggtgtatggaaagttctgtgaatgcgacgatagggaatgtatcgacgatgaaacagaagagatttgtggaggtcatggtaagtgttattgtggcaactgctactgtaaggctggttggcacggagacaagtgtgagttccagtgcgacataacgccgtgggagagtaagcgacgctgcaccagtcctgacggcaagatctgttcgaatcggggaacttgcgtctgcggggagtgcacatgccacgacgtggaccctaccggtgactggggcgacatacacggcgatacttgtgagtgcgatgagagagactgtagagcagtgtacgaccgttactcagacgatttttgttctggtcacgggcagtgcaactgtggtagatgcgattgcaaagccgggtggtacggtaaaaaatgtgaacatccccagagctgtacacttagcgccgaggaatctataagaaaatgtcagggatcaagcgatcttccctgctccggtagaggcaagtgtgagtgcggaaagtgcacttgttaccctccaggagataggagagtttacggtaagacatgcgagtgtgacgacagacgatgtgaagatctggatggcgttgtctgtggcgggcacggcacatgtagttgtgggcggtgcgtgtgtgagagagggtggttcgggaagctttgccagcacccccggaagtgtaatatgactgaggagcagtcgaagaatctatgcgagtccgccgatggcatactctgctccgggaaagggagctgtcattgtggcaagtgcatttgcagcgcggaagaatggtacatcagcggggaattttgtgattgtgatgacagagattgtgataaacacgatggcctgatatgcaccggtaatgggatttgttcatgtgggaattgtgaatgttgggatggatggaacggcaacgcctgcgaaatttggcttggtagtgagtacccttag

SEQ ID NO: 191590 - DNA, 903 bp, Artificial Sequence
  Description of Artificial Sequence: Synthetic coding sequence
atggccaactgcgagttcagccccgtgagcggcgacaagccctgctgccggctgagtaggcgcgctcagctctgcctgggtgtctccattctcgtgttgattctagtggtcgtccttgctgtagttgtccccagatggcgtcaacagtggtcggggcccggaacgactaaacgctttcctgagacggtcctggcccgttgcgtcaaatacacagagatccaccccgagatgcgtcacgtggattgccagtcagtttgggatgcctttaagggggcatttatctctaagcacccgtgtaatattactgaggaggactaccagcccctgatgaaactaggcactcagacagtcccttgtaataagatactgctgtggtccagaataaaggatttagctcatcagtttactcaggttcagcgggacatgtttacgctggaggatacgttattggggtacctggccgacgacctgacgtggtgcggagaattcaatacatccaagatcaattaccagagctgtcccgattggcgcaaggactgttcaaataacccagtttccgttttctggaagactgtctccaggcgtttcgcggaagctgcatgcgacgtggtgcacgtgatgctgaatggttcccggtctaaaatcttcgataagaattcaaccttcgggtccgtggaagtccacaacctccagccagagaaagtccagacattggaggcatgggttatccacggcgggagagaggacagccgggacctgtgtcaggaccccacaataaaggaactggagagcatcatcagtaaaaggaacattcaattctcatgtaaaaatatctataggcccgataagtttctgcagtgcgtaaaaaatcctgaagactcgtcgtgcaccagcgagatctag

SEQ ID NO: 191591 - DNA, 942 bp, Artificial Sequence
  Description of Artificial Sequence: Synthetic coding sequence
atgaaccagctgagcttcctgctgttcctgatcgccaccacccggggctggagcacggatgaagctaacacttacttcaaggaatggacatgctccagttccccctctcttccaagaagttgcaaggaaatcaaagatgagtgtccctcagcctttgacggactgtacttcctccggacagagaatggcgtgatctaccagaccttttgcgatatgacttcaggcggaggcgggtggactttggtggccagcgtgcatgaaaacgacatgcgcggcaaatgtaccgtcggggaccgctggtcctcacaacagggaagcaaggccgtctatcctgaaggcgacgggaattgggcaaattataacacctttgggagtgcagaagcagcgacaagcgatgactacaagaaccccggatattacgacatccaggccaaggacctgggtatctggcatgtgccgaacaaatctcctatgcaacactggagaaattcctctcttctccgatataggacagataccggatttttgcaaacactgggacacaatcttttcggcatttatcagaagtacccggtaaagtacggggaaggaaagtgctggactgacaacggtcctgtaattcctgttgtgtacgattttggcgacgcccagaagaccgcttcttactacagcccttacggccaaagggaatttacggccggctttgtgcagttccgggtgttcaataatgagcgggcagctaacgcactttgcgcaggaatgcgagtgaccggatgcaacaccgaacaccattgcatcggaggaggtggatacttcccagaggctagcccgcagcagtgtggagactttagcggatttgattggagcggttacgggacacacgtgggctacagttcttctcgggagattacagaagccgcagtactgctcttttacagatag

SEQ ID NO: 191592 - DNA, 978 bp, Artificial Sequence
  Description of Artificial Sequence: Synthetic coding sequence
atgctgagcatgctgcggaccatgacccggctgtgcttcctgctgttcttctctgttgctaccagcggttgctccgccgccgcagcttccagcctcgagatgctcagtcgggagttcgagacctgtgctttctctttcagttccctccccagatcctgcaaggagatcaaagagagatgtcattcagccggagatggcctgtattttttgcggaccaaaaacggagtcgtgtaccagacgttctgtgacatgacttctggaggcggcggctggacgctggtggcatctgttcatgagaatgacatgaggggaaagtgcactgtaggggaccgctggtctagtcagcaggggaataaggccgattatccagagggtgatggtaactgggctaactataatacatttgggtcagctgaggctgccacgagtgatgattataaaaacccaggatactatgacattcaagccaaggacttgggaatctggcacgtcccaaacaagagccctatgcagcactggagaaactctgctttactgcgttaccggactaatactggttttttgcagcgcctgggacacaacttgtttggcatctatcagaagtaccctgtgaagtaccgcagtggtaagtgttggaacgataacggtcctgccatacccgtggtgtatgacttcggagacgcaaaaaagactgcttcatactatagtccttacggacaacgggagttcgtggctggatttgtacagttcagggtgtttaataacgaaagggcagctaatgctctatgcgctggcattaaggttaccggatgcaatacagagcaccactgtatcggcgggggagggtttttccctcaggggaaaccacgtcagtgcggggattttagcgcatttgattgggatggatatggaacccacgtgaaatcctcttgctccagagaaattacagaagccgctgttctgttgttctatcggtag

SEQ ID NO: 191593 - DNA, 2736 bp, Artificial Sequence
  Description of Artificial Sequence: Synthetic coding sequence
atggacggcgccatgggcccccggggcctgctgctgtgcatgtacttggtcagcctgctgatattgcaggccatgccagccctgggaagcgctacaggcaggtcgaagagcagtgaaaagcgacaggccgtcgacaccgccgtagatggagtgtttattagatccttgaaggtcaattgtaaagtgacaagcagattcgcccactacgtggtcacttcacaagtggtgaatacagcgaacgaagccagggaggtggcatttgacctggaaatacctaaaactgcattcataagcgattttgctgtgactgcggacgggaatgctttcatcggcgacataaaagacaaagtgaccgcctggaagcagtatcggaaggccgccatcagcggtgagaatgcaggcctcgtaagggccagtggtaggactatggagcagttcaccatccaccttactgtcaaccctcaatccaaggtgacatttcagctaacttacgaagaagtcctgaaaagaaaccacatgcagtatgaaatagtgattaaagttaagcctaaacagttggtccaccacttcgagatcgacgtcgatatattcgaaccccagggaatttcgaaactagacgcacaggcctcctttctaccaaaggagctcgctgcgcaaactattaagaagtccttttccggtaaaaaaggtcatgtgctgtttaggcctacagtttctcagcagcagtcgtgcccaacatgctccaccagcctgcttaatgggcattttaaggttacgtatgatgtgagtcgcgataagatctgcgatcttttggtcgcaaacaaccacttcgctcatttttttgctcctcagaatctgacaaatatgaataagaacgtcgtattcgtcatagatatctctggatcaatgcgcggccagaaagtcaaacaaaccaaagaagcactgctgaaaatcctgggcgacatgcagccaggcgactacttcgatctggtacttttcggaacccgggttcaatcttggaagggatccctggtgcaggctagcgaagcgaacctgcaggcagcacaggattttgtgcggggattttccctggacgaggctactaacctcaacggaggtctgttgcgcggaatcgagatactcaatcaggtgcaagaatcacttccagagctgagcaaccacgccagcatcctgattatgttgaccgacggcgaccctaccgagggcgtgaccgaccggagccaaatactgaagaacgtacgcaatgctatccgcgggcgatttcccctttataaccttggttttggacacaacgtcgacttcaacttcttggaagtcatgagcatggagaataatgggcgggcgcaacgaatctatgaggatcatgacgccacacagcagctgcagggattctattctcaggtcgccaaacccctcctggtcgatgtcgacctgcaatatccccaagacgctgtgctggcactgactcaaaaccaccataaacagtactatgagggatcggaaattgtagtggccggtagaatcgcggacaataagcagtcatctttcaaggctgacgtgcaggcacacggtgaagggcaggagttttcgattacatgccttgtggatgaggaagagatgaaaaagctgctgcgcgaaagaggccacatgctggagaaccatgtcgagagactgtgggcttacctcaccatccaggagctgctagccaaacggatgaaagtggacagggaggaacgggcgaatctcagtagtcaggccctgcaaatgtccctggactacggattcgtgactcctctgacttcaatgtccataaggggaatggctgatcaggacggactgaaacctacaattgacaagccatccgaggatagccccccactcgaaatgttgggacccagacgcaccttcgtcctgtcagcgctgcagccttcgcccacacactcatccagtaacacccagaggcttcctgaccgtgtgaccggcgtggacacagaccctcacttcattatccatgtaccccagaaggaagacacactgtgcttcaatataaatgaagaaccaggggttatactgagtctggtgcaggatcctaataccggattctccgtaaacggacagttgataggaaacaaagcccgctcacccggccagcacgacggcacgtattttggccgtctcggaattgccaatccagccaccgatttccagctcgaagtgacaccccagaatataacattaaatccaggattcggcggaccagtcttctcctggagggatcaagcagttcttcgacaggatggagtggtcgttacaattaataagaaacgtaacctggtggtgtcagtggatgatggtggtacattcgaagtcgtcctccaccgtgtctggaaagggtccagcgtccatcaggatttcctgggcttctacgtacttgacagccatcgaatgagtgcccggacccacggactgttgggtcaattctttcaccccatcgggtttgaggtgtccgacatacatcccggttccgacccaaccaagccagacgccaccatggtggtcaggaacaggcgcctaacagtgactcgcgggcttcagaaagattactccaaggatccttggcatggagccgaggtcagctgttggtttatccataacaacggagcgggactcatcgacggtgcatataccgactacatcgttccagatatattctag

SEQ ID NO: 191594 - DNA, 1872 bp, Artificial Sequence
  Description of Artificial Sequence: Synthetic coding sequence
atgaacaagaacgtggtgttcgtgatcgacatcagcggcagcatgagaggtcagaaggtcaaacagacaaaggaagctctgctgaagatcttgggcgatatgcagcctggagactacttcgacctggtcttattcgggaccagggtgcagagctggaagggatccctcgtgcaagccagcgaggcaaacctgcaggccgcacaagactttgtacgcgggttctccctggacgaggccaccaatcttaatggggggctgctccgcggaattgagatcctgaatcaggtgcaggaatcactcccggagctgtctaatcacgcttcaatcctgataatgctgactgatggcgatccgacagaaggcgtcaccgatagatcccaaatactgaaaaacgtgaggaacgctatccggggtaggttccccctgtacaatttaggattcggacataacgtggacttcaactttcttgaggtgatgtccatggagaacaacggacgggctcaaagaatttatgaagatcatgatgcaacccaacaattgcaaggtttttatagccaggtggccaagcctctgctcgtggacgtcgatctccagtatcctcaggacgcggtcctggcactcacgcaaaaccatcacaagcaatactatgaggggtccgaaattgtggtggctggccggatagctgacaacaaacagtcctcatttaaagctgacgttcaggctcatggggagggacaagaattttccattacctgcctcgtcgatgaggaggaaatgaagaaattgcttagggaacggggacacatgctggagaatcatgtagagaggctgtgggcttacctaactattcaggagctgctggccaaaaggatgaaggttgaccgcgaggagagggcgaatcttagtagccaggccttacaaatgtcactggattatgggtttgtcactcctctcacctcgatgagtattcgagggatggcagatcaggatgggcttaaacccactattgataagcccagcgaagactccccacccctcgagatgttgggcccccgcaggacttttgtactttccgctctgcaaccgtcaccaacacattcttccagcaatacccagaggttgcccgaccgtgtgacgggtgttgacacagacccccacttcattattcatgtgccccagaaggaagacactctgtgtttcaacatcaacgaagagccaggggtcatcctttctttggtccaagatcccaatactggcttttcagtgaatggccagcttattgggaataaagcaagatcacctggacagcacgatgggacttacttcggacgcctcggaatcgctaatcccgccactgacttccaacttgaagtcaccccccagaatattactcttaatcctggttttgggggcccagtgttctcctggagggatcaggctgtgctgagacaggacggagttgtggttaccatcaacaaaaaacggaacctggtagtctctgtagatgatggaggaacatttgaagttgtgctccaccgcgtttggaaagggtcctctgtgcaccaagactttctcggattctatgttctggactcgcatagaatgtcagcccggacacacggcttgctggggcaattctttcaccctattggcttcgaagtgagcgacatccaccccggtagcgaccctacaaagcccgatgccaccatggtggttagaaaccgaagacttacagttactagaggcttacagaaagattactccaaggacccctggcacggtgccgaggtgagctgttggttcatccataacaatggggccgggttaatagacggcgcctacactgattatatagtgcccgatattttttag

SEQ ID NO: 191595 - DNA, 2310 bp, Artificial Sequence
  Description of Artificial Sequence: Synthetic coding sequence
atggagcagttcaccatccacctgaccgtgaacccccagagcaaggtcacgtttcagttgacctacgaagaggtgctcaaaaggaatcacatgcagtacgaaattgtgatcaaggttaaacctaaacagctagtgcaccacttcgagattgacgtggacatctttgagccccaggggatttccaagttggacgcgcaagcctcattcctcccaaaggagctagctgcccagacaataaagaaaagtttttccgggaagaaaggccacgtgctgtttcggcccaccgtatctcagcagcagtcatgccccacatgctcaaccagcttgctgaatggacacttcaaggttacctatgatgtcagtcgagataagatttgtgatctgctggttgccaataatcacttcgcccactttttcgcccctcagaatctgacaaatatgaataagaacgtggtgttcgtcatagacatttccgggagcatgaggggccagaaagtgaaacaaaccaaagaggcgttgctgaaaattctgggggacatgcaacccggcgactatttcgacctggtgctcttcggaacaagggttcagtcctggaaaggttctcttgtccaggcaagcgaggctaacctgcaagcagcgcaagacttcgtgcggggttttagtctagacgaggccacaaatttaaacggaggcctgctgaggggaatcgagattttgaaccaggtccaggaatcactccctgaactgtctaaccatgcctcgatacttataatgctaactgatggggaccccactgaaggagtaacagatagaagtcagatcctaaagaacgttcgtaatgctattcgcggaaggtttccactttataacttggggttcgggcacaatgtcgacttcaatttcctggaggttatgtcaatggaaaataacggaagggcccaaagaatttacgaagatcacgatgctacccagcagctgcaaggattttactcccaggttgcaaaacccctcttggtggatgttgatctgcagtatcctcaggatgcagtattggccttaacccagaatcaccataagcagtattacgagggatcggagatcgtagtggccggccgcatcgcagataacaaacaatccagttttaaggcggacgtccaggcacacggagagggtcaggaattcagcataacgtgtctcgtggacgaagaggagatgaagaagttgctgcgggaaagaggtcatatgctggagaaccacgtagaacgactttgggcttacctgacaatccaggaactgctggccaaacgaatgaaggtcgaccgcgaggagcgtgcaaacttgagcagccaagccctgcaaatgtccctcgactacggattcgtgacccctttaacgtcaatgtctatcagaggcatggctgatcaggatgggctcaagcccactatcgataaaccctccgaggattctcctcccttggagatgctcggccctcgccgcaccttcgtgctttcagctctgcagccaagtccaacccactcttctagcaacacccagaggctgcccgatcgtgtgacaggagtggacacggatcctcattttatcattcacgtaccacagaaggaggacaccttgtgtttcaatattaatgaagaacctggggtgatactgagcttggtgcaagatccaaatactggattttctgtgaatggacaattgatcgggaataaggctagatcccctggacaacacgatggaacctacttcggccggctgggcattgctaatccggccacagattttcaacttgaggtcaccccacagaacattaccctgaatcctggctttggcgggccagtgttcagctggcgcgaccaggccgtcctgcgacaggatggagtagtcgtcacaattaataaaaagagaaatctggtcgtctcggtggacgatgggggcacctttgaggtcgtgctgcaccgcgtgtggaaaggctcttcagtgcatcaagatttcttgggtttttacgttctggacagccatcgcatgagcgctagaacgcacggactgttggggcagttttttcaccccattggcttcgaagtttcagatatccacccgggtagcgaccccaccaaaccagatgccaccatggttgtgaggaatcgaagacttacagttaccaggggcctgcagaaggactactcaaaagatccgtggcatggtgcagaggtctcttgctggttcatccataataatggtgccggccttatagacggtgcctatacggactatattgtgcccgacatcttctag

SEQ ID NO: 191596 - DNA, 1938 bp, Artificial Sequence
  Description of Artificial Sequence: Synthetic coding sequence
atggacggcgccatgggcccccggggcctgctgctgtgcatgtacctggttagtctgctgatcttgcaagcaatgcccgccctagggtccgccacaggccggagcaaatcgtcggagaagcggcaggcagtggacacggcggtggatggggtatttatacgcagcctgaaggtcaactgtaaagtgacgtccaggttcgctcattatgtggtaacgtctcaggtcgttaacacagctaacgaggcccgcgaggtcgctttcgacctggagattcctaagactgcctttatctctgacttcgccgtgacagctgatggaaacgcttttatcggggatatcaaagacaaagtcacagcctggaaacagtataggaaggccgccatatctggagagaacgctggactagtgagggcatctggtcgtacaatggagcagttcactattcacctgacggtgaatcctcagtcgaaggtcacctttcagttgacatacgaggaggttttgaagcgcaaccatatgcagtatgagatcgttataaaagtgaagcccaagcagctggtgcaccatttcgaaatagacgtagatatctttgaaccccaaggaatctctaaactggacgctcaagcatcgttcctgcccaaggaactggccgctcagaccatcaagaaatcctttagtggtaagaagggccatgtgctttttcggcctacagtgtctcagcagcagagctgtccaacttgttccaccagcctgctcaacggccacttcaaggttacttacgatgtctctagagataaaatatgtgaccttctggttgctaacaaccactttgcccatttcttcgcacctcagaacctcaccaatatgaacaaaaatgtggtgttcgtgatcgacataagtggttctatgagaggccagaaggtcaaacagacgaaggaagctctccttaagatactgggggatatgcagcccggggactactttgatctcgtactgtttggtacgcgcgtgcagtcatggaaggggtcattggtgcaggctagcgaggctaacctgcaggccgctcaagactttgttcgcggattctctctggacgaggccacaaacctcaacggcgggcttctaaggggcatcgaaatcttgaatcaggttcaggaatcacttcccgagttgtcaaaccatgccagcatactgatcatgctcacagatggagatcccacggagggagttacggataggtcccagattcttaagaacgtacggaacgccatccgtggaaggttcccactgtacaatctaggatttggccacaatgtcgatttcaatttcctggaggtcatgtccatggaaaataatggccgggcacagaggatctacgaggatcacgatgctactcaacagttgcagggattctactcccaggtggctaagcctctgttggtggacgtggacctacagtatcctcaggatgcggtgctcgcactgactcagaatcaccacaaacagtactatgaggggagcgagatcgttgttgccggcagaatcgccgataataagcagagctcgtttaaagctgacgttcaggcgcatggcgagggtcaagaattttctataacctgcttggtcgacgaggaggagatgaaaaaattgcttcgagaaagggggcacatgttggagaaccacgtcgagcggctttgggcttacctcactatacaggagctacttgcaaaacggatgaaagtggacagggaggaacgtgctaatctttccagccaggcactgcagatgagcctggactatggctttgttacaccattaacctccatgagcattcgagggatggccgatcaggatggcctcaagccaaccattgacaagccaagtctgcatcacccacgagcccccgagcggggccacccagtcctacaacaccagtag

SEQ ID NO: 191597 - DNA, 2841 bp, Artificial Sequence
  Description of Artificial Sequence: Synthetic coding sequence
atgaagcggctgacctgcttcttcatctgcttcttcctgagcgaggtgagtgggtttgagatccccattaatgggctttcagaatttgtggattacgaggatttagtagagctcgccccaggcaagttccaactggtcgccgagaaccgcaggtaccaacgctctctaccaggggagtccgaggaaatgatggaggaggtggatcaggttactctttattcctataaagttcaaagcacaattaccagccgcatggccaccacaatgatccagagcaaggtggtcaacaactctcctcagcctcagaatgtggtattcgacgtgcaaatacccaagggcgctttcattagcaatttcagcatgactgtcgacggaaagacattcaggagtagcattaaagaaaaaactgtaggccgagccctttatgctcaggctcgcgccaagggaaaaaccgccggactggtgcgatcatcagctctagatatggaaaatttccgcactgaggtcaacgtacttccaggcgccaaagtgcagtttgagctgcattatcaggaagttaaatggcgcaaacttgggagctacgaacaccgtatctatctgcagcctggcagattagcaaagcacttggaagtggacgtgtgggtgatagagccccaaggtctgcgattcttacacgtgccagacacgttcgaaggacacttcgacggagtgccggttataagcaaagggcagcagaaagcacatgtaagtttcaagccaactgtcgcccaacagaggatctgcccgaattgcagggagaccgcagtcgacggagagctagtagtcctctatgacgtgaaacgagaagaaaaggccggtgagttagaggtgtttaatgggtacttcgtgcactttttcgcccccgataacttagaccccatccctaaaaacatcctgttcgtcattgatgtctccgggtctatgtggggtgtgaaaatgaagcagacagtagaagctatgaagaccatccttgacgatttaagagctgaagaccacttcagcgtaatcgattttaaccagaatatccggacgtggagaaacgacctcatctcagccacaaaaacccaagtcgctgacgctaagaggtatatcgaaaagatacaaccttccggcggtaccaacatcaacgaggcactcctgcgtgctatctttatcctcaacgaggctaataacctgggccttttagatccaaacagtgtgagtctgataatccttgttagtgatggcgaccctaccgtcggagaacttaaactgtcaaagattcagaagaatgtgaaagaaaacattcaggacaacatctctctgttttctttgggtatggggtttgatgtggactacgacttcctcaaacgcctttccaatgagaaccatggcatcgcccagcgaatctacgggaatcaagacacctcttcccaactgaaaaaattctataaccaagtaagcaccccactgctgaggaatgtgcaatttaattacccacatacaagcgtcacagatgtgacccagaataactttcacaattactttggcggttctgaaatcgtggtggctggaaaattcgatcctgccaagctggaccaaattgaatccgttatcacagctactagcgcaaacactcaacttgttctggagaccctggctcaaatggacgacctgcaggattttctctccaaggacaagcatgctgatcccgacttcactcggaagctgtgggcatatctcactatcaatcagctgcttgcagagcgaagcctcgccccaacggccgcggcaaagcggcggataaccagatctatccttcagatgagcttggaccaccatatcgtaaccccacttacgtctcttgttattgagaatgaggcgggagacgagagaatgttagccgacgcaccccctcaggacccatcttgctgcagtggggccctatattatggttcaaaggtggtgccagactcaacaccttcctgggccaatccatcccccacgccagtaataagcatgctagcacagggatcccaggtgcttgagagcacccccccaccacacgttatgcgagtggagaacgatccacattttatcatttatcttcccaagtcccagaagaacatatgttttaacatcgactctgaacccggtaagatactcaaccttgtcagcgatcccgagtccggcatcgtcgtgaacggccagctggtgggcgccaagaaaccaaacaacgggaaactttcgacctacttcggcaagctgggcttttacttccagagcgaggatattaaaattgagatttccaccgagacaattactctgagtcacgggagttcaacattcagcctcagctggagcgatacagctcaagtaactaaccagcgcgtccagatttccgtgaagaaggaaaaggttgtcactataaccctggacaaagagatgtcattttctgttctcctgcatagagtatggaagaaacaccctgtgaatgtagacttcctgggcatctacatcccaccaactaataaattctctcccaaagcacatgggctgattggccagtttatgcaggagcccaaaatccatatctttaacgagcggccagggaaagaccctgagaaacctgaggctagcatggaagtgaagggacaaaagctcatcataacccgcggactgcagaaagactatcggacagacctggtctttggcacggacgtgacttgttggtttgttcacaactcgggcaagggcttcatagatggacactataaagactactttgtccctcagctttactccttcttgaaaaggccctag

SEQ ID NO: 191598 - DNA, 2658 bp, Artificial Sequence
  Description of Artificial Sequence: Synthetic coding sequence
atggtggccctgagccacctgggcagcgccctgcagctgggcagcctgttccccagaagcccctttagactgctgggaaagcggagcctgcccgagggagtggccaacggcatagaagtgtactcaacaaagatcaattcaaaagtgacctctaggttcgcccataatgttgttaccatgagagccgtgaaccgcgctgacaccgccaaggaggtctcgttcgatgtggaactcccgaagaccgccttcataactaactttaccctgaccattgatggcgtgacatatcctggaaatgttaaggagaaggaagttgcaaagaaacagtacgaaaaggcagtgtcccaggggaagaccgcagggcttgtgaaagcgagcggccgcaagttggaaaaattcactgtttccgtgaacgtggctgctggtagcaaagtgaccttcgaactgacatatgaagagcttttgaagcggcacaagggcaaatacgagatgtatctcaaagttcaaccaaagcagctcgtgaaacactttgagatcgaagtagatatatttgaaccacagggtatttctatgctcgatgcagaagcgagctttatcaccaatgacctgctgggttcggcccttacgaaaagtttttcaggtaagaagggtcacgtgtctttcaaaccttccctggatcaacaacggagttgtcctacgtgtaccgactcgctcctgaatggtgactttacaattacatatgacgttaacagggagtccccagggaatgttcagatcgtgaatggctatttcgtgcatttttttgcacctcaggggttacctgtggttcctaaaaacgtggcgttcgttatcgacatatcgggcagcatggcgggcagaaaacttgagcagaccaaggaggccctgttaaggatacttgaagatatgcaggaggaggactacctgaattttatcctattctctggagacgtctctacttggaaagaacatcttgtacaggcaacgcccgagaacctgcaggaagcaaggacattcgtgaagtcgatggaagacaagggcatgacaaatatcaatgacggactcctgcgggggatcagtatgctgaataaagcacgcgaggaacaccgaataccagagcgatccacatcaattgtcattatgctgacagacggagatgccaacgtaggcgaatccagacctgaaaagatacaagagaacgttcgcaatgcaataggtgggaagtttccactgtacaatctggggtttggcaataatctgaattacaacttcctggagaatatggccctggagaaccatggtttcgccaggcgcatctatgaggactccgacgccgatctgcagctgcagggcttttatgaagaagtggccaacccgttactgaccggtgtcgaaatggaataccccgagaatgccattttggacttaacccagaatacctaccagcatttttatgacggtagcgagatcgtagtagctggccgtctagtggatgaggatatgaattcattcaaagcggatgtgaaaggccacggcgccaccaacgacctaactttcactgaggaagttgacatgaaagaaatggagaaagctctccaggagcgcgactacatttttggcaattacatcgaacgtttatgggcttatttaacaattgagcaattgctggagaaacgcaaaaacgcacatggggaggaaaaggagaacctcaccgctagagccttggacctgtcactcaagtaccattttgtaaccccactgactagcatggtcgttaccaagcctgaagacaacgaagatgaacgtgccatagccgacaagccaggcgaggggttttcagccacccccgtttctccggctatgagctacctgacctcctatcagccccctcagaacccgtactactacgtcgacggtgatccacacttcattattcaaatacccgaaaaggacgatgcactgtgtttcaacatcgacgaggcccccggaacagtgctgaggcttatccaggacgcagtcacaggtttgaccgtcaacgggcagatcacgggcgataagcgaggcagccccgatagcaagacccgtaaaacctattttggaaagctcggcattgcgaacgcacagatggattttcaggtggaggtcactacagagaagattaccctgtggaaccgcgccgtgccatccacattctcctggctggataccgtgacagttactcaggatggactgagtatgatgataaataggaaaaatatggttgtctcattcggagacggagtgacatttgttgtagttttgcaccaggtctggaagaaacacccggttcatcgcgactttctaggattttacgtggttgatagccatagaatgtctgcccagacacacggtctgttgggccagtttttccagcctttcgacttcaaggtaagtgacatccgcccgggctcggatccgactaaaccggatgcaaccctggtagtaaagaatcaccagctgatcgtgacccgcgggtcccaaaaagattacagaaaagatgcctcaattggcacgaaagtcgtgtgttggttcgtccataacaacggagaaggactaattgatggggttcatacagattacatagtgcctaaccttttctag

SEQ ID NO: 191599 - DNA, 2013 bp, Artificial Sequence
  Description of Artificial Sequence: Synthetic coding sequence
atggccttcgcctggtggccctgcctgatcctggccctgctgagctctctggccgctagtggtttcccccgctctccttttagactactcgggaaaagaagtctgccggagggcgtggccaatggcattgaggtgtacagtactaagattaattccaaggttacatccagatttgcccacaacgtggtgaccatgcgtgcggtcaaccgtgcagatacggccaaggaagtctctttcgatgtggaactccctaaaacagccttcatcaccaattttacgttaaccattgacggtgttacctaccccggaaacgttaaggagaaagaggtcgcaaagaagcaatatgaaaaggccgtctcccagggtaagaccgccgggctggtgaaggcatcaggaaggaaactcgagaagtttacagtgagtgttaacgtggcagctggcagcaaggtgacatttgaactgacatacgaggagcttctcaaaaggcataagggcaagtacgaaatgtatttgaaagtgcagccaaagcagctcgtgaaacatttcgagattgaagtggatatcttcgaacctcaggggatatcgatgctcgacgctgaggccagttttatcacaaacgatctcttgggctctgcgctaaccaagagcttcagcggcaagaaggggcacgtctccttcaagccaagtctggatcagcaaagatcttgccccacttgcaccgactccctccttaacggcgatttcacgattacctatgacgtaaacagggaatctccaggcaacgttcaaatcgtgaatggatactttgtccacttctttgctccccagggcttgccagtagtgccaaagaacgttgcttttgtcatcgatatcagcggttcgatggccggtcggaagctggagcaaactaaagaggccctgctacgcattctggaagatatgcaggaagaagattacctcaactttatcctattctcgggcgacgtatctacgtggaaggagcacctggtgcaggcgactccagaaaacctgcaggaagcgagaacctttgtgaagtccatggaagacaaagggatgaccaacatcaacgatggactcctccgtggcatcagtatgctcaataaggctagggaggagcaccggattcccgagcgaagcacgtctatagtgatcatgctgaccgacggtgacgcaaacgtgggtgagagccgccctgagaaaattcaagagaacgtccgtaatgccatcggtggcaaattccccctgtacaatctgggatttggcaataacctgaactacaacttcttggagaacatggctctggaaaaccatggttttgcccgcaggatttacgaggacagcgatgcagaccttcaactgcaagggttttacgaggaggtggccaacccactgctgaccggagtcgagatggaataccccgagaacgcaattttggatcttacacaaaatacttatcagcatttttacgacgggtccgagattgtcgtcgcgggcaggctggtcgacgaggatatgaactctttcaaggctgacgtgaagggacatggcgcaactaacgatttgacgttcacggaggaagtggatatgaaggaaatggaaaaagctttgcaggagagagattatatctttggaaactacatcgagagattgtgggcttatctcacaatagaacagttgctggagaagaggaagaatgcacatggggaggagaaagagaacttaactgcccgcgccttggacctcagccttaagtatcattttgtgactccacttactagcatggtggtgaccaagcctgaagataatgaagacgagcgggcaatagctgataagccaggcgaagggggtgacagtcacactggcgaacctagacacgtcctgcccgaccagctccccgcttcctcaaaaccactcttgttgtgcggacgcggctcacccctccatcaccctaacagtggggagaggcggtgtccactccttcagcaccgctag

SEQ ID NO: 191600 - DNA, 2673 bp, Artificial Sequence
  Description of Artificial Sequence: Synthetic coding sequence
atggccttcgcctggtggccctgcctgatcctggccctgctgagctccctggccgcgtcagggttccctcggtctccattccgcctgctggggaagcgctcattaccggagggggtggctaacggaattgaggtttattctacgaagattaacagcaaggtaacgagtcgctttgcacataacgtcgtcacaatgcgcgccgtgaatcgagcggacaccgctaaggaggtgtctttcgacgtggagctgccaaagacagccttcatcaccaattttacactgacaatcgatggagtcacctaccccggcaacgtcaaggaaaaggaggttgcaaaaaagcagtacgaaaaagctgtgtcgcagggaaagaccgccggtctggtgaaggcaagcggtagaaagttggagaaattcacagtctcagtcaacgttgccgctgggagcaaagttacatttgagctgacttatgaagaactgctcaagcggcacaagggaaaatatgagatgtacctaaaggtccagcccaaacagttagtgaagcacttcgaaatcgaagtcgacatcttcgagcctcagggcatctctatgctggatgcggaggcctcatttattacaaacgatcttctgggctcagctcttacaaaaagcttttccggaaagaagggccacgtgagcttcaaaccctcacttgatcagcaaagatcgtgccccacatgtaccgattcacttctgaacggagattttacaatcacctatgacgtcaatcgggagagtccaggtaatgtccagattgtgaatggctactttgtgcatttctttgctccccaaggactccccgtcgtgcctaaaaacgtggcattcgtgattgacattagtggtagcatggcaggccggaaattagaacagaccaaagaggctctcctcagaattctggaggatatgcaggaggaggattatctgaatttcattcttttttccggggatgtctctacctggaaagagcacctcgttcaagccacgcctgagaatctacaagaagctcgaacgtttgtgaagagcatggaggacaaaggaatgacaaatatcaacgacggccttcttcgtggcattagtatgctgaataaagcgcgcgaggagcacaggattcctgagcggtccacttcaattgtgattatgctgacggacggcgacgcgaacgtaggcgaatccagacccgaaaaaatacaagaaaatgtgcgcaacgcgatcggaggcaaatttcccttgtataatctgggctttggcaataacttaaactataatttccttgagaacatggccctggagaatcacggattcgctcggcggatctatgaggacagcgacgctgacctgcagctgcaagggttttatgaagaggtagcaaatcctctcttgaccggtgtcgagatggagtacccagagaacgcgatccttgacctcactcagaatacttaccagcacttctatgacggaagcgagatcgtggtggctggacgtttagttgatgaggatatgaactccttcaaagctgatgtcaaggggcatggtgccacaaacgacctgacctttacggaggaggttgatatgaaagaaatggagaaggctcttcaggaaagggactatatcttcgggaactatatcgagagactgtgggcatatctaaccatagaacaactgctcgaaaagaggaagaatgcacatggcgaagagaaggagaatcttacagctcgcgccctagacctctctttgaaataccactttgtgactccactgactagtatggtggtgaccaaaccagaggataatgaggatgaacgggcaatagctgataagcctggggaggacgcagaagccaccccagtaagccctgcaatgtcctatcttaccagctatcagcccccccaaaatccgtactattacgtggacggcgatccccactttattatacagattccagagaaagacgatgcgctgtgtttcaacatcgacgaggcccccggaaccgtattgcgactcatccaagatgcagtgactggtttgacggtgaatgggcaaattactggtgacaagcgcgggtcacccgactctaaaacgcggaagacttactttggtaagctagggattgccaacgcacagatggatttccaggtggaagtcactaccgagaagatcacattgtggaacagggccgttcctagcacctttagttggctggatactgtcactgtgactcaggacgggctgagtatgatgattaatagaaagaacatggtggtgagtttcggcgatggggtaactttcgtagtggtgctgcaccaagtatggaagaaacatcctgtgcacagagattttctaggcttctacgttgttgacagccacagaatgtccgctcagactcacgggcttctcgggcagttcttccagcctttcgacttcaaggtgagcgacatccgccccggctcagaccccaccaaaccagacgctacgctcgtcgtcaaaaatcaccagttaattgtaacgaggggatcacagaaggattaccggaaggacgcctcaatcggcaccaaagtagtgtgctggttcgtgcacaacaacggagaggggttgatagacggggtccatactgattacatagttcctaacctgttttag

SEQ ID NO: 191601 - DNA, 1977 bp, Artificial Sequence
  Description of Artificial Sequence: Synthetic coding sequence
atggccttcgcctggtggccctgcctgatcctggccctgctgagctcgttggcagcatcgggcttccctcgctcaccgtttcgacttttaggtaagcgttccttaccagagggcgtagcgaacgggattgaggtgtactctacaaagatcaactcaaaagtaacaagtaggttcgcccataatgttgttaccatgagagcagtgaaccgggctgatacagctaaggaggtatcattcgatgtggaactcccaaagaccgcctttattacaaattttactctcactatcgacggagttacataccccgggaatgtaaaagagaaggaagtggctaaaaaacagtatgagaaggctgtgagccaaggtaagacggcaggcctggtcaaggccagcggccggaaactggagaagttcactgtttccgtcaacgtggcagccggatccaagcgccacaaagggaaatacgagatgtacctgaaagtccagccaaagcagctggtgaagcactttgagattgaggtcgacatctttgagccccagggcatctctatgttagatgcagaggcctccttcatcaccaatgaccttctgggaagcgccctgacgaaaagtttctccgggaaaaaaggacacgtctcctttaagcccagcctcgaccagcagcgttcatgcccgacatgtacagactccctccttaatggtgatttcacgatcacttacgacgtgaacagagagagtcccggaaatgtgcagatcgttaacggctactttgtgcacttcttcgcccctcaaggcctgccagtggtccctaaaaatgtcgcttttgttatcgatatcagcggtagtatggcggggcggaaactcgagcagaccaaggaagccttgctgcgaatcctggaagatatgcaggaggaagattatctgaactttattctgttttccggcgacgtgtcaacctggaaggagcatcttgtacaggctacaccagagaacttacaggaggccagaacctttgtgaagtcgatggaggataagggcatgaccaatattaacgacggtctgctccgaggaatctccatgctgaacaaggcaagggaggagcataggattcccgaacggtccacctctatcgtcatcatgttgactgatggagacgcgaacgttggcgagtcacgtcctgagaaaatccaggagaacgtgcgcaatgcaatcggcggcaagttccccttgtacaatctggggtttggcaacaacctgaattacaatttcctcgagaacatggcactggaaaaccacggcttcgcgcggcgtatctatgaagactccgatgccgacctgcagctgcaggggttctacgaagaggtggcaaatccattgttgactggcgtggagatggagtatcccgaaaatgccatcctggacctgacgcagaacacctaccaacacttctatgatggttccgaaatagtggtggctgggcgccttgtagatgaggatatgaatagctttaaagcagacgttaaaggtcatggcgccacaaatgacctgacctttaccgaagaggtagatatgaaggagatggagaaagcactgcaggaacgcgattatattttcggcaattacattgagcgcctgtgggcttacctgactattgagcagctcttggaaaaacgcaagaacgctcacggggaggagaaggagaaccttactgctagagcacttgatttaagtttaaagtaccacttcgttacacccttgaccagcatggttgtgaccaagcccgaggacaacgaggacgagcgggccatcgcagacaagcccggagaggggggagatagccatactggcgagccacgccatgtcctgcccgaccagttaccagcctcctccaagccacttcttctttgtggcagaggttccccactccatcaccccaattccggcgagcgcagatgccctctgcttcaacaccggtag

SEQ ID NO: 191602 - DNA, 2793 bp, Artificial Sequence
  Description of Artificial Sequence: Synthetic coding sequence
atgaagcccccccggcccgtgcggacctgcagcaaggtgctggtgctgctgagccttctggcaatacatcagaccacaactgccgagaagaatgggatagatatttacagccttacagtggactcacgtgtgagctcccgcttcgctcacaccgtggtcacctcacgggtggtgaaccgggctaatacagtacaggaggccaccttccaaatggaacttcctaaaaaggcatttattacgaacttctcgatgattattgacggcatgacttatcccggaattattaaggaaaaggctgaagcccaggcgcagtattccgctgcggtggccaagggaaaaagcgcggggctggttaaagcaactgggaggaacatggagcagttccaggttagcgtctccgtcgcgccgaacgctaagataacctttgagttggtatacgaagaactgctgaaacgccgcctcggggtctacgaattgctgttgaaggttcggccacagcagctggttaagcacctgcaaatggatatccacatttttgagccgcagggtatcagttttctggagaccgagtctacatttatgaccaaccaacttgttgatgctttaacaacttggcaaaataaaaccaaggcccatatccggtttaagccgaccctctcacagcagcagaagagtccagaacagcaggaaacagttctcgacggcaacttgatcatcaggtacgatgttgatcgtgcgatttcgggtgggtctattcaaatagaaaacggatatttcgtgcactatttcgcacctgagggccttactaccatgcccaagaacgtggtgttcgtcatagataagtctggctcaatgagtggccgcaagatccagcagaccagggaagcattaatcaaaattctggatgatctttctccgcgagatcagttcaatcttatcgttttttctacggaagcgacccagtggagaccaagtctagtcccagcaagcgcagagaatgtaaataaagccagatcttttgcggctggtattcaagctttaggggggactaatattaacgatgcgatgctgatggccgtacagctcttagatagttcgaaccaggaagaaagactgccagagggctctgtttccctcatcattctgttaaccgacggcgaccccaccgtgggcgaaacaaaccctcgttccatccaaaataacgtgcgtgaagctgtgagcggtcgatacagccttttttgtctcgggtttggtttcgatgtgtcttacgcctttctggaaaaactagcactcgataacggcggcttggcccgaaggatacacgaagatagtgactctgctttacagctccaagacttctaccaagaggtggccaatccattactgactgctgtgaccttcgagtaccctagcaacgctgttgaggaggtgactcagaataatttcagattacttttcaaaggatctgaaatggtggtcgctggaaaactgcaggacagaggtcctgacgtcctcaccgctacggtttcaggcaaactgcccacccaaaacattacattccagactgaaagcagcgtcgccgaacaagaggctgagttccagtcacccaagtacatattccacaatttcatggaaaggctgtgggcctatttgacgattcagcaactcctcgaacaaacggtaagcgctagcgatgctgaccagcaggccctgcgaaatcaggctttaaatttgagcttggcgtactcattcgtcactcccttgaccagcatggtcgttaccaaacctgacgatcaagaacagtctcaagtggcagagaaacctatggagggcgagagcagaaatcgaaatgtgcattccggtagtacttttttcaagtactaccttcagggggctaagatcccaaagccggaagcctccttttcacctaggagggggtggaatagacaggctggcgcagctggatcacgaatgaattttaggccgggcgttctaagcagccggcagctaggacttcccggcccacccgacgtaccagaccacgcagcataccacccctttcgacgcctggcaattctaccagccagcgctcctcccgccacttccaatccagacccggcagtatctcgagttatgaatatgaaaatagaggaaaccaccatgaccacccaaacgccggctccaatacaggcgccaagtgctattctgcctctacctggccaatctgtggagcgtctttgcgttgaccccaggcacagacaaggaccggtgaatttgcttagtgatccagagcagggtgttgaagtcacaggccagtacgagcgagaaaaggccggattctcgtggatagaagtcacattcaagaaccctctagtgtgggttcatgcgagtccggaacatgtcgtggtaaccaggaacaggaggagctccgcatacaaatggaaagaaaccctgttctctgtcatgccaggcctaaagatgacaatggacaagactggattactattgttgagcgaccctgataaagtgaccattggcttactattctgggacggaaggggcgagggattacggctactgcttagggacaccgaccgttttagcagtcacgtgggcggcacacttggccaattttaccaggaagtactgtggggatctccagctgcgagcgacgacggccgacgaactctccgtgtgcagggtaacgatcactccgctacgagggagagacgtctggattaccaggagggccccccaggggtggagatctcttgttggagcgttgaactatag

SEQ ID NO: 191603 - DNA, 2745 bp, Artificial Sequence
  Description of Artificial Sequence: Synthetic coding sequence
atgaagcccccccggcccgtgcggacctgcagcaaggtgctggtgttgctgagcctgctggccatccatcaaacaacaacagctgaaaagaacgggattgacatctattccttgaccgtagatagtagggtatcctcacgtttcgcacataccgttgtcacgagtagggttgtgaaccgggccaacacggtgcaagaggctacctttcagatggaattgcccaaaaaagctttcataaccaatttttctatgatcatcgatgggatgacctatccagggattattaaagagaaggctgaggcacaagcacaatacagtgcggctgtggccaaggggaaatcagccggtctggtgaaagccactggacgaaacatggagcagttccaggtcagtgtgtccgtcgctccaaatgctaagatcacattcgaattagtttatgaggagcttcttaaaaggagactgggcgtctacgaactgttgctaaaggtgcgaccacagcagctggtgaaacaccttcagatggacattcacatctttgagccccaggggatcagcttcctggagacagagtccacctttatgacaaatcagctggtcgatgccctgaccacctggcagaacaagaccaaagcccatattcgctttaaacctaccttgtcccaacagcagaagtcccctgagcagcaggagactgttctcgatggaaacctgattattcgatacgacgtggatcgagcgatctcaggcggctccatacagattgaaaatggatacttcgtgcattacttcgcgccagagggcttaaccacaatgcccaaaaatgtagtatttgttattgataagtcaggatctatgagcggccgaaaaatccagcagacgagagaagcactgataaaaatcctcgatgatctcagtccccgagaccagttcaacctgatcgttttctccacagaagccacacagtggaggccaagcctcgtcccagcttcagcagaaaatgttaacaaggctcggtccttcgccgccggtattcaagccctcggagggacaaacatcaacgacgcgatgctgatggccgtgcagctattagatagcagtaaccaagaggaaaggctcccagaggggagtgtgtcactaatcattctgctcacagatggcgatcccactgtgggtgagaccaaccccaggagcatacagaacaatgtgcgtgaggcagtgagcgggagatactccttgttttgcctggggttcggttttgacgtcagttacgccttcttggagaaactggcgcttgacaatggtgggctggcccgtaggattcacgaagatagcgacagcgcactgcaactccaggacttttatcaagaggttgccaaccccctcctgaccgccgtgaccttcgaatacccatccaatgctgtcgaggaggtgacccaaaacaacttcagactgctgtttaaggggagcgaaatggtggtcgctggcaaactgcaggatcgaggtcccgacgttctgacggcaactgtgtcagggaaattgcccacccagaacatcacctttcagacggaatccagtgtcgctgagcaagaggcggagtttcagtcccctaaatatatcttccacaactttatggagagattgtgggcctatttaactatccaacaactgttggaacaaaccgtgtctgcctcggatgccgaccagcaggccctccggaatcaggcactcaatttgtctctggcctactcctttgtgactccactcacatctatggtcgtgactaaaccagatgaccaggagcagtcccaggtggcggagaagcccatggaaggagagagcaggaataggaatgtgcattcggctggagctgccggttctcgcatgaatttccggccaggtgttctgagctctaggcagctgggccttcccgggccgcccgatgtccctgaccacgcagcttaccacccctttcggcgtctagctatcctgcccgcatccgctccgcccgcgactagcaaccctgatcccgccgtgtccagagtgatgaatatgaagatagaggaaacaaccatgacgacccagactcccgcgtgcccctcatgctcaaggtccagggccccagcagttccggccccaatccaggctccctctgccatactgccactcccaggacaaagtgtggagagactttgtgttgatcctagacatcgccaaggcccagtgaatcttctgtcagatcctgaacagggcgtagaagtaactggacaatatgaacgggagaaagcaggattttcgtggattgaagtgactttcaaaaacccactagtgtgggtgcatgcgagcccggaacatgtagtagttacccgaaatagacgctcttctgcttataaatggaaggaaacattattcagtgtgatgcccggcctaaagatgaccatggataagaccggcttactactgctgtctgatcccgataaggtgactataggactgctgttctgggatggaaggggtgaaggccttagactcctgttgagggatacagatcgtttcagctctcatgtcggcgggactctagggcagttttaccaggaggtactatggggttctccggcggctagtgacgatggccggcgtacccttagggtgcagggtaatgatcatagcgccacacgggagaggcggctggactaccaggagggtccgcctggagttgaaatttcctgctggtctgtggaactatag

SEQ ID NO: 191604 - DNA, 2703 bp, Artificial Sequence
  Description of Artificial Sequence: Synthetic coding sequence
atgaagcccccccggcccgtgcggacctgcagcaaggtgctggtgctcttaagcttactggccatccaccagacgacaacagcagagaaaaatggtatagacatatatagcctgactgtggacagccgtgtcagctcaaggttcgcacacaccgttgtcacttccagagttgtgaaccgtgccaacactgtgcaggaggctactttccagatggaactgcctaagaaggcattcatcaccaacttcagtatgataatcgacgggatgacctaccctgggatcatcaaggagaaagctgaggcccaggcgcagtacagcgcagcagtggcgaaaggaaagagcgcgggactggtgaaggcaacagggcggaatatggagcaatttcaggtttcggttagcgttgccccgaatgctaagataacatttgagctagtttatgaggagttgctgaaacgccgactgggggtatatgagttgctgctgaaagtgaggcctcaacagctggtgaagcacctacagatggacattcacattttcgaacctcagggtataagcttcctggagaccgagagtacctttatgacgaaccagctggtggacgcactgaccacttggcaaaacaaaacaaaagcccatattcgattcaaaccaactctttctcaacagcagaagtcacccgaacagcaggagactgtccttgacggaaaccttattatacgttatgacgtagatagggcgatatcagggggctcaatacagattgagaacggctactttgtgcattactttgccccagagggacttaccactatgccaaagaacgtggtcttcgtcattgacaaaagcgggagtatgagtggccgcaagatacaacagacaagggaagcccttatcaaaatattggacgacttgtcacccagagaccagtttaacctcattgttttctcaactgaggccacccagtggagacccagcctcgtaccagcctcagctgagaatgtaaataaggcccgctcatttgccgccggcatccaggcgctgggtggaactaatattaatgacgcgatgttaatggccgtgcaactgctggacagtagcaatcaggaggagagactcccagagggtagtgtgtccctcatcattctgctgacagacggcgatccaacagtcggtgagacgaatcctcgctcaatccaaaataatgtgagggaagcagtttcagggcgttattccctgttctgtctgggctttggtttcgatgtgagctatgcttttcttgaaaaactagcgctggataacggcggcctggctagaaggatccacgaggatagcgatagtgccttacaactccaggacttctatcaagaggtggctaaccctttactcacagcggtcaccttcgagtatccttcaaatgctgtggaggaggtgactcagaacaatttccggctgttgttcaagggatccgaaatggtcgtggcaggaaagctacaggacagagggccagacgtgttgaccgctacagtaagtggtaaactcccgactcagaatattacgttccagaccgagtcgtccgtggctgaacaggaggccgaattccaatcaccaaagtatatttttcataattttatggagcgtctttgggcctatttgactatccaacagctcttagaacaaaccgtctctgccagtgacgcggatcagcaggctttgcgcaatcaggccctgaacctgagtctggcgtatagcttcgtgacgcctctgaccagtatggtggtgactaaacccgatgatcaagagcaatcccaggtggcagaaaagcccatggaaggcgaatcgcgaaacagaaacgtacatagtgctggggccgctggcagccgcatgaattttagacccggtgtgctctcaagccgtcagcttggtctgccgggccctccagatgtcccggatcacgcagcctaccacccgtttaggcgcctggctatactcccagcctctgctccacccgcaacttctaaccccgaccccgccgtaagcagggtcatgaacatgaagatcgaggagactacaatgaccactcaaaccccagccccgatacaggcgccgtctgccatcttgccacttcctggtcagtcagtggagcgcctgtgtgtcgaccctcgacacaggcaaggcccggtaaacttactatcagaccccgaacagggagtggaggtaactggccaatatgaacgcgaaaaggccggattctcttggattgaagtaacctttaaaaatccactagtatgggtgcacgctagtccagagcacgtggtcgtgacacgaaaccgtcgtagttcagcttataaatggaaggagacactgtttagtgtgatgcccggcctcaagatgactatggacaaaacagggttactgctgctcagcgatccagataaagtgacaattggtctactgttttgggatgggcgcggggagggcctgcgcctactgttgcgcgataccgaccggttcagctcacacgtcggcggcaccctgggccagttctaccaggaggtgctttggggaagtccggccgcctccgatgatggaaggcggactctccgggtccaggggaacgaccattctgcaactagggagaggcgactcgactatcaagaaggtccgcctggtgtggagatttcctgctggtcagtggagctttag

SEQ ID NO: 191605 - DNA, 1683 bp, Artificial Sequence
  Description of Artificial Sequence: Synthetic coding sequence
atgacctaccccggcatcatcaaggagaaggccgaggcccaggcccagtattcagccgctgtggctaagggcaaatctgccggcctggttaaagccaccggccgaaatatggagcagtttcaggtctccgtgtctgtggctcccaatgctaagattacattcgagctggtttacgaagagctcctgaagaggcgcttgggggtgtacgagctactgttaaaggtccgcccgcagcagttagtcaagcatttgcagatggacatccacatttttgagccacagggcatatcattcctggaaaccgagtcaaccttcatgacaaaccagctggtggatgcccttaccacctggcagaacaaaaccaaggctcacattcgcttcaaaccgaccttgtctcaacagcagaagtctcctgagcagcaggagaccgtactggatggaaatctaattattagatatgatgttgacagggccatctccggcggctcaattcaaattgaaaacgggtatttcgtgcattacttcgctccagagggactgaccacaatgccaaagaatgtcgtttttgtgatcgataaaagtggtagtatgtcgggaaggaagattcagcagacgagagaggcattaatcaagatcctggacgacctgagtcctagagatcaatttaatcttattgtgttttcaacggaggccacccagtggcggccttctcttgtgccagcttctgctgagaatgtcaataaagccagatcgttcgccgctggaattcaggctctcggtggcaccaacattaatgacgctatgctgatggctgttcagctgctcgactcatccaaccaagaggagagactaccagaaggttccgtttcactgatcatcttgctcacagacggcgacccgactgttggcgaaactaacccccgatcaattcagaataacgtcagagaggccgttagcggacggtacagcctcttttgcctcggatttgggttcgacgtgagctatgccttcctggagaaactggcattggacaatggcggcttagcgaggcggatccacgaggatagcgattctgccctccaactgcaagatttctaccaggaggtcgccaatcctctgttgacggcggtgacattcgaatatccctcaaacgccgtcgaggaagtcacccaaaataactttagacttctgttcaaagggagtgagatggtcgtggcaggcaagttacaggacagaggcccagatgtgctgactgccaccgtcagtgggaagctgcctacccagaacattacttttcagactgagagttctgtcgccgagcaagaggccgagtttcagagccccaaatacatctttcacaatttcatggaaaggttatgggcttatctgactatacagcaactcctcgaacagactgtctcggcaagcgatgcagaccagcaggcactccgcaatcaggctctgaatctctctctggcttactccttcgtcacacccttgacatccatggtagttacaaagcccgacgatcaggagcaatcccaagtggcagaaaagcctatggagggagaatcccgtaatagaaacgtccatagtggctctacctttttcaagtactacctgcagggagcgaaaatccctaaaccgggggataaggtgggcgggggagggcgtggggattag

SEQ ID NO: 191606 - DNA, 2667 bp, Artificial Sequence
  Description of Artificial Sequence: Synthetic coding sequence
atgaagcccccccggcccgtgcggacctgcagcaaggtgctggtgctgctgtcactcctcgcaatacaccagactaccaccgccgaaaagaacgggattgatatctattccctgaccgtggactcacgcgtgagtagccgctttgcccataccgtggtgacgtccagggtggtgaacagagcaaatacggtacaggaggccaccttccaaatggaattgcccaagaaagcattcatcacaaatttttccatgataatcgatggtatgacctacccagggatcatcaaggaaaaggcggaagcccaagctcaatacagcgccgcagtggctaagggcaaatctgcaggtcttgtaaaagccacggggcggaatatggagcagtttcaggtcagcgtgtcagtcgcgcccaatgcaaaacggagactgggagtgtatgaactgcttctgaaagttaggccacagcagttagtgaagcatctgcaaatggatattcatatctttgaaccacaaggtattagttttctagagacagagagcacttttatgacaaatcaactcgtcgatgctttgactacatggcagaacaagaccaaggcccacatccggttcaagcccacactgtctcagcagcaaaaatctcctgagcaacaggagaccgttctggacggcaacctcattattcggtacgacgttgaccgggcaatctcgggtggctccatccagatcgaaaatggctactttgtccattatttcgcacctgaaggacttacaacaatgccgaagaatgttgtcttcgtgatcgacaagtctggcagtatgtccgggaggaaaatacagcagactcgtgaagccttaatcaagatactggatgatctgtctcctagggaccagtttaacctgattgtgttctcaaccgaggcgacccagtggcggcccagtttggttcctgccagtgccgagaacgtgaacaaagcccgctcatttgccgctggaatccaggcgctgggtggcacaaatatcaacgacgctatgctcatggcagtccaattgctggatagctcaaatcaggaggagaggttacctgaggggagcgtgtcgctgattatactcctgaccgatggagatcctacagtcggcgaaaccaaccctcgctccatccagaacaacgtgagagaagccgtgtccggacgctactcactgttctgtctaggttttggcttcgacgtaagctatgcttttctcgaaaaactggctctcgataatggtggcctagccagaagaatacacgaggactctgatagcgcactgcagctgcaagacttctatcaggaagttgccaatcctttgctgaccgccgtgaccttcgagtacccttctaacgccgtagaggaggtcacccagaataatttccggcttctgttcaagggcagcgagatggtcgtggcggggaaactgcaggaccgtggcccagacgtcctgacagcgactgtctcaggcaagctgcccactcagaatataacctttcaaactgagtcatccgtggcggagcaggaggcggaattccaatccccaaaatacatctttcacaacttcatggagcgactctgggcctaccttactatccagcagctgctggaacagacggtttcagcaagcgacgcagaccagcaggcccttcgcaatcaggccctgaacctcagcctggcctacagctttgttacaccgttgaccagcatggtggtcaccaaaccagatgatcaggaacaaagccaggtggctgaaaagcccatggagggagagtctcggaaccggaacgtgcatagcgcaggggccgcaggcagccggatgaatttcagaccaggggtactctccagtagacagctgggacttcccgggccgccagatgtgcctgatcacgccgcatatcacccattcagacggttggccattttgccagcaagtgctcctccggcaacttctaaccctgatcctgcagttagtagagtgatgaacatgaaaatcgaagaaacgactatgaccactcaaactcctgcacctatccaggctccgagtgctattctaccccttcctggtcagagtgtcgagcgcttgtgcgtggacccacgacaccgccagggcccagtgaacttgttgtccgaccctgaacagggcgttgaagtcactggacaatatgagagagaaaaagccggattttcctggattgaggtaacgttcaaaaaccccttagtatgggttcatgccagccctgagcacgtggtggttacaagaaaccggcgctcctcagcgtataagtggaaggaaactctgttttccgtgatgcctggactcaaaatgaccatggacaaaactggcctgctcctgctgagcgaccctgacaaagtaacaattggcttactgttttgggatggacgaggcgaggggcttcgcctcctactccgcgacaccgaccggttctcatctcacgttggaggaacactcggccaattctatcaagaagtgctgtggggatcccctgctgcctccgatgacggccggcggacgcttagagtccagggtaatgaccattccgccacgcgggagcgacgtctggactaccaagaaggcccccccggcgttgagattagttgctggtccgtggagttgtag

SEQ ID NO: 191607 - DNA, 2871 bp, Artificial Sequence
  Description of Artificial Sequence: Synthetic coding sequence
atgctgctgctgctgggcctgtgcctgggcctgagcctgtgcgtggggtcgcaggaggaggcacaatcctgggggcattctagcgagcaggatggtctcagagtcccccgtcaggtaagactgctgcagcgcttgaaaaccaaacctctcatgacagagttctcagtgaaatccaccatcatctctagatacgcctttaccaccgtttcatgccggatgctcaatcgagcatccgaggaccaggacattgagtttcaaatgcagattcctgccgctgcatttattacaaacttcactatgctgatcggtgacaaggtctatcagggagaaatcaccgagcgagaaaaaaagagcggagaccgagtaaaggagaagaggaataaaacgactgaggaaaatggcgagaagggtactgaaatcttccgagcctccgccgtcatcccctcaaaggacaaggccgccttcttcttgagctatgaggagctgctccaacggagattaggaaagtatgagcattcaatctccgtccgcccacagcagttgtccggccgcctgagcgtggacgtaaacatccttgagtctgccggaatagcctcacttgaagtgctgcccctccataactccagacagcgcggctccggtaggggggaggacgattctggccccccacccagcacggtgattaatcaaaacgagacattcgcaaatattatttttaagccgactgttgttcagcaggccagaatcgcccagaacggtattcttggcgatttcataatcaggtacgatgtgaatagggaacagtccatcggcgacatccaggtgttgaatggctatttcgtgcactacttcgcacctaaggacctgccccctttgccaaaaaatgtagtgttcgttctcgatagctccgcaagcatggtggggactaagctccgccaaacaaaagacgccctttttaccatcctgcatgatctccgaccccaggaccgttttagtatcatcggtttttcaaaccggatcaaagtgtggaaggaccacctgattagcgtaacgccggatagtataagggacggtaaagtttacatacatcatatgtcacctacaggtggtaccgacattaatggtgcgctccagcgcgcgatcagactcttaaataagtacgtagcacattcagggattggcgaccggagtgtgtctctgatcgtctttttaacagatgggaagcccacagtaggtgaaacccacactctcaaaatactcaataacactagagaagccgctcgcggccaggtgtgtatttttaccattggtatcgggaacgacgtagattttaggcttcttgaaaagctctctttggagaattgcgggctgacgaggagagtccacgaggaagaagatgctgggtctcagctgatcggattttacgacgagataagaacccctctgctgtcagacattaggattgattacccaccctcatccgtggtgcaagcgacaaaaaccctattcccgaattactttaatgggagtgagattatcattgctggcaagttagtcgaccggaagctggaccaccttcacgtggaggtcactgcttccaattcaaagaagtttatcattttgaaaaccgatgtacctgttcggccccaaaaagcgggaaaggacgtgactggatccccaagaccgggcggcgacggggaaggggacactaaccatattgagcggctgtggtcctatctgaccacaaaagaacttcttagttcctggttgcagagtgatgacgagcctgagaaggagaggttgaggcaacgcgcccaggctctcgccgtctcttaccgctttctgaccccgttcaccagcatgaagttgcgtgggcccgtgccacggatggatggcctagaggaagcccacggtatgagcgctgctatgggtcctgaacccgtggtgcagagcgtgcgcggtgcaggtactcagccgggccccctattgaagaaaccttaccaaccacgcatcaagatttcaaagacaagcgtggacggtgacccccacttcgtggtggactttcccttgtcaaggctgacggtttgtttcaacatcgacggacagccaggagacattctgagacttgtctctgatcaccgagattcaggcgtcactgttaacggggagctgatcggggcacccgccccacccaatggtcacaaaaaacagcgcacctatctaagaactatcacaatccttattaacaagccagagaggagctatcttgaaattactcctagtcgcgtgatcttggacggtggcgataggctcgtcctcccctgcaatcaatcagtggttgttggtagctgggggcttgaggtgtcagtgagtgcgaatgctaacgtcaccgtgacaatccagggctcaatagctttcgtgatactaattcacctttataagaagcctgctcccttccagagacatcatctgggcttttacatcgcgaatagtgagggtctttcttccaattgccatggactcctggggcagttcttgaaccaggacgctaggctgaccgaagatcccgccggtccctcccagaacctgacacatcccttactcctgcaggtcggtgagggcccagaagccgtgctgacagttaagggccatcaagttcccgtcgtgtggaaacagaggaagatttacaacggtgaagaacaaatcgactgctggtttgcccgcaataacgctgccaagctcatcgacggcgagtacaaggactatctcgcatttcacccgttcgatacaggcatggacacttggccagggaacgtccagggcgcacttaaacttgccgccttaaaaatgcaggtgcacgagggccaatag

SEQ ID NO: 191608 - DNA, 2229 bp, Artificial Sequence
  Description of Artificial Sequence: Synthetic coding sequence
atgcggaactacgacagcggccccccccccagcaccgtgatcaaccagaacgagacctttgccaatatcatcttcaagccaaccgtcgtgcaacaagcacggattgcccagaatgggattcttggtgactttatcattcgctatgacgtaaaccgagaacagagcatcggtgatatccaggttttaaacggctattttgtccactattttgcgcccaaggacttaccgcccctccccaaaaatgtggttttcgtgctcgacagttccgctagcatggtaggaaccaagctccgacagaccaaggatgcactattcaccatcctgcacgacttgcgtcctcaggaccggttttccattatcggatttagtaaccgcataaaagtttggaaagaccacctgatatccgtaaccccagatagcatccgggacgggaaagtgtatatccaccatatgtctccaactggcgggacagacattaacggtgcgctacagcgcgctatccgcttgttgaataagtatgttgcgcactcaggaattggggacaggtccgtctcactcattgtttttctgacagacggtaagccaacggtcggagagactcacactttgaaaatcctgaacaacacaagggaggccgcgcggggacaggtgtgcatattcaccatcgggattggcaatgacgttgacttccgcctcttggagaagttatctttggagaattgtggccttacgcgacgcgtccacgaagaggaggacgccggaagccaactgataggcttttacgatgaaataaggactcctctgctatcagatattcgaatcgattatccgcccagcagcgtagtacaggcaacaaaaaccctgtttcctaattacttcaacggctcagagatcatcatagccggcaaactggtggaccgcaagctggaccatctccacgtggaggtgaccgcctccaatagcaagaaatttatcattttgaagaccgatgtgccagtccggccacagaaggcgggaaaggacgtgacagggagtcccaggcctggtggcgacggtgaaggtgacaccaatcacatcgaacgactgtggagctacttgacaaccaaagaattgctcagcagctggctacaatctgacgatgaaccagagaaggaacggttgcgtcagagagcccaggccttagcagtgtcctatcgattcctgactcctttcacatccatgaaattgcgcggtccagtcccacgaatggatggtcttgaagaagcccacggcatgagcgcagccatggggcccgaacctgtagtccagtctgttagaggcgccggaacccagcctggaccactgctgaaaaagccgtaccagccgcgaatcaaaatctccaaaaccagcgtcgacggtgacccacattttgtggtggattttccactctcacgcctgactgtctgttttaatattgatggccagccaggagatatcctgcgcttagtgagtgaccatcgcgattccggtgtgacagttaacggagagcttattggcgccccagccccaccaaacggacataagaagcaaagaacctacctgcggactatcaccatactgataaataagcccgagcggagctatctcgagataaccccctcccgagtgatcttggatggaggagaccgcctcgtattaccgtgcaaccaaagcgtggtggtggggtcttgggggctggaggtctccgtgtctgccaacgctaatgtgacagtgactattcagggctccattgctttcgtgatcctcatccacctttacaagaaaccagctccctttcaacgccaccacctggggttttacatcgcgaactccgagggtctgtcatcaaattgtcatggccttctgggccagttcctgaaccaggacgcccgtcttacagaggatcctgccggcccttctcaaaacctgacacatcccctgcttctccaggtaggggaaggccctgaggctgtcctgacagtgaaaggacatcaggtgccagtggtgtggaagcaaaggaagatctataacggagaagaacagatcgattgttggtttgctagaaataacgccgcaaagctcatcgatggcgagtacaaagattatctagcttttcacccattcgatacgggcatggacacctggcccggaaatgtgcagggcgctctcaagctggctgctctcaaaatgcaagtgcatgaaggccagtag

SEQ ID NO: 191609 - DNA, 2109 bp, Artificial Sequence
  Description of Artificial Sequence: Synthetic coding sequence
atgctgctgctgctgggcctgtgcctgggcctgagcctgtgcgtgggaagccaagaggaggcccagtcatgggggcattcaagtgaacaagatggtcttcgggtgccacggcaggtgcgtctcctgcaaagactgaagaccaaacctctgatgaccgaattttctgtcaagtctacaattatcagccgatatgcgtttacaactgttagctgccgcatgttgaatagggcgagcgaggatcaagacatcgagtttcagatgcagattcctgcagcagccttcataaccaacttcaccatgctgattggcgacaaagtctatcagggggagattacagagagggagaagaagtccggagaccgcgtgaaggagaagcgcaataagactacggaggaaaatggcgaaaaaggaacagagattttcagagccagtgctgtgatcccctccaaagacaaagccgccttctttctgtcctatgaagagctgttgcagcgccgtctgggaaagtacgaacacagcatctctgtgaggccacagcagctcagcggtagactgtctgttgacgtaaatatcctagaaagcgcagggattgcctcactggaagtcctgcccctgcacaactctcgccagagaggctcgggcaggggcgaggatgactccggacctcccccaagtaccgtgattaatcagaatgagacttttgccaacattatttttaagcctaccgtcgtgcagcaagcccgcatagcccagaatggaatccttggggattttattatccggtatgacgtgaaccgagaacagtccattggcgacattcaagtgctgaatggttatttcgtacactacttcgctccaaaggatttgcctcctctccccaagaacgtggtgttcgtgcttgatagtagcgcatctatggtgggtacaaaattacgacaaacgaaagacgccctgttcacaattctgcatgatctcagaccacaggacaggttctccataattggattctccaataggataaaggtgtggaaggaccacctcatatcagtcactcccgattccatccgagacggcaaagtatacatccaccacatgtcccccacaggcggaactgacattaatggagctctgcagagagcgattagactcctgaataagtacgtggcccactcaggcatcggggacagaagtgtgtccctgattgtgttcctcactgacggcaaacccacagtgggtgaaacacacacattaaaaattctaaacaatacccgggaggcagcaagggggcaggtgtgcattttcacaattgggatcggaaacgacgtagactttcgcttactggaaaaacttagcctcgagaattgtggactgacacgtcgagtccacgaagaggaggacgccggcagccagctgattggattctacgatgaaatccgaacaccattgctgtcagatataagaatcgactatccaccgtccagtgtcgtgcaggcgacaaaaacgcttttcccaaactacttcaatggatcagaaattatcatcgcaggcaagctcgttgacaggaagctggatcaccttcacgtggaggtgactgcatctaactcaaaaaagtttatcatcctgaagaccgacgttccggtgagaccgcagaaggctggtaaggacgtcacggggtcacctcggccaggaggcgatggagagggagacactaaccatatagaacgattatggagctacctgactaccaaagagctcctttcctcctggttgcagtcagatgacgaaccagaaaaagaaagacttagacaaagagcccaggccttggccgttagctatagatttttgaccccatttacgagtatgaagttaagaggcccagtgcctagaatggatggcctcgaggaagcccatggaatgtcagccgcaatgggccctgagcccgtggtccaaagtgtgcgtggtgcaggtacacagccaggtcctctgctgaagaagccctatcagccaaggatcaagatttccaagacatctgttcgggggttcagacgcgaagaacagatattcagtaatgtaatgaagttcccgttcgctagtatcctagaactgtag

SEQ ID NO: 191610 - DNA, 2088 bp, Artificial Sequence
  Description of Artificial Sequence: Synthetic coding sequence
atgctgctgctgctgggcctgtgcctgggcctgagcctgtgcgtgggttcccaggaggaagcacagtcatgggggcatagttctgagcaggacggcctgcgggtgccgagacaggtccgtctgttacagaggctgaaaaccaaaccactcatgaccgaatttagcgtgaagagtaccattatttccagatatgcgtttacgaccgtttcttgccgcatgctcaatcgcgcgtcagaggaccaagacattgagttccagatgcaaataccggctgccgcattcattactaatttcaccatgctcattggggataaggtgtatcaaggagaaataacagaacgagagaagaagtctggagatcgcgtgaaagagaaaagaaataagaccaccgaagaaaacggtgaaaaaggaacagaaattttccgggctagtgccgttatcccaagtaaagacaaggctgctttctttttgagctatgaggaacttctccagagaagactggggaagtacgagcactccatatccgtccgaccacagcagctgtcagggcgactgtctgtggacgtaaatatactcgagtccgccggcatcgcttcactcgaggtgttgccactgcacaattcccgtcagcgtggttccggcagaggcgaggacgatagtggaccacctccatccaccgtaatcaatcagaatgagactttcgccaacataatctttaagcccaccgttgtccagcaagcccgaatagcccagaatggcattttaggagatttcatcattcggtatgacgtgaatagggaacagagtatcggtgacatccaggtccttaatggctacttcgttcattattttgcacctaaggatttgcctcctctcccaaaaaacgttgtctttgtgcttgactctagcgcatccatggtgggcactaaacttaggcagacaaaagatgccttgttcactattcttcacgacttaagaccccaagatagattcagcattatcggattttccaataggatcaaggtctggaaagatcacctgatctctgtgacccccgattccattcgggacggcaaggtttacatccatcatatgtcccccactgggggaacggacatcaacggtgccctacaacgtgccatccggctgcttaacaagtatgttgcccactccgggattggcgatcggagcgtgtccctgatcgtctttctaacggatggaaagccgactgtgggggagacccatactctaaaaattctaaacaacacccgtgaagccgcgcggggacaagtgtgtatttttacaattggaatcggcaacgatgtagatttccgcctcctggaaaaactctccctagagaactgcgggctgacacggcgagtgcacgaagaggaggacgccggaagtcaactgatcggtttctatgatgagatcagaaccccgctgctgagtgacattaggatcgattatcccccttcttctgtcgtgcaggcgaccaagacccttttccccaattactttaatggcagcgaaattatcatagccggtaaacttgttgatcgcaaattggaccatctgcatgtggaggtcactgccagcaattccaagaagttcattatcctgaagacagatgttcccgtgcgaccccaaaaagctggtaaagacgtgactggttcaccaagacccggtggtgacggtgaaggggacacaaaccatattgagaggttatggagttacctgacaaccaaggaactgctctcctcttggctgcagtccgacgatgagccagaaaaggaaagactgcgccagcgtgcccaggcccttgcagtgagttaccggttccttactccctttacgagcatgaagctccgggggcctgtgccacgaatggatgggctggaggaggcccacgggatgagtgccgcaatgggccctgaacctgtcgtgcaatcagtgagaggggcgggcactcagcctgggcccctgcttaaaaaaccccctaacagcgtcaaaaaaaagcagaacaagacgaagaaacgacatggccgggacggagttttccccttgcaccatctgggtataaggtag

SEQ ID NO: 191611 - DNA, 2172 bp, Artificial Sequence
  Description of Artificial Sequence: Synthetic coding sequence
gacagcggccccccccccagcaccgtgatcaaccagaacgagacctttgctaatattattttcaaaccgaccgtggtgcagcaggctaggattgcacagaatgggatcctgggcgattttatcataagatatgatgtcaatagagaacagtcaataggtgacatccaggtgctgaacgggtactttgtgcactacttcgcacccaaggatctcccaccactgcctaagaatgtggtgtttgtgctcgatagtagcgcctctatggtcgggactaagctgcgacagacaaaagatgctcttttcactatactgcatgatctgcggccacaagatcgattctctattataggattttccaaccgcatcaaagtctggaaagatcacctgattagtgttactcctgatagtattagagacggtaaggtgtacatccaccatatgtctccaaccggaggcacagatatcaatggtgcgctgcaaagggcaattaggctcttgaacaaatacgtagcccactcaggaatcggcgacaggtccgtgagcctgattgtgttcctgacagatggaaaacctaccgttggagagacccacaccctgaagatcctgaataatactcgcgaagccgcacgcggccaggtttgtatctttacaattggaatcggaaatgacgtggatttcaggctactagagaaactcagcctggagaattgcggcctgactagacgggttcatgaagaggaggatgccgggtcacagttgataggattctacgatgaaattcgaacccccctgctgtcagacatacggattgattaccccccctcctcggtggtgcaagccactaagacactgtttccaaactatttcaacggctctgagattatcattgctggcaagttggtcgacaggaagttggaccacctccacgtggaggtgacagcatcaaacagtaaaaagttcattatcctgaagactgatgtcccggtgcgcccccagaaggcaggcaaggatgtgacagggagtccccgcccaggaggggatggcgaaggagatactaaccatatcgagcggctgtggtcttacctgactacaaaggagttgctgagcagttggctacagtccgacgatgagccagaaaaggagcgtctgcgtcagagagcccaggcacttgctgtctcctacaggtttctaaccccgttcaccagcatgaagcttagggggccagtgcccagaatggacggcctcgaggaggcccacggaatgtctgctgctatgggccccgagcctgtcgtgcaatcagtccgcggtgccgggacccagcccggacctcttctcaagaagccctaccagcctcgtataaagatatctaagactagcgtcgatggagacccccactttgtcgtggactttcctctgtctcgtctgaccgtctgcttcaacatagacggtcaaccaggtgacatcctgcgcctggtgagcgaccaccgagattccggagtaactgtgaatggagaactgatcggagcgcctgccccaccaaacggacacaagaaacaacggacttacttgcggaccatcaccattctgattaataaaccggaaagatcctaccttgaaattaccccgagtcgtgtgattctagacggaggtgaccggttggtcctgccctgtaaccaatctgtggtggttggctcatggggcctggaggtatccgtatcggctaatgccaacgtgacagtcaccatccaggggtccatcgcttttgtgatactgattcacctttacaaaaagccggccccttttcaacggcaccaccttggcttctacattgccaattctgaagggttgtccagcaactgtcacggactcctgggacagttcctgaaccaagacgcgaggttgaccgaggacccagccggcccctcacagaatctgacccaccccttgcttttgcaggtgggtgaaggtcccgaggcagtcttgacagtcaaaggtcaccaggttcccgttgtgtggaagcagagaaaaatctataatggcgaggagcagatcgactgctggttcgcccggaacaacgcagcaaaactaattgacggtgaatacaaggattaccttgcatttcacccttttgatactgggatgttggggagagggatgtcaagagagttgtag

SEQ ID NO: 191612 - DNA, 1599 bp, Artificial Sequence
  Description of Artificial Sequence: Synthetic coding sequence
atggcccccagcagcccccggcccgccctgcccgccctgctggtgcttttaggagccctgtttccaggccctggaaatgctcagaccagcgtgtctccatcaaaggtgattcttcctcgaggaggctccgtccttgtgacctgcagtacaagctgtgatcaaccaaaactcctgggcatcgaaacccccctgcccaaaaaagagctccttctgcccgggaacaaccggaaggtgtacgagttatccaacgtccaggaagatagtcagcctatgtgctacagtaactgtcccgatggccagtcaacagccaagaccttcttaaccgtgtactggacccccgagcgagtcgaattggcccctttaccttcctggcagcctgtcggcaaaaatcttacgttacggtgccaggttgagggaggggcccctcgggcgaatttaaccgtggttctgttgaggggggagaaggaactcaaacgcgagcctgccgtgggagagccggccgaagtcactaccactgttctggtccgcagggaccatcacggagcgaatttcagttgtcggactgaactggatttgagaccacaaggtctggagctgtttgaaaatactagcgcgccataccagttacagacctttgttttgcccgccactcctcctcagcttgtgtctccccgcgtgctggaagttgacacacaaggcacagtggtgtgttccttggacggattattccctgtgagtgaggcgcaggtccacctggcattgggtgatcagcggctaaatcccacagtgacctacggcaacgactctttttctgctaaagcatccgtgtctgtcaccgcggaggacgagggcacacagcgcctgacctgcgcagtcattctgggtaaccagtcccaagagacccttcaaacagtgacaatttactccttcccagcccccaacgtgattcttactaagcccgaggtgtctgagggcacggaagtgactgtgaagtgtgaagcacacccacgggcaaaggttacgctgaatggagtgcccgctcaaccactcggccctagggcacagcttctcctgaaagcaacgcctgaagataatggtaggagtttctcttgcagtgcgacactggaggtcgccggccagttgatccacaaaaaccagacccgcgaactgagggtgctctacgggcctcgtctagatgagcgtgactgcccagggaattggacttggcccgaaaactctcaacagaccccaatgtgccaagcttggggcaatcccctcccagagctgaagtgcctgaaagacggcactttcccactcccaatcggtgaaagcgttaccgtgacacgtgaccttgagggtacttatctttgtagggccaggtcaacccagggtgaagtgactcggaaagtaaccgtgaacgtgctctcccctagatatgagattgtaatcattacagtggtcgctgcagcggtgatcatgggaaccgctggactgagcacgtatctgtataacagacagaggaagattaaaaagtaccgactgcagcaggcccagaaggggacacccatgaagccaaacacacaagctactccgccttag

SEQ ID NO: 191613 - DNA, 933 bp, Artificial Sequence
  Description of Artificial Sequence: Synthetic coding sequence
atggcccccagcagcccccggcccgccctgcccgccctgctggtgctgctgggtgcattattccctgtttctgaagctcaagtccacctggcattaggggatcaaagacttaacccaaccgtgacctacgggaacgatagtttctccgccaaagcctccgtgagcgtcacagctgaggatgaaggtacccagagactcacgtgcgctgttatcctaggaaatcagtctcaggagactctccaaacggttacaatttactcattccctgcgcctaatgttattctgactaaacctgaagtcagcgaaggaaccgaagtgactgtcaagtgcgaggcacaccctagggctaaggtgactctgaatggcgtgccagcccagccactgggtcctagggcccagctcctcctcaaggcaacaccggaggacaacgggcgatcattctcctgtagcgcaacgcttgaggtcgcaggtcagctgatacacaagaaccagacaagagagcttcgagtgctgtatggcccacgactcgatgagcgtgattgccccggaaattggacttggccagaaaactctcaacagaccccaatgtgccaggcttggggtaatccattgcctgagctgaaatgcctgaaagatggtactttcccgcttcccatcggcgaatcagttaccgtcacacgcgacctcgaagggacctatttatgtcgcgcgagatccacgcagggggaagtgacccggaaagtcaccgtgaatgtcctcagcccacgctacgaaatcgtcatcataaccgtggtggccgcagctgttattatgggcacagccggattgagtacctacttgtacaaccgacagagaaaaattaagaaatatagattgcaacaggctcagaaggggaccccaatgaagcctaacacccaggccactcccccttag

SEQ ID NO: 191614 - DNA, 828 bp, Artificial Sequence
  Description of Artificial Sequence: Synthetic coding sequence
atgagcagcttcggctaccggaccctgaccgtggccctgttcaccttgatctgctgccccgggtccgacgaaaaggtgttcgaagtccatgtgcgcccaaaaaagctggcggtggaaccaaagggcagtttagaggtcaattgcagcacaacctgcaaccagcctgaagtgggcggcctcgagacctctttagacaaaattctattggatgaacaggcacagtggaaacactatctagtgtctaacatctcccatgacactgtcttgcagtgccatttcacctgctcgggcaaacaagaaagtatgaattctaatgttagtgtctatcagccacctcgccaagtgattctcaccttgcagcctaccctggtggccgtcggcaagtcattcacaattgagtgccgtgtgccaactgtcgagcccctcgacagtctgactttatttctctttagggggaacgagacgctgcactatgaaaccttcggcaaagccgcccctgcacctcaagaggccaccgccacatttaatagcacagcggatcgcgaggatggacataggaatttcagctgtctcgccgttttagatctcatgtctcgcggcggtaacatatttcataaacatagtgccccaaagatgctggagatttatgaacctgtgtcagattcccagatggtgattattgtgactgtggtctcagttctcttaagcctctttgtgacctcagtgcttctctgcttcatcttcgggcagcacctgaggcagcagcgtatgggtacatatggagtcagggccgcctggcgcagacttccccaagcctttcggccgtag

SEQ ID NO: 191615 - DNA, 828 bp, Artificial Sequence
  Description of Artificial Sequence: Synthetic coding sequence
atgagcagcttcggctaccggaccctgaccgtggccctgttcaccttgatatgctgccctggctccgacgagaaagtgtttgaggtgcacgttcgcccaaagaagctggcagtggagccaaagggatccctcgaggtaaactgttccactacctgcaatcaacctgaggtgggagggttggaaaccagcctggacaagattctcctggacgagcaagctcagtggaagcactatctggtttctaacataagccacgataccgtactccagtgtcattttacctgctccgggaaacaggagtccatgaattcaaacgtctccgtgtaccaaccgccaaggcaggtgatcctcacactacagcctactttggtggcagtgggcaaatcttttaccatagagtgccgggtgcctacagtggagccactggacagtctgacattatttttgtttcgaggcaacgaaactctgcattatgagacattcggaaaagcagccccagcaccgcaagaagcgacagctacatttaactctaccgcagaccgagaagacggccaccgaaatttcagctgcctcgcagtcctggatttaatgagtagaggggggaacatcttccacaaacacagcgctcccaaaatgctggagatctatgaacctgtttcagatagccaaatggtgataattgtaactgttgtttccgtcctcctctcactttttgttacctcagtactgctatgcttcatttttggccaacacctccgccagcagaggatgggtacatatggggtgagggccgcctggcgacggctgccccaggcttttcgcccttag

SEQ ID NO: 191616 - DNA, 828 bp, Artificial Sequence
  Description of Artificial Sequence: Synthetic coding sequence
atgagcagcttcggctaccggaccctgaccgtggccctgttcaccctcatttgttgccccggcagcgacgaaaaggtcttcgaagtgcatgtgcgacctaaaaagctggccgtggaacctaaaggctcactggaagttaactgttctactacgtgtaatcagcctgaagttggaggactcgagacttctctggataagattctgttggacgaacaggctcaatggaagcattatctggtgagcaacatttctcacgacaccgtactccagtgccattttacttgtagcggaaaacaggaatcaatgaattcaaacgtcagtgtttaccagcctccccgacaggtcattctgacccttcaacccacattagtcgcagttggcaagagttttactattgaatgtagggtccccactgtggagccactagatagcctcaccttgtttctgttcaggggcaacgagacactgcattatgaaacctttgggaaggcagcgccagcccctcaggaagccactgccaccttcaacagcacggcagaccgggaggatgggcataggaacttctcttgtctggctgtgctcgacctgatgtccagaggaggaaacatattccataagcatagcgccccgaagatgcttgagatttacgaaccggtctcagattcccaaatggtcatcatcgtaacagtggttagcgtgctgttaagtctgtttgtgactagcgttcttctgtgctttattttcgggcagcatctgaggcagcagcgaatgggcacttacggtgttagggcggcctggaggaggctacctcaagcattcagaccctag

SEQ ID NO: 191617 - DNA, 828 bp, Artificial Sequence
  Description of Artificial Sequence: Synthetic coding sequence
atgagcagcttcggctaccggaccctgaccgtggccctgttcaccctgatctgctgccccgggagtgatgaaaaggtgtttgaagttcacgtgaggccaaagaaactcgcagttgaacccaagggatctttggaagtcaattgctccactacatgcaaccaaccagaagtgggtggtctggaaacaagtctagacaaaattcttttagacgaacaggcccaatggaagcattacctggtgagcaatatctcacacgacacggtgctccagtgtcacttcacatgctccggaaagcaagaaagcatgaacagcaacgtgtccgtttatcagcctccacgacaggtcattctgacgttgcagccaacacttgtcgctgtcggtaaatccttcactattgaatgccgggtccccacagtagagccccttgattcactcactctatttctgttcagaggcaatgaaaccctgcattatgaaacttttggtaaagcagcacctgctcctcaggaggctaccgccacattcaactcgaccgctgatcgggaggacggtcacagaaatttctcatgtttggctgtactggacctcatgtcccggggaggaaatattttccacaaacacagtgccccaaagatgttggagatttatgaacctgtgtctgatagtcaaatggttatcatagtgactgtcgtatcagttctgttatctcttttcgtgacctcggtgttgctctgcttcatcttcggccagcatctacggcagcagaggatggggacatacggtgtgcgcgccgcttggcggcgtctgccacaggccttcagaccctag

SEQ ID NO: 191618 - DNA, 828 bp, Artificial Sequence
  Description of Artificial Sequence: Synthetic coding sequence
atgagcagcttcggctaccggaccctgaccgtggccctgttcaccctgatatgttgccccggcagcgatgaaaaggtgttcgaggtacacgtgcggcccaagaagctcgccgtggagcccaagggctccctagaggtcaattgctccacaacatgtaaccaacccgaggttggtggacttgagacatctctggacaagatcttactcgacgagcaggcacagtggaagcattatttggtctctaatatctcccatgataccgtactccagtgccactttacctgtagtgggaagcaggaaagcatgaactccaacgtctcggtgtaccaaccccccagacaggtgatactgacattgcagcctaccctagtagcagtggggaagagcttcacaattgaatgcagggtgcctaccgtggaacccctcgactcactgacgctctttttgttcagaggcaatgagaccctgcactatgagaccttcggcaaggcagctccagctcctcaggaagccacggccacattcaacagtaccgcagacagggaggacggccaccgcaacttttcttgcctggcagttctggatctgatgtcccggggagggaacatttttcacaagcattctgctcctaaaatgttggagatatatgaaccagtaagcgacagccaaatggttatcatcgtcacggtggtgtctgttctcctctcgttgttcgtaactagtgtacttctgtgcttcatcttcggccagcacttgcgccagcagagaatgggcacatacggcgtccgtgcggcatggcgtagactgcctcaggcttttaggccttag

SEQ ID NO: 191619 - DNA, 1644 bp, Artificial Sequence
  Description of Artificial Sequence: Synthetic coding sequence
atggccaccatggtgcccagcgtgctgtggccccgggcctgctggacactgctggtgtgctgcttactcacccctggggtgcagggacaggaatttctcttgcgagtggagccccaaaatcccgtactgtccgcaggcggttcgctcttcgtgaactgctccaccgactgtccttcctccgaaaagatagcgctggagacgtctctgagtaaagagctagtggcttctgggatgggttgggccgcttttaatctgagcaacgtgactggcaattccaggattctctgctcagtgtactgtaacgggagccagattaccggcagtagcaatatcactgtataccggctgccggaaagagtggaactggcgccactgccgccgtggcaacctgtgggccagaacttcacccttcgatgccaagtggaagacggaagtccgcggacgtcactcacggtcgtgctcttgcggtgggaagaggagctgtcacgacagcccgcggttgaggagcctgccgaagtcaccgcgacggttctcgctagtagagatgatcacggtgctccattcagttgcaggacagaactggatatgcagccgcaggggctcggactgtttgtcaatacaagtgcaccacgacaattgcgcactttcgtgttacctgtgacgccaccaaggctggttgctcccagattcttagaagtcgaaacctcatggccagttgactgcaccctggacggtttgttccctgctagcgaggcacaggtatacttggccctgggggaccagatgcttaacgccaccgtgatgaaccatggcgatactctgactgccacagccacagcaaccgcacgggctgaccaggagggagctcgcgaaattgtttgcaatgtgactctgggcggcgaacgcagagaagctagagagaacctgaccgtcttttctttccttggacctattgtaaacttatcagagcccaccgctcacgagggaagcaccgtcacagtgtcatgcatggccggggctcgcgtccaggttacccttgacggagtccctgccgccgcccccggccagcccgcacaactacaactgaatgccactgagtcagatgacggacgaagcttcttctgctcagccacactcgaggtcgacggggaattcttacacagaaacagctctgtacaactccgggtgctctacggtccaaaaattgatagggcaacctgtcctcagcacctaaagtggaaagataagacccggcacgtgttgcagtgtcaagcacgcggtaatccttacccagaacttcgatgtctgaaggagggctcaagccgagaggtgcccgttggcatcccattcttcgtaaacgtaacccacaacgggacttatcagtgccaggcctcgtcaagccgcggcaaatacaccctggtcgtggttatggacatcgaagctggatcctcccactttgtcccagtgttcgtggctgtcttgctgaccctgggggtagtcactatcgtgctcgctctaatgtatgtgtttcgcgagcatcagcgttcaggtagttatcacgtgcgtgaagaaagcacttatctgccactcacaagcatgcagcccaccgaggcaatgggggaggaacccagtcgcgccgagtag

SEQ ID NO: 191620 - DNA, 819 bp, Artificial Sequence
  Description of Artificial Sequence: Synthetic coding sequence
atgggcagcctgttccccctgagcctgctgttcttcctggccgccgcttatccaggagtagggtccgccctgggaagaaggaccaaaagggctcaaagcccaaaaggatcccccctggcccctagcgggacgagcgtgcctttttgggtccgcatgagtccagagttcgtagccgtgcagcctggcaaatcagtacagctgaactgctcaaattcatgtccgcagccgcagaatagttccctgagaactcctttacggcagggaaagaccctccgaggcccaggctgggtctcctaccagcttctggacgttagggcctggtcctctttagcccactgtctggtgacctgtgcgggaaaaactcgttgggcgactagccgcattaccgcatattccgtacccgggggcctcctgggaggcgacccagaggcttggaagccgggccacttatttcggaaaccaggagctttacataggcctgggtctgggcagcgggacctggacttgcgagtatgttgttggaccccgagattacttgccgcccgcgacctaccccgcgctccacagtcccggagaccaggcgggcctcagcagctcggcacacattataccgacgccagactggagccaagagcacattctttcggcctgagattccacaggtgcccctgcagagatccacctcactgtggccggtgtgtcccaatgcaggtgccctcatatgaggtgcccggcgtgaaaggcgatgtgctctgccgcctgagtgaaaagaagagaaatatgaagcagtctggagagatggccatccacggtggttag

SEQ ID NO: 191621 - DNA, 816 bp, Artificial Sequence
  Description of Artificial Sequence: Synthetic coding sequence
atgggcagcctgttccccctgagcctgctgttcttcctggccgccgcctatcccggggtgggctctgccctggggaggcgcactaaacgggcccagtctccgaagggatcccccctagcgccctctggaacttccgtgcccttttgggtgcgcatgtcccccgaattcgttgcagtccagcccggaaaatccgttcagctcaattgttccaatagttgtccccaaccacagaacagttctctgaggacgccgctgcggcagggaaaaacattgcgcgggccgggatgggtgtcctaccagctgctggacgtgcgggcctggagcagcctcgcacattgcctggtgacatgcgcaggtaagacccggtgggctacaagtagaattactgcttacaaacccccacactctgtgatactggagcctccagtgctgaaaggccgaaagtataccttaaggtgtcacgtgactcaggttttcccagtgggctacttagtagtgacacttagacacggcagtagagtcatttattccgaaagcttagagcgctttactgggttagatctcgccaacgtcacacttacatacgagttcgctgcgggtcctagggacttctggcaacctgtcatctgccacgctcggctgaatctggacggattagtggttcggaattcctcggccccgattacactaatgctggcgtggtcccccgcgcccaccgcgcttgcttccggatcaattgcagccttagttgggatcctcctgacagtcggagcggcatatctctgtaaatgcctcgcaatgaaaagtcaggcgtag

SEQ ID NO: 191622 - DNA, 714 bp, Artificial Sequence
  Description of Artificial Sequence: Synthetic coding sequence
atgggcagcctgttccccctgagcctgctgttcttcctggccgccgcgtatcctggtgtaggctcagctctcggccgtcggactaaaagggcacaatcaccaaagggatccccacttgccccctcaggaacatccgtgcccttctgggttaggatgtcacctgaattcgttgccgtacagcccgggaaatccgttcagctcaactgcagcaactcctgcccccagccccaaaattcgtcactgagaacccctctgaggcagggaaagactctgagaggcccaggatgggtctcataccagcttttagacgtgcgcgcttggtcctccctagcccattgtctggtcacctgcgcggggaagacaaggtgggccacaagccgtattacagcttataaacccccccactcggtgatcttggaacccccagtactgaaaggacgaaaatacacccttcgatgccacgttactcaggttttcccggtgggctatctggttgtcacactacggcatgggtccagagtcatttatagcgaatcccttgagagatttaccgggcttgatctggccaacgtgaccctgacttatgagtttgcagcaggaccgcgcgacttctggcagcctgtgatttgccatgctcggcttaatttggacggattggtggtcagaaacagttcagcgcctatcacactgatgttaggggaggctcccttatag

SEQ ID NO: 191623 - DNA, 498 bp, Artificial Sequence
  Description of Artificial Sequence: Synthetic coding sequence
atggagctgtgccggagcctggccctgctgggcggcagcctgggccttatgttttgtctcattgcgctgtccaccgacttctggttcgaagctgtgggcccaacccacagtgctcacagcgggttgtggcccaccggtcacggagacatcattagtggctacattcacgtgacccaaaccttcagtattatggcagtcctgtgggccctcgtgagcgtgagctttcttgtcctgtcatgcttcccttctcttttcccacctgggcatggacccctggtgtccactacagctgcgtttgcggcagcaattagcatggtggttgcaatggcagtctacaccagcgagagatgggaccagcctccccacccccagatccagacatttttcagttggtccttctacttggggtgggtgtccgcaattctcctgctgtgtactggggctctatctttgggggctcactgcgggggcccacggccaggctacgaaacgctctag

SEQ ID NO: 191624 - DNA, 1674 bp, Artificial Sequence
  Description of Artificial Sequence: Synthetic coding sequence
atgatggtggtgctgctgggcgccaccaccctggtgctggtggccgtggccccgtgggtccttagcgcggccgcggggggtaaaaacttaaaatcaccacagaaggtcgaggtggacatcatcgacgacaactttatactcaggtggaaccgttccgatgaatctgtcggtaacgtgaccttttcatttgactatcagaagaccgggatggataactggattaaactcagcggatgccaaaacatcacttccaccaagtgcaattttagcagcctcaagcttaacgtgtacgaggagatcaagttgcggatccgcgccgaaaaggaaaatacttcttcctggtacgaggtggatagcttcacccccttccgcaaagcacaaatcggcccaccagaggtacatctggaggctgaagataaagctatagtaatacacatctccccaggcacgaaggattccgtcatgtgggctttagatgggctgtcattcacctactctctggttatttggaaaaattcttccggcgtagaggagagaattgagaatatttatagtcgccataagatttacaaactttctcctgagacgacctattgtctcaaggtgaaagcagctctgttaactagctggaaaattggggtctatagcccagtgcattgcataaagacaactgtagaaaatgagttaccgcctcccgaaaatatcgaggtaagtgttcagaaccagaactatgtgctaaaatgggactatacttatgcgaatatgaccttccaggtccagtggcttcacgcttttctgaagcgtaatcccggtaaccatctgtataagtggaagcagatccccgactgcgaaaatgtaaagactacccagtgcgtgttcccccagaatgtctttcaaaaaggaatctacttgctcagagtccaggctagtgatggcaataacacatctttttggtcggaagaaataaagttcgataccgaaatccaggcattcctgctgccaccggtgtttaacatccgtagtctctccgattcttttcatatttatatcggggctcctaagcagagcggcaacacccctgttatacaagactatccactgatttacgagatcatcttctgggagaacacctccaatgctgaacggaagatcatcgagaagaaaacagacgtcacagtgcccaatctcaagcccctcactgtttattgtgtcaaggctagggcgcacactatggatgaaaagctcaataaatctagtgtgttttctgacgcagtatgcgagaagacaaagcctggcaacacctcgaaaatttggctgatcgtaggcatctgcatagccctatttgcgctgcctttcgtgatttacgccgctaaagtttttctgcggtgtatcaattatgtcttttttccatctctgaaaccaagctcttcaatagacgaatattttagcgagcagccactgaagaacctgttgctgtccacgtctgaagagcagattgaaaaatgcttcataatcgaaaatatctcaaccatcgcgactgttgaagagacaaatcaaaccgacgaggaccacaagaaatatagttcacagactagccaggactcgggcaactactcaaatgaggatgagtctgaaagcaaaacatcagaagagctccagcaggatttcgtctag

SEQ ID NO: 191625 - DNA, 1467 bp, Artificial Sequence
  Description of Artificial Sequence: Synthetic coding sequence
atggacaactggatcaagctgagcggctgccagaacatcaccagcactaagtgcaacttttcctccttaaaacttaacgtctatgaggaaatcaagctgcgtattagagccgagaaggaaaatactagcagttggtacgaggtagacagcttcacacctttccgcaaagcccagatcggccctcctgaggtgcacttagaagccgaggataaggctatcgtgatacacattagccccggcactaaggactctgtcatgtgggcattggatggattatccttcacttattcgctcgtgatctggaaaaacagtagcggagttgaggagagaatagaaaacatctacagccgacacaagatctacaaattgtcgcccgaaacaacttactgcctgaaggtcaaagcagccctgttaaccagctggaaaataggcgtttacagtcccgttcattgcattaagacaactgtggagaacgaactcccgccaccagagaatatcgaggtgagcgtccagaaccagaattacgtcctaaaatgggactacacctatgccaacatgacttttcaggtccagtggttacacgccttcctgaaaaggaaccccggcaaccacctgtacaagtggaagcaaatacctgactgcgagaacgtcaagaccacgcaatgcgttttccctcagaatgtgttccagaagggaatttatctgcttcgcgtccaggcttccgacggaaataacacatctttttggtccgaggagattaaatttgacactgaaattcaggctttcctgctgccccccgtgtttaatattcgatcattaagcgacagctttcatatttatatcggcgctcccaagcagtctggcaacactcccgtgatacaagactaccctttgatttacgaaattattttttgggagaacacatccaatgcagaacgtaagattattgagaaaaaaacagatgtgaccgtgcctaaccttaagccacttactgtgtactgtgtaaaagccagggcccacaccatggatgaaaagcttaacaagtctagcgtgttcagcgacgctgtctgcgagaagacaaagcccggcaacacctctaaaatctggctcatcgtgggcatctgtatcgcactctttgccctcccctttgtgatctatgcagccaaggtgtttctccgctgtatcaactatgtgttttttcctagccttaagccaagttcctcaatagatgagtactttagcgagcagccactgaagaatctactgctgagcacgtcggaggagcaaattgagaagtgcttcataatcgagaatatttcaacgattgccaccgttgaagagactaatcaaaccgacgaggaccacaagaagtattcaagccagacttctcaagactccggtaactatagcaacgaggatgaatctgaaagcaaaacatcagaggaactgcagcaggattttgtctag

SEQ ID NO: 191626 - DNA, 1491 bp, Artificial Sequence
  Description of Artificial Sequence: Synthetic coding sequence
atgatggtggtgctgctgggcgccaccaccctggtgctggtggccgtggccccatgggtgttgtctgcagcggcaggggggaaaaaccttaagagcccccagaaggtggaagtggacatcatcgacgacaactttatactgcggtggaataggtcagatgaaagtgtcgggaacgtgacattcagcttcgactatcagaagacaggaatggacaattggatcaagctgtctggatgccagaacatcacttccaccaagtgcaatttttcgtcactgaagttaaatgtttacgaggaaatcaagctgcgcataagagccgagaaggagaacaccagttcctggtacgaagtggactctttcactccatttcggaaagcacagatcggtcctcctgaagtgcacttggaggcagaggataaggccattgtgatccatatttcgccaggaacaaaggactcagtcatgtgggccctggacggcctgtcattcacatattcccttgtgatctggaaaaattcatctggcgttgaagagcggatcgaaaacatttattcacgacataaaatctacaaacttagccctgagaccacatactgcctcaaggtcaaagccgctctgctgaccagttggaaaatcggcgtttatagtccagtccactgcataaagaccaccgttgagaacgaactccccccgccggaaaatattgaggtatcggtccagaatcaaaattacgtgctgaaatgggattacacttacgccaatatgacattccaagttcagtggcttcacgcattccttaaacgtaatcctggcaatcacctatataagtggaagcaaatcccagactgcgaaaacgtgaagaccacacagtgtgtcttcccacaaaacgtatttcagaagggcatatatttgctgcgagtgcaggcgtcggatggaaataacacttcattttggtccgaggagatcaagtttgataccgagatacaggccttcctgctgccaccagtttttaatatccggtccctttctgatagtttccacatctacatcggggctcccaagcaatccggaaatacaccagtgatccaggactatccacttatttatgagatcatattttgggagaatacatcaaacgctgaaagaaaaatcatcgaaaaaaagactgacgtgaccgtccccaacctgaaaccactaaccgtgtattgcgtgaaagcaagggcgcacaccatggatgagaacgacgccgtgtgcgaatacttcagcgaacagcctctcaagaatctactactctccacatcagaggaacaaatcgagaaatgctttataattgaaaatatcagcaccatcgccaccgttgaggagaccaaccagaccgacgaagatcataaaaaatacagctcccagactagccaagattctggcaattattccaatgaggacgagtctgagtcgaaaactagcgaggagctccagcaggacttcgtctag

SEQ ID NO: 191627 - DNA, 1548 bp, Artificial Sequence
  Description of Artificial Sequence: Synthetic coding sequence
atgctgctgagccagaacgccttcatcttccggagcctgaacctggtgctcatggtctacatttcattagtcttcggcatctcttacgacagtcccgactatactgacgagagttgcactttcaaaattagcttaaggaatttcagatccattcttagttgggaactcaagaaccattctattgtgccaactcattatacacttctgtatacaatcatgtctaaacctgaggatctgaaggtcgtgaagaattgtgcgaataccaccaggagcttttgtgacctgaccgacgagtggcggagtactcacgaggcctacgtgacagtactcgaagggttttccggtaatactactctgtttagctgctcccacaatttttggcttgccattgatatgagttttgaacctcctgaattcgagatcgtaggtttcacaaaccatatcaacgtcatggtaaaattcccttccatcgtagaggaggaactgcagtttgacctgagccttgtgatcgaagagcagtccgaggggattgtaaaaaaacataagcccgaaataaaaggaaatatgagtgggaacttcacctatatcatcgacaagctaatacctaataccaactactgcgtgtctgtctacctcgaacattccgacgagcaggctgtgataaagtcgcccctcaagtgtacccttctcccgcccggccaggagtccgagagtgctgaatcggctaagatcgggggcattataacagtgttcttgatcgccctggtactgacctccacaattgtaacactaaaatggatcggctacatatgcctaaggaacagcctgcctaaggtccttaatttccacaactttttagcttggcccttccctaatctgcctccactagaggccatggacatggtagaagtcatttacattaatcgaaagaagaaagtgtgggattacaactatgatgatgaaagcgactccgatacagaggcagctcctcggacatcagggggaggctacacgatgcacgggcttactgtcagacctctcggccaggcaagcgccacgagtaccgagagtcaactcattgatccagagagcgaggaggaacctgatttacctgaggttgacgtggagcttccgaccatgcctaaggattcaccacaacaactggagcttctctctggcccttgtgagcggcggaagagccctctgcaggatccttttcctgaggaagactattcaagcactgagggatctggcggccggatcacatttaatgtcgaccttaatagcgtatttctgagggttctggatgatgaggactctgatgacctcgaagcccctctgatgctgtcatctcatctggaggagatggtggaccccgaggacccagataacgtccaaagtaaccacctgctggccagcggcgaagggactcagccaacttttccatccccctccagtgaggggctatggtctgaagatgccccatccgaccaatctgacacatccgagtccgacgtggatctgggggacggatacatcatgcggtag

SEQ ID NO: 191628 - DNA, 1548 bp, Artificial Sequence
  Description of Artificial Sequence: Synthetic coding sequence
atgctgctgagccagaacgccttcatcttccggagcctgaacctggtactcatggtttatattagtcttgttttcggcataagctacgattccccagattatacagatgagagttgcacctttaaaatatccctgcggaactttagatccatcttgagctgggagctcaagaaccactcaattgtccccacccattacacactcttatacacaatcatgtccaagcccgaagacctgaaggtggtaaagaattgcgcaaatactacacgctcattttgtgatctgacagatgaatggcgctcgacacacgaagcatatgtcacagtgctcgaaggcttctccggcaatacaaccctattcagctgctcgcataatttttggctcgccatcgatatgtctttcgagcccccagagttcgaaattgttggcttcacgaatcatatcaatgtaatggtgaagtttccttcaatagtcgaggaagaactacagtttgacttgtcactggttattgaggaacagtccgagggcatcgtgaagaaacataaacccgagataaagggaaacatgagcggcaatttcacctacattattgataagctgattccaaacaccaattactgcgtctctgtctatctcgagcattctgacgaacaggcggtaatcaaaagtcctctcaaatgcactttgctaccacccggacaggaatccgagtcagcagagagtgccaagattgggggcattatcacagtattcctcattgcattagtgctcacaagtacgatagttaccctgaagtggataggttatatctgtctgaggaattccctaccaaaggttctgaactttcataactttctggcctggcctttccccaacttgcccccgttggaggccatggacatggttgaggtgatctacatcaaccgtaaaaagaaggtgtgggactacaattacgacgacgaaagcgatagcgatacagaggcagcgccgaggaccagtggaggtggatataccatgcacgggttgaccgtgcgccccctggggcaggccagtgcaacctctaccgagagtcaactgatagaccctgaaagtgaggaggagcctgacctgccagaggtggatgttgagcttcctacaatgcctaaggattccccacagcagctggaactgttgtcagggccgtgtgaacgccgcaaatcaccccttcaagatcctttcccagaggaagactacagttctacagagggaagtggaggaagaatcacctttaacgtggatctaaactcagtgtttctgcgcgtgctggatgacgaggacagcgacgacctcgaggcgcctttgatgctctcctctcaccttgaggaaatggtggacccggaggaccccgacaatgtgcagtccaatcacctcctggcttccggggaagggacccaacctactttcccttctccttcatccgaaggactgtggagcgaggacgcgccaagcgaccaaagtgatacaagtgaatccgacgtggatctgggggatggctacatcatgcgatag

SEQ ID NO: 191629 - DNA, 996 bp, Artificial Sequence
  Description of Artificial Sequence: Synthetic coding sequence
atgctgctgagccagaacgccttcatcttccggagcctgaacctggttcttatggtgtacatcagcctggttttcggtattagctatgattcacccgattatacagacgagtcctgcacgttcaagattagcctcaggaatttcaggtcaatactgagctgggagctgaagaaccactcgattgtacccacccactacacgctcctgtacacaatcatgagcaagccagaggacttgaaggtggtaaagaattgcgctaacacaaccagatctttctgtgacctgaccgatgagtggcgcagtacccatgaagcctacgtgacggtactggagggcttctccgggaataccacgttattcagttgcagtcataacttctggctagctattgacatgtctttcgagcctcctgagtttgagatagtggggtttaccaatcacattaacgtgatggtcaagttccctagcatcgtagaagaggagctgcagtttgacctatccctcgtgattgaggaacagtctgaaggaatcgtcaaaaaacacaaaccagaaatcaaaggcaatatgagcggcaacttcacctacataattgacaagctgatcccaaacaccaattactgcgtgtccgtatatctggagcatagcgatgaacaggccgtcatcaagagtcccctgaaatgcacgttgctccccccaggccaggagagcgagtcagctgaatccgctaaaatcggcggcatcatcaccgtttttctgatcgcccttgtgctaacatcaacaattgtcacactaaaatggatcggctatatatgcctgcgtaactctttgcctaaagtgcttcgccaaggcctggccaagggatggaacgctgtagccatccaccgctgctctcacaacgccctgcaatccgagactccagaactaaagcagagcagctgtttgagctttccctcctcatgggactataaacgagcctcactgtgcccttccgattag

SEQ ID NO: 191630 - DNA, 996 bp, Artificial Sequence
  Description of Artificial Sequence: Synthetic coding sequence
atgctgctgagccagaacgccttcatcttccggagcctgaacctggtactgatggtctacattagtttagtgtttgggatcagttatgacagcccagactacaccgacgaatcctgcacatttaagatttctcttcgtaacttcagatccatactcagctgggaattaaagaaccactccatcgtacctacacattatactttactttacaccatcatgtcaaagccggaggatctgaaggtggtgaagaattgcgcgaatacaacccgcagcttctgtgatcttactgacgagtggcggtctacacacgaagcctatgtgaccgtgctcgaaggcttcagcgggaacacgactctgttctcatgctctcataatttttggctcgccattgatatgtctttcgaaccacctgagttcgagatcgtcggattcacaaatcacatcaacgtgatggtaaagttcccgagcatcgtagaggaagagttacaatttgacctctcgctggtcatcgaggagcagagcgaaggtatagtgaaaaagcacaagcccgaaataaaaggcaatatgtccggcaattttacatacataatcgacaagctcattcccaatacgaactattgcgtttccgtgtacctcgagcattccgatgaacaggctgtgatcaagagccccctaaagtgcactctcctgcctcccggacaggagtcggaaagcgctgaatcagccaagattggagggatcatcaccgtatttctcatagctctggtccttacctccacaatagtaacgttgaaatggatcggctatatctgcctccggaattccctgcccaaggttctgaggcagggcctggcaaaagggtggaatgcagtcgccatacacaggtgtagccacaatgccctgcagagcgagactcctgagcttaaacagtccagctgcctttcattcccctcatcatgggattataagagagcctcactctgtcccagcgactag

SEQ ID NO: 191631 - DNA, 561 bp, Artificial Sequence
  Description of Artificial Sequence: Synthetic coding sequence
atgctgctgaagagccccgagaacagcctgctgcagttccagttcaagtatggcgtacctactccaactaacgtgaccatcgagtcatataatatgaatccgatcgtctattgggagtaccagataatgccacaagtgccagtgtttacagtcgaggtaaaaaattacggtgttaaaaacagcgagtggatagacgcctgcattaacatttcacaccattactgcaatatcagtgaccacgtcggggatccttctaacagtttatgggtgcgcgtcaaagcaagagttggccagaaggaatctgcgtacgcgaagtctgaggagtttgctgtctgccgggatggcaagattggacctcctaaattggacatcaggaaagaagagaaacagattatgatcgacatattccatccatccgttttcgtcaatggtgatgaacaggaagttgactacgaccccgagactacctgctacattcgggtttataatgtctacgtgaggatgaacgggtctgaaatcaagaggtcctgcgccttttctcttttcagttttttcatctag

SEQ ID NO: 191632 - DNA, 1470 bp, Artificial Sequence
  Description of Artificial Sequence: Synthetic coding sequence
atggccctgctgttcctgctgcccctggtgatgcagggcgtgagccgcgccgagatgggcaccgcagatctgggacctagttctgtgcctactcccactaatgtcactattgagagctataacatgaacccaatcgtgtactgggagtaccaaataatgccccaagtgccggtattcaccgttgaagttaagaactacggagtcaagaacagcgagtggatagacgcttgcatcaacattagccaccactactgcaatatttcagatcacgtcggggatccatcaaactccctgtgggtgcgagtcaaagcccgggttggccagaaagagtccgcctatgcaaaaagtgaggaattcgctgtgtgtagagatgggaagatcggacctccaaagcttgacatacgcaaggaggaaaagcagatcatgatagacatctttcacccgagcgtgttcgtgaacggggatgagcaggaagtggattatgaccccgagaccacgtgttacataagggtgtataacgtatatgtccgcatgaacggatccgagattcagtataaaattctgacacagaaggaggatgattgcgatgaaattcagtgtcagctggcaatacctgtctcctccctgaattcacagtactgtgtttcagcggaaggcgtacttcacgtctggggtgtgaccactgagaagagcaaagaggtatgcatcacgatatttaatagctctataaagggatccctgtggattccagtcgtggctgcacttctgctgtttttggttctgtcactggtgttcatttgcttttatattaagaaaatcaacccattaaaggagaagtctatcatcctgcctaagagcctcatatccgtagtgagatccgcaaccctagagaccaagcccgagagcaagtacgtatcccttatcacgtcctaccagcccttcagcctggaaaaggaggtggtttgtgaagaacctctgtcccccgccaccgtgcccggcatgcataccgaagacaaccctggcaaagtggagcatacagaggaactcagtagcataactgaggttgtgaccactgaggagaacattccagatgtggtgcctggcagccatctcactccaattgaacgagagagtagcagtcccctatcttctaatcaatccgaaccaggatctattgccctcaattcctaccattctaggaactgctcagagtctgatcactcccgaaatggcttcgatacagatagctcttgtctggaaagccacagctccctgtccgatagtgaatttccccccaataacaaaggcgaaatcaagaccgaggggcaggaacttataaccgtaatcaaggcccccactagcttcggttacgacaagcctcacgtcctcgttgatctgttggtcgacgactcaggaaaggaatccttaataggttacagacccacagaagacagcaaagaattcagctag

SEQ ID NO: 191633 - DNA, 486 bp, Artificial Sequence
  Description of Artificial Sequence: Synthetic coding sequence
atgctgctgaagagccccgagaacagcctgctgcagttccagttcaaatacggggtccccacaccgacgaatgtgactatcgagtcttataatatgaatcctatcgtgtactgggagtatcagatcatgcctcaggttccagtgtttaccgtcgaggtgaaaaattacggtgtgaaaaactccgagtggatcgatgcctgtataaatatttcccaccactactgtaacatttccgatcatgtgggggatccctcaaacagcctctgggtgagagtaaaggctcgggtgggtcagaaggagtctgcctacgcgaaatccgaggaatttgcggtgtgccgagacggaaaaatcgggcctcccaaactagacattcgaaaggaggaaaagcaaattatgattgatatatttcacccttccgtgttcgtcaacggtgatgagcaggaggtagactacgacccggagactacttgttatatccgggtatag

SEQ ID NO: 191634 - DNA, 825 bp, Artificial Sequence
  Description of Artificial Sequence: Synthetic coding sequence
atggccctgctgttcctgctgcccctggtgatgcagggcgtgagcagagcagaaatgggcaccgcggacctggggccttccagtgtgcctaccccaactaacgtgaccattgagtcctataatatgaatcctattgtgtactgggagtatcagattatgcctcaggtgcctgtgtttacggtggaagttaagaactatggggtgaagaactctgagtggatcgacgcatgtatcaacatctcccaccattactgtaacatttctgaccacgtcggcgacccatccaatagtttgtgggttcgagtgaaggcccgggtgggccagaaagagtcagcttatgccaagagcgaagagtttgccgtgtgtagggatgggaaaatcggacctccaaaattagacattaggaaagaggagaagcaaatcatgatcgacatatttcaccctagcgtcttcgtcaacggagatgagcaggaagtagattatgacccagaaactacttgttacatcagggtatataatgtttatgtcagaatgaacggtagcgagatccaatacaagatcctgacccaaaaagaggatgactgtgacgagatacagtgtcagctggccattccggtttcatcattgaacagtcagtactgcgtttctgcagaaggcgtgctgcacgtctggggcgtgaccactgagaagagcaaggaagtgtgtatcactatcttcaactcctcaataaagggctccttatggatccctgtggttgccgctctgcttcttttctgtctggcttggtattcgtccgtgtttatcctgcgaaagctgattcactag

SEQ ID NO: 191635 - DNA, 633 bp, Artificial Sequence
  Description of Artificial Sequence: Synthetic coding sequence
atggccctgctgttcctgctgcccctggtgatgcagggcgtgagccgagctgagatgggtactgcggatctggggccttcttccgtccccacccccacaaatgtaacaatcgagtcctacaacatgaatcccattgtgtattgggagtaccagatcatgccacaggtgcctgtgttcaccgtagaggtgaagaattatggtgtgaaggcccgggtgggccagaaggagtcagcttacgcaaaaagcgaggaatttgctgtgtgccgcgacggcaaaatcggtccccctaaactggatattaggaaagaggagaagcagattatgatcgatatattccaccctagtgtcttcgtaaatggcgatgagcaggaagtggactacgatccagagactacatgttatatcagagtctataatgtttacgtgcggatgaatggcagtgagattcagtacaaaattctcacgcagaaagaggacgattgtgacgagatccagtgtcaactggctatccccgtatccagtctcaacagccaatattgtgtgtccgccgagggagtgctgcatgtttggggggtgacgactgagaagtctaaagaagtttgtattacaatttttaacagcagcataaaatag

SEQ ID NO: 191636 - DNA, 1386 bp, Artificial Sequence
  Description of Artificial Sequence: Synthetic coding sequence
atgcccacccccaccaacgtgaccatcgagagctacaacatgaacccaattgtctattgggagtaccaaataatgccccaagtcccagtgtttaccgtggaagtcaagaactacggcgtcaagaactccgaatggatcgacgcctgcataaatatctctcaccattactgcaacatctctgatcacgtgggagatccctcaaactccttatgggtaagagtaaaggcaagggttggacagaaagagagcgcttacgctaaatctgaggaatttgctgtctgcagggacggaaaaattggacccccgaagctcgacattagaaaggaggagaagcagatcatgattgacatctttcacccatccgtgttcgttaatggagacgaacaggaggtcgattatgacccggagacgacctgttatattagggtgtacaatgtgtacgtcaggatgaatggatcggaaatccaatataagatactgacccagaaagaagatgattgtgacgaaatccaatgtcaactggcaattcccgtgagcagcctgaattcccaatattgtgttagcgccgagggcgtgctgcacgtttggggggtgactaccgagaagtccaaggaagtgtgtattacgatctttaattcctctatcaaaggctcactgtggattcctgtggtggcggctctgctgctgttcctggttctgagcctggtgttcatttgcttttatatcaaaaagattaatcctttgaaggagaaaagtataatcctaccaaaatctctgatttctgtggtgcggagtgccactctggagactaagccagaatccaaatatgtgagcctgatcactagctaccaaccttttagtctggagaaagaggtcgtgtgtgaggagcccctgagccccgccaccgtcccagggatgcacaccgaggataatcccggaaaagtggagcacaccgaggaactgtcgagcattaccgaagtcgtgacaaccgaagaaaacatcccggacgtcgtgccaggatcacatctgacacctattgagagagagagtagctcacctctaagttccaaccagagtgagccgggttcaattgctctcaattcataccatagccggaattgctctgaatcagaccactctcgaaacgggtttgatacagattcaagctgtctggagtcacactctagcctctcagacagcgagtttccccctaacaataaaggagagattaaaactgagggacaggagctcatcaccgttatcaaagcgcctacctctttcggatatgacaagcctcacgttctcgtggacctgctggtggacgactcaggcaaggaaagcctaatcggctaccgacccacagaggattcgaaagagttctcctag

SEQ ID NO: 191637 - DNA, 1014 bp, Artificial Sequence
  Description of Artificial Sequence: Synthetic coding sequence
atgcggcccaccctgctgtggagcctgctgctgctgctgggcgtgtttgccgctgccgcggcagcgcccccagatcctctgtcacaactgcctgctcctcagcatcccaaaatacgtttgtataatgctgagcaggtgctgtcttgggagccggttgcccttagtaatagcacgagacctgtagtataccaggtgcagttcaaatatactgactctaagtggttcacggcggacataatgtccataggcgtaaattgtacccaaataacagcaaccgagtgtgatttcacagcagcttcgccatctgccggatttcctatggattttaacgttacactcaggcttcgcgccgagctaggtgcactgcacagcgcatgggtaactatgccgtggtttcagcattacagaaacgtgaccgtaggtccccctgaaaatatagaagtcactcctggcgaaggctcactgattatcagattcagctctcccttcgatatcgcagacacatccaccgccttcttttgctattacgtgcactattgggagaagggagggatacagcaggttaaaggaccattcaggtctaacagcataagtctggacaacctgaaaccttccagggtgtactgtctacaggtacaggctcaacttctctggaataaatccaatatttttcgcgtgggacacttaagtaacatcagttgttacgagaccatggctgacgctagtaccgagctgcagcaagtgatcctgatatccgtcgggacgttcagtctgctatccgtccttgccggcgcctgcttctttctggtgctcaagtatcgggggttaatcaagtattggttccacaccccgccatccataccactgcaaattgaggaatacctaaaagatcctacgcagcccatcctcgaagccctggacaaggacagcagtccaaaggacgatgtttgggacagcgtctccataataagcttcccagagaaagaacaggaagacgtacttcagacactgtag

SEQ ID NO: 191638 - DNA, 378 bp, Artificial Sequence
  Description of Artificial Sequence: Synthetic coding sequence
atgcacaaggaggagcacgaggtggccgtgctgggcccccccccctccacaattctccctagaagcactgtgattaacattcattccgagacctcagtgcctgaccacgtagtttggtccctttttaacactctgtttctcaattggtgctgtctaggctttattgccttcgcctattctgtcaagtcccgcgatcgcaaaatggtcggtgatgttacaggggctcaggcttacgcatctaccgcgaagtgcttgaatatatgggccctcatactcggaattttaatgaccataggctttatcctgctcctggtcttcggcagcgtgaccgtgtaccacatcatgctgcagattattcaagagaagcgtggctactag

SEQ ID NO: 191639 - DNA, 378 bp, Artificial Sequence
  Description of Artificial Sequence: Synthetic coding sequence
atgcacaaggaggagcacgaggtggccgtgctgggcccccccccctccaccatactcccgcggagcacagtgatcaacattcactcagaaacctcagtgcccgatcatgtagtgtggagcctattcaatactctgtttctgaattggtgttgccttggatttatagcgtttgcctacagcgttaaatctagagatcggaaaatggtgggtgacgttacgggcgctcaggcctatgcctcaaccgccaagtgcctgaacatctgggccctcatccttgggatcctgatgacaatcggatttattctgctacttgtgtttggttctgtgacagtgtatcatattatgctccagatcatccaagaaaagaggggctactag

SEQ ID NO: 191640 - DNA, 300 bp, Artificial Sequence
  Description of Artificial Sequence: Synthetic coding sequence
ccccagagccagaagatgcacaaggaggagcacgaggtggccgtgttggggcctcccccctcaaccattctccccagatcgaccgtgatcaacattcacagcgagacctctgttcccgaccacgttgttgttcccgtgcagcaccccctcttggaatgttgcttgggatttattgccttcgcctattccgttaaaagtagggatcggaaaatggtcggagatgttactggcgcacaggccctgcatcgtcaagtgcccgagcatttaggcccagatagcggccatcctcatgatcactag

SEQ ID NO: 191641 - DNA, 378 bp, Artificial Sequence
  Description of Artificial Sequence: Synthetic coding sequence
atgcacaaggaggagcacgaggtggccgtgctgggcccccccccctccacgatcttaccaaggtcgacggtgatcaacattcatagtgagacctcagtgcctgatcatgtggtgtggtcactttttaacaccttgttcctgaactggtgttgtttagggttcatcgcattcgcttactccgtcaaatctcgggatcggaagatggtgggggacgtaactggtgcccaagcttacgccagcactgctaagtgtctgaatatttgggctttaattcttggaatcctgatgaccattggattcatcctgcttttggtttttggatctgtaacagtgtaccatatcatgctgcagatcatccaggagaagcggggatattag

SEQ ID NO: 191642 - DNA, 495 bp, Artificial Sequence
  Description of Artificial Sequence: Synthetic coding sequence
atgaaccacatcgtgcagaccttcagccccgtgaacagcggccagccaccgaactacgaaatgttaaaagaggagcaggaggttgctatgctaggcgtgccgcataacccagccccccctatgtctaccgtaatccacattagatcggaaacatcggtgcctgatcacgtcgtcgttcccgtacagcatcctctgcatgagtgctgtctgggctttattgcattcgcctattctgtgaagagcagggacaggaagatggtcggcgacgtgacaggagcacaagcgctgcatcggcaagttcctgaacacctgggtccggactttggacatttgcacgatcattcggctcatcaccatccttcagtgggcaggccaggacccgccattgaccaggaagcctcattgcgacctggtgctcttcccgtcacttgcatacccagaacgctatcctcgatacctcgaccagcacctcgcggccaagaactatgcccatag

SEQ ID NO: 191643 - DNA, 399 bp, Artificial Sequence
  Description of Artificial Sequence: Synthetic coding sequence
atgaaccacatcgtgcagaccttcagccccgtgaacagcggccagccgcctaactacgaaatgctgaaggaggagcaggaggtggcaatgctgggtgtgccccacaacccggctccccccatgagcactgttatacacatacgttcagaaacatccgttcccgatcacgtggtatggtctctttttaatactctattcatgaacacttgctgcctggggtttatcgcattcgcttactctgtcaagtcccgcgatagaaagatggtaggagatgtcaccggggctcaagcgtatgcaagcacagctaaatgcctcaatatttgggccttaatcctagggatctttatgaccattctgttgattatcattccagtgctagtggtgcaggcccagagatag

SEQ ID NO: 191644 - DNA, 447 bp, Artificial Sequence
  Description of Artificial Sequence: Synthetic coding sequence
ccccccaactacgagatgctgaaggaggagcacgaggtggccgtgctgggagcccctcacaatccggcaccaccaacttcaaccgtcatccacattagatctgaaactagcgtccctgaccacgtggtagtgccagtgcagcaccccctgcacgagtgctgcctggggtttattgcattcgcctatagcgtaaagtcacgtgacaggaaaatggtgggggacgtgaccggcgcccaagccctccatcgccaggtgccagagcatctaggcccggatagtggccacccacacgaccacagcgcgcatagacatccatcagccgatctgccgggattgtggatcgaccaggaggcgagcctgcggcctggcgcactgcccatgacatgtatccctcgcacgccaacttccattccccgccccgctcccggcgctgaaagctgtatctag

SEQ ID NO: 191645 - DNA, 402 bp, Artificial Sequence
  Description of Artificial Sequence: Synthetic coding sequence
atgaaccacaccgtgcagaccttcttcagccccgtgaacagcggccagccgccaaattatgagatgttaaaagaggagcatgaggtggctgtcctcggggcacctcacaacccagctcctcccacgtcaacggttattcacatccgctcagagacctcagtgcccgatcatgtggtgtggtccctgtttaatactctgttcatgaacccctgttgcttagggttcattgcctttgcttactcagttaagagtcgcgatcgaaagatggtgggggacgttaccggagcacaagcttacgcatccactgccaagtgtctgaacatttgggctcttatccttggaattctcatgaccattcttctgattgtcatcccagtcctgatctttcaggcctacggatag

SEQ ID NO: 191646 - DNA, 3078 bp, Artificial Sequence
  Description of Artificial Sequence: Synthetic coding sequence
atgagcaacggctacagcaccgacgagaacttccggtacctgatctcttgtttccgggcccgcgtcaagatgtacatccaggtggagcctgtgcttgactatttgaccttcctgccagccgaggttaaggaacagatccagcgaaccgtagcgaccagcggtaacatgcaggccgttgaactgctcttgtcaacgctcgagaagggagtctggcaccttggctggacgagagagttcgttgaggctctgcgccggacaggaagtccactcgccgcccggtacatgaatcccgaacttacagacctgccaagccccagcttcgagaacgcgcatgatgaatacctccagttgctgaacttgctgcagccaaccctggttgacaagctcctggtgagggacgttctggataagtgtatggaggaggaactgctgaccattgaagaccggaatcgtatcgccgctgcagagaacaacggcaacgaatcgggagtcagggaactgctgaagaggatcgtccagaaagaaaactggttctctgcctttcttaacgtgctgaggcagaccggtaacaacgaactggtgcaggagctgactggatcagactgctcagagagcaacgcggagattgaaaatctttcacaggtggatgggcctcaggtggaagaacagctgctgtcaacaactgtgcaacctaatcttgagaaagaagtctggggaatggagaacaattcgtccgaatcctctttcgccgattcgagcgtcgtgtccgagtcggacacctctttggccgaaggatcagtaagctgcctcgacgagtctttgggccataattcgaatatgggctccgacagtggcacaatgggaagtgactccgacgaggaaaatgtcgccgccagagcttctccagagcctgagctgcagctccggccctaccagatggaggtcgctcagcctgcattggaaggcaaaaatattatcatatgcctgcctactggctctggtaagaccagggtagcagtctacatagctaaggatcatttggataagaagaaaaaggctagcgagccgggcaaagtcatcgtactcgtcaacaaagttctgctcgtggaacagttattcaggaaggagttccagcctttcctgaagaaatggtatcgagttatcggcctgtcgggagacacccaactgaagatctccttccccgaagtggtgaaatcatgcgacataatcatatccactgcacagattcttgaaaactccttgctgaacttggagaacggcgaagatgccggggtacagctgtctgatttttcactgatcatcattgatgagtgtcatcacactaataaggaggctgtgtacaacaacattatgaggcattacttgatgcagaagctgaagaacaaccgccttaagaaagaaaacaaacccgttattccccttccgcaaatactcggtctcaccgcgagcccaggggtggggggcgctaccaaacaggccaaagccgaggagcatatccttaagctttgcgctaacctggacgcctttaccatcaaaacagtcaaggaaaatctcgaccagttaaaaaaccagatacaggaaccctgtaaaaaattcgcaatcgccgatgctactagggaggatcctttcaaggaaaaactgctggagatcatgacgcgcatccaaacatattgtcaaatgagtcctatgtcagactttggcacacaaccctatgaacagtgggccatccaaatggaaaagaaggcagcgaaagagggcaaccgtaaggagagggtgtgcgctgagcatctgagaaaatacaacgaagcactccagataaacgacacaattagaatgatcgatgcatacacccacttagaaacattctacaacgaagagaaagataagaagtttgccgtgattgaagatgatagtgacgaaggcggtgatgatgagtactgcgacggcgatgaggatgaggacgatttgaaaaagcctctaaagctggacgaaactgaccggtttctgatgaccctgttttttgaaaataacaaaatgctcaagcggctagccgaaaacccagaatacgaaaacgaaaagctcaccaaactgcggaacaccattatggagcagtatacgcgaacagaggaaagcgcccgcggtatcatttttaccaagactcgacagtccgcttatgccctatctcagtggattactgagaatgagaagtttgctgaagtaggagtgaaggcgcatcacctaattggggctgggcactcatcagagtttaaaccaatgactcagaacgaacagaaagaggtgatttccaaatttcgtaccggcaaaatcaatctgctcatcgcgaccaccgtggccgaggagggcctggatataaaggaatgcaacatcgttataaggtatggccttgtaactaatgagatagctatggtgcaggccaggggacgggcccgcgccgatgagtccacttacgtcttagtcgctcactctggcagtggagtgatcgagcatgaaaccgtgaacgatttcagggaaaaaatgatgtataaagccattcattgcgtgcagaacatgaagcccgaggaatacgcccacaaaatactcgagttgcagatgcaaagcattatggagaaaaaaatgaagaccaaacgcaatatagcaaagcactataagaacaaccccagcctcatcacattcctgtgcaagaactgtagcgttctcgcttgtagtggcgaggatatccatgtaatcgaaaagatgcatcacgtcaatatgacccccgaattcaaagagctctatattgttagagagaacaaagcactgcagaaaaagtgcgccgactaccaaataaacggcgagataatctgcaagtgtgggcaggcctggggcactatgatggtacataagggcctcgatctaccatgcctgaaaatccgaaatttcgtggtagtgtttaagaacaattctaccaagaagcagtacaaaaagtgggtagagttacccattacatttcctaacctggattattccgaatgctgccttttcagcgatgaggactag

SEQ ID NO: 191647 - DNA, 666 bp, Artificial Sequence
  Description of Artificial Sequence: Synthetic coding sequence
atgagcaacggctacagcaccgacgagaacttccggtacctgatctcctgttttagagcccgggtaaaaatgtacatccaggtggagcccgtgttagactatctcacctttctgcccgctgaggtcaaggagcaaattcaaagaaccgtagcaactagtggcaacatgcaggccgttgagctcctgctgtcaacattggagaagggggtatggcatctgggctggactagagagttcgtagaggccctgagacgtacggggagcccactggctgcccggtatatgaatccagaactcacagatctaccaagtccaagttttgagaatgcccacgacgagtacctgcaactgctaaatctgctccagcctaccttggtggataagcttctcgtaagggatgtgctggacaagtgcatggaggaggaattgttgactatagaggacaggaatcggatcgccgcggctgaaaacaatgggaacgagagtggtgttcgggagctgcttaagcgtatagtgcagaaagagaactggttctccgcattcctgaatgtgttgcgacaaaccggtaacaatgagcttgtccaggagctcactggcagtgactgcagcgaaagtaacgcggggatctgcaacttcaccgaggaagacagctccaatagtgcatag

SEQ ID NO: 191648 - DNA, 3078 bp, Artificial Sequence
  Description of Artificial Sequence: Synthetic coding sequence
atgagcaacggctacagcaccgacgagaacttccggtacctgatcagctgtttccgagcgcgcgttaagatgtacatccaagttgagccagtactagactatctgaccttccttcctgcagaggtgaaagagcagattcagcgaacagtggccacttctggcaatatgcaagcggtggagctgctcctctcaaccttggaaaaaggcgtgtggcacctgggctggacacgcgaatttgtcgaggccctccgaagaaccggatccccccttgccgccaggtatatgaatcccgaactgactgacctcccttccccgagttttgaaaacgcccacgatgagtacctccaactactgaacctactgcagcccactctggttgataagctgctggtccgggatgtgctggacaaatgcatggaagaagaactgttgacaattgaagatcggaacaggattgcggccgctgaaaacaacggtaatgaaagcggggtccgggagctgttaaagagaattgtccagaaggagaactggttctccgccttcctgaacgttttgaggcagaccggcaataacgagcttgtacaagagttgaccgggagtgattgctctgagtccaatgcagaaatcgagaatcttagccaggtggacgggccccaggtggaggagcaactgctctccacaaccgtacaaccaaacctggaaaaagaggtgtggggtatggagaacaactcatctgaatcgtcattcgctgattcctctgtagtctcagaatccgacacgagccttgcagaggggagtgtgtcatgccttgatgaaagtcttggccacaactcaaacatggggtccgactcaggcacaatgggaagtgacagcgatgaagaaaacgtggctgcccgtgcgtccccagaaccagagctgcagctgcgaccctaccagatggaggtggcgcaacctgcgctcgagggcaagaacatcattatatgtctccccaccggatccgggaagactagagtcgctgtctatatcgccaaagaccatctggacaaaaaaaaaaaagcgtcggagcctggaaaagttatcgtgctggtgaataaagttctactggtcgaacagctctttcggaaagaattccagcccttcctgaagaagtggtatcgcgtcattggcttgtctggggacacacagctgaagatctcgtttccggaggtggtgaagagctgcgacattatcatttccactgcacagatcctcgagaatagtctgttgaacctcgagaacggcgaagatgccggcgtgcagctcagcgatttcagtctcatcatcatcgacgagtgccaccacaccaacaaggaggccgtttacaataatatcatgcgacattatctcatgcagaagctgaagaataatcgactcaaaaaagaaaacaagcctgtgatccccctgcctcagatcctgggccttacagcctcccctggcgttgggggggccactaagcaggccaaggctgaggagcacatcctgaaattgtgtgccaatctcgacgccttcactatcaaaacagtgaaagagaacttggatcagctaaaaaaccaaatccaagaaccatgcaagaaattcgctatcgcagacgccacaagggaagatccttttaaagaaaaactgctcgagattatgaccagaattcagacctactgtcagatgagcccaatgtccgattttggtacccagccgtacgaacagtgggccattcagatggagaagaaagcggccaaagagggcaatcggaaggaacgggtatgcgctgaacatctcaggaagtacaatgaagccctgcaaattaacgacaccattcggatgatcgatgcctacacccatctggagacattctataacgaagaaaaagacaagaaattcgccgtcatcgaggatgactctgatgaggggggggatgatgagtactgtgacggggatgaagacgaagatgacctaaagaaacctttgaaactggacgagacagaccggttcctaatgacactttttttcgaaaacaacaagatgctcaaacgtttggcggaaaaccccgagtatgagaacgagaaattgactaaactccgcaacacaattatggaacagtacacacgcactgaagaatccgcacggggaatcatttttacaaaaactcgccagagcgcttatgccctttcccaatggataactgaaaatgagaaattcgctgaggtaggcgtcaaagctcaccacctcattggcgcaggccattcaagtgagttcaaacccatgacacagaacgagcaaaaggaagttatatcgaaatttcgcaccggtaaaatcaatctgctgattgcaaccacagtcgccgaggaaggcctagatatcaaggaatgtaatatcgttatcaggtacggcctggtgactaatgagattgcaatggtccaggccagagggcgcgccagggccgacgagtcaacttacgtccttgttgcccacagcgggagcggagtgattgagcatgagacagtcaacgactttcgagaaaaaatgatgtacaaagccattcactgtgtgcaaaatatgaagccggaggaatacgctcacaagatcctggagctccagatgcagtctataatggagaagaagatgaaaacaaagcgcaatatcgcaaagcactataaaaataacccctctctgataaccttcctttgtaagaattgctccgtgctggcctgttctggggaggacatccacgttatcgagaagatgcatcatgttaatatgacaccagagttcaaagaactttatattgtccgtgagaacaaggccctccagaaaaaatgtgcagactaccaaatcaacggtgagattatctgcaaatgcggacaggcttggggtaccatgatggtgcataagggcctcgatctgccttgtctgaagatcagaaactttgtcgtagtcttcaaaaataatagcacaaaaaagcaatataaaaagtgggttgagctgccaataacatttccaaacctcgactacagtgagtgttgcctgttttccgacgaagactag

SEQ ID NO: 191649 - DNA, 1050 bp, Artificial Sequence
  Description of Artificial Sequence: Synthetic coding sequence
atgcccgtggagcggatgcggatgcggccctggctggaggagcagataaacagcaacaccatccccgggctgaagtggcttaacaaggaaaagaaaatattccaaattccatggatgcacgcagcgcgccatggctgggacgtggaaaaggacgctcccttgttccgaaattgggccattcataccggtaagcatcagcccggagtagacaagccagaccccaaaacctggaaagccaacttccggtgtgcgatgaattccctccctgatatagaggaagtcaaggataagtcgattaagaaagggaacaacgcattccgcgtataccggatgttgcccctgagtgaacggccatcaaaaaaagggaagaaaccaaagaccgaaaaggaggacaaggtaaagcacatcaaacaggagccggtggagtcatcgctgggtctgtcaaacggcgtcagcgacctgagccccgaatacgctgtcctgacatccacaattaaaaatgaagtggacagtaccgtgaatatcatcgtggtcgggcagtcccatctggattccaacatcgaaaatcaggagattgtgaccaacccccctgatatctgccaggtggtagaagtgaccactgaaagtgacgagcagcctgtttcaatgtcagagctgtaccccttacaaatatctcctgtgagttcctacgccgagtctgaaaccacagattctgttccctccgacgaggagtccgcagagggacgcccacattggagaaaacgcaatattgaaggcaaacagtatctctccaacatggggacccgagggtcttatttgctccccggaatggccagttttgtgaccagcaacaagccggaccttcaggtcactattaaggaagaatccaaccccgtgccgtacaactccagctggccaccattccaagatctacccctttcctcctctatgacccccgctagttctagcagtcgccctgatagggagacccgcgcatcagtgattaagaagacttccgacatcacgcaagccagagtcaaaagctgttag

SEQ ID NO: 191650 - DNA, 414 bp, Artificial Sequence
  Description of Artificial Sequence: Synthetic coding sequence
atgcccgtggagcggatgcggatgcggccctggctggaggagcagataaatagtaacactattcccggcctgaagtggctgaataaagagaaaaagatattccagattccctggatgcatgccgccaggcacgggtgggatgtcgaaaaggacgcaccattatttaggaattgggcaatccataccggaaagcatcagcccggagtagataagccagatcctaaaacatggaaagcgaattttcgctgcgccatgaattcactgcccgatatcgaggaggtgaaggacaaatctatcaaaaaggggaacaacgcctttagagtgtacagaatgttacccctgagtgaaaggcccagtaagaaaggtaaaaagcctaaaaccgagaaagaggataaagtgaagcatattaagtag

SEQ ID NO: 191651 - DNA, 414 bp, Artificial Sequence
  Description of Artificial Sequence: Synthetic coding sequence
atgcccgtggagcggatgcggatgcggccctggctggaggagcagatcaattcgaacacgattccaggcctcaagtggctgaacaaggagaagaagattttccagatcccctggatgcacgccgccaggcacggatgggatgtggagaaggacgctccactcttccggaattgggccattcatactggcaagcaccagcccggggtggacaaaccagacccaaagacctggaaggccaattttcgctgtgcaatgaatagtctccccgacatagaagaagttaaggacaaaagcatcaagaaaggcaataacgcctttagggtttataggatgctcccactgtcagagcgcccttcaaagaaaggaaaaaagccaaagacagaaaaggaggacaaagtgaagcacattaagtag

SEQ ID NO: 191652 - DNA, 531 bp, Artificial Sequence
  Description of Artificial Sequence: Synthetic coding sequence
atgcccgtggagcggatgcggatgcggccctggctggaggagcagatcaattccaacacaatccccggactcaagtggctaaacaaagaaaaaaagattttccagatcccatggatgcacgcggcgcggcatggctgggatgttgaaaaggacgcacctttgtttcgcaactgggcaatacacacggggaaacaccaacctggggttgataagcctgatcccaaaacttggaaggccaactttcggtgcgcaatgaactcactcccagacattgaggaggtcaaggacaagagtatcaagaaaggtaacaacgcttttagggtgtatcgcatgcttccattgagcgaacgaccctccaaaaaaggcaagaagcccaaaactgagaaagaggacaaagtgaagcatatcaagcaggagcctgtggaatccagcctgggactctctaacggggtgtctgatctttcgccagaatatgccgtcctgacttctaccataaagaatgaagttgatagcaccgtgaatatcatctag

SEQ ID NO: 191653 - DNA, 486 bp, Artificial Sequence
  Description of Artificial Sequence: Synthetic coding sequence
atgcccgtggagcggatgcggatgcggccctggctggaggagcagattaattccaatacgatccccggacttaaatggctgaataaagagaagaaaattttccagattccttggatgcatgccgccaggcacgggtgggacgtggagaaagatgcaccactgttccggaactgggcaatccatacaggcaagcaccaaccgggcgtcgataaacccgatcccaaaacttggaaagctaactttcgctgcgcgatgaattcattgcccgacatagaggaagtcaaggacaagtctattaaaaagggaaacaacgcatttcgcgtgtacagaatgctcccactgtccgaacggccctcaaaaaaaggaaagaagcccaaaacagagaaggaagacaaagtaaaacacattaagcaggaacctgttgagtccagcctgggactgagcaacggagtcagcgatttgagtccggaatacgccgtcttgtag

SEQ ID NO: 191654 - DNA, 1284 bp, Artificial Sequence
  Description of Artificial Sequence: Synthetic coding sequence
atgggcacccccaagccccggatcctgccctggctggtgagccagctggatctgggacaattggagggggtggcctgggttaataaatctcggacccggtttaggataccttggaagcacgggctgaggcaagacgctcagcaagaggactttggtatctttcaagcatgggctgaggccaccggcgcatatgttccaggaagggacaagccagacttgcccacttggaaaaggaatttcagatcagccctcaataggaaggagggtttgcggctggctgaagatcggtcgaaggatcctcacgacccccacaaaatttacgaatttgtgaattctggggtgggcgattttagtcagccagatacgtccccggatacaaatggtggaggctctaccagcgacacccaggaggacattttagacgaactcctgggaaatatggtgctggcaccactgcccgatcccggacctcccagtctggctgtggcgcccgagccctgcccacaaccactcagaagcccttcactggacaatcctacacccttcccaaacctaggacccagtgagaacccacttaaacgattgttggtgcccggggaagaatgggaatttgaagtgaccgcattctaccgcggaagacaagtcttccagcagaccattagctgtccggaaggcctgagattggttgggagcgaggtgggtgacagaacactgccaggctggcctgtgactttgcctgatcccgggatgtccttaacggatcgtggagttatgagctatgtccgccatgtgctaagctgtctcggaggcgggttggccttgtggcgggcaggacaatggctgtgggcccagagactgggtcattgtcacacttactgggccgtttcagaggagctactccccaactcaggccatggccctgatggggaagttcctaaggacaaggaaggtggcgtgttcgacctgggtccctttatagttgaccttatcacttttactgaaggctctggcaggtcaccacgctacgccttgtggttttgcgtgggggagtcatggccccaggaccagccttggaccaaacgcctggttatggtgaaagtagtgcccacctgtcttagggcactcgttgaaatggccagggtgggaggcgcctcctcgctggaaaatacagtcgacctgcacattagtaattctcatccactgtccctgacatcagatcagtacaaagcatatttacaggatctggttgaagggatggattttcaaggacctggcgagtcctag

SEQ ID NO: 191655 - DNA, 903 bp, Artificial Sequence
  Description of Artificial Sequence: Synthetic coding sequence
atgggcacccccaagccccggatcctgccctggctggtgagccagctggatcttgggcagttggaaggagttgcctgggtgaacaagtctaggacacggtttagaatcccctggaaacacgggttgaggcaggacgcacagcaggaggacttcggcatattccaggcctgggctgaggccacaggcgcgtacgtgccagggagagataagcccgatctgcctacctggaagcggaacttcaggtctgccctgaatcggaaagaagggctgagacttgcagaggatcggagcaaagatccacacgatccacacaaaatctatgagtttgtgaatagcggcgtaggcgatttctcccaacccgacacttctccagacacgaacggaggcggaagtacatccgacactcaggaggatatactagatgagctgctgggcaacatggttctggcccccttgcctgaccccgggccacctagcctcgccgtggcaccggaaccgtgcccccagccgctgaggtctccctctctggacaacccaacccccttcccgaacctaggacccagtgaaaatcccctgaagaggctgctagtgcccggagaggacttgattacctttactgagggaagtggccggtccccccgatacgcactttggttttgcgtcggcgaatcctggccacaggatcaaccttggacaaaaaggctggtcatggttaaagtagtgcctacgtgtctgcgggcattggtagaaatggcacgcgtagggggcgcgagcagccttgagaacaccgttgaccttcatatcagtaatagccaccctttgtccctcacctctgaccagtacaaggcatatctccaggacctggtggaaggaatggacttccagggacctggcgaaagttag

SEQ ID NO: 191656 - DNA, 1284 bp, Artificial Sequence
  Description of Artificial Sequence: Synthetic coding sequence
atgggcacccccaagccccggatcctgccctggctggtgagccagctcgacctggggcagctagaaggcgttgcctgggtgaataaaagtagaacacggttccgcataccatggaaacatgggctgagacaagatgcacaacaggaagactttggtattttccaggcgtgggctgaagcaacaggagcgtatgtccctggccgcgataagcccgacctcccgacatggaaacgaaacttcaggtcagctctgaaccgcaaggaggggttgagacttgctgaggatcggtccaaggacccacatgaccctcacaaaatctatgagttcgtgaacagcggggtcggcgatttttcccaacccgacacttcacctgatacaaacggcggaggaagcacaagcgatacgcaagaggatatactggacgagctactcgggaacatggtgctggctcccctgccagaccccggaccgcctagtttggccgttgctccggagccatgtcctcagccgctcagatcgcctagtctggacaacccaacaccttttcccaacctgggaccgtcagagaaccccctgaaaaggcttctggtgcctggggaggagtgggaatttgaagtaacggccttctatagaggccgacaagtgtttcagcagactattagttgcccggaaggactgcggctggttggcagcgaggtaggtgacagaaccctccctgggtggcccgtaaccctcccggaccctggcatgtctctgaccgaccgaggcgtgatgtcgtacgtccgccatgtcttatcctgcttgggtggaggcctggccttatggagggcaggacagtggctctgggcacaacgacttggacattgccacacgtactgggcagtgagcgaggagctgttgcccaacagcggccacggccccgacggagaagttcctaaagacaaggagggcggagtgttcgacctgggtccattcatcgtcgacctgataacattcactgagggttccggccggtccccccgctatgctctttggttctgcgtgggcgaatcatggccccaggatcagccatggactaagaggctggttatggtcaaggtggtgcccacatgcttgcgggcgctggtggaaatggcgcgggtggggggagcttctagcctggagaacaccgtggacctccatatcagtaacagccacccacttagtttaacctccgatcaatacaaagcgtacctacaggacttggtggaagggatggacttccaaggccccggcgaatcctag

SEQ ID NO: 191657 - DNA, 315 bp, Artificial Sequence
  Description of Artificial Sequence: Synthetic coding sequence
atgggcacccccaagccccggatcctgccctggctggtgagccagttagatctcgggcagctcgagggtgtggcctgggtgaacaaatccagaacacgatttcgcataccttggaaacacggcttgaggcaggacgcacagcaggaggattttggcattttccaggagttaggaacctttccctcacaaacacccctgaggactcccatggtggaggccgtgttactgatccctcgcaagactttttggatgtcctactgggtgacttggtgctggccgcacagtcagatcagagatccacaggcgtggctctag

SEQ ID NO: 191658 - DNA, 846 bp, Artificial Sequence
  Description of Artificial Sequence: Synthetic coding sequence
atggtgctggcccccctgcccgaccccggcccccccagcctggccgtcgcccccgagccctgtcctcagccccttagaagcccctccttggataatcctactccgtttccaaacctgggcccatccgaaaatccactgaagcgcctgctggtgccgggtgaggagtgggaattcgaagtgactgccttctaccggggccgacaggtgttccagcagactatttcctgcccagagggattacgcctggtggggtcagaagtcggggatcggaccctgccggggtggccagtcacacttccggaccccggaatgtcactcactgatcgaggcgtgatgagctatgtccgccacgttctgagttgcctgggcgggggtctggccctctggagagctggacaatggttgtgggcccagcgtttggggcattgccacacttactgggcagtctctgaggaattgctgccaaattccggccatggccctgatggggaggtgccaaaggacaaggaaggtggcgtttttgatctgggacccttcattgtggaccttattactttcacagagggttccggacgatccccgagatacgcgctgtggttctgcgtgggtgaaagctggccacaggatcagccgtggacaaaacggctcgtgatggtgaaggtggtgcccacctgtctcagagcactggtcgagatggccagagtcggcggcgctagcagtctggagaacacagtcgatctgcacatttcaaattcccatccactttccctgacttctgatcagtataaagcttacttgcaggacttagtcgaggggatggacttccaaggaccaggtgaatcctag

SEQ ID NO: 191659 - DNA, 465 bp, Artificial Sequence
  Description of Artificial Sequence: Synthetic coding sequence
atggtgctggcccccctgcccgaccccggcccccccagcctggccgtggcgcctgagccgtgcccacagccattgagaagcccatccctggacaatccaaccccctttcctaatcttgggccttccgaaaaccctctaaagcggttgctagtgcccggggaagatctgatcaccttcaccgaagggtctgggaggtctccccgctatgcattgtggttctgtgttggtgagtcatggcctcaggaccagccatggacaaaaaggctcgtcatggtcaaggtggttcccacatgtctgcgcgcccttgttgaaatggccagagtagggggtgcatcctctctggaaaatacagtggatcttcacatttcaaatagccaccctctgtctctgacctcagatcagtataaggcctaccttcaggacctggtagagggaatggacttccagggacctggcgagagttag

SEQ ID NO: 191660 - DNA, 846 bp, Artificial Sequence
  Description of Artificial Sequence: Synthetic coding sequence
atggtgctggcccccctgcccgaccccggcccccccagcctggccgttgcccccgagccctgcccacagcccctcagatccccctctctcgacaatccaaccccattccccaatctcgggccatctgaaaacccgctaaaacgactgctcgtccctggcgaggagtgggaattcgaggttactgcattttatcggggccgccaggtcttccaacagactatttcttgtcctgagggactccgactcgtgggctctgaagtgggggaccgaacccttcccggatggccagtcacacttcccgacccgggcatgtccctgaccgaccggggagttatgtcatatgtgagacatgtcctttcctgcctcggtgggggacttgcattgtggcgggctggtcagtggctgtgggcccagcgacttggacattgtcacacctactgggccgtgtcagaggagctccttccgaactctggccatggccctgacggcgaggtaccaaaggataaagagggtggcgtattcgacttaggcccttttatcgtggatcttatcacatttaccgaaggaagcggacgttccccacgctatgccctttggttctgtgttggggaaagctggccccaagaccaaccttggacaaagcgcctggtgatggtgaaggtagtgccgacctgtcttagagctctggttgagatggctcgggtaggtggcgccagtagtctcgagaatactgtggatctccatatctccaacagccatcccctgtctctcacaagtgatcagtataaagcgtatttgcaggacctcgtggaaggaatggactttcagggccccggggagtcttag

SEQ ID NO: 191661 - DNA, 903 bp, Artificial Sequence
  Description of Artificial Sequence: Synthetic coding sequence
atgggcacccccaagccccggatcctgccctggctggtgagccagctggacctgggacagctcgaaggagtggcttgggtgaacaaatcaaggacacgcttccgaattccctggaaacacggcctccgccaggatgcgcagcaggaggacttcggtattttccaggcttgggctgaagctacgggggcctacgtccccggacgggataaaccggacctcccgacttggaaaaggaactttcggtctgctctgaataggaaggaaggactgcggctcgcagaggaccgctctaaggatcctcacgatccacataagatttatgagtttgttaactcgggggtgggagacttttcccagccggacacttcccccgataccaacggaggcggctccactagcgacacacaggaggatatcctggatgaattgctgggtaatatggtacttgctccattaccagacccgggccctccgagtttagccgtggcacccgagccatgcccccagcctctgcgctccccaagtttagataacccaacaccctttcctaacctgggccccagcgagaacccactaaagcgcctgctggtgccaggtgaggacctgatcaccttcaccgagggatctgggcggagccctaggtacgccttgtggttctgtgtgggagagagttggcctcaggaccagccgtggaccaagaggctggttatggtgaaagtcgtgcctacttgccttcgagctctggtggaaatggcccgggtgggcggcgcttcctctctcgagaacacagtcgatctgcatatatctaatagtcatccactaagcttaacaagtgaccaatacaaggcctatttgcaggacttggtagagggcatggattttcaggggccaggagaaagctag

SEQ ID NO: 191662 - DNA, 465 bp, Artificial Sequence
  Description of Artificial Sequence: Synthetic coding sequence
atggtgctggcccccctgcccgaccccggcccccccagcctggccgtagctcctgagccctgcccccagccactgcgatctcccagtctggataacccaactccttttccgaatctcggcccttctgagaaccctttgaagcgcttgctggttcccggggaagatcttattacattcacagaaggatctgggagatctccacgatatgcattatggttctgcgttggggaaagttggccgcaggaccagccctggacgaaaaggctggttatggtgaaagtggttcctacgtgccttcgcgcgcttgtagaaatggctagagtgggtggcgcctcatcactggagaataccgtcgacctacacatttcaaatagccatccactcagtctcacctccgatcaatataaggcatatcttcaggatctggtcgaggggatggacttccaggggccgggtgagagttag

SEQ ID NO: 191663 - DNA, 1404 bp, Artificial Sequence
  Description of Artificial Sequence: Synthetic coding sequence
atggccctgcacccccggcgggtgcggctgaagccctggctggtggctcaggtggacagcggactgtatcctggattgatttggttgcatagagatagcaaaagattccagatcccgtggaagcacgccacccgtcattcccctcagcaggaggaggaaaacacaatttttaaggcatgggccgtcgaaactgggaaataccaggaaggggtagacgaccccgatccggccaagtggaaggcacaactgagatgcgctctgaataagtcacgcgagtttaatttgatgtatgacggaacaaaggaggtgccaatgaacccagtaaaaatctatcaggtgtgtgacataccgcagccacaaggttccatcatcaaccctggttccaccgggtccgctccctgggacgaaaaggataacgatgtggacgaagaggacgaggaagacgagctggaccagtcccagcaccatgttccaatccaggataccttccccttcttgaacatcaacggatcaccgatggctcctgcctctgtggggaattgtagcgtggggaattgctcgcccgaggcagtttggcctaagaccgagcccttagagatggaagtgccccaggcaccaatccagcctttttacagctcccccgagttatggatctcctctcttcccatgacagatcttgacataaagttccaatacaggggaaaggaatatggccagaccatgacagtgtctaatccccaaggctgccggcttttttatggtgatctaggcccgatgcccgatcaagaggagctgttcggacccgtgagtctcgaacaggttaagttccctgggccagagcatattaccaacgagaagcagaaactctttacaagtaaactgctcgatgttatggatagaggactgatcctggaagtgtctggacacgctatctacgctattaggctgtgtcagtgcaaggtgtactggtccggcccgtgtgcgccatcactagtggcccctaaccttatcgagcggcaaaagaaagtgaaactcttctgcttagaaacattcctctccgacttaattgctcatcaaaagggccaaatcgagaagcagccaccgttcgaaatttatctttgtttcggagaggagtggcccgacggcaagcccctcgaacgcaaattaatccttgtgcaggtaattccagtcgtcgctagaatgatatatgagatgtttagcggcgactttacccgcagctttgattctggatccgtgaggttgcagatctccacaccagacatcaaggataatatcgtggctcaactcaaacaattataccgtatcctccagacgcaggaaagctggcagccaatgcagcccacacctagtatgcagctgcccccagctctaccaccccagtag

SEQ ID NO: 191664 - DNA, 831 bp, Artificial Sequence
  Description of Artificial Sequence: Synthetic coding sequence
atggccctgcacccccggcgggtgcggctgaagccctggctggtggcccaggtggattcagggctttaccctgggctaatctggctgcatcgggatagcaagaggttccagattccctggaaacacgctacccgccatagtccacaacaggaggaagagaacacaattttcaaagcgtgggctgtcgaaaccggtaaataccaggagggcgtggatgaccccgatcctgctaaatggaaagctcagctccggtgtgccctcaataaatcaagagaattcaacctcatgtatgatggaacaaaagaggtccccatgaaccccgtaaagatctaccaggtttgcgatatcccgcagcctcaggggagcattatcaaccccggctccacaggatcggcaccttgggacgagaaagataacgatgttgacgaggaggatgaggaagatgagctcgatcagagccagcaccacgtgccaattcaggacacgttcccttttctaaatatcaacgggtctcctatggcccctgctagcgttggcaattgtagtgtagggaactgctcaccggaggctgtatggcccaagaccgagcctctagaaatggaggtaccacaagcgcccattcagcccttctattcctcaccagaactctggatttccagcctgcctatgactgatctcgacatcaaattccagtaccgcggaaaagagtacggccagactatgacagtgtccaaccctcagggctgtcgactgttctatggagatctcggtcccatgccagaccaggaagagcttttcggtccagtgtcactggaacaggtcaaattctag

SEQ ID NO: 191665 - DNA, 1119 bp, Artificial Sequence
  Description of Artificial Sequence: Synthetic coding sequence
atgtacgacggcaccaaggaggtgcccatgaaccccgtgaagatctaccaagtgtgcgacattccccagccacagggttccattatcaatcctgggagtaccggctcggcgccatgggacgaaaaggacaatgacgtcgatgaggaggacgaggaagatgagctggaccagagccagcaccacgtgccaatacaagacacctttccttttctgaacattaatggctccccaatggcccctgcttcggttggaaactgtagcgtgggtaactgtagccctgaagctgtatggcctaaaaccgaacctctcgaaatggaggtgccacaggccccaattcaacccttttactcatcccctgagctgtggatctcctcactgccgatgaccgatctggacattaagtttcagtacaggggcaaagagtatggccaaaccatgacggtgagtaacccccagggctgtagacttttttacggcgacctggggccaatgccagatcaggaagagctctttggtcccgtgagcctcgaacaggttaagtttccaggtcctgagcatatcaccaatgaaaaacagaaattgttcacttccaagctcctggacgtaatggataggggattgattctcgaggtctctggccatgcgatctatgctattcgcctgtgtcagtgcaaagtatactggagcgggccttgcgctcccagcttggtagcaccaaacctgattgagagacagaagaaggtgaagctcttctgcttagaaacattcctgagcgacttgatcgcacatcagaaaggtcagatcgaaaagcaacctcccttcgaaatatacctctgcttcggtgaggaatggcccgatggtaagccccttgagcgtaaactgattctcgtccaagtgattcccgtggtagctaggatgatttacgaaatgttttctggggactttactaggtctttcgattctgggagcgtgagactgcagattagcacaccggacattaaagataacattgtggcacagctaaaacagctctataggatactgcagactcaggagtcctggcagcccatgcagcctacccccagtatgcagcttcctccagccctccctccccagtag

SEQ ID NO: 191666 - DNA, 1281 bp, Artificial Sequence
  Description of Artificial Sequence: Synthetic coding sequence
atgtgcgaccggaacggcggccggcggctgcggcagtggctgatcgagcaaattgattctagcatgtaccctggcctaatttgggaaaacgaggaaaaatcaatgtttcgtattccatggaagcacgctggcaagcaggattacaaccaggaggtggacgcttccatattcaaagcctgggccgtttttaaggggaagtttaaagagggcgataaagccgaacccgccacctggaaaacgcgcttgagatgtgctctaaacaaatcccctgacttcgaagaagtaaccgaccgttcccaactagatatttccgagccatataaagtatatcgcatcgttcctgaagaggagcagaaatgtaagctgggtgtagccactgcgggctgtgtaaatgaagtgacagaaatggagtgtggccgtagtgagattgacgaactgatcaaggaacccagcgtggacgactatatggggatgatcaagagatcccctagtccccctgaagcgtgtaggagccagcttctgccggactggtgggcacaacagccaagtactggagtcccactcgtcactggttacacaacctacgatgcccaccacagcgccttcagtcaaatggtaatctccttctactacggtggcaaactcgtgggtcaggccaccacaacatgtcccgaaggatgtaggctgagcttaagccagccaggccttccaggaaccaaattatacggtcctgaaggcctagagctcgtccgctttccccccgcagatgcaattccttcagagcgacaaaggcaggttacccgaaagctttttggacaccttgagaggggggtgttgcttcattcttccagacaaggcgtgtttgtgaaaagactgtgccaaggccgggtattttgctcaggaaatgccgtggtatgtaaaggccggccaaacaaactggaacgcgatgaggtggtacaggtgttcgacacaagtcaattttttagagagttgcagcagttctacaactctcagggaagattgcccgacgggcgggtagttctgtgttttggcgaagagtttcctgatatggcaccgttacgaagcaaactaatcctggtgcagattgaacagctgtatgttcgccagctcgctgaggaggccgggaagtcatgtggggctggatccgtaatgcaggcacctgaagagcctccccctgaccaggtttttcgaatgtttcccgacatctgtgcctcacatcagagatcattcttcagggaaaatcagcagatcactgtgtag

SEQ ID NO: 191667 - DNA, 546 bp, Artificial Sequence
  Description of Artificial Sequence: Synthetic coding sequence
atggccggcagccgggaggtggtggccatggactgcgagatggtgggattaggtccacatcgggaatcaggcctggcaaggtgtagccttgtgaacgtgcacggggccgtgctttatgataaattcattcgacccgagggggagatcacagattacaggaccagagtgtcgggagttactcctcagcacatggttggagcaacgccattcgcagtggcgcgtttagaaatccttcagctgctcaaaggcaaactagtggttggccacgacctcaagcacgattttcaggcgctgaaggaggacatgagtggttacacaatttatgatactagcaccgaccgtctactctggagggaggccaaattggatcattgtcggcgcgtaagtctgcgggtgctctcggaacgtcttctgcataaaagtatacagaacagcctgctgggtcactcatccgttgaggacgcccgggccaccatggagttgtaccagattagccaacgcataagggcaagacgggggctgccccggctcgccgttagcgactag

SEQ ID NO: 191668 - DNA, 546 bp, Artificial Sequence
  Description of Artificial Sequence: Synthetic coding sequence
atggccggcagccgggaggtggtggccatggactgcgagatggtgggcttgggtccgcatcgtgaatccgggctggcacgatgttccttggttaacgtccatggggcggtgctttacgacaaatttatcagacccgaaggagaaataactgactaccgaacccgcgtgtccggcgttacacctcagcacatggtgggggctacgcctttcgcagtggcgcggctggagatcctgcagctccttaaaggcaagcttgtggtggggcacgaccttaaacatgactttcaggcgctgaaagaagacatgagtgggtataccatctacgacacctcaacagacagactgctttggcgcgaggcaaagctggaccactgtcggcgcgtgtcactgcgcgtgctcagcgaaagattactccacaagtccattcaaaattcactactaggacattcaagcgtggaagacgctagggcaacaatggagttgtaccagatcagccagagaatccgtgccagacggggtctacccagactagcggtgtccgactag

SEQ ID NO: 191669 - DNA, 1062 bp, Artificial Sequence
  Description of Artificial Sequence: Synthetic coding sequence
atgagcaccctgctgctgaacctggacttcggcgagcccccccccaagaaagccctagaggggaacgccaagcacaggaattttgtcaagaaacgtcgcctcttggagcggcgtggcttcttgtccaagaaaaaccagccaccgtcaaaggctccgaaattgcactccgaaccctcaaaaaagggagaaactccgactgttgatggcacctggaagactcccagttttcccaagaagaaaacagcggcaagtagcaacggatccgggcagccactggacaagaaggccgcagtctcatggctgacccctgccccatcaaagaaagccgactcagttgccgcgaaggttgatctgctgggagagttccaatccgccttgcctaaaatcaatagtcaccctacaaggtcccagaagaaaagttctcaaaagaaaagtagtaagaaaaaccatcctcaaaagaacgcaccacagaacagtactcaggcccatagcgagaataaatgcagcggcgcgtcccaaaaactgccaagaaaaatggtcgccatagactgtgaaatggtggggaccggtccgaaagggcacgtttcctctctggcccgctgtagtatagtgaattacaatggagacgtgctctatgatgaatacatactccctccttgtcatatcgtggactatcgcacccgttggtcaggaatcagaaaacagcacatggtcaacgcaacaccctttaagatcgcacggggtcagatcctgaagattctcaccggtaagatcgttgtgggccacgctattcacaatgacttcaaagccttgcagtacttccaccctaaatccctgaccagagacacatcccacattcccccactgaatcgcaaagccgattgtccagagaatgccaccatgagcttgaagcacttaaccaagaagctcttaaatagagatatccaggtcgggaaatcaggccatagctctgtcgaggacgcacaagccactatggagctgtataagctggtcgaggtggagtgggaagagcatttggcacggaacccgcccacagattag

SEQ ID NO: 191670 - DNA, 1062 bp, Artificial Sequence
  Description of Artificial Sequence: Synthetic coding sequence
atgagcaccctgctgctgaacctggacttcggcgagcccccccccaagaaggccctggaggggaatgcaaaacacaggaatttcgttaaaaagcgaaggttattggaacggagaggatttttgagcaagaaaaatcaaccaccaagcaaagcccccaaactgcactcagagccatcgaaaaagggcgaaacacctacagtcgacggtacttggaaaactcccagtttcccaaaaaaaaagaccgcggcttcgtcaaatggatcaggccagcccctcgacaagaaagccgcagtatcttggctcacccccgccccttccaagaaagccgattccgtggctgcgaaggttgacctgcttggcgagtttcagagcgccctcccaaagattaactcacacccgacaagatctcaaaaaaaaagcagccagaagaagagctctaagaagaatcatccccagaaaaacgccccacagaactcaacccaggctcactctgagaacaagtgctcaggcgcctcgcagaagctgcctagaaaaatggtggccattgactgcgagatggtgggaactggccctaaagggcacgtgtccagcttagcccgttgcagcatcgtaaattacaacggcgatgtcctctatgacgagtacattttgccaccgtgtcacatcgtggactataggactcgctggtcaggaatccggaagcagcatatggtcaacgccacaccgtttaaaatcgccaggggccagatcctgaagattctaacggggaagatagtggtgggtcatgccatccacaacgattttaaggccctgcaatatttccacccgaaatcacttacacgagataccagtcatattcccccacttaatcggaaagcggattgccccgagaacgcaaccatgtccctgaagcacctaactaagaaactcttaaatagagacatccaggttggtaaaagcggccattctagcgtggaagacgctcaggctacaatggagctctataagttggtggaagtggagtgggaggaacacctggccagaaaccctccaaccgactag

SEQ ID NO: 191671 - DNA, 360 bp, Artificial Sequence
  Description of Artificial Sequence: Synthetic coding sequence
atggaggccagcgccctgaccagcagcgccgtgaccagcgtggccaaggtggtccgagtggcctccggtagcgctgtggtgctgccacttgctaggatcgctactgtggtgatcggcggagtggttgccgtgcccatggttttaagtgccatggggtttaccgccgcagggatcgcctcgagttccattgcagccaaaatgatgagtgcagctgctatcgccaacgggggcggcgtggcctccggcagcctggttgctacccttcaatcgctgggggctaccggactgagtgggttaactaaattcattctcggtagtattgggtctgccatcgccgcagtgatagctcggttctattag

SEQ ID NO: 191672 - DNA, 369 bp, Artificial Sequence
  Description of Artificial Sequence: Synthetic coding sequence
atggaggccagcgccctgaccagcagcgccgtgaccagcgtggccaaggtagtcagggtggcctccggcagcgcagtggtgctacctttggccagaatcgctacggtcgtgattgggggaggggaatcagtggtggctgtaccaatggtcctcagtgcaatgggtttcactgccgccgggatagcgtcctcctccatcgccgctaaaatgatgtccgctgcagctatcgcaaatggcggcggggttgcaagcgggagcttggttgcaactttacagagcctcggtgcaactgggttatctggattgacaaagtttatcctgggtagcatcggaagcgccatcgctgccgtaatcgctcggttttattag

SEQ ID NO: 191673 - DNA, 369 bp, Artificial Sequence
  Description of Artificial Sequence: Synthetic coding sequence
atggaggccagcgccctgaccagcagcgccgtgaccagcgtggccaaggtggtcagggtggcttccggctctgcagttgtgttgcctctggcaagaatcgctactgtggtgattggcggcgtggcgtccatagtggccgttccaatggtgctttctgctatgggttttacagctgctggaatcgcctcgtccagcattgctgccaaaatgatgagtgccgcggccatcgccaacggagggggggttgcctccggctccttagtagccaccctgcagtctcttggcgctacaggcttgagcggcctcactaagttcattcttggaagcatcggctcagccatcgccgcggtgatcgccaggttctattag

SEQ ID NO: 191674 - DNA, 189 bp, Artificial Sequence
  Description of Artificial Sequence: Synthetic coding sequence
atggaggccagcgccctgaccagcagcgccgtgaccagcgtggccaaggttgtaagagtggccagcggcagcgcggttgttctgccacttgctaggattgccacagttgtgattggaggtgtggtagcagtgcccatggttctatccgccatgggttttaccgctgctgggattgcctcctctagctag

SEQ ID NO: 191675 - DNA, 174 bp, Artificial Sequence
  Description of Artificial Sequence: Synthetic coding sequence
atggaggccagcgccctgaccagcagcgccgtgaccagcgtggccaaagtcgtgagggtcgcatcaggctccgccgtggtcctgccactcgcacggatcgcaaccgtggtgattggcggggtagtagctgtgccgatggtgctgtctgccatggggttcacggctgccgggtag

SEQ ID NO: 191676 - DNA, 360 bp, Artificial Sequence
  Description of Artificial Sequence: Synthetic coding sequence
atggaggccagcgccctgaccagcagcgccgtgaccagcgtggccaaggtcgtgcgggtggcctctgggtcagccgtggtactccctctggcccgcatcgctaccgtcgtcatcgggggcgtcgtggccgtaccaatggtcctgagtgcaatgggcttcacagccgctggaattgcctcaagcagcatcgctgcgaaaatgatgagtgccgctgcaatcgccaatggaggcggtgtcgcttccggcagtctcgtggcaactctgcaaagcctgggagctacaggactatctggtctcaccaaatttattttaggctccatcggtagtgccattgctgctgtgatcgcaagattctactag

SEQ ID NO: 191677 - DNA, 123 bp, Artificial Sequence
  Description of Artificial Sequence: Synthetic coding sequence
atggaggccagcgccctgaccagcagcgccgtgaccagcgtggccaaagtcgttcgcgtcgcttcgggcagcgctgtggtcctgcccttagcccggattgcaactgtcgttatagggggttag

SEQ ID NO: 191678 - DNA, 282 bp, Artificial Sequence
  Description of Artificial Sequence: Synthetic coding sequence
atggaggccagcgccctgaccagcagcgccgtgaccagcgtggccaaggtggttagagtggcaagcggctcagctgtggttttacctctagccagaattgccaccgtagtgatcgggggtgtggtcgcggtaccaatggtgcttagcgccatgggttttaccgccgcgggaatagcctcttcatcaatcgccgctaagatgatgtccgctgcagcgatcgccaacggcggcggagttgctagtgggtctctggttgccaccctccagagtctgggggcctag

SEQ ID NO: 191679 - DNA, 2358 bp, Artificial Sequence
  Description of Artificial Sequence: Synthetic coding sequence
atgggcaagaagtacaagaacatcgtgctgctgaagggcctggaggtaataaatgattatcatttccgcatggtcaagagccttctctccaatgatctgaagttaaatctgaagatgagagaagagtatgataagatccagatcgctgacctgatggaagagaaattcagaggcgacgctggtcttggaaagctgattaaaatctttgaggacatacctacgttggaggacctggccgagacactaaagaaggagaaactgaaagttaaggggccagctctgtcaagaaaaagaaaaaaagaagtggacgctacctcccccgcaccatcaacaagcagtaccgtgaagaccgagggtgctgaagccacccccggcgcccaaaaacgcaagaagtctacaaaagagaaggctggcccaaaggggtccaaggtgtctgaggagcagactcagccaccgagtcccgccggtgcggggatgtcaacagccatggggagatccccctcgcccaaaacatctctcagcgcaccccctaattcttcaagcaccgaaaaccccaagacagtagccaaatgccaggtgacccccagacgaaatgtgctgcaaaaacggccagtcattgtgaaggtactgtccactaccaaaccgttcgagtacgagacccctgaaatggagaagaaaatcatgttccatgcaactgtggctactcagacacaattcttccacgtcaaagtgttaaacacctccttgaaggagaagtttaacgggaaaaagatcattatcattagcgactatctagaatacgacagcctgctggaagtgaatgaggaaagtaccgtgtctgaagcaggccctaatcaaacatttgaggtgcccaacaaaataattaacagagcgaaagagaccctgaagattgatattcttcataaacaggcatctggaaatattgtctatggggttttcatgctgcacaaaaagactgtgaatcagaagaccaccatttacgagatccaggacgaccgagggaaaatggacgtggtcgggaccgggcagtgccataatatcccttgcgaggaaggagataagctccagctcttttgttttaggctacgtaagaagaaccagatgtcaaagctgatctcggagatgcatagtttcatccagatcaagaagaagacgaaccctaggaataacgaccccaagtctatgaaactcccccaggaacagaggcagttgccctacccttccgaagctagcacgacattccccgagtctcatttgcgcactcctcagatgccgcctacaacccctagttcttcatttttcacaaagaaaagtgaagatacgatttctaagatgaatgattttatgcgtatgcagattttaaaggagggctctcatttccctgggccgttcatgactagtattggacccgcggagtcccatccacacactcctcagatgcccccttcaaccccctccagttccttcctgaccaccaaatccgaggacaccatctcaaagatgaacgatttcatgcgcatgcaaattctaaaggagggatctcacttcccgggtccattcatgacatcgataggtcccgcagaatcccatccacacaccccgcagatgccacccagtaccccaagtagctctttcctgacaacactgaagccaagattgaagacagaaccagaagaggtttccattgaagacagcgcccagagcgatctgaaggaagtcatggtcctgaatgccactgagagtttcgtttacgaacccaaagaacagaagaagatgttccacgctaccgtcgctaccgaaaacgaagtgtttagggtcaaagtgttcaatatcgaccttaaagaaaagttcacaccgaagaagatcatcgctatagctaattatgtgtgtcgcaacgggtttctagaagtctatccctttaccctggtagcagacgtgaatgccgaccgcaacatggagatccctaaggggctgatccgcagcgcaagcgttactcccaaaataaaccagctctgcagtcagaccaaaggaagcttcgtcaacggcgtgttcgaagtgcacaagaagaacgtgcggggcgagttcacttactatgagatccaggacaacactggcaaaatggaggtcgtcgtacacggtcgtctgactacgatcaattgcgaagagggcgataagcttaaacttacttgcttcgaactggctcccaaaagcggcaacaccggagaactccgttccgtaatccactcccacattaaggtaatcaagacccgaaaaaacaagaaggatattttgaaccccgattcctctatggagacctctcccgacttttttttctag

SEQ ID NO: 191680 - DNA, 2022 bp, Artificial Sequence
  Description of Artificial Sequence: Synthetic coding sequence
atgggcaagaagtacaagaacatcgtgctgctgaagggcctggaggttatcaacgattaccatttccggatggtgaaatcccttctgtctaatgacctgaagctgaatcttaaaatgcgcgaggagtacgataagattcagattgccgacctgatggaggagaagttccgcggggacgcgggactgggcaaactgatcaaaatttttgaggatatccctaccttagaggacctggccgagacattaaaaaaagaaaaactcaaagttaaaggcccagccctctctagaaaacgtaaaaaagaggtggatgcaacatcccctgcccccagcacatcctctacagtaaagacagaaggggccgaggcgaccccaggggctcagaagaggaagaagagcaccaaagaaaaagcaggtcccaagggctctaaagtgagtgaggagcagacccagcccccttcccccgccggcgcgggaatgagcaccgcgatgggaagatcccctagtcccaagaccagccttagcgcccccccaaatagctccagtaccgagaaccctaagactgttgcaaagtgtcaggttactccccgcaggaacgtcctccaaaagagaccggtgatcgtgaaagtcctgagcactaccaagcctttcgaatatgagaccccagaaatggagaagaaaattatgttccacgcaaccgttgccactcagacacagtttttccacgtgaaagtgctgaatacttctctgaaagaaaagtttaacgggaaaaagattatcattatttctgattaccttgaatacgacagtctgctggaggtgaatgaggagtccacagtcagtgaggcgggccctaaccagacatttgaggtcccgaataagataattaaccgggctaaggagacgctaaagattgatatacttcataagcaggcatctggcaacattgtgtacggggtgttcatgctacacaagaagaccgtgaatcagaaaactacaatttatgagatccaagatgaccgggggaagatggacgtggtaggcactgggcagtgtcataacatcccatgcgaggagggagacaaactgcagctgttctgtttcaggctgcgtaagaagaaccagatgagtaagctgatttccgaaatgcattccttcatacagattaagaagaagacaaacccccgcaataacgatccaaagtccatgaaactccctcaggaacagagacagctgccttacccgtctgaagcatctacgaccttccccgagtcccatcttcgaacccctcaaatgcctccaacaacccctagctcctcttttttcactaagctgaagcccaggctcaagacagagcccgaagaagtgagcatcgaggattccgcacagtccgacctcaaagaggttatggttctgaatgctaccgaaagcttcgtttacgaaccaaaagagcagaagaaaatgtttcatgcaacagtggccactgagaatgaggttttcagagtgaaggtcttcaatatagatctcaaagaaaagttcacccctaaaaagattatcgctatcgctaactatgtttgccgcaatgggtttcttgaggtgtacccctttaccctcgtggctgatgtgaatgccgaccggaacatggagataccaaaagggcttatccggtctgcctccgtaacccctaaaattaatcagctgtgcagccaaacaaaagggagcttcgttaatggcgtttttgaggtacacaagaagaacgttcgcggcgaatttacttattacgaaatccaggataacacgggtaaaatggaggtggtggtccatgggagactgacaaccatcaactgtgaggagggagacaagctgaagcttacatgtttcgagctcgctcccaaaagtggtaacacaggagagttgagatcggtgatccatagtcatataaaggttataaaaactaggaagaacaagaaagacatcctcaaccctgacagctccatggagactagcccggatttcttcttctag

SEQ ID NO: 191681 - DNA, 1245 bp, Artificial Sequence
  Description of Artificial Sequence: Synthetic coding sequence
atgggcaagaagtacaagaacatcgtgctgctgaagggcctggaggtgatcaacgactatcactttcggatggtgaaatcactgcttagcaacgatctgaagctgaatctaaaaatgcgtgaggaatacgacaagatacaaattgcagacctgatggaagagaagttccgcggcgacgctgggctcggaaaactgattaagatttttgaggacatccctaccctggaggatctggccgagacacttaaaaaagagaagctgaaagtgaagggcccagcattgagcaggaagcgaaagaaagaggtagacgccacgagccctgccccctccacttcgagcacagtgaagactgagggggccgaagctacaccaggcgcacagaaaagaaagaagtcaaccaaggagaaggccggccccaagggatccaaggtgtcagaagagcaaacccagccacccagtcctgcaggtgccgggatgtcaacagccatgggacgatccccatctcctaaaaccagtctgagcgccccacctaatagttcctcaacagagaatccaaagacagtggctaagtgccaggtaacgcctcggaggaatgtgctgcagaaacgacccgtgatcgtgaaagtgttgtcaaccacaaagccgttcgagtacgaaacccccgagatggaaaagaaaatcatgtttcatgcaaccgtggccacccagacacagttcttccatgtcaaggtgctgaacacctctctgaaggagaagttcactccgaaaaagattatcgccatcgcgaactatgtgtgcagaaatggtttcctggaagtgtatccctttacactggtggccgacgtcaacgcagatagaaatatggagattccaaaaggcctgatccggagcgccagtgtgaccccaaagatcaatcagctctgtagccagacgaaagggtcctttgtgaacggcgttttcgaggtccataaaaagaatgtaagaggcgaattcacatattacgagattcaggacaacaccggcaaaatggaggtggtggtgcacggacggctgacgaccatcaactgtgaggagggcgacaagctgaagctcacttgttttgagttggcacccaagtcaggcaatacgggtgaattacgcagcgttattcattctcatatcaaggtgatcaaaactaggaagaataagaaggatatcttgaatccagattccagtatggagaccagccctgactttttcttctag

SEQ ID NO: 191682 - DNA, 2190 bp, Artificial Sequence
  Description of Artificial Sequence: Synthetic coding sequence
atgggcaagaagtacaagaacatcgtgctgctgaagggcctggaggtgataaatgattatcactttcgtatggtgaaatctcttctgtccaacgatctgaagctgaacctgaagatgagggaggagtacgataaaatccaaattgccgatttgatggaggagaaatttagaggggatgcgggactgggaaagctaattaagatcttcgaagatatacctactctggaagatctggcagagacactgaagaaggaaaaacttaaagtcaaggggcccgcactgtccagaaagcgcaagaaggaagttgacgccacttcccccgcaccatccacaagttccacagttaaaactgagggcgctgaagctactccaggcgctcagaagcgcaagaaatcgacaaaagagaaagccgggcccaaggggagcaaagtgagcgaagaacagacgcagccacccagccctgctggcgctgggatgtcaactgccatggggcggagtccctccccaaaaaccagcctttcagccccccctaactctagttccacagaaaaccccaagaccgtggcaaaatgtcaagtgactcccagacgtaatgttctgcagaaaagacccgttatcgttaaggtgttaagtacaactaagcctttcgagtacgagacacctgaaatggagaagaaaatcatgttccatgcaaccgtggccactcagacccagttttttcatgtcaaggtcctaaatactagcctgaaagaaaagttcaacggcaaaaaaatcatcattataagtgactatctcgagtatgatagcctcctagaggtcaatgaggaatccactgtgtccgaggctggccccaatcaaaccttcgaggttcctaacaaaatcataaaccgcgcaaaagagactcttaaaattgacatcttgcacaagcaagccagcggcaacatcgtctatggagtctttatgctccacaagaagactgtgaaccaaaagacaaccatatatgagatccaggacgacagggggaaaatggatgtcgtggggaccggccaatgccacaatatcccttgcgaggagggcgataaactgcaactcttttgtttcagactgcgaaagaaaaaccagatgtcaaagcttattagtgaaatgcatagctttattcagatcaaaaagaaaaccaaccctagaaacaatgatcccaagagcatgaaactgcctcaggaacagagacagctgccataccccagcgaagcctccaccacatttcccgagtctcacctgcgaacaccacaaatgccccccaccactcccagcagttcattcttcacaaagaaatccgaagatactattagcaagatgaacgatttcatgagaatgcagatactgaaagaagggagccactttcctggacccttcatgactagcatagggccagccgaaagccatccccatactcctcagatgcctcccagcactccctcaagctcttttttgacaacgctgaaacctcgccttaagactgaacctgaggaggtgagtatagaagattccgcccagtctgatctcaaagaggtcatggtcctgaacgcgacagaatcatttgtgtacgaacctaaggaacaaaaaaagatgtttcacgctaccgttgcaactgagaatgaggtttttagagtcaaggtatttaacattgacctgaaagaaaaatttactcccaaaaagatcatcgccattgctaactatgtgtgccgaaacgggttcttggaagtgtatccctttactctcgtcgcagacgtcaacgccgaccgcaacatggaaatccctaaaggtcttatccgaagcgcctccgtgacgccgaagatcaatcagctctgctcccagacaaaggggtcatttgtcaatggtgtcttcgaagttcacaaaaagaacgtgcgtggcgagtttacatattacgaaatccaggacaatacaggcaaaatggaagtagtggtgcacggccgcctcacgaccatcaattgtgaggagggagacaaactcaaactgacctgttttgaactcgctccaaagtcaggcaatacaggcgaattgaggagcgtaatccacagtcacattaaggtgattaaaacaagaaagaataaaaaggatatcctgaaccccgactcttccatggagactagtccagactttttcttctag

SEQ ID NO: 191683 - DNA, 2190 bp, Artificial Sequence
  Description of Artificial Sequence: Synthetic coding sequence
atgggcaagaagtacaagaacatcgtgctgctgaagggcctggaggtgataaatgactaccacttccgcatggtaaagagtttgttgagcaacgacctcaagttgaatcttaagatgcgagaagaatacgataaaatccagatcgccgatctgatggaggaaaagttcagaggcgacgctgggctggggaaactaattaagattttcgaggatatccccacccttgaagacctcgcagaaacactgaagaaggaaaagttaaaagtgaagggtccagccctctccagaaagcgtaaaaaagaagttgatgctactagccccgccccctccacctcatccaccgtgaagacagagggggctgaggccacccctggggcccagaagcgtaaaaagagcacgaaagagaaagcaggaccaaagggatctaaggtctccgaggagcagacacagcccccatctcctgcgggcgcgggtatgagtactgcaatgggaaggtcgccgtcccctaagacttccctgagcgcccctcctaattcctccagtactgagaacccgaaaaccgtggccaagtgtcaggtgaccccccggcggaatgtgttacagaagaggccagtcatagtgaaagttttgagcaccacgaagccttttgagtacgaaacaccggaaatggagaagaaaatcatgtttcatgcaactgttgctacccaaacccagttctttcatgtgaaagttctgaacacttcactcaaggagaaattcaatggcaagaagatcatcattatcagtgactacctggaatatgacagtctgctggaagtgaatgaggagtccaccgtttccgaggccggacccaaccaaacgttcgaagtaccaaacaaaattataaacagggcaaaggagacgctcaaaatcgacattctgcataaacaggcttctggaaatatcgtatacggcgtatttatgctgcacaaaaagacagtcaaccagaaaacaacaatttacgaaatccaggacgatcgggggaaaatggacgtcgtggggactgggcaatgtcataatatcccatgcgaggaaggcgacaagctccagctcttttgcttcagactacggaaaaaaaaccagatgtctaaactgatttctgaaatgcacagttttattcagatcaagaagaagaccaatccacgcaataacgatcccaagtcaatgaagctgccccaggagcagagacagctgccttacccctcagaagcctctacaacgttccccgagagtcaccttaggacaccacagatgccgcctacaaccccctcaagctccttctttactaagaagagcgaggataccatcagcaaaatgaatgacttcatgaggatgcaaatattgaaggagggttcgcatttccccggtccattcatgacttcaattggccccgccgaaagtcacccacataccccacagatgcctcctagcacccccagcagcagtttccttactacactgaaaccaagattaaagactgagcccgaagaggtaagcatcgaagatagcgcccaaagcgacctgaaggaagtgatggtgctcaatgcaaccgaaagtttcgtgtacgaaccaaaggaacagaagaagatgtttcatgctacagtcgctacggaaaatgaagtttttagggtgaaggttttcaatatagacttgaaagagaaatttactccgaagaaaataattgcaatcgctaactacgtgtgtcggaacgggtttctggaagtgtatcctttcacactcgtagccgacgtgaatgccgaccgcaacatggagatccctaagggattgatacgttctgcgtcggttacaccaaagataaatcagttatgtagtcagaccaaagggtcctttgtgaacggcgtgtttgaagtacataagaagaacgtgcggggcgagtttacatattatgagattcaagataataccggaaaaatggaggtggtcgtgcatggtcggctgaccaccattaactgtgaggaaggagacaagcttaagctcacctgctttgaactcgcacccaaatcgggcaacactggagagttgaggagtgttatccactctcacattaaagtgattaagacacgcaagaataagaaagatatattaaatcctgacagcagcatggagacctcgccagactttttcttttag

SEQ ID NO: 191684 - DNA, 384 bp, Artificial Sequence
  Description of Artificial Sequence: Synthetic coding sequence
atgggcaagaagtacaagaacatcgtgctgctgaagggcctggaggtgataaacgactaccactttcgaatggtcaagagtttactgtctaacgacctcaagctgaacctgaagatgcgcgaggaatacgataaaatccagatcgcggaccttatggaggaaaagtttcggggtgacgcaggcctagggaagctgattaagatttttgaggatattcctaccctcgaagacctggctgagaccctgaaaaaggaaaagctcaaagtgaagggacccgctctctcaagaaaaaggaagaaggaggtcgacgcgacttcccccgctcctagcacgagctccaccgtaaagacggaaggagcagaggcgactccaggcgctcagtag

SEQ ID NO: 191685 - DNA, 2202 bp, Artificial Sequence
  Description of Artificial Sequence: Synthetic coding sequence
atgagcgtgaagatgggcaagaagtacaagaacatcgtgctgctgaagggtctggaggttatcaacgattatcactttcggatggtgaagagcctgctgtccaatgatctgaaattgaacctgaagatgcgcgaagagtacgacaagattcagatagctgatctgatggaggaaaaatttcgcggggatgcaggcctgggcaaactaataaagatcttcgaagatatacctaccttggaggatcttgcagaaaccttaaaaaaagagaaattaaaagttaaaggcccagccctgagcagaaagagaaagaaagaggtggatgctaccagccccgcccccagtacgtcatctactgtgaagactgaaggtgccgaagccacccccggggctcagaatccgaagaccgtagctaagtgtcaagtcactccgaggagaaatgtgctgcagaaacgcccagtgattgtgaaggtgctttccacgaccaaacctttcgagtacgaaacccctgagatggaaaaaaagatcatgttccacgcgactgtcgccactcagactcagttctttcacgttaaagtgttgaacaccagtttgaaggagaagtttaacggaaaaaaaattattattattagcgactatctcgagtatgacagcctgctcgaagtcaacgaggaatctaccgtttccgaagccgggcccaatcagacatttgaagttccgaataaaataataaatagagccaaagaaacactgaaaatcgatattctccataagcaggctagtggtaatatcgtgtatggcgtttttatgctgcacaagaaaaccgtgaatcagaagacaacaatctatgaaatccaggatgatcgcggaaaaatggatgttgtaggaactgggcagtgccataacattccttgcgaggagggggataagttgcagttattctgctttcgactgcgaaagaaaaatcagatgagcaaacttatctccgaaatgcacagtttcatccaaattaaaaagaagactaacccccgaaacaatgatcccaagtctatgaagctccctcaggagcaaaggcagctcccatacccttcagaagcttccaccaccttccccgagtcacacctgcgcacccctcaaatgccaccgacgaccccttcctcaagctttttcactaaaaagtcagaagataccatctcaaaaatgaatgacttcatgaggatgcagatccttaaagaaggctctcactttcccgggccctttatgacaagcataggccccgcagagtcccaccctcacaccccccaaatgcccccatctaccccaagctcctcctttcttacaaccaaaagcgaagatacaatttctaagatgaacgactttatgcggatgcagatccttaaagagggcagccactttccaggaccatttatgactagtattgggccagctgagagccacccccacacgcctcagatgcctccttcgactccaagctcctctttcctgacaacactgaaaccaagactgaagactgagcccgaagaagtatcgattgaagactccgcccagtccgatctgaaagaggttatggtgctgaatgcaacagagtcttttgtgtacgaaccaaaagagcagaagaaaatgtttcatgctaccgtcgctactgagaatgaggtgtttagggtgaaggtgtttaacatcgacctgaaggaaaagttcacaccgaagaagataattgctattgctaactatgtgtgtcggaacggtttcttagaagtttatccatttacactggttgctgacgttaacgctgatcggaacatggaaatcccaaaaggtcttataagatcagccagtgtcacacccaagattaaccaactgtgcagccagactaaaggttccttcgtgaatggtgtgttcgaggtccacaaaaagaacgtgaggggtgaatttacctactacgaaatacaggataatacgggaaaaatggaggtggtagtccacggaagactcaccacaatcaattgtgaggagggcgacaagctgaaactgacttgttttgagctggccccaaagagcgggaacaccggggagctccggagtgtgatacactcccatattaaagtcattaagaccagaaaaaataaaaaagatattctgaatccagactcctcgatggagaccagtccggacttctttttttag

SEQ ID NO: 191686 - DNA, 543 bp, Artificial Sequence
  Description of Artificial Sequence: Synthetic coding sequence
atgggcaagaagtacaagaacatcgtgctgctgaagggcctggaggtcatcaatgactaccacttcaggatggtgaagagcttactgtctaacgacctgaaactcaacctgaaaatgcgtgaagagtacgacaaaatacaaatcgccgatttaatggaagagaagttccggggtgacgctggtttgggcaaactcattaagattttcgaggatattcctaccctcgaggacctggccgagactctcaagaaggagaagcttaaggtgaagggccccgcgctctccaggaaacgaaagaaagaggtagatgccacaagtcctgctcccagcacatcaagcactgtcaagaccgaaggcgccgaggccactcctggtgcgcagaaaagaaagaagagtacaaaagaaaaagcagggcctaaagggtccaaggttagcgaggagcagacccaacctccgagcccagccggggccgggatgagcaccgctatgggccggagccccagccccaagaccagcttatcagcacctcccaacagctcatag

SEQ ID NO: 191687 - DNA, 1485 bp, Artificial Sequence
  Description of Artificial Sequence: Synthetic coding sequence
tgaagcaccgagaaccccaagaccgtggccaagtgccaggtgacccctcggcgcaatgtcctccagaaaagacctgtcatcgtgaaggttctctcaaccacaaagccgtttgagtatgaaacccccgagatggagaaaaaaattatgtttcacgccacagtagcaacacaaacacagttcttccatgtaaaggtgctcaacacgtccctgaaagagaagttcaatggcaagaagatcataattatatctgattacctcgagtacgactcactgctagaagtcaacgaggaaagcactgtttccgaagccgggcccaatcagacattcgaggtccccaacaaaatcatcaacagggccaaggagactctcaaaattgatatcctccataaacaggcctctgggaatatcgtttacggggtgtttatgctccacaagaagaccgttaatcagaagacaaccatatatgaaatccaggatgaccgcggcaagatggacgttgtgggtacaggacagtgccacaacattccgtgcgaagagggagacaagctgcaacttttttgcttcaggttacggaaaaagaatcagatgtccaagcttatatccgaaatgcactcctttattcagattaaaaaaaaaaccaacccacgcaacaatgacccgaaaagcatgaaacttccccaggaacagcggcagctcccttatccaagtgaggcttcgaccacatttccagagagccacttgcgtaccccccagatgccgccaacaacaccctcgtctagtttcttcacaaagctgaaaccccggttaaaaacagaacccgaagaagtgagtattgaggatagtgcacagagcgacctcaaggaggtgatggtcctcaacgctacagagagcttcgtgtatgaacctaaagagcagaagaaaatgttccacgcaaccgtcgccaccgagaatgaagtgtttcgggtgaaagtgtttaatatagatttgaaggaaaagttcacacctaagaaaataatcgccattgctaattacgtatgtcgaaatgggtttttggaagtgtacccgttcaccttggtggctgacgtaaacgccgatcgcaacatggaaatccccaaggggttgataagaagcgcttcggtcactcctaaaataaaccagctctgcagccagaccaagggctctttcgtgaacggtgtgtttgaggttcacaaaaagaatgtgcgtggcgagttcacttactatgagattcaggacaataccggcaaaatggaggtggtggtgcacgggcgcttgaccacaattaattgtgaagaaggcgacaagctgaaacttacctgctttgaactggctcccaaatctgggaatactggggaactccgaagtgtgatccactcccatatcaaggtgatcaagactcggaaaaacaagaaggatatcttgaaccccgacagcagtatggagacctcccctgatttctttttctag

SEQ ID NO: 191688 - DNA, 753 bp, Artificial Sequence
  Description of Artificial Sequence: Synthetic coding sequence
atgaccctgagccccctgctgctgttcctgccccccctgctgctgctgcttgatgtgcctactgcggccgtacaggccagccctctgcaggctctggatttttttggtaatgggcccccagtgaattataagaccgggaatttgtatctgagagggccgctgaagaaatccaatgctcctttggtgaacgtgactctatactacgaagccctgtgcgggggttgtagagccttcttaattagggagctgttcccgacatggttattggtcatggagatacttaacgtgacgcttgtcccttacgggaatgcccaagagcagaacgtctccggcagatgggagtttaagtgccagcacggcgaggaggaatgcaagtttaacaaagttgaagcctgtgtgttggacgagctcgatatggaactcgcttttttgaccatagtgtgcatggaggagttcgaagatatggaaagaagcctgcctctgtgcctgcagttatatgcccccggcctgtcacccgacacaatcatggaatgtgcaatgggcgatcggggaatgcagctgatgcacgctaacgcccaacgaacagacgcgttgcagcctccacacgagtacgtaccttgggtcaccgtaaacgggaagcccctagaagatcagacacagcttttgacattagtctgccagctgtaccagggcaagaagccagacgtttgcccgtcttcaaccagctctcttcgctcagtttgctttaaatag

SEQ ID NO: 191689 - DNA, 588 bp, Artificial Sequence
  Description of Artificial Sequence: Synthetic coding sequence
atggccctgctgttccccctgctggccgccctggtgatgaccagctactctcccgtcggcagtttagggtgtgacctcccccagaaccatggtctgctcagcagaaatactttggtcctcctgcaccagatgcgcagaatcagtccattcctgtgcctgaaggaccgaagagacttcaggttccctcaagagatggtgaaaggaagtcaacttcaaaaagcccacgtcatgtccgtgttgcacgaaatgctacagcagatattctccctgttccacactgagcgctccagtgcagcctggaacatgaccctcttggatcaactacacacaggcttgcatcagcagctacagcaccttgaaacctgcctcttgcaagtggtgggggagggtgagtccgccggagccataagctcacccgcattaactctgcgccgctattttcaaggcattagggtttatctgaaagagaagaagtacagcgattgtgcttgggaagtggtacgaatggaaattatgaagagtctattcctgagtacaaacatgcaagaaagactgcgttcaaaagatcgagatctagggtctagctag

SEQ ID NO: 191690 - DNA, 861 bp, Artificial Sequence
  Description of Artificial Sequence: Synthetic coding sequence
atgagcgcccccctggacgccgccctgcacgccctgcaggaggagcaggctcgtctgaagatgaggctgtgggacctccagcaacttcgaaaggagttaggtgattctccgaaagacaaggtgccgttcagtgtgccaaagattcctctagtgtttaggggacacacccagcaggatccggaagtgcccaagtcattagtcagtaatcttaggatccactgcccattgctggcaggaagcgccctcataacttttgatgaccctaaagtggcagagcaggtgctgcagcaaaaagaacataccataaacatggaggaatgccgtttacgagttcaggtccagccactagaacttcctatggtgacgacaattcagatgagcagccagctaagcggcaggagagttcttgttaccgggtttccggccagcctcagacttagcgaagaagagctcctggataaactggagatctttttcggtaaaacacgaaatgggggcggtgatgtagacgtcagggaactgcttcccggctccgtgatgctgggtttcgcacgcgacggcgtggcccagagactgtgtcagatcggacaatttacagtgccacttggcggtcagcaagtgccgctgagggtcagcccatatgtgaacggtgagatacaaaaagctgagatccgaagtcaacctgttccccgaagtgtcctcgtgctgaacatcccagatattctcgatggccccgagctccatgatgtgctagagattcactttcaaaagcctactagaggcggaggggaggtggaagcgctgactgtcgttccccagggccaacaaggactggcggttttcacaagcgaatctggatag

SEQ ID NO: 191691 - DNA, 867 bp, Artificial Sequence
  Description of Artificial Sequence: Synthetic coding sequence
atgagcgcccccctggacgccgccctgcacgccctgcaggaggagcaggccagactcaaaatgcgactctgggacttgcagcaactgaggaaagaactcggcgatagccccaaagataaggtacctttcagcgtgccgaagattccccttgtcttcagagggcatacacagcaggatcccgaggttccaaagtcattagtatctaacctcagaatccattgcccgttattggccggatctgcccttatcacgttcgatgaccccaaggtggccgaacaggtgctccagcagaaggaacatactatcaatatggaggagtgtaggctccgggtacaggttcagccgttggaactccccatggtcacaaccattcaggtgatgatgtccagccaattaagcggtcgtagagtccttgtcacggggttccccgcaagtttgcggttgagtgaagaggaattgttggacaaactcgaaatcttcttcggtaaaacccggaacgggggcggagacgtagatgttcgagaacttctgccagggagcgttatgttggggtttgcccgcgatggagtggctcagagattgtgccaaatcgggcaattcactgtgccgctgggaggccaacaagtacccctgagagtcagcccctacgtgaacggagagatccagaaggctgaaatcagatcccagcccgtccctaggtctgtattagtcttgaatattcctgacatcctggatggtcccgaattgcatgacgtcctcgaaatccactttcaaaaaccaacacgaggcggcggcgaagtggaagctctcacagtggtcccgcagggccaacaaggcctcgctgttttcacttctgagagcggatag

SEQ ID NO: 191692 - DNA, 1335 bp, Artificial Sequence
  Description of Artificial Sequence: Synthetic coding sequence
atggccgtgaccacccggctgacctggctgcacgagaagatcctgcaaaatcacttcgggggtaaacggctgtctctactgtacaagggatctgtacacggcttccgcaacggggtcctcctggatcgatgctgtaaccagggtccaactctaactgtgatctatagcgaggaccatatcataggggcttatgcggaggagtcataccaagaggggaagtatgcctccattattctcttcgccctccaggataccaaaatctccgagtggaaactcggcctttgcactcccgaaaccctgttttgttgtgacgtgactaaatataattccccaactaattttcagatcgatgggagaaaccgcaaggttataatggatttaaaaactatggaaaacctcggcctcgctcagaactgcaccatcagtatacaggactatgaggtctttcggtgtgaagattctctggatgaacgaaagatcaaaggggttattgagctgcgaaagtcattgttgtctgccctgcggacatatgagccatacggaagcctcgtacagcaaattcgtatcctgctgctaggccctatcggagctgggaagtcaagctttttcaatagcgtccgatcagtgtttcaaggccacgtgacccaccaggcactggttggtaccaatacaacaggaatatctgaaaagtatcggacatacagcattcgcgacgggaaggatgggaagtacttgcctttcatcctgtgcgattccctaggactcagcgagaaagagggcggtctgtgccgagatgacattttctatatcctgaacggcaacatccgtgatagataccagttcaaccccatggagagcatcaagctaaatcaccacgattatatcgacagtcccagtctgaaggataggatccattgtgtggccttcgtcttcgatgcgtctagtatccagtatttctccagccagatgatcgtcaaaatcaagcggattcggcgcgaactcgtaaatgcaggcgttgtgcatgttgcattgctcacgcacgtcgattcaatggatttgatcaccaagggcgacctgattgagatcgaaaggtgcgaaccagtccggagtaagctggaagaggtccagcgcaaactgggcttcgcgctctcggatattagcgttgtcagcaattattcatctgagtgggagctcgacccggtgaaggacgtcctcattctgtcagctcttagaagaatgttgtgggctgcagacgatttcctggaggacttgccgtttgaacagattggaaatctaagggaggaaattatcaattgcgctcaggggaaaaagtag

SEQ ID NO: 191693 - DNA, 588 bp, Artificial Sequence
  Description of Artificial Sequence: Synthetic coding sequence
atggacctgaagaccatggagaacctgggcctggcccagaactgcaccatctccattcaagactatgaggtctttaggtgtgaggattctctcgacgagaggaagataaaaggcgtaattgagctcaggaagagcctgcttagcgccttacggacatatgaaccgtacggtagcctcgtccagcagatccgcatactcctgcttggaccgatcggggctgggaaaagctcttttttcaattctgtgagatcagtgtttcaggggcacgtcacacaccaggcgctggtgggcactaacaccacagggatcagcgaaaaatacagaacttactccatacgggacggaaaggacgggaagtacctgccatttattctttgtgattcgctaggtttgtctgaaaaggaaggggggctttgtcgagatgacattttctatatcctcaacgggaatatacgagataggtaccagttcaatcccatggagtctatcaagctcaaccaccacgattacatcgatagcccatccctaaaagatcggatacactgtgtcgccttcgtgtttgacgcgagcagcatccagtacttctag

SEQ ID NO: 191694 - DNA, 231 bp, Artificial Sequence
  Description of Artificial Sequence: Synthetic coding sequence
tgactgagcgacatcagcgtggtgagcaactacagcagcgagtgggaacttgacccggtcaaagacgttctgattctttccgccctgcgcaggatgttgtgggcggccgatgacttcttagaggacctaccatttgaacagatcggccgttggttcggcggggtggaggcctggaagcgctctggaaatctccgagaggaaattataaattgcgcccaggggaagaaatag

SEQ ID NO: 191695 - DNA, 390 bp, Artificial Sequence
  Description of Artificial Sequence: Synthetic coding sequence
atggagagcatcaagctgaaccaccacgactacatcgacagcccctccctaaaggacaggatccattgtgtggccttcgtcttcgacgcatccagcatccagtacttcagcagtcaaatgatcgtcaaaatcaagcggataagaagagagctggtgaacgcaggcgtggtgcatgtggccctcttgacccacgtcgactccatggacctgatcactaaaggagatctgattgagattgagcggtgtgaaccagttaggagtaaagtcatgaatgatgcgctgcgtaaacatatcttttgggggatgttgcttcagtctcataccagtgtctacaagaataaaaacaaacaactgctgggcctgagacgcataacgaaattattgaaatag

SEQ ID NO: 191696 - DNA, 585 bp, Artificial Sequence
  Description of Artificial Sequence: Synthetic coding sequence
atgctgtgcgacaccatgggcctggacggcgccgagggcgccggcttgtgtatggatgacatacctcacatactcaaaggatgtatgccagatcgttaccagttcaacagtcgcaaaccaatcacgcctgaacacagcactttcatcacatcgcccagtctgaaggaccgcatccattgcgtcgcgtacgtactggatataaattcaatcgacaacttatactcgaagatgcttgccaaggtcaagcaggtgcataaggaggtgctgaattgtggtatcgcctatgttgcactgctcaccaaagtagatgactgcagtgaggtgttacaagataattttctgaacatgtctagatcaatgacatcacagagccgcgtcatgaatgtccacaagatgttgggcataccaatttctaatattctcatggtcggaaattatgcctcggatctggagcttgatccaatgaaagatatactcatcctctccgctctgagacagatgcttagagctgccgacgactttttggaggatctgccactggaggaaacgggagccattgagcgtgcgctccagccatgtatctag

SEQ ID NO: 191697 - DNA, 1359 bp, Artificial Sequence
  Description of Artificial Sequence: Synthetic coding sequence
atggaggtgaccacccggctgacctggaacgacgagaaccacctgcggaagctgcttggcaacgtgagcctctcactgctctacaagagcagcgtacatggcggatccattgaggacatggtggagcggtgctcgcggcaaggatgtaccattactatggcctacatagattataatatgattgtggctttcatgctcggcaactatattaatttgcacgaatcctcaaccgaaccaaatgatagcctgtggtttagcctgcagaaaaagaatgacaccacagagattgaaactttgttgctaaatactgcccccaagatcattgacgagcagctggtctgtcgactatccaagaccgacatttttatcatttgtcgtgataataagatctacttggataaaatgatcacacggaacttaaaactgagattctatgggcatcggcagtaccttgaatgtgaggtctttcgcgtggagggaatcaaagacaacctggacgatatcaagagaattataaaagctagggaacaccggaatagattgttagctgatattcgcgattatcgaccctacgcggatttggtgagcgaaatacgcattctcttagtggggcctgtggggagtggaaagagtagcttttttaactctgtgaagagcattttccatgggcacgtgactggacaggcagtggtcggcagcgatattacttcaattaccgagaggtacagaatttactccgtaaaggacggaaagaacggaaagagtctgccatttatgctttgtgatacaatgggacttgacggcgcagaaggagctgggctttgcatggacgatatacctcatattctcaaaggctgtatgcccgataggtatcaattcaactcccgaaaacccatcactcctgaacattctaccttcattacctcaccgtcactcaaagacagaatacactgtgttgcctatgttcttgacattaactccatcgacaacttgtactcaaaaatgctagccaaggtcaagcaggtgcataaagaggtgctgaattgcggcatagcttacgtggccttgttgactaaggttgacgattgctctgaggtcctccaggataacttcctcaatatgtctcgctccatgacctcacagtccagagttatgaacgtacataaaatgcttggcatccctatctcaaacatcctgatggtgggtaattacgctagcgatctagaactcgatcctatgaaagacatcctgatcctgtccgccctccgtcagatgctgagggcagccgatgatttcctcgaagacttaccccttgaggaaaccggcgcgatcgagcgagcgctgcagccatgtatctag

SEQ ID NO: 191698 - DNA, 294 bp, Artificial Sequence
  Description of Artificial Sequence: Synthetic coding sequence
atggaggtgaccacccggctgacctggaacgacgagaaccacctgcgcaagcttcttggtaatgtcagcttaagcttgctgtacaaatcgtccgtgcacggaggatccattgaagatatggtcgagaggtgtagcagacaaggttgtacaatcacaatggcctacatcgattacaacatgattgttgcattcatgcttggaaattacataaacttacatgagtcgagcacggagccaaatgattcactttggttttccttgcagaaaaagaacgacaccaccgaaatcgaatag

SEQ ID NO: 191699 - DNA, 1437 bp, Artificial Sequence
  Description of Artificial Sequence: Synthetic coding sequence
atgagcaccaacggcgacgaccaccaggtgaaggacagcctggagcagctgaggtgtcacttcacttgggagctgtcaatcgatgacgacgagatgcccgatctcgaaaaccgggtgctagatcagattgagttcctggatacaaagtattccgttgggattcataacctgctcgcatacgtaaaacacctgaaggggcagaatgaggaggcgttgaaaagtctcaaggaggcggaaaatttgatgcaggaggagcacgacaatcaggctaacgtacggtccctggtaacctggggaaatttcgcctggatgtattaccacatggggaggctcgccgaagcgcaaacctacctggacaaagttgagaatatatgtaaaaaactgtcgaacccgtttcgctaccggatggagtgccctgagatagattgcgaggagggatgggctctgctgaaatgcggaggcaagaattacgaacgggctaaagcatgcttcgagaaagtcttagaagtggatccggagaaccccgagtccagtgccgggtatgcaatctctgcgtatagactcgatgggtttaaactggcaactaagaaccataaaccattctcactcttgcctctgcgccaggctgtgcgcctgaacccggataatggatacattaaagtgctgttggccttgaaactgcaggacgagggacaggaagccgagggagagaaatacatcgaagaggccctggcaaatatgagttcacagacctatgtattcaggtatgccgctaagttctatcgtcggaaggggagtgtggataaggcgctcgagctgctgaagaaggccctgcaggagacgcctacttccgttttgctgcaccaccagatcgggctctgttacaaagcacagatgatccaaataaaggaagccactaaaggccagccacgaggccagaacagagagaagctagacaagatgatacggtcagccatctttcattttgagtctgcagtggaaaaaaaacctacctttgaagtggcgcaccttgacctggctcggatgtatatcgaagcgggaaatcaccgcaaagctgaggaaaatttccagaaactcttatgtatgaaacctgttgtcgaagaaaccatgcaggacatccatttccactatggaagattccaggagtttcaaaaaaaatctgacgtcaatgcaatcattcattacctcaaagctattaaaattgagcaggcctccctgacacgcgataaatctattaactcccttaagaagcttgtgctccgcaaactacgccgtaaggcgttggatctggagtccctcagtctgctggggtttgtgtataaactagaggggaatatgaatgaggcgctggagtactacgagcgagcactgagattggcagccgatttcgaaaattcggtgcgccagggcccctag

SEQ ID NO: 191700 - DNA, 1344 bp, Artificial Sequence
  Description of Artificial Sequence: Synthetic coding sequence
atgcccgacctggagaaccgggtgctggaccagatcgagttcctggataccaagtactcagtcggcattcataatctgctggcgtatgtgaaacacctcaagggccaaaacgaagaagcgttgaagagcttaaaagaagcggagaacctgatgcaggaggagcatgacaaccaagctaacgtccgctccctggtgacatggggcaatttcgcttggatgtactaccatatgggtcgcctcgctgaggctcagacctatcttgacaaggttgagaatatttgcaagaaattatcaaaccctttcagataccggatggagtgccctgagatcgattgtgaggagggatgggcattacttaaatgcgggggcaaaaactacgaacgtgccaaggcttgttttgagaaagttctggaggtggaccccgagaaccctgagagttcagcaggatatgcaattagcgcatatcgtttggacggctttaaactagcgacaaagaaccacaaaccatttagtttattaccactgagacaggccgtgcgactcaaccctgataatggctacattaaggtcttgctagcacttaaattacaggatgagggccaagaggccgagggagagaagtacattgaggaagctctggcaaatatgagctcccagacttacgtctttaggtatgctgctaaattttacagacggaaggggtccgtcgataaagcactggaactgctgaagaaggctctgcaggagacacccaccagcgttctgctccaccaccaaatagggctttgctataaagcacaaatgatccagatcaaggaggctacaaaaggtcagccgagaggtcaaaatagagaaaagctcgacaagatgatccgcagcgctatttttcactttgagtccgcagttgagaaaaaacccacattcgaggtcgctcatttggaccttgccaggatgtatatcgaggcgggcaatcaccgcaaggctgaagaaaatttccagaagctcttgtgcatgaagcctgtggtcgaggaaaccatgcaggacattcactttcactacgggaggttccaggaattccagaaaaaatccgatgtgaacgcgatcattcactatctcaaagctatcaagatagaacaagcaagtttgacacgagacaagtctattaatagtctcaaaaagctcgtactccgaaagctcaggaggaaagccctagacttagagtccttgagcctgctcggctttgtgtacaagctcgaaggtaacatgaacgaggcccttgagtattatgaacgtgccctgcgcctggccgctgattttgagaacagcgtgcggcagggaccttag

SEQ ID NO: 191701 - DNA, 1419 bp, Artificial Sequence
  Description of Artificial Sequence: Synthetic coding sequence
atgagcgagaacaacaagaacagcctggagagcagcctgcggcagctcaaatgccatttcacgtggaacctgatggagggagagaactccttagacgactttgaggataaagttttctacaggaccgaattccagaatcgcgagttcaaggcaacaatgtgcaatctgctcgcttacttaaagcacctgaagggacagaatgaagcggctctagagtgcctgaggaaggctgaagaactgatccagcaagagcatgctgaccaggccgagatcagatctctcgtgacatggggaaactatgcttgggtgtactatcacatggggagactgtccgacgttcagatttacgtcgacaaagtgaagcacgtttgcgaaaagttctccagtccctataggatcgagtcgcctgaactggattgcgaggaaggctggacacgcttaaagtgtggggggaatcagaatgagagggcaaaggtttgtttcgagaaggcgctggagaaaaaacctaaaaacccagaatttacaagcggacttgctattgcttcgtatcggctcgataactggcctccctctcaaaatgccatagatcctctgcgccaggccatcaggctgaaccctgacaaccaatacctgaaagtcctgctagccctgaaactacacaaaatgcgggaggagggtgaggaagaaggagagggggaaaaactagtggaggaggctctcgaaaaggcacctggagtgactgacgtgttgagatcagccgctaaattctaccggagaaaagacgagcccgataaagctattgaactgttaaagaaggctttagagtatatccctaataacgcttacttgcattgccagattggctgttgctacagagctaaagtctttcaggttatgaacttgcgcgaaaacggaatgtatggcaagcggaaattactggagcttattggccacgccgtcgcccacctcaaaaaagctgacgaggcgaatgacaatctgttcagagtgtgctcaatcttggcctctctccacgctttggccgaccagtacgaggacgcagagtactatttccaaaaggagttctcaaaggagcttaccccagtggccaagcagttactgcacctacgatacgggaactttcaattgtaccagatgaagtgtgaagacaaggctattcaccacttcattgagggggtaaagataaaccagaaaagcagagagaaggagaaaatgaaggataagctccagaaaatagcaaagatgcggctgagcaaaaatggcgccgatagcgaagcattgcatgtgctggcctttcttcaggagctgaacgagaagatgcagcaggccgatgaggattctgagcgaggcctcgagagtggttcccttattcctagtgccagtagctggaatggtgaatag

SEQ ID NO: 191702 - DNA, 1356 bp, Artificial Sequence
  Description of Artificial Sequence: Synthetic coding sequence
atgcccaagaacaagaagcggaacaccccccaccggggcagcagcgctggggggggtgggtctggagccgctgcggccaccgctgctacagctggagggcaacaccggaacgtgcagcctttttccgatgaagacgccagtattgagaccatgagccattgctctgggtactccgatcccagtagtttcgccgaggacgggcctgaggtgctggacgaggagggaacgcaggaagacctagaatacaaactgaagggcttgattgacctaacactcgataaaagcgccaaaacgaggcaggccgcacttgagggcattaaaaatgctctggctagcaagatgctgtacgaatttattctcgagagaagaatgacgttgactgacagcatagaaagatgcctgaaaaaaggcaaaagcgatgaacagagggcagccgcagcactagccagtgtgctctgcatccagctgggaccaggaattgagtcggaagagatacttaagaccctaggccctatcctgaagaagatcatttgtgacggcagtgccagcatgcaggccagacaaacctgcgctacttgctttggagtgtgctgttttatagcaacagacgatatcaccgagttgtatagtacgctcgaatgcttagaaaatatcttcaccaaaagctatttaaaggagaaagatacaacagtgatttgtagcacccctaacactgtattgcacatttcttccctcttagcgtggaccttactcctgacaatatgcccgatcaatgaggtgaagaaaaaactggagatgcacttccataaattaccaagtctcctaagttgtgatgatgtgaacatgagaattgccgctggtgagagtctcgcgctactgtttgagctggcaagaggaattgagtctgatttcttttatgaggacatggagagtttaacgcagatgctgcgcgccctggccaccgatggaaataagcaccgagcaaaagtagacaaacgcaaacagaggagtgtgtttcgcgatgtactgagagccgtggaagaacgcgactttcccactgaaaccatcaaattcggccccgagaggatgtacattgattgttgggttaagaagcacacatacgacacattcaaagaggttttggggagtgggatgcagtatcatctgcagtcgaacgagttcctgaggaatgtgtttgaactgggtcctccagttatgctggacgcagctaccctgaaaactatgaaaattagtagattcgagcgacacctctacaactcagctgcttttaaggctagaaccaaagcgcggagcaagtgtcgcgacaaaagagcagacgttggagagtttttttag

SEQ ID NO: 191703 - DNA, 1356 bp, Artificial Sequence
  Description of Artificial Sequence: Synthetic coding sequence
atgcccaagaacaagaagcggaacaccccccaccggggcagcagcgcaggaggcggagggtctggcgcagctgccgctactgccgccactgccggcggtcagcacagaaacgtgcaacctttcagcgatgaggatgctagtattgagacgatgagtcactgcagcggttactctgatcctagtagcttcgccgaagacggccccgaagtgcttgatgaagaaggtactcaggaggaccttgagtacaagcttaaagggctgattgatttgaccctcgataagagcgccaagacaaggcaggccgccctggaaggaatcaaaaatgcgctggcttcaaagatgctgtacgagtttattttagaaaggcgaatgacattaaccgactctattgagagatgcttgaaaaaagggaagtcagacgaacagcgagctgcggctgccctggcgtcagtgctgtgcattcagttgggacctggtatcgagtctgaggagatcctgaaaactttgggacctatcctaaaaaaaattatatgcgacggatcggcatctatgcaggcgagacagacctgcgcaacctgctttggagtttgctgctttatcgccaccgacgacataacggagttatactcaaccctcgagtgcctggaaaacatctttactaagagctacttgaaagaaaaagatactaccgtcatttgttcgacccctaatactgttctccacattagcagcctgctagcttggacattactgctgactatctgccccattaatgaggtgaagaaaaaactggagatgcacttccacaagcttccctcgcttctttcatgcgacgacgtgaatatgagaatcgccgccggcgaatcccttgctctgttatttgaattggctaggggaattgaaagcgactttttctatgaagacatggagtcactgacacagatgttaagagcactggcaacggacggtaataagcacagagctaaagtggacaagagaaagcagcgcagtgtattccgagatgtgttgcgggctgtagaggaacgtgattttcctacagagaccatcaagtttggcccagaacgtatgtatatcgactgctgggtgaagaagcatacctacgatacttttaaagaagttctcgggtctggcatgcagtaccatctgcagtcaaacgagttcctccggaacgtgtttgaattaggcccccctgtgatgctggatgcggccactcttaagactatgaagatctcacgctttgaacggcacctttacaactcagcggccttcaaggcccgcacaaaggcacggagcaagtgtcgcgacaaaagggcggatgttggcgaattcttctag

SEQ ID NO: 191704 - DNA, 57 bp, Artificial Sequence
  Description of Artificial Sequence: Synthetic coding sequence
atgcccaagaacaagaagcggaacaccccccaccggggcagcagcgcgggcggatag

SEQ ID NO: 191705 - DNA, 96 bp, Artificial Sequence
  Description of Artificial Sequence: Synthetic coding sequence
atgcccaagaacaagaagcggaacaccccccaccggggcagcagcgctggcgggggcggaagtggtgctgccgccgcaactgctgctacagcttag

SEQ ID NO: 191706 - DNA, 189 bp, Artificial Sequence
  Description of Artificial Sequence: Synthetic coding sequence
atgcccaagaacaagaagcggaacaccccccaccggggcagcagcgccggcgggggcggttcgggagccgccgcggctacggcagctacggctggaggacagcatcgaaacgttcagccattttctgatgaagacgcatcaatcgagacaatgagtcattgcagtgggtattccgaccctagcagttag

SEQ ID NO: 191707 - DNA, 1206 bp, Artificial Sequence
  Description of Artificial Sequence: Synthetic coding sequence
atgagccactgcagcggctacagcgaccccagcagcttcgccgaggacggcccagaagtgctagacgaggagggcacacaggaggatctggagtataagcttaaaggccttatcgacctaacactcgataagtcagcaaaaactaggcaggctgctctggagggaattaagaatgctctggcaagcaaaatgctatacgagttcatcctggagcgtaggatgaccctgacagacagtatcgagaggtgcctgaaaaaagggaaatcggatgagcagcgagcagccgccgccctagctagcgtgttatgcatccagttggggcccggtattgagagcgaagagatcttgaagactctcggaccaatactcaaaaagattatctgcgacggaagcgcttctatgcaagctaggcaaacctgtgccacttgctttggcgtctgctgtttcattgctacggatgacatcacggaactctatagcacactagagtgtctggagaacattttcaccaagtcttacctcaaggaaaaggatactacagtgatctgttcaacgccaaatactgtgctacacatttcatccctcctcgcctggactcttttgctaaccatctgcccgatcaacgaggtaaagaagaaactggagatgcattttcacaaactcccgtcacttcttagctgtgacgacgttaatatgagaatcgcggcgggagaatctctcgcccttctgtttgagctcgccagaggcatcgaatcggacttcttttacgaagatatggaaagcctgactcagatgctgcgagcacttgccactgacggaaataagcatcgcgccaaggtggataagaggaaacaacgatccgtgttccgcgacgtcctccgagctgtggaggaacgagacttccccacagagaccatcaagttcggcccagagcggatgtacatcgactgttgggtgaaaaaacacacttatgacacgttcaaagaagtcttgggaagcgggatgcagtatcatttacagtccaatgaatttctcaggaacgtgttcgagctcgggcctccggtgatgctggatgctgccacccttaagacaatgaagatctccagattcgaacggcacctctacaattctgcagcttttaaggccagaactaaggcccggagcaagtgccgcgataagcgggcagacgtcggcgagttcttctag

SEQ ID NO: 191708 - DNA, 474 bp, Artificial Sequence
  Description of Artificial Sequence: Synthetic coding sequence
atgcacttccacaagctgcccagcctgctgagctgcgacgacgtgaacatgcgcatcgccgccggtgagtcactggcattattatttgagctggcccgcggcatagagagcgatttcttctatgaggacatggaaagcctgacacagatgctgcgggccctggcgactgacggcaataaacatcgagctaaggttgataagcgcaagcaacgcagcgtgttccgcgatgtgctgagagccgttgaagaacgggactttcccacggaaactatcaagtttggcccggaacggatgtatatcgattgttgggtcaaaaagcacacttatgacaccttcaaggaagtcctcggttcaggtatgcagtatcacttgcagtcaaatgagttcttacggaatgtgtttgaactgggcccaccagttatgctggatgctgctacgctaaagaccatgaaaatctctagatttgaacggtag

SEQ ID NO: 191709 - DNA, 1827 bp, Artificial Sequence
  Description of Artificial Sequence: Synthetic coding sequence
atgggccccaagaagagctggcggagccacttcttccccctgcccgaggtatggcttctgcttctcctgtcccaggcactgagcccgtcacacgggccacagacccaggcgggagtagggctggtctggagtgtcccactgccatcagctcttagaagtcaaagttgcctgggggccccactgagggatgctagtgagcttaccacggtgcatctatttcctacaagagggtggggggcgaggcgcgctctttgggtgcatagcagtgccagcgcctcctctgccgcgagccgcaggaggctgagagcccaggcctccggcatctcgagcttttcattggtcgacggaggggcacctagagaagatgggggagcgcgcggagtctggctgccttccagcggtcaggtgtccgctcagcgaacaggtcgccgtctggtcggcctggagcctacccctaccgggagtttgacaccgcggccacctagacccgtgcccggaatgccccgcgccaggaaggggaatacactgagaaagggcggacagagacggggcggtggggcacgttctagtgctcaggcggatagtggtagttccgatgacgaggctgcttccgaagcgagatctacagcatcagagtgccctagcctcctttctacaaccgctgaagactccctaggcggcgacgtcgtggacgagcaaggacagcaggaggatctcgaagagaagctgaaagaatatgtggattgccttacagacaagtccgcgaagacaagacagggagcactcgaaagcctgcggctcgcactggcatcgcggctccttccagactttctgttggagcgccggttgacactggccgatgcactggagaaatgtctgaaaaagggaaaaggcgaagaacaggccctggctgccgccgttcttgggcttttgtgtgtccagctggggcccggacccaagggagaagaattgttccatagtctgcagccccttctggtgtccgtactttcggacagtactgcatcacccgccgcccggttacactgcgcctcagcactcgggttgggatgttatgtggccgccgccgacatccaagacctcgtctcttgtctcgcctgcctcgagtctgtgttttctaggttctacggacttggaggcagttctacgagccccgtcgtgccagcttccctccacgggctattgtcagcagcactgcaagcatgggccttactgttaaccatctgcccctctactcagatcagccacatcctggacagacaactccccaggctcccccagctacttagcagtgaatctgtcaatcttcgcattgcagccggggaaaccattgcactcctctttgagctcgccagagatctcgaagaggagtttgtgtacgaagatatggaggcactgtgctccgtcctacgcaccctcgctacagattctaacaaatacagggcaaaggccgatagacgtaggcagagatctactttccgggctgtgctgcatagcgtagaggggggagagtgcgaagaggagatcgtgcgcttcggtttcgaagtactgtatatggactcttgggctcgccacaggatctacgcagcgttcaaagaggttctgggttcaggcatgcaccatcacctccaaaacaacgaactccttcgcgatatcttcggtctgggtcctgtcctgctgctggatgcgacagctctgaaagcatgtaaggtgccaaggttcgagaagcacctttataatgccgcggcctttaaggcaagaaccaaggcccgctcaagagtacgcgacaagcgcgctgacatcctgtag

SEQ ID NO: 191710 - DNA, 1329 bp, Artificial Sequence
  Description of Artificial Sequence: Synthetic coding sequence
atgccccgggcccggaagggcaacaccctgcggaagggcggccagcgccgtgggggcggtgcccggagtagtgcacaggctgactctggctcctctgacgacgaggccgcaagtgaggcccgtagtacagcctccgaatgcccttcccttctcagcaccactgctgaggatagtctgggtggcgacgtggtggatgagcagggacagcaggaagatctagaggaaaagctcaaagaatacgtggactgcctcaccgataaatctgcaaaaacacggcagggtgccctagaaagtctgcgcctggccctggccagcaggctgctccccgacttcctcctcgagcgtcggctgaccctggcagacgctctcgagaagtgcctcaagaagggcaagggagaggagcaggcacttgccgctgctgtgctggggttattatgtgtacaactggggcccgggcctaagggtgaggagctctttcactctttacaacctctgttggtaagtgtgttatccgattctacggcatccccagccgcaagacttcattgcgcgtcagccctgggcctcggatgctatgtagcagcggctgacattcaggacctggtttcctgtctggcatgtctcgagagcgtgttttcacgtttctacggcttaggcggaagctccaccagtcccgtggtgcccgctagcttacacggccttctgtctgctgcgcttcaggcctgggccttactgttgaccatctgcccgtctacccaaattagccatatcctggaccggcagctgcctagacttccccaacttctgtcaagtgagtcagtgaatctgagaatcgcagccggtgagactattgcattgctgtttgagctcgcgagagatttggaagaggaatttgtttatgaggacatggaagccctgtgctccgtgctccgcactttagccaccgactcaaacaagtatcgcgctaaggcagatcggaggcggcagcgctctacctttcgtgctgtactccactctgttgaaggcggcgagtgcgaagaagaaatcgtccgttttggctttgaggtgctctatatggactcctgggctcggcatagaatatatgccgccttcaaagaagtgctgggctcagggatgcatcatcatttacagaacaacgagctgcttcgcgatatattcggtctgggtcctgtgctgctcttggatgctactgctttgaaagcttgcaaagtgccaaggttcgagaagcatctctataacgccgctgccttcaaggctaggaccaaggctcgtagtcgggtaagagataaaagggcagatatactctag

SEQ ID NO: 191711 - DNA, 1521 bp, Artificial Sequence
  Description of Artificial Sequence: Synthetic coding sequence
atggcctggaacagccccagccggcggcccgtgtggcagggcggcgctcctagggaagacggcggcgccagaggcgtgtggctcccgtcttctggccaggtgtccgctcagcgaacgggcagacgacttgtcgggctagagcctacccctactggttcactgacgccacgcccccctagacccgtccccggcatgcctagggccagaaaaggaaacaccctcagaaagggtgggcagaggcgaggggggggcgcccgtagcagcgcgcaagcagattccggtagcagtgacgacgaggccgcatctgaggctaggtctaccgccagcgaatgcccatctctgttatcaactacagccgaagacagtctcggtggtgacgtggttgacgaacagggccagcaggaagacctggaggagaaactgaaggagtacgtggactgtcttaccgataagtctgccaagacaagacaaggcgcacttgagtcccttcgactcgcccttgcaagtaggctgctgcctgacttcctcctagaacgccgtctgaccctggccgatgccctggagaaatgcctcaagaaggggaagggtgaagagcaggccctggccgccgccgtcctgggccttctgtgcgtccaacttgggccaggcccaaaaggtgaggaactctttcactcgttacaacctctgcttgtttctgtgttgagcgattctacagcgagcccggcagcccggctgcactgcgcaagcgctctagggttgggatgctacgttgctgctgctgacatacaggacttggtgtcctgtcttgcctgccttgaaagcgtcttttctcgattctacggactgggagggtcatctacctccccagtggtccccgcgtcattgcacgggctgctgtccgcagctctccaggcctgggcactcctcctgactatttgcccttctactcagatctcccacatcctggaccgccaactcccccggctcccgcagctactcagctctgaatcagtgaacctgaggattgccgccggcgaaactatcgccctattgtttgagctggcccgagacctggaggaggaatttgtttacgaggacatggaagcactctgctccgtgctgcggacacttgcaaccgattcaaataaataccgcgctaaagccgacagacgacgccagaggagcacattcagggccgtgctacactccgtggaagggggcgagtgcgaggaagaaatcgtgagattcggctttgaggtgctttatatggactcctgggctaggcacaggatatacgcagcctttaaggaggttctgggaagcggaatgcatcatcacctgcaaaataacgagttgctgcgcgacatattcggcctgggaccggtcttgctgctggatgcaacagcgctgaaagcatgtaaggtgccaagatttgagaagcatctctacaacgctgcagcattcaaggcacgcacgaaggccagaagtagagtgagggataagcgggcagacatactctag

SEQ ID NO: 191712 - DNA, 1329 bp, Artificial Sequence
  Description of Artificial Sequence: Synthetic coding sequence
atgccccgggcccggaagggcaacaccctgcggaagggcggccagagaagaggggggggagcgaggagcagtgcacaggccgacagcgggtctagcgacgatgaggccgcaagcgaggccaggagtacagcatctgagtgtccgagcttactgtctaccaccgcagaggactccctgggaggagacgtggttgatgaacagggccaacaggaggatctggaagaaaagctgaaggaatacgttgactgtttgaccgacaagtctgcaaagaccagacagggtgccctcgaatctttacggcttgcacttgccagccggctgctgccggattttctgctggaaagaaggctcactttggccgatgcattggaaaagtgcttaaagaagggtaagggggaggaacaggctctggcggcagccgtgctcggcctactgtgcgtgcagctaggacctggaccaaaaggcgaggaactgtttcattctctgcagcccctcctcgtgagcgtcttaagtgacagcacagcttcccctgcagctagattacattgcgcttccgctctcggcctgggctgctatgtagctgcggctgatattcaggacctggtgtcctgtctcgcatgtctggagtctgtattttcccgattttatggattaggtggctcaagtaccagccccgtcgtgccggcgagcctgcacggcttgcttagcgccgcactgcaagcctgggcgttactcctgaccatatgcccttccacacagatcagtcacattctggatcgccagttgcccaggctgccacagcttctgagtagcgaatcggttaatctccgcatcgcggcaggagaaaccatcgcactgttgttcgaattggcacgcgacctcgaggaggagtttgtgtatgaagatatggaggcgctgtgctcggttttgaggacactggctacagattccaataagtaccgcgctaaagcggatcggagaaggcaaaggagcaccttcagggctgtcctgcatagtgtggagggtggtgagtgcgaggaggaaatcgtcaggttcggattcgaagtgctgtatatggattcttgggctcgacataggatctacgcagcctttaaggaggtacttgggtcaggcatgcatcatcacctgcagaataatgaacttctgcgagatatttttggtctgggcccagtgctcctgttagatgccaccgctctgaaggcttgtaaggttccccgattcgaaaaacatctgtacaatgcggctgccttcaaggcacggactaaagcccgtagtagagtgagggataaacgggcggatatactgtag

SEQ ID NO: 191713 - DNA, 1713 bp, Artificial Sequence
  Description of Artificial Sequence: Synthetic coding sequence
atgaccctgctgtggtgcgtggtgagcctgtacttctacggcatcctgcagagcgatgcttcggaaaggtgtgacgactggggactggacaccatgaggcagatccaggtgtttgaggatgagccagcgcgtattaagtgtccactgttcgaacattttctcaagtttaattactccacagcccattctgcggggctcacattgatctggtactggacccgccaagatagagatctggaggagcctattaatttccgacttcccgagaatcggatcagtaaagagaaggatgtgctgtggttcaggcctacactgctgaacgataccggaaattatacttgcatgttacgcaatacaacttattgctccaaggtggcatttcctctcgaagtggttcagaaggatagctgcttcaattctcccatgaaacttccggttcacaagctctatatcgagtatggaatacagcggattacttgcccaaacgtggatggatattttccttcttcagtcaaacctaccatcacttggtacatgggttgttacaaaatccaaaacttcaataacgtgatccccgagggcatgaacctgagcttcctcattgctcttatttctaacaacggaaactacacctgcgttgtgacatatcctgaaaatggtaggacctttcatttgacacgaaccctcactgtgaaggttgttgggtctcccaagaatgctgttccaccagtgattcactccccaaatgaccacgttgtgtatgagaaggagcctggcgaagagctcctgatcccctgcaccgtttacttttcttttttaatggattctaggaacgaagtgtggtggacaatcgatggtaagaaaccagacgacattaccattgatgtaactattaacgagagcatctctcacagtagaaccgaggatgaaacaagaacacagattctgtccattaaaaaagtaacctctgaagacctgaaacgcagctacgtttgccacgcccgcagtgcgaagggtgaagtggccaaagcagctaaagtaaagcagaaggtccccgcccccaggtataccgtagaactggcgtgtggttttggcgctactgttcttctggtggtgattctgattgtggtctatcacgtgtattggttggagatggtgctgttctaccgagcccattttgggactgatgagacaatcttagatggaaaggagtatgatatttatgtgtcatatgcccggaacgccgaggaggaagagtttgtgctcttaacactgcgcggtgttttggaaaacgagttcggatataagctgtgtatcttcgatcgcgactcattaccaggcggaattgtgaccgacgaaacactgagtttcatccaaaaaagccggaggttgctggtcgttcttagcccaaattatgtcctgcagggaactcaggcgctccttgagctaaaagctggactggaaaatatggcctctcgtggcaatataaacgttatcctcgttcagtacaaggcagtgaaagagaccaaggtcaaggagttaaagcgagctaagaccgtcctgactgtgattaaatggaagggagagaagtctaaatatccccaggggcgattttggaagcagctgcaggttgctatgcccgtgaagaaaagtcccagaaggagctcctccgatgagcaaggcctctcttattctagtctcaagaatgtgtag

SEQ ID NO: 191714 - DNA, 2064 bp, Artificial Sequence
  Description of Artificial Sequence: Synthetic coding sequence
atgaccctgctgtggtgcgtggtgagcctgtacttctacggcatccttcagtcagacgccagcgagcggtgtgacgattgggggctggatacgatgagacaaattcaagtgtttgaggacgaacccgcccggatcaaatgtccgctgttcgagcactttctgaaatttaattatagcactgcacacagcgccggcttaacactgatctggtattggactcggcaggatagggacctggaagagcctattaatttccggctgcctgagaaccgcatttctaaggaaaaggacgtcctgtggtttcgcccgactctactgaatgatactggcaattacacttgtatgcttcgaaacaccacttattgcagcaaggttgcttttcccctggaggtggtgcaaaaggacagctgttttaacagccccatgaagctccctgtgcataagctatatatcgagtacggaatccagcgcattacctgtccaaacgtagatggctacttccccagctccgtgaaacccacaataacctggtacatgggttgctataagatacagaactttaataatgtgattcctgaagggatgaatctgagttttcttatagctctgatcagtaacaacggaaactatacgtgtgttgttacatatccagaaaatggaagaacgttccacctgactcgaacattaaccgtcaaagtcgtgggatcacccaagaacgctgtaccccctgtgattcactcccccaatgaccatgtcgtgtatgaaaaggagcctggagaggaactcctgattccctgcaccgtgtatttctcgtttttgatggacagtcggaacgaagtgtggtggaccatcgatgggaagaaaccagacgacatcactatcgacgtcaccataaatgagtccatttcacactcaaggacagaggatgagacccgcactcagatcttgtcaataaagaaagtgacctcagaagacctcaaaaggtcatatgtgtgtcacgcccggtcagctaagggggaagtagctaaagccgctaaggtgaaacagaaggtacccgcacccaggtacactgtggaacttgcgtgcggattcggtgcgactgtgctactggtggtcattctgatagtcgtgtatcacgtatattggcttgaaatggtgttgttttacagggcccacttcggtactgacgagaccatcctggacgggaaggagtatgatatttacgtatcatacgcccgcaatgctgaagaagaagagtttgtgcttctcactctacgcggggtcctcgaaaacgaatttggctataaactctgtattttcgacagggattcccttccaggcggcaacacagtagaagccgtgttcgactttatccagcgaagtcgcaggatgattgtggtactcagtcccgattacgtgaccgaaaaatccatttctatgctagaatttaagcttggggttatgtgccaaaactcgattgccacgaagttgatagtagtggaatacagaccgctcgagcacccgcaccccgggatcctccaactgaaggagtctgtaagcttcgtctcatggaaaggagagaagagtaagcactcaggctcaaagttttggaaagctctccggctcgcactgcctctgcgctctctgtctgcatcttctgggtggaacgagtcttgcagtagccagagtgacatctccctcgaccacgttcagcgccgacgctcccggctcaaagagccgccagaactgcagtcgtccgaaagagcagctggatcccctcctgctcccggtacaatgtctaagcatcgaggcaagtctagcgccacatgtcgatgttgcgtgacttactgtgaaggtgagaatcacctgaggaataaatctagagctgaaatccacaaccagccacagtgggaaacacacttatgcaaacctgtgccccaggaaagtgagacgcagtggatccagaatggaacaaggctggagccacctgccccccagatatctgcgctggcccttcatcatttcactgacctttctaacaataacgacttctatatcttatag

SEQ ID NO: 191715 - DNA, 1713 bp, Artificial Sequence
  Description of Artificial Sequence: Synthetic coding sequence
atgaccctgctgtggtgcgtggtgagcctgtacttctacggcatcctgcagagtgacgcatctgaacgatgcgatgactggggactggatacgatgagacagatccaggtttttgaggatgaaccagcaaggatcaaatgtccactgtttgaacattttcttaagttcaactactcaaccgcccactccgccgggctcacacttatctggtactggactcggcaggatcgggacctcgaggagcccataaattttaggctgcccgagaatcgaatctccaaagagaaggatgtcctctggttccgccctactctccttaatgacacggggaattacacctgtatgttacgaaacactacttactgttcaaaggtggcatttccccttgaagtagtgcagaaggacagctgtttcaacagtccaatgaaacttccggtgcacaaactgtatatcgagtatggaatccagaggattacatgcccaaatgtagacggctactttccttcatctgttaagcctaccattacttggtatatggggtgttataagatacagaatttcaacaatgttattccggagggcatgaatctgagcttcttgattgcactcataagcaataacgggaattatacatgcgtggtcacatatcctgagaacggacgcactttccacttaactcgtacattaactgtgaaggtcgttggatcaccgaaaaatgccgtgccccctgtgattcattctcctaacgaccacgtcgtgtatgaaaaggaaccgggggaggagctgttaatcccctgcactgtgtatttcagttttctgatggacagtcgcaacgaggtctggtggacaatcgacgggaaaaaacctgatgatatcactatagatgtgacaatcaatgagagcattagccattcccgaacagaagatgaaacaagaacgcagatcctgagcataaagaaggtgacttctgaagatctgaaacgttcttacgtttgccatgcccggagcgcgaaaggggaggtggccaaggccgcaaaggtgaagcagaaagtacctgcacctcgatatacagtggagctggcatgtggctttggcgccacagtgctcttggtcgtgatacttatcgttgtctaccacgtgtattggctggagatggtgctattttaccgcgcccattttggaacggacgaaaccatccttgacggcaaagagtatgatatctacgttagttatgcaaggaatgcggaagaagaggagtttgtgctgctgacgctgagaggcgtactcgagaacgagtttggctataaactctgtatatttgatcgggatagcttgccaggcgggattgttaccgacgagaccttgtcttttattcagaagtctcggcggcttctggttgtgctgtccccaaactatgtgctgcagggcacccaggcgctgcttgagctcaaagccggattagagaatatggcctccagaggcaatatcaatgtcattctcgtgcagtataaggctgtaaaagagaccaaagtgaaggagctgaagagggccaagacggttttaactgttatcaagtggaagggggagaaaagcaaatacccgcaaggccgtttctggaagcaactgcaagtggctatgccagtgaagaagtccccgcgacggtcctcaagtgacgagcaggggctgtcctacagttcactaaagaacgtgtag

SEQ ID NO: 191716 - DNA, 1071 bp, Artificial Sequence
  Description of Artificial Sequence: Synthetic coding sequence
atgaccctgctgtggtgcgtggtgagcctgtacttctacggcatcctgcagagtgatgctagcgaaaggtgcgatgactggggtctcgacaccatgcgtcagattcaggtgttcgaggatgagcctgcacggatcaaatgccctttatttgagcatttcctgaagttcaattatagtaccgctcatagtgctggcttaacccttatctggtattggacccggcaggacagggacttggaggagcctatcaattttaggctgccagaaaatagaatcagtaaagagaaggacgtcttgtggtttcggcccactctcctgaatgacactggcaattatacctgcatgctgcgaaacactacgtattgcagcaaggtggctttccctctggaagtcgtgcagaaagactcctgctttaattcacctatgaagctaccagttcacaaattgtatatagagtacggcatccaaagaatcacttgtcctaatgtggacggctactttccctctagtgtgaaaccaacgattacttggtatatgggctgttataagatacaaaatttcaacaatgtaattcctgagggtatgaatctctccttccttatcgcgctcatttccaataacggaaattatacatgcgtcgtgacctacccagagaacggacgcacctttcacctcacaagaactttgactgttaaagtggtgggctcacctaagaacgctgtgcctcctgtcatccattcccccaacgatcacgtggtgtacgaaaaagagcctggagaggagttgttaatcccttgtacagtgtacttcagtttcctgatggactcacgcaacgaggtgtggtggacaatcgacgggaagaaaccggatgatatcaccatcgacgttacaatcaatgaatcgatctctcacagccgaactgaggacgaaacaagaacacagattctctctattaagaaggtgaccagcgaggacttaaagagatcttatgtgtgtcatgctcgctctgcaaagggggaggtcgccaaggctgctaaggttaagcaaaaggggaaccgctgcggacagtag

SEQ ID NO: 191717 - DNA, 342 bp, Artificial Sequence
  Description of Artificial Sequence: Synthetic coding sequence
atgaccctgctgtggtgcgtggtgagcctgtacttctacggcatcctccagtcggatgccagcgagcgctgcgacgattgggggctggacacaatgcgacaaattcaggtttttgaggacgagcccgcacggataaaatgccctctgttcgaacatttcttgaaattcaactattccacagctcactcagccgggttgactctgatatggtactggaccagacaggatcgcgatctagaagagcccatcaattttaggctgccagagaatcggatctccaaagaaaaggacgtgctttggttccgccccacgctgcttaatgacaccgggaattatacatag

SEQ ID NO: 191718 - DNA, 1071 bp, Artificial Sequence
  Description of Artificial Sequence: Synthetic coding sequence
atgaccctgctgtggtgcgtggtgagcctgtacttctacggcatcctgcagtccgacgctagcgaacgctgcgatgactggggactggacacaatgcgccagattcaggtgttcgaggatgaacctgctcggattaaatgcccgctgttcgagcattttctgaagtttaattacagcactgcacacagcgccgggttaacactcatctggtattggacacgtcaggatagagaccttgaagagccaatcaacttccgtctacccgaaaaccgcatcagtaaagagaaggatgtactttggttccgccccacactcctgaacgacacagggaactacacttgcatgctccgtaacactacttattgtagcaaagtcgctttccctctagaggtggtgcaaaaggattcttgttttaattcccccatgaagctccctgtgcacaaactgtatattgagtatggcattcagcggataacctgtcccaatgtcgacggctactttccttcttccgttaagcctaccattacttggtacatgggctgttataagatccagaattttaacaacgtgatacctgaaggtatgaatctgagcttcctgattgccctgatctccaacaatggcaactacacttgtgtagtcacttatcccgagaacgggagaacatttcatctcaccaggactctcaccgtaaaagtggtgggatccccaaaaaacgctgtgccccctgttatacactctcccaacgatcatgtcgtgtacgaaaaggaaccgggggaagaacttctgatcccgtgcaccgtgtacttcagttttcttatggactctaggaacgaagtgtggtggacaatcgacggcaaaaaaccagacgatattacaatcgacgttacaattaacgagtcaattagtcactccagaaccgaggacgagaccagaacccaaattctgtccatcaaaaaagtgacatccgaagaccttaaacggagctatgtgtgtcacgcgcggagcgcaaagggcgaggtggcgaaagcggccaaggtcaaacagaagggtaatagatgcgggcaatag

SEQ ID NO: 191719 - DNA, 1713 bp, Artificial Sequence
  Description of Artificial Sequence: Synthetic coding sequence
atgaccctgctgtggtgcgtggtgagcctgtacttctacggcatcctgcagtcagacgcctccgaacgctgcgacgattgggggctggacactatgaggcagatacaggttttcgaggacgaaccggctaggatcaagtgtcctctgtttgaacatttcctgaagtttaactacagcaccgcccattcggccggactgacattaatttggtattggacgcgccaggacagagacctcgaggagcctataaattttcgactgcccgagaaccgtatcagcaaggagaaggacgtgctgtggttccgtcctaccctcctaaacgataccggcaactatacatgcatgctgaggaataccacgtactgtagcaaggtggcgtttccactggaggtcgtgcaaaaagatagctgcttcaattcacccatgaagctgccagtgcataagctgtacattgagtatggcatccagcggatcacctgtccgaatgtggacggctatttcccaagctctgtgaaaccaaccatcacttggtacatgggatgttataaaatccagaacttcaacaacgtcataccggagggaatgaatctttcctttctcatcgccctgatctctaataacggtaactacacatgtgttgtcacttatccagagaacggtagaacgttccatctgactagaacccttactgtgaaagtcgtgggttcccccaagaacgctgtgcctcctgtgatccatagccccaatgaccacgtagtgtatgagaaagagccaggggaggagcttctcattccgtgtaccgtctattttagtttcttgatggattcccggaatgaggtgtggtggacaatcgatggcaagaaacccgacgacattacaattgacgtcacaataaacgagtctatttcccactctagaactgaggacgagactcgaacccagatcctgtcaattaaaaaagtgaccagtgaggacttgaagagaagctatgtgtgtcacgccagatctgccaagggcgaagtcgccaaggccgccaaggtcaagcagaaagtgcccgccccaagatatacagtggagctggcctgtgggtttggcgccaccgtcctgctagtggtcatcctgattgttgtttaccatgtgtactggctggaaatggtccttttctatcgcgctcattttgggaccgacgagaccattcttgatggtaaagagtacgacatctacgtatcgtatgcccggaacgcagaggaagaagagtttgttctcctcactctgcgcggcgtgctcgaaaatgaattcggctacaaactgtgcatctttgacagagactctcttcctggcggtattgtgacggacgagactctgagcttcatccagaagtctagacgactcctggtagtgctgagtccgaattacgtgctgcagggtacacaggccctcttggagctgaaagccgggctcgaaaacatggcatcgcgcgggaatatcaatgttatcctcgtccagtacaaggcagtgaaagaaactaaggtgaaagagctcaagagagccaagactgtgctgactgtcattaaatggaagggggagaagagcaaatacccacaagggcggttttggaaacagctacaggtcgccatgcccgtcaagaaatctccccgccgctccagcagcgacgagcagggattgagctattcttctctgaaaaacgtgtag

SEQ ID NO: 191720 - DNA, 2064 bp, Artificial Sequence
  Description of Artificial Sequence: Synthetic coding sequence
atgaccctgctgtggtgcgtggtgagcctgtacttctacggcatcctgcagagcgatgcctcagagaggtgtgatgactggggtctggacaccatgcggcagatacaggttttcgaagacgaaccggcccgaatcaaatgccccctctttgaacacttccttaaattcaactatagtacagcacacagcgccggactcaccctgatctggtattggactagacaagatcgcgacttggaggagccaataaattttcggctcccagagaataggatctccaaagagaaggatgtgctgtggttcaggcccaccctgttaaacgataccggtaattatacctgcatgctcaggaacaccacctactgttccaaagtggcatttccgttagaagttgtccaaaaagatagctgcttcaattcccctatgaaactacctgtgcataaactttacatagaatatggcattcagcgtatcacatgtccaaatgtggatggatatttcccttcttcagtaaaaccgacaatcacttggtatatgggctgttataagatccagaattttaacaatgtaatccccgaagggatgaatctgagttttctgatcgcactgattagcaataacgggaattacacgtgtgtggttacgtacccagaaaatggacggacctttcacctcacacgcacattaacagtcaaggtggtgggcagcccaaagaatgccgtgccacctgtgattcactctccaaacgaccacgttgtctacgagaaggaacccggtgaagaactcttgattccgtgcaccgtttatttctcgttcctcatggatagtagaaatgaggtgtggtggaccatcgatggcaaaaaacctgacgacattactatcgatgtcacgataaacgaatctatcagccactctagaaccgaggatgaaacccggacccagattctgtcgattaagaaagtcacaagcgaagacctgaagcggtcttatgtctgccatgctcgctcggctaagggcgaagtagcgaaggccgccaaggttaagcagaaagtgccagccccgcggtacaccgtagaactggcttgcggcttcggtgctacagtattactagtcgtgatactgattgtggtatatcatgtttattggctcgagatggtcctgttttatcgggcacacttcggcactgacgagactattttggacggcaaggaatacgacatctacgtgtcgtatgcgcgtaatgctgaagaggaggagttcgtgttgcttacactgcggggggtgttggaaaacgagtttggttataaactctgcatttttgatcgagactccctcccaggcggcaataccgtcgaggcagtgttcgactttattcagcgctcacggcgcatgattgtggtgctgagcccggactacgtcactgagaagtccatttctatgctggagtttaagctaggggtgatgtgtcaaaattctatcgcaactaaactgattgtggttgaataccgccctctggaacatccacaccctggaatcctgcagctcaaagagtccgtttcttttgtgtcctggaagggagaaaagtcaaaacactcaggttccaaattctggaaggcgcttcgattggccctcccactcaggtccctcagcgcttcgtctgggtggaatgaaagctgcagttcacagagcgacatctcactggaccacgtccaaaggcgtaggtccaggttgaaagagccccccgaactgcagtcatctgaacgggccgctggttcgcccccagctcccggaactatgtccaagcacaggggcaagtcatccgcaacttgtaggtgttgtgttacctactgtgaaggagaaaatcatttaagaaataagtctagagccgaaattcataatcaaccccagtgggaaacacatctttgtaagcccgttcctcaggagagtgagacccaatggatccagaacggcactagacttgagccgcccgccccccagatatccgctctcgcacttcaccactttacagacctgagcaacaataatgacttttatatcctgtag

SEQ ID NO: 191721 - DNA, 1713 bp, Artificial Sequence
  Description of Artificial Sequence: Synthetic coding sequence
atgaccctgctgtggtgcgtggtgagcctgtacttctacggcatcctgcagagtgatgcttccgagcggtgtgatgactggggactggacacgatgaggcagatccaggttttcgaagatgagccagcgcgcataaagtgtcccttgtttgaacattttctgaagttcaattattcgaccgctcactccgcaggcctgacgctgatatggtattggacccggcaagacagggacctggaggaaccgataaactttagactgccggaaaaccgcatcagcaaggaaaaggatgtgttgtggttccgaccaaccttactcaacgatactggaaactatacttgcatgctccgaaatactacttactgtagcaaggtggccttcccactcgaggttgttcagaaagatagttgtttcaactctcccatgaagctcccggtccacaaactttacattgagtacggcatccaacgcatcacctgcccgaacgttgatggatactttccatccagcgtgaagccgacgattacctggtatatgggttgctacaagatccagaacttcaataatgtcattccagagggaatgaatctatccttccttatagcactgatttcaaacaacggcaattatacctgcgtggtaacttacccggaaaatggcaggacattccatctgacccggactctgactgtgaaagtcgtggggtcccctaaaaatgcagtcccacctgttatccacagcccgaatgatcacgtggtctacgagaaagagcccggtgaggagcttttgattccttgtactgtctactttagcttcctaatggattcacgaaacgaagtttggtggaccattgacggaaagaaacctgatgacatcacaatcgacgtcactattaatgagagtatctcacacagtagaaccgaagacgaaaccaggacccagatcctgagtattaaaaaggtgacctccgaggacctaaagcgttcctacgtgtgtcacgcacggagcgccaagggagaggtagccaaagctgccaaggtgaagcagaaagtcccagcccccaggtacacagtggagctggcttgcggttttggagccactgtgctgcttgttgtgatcctgattgtggtttaccatgtgtactggctggagatggttctcttctatagagcacactttggaaccgacgagacaattctggatgggaaagagtatgatatttacgtgtcttacgctcggaacgctgaggaagaggaatttgtgctgctcaccttgcgaggagttctcgaaaacgagttcggatataagctgtgtatctttgatagggatagtctcccaggcggtatcgtgaccgacgaaacactctcatttatccagaaatcacggcggctgttagtcgtgctgagtccgaattacgtgctgcagggtacacaggccttactagagctaaaagcgggcctggaaaacatggcctcccggggaaatattaatgttatcctggtgcagtacaaggcagtaaaggagaccaaggttaaagaactcaaaagagccaagaccgtgctgacagttatcaagtggaagggagagaagagcaagtatccccaaggccgcttctggaagcaactgcaggtggctatgccagtaaagaagagcccgaggcgcagctcttccgacgagcagggattaagctatagttctctcaaaaacgtctag

SEQ ID NO: 191722 - DNA, 438 bp, Artificial Sequence
  Description of Artificial Sequence: Synthetic coding sequence
atgaccctgctgtggtgcgtggtgagcctgtacttctacggcatcctgcagtccgacgcctcggaacggtgtgacgactggggcctggatacaatgaggcagattcaagtcttcgaagacgagccggctagaatcaaatgtcccttgtttgaacactttctaaaattcaattactcaaccgcacactcagcaggcctcaccctcatctggtactggacgcgacaggatagggatttagaagaaccaattaattttcgcctaccagagaacaggatctcaaaagagaaggatgtcctatggttccggcctacgctattgaatgataccggaaactatacttgcatgctgcgaaataccacttattgcagcaaggtcgcatttcctctcgaggtggtgcaaaaagactcttgtttcaattcacctatgaaactgccttag

SEQ ID NO: 191723 - DNA, 2091 bp, Artificial Sequence
  Description of Artificial Sequence: Synthetic coding sequence
atgaaggcccccatcccccacctgatcctgctgtacgccaccttcacacagagcctcaaggtggttactaaaagaggatctgccgacgggtgtacggactggagcatcgatatcaaaaagtatcaagtactcgtgggagagccagtgcggatcaagtgcgcgctcttctacggctatataaggacaaattattcccttgcgcagtccgccggtttgagcttgatgtggtataaaagttctggacctggtgacttcgaggaacctatcgctttcgacggcagccgaatgtcaaaagaagaggactccatatggtttaggcctacactcctgcaggatagcggtttatatgcctgcgtcatccgtaatagtacctactgtatgaaagtgagcataagcctcaccgtgggcgagaatgacactggtctgtgctacaattctaagatgaagtacttcgagaaagctgagctgtccaagagcaaggaaatcagctgccgcgacatagaagacttccttctgcctactcgggaaccagaaattctgtggtacaaagaatgtcgcaccaaaacatggcggcccagcatcgtctttaaacgcgacactctccttatccgggaagtccgagaagacgacattgggaattacacttgtgagttgaagtatggtggattcgtcgtgcgccgcacaaccgagctcaccgtgacggcgcctctgacagataaacctccaaaacttctttaccccatggaaagcaagctaactatccaggagacacagttgggcgactctgccaatcttacttgtcgggctttctttgggtacagcggggatgtatcgcccttgatttactggatgaagggcgaaaagttcattgaagatctggacgaaaatagagtgtgggagtccgacatcaggatcctgaaagagcacttgggagaacaagaggtttctatatctttgatcgtggattctgtcgaagaaggggatctgggtaactacagttgttacgtcgaaaacggcaacggacgaaggcatgcctcagttctcctccacaaacgggaactgatgtacacggtcgaactggcagggggccttggggccatcctgcttctactggtctgcctcgttacaatctataagtgctataagattgagatcatgctgttctaccgcaatcatttcggtgcggaggagttggatggcgataataaggattacgacgcctacctttcttataccaaggtagaccctgatcagtggaaccaggaaaccggcgaggaagagagatttgcacttgaaatcctccctgacatgctggagaagcattatggctataagcttttcattcccgacagagacttgataccaaccggcacctacattgaggacgtggcccgctgtgtggatcagtccaagagactgataatcgttatgacgcctaattacgttgttcggcgcggctggagcatcttcgagttggaaacaaggctcagaaatatgctggtgacaggcgagatcaaagtgatactcattgagtgctcagagttgcgcggtattatgaattaccaagaagtggaggctctgaaacatactataaaactgcttactgtcataaagtggcacggccctaaatgcaataagctcaactcaaagttttggaagaggcttcagtatgagatgcctttcaagagaattgagcccatcacccacgagcaggctctggatgtgagcgaacagggtccattcggcgagcttcagaccgtctctgccatttcgatggcagccgcaacctccactgccctggccacagcccacccagatctaaggagtacttttcacaacacgtaccatagtcagatgaggcagaagcattattatcggtcctacgaatacgatgttccgcctacgggaacgctgcctcttaccagcatcggcaaccaacatacctactgtaacataccaatgacactgattaatggacagcgtccccagactaagtcatccagagagcaaaatcccgatgaggcccatacgaatagcgccattctgcctctgctgcctagagagactagcatttcatccgtgatttggtag

SEQ ID NO: 191724 - DNA, 2091 bp, Artificial Sequence
  Description of Artificial Sequence: Synthetic coding sequence
atgaaggcccccatcccccacctgatcctgctgtacgccaccttcacccagtcactgaaggtcgtgaccaagcgaggttccgctgatggctgtacagattggagcatagacatcaagaagtatcaggtgctcgtaggagagccagtgaggataaagtgcgctctgttttatggttacatcagaaccaattacagcctcgctcagtccgccggtctgtctttaatgtggtataagtcctcgggtcccggcgacttcgaggaaccaatcgcctttgacgggagtcgtatgagcaaggaggaagattccatctggttcaggcccacccttcttcaagactctgggctttatgcctgcgtcattaggaacagtacttactgcatgaaagtatcaatttcactgactgtgggcgaaaatgacacaggcctgtgttataacagtaaaatgaaatattttgagaaggccgaactttctaaatccaaggagatatcgtgtagagacatcgaggactttctgctgcccacacgggagcctgaaatcctgtggtataaggagtgtcgtacaaagacttggagaccaagtatcgtgtttaaaagagacaccctgttaattcgagaggtgcgcgaggacgacataggaaattacacctgcgagctcaagtacggcgggtttgttgttcggcgtacgacagagctcaccgtgactgcccctctaaccgataagccacccaagctgttgtaccctatggagagcaagctgacaattcaagaaacccagctcggggactcagctaacctgacctgtagggcttttttcggctactcaggcgatgtgagtcctctgatctactggatgaaaggcgagaaattcatagaagatctggatgagaacagggtgtgggagtccgatattcgtattctgaaagagcatctgggagagcaggaggtgtctatcagtctgatcgtggattccgtggaggaaggggaccttgggaactactcctgttatgtagaaaacgggaatggtcgtcggcacgctagcgtgctcttgcataaaagagaactgatgtatactgttgagctcgccgggggactgggagcaatcctcctgctcctggtttgtctcgtgacaatttataaatgctataaaatcgagataatgttgttctatcgaaatcattttggagcggaggagcttgacggggataataaggattacgatgcatacctttcatacacgaaggtagaccctgaccaatggaaccaggaaacaggagaagaagaacggttcgccctggagatccttcccgacatgctggagaagcactacggatacaagctgttcatccccgaccgagatctcatcccaaccggaacgtatatagaggacgttgccagatgcgtggatcaaagtaagcggctcattattgtaatgacaccgaactacgttgttcgccgtggttggagcatattcgagctggaaactcggcttcgcaatatgctggtgaccggagagattaaagtgatcttgattgaatgctcggagctgcgggggattatgaattatcaagaggtggaagctcttaagcatacaatcaagctcctcacagttatcaagtggcatggccccaaatgcaacaagctgaactccaaattctggaagcgactgcagtacgaaatgccatttaagaggattgagccaattacacacgagcaggccctcgatgtgagtgagcagggcccctttggcgagctgcagacagtttcagccatttcaatggcagccgctacatctaccgccctggccacggcacatccagatctgcgatctacatttcacaatacatatcatagccagatgcggcagaaacactattaccgcagttatgagtatgacgtgccgcccactggcactctgcccttaactagcatcggcaatcaacacacctattgcaacatcccgatgactcttatcaatggacagaggccacagaccaagtcatcgagagaacaaaatccagacgaagcccacacgaactccgcaattctgccattgctgcccagagagacctccattagttctgtgatttggtag

SEQ ID NO: 191725 - DNA, 2061 bp, Artificial Sequence
  Description of Artificial Sequence: Synthetic coding sequence
atgaagccccccttcctgctggccctggtggtgtgcagcgtggtgtcaacaaatctgaaaatggtctctaaacggaatagcgtggacgggtgtattgactggtcagtcgatctcaagacatacatggctcttgcaggagagccagtgagagtgaagtgcgctctcttttattcctacattcgcactaactactcaaccgcacagtctacaggcctgagactgatgtggtataagaacaaaggcgacttggaggaacccataatcttcagcgaggtccgaatgagcaaggaggaagacagcatctggttccattccgctgaagcgcaggacagtggattttacacttgtgtgcttaggaattctacatattgtatgaaggtgtccatgagccttacggtggctgagaatgaatcaggcctttgctacaattctcgcattcggtatctggagaagtcagaggtcactaagaggaaggaaatttcttgccccgacatggacgactttaagaaaagtgatcaggaaccagatgttgtgtggtataaagaatgcaagcccaagatgtggcgatctatcatcattcaaaagggcaatgcattgttgattcaagaagtgcaggaggaggacggcgggaattacacgtgcgagctgaagtatgaaggtaaactcgttagaaggacaactgagctgaaggtgacagctctgctcactgacaaacctcccaaaccccttttcccaatggagaaccagccctcagtgatcgatgttcagctaggaaagcctctcaacattccttgtaaggcctttttcgggttctccggtgaatcaggccccatgatttactggatgaagggggaaaagtttatcgaggaactggcaggtcatatccgggaaggagagatccgcctactgaaagagcacctcggggaaaaagaagtcgaactggccctgatttttgactctgtcgttgaggctgacttagcaaattacacttgtcacgtggagaacagaaatggccgtaagcatgcctctgtgttgctccgcaagaaagatctgatatacaagattgagctcgccggagggcttggcgccatctttctgttactggttctgctggtagtgatctataagtgttacaatattgagttgatgttgttctataggcagcattttggagccgatgaaacaaatgatgacaacaaagagtatgatgcatacctgagttacactaaagtggaccaggataccctagactgcgataatccagaagaggagcaatttgccttggaggttctccctgacgtcctagagaagcactatggttataagctgtttatccctgaaagggatctgataccttccggaacctacatggaagaccttacccggtacgtggagcagagcaggagactcatcatcgttctcacacctgattatatcctgcggcgaggctggtctatttttgagctggagtctagactacacaatatgctggtgtcaggagagatcaaggtcattctgattgagtgtaccgagttgaaggggaaagtgaattgtcaggaggtcgaaagcctaaagcggtctattaaactgctgagtctcatcaaatggaaagggtctaagtccagcaaactgaattccaagttttggaagcacctagtctatgagatgcccattaagaagaaggagatgttaccgcgctgccacgtgctggattctgccgagcagggtctgttcggggagctgcagcctatccccagcatcgccatgaccagcaccagtgcaacgctcgtctctagtcaggccgacctgcctgagtttcaccccagcgacagtatgcaaatacgccattgctgtagaggatataagcacgaaattcctgctacgacactgcctgtgccatctttgggtaatcaccacacgtattgtaatctacccctgacactgctcaacggccaattgccactgaacaataccctgaaggacacccaggagtttcacagaaattcatctctcctgccactgagttccaaggagttatcgtttactagtgatatctggtag

SEQ ID NO: 191726 - DNA, 2061 bp, Artificial Sequence
  Description of Artificial Sequence: Synthetic coding sequence
atgaagccccccttcctgctggccctggtggtgtgcagcgtggtgtcgactaatttgaagatggtgtctaagcggaactccgtggatggctgtattgactggagtgtagacttgaaaacatacatggccctggccggtgaaccagtccgggtcaagtgcgcattattttattcctacatcaggacaaattatagcacagcacagagtacggggctgagactaatgtggtacaaaaacaaaggagatctggaagagcccattatctttagtgaggtgagaatgtccaaggaggaggacagtatatggtttcactctgctgaggcgcaggacagcggcttctacacatgcgtgcttcggaatagtacatactgtatgaaagtctcaatgagcttgacagtggccgaaaatgagagcggattgtgctacaattctagaattcgatacttggagaagagtgaggttactaagagaaaagagatcagttgtccagatatggacgatttcaagaagagtgaccaagagcccgatgtcgtctggtataaggaatgtaagcccaagatgtggagatcaatcattattcaaaaagggaacgcactgctcatacaagaggttcaggaggaggatgggggcaactacacctgcgagctgaagtatgagggcaagctcgtgcgaaggacgacagagcttaaagtgacagcactcttgaccgataagccccctaagccactcttccctatggagaatcagcccagcgtgatcgacgtgcagcttggtaagcccttgaatattccttgtaaggcattcttcgggttttcgggggagtcaggacctatgatttactggatgaagggggagaaatttatcgaggaactcgccggacacatcagagaaggagagatcaggcttctgaaggagcatttaggagagaaagaggtcgaactagcactgatctttgattccgtcgttgaggcggacttggccaattacacttgccatgtggagaaccgtaacggccgaaagcacgcctccgtgttgctgcgaaaaaaggacctaatttacaagattgaactggcagggggtctgggcgcaattttcctcctgcttgtcctgctggtcgtgatctacaaatgctacaatatagagctgatgctcttttataggcagcattttggcgcggatgaaacaaatgatgataacaaagaatacgatgcctaccttagctacactaaagtggaccaagatacactcgactgtgataaccccgaggaggagcaatttgcgcttgaggtactcccagacgtgctggagaagcattatggttacaagttgttcatccctgaacgagatctgataccctcggggacatacatggaagatctgactaggtatgttgagcaatcccgcagactgatcatcgtgttaacacctgactacatcctacgtaggggttggtcaatttttgagctagagtccagactccataatatgctggttagtggtgaaatcaaagtcattttgatcgagtgcaccgaactgaagggtaaagtcaactgccaagaggtggagtcactgaagaggagcattaagttgctgtccctgattaaatggaaaggctccaaaagctcaaaactgaactcaaagttctggaagcacttagtttacgaaatgcctattaagaagaaggagatgctccctcggtgtcacgtccttgacagtgccgagcagggtctatttggcgagctgcagccaatcccaagcatcgccatgacatcaacatccgcgactctcgtaagcagccaagctgatctccccgagtttcacccctcagacagtatgcagatccggcactgctgtcgtggatacaagcatgaaattcccgccactacactgcctgtaccatcacttggaaaccatcacacctactgcaacttacccctgaccctgttgaacgggcagttacctctgaataacactctcaaggatactcaggagtttcacaggaatagctccttgttgcctcttagctctaaggaactaagcttcacctcagatatctggtag

SEQ ID NO: 191727 - DNA, 876 bp, Artificial Sequence
  Description of Artificial Sequence: Synthetic coding sequence
atgcgggacaacaaggagtacgacgcctacctgagctacaccaaggtggaccaggacaccctagattgtgacaaccccgaggaggaacagttcgcactcgaggtcttacctgacgttttagagaagcattacgggtacaaattattcataccagaacgcgacctgatcccttccggcacatatatggaagacctgacgcggtatgttgaacagtcgcggagactaattatcgttctgacccctgactatatcttgcgacgcggttggagcattttcgagttggaatcccgcctacataacatgctggttagcggcgaaatcaaggttatcctaattgaatgcaccgagcttaaagggaaagttaactgccaagaggtcgagtccctcaaaagatctattaaactgttgtccctgattaagtggaaaggatccaagtcatccaaacttaacagcaagttttggaagcatctggtctacgaaatgccgatcaagaagaaagagatgttaccccggtgtcatgttctggactccgccgaacaaggtcttttcggtgaactccagccaattccttcgatagccatgacctcaacttccgccaccctggtctcctcccaagcagacctccccgagttccacccctcagattctatgcaaattaggcactgttgcagagggtataagcatgaaatccctgcaactactctccctgtgccctcactgggaaaccatcacacctattgcaacttacctctgacgctgctcaacggtcagctgccacttaataacacactcaaagatacacaagaattccaccgaaattcaagtctgttgcccctgtcaagtaaggagctcagtttcacctccgatatctggtag

SEQ ID NO: 191728 - DNA, 1197 bp, Artificial Sequence
  Description of Artificial Sequence: Synthetic coding sequence
atgctgcggctgtacgtgctggtgatgggcgtgagcgccttcaccttacaacctgccgcccatactggggcagccaggtcatgtaggtttagggggaggcactataagcgagaattcagactggagggagagcccgtcgcactaaggtgtccccaagtcccctactggttatgggcatcagtgtcaccccggattaacctgacctggcataagaacgacagtgcaaggaccgtgcctggggaggaggaaacgcgcatgtgggcacaggatggcgccctgtggctactccccgccctgcaggaggattcaggtacctatgtgtgcaccacccgcaatgcctcttattgtgataaaatgtccattgagctgagagtgttcgagaataccgacgccttcctgccctttatcagttatccacaaattttgactctgagtacaagtggggtgctggtttgcccagacctctccgagttcacacgagataagaccgatgtgaaaattcagtggtacaaggacagcctattgttggacaaggacaacgaaaaatttttgtcggtgagaggcactacacacttactggttcatgacgtcgccctagaagatgcgggttactaccgctgcgtgttgaccttcgcacacgagggtcagcagtacaatattacgaggagcattgagttgcgaatcaaaaaaaaaaaggaggagaccatccccgtgatcataagcccgctcaagaccatttctgccagtctgggctcaagactgactataccctgcaaggtatttttgggcaccgggactcctctcaccactatgctatggtggaccgctaatgacactcatattgaatcagcttatcccggtggaagagttacagaaggcccccggcaagagtactcggagaacaacgagaattacatcgaagtccccctgatttttgatcctgtcacacgggaggatctacacatggattttaagtgcgtcgttcacaacacgttgagctttcagacccttcgcactacagtgaaagaggcttcaagtaccttttcctggggcatcgtgctggctcccctgtcgctggcatttctggtgctgggtggaatctggatgcaccgaaggtgtaaacatcgaactggaaaggctgacggacttactgtcctatggccccatcatcaggatttccaatcttacccaaagtag

SEQ ID NO: 191729 - DNA, 1197 bp, Artificial Sequence
  Description of Artificial Sequence: Synthetic coding sequence
atgctgcggctgtacgtgctggtgatgggcgtgagcgccttcaccctgcagcccgccgcccacacaggcgccgcccgcagctgtagatttcgcggccggcactacaagagggaattccggcttgaaggtgagcccgtggccctccggtgtccacaggttccatattggctgtgggctagcgtgtctccacgaatcaacctcacctggcataaaaatgacagcgcaaggactgtacccggggaggaggaaacgcgtatgtgggctcaggacggcgccctgtggttgctgccggctcttcaggaggattcaggcacttacgtttgcacaacacgcaatgccagctattgtgacaagatgtccattgagttacgggtcttcgagaataccgacgccttcctgccttttataagctatcctcagattctcactctgtccaccagtggagtgctggtctgccctgacctgagtgagtttacccgcgataagacagacgtgaaaattcagtggtacaaagacagcctgctgctagacaaagacaatgagaaattcctgagcgttagaggtactacacatttgttagtccatgacgtggctctcgaagatgccgggtattacagatgtgtgctcacatttgcacatgagggccaacagtataatataacccgctctatcgaactgagaatcaagaagaaaaaggaggaaaccatacctgtgatcattagtccactgaagacaatttcagcgtccctaggatcccgccttaccattccttgtaaggtattcctaggaaccggtacgcccttaacgactatgctctggtggacagcgaacgacacgcatatagagtctgcttatcccggggggagagtcaccgaagggccgcgccaggaatactccgagaacaatgaaaactacattgaggtaccactgatcttcgatcctgttacccgagaagatttgcatatggattttaagtgcgttgtccacaacaccctgagctttcaaacattgcgcactactgtaaaggaggccagcagcacatttagctggggaattgtgctggcacccctttccctggcattcctggtactaggcggcatttggatgcataggaggtgtaaacaccgtactggtaaggccgacggtctaaccgtattgtggcctcatcaccaggacttccaaagctaccctaagtag

SEQ ID NO: 191730 - DNA, 690 bp, Artificial Sequence
  Description of Artificial Sequence: Synthetic coding sequence
atgctgcggctgtacgtgctggtgatgggcgtgagcgccttcaccttgcagccggcggctcacacaggggccgctcgctcatgtcggttcaggggtcggcactataagcgagagttcagattagagggtgaaccagtggcactacggtgccctcaagtgccttattggctgtgggcatctgtttcaccacgaataaatctgacatggcacaagaatgacagtgcccgcactgtgcctggagaagaagagacacgcatgtgggcccaggacggggctctgtggctactccctgcacttcaggaggacagtggcacctatgtgtgtaccacacggaatgcctcctactgtgacaagatgtccattgagttgagagtctttgagaacaccgatgcttttctccccttcatctcatacccgcagatcctgactctctccaccagtggtgtgttggtgtgccctgacctatcagagtttaccagagataagacagacgtcaagattcagtggtataaggactcacttctactggataaggacaacgagaagtttctgtctgtgcggggaactacccatctcttagtgcacgacgtggctctcgaggacgcggggtattatcgatgcgttcttacattcgcccatgaaggccagcagtacaatattacaagaagcatcgaactgcgcattaagtag

SEQ ID NO: 191731 - DNA, 1098 bp, Artificial Sequence
  Description of Artificial Sequence: Synthetic coding sequence
atgctgccccccctgcccagccggctgggcctgctgctgctgctgctgctgtgtccagcccacgttggagggctatggtgggccgtggggtcgccgctggttatggatcctacttccatctgtcgcaaagccagacggcttgctggtcggcaagccgaactgtgccaggcagagcctgaggttgttgcggaactggccagaggcgcgcgactcggcgtgcgcgagtgtcaattccagtttagattcagaagatggaactgtagctcccactctaaagcctttgggcggattttacagcaggatatccgcgagacggcattcgtcttcgctatcacagctgctggtgcgtctcacgcagtcacccaagcctgcagcatgggcgaattactccagtgtggttgccaagcgcccagaggccgcgctccgcctcgaccctctgggctacctggaacacccggcccccccggtccggcggggagcccagaaggttcagcagcctgggaatggggaggttgcggtgatgacgtcgactttggtgacgaaaagtcccgcctgttcatggatgccagacataaaagggggagaggcgatattagagcgttagtgcagctccacaataatgaggccggccgcctggccgttagatcacacacccgcacagagtgcaagtgccacgggttgagcggaagttgcgcattgagaacatgctggcaaaaattgccaccatttcgggaggtgggagcaaggttactcgagagattccatggcgcgtccagggtgatgggtaccaatgatggaaaagctcttctgccagccgttcgcaccttaaagcccccagggagagccgacctgctgtacgctgccgacagtcccgacttctgcgcccctaacaggcgtactggctcccctggtacaagggggcgggcctgtaacagtagtgctccagacttaagtgggtgtgacctgctctgctgtggacggggacaccgtcaagaatcggttcaactggaggaaaactgcctctgtcggtttcactggtgctgcgtcgtgcagtgccaccgatgtcgcgtgagaaaggaattgtccttatgtctatag

SEQ ID NO: 191732 - DNA, 987 bp, Artificial Sequence
  Description of Artificial Sequence: Synthetic coding sequence
atgggcttctggatcctggccatcctgaccatcctgatgtacagcacggccgcgaagttctccaaacagtcatggggactcgaaaatgaagccctgatcgtgcgctgccctaggcagggcaagccatcgtataccgttgactggtactactctcagacaaataagagcatccctactcaggaacgaaacagggtctttgcatcaggacagcttctcaaattcctacctgccgctgtggcagactccggcatttacacatgcatagttagatctcctactttcaatcgaactggttacgcgaatgtaaccatctataaaaagcaaagtgactgtaatgtgcccgactatctaatgtatagcacggtttccggctcagagaaaaactcaaaaatttactgccccactatcgacttgtataactggacagcgcccctagagtggtttaagaactgtcaggcccttcagggctcccgctatcgagctcataagtccttcctggtcatcgacaatgtgatgactgaggacgccggggattacacttgcaagttcattcataatgaaaacggcgctaactattctgtgacagctacccgctcgtttacagtgaaagatgaacaagggttctccctattccccgtcattggcgcccctgcacagaacgaaataaaagaggtggagatcggaaagaacgcaaacttgacctgtagcgcatgctttggcaaagggactcaattcttggctgcagtgctgtggcagctgaatggaactaaaatcaccgactttggggagcctaggatacagcaggaagaaggacagaaccagagtttcagtaacggacttgcttgcttggacatggtgctcaggatcgctgatgttaaggaagaagatcttctcctgcagtacgattgtttggccctgaatctccacggtcttcggaggcacaccgtgagactgtcaaggaaaaacccaagcaaggaatgtttctag

SEQ ID NO: 191733 - DNA, 780 bp, Artificial Sequence
  Description of Artificial Sequence: Synthetic coding sequence
atgggcttctggatcctggccatcctgaccatcctgatgtacagcacagcggcgaaattctctaaacaaagttggggcctcgaaaacgaggctcttattgtccgttgtccgcgtcaaggaaaacctagctacaccgtggattggtactactcacagaccaataaaagtattccaacccaggagcgcaaccgggtgttcgcctccggacagttgctgaaattcctcccggccgcggtcgcagactccggaatctacacatgtattgtccgctcccctacctttaaccggaccggctatgccaacgtgaccatttataagaaacagtctgactgtaatgtgccggattatctgatgtactccacagtatcaggctcagagaaaaactccaagatttactgtcctaccatcgacctttacaattggactgctccactggaatggttcaagaattgtcaggctcttcaggggtcccgctacagagctcacaagagctttttagtgatcgacaacgtcatgactgaggacgcaggcgactatacctgcaaatttatacataacgagaacggagccaactactccgtcaccgccacccgttcatttaccgtgaaagtgtggtgccaatccttctgcaagctaaaaaaatccctcatcttttccaatactcattggatccagagcctcatgaggggcttcgtgatggtgtactacggggtacacaaatgttgccgcgttgtattcaatttatgtctgcagtacttccagcatcaccagtggccctag

SEQ ID NO: 191734 - DNA, 636 bp, Artificial Sequence
  Description of Artificial Sequence: Synthetic coding sequence
atgtacagcaccgtgagcggcagcgagaagaacagcaagatctactgtcccacgattgatctctataactggacagctcctctggagtggtttaagaactgccaggctctgcagggctcaaggtatcgcgcccataagagtttcctggtgatcgacaacgtcatgaccgaagacgcaggcgattatacttgtaagtttatccataatgaaaatggcgctaactattccgtgactgcgacgaggtccttcactgtgaaggatgagcagggcttcagtttgtttccagtgattggggcccctgcccagaatgaaattaaagaggtggaaataggtaagaatgctaatcttacgtgctctgcttgcttcgggaagggtactcaattcttggccgccgtgctgtggcagctcaatgggacaaaaatcactgatttcggcgaaccgcgaattcagcaggaggaggggcagaaccaatctttctccaacggactagcgtgtcttgatatggtcttacgtatcgcagatgtgaaggaagaggatttgctcctgcagtatgattgcttggccctgaacctacatggtctcaggaggcacacagtgcgcctttcgcggaagaacccctccaaggagtgcttctag

SEQ ID NO: 191735 - DNA, 945 bp, Artificial Sequence
  Description of Artificial Sequence: Synthetic coding sequence
atgggcttctggatcctggccatcctgaccatcctgatgtacagcacagctgctaaattttcaaaacagagttgggggttagaaaacgaagcattgatcgtcagatgcccgcgacaggggaaaccttcctatacagttgactggtactactcccaaacgaataaatctatacccacacaggagaggaaccgggtctttgcgagtggacagctgctgaagttcctcccggctgccgtggccgactctggaatctatacatgcatcgtcaggtctcctacattcaatagaactggatatgctaacgtgacgatctacaaaaagcagagtgattgcaatgttcctgattacctgatgtattctacagtgtctggctccgagaagaattcgaaaatttattgtccaaccatagacctctacaattggaccgccccattggaatggtttaagaactgtcaagcccttcagggaagtcggtacagggcacacaaaagcttcctggtaatagacaatgtgatgaccgaagatgccggggattacacctgtaagttcatacataacgaaaacggcgcaaattactccgtgacagcaacaaggtccttcaccgtgaaggatgaacaggggttctccttattcccagtgatcggggcccctgcccaaaatgagatcaaggaggtcgaaataggaacacagtttctggccgctgttttgtggcagttaaatggcacaaagataacagacttcggtgagccacgcattcaacaagaggaggggcaaaatcagtcattctccaacggcctcgcgtgcttggatatggtgttgaggatcgccgatgtgaaggaggaggaccttcttcttcaatatgactgtctggccctgaacctgcatgggctgagacgccacactgtccgcttatccagaaaaaatccgagcaaggaatgtttctag

SEQ ID NO: 191736 - DNA, 117 bp, Artificial Sequence
  Description of Artificial Sequence: Synthetic coding sequence
atgggcttctggatcctggccatcctgaccatcctgatgtacagcactgccgctaaattctcaaagcagagttggggactggagaacgaggcactcattgtaaggtgtcctcgctag

SEQ ID NO: 191737 - DNA, 1728 bp, Artificial Sequence
  Description of Artificial Sequence: Synthetic coding sequence
atgtggagcctgctgctgtgcggcctgagcatcgccctgcccctgtccgtgaccgctgacggctgcaaagatatctttatgaaaaatgagattttaagtgcaagccagcctttcgcctttaattgtaccttcccccccataacaagcggagaagtgtctgtaacctggtacaaaaattccagtaaaatcccagtctctaaaatcattcagtctaggattcaccaggacgagacatggattttatttctgcccatggagtggggtgactcgggcgtataccagtgtgtcataaagggccgcgattcttgtcatcgtatacacgttaatctcacagtctttgaaaaacactggtgtgatacttcgatcgggggcttaccgaatctcagtgatgagtacaagcaaattctgcatctcggcaaagacgattcacttacatgccatctgcattttcctaagagctgcgtgttggggcctatcaagtggtacaaggactgcaatgagattaagggcgaaagatttactgtcctcgagacgcgcctgctggtgagcaacgtgagcgcagaggatcgaggcaactacgcatgccaggctattttgacccattctggaaaacagtacgaagtcttaaacggaatcacagtctctataaccgagagagctggctatggagggtcagtgcctaaaatcatctaccctaagaaccattcaattgaagtgcagctgggaacaacactgatagtggattgtaatgtgacggacacaaaggataacacaaatttacggtgctggcgggtgaacaatacattggtggatgattattacgacgagagtaaaaggatccgagagggcgtggaaacgcacgttagctttagggaacacaatctatatacggtgaatatcacatttctggaggtcaagatggaggattacggcctccctttcatgtgtcacgccggggtcagcacagcttacattattcttcaactgcccgctccagacttccgggcctacctcatcggagggcttattgcacttgtcgccgtagcagttagcgtcgtttatatttataatatctttaagattgacattgtcctgtggtataggagtgccttccactctacagagacgatcgtggatggcaaactgtacgatgcttatgtgctctacccaaagcctcacaaggaatcacagaggcatgccgtcgatgccttagtactaaacatcttgccagaggtgctggaaagacaatgcggatataagttattcatattcggtcgagacgaattccccggacaagccgttgccaacgtgatagacgaaaatgtaaagctgtgcaggaggctgattgttatagtcgtccccgagagcctcggctttggactgctgaagaatttaagcgaagaacagatcgccgtctattctgccctgatccaggacggcatgaaggtgatccttatagaattggaaaaaattgaggattacaccgtcatgccggaatcaatacagtacattaaacagaaacacggcgctattagatggcacggagactttactgaacagtcacagtgcatgaaaacgaagttctggaaaacagtcaggtatcatatgcctccaagacgctgccgtcccttccctcctgttcagcttttgcaacatacaccttgctatcggaccgccggaccagagctgggctcgcgacggaagaaatgcaccctcaccaccggctag

SEQ ID NO: 191738 - DNA, 519 bp, Artificial Sequence
  Description of Artificial Sequence: Synthetic coding sequence
atgtggagcctgctgctgtgcggcctgagcatcgccctgcccctgtctgtgacagctgacggttgcaaagacatctttatgaagaatgaaattctctccgcgtcccaaccattcgcattcaattgcacatttccaccaattacaagtggggaggtgagcgtcacctggtacaagaattcatctaagattccggtatctaaaattatccagagccgtatacaccaagatgagacctggatcctcttcttacccatggagtggggggactccggggtgtatcaatgtgttattaagggccgcgactcctgtcataggattcacgtcaacctgaccgtgtttgagaagcattggtgcgatacttcaatagggggcctgcccaatctgagtgatgagtacaaacagattttacacctgggcaaagacgactcattaacctgccacctgcacttccccaagagctgcgtgctgggtccgataaaatggtacaaagattgtaacgaaattaagggcgaacgctag

SEQ ID NO: 191739 - DNA, 1374 bp, Artificial Sequence
  Description of Artificial Sequence: Synthetic coding sequence
atgaccggcctggtgagcctgagctacttccccctgagcacccggagttgtgccttgcaaagctgttcacccgtatggggatgcggtccatgttgcagcgcaggatgtccaagcccattccactgcctatctcagcaggactgcaatgagataaaaggtgagagatttacagtcctcgagacccgactgcttgtcagcaacgtgagcgctgaagatcggggcaactatgcgtgccaagccatccttacccatagcggtaaacagtacgaggtcttaaatgggatcacggtttccattaagagagccggctacggtggatcagtgcctaaaatcatctatcctaaaaatcacagcatcgaagtccagctgggtacaaccttgatagtggattgcaatgtaactgacacaaaggacaataccaacctgcgctgttggagagtaaataacactttagtggatgattattatgacgagtctaaacgtatccgggaaggagtcgagacacacgtctctttcagggaacacaatctgtacaccgtcaatatcacctttctcgaagttaagatggaggattacggtctgcccttcatgtgccatgcgggtgtctccacagcgtacattatcctgcaattaccggcccccgacttcagggcctacctaattgggggattgattgcactggtcgctgtggcagttagcgtggtctacatctacaacatcttcaagatagacattgtgctctggtatcgtagcgcctttcactccacggaaaccatcgtggacggtaagttgtacgatgcttacgtgctctacccaaagccacacaaggaatcccagaggcatgcggtggacgctcttgttctcaatatcctccccgaggttcttgagcgacagtgtgggtacaaactgtttattttcgggcgcgatgaattcccagggcaggccgtagcaaatgtcattgacgagaacgtgaaactgtgtagaagacttatcgtcatcgtggtgccagagagtctaggatttggcctgcttaaaaacctttccgaggagcagatcgcagtgtattccgcacttatccaggatggcatgaaagtgattctgatcgaactggagaaaattgaagactacacagtcatgccagagtccatccagtatattaaacagaaacatggcgctatacggtggcatggcgacttcacagagcagtcccagtgtatgaagactaagttctggaaaaccgtgcgatatcacatgcctcctcgccgctgccgccctttcccacccgttcaactgctccaacatacaccctgctataggacagccggtccggaattgggaagtagacggaaaaagtgcaccctcaccacaggttag

SEQ ID NO: 191740 - DNA, 1728 bp, Artificial Sequence
  Description of Artificial Sequence: Synthetic coding sequence
atgtggagcctgctgctgtgcggcctgagcatcgccctgcccctgagcgtcactgcagatggctgtaaagatatctttatgaagaatgagattcttagcgctagccaacccttcgcttttaactgtacatttcctcccatcactagtggcgaggtgagtgtgacctggtataaaaattcctctaagatacctgtttctaaaatcattcagtctcgcattcaccaggacgagacctggatcctttttttgccaatggagtggggcgattcaggcgtctaccagtgcgtgattaaaggccgagacagctgccaccgaattcacgtaaatctgaccgttttcgaaaaacactggtgtgacacgagcatcggaggcctgcccaatctcagcgatgagtacaaacagattctccacttaggcaaagatgacagtctcacttgtcatttacactttcctaaatcctgcgttcttgggcctatcaagtggtataaggactgcaatgaaattaagggcgagcgctttaccgtgcttgaaactcggctgctggtgagcaatgtgagcgctgaagatcgcggaaactacgcttgccaggctatcctgactcacagcgggaaacaatacgaagtcttgaacggaatcacagtctctattaccgagagggcaggctacggtgggtcagtgccaaagatcatttacccgaagaaccatagtatcgaagtgcagctgggcacaactctcatagtggattgcaatgtcactgacacaaaagacaatacaaatttgcggtgttggcgggtgaataacacattggttgacgattattatgacgagtctaaaagaatcagagaaggcgtagagacacacgtgagcttcagggaacataatctgtacaccgtgaatattacattcctagaggtgaagatggaggactatggcctgccgttcatgtgccatgccggggtttccacagcttacattatcctccaactcccagcccctgatttcagagcatatctgatcggaggactcattgcactagtggctgttgctgtgtctgtcgtgtatatctataatatttttaagatcgacatcgttctgtggtataggtctgcttttcactcgaccgaaactattgttgacggtaagctgtatgacgcctacgtcttatatccaaagccccataaggaaagccagcgacacgcagtcgacgcactggtgcttaatattctgccagaagtgctcgagcgtcaatgcggttataaactgttcattttcggacgcgacgagttcccagggcaggccgtggccaacgtgatcgacgaaaatgtcaagctctgccgcaggctcattgtcatcgttgtgcccgagtccctcgggttcgggcttctgaagaacctgagcgaggagcagattgcggtgtatagcgctctgattcaggacggaatgaaggtgatcctcattgaacttgagaagatcgaagactacaccgtgatgccagagagcatacagtacatcaagcaaaaacacggagcaatcaggtggcacggcgactttaccgaacagtcccaatgtatgaagacgaagttctggaaaaccgtgcggtaccatatgcccccacgtcgctgcagaccctttccccctgtgcagttgctgcagcacactccatgctaccggactgccggcccagaactgggatctcggcggaagaaatgtaccttgacaacggggtag

SEQ ID NO: 191741 - DNA, 300 bp, Artificial Sequence
  Description of Artificial Sequence: Synthetic coding sequence
atgcagccccgggtgctgctggtggtggccctgctggccctgctggcttccgcgcgcgcgtcggaagccgaggacgctagtctgctgtcttttatgcagggttacatgaagcatgccacaaagacggcaaaggacgctttaagtagcgttcaggagtctcaggttgctcaacaggcgagaggttgggttaccgatgggttttccagtcttaaggattactggtctaccgtcaaggacaaattttcagagttctgggacctggaccctgaagttcggcctacatcggcggtggctgcatag

SEQ ID NO: 191742 - DNA, 1500 bp, Artificial Sequence
  Description of Artificial Sequence: Synthetic coding sequence
atgagccggaccgagctgcccagcccccccagcgtgtggttcgaggctgaattttttcatcacatcctgcattggacccccattcccaaccagtctgagagtacatgctacgaagttgccctgctacgctatggcattgagtcttggaattccattagcaattgttcccagaccctctcttacgacttgacagctgtgactctggacctgtaccattccaacggctatagagctagggtccgcgccgttgacgggtccagacactctaactggaccgtcacaaatactaggtttagcgtggatgaggtcacactcaccgtgggttccgtgaacctggaaatccataacggttttatcctgggtaaaatacagctgcctcgacccaagatggcgccagctaatgacacatacgagtccatatttagccacttccgagaatatgaaattgccattcgcaaggtgcctgggaattttacatttactcacaaaaaggttaagcacgagaacttttcactgctgacaagcggtgaggtgggggagttttgtgtgcaggtaaagccgtctgtggcctcacgctccaataaaggcatgtggagcaaggaagaatgtatctctctcacccgtcagtacttcacagtcaccaacgtgataatttttttcgccttcgttctgcttctctctggcgctctcgcatattgtttggcactgcagttgtacgtcaggcgaaggaaaaaattgccaagtgtgttgctcttcaaaaaaccttctcccttcattttcatcagccaacggccatcacccgagacccaggatacaatccaccctctcgatgaggaagcttttttgaaagtcagccctgaactgaaaaaccttgatttacatggttctactgacagcggcttcggaagcacaaagccatcgctacagactgaggaaccccagtttttactgcccgatcctcacccacaggcagataggactctcggtaatagagagcccccagtgttaggagattcatgtagctccgggagttctaatagtacagattctgggatttgtctgcaggaaccatccctgagcccgtccactggaccaacatgggaacaacaagtcggcagcaactcccgcgggcaagatgattccggcatagacttggttcagaactcagagggacgcgctggtgatactcagggcggctctgcacttgggcatcattcccctcccgaacccgaagttcccggagaggaagaccctgctgcagtagcctttcagggatacctcaggcaaaccaggtgcgcagaagagaaggcaaccaagaccggatgtctggaagaagagtctccccttacggacggcctgggccccaagtttggccgctgcctcgtggacgaggcaggccttcacccaccagccctggccaaaggttaccttaagcaagatccgttggaaatgacactcgcgtcctccgggcccaacgggaccgtcgagcctgcgcattag

SEQ ID NO: 191743 - DNA, 1677 bp, Artificial Sequence
  Description of Artificial Sequence: Synthetic coding sequence
atgagccggaccgagctgcccagcccccccagcgtgtggttcgaggccgagtttttccaccatatcttgcactggacgcctatcccaaatcaatccgagagcacttgctatgaggtagctctccttaggtatgggatcgaaagttggaattctataagtaactgtagtcagacactctcctacgacctgaccgccgtaacattggatctgtaccattctaatggctatcgggcccgagtgcgggccgtcgacgggagtcggcactcaaactggacagtgaccaatacacggttttccgtggacgaggtgactcttacagtcggctctgtgaatctcgagattcacaatggttttatcctgggaaaaatacagctccccaggcctaagatggccccggcaaacgacacctatgaatccatcttctcccatttccgagagtatgagatcgcaattcgtaaagtacctggtaacttcacttttacgcataaaaaagtcaagcacgaaaatttctcactgctgacatccggagaagtaggcgagttctgcgtgcaggtgaaaccaagcgtagcttcccgatccaacaagggcatgtggagcaaagaggaatgtatttctctgacccgccagtatttcacggtaactaacgtcatcatcttctttgcctttgtgctcctgctttccggagccttggcctactgcctggcactgcaattgtatgtgcgacgtcgaaagaaactcccttcagtcctcctgttcaagaaaccctctccgtttatttttatcagccagcgcccatcccccgagactcaggacacaattcatccacttgatgaggaggcttttttgaaggtgagccccgagttgaaaaatctcgatctgcacggatcaaccgatagcggttttggttctaccaaaccatcactgcagactgaggagccacagtttctcttgcctgaccctcatccacaggcggatcggactctgggcaacagggagccccccgttctcggcgactcttgttcctctggatcgtcgaatagcaccgacagcggaatctgcttgcaagagccttcactctccccttccacaggtcctacatgggaacaacaggtcggctctaactctaggggccaggatgactccggaattgatctggtgcagaacagtgagggaagagccggggatacacaggggggatcggctttgggtcaccactccccaccggaacccgaagtcccaggggaggaggaccctgctgctgttgcgttccagggctatttgagacagacgagatgtgccgaagagaaagccaccaaaactggatgcctggaagaggagagcccgctgactgacggcctgggccccaaatttgggagatgcctcgtggatgaagctgggctccatccacccgcattggctaaaggatacctcaagcaggatcctcttgaaatgactttggctagctcgggagctccgacggggcagtggaatcagcccacggaggagtggtccctgctggccctcagttcttgctccgacctgggcatcagcgattggagttttgcccatgatctagccccactcggttgcgttgccgcgccaggcggactgctaggctcctttaattccgacctcgtaactttgcctctcatctcttccctgcagagcagtgagtag

SEQ ID NO: 191744 - DNA, 1290 bp, Artificial Sequence
  Description of Artificial Sequence: Synthetic coding sequence
atggcccccgccaacgacacctacgagagcatcttcagccacttccgcgagtatgaaatcgccattagaaaagtccctggaaacttcaccttcacgcacaagaaggtgaaacatgaaaacttcagtctgttaacgagcggcgaagttggggaattttgtgtacaggtgaaaccgagtgtcgcttctagaagcaacaaggggatgtggagcaaggaggagtgcatctctttgactcgccagtatttcactgtgacaaacgtgatcatctttttcgccttcgtgctgctcctgtccggagcgctggcctattgcctggcactgcagctgtacgttcgccgccgcaagaagcttcccagcgtccttctgttcaaaaagccctcgccgttcatctttatttcccagcgtccttccccagaaacccaggacacaatccaccccctggacgaggaggccttcctaaaagtctcccctgagctcaaaaatctggacttgcacggttccaccgattccggcttcgggtccactaaaccgagccttcagaccgaggagccacagttcctgttgccagatccgcacccccaggctgatagaaccctggggaaccgagaaccccctgtccttggagatagctgctcaagtggttcaagcaattcaaccgattccggaatatgcctccaggagcctagtctgtcccctagcacaggacctacgtgggaacagcaggtgggcagcaactccagaggacaggatgacagcgggattgatctcgtccaaaattccgagggccgggccggagacacgcagggcggaagcgctttgggccatcattctccaccagaacctgaggtgcccggcgaagaagaccctgccgcagttgcatttcagggctacttgcgtcagacccgatgcgccgaggagaaagcgaccaaaaccggctgtttggaagaggagagccctcttacagatggcttaggacccaagtttggccgatgcctcgtggatgaagccggcctgcatcctcccgctctcgccaagggctacttaaaacaggatcccctagaaatgacactagcaagcagcggtgctcctactggccagtggaaccagcccaccgaggagtggtccttgctcgctctatcaagttgtagcgacctggggatcagcgattggagctttgcccatgatctggctcctcttggttgcgttgcggccccagggggtctcctcggcagctttaactcagacttggtcacacttcctctaataagttcattacagagtagcgaatag

SEQ ID NO: 191745 - DNA, 1269 bp, Artificial Sequence
  Description of Artificial Sequence: Synthetic coding sequence
atgagcagcagctgcagcggcctgagccgggtgctggtggccgtggctactgctcttgtaagcgcaagcagtccatgtccccaggcctggggcccgccaggagtccagtatggacaaccgggtcggagtgtcaagctgtgctgccctggagtcactgccggagaccctgtcagctggttccgagacggggagcccaaactactacaggggcctgattccggcctgggccatgaactcgtccttgctcaggccgattctactgacgaaggaacctatatatgtcaaaccttagacggagcccttggtggcactgtgacactgcagttgggatacccaccagcacggccagtcgtgagttgccaggccgccgattacgaaaacttttcttgcacttggagtccaagtcagatttctggcctgcccacacggtaccttacatcgtatagaaagaaaaccgtcttgggggcagatagccagaggcggtctccttccacaggcccgtggccgtgtccgcaggacccccttggcgcagctagatgcgtcgtgcacggagctgagttctggtcacaatacaggattaacgtcactgaggttaatcctctgggtgcctcaacacgactgctggacgtgtccctgcaaagcatcctgagacccgaccctccgcagggacttcgcgtggagtcggttccgggataccccaggagactgagagcaagttggacttatcctgccagctggccgtgccagccacattttttattgaagtttaggctgcaatatcgtccagctcagcatccagcatggtccaccgtggagcctgcaggcctagaggaggttataacagatgctgttgctggcctgccacatgctgtccgcgtgagcgcaagggactttcttgatgcggggacctggtctacctggagtccagaagcatggggcactccctcaaccggaacgattcccaaagaaatccctgcatggggccagctgcacacacaacctgaagtggagccccaggtagattcccctgcacctcccagaccatccctacagccgcacccgagactgctggaccatcgggatagcgtggaacaggtggcagtgctcgcctctctcggcatactcagcttcctgggtctggttgcgggcgctttggccctgggtctgtggctgaggctccgcagagggggcaaagacggttcaccaaagccaggtttcttggcctccgtaatccctgttgatcggaggcccggggcaccaaatctctag

SEQ ID NO: 191746 - DNA, 1173 bp, Artificial Sequence
  Description of Artificial Sequence: Synthetic coding sequence
atgagcagcagctgcagcggcctgagccgggtgctggtggccgtggcgactgccctagtttctgcatcctccccatgcccccaagcctggggacctcctggagtgcagtacggccagcccgggcgctccgtgaaactgtgctgcccgggggtaacagctggggacccagtctcatggttccgagacggggaaccgaagctgctgcagggccctgattcagggctcgggcatgaattggtgctggctcaggctgatagcacagatgagggaacctacatctgccaaacactggacggcgccctcggcggcacggtcaccctgcagctgggctacccacccgcccgacccgtggtctcctgtcaggcagctgactacgaaaacttttcttgcacgtggagcccctctcaaatctccggtctgccaactcggtacctgacctcttacagaaaaaagactgtcttaggcgccgacagccagcgaagaagcccctccacgggaccctggccttgcccgcaggatccattgggcgcggctcgttgtgtcgtgcacggcgccgaattctggtcacagtaccgaatcaatgtgacagaggtgaacccactgggagcatccaccaggcttcttgacgtgagtctgcagagtatattgcgccctgaccctccgcagggcttaagagtggagtccgtgcccggctatccgcgcagacttcgcgccagttggacctatcctgcttcctggccctgtcaacctcatttcctcttgaaattcaggcttcagtatagacccgctcagcaccccgcttggagtaccgtggaaccggctggcctggaagaggtgatcacagacgccgtggcgggtctgccccatgccgtccgtgtgtccgccagagatttcctggacgccggtacctggtcgacttggtcgcctgaggcctggggaacccctagtactggcactatcccaaaggaaatcccggcttggggacagctgcatacccaaccagaggtggaacctcaggtggattcacctgctcccccccggccttccttacagccccatccacgccttctggaccaccgagattctgttgaacaagtcgccgtgctggcctcacttggtattctgtcctttctgggactggtggcgggcgctctggccttagggctctggtag

SEQ ID NO: 191747 - DNA, 1269 bp, Artificial Sequence
  Description of Artificial Sequence: Synthetic coding sequence
atgagcagcagctgcagcggcctgagccgggtgctggtggccgtggcaaccgctcttgtgtctgcttccagtccttgcccccaggcgtggggccccccaggtgtgcagtacgggcagcctggccggagcgtcaagctgtgttgtcctggagttacagccggggatcctgtctcctggttcagggacggcgagcctaagcttctccaaggaccagactctgggttaggacacgagctggtcctggcccaagccgattcaacagatgagggaacctatatctgtcagaccctggatggcgctctgggcggtaccgtgacactgcagctgggctatccacccgcacggccagtggttagctgccaagccgcagattatgaaaacttttcttgtacctggagtccctcacagatatcgggtctgcccacacgctacttaactagctatcgaaaaaagactgtgctaggcgccgactcacagcggagatctccctctaccggaccatggccctgcccacaagaccctctgggggcggcaagatgtgttgtgcatggcgcagaattttggagccagtacagaattaacgttactgaagtaaatcccctgggtgcgagcacccgcctccttgacgtttccctgcaaagcatactccggccagacccaccccagggcctacgggttgaatctgttccagggtaccctagacgcctgcgcgctagttggacttaccccgcaagttggccttgtcagcctcactttctcctgaagttccgcctgcaataccgacctgcgcagcatcctgcctggtctaccgttgaacctgctggcctcgaagaggtgatcacagatgccgtcgcgggcctcccgcatgccgtcagggtctctgcgagagatttcctggatgctggtacttggtcaacttggtctcccgaggcgtggggaactccaagcactggcaccattcccaaggaaatccccgcatggggtcagctacacactcagcccgaggttgagccccaggttgattcccccgccccaccacgaccaagtttgcaaccacacccccgtcttcttgaccatcgcgacagcgtcgagcaggtagctgtgcttgcgagccttgggattctatcctttcttgggctcgtggcaggagccctggccctgggcctttggctacgccttcgaaggggtggaaaggacggaagtcctaagccaggcttcttagcaagcgtcataccagtggacaggaggcctggcgctcccaatctctag

SEQ ID NO: 191748 - DNA, 1269 bp, Artificial Sequence
  Description of Artificial Sequence: Synthetic coding sequence
atgagcagcagctgcagcggcctgagccgggtgctggtggccgtggcaactgctttagtttcggcctcttctccctgccctcaggcttggggaccgccaggagtgcaatacggtcagcctgggaggtcagtcaaactgtgctgcccaggtgtgacagccggcgatcccgtctcgtggtttcgcgatggggagcctaaactccttcagggacctgactctggcctagggcatgagctggtgcttgcccaggcagatagcacagatgagggcacttacatttgtcagactctcgacggcgcccttggcggcactgtgactctgcagctagggtacccaccagcaagacctgtagtctcttgccaggctgcagactacgagaatttcagttgcacttggtctcccagtcaaatttcggggctgcccacacgttacctaacttcctatagaaaaaagaccgtgctcggggcggattcacagagaagatctccctccaccggtccctggccttgtccgcaagatccgttgggtgccgctcgctgcgtagtgcacggcgccgaattctggagtcagtataggatcaacgtgactgaagtaaaccctttaggtgcatctacacgcttgctcgacgtgtcacttcaatctattctgcggcccgaccccccgcagggcttacgtgtggagtctgtccccggataccccaggcggctcagggcttcatggacctatcccgcaagctggccatgccaaccccatttcctccttaaattcaggctgcaatatcgccccgcgcagcaccctgcatggtccaccgtggaaccagccggtctcgaagaagtcattactgatgcggtggctggtcttccccacgccgtcagagtttccgctcgcgactttctggatgcaggtacatggagtacctggtcaccagaggcttggggaacaccaagcactggtacaatacccaaagaaattcctgcttggggccagctacacacacagcccgaggtggagccacaggtcgattccccagcacccccacgtccttcactccaaccacacccccgcctactggaccacagagattccgtggagcaggtagccgtactggcttccctggggattctgtcattcctcgggttggtagcaggggctctggcactgggcctgtggctcagattgaggcgaggaggcaaagacggatccccaaaaccgggatttttagcatctgtgattccagtcgatcggagacctggcgccccaaacttgtag

SEQ ID NO: 191749 - DNA, 813 bp, Artificial Sequence
  Description of Artificial Sequence: Synthetic coding sequence
atgagcagcagctgcagcggcctgagccgggtgctggtggccgtggccaccgccctggtcagcgcatcttccccctgtccacaggcatgggggcctcctggtgtgcaatacggacaacccgggaggagcgttaaattgtgctgcccaggagttaccgcaggggaccctgtgtcctggttccgagatggcgagcctaaacttctccaaggccctgacagtggcctcgggcacgaactagtactcgcgcaggcagatagcaccgatgaagggacttatatctgtcagacgttggacggtgctctgggggggacagtgacattgcagttaggctatcctccagcccgccccgtcgtcagttgtcaggcagcagattacgaaaatttctcttgcacttggagtccttcccagatcagcggactacccacccggtatttaacctcttacaggaagaagaccgtgcttggtgccgactcccaaagacggtcgcctagcacagggccctggccctgcccacaggatcctctgggtgccgcccgttgtgtggtgcacggggccgagttttggtctcagtacaggatcaatgtgactgaggtgaaccccctgggcgctagcacccggctcttggatgtgtccctgcagtccatactcaggccagatccgccccaggggcttcgggtagagagtgtacccggatatccacgcagacttagggcttcctggacctaccccgcctcatggccttgccagcctcattttttactcaagtttcgcctacagtatcgccctgcacagcaccctgcgtggagcacctag

SEQ ID NO: 191750 - DNA, 504 bp, Artificial Sequence
  Description of Artificial Sequence: Synthetic coding sequence
atgagcagcagctgcagcggcctgagccgggtgctggtggccgtggctacagcactcgtgtccgccagctctccatgtccccaggcttggggcccgcccggggtgcagtacggacagcctggtaggagcgtcaaattatgctgccctggggtgactgccggagatcccgtttcctggttccgcgacggtgagcctaagttactgcaggggcccgatagtggactgggacacgagctcgtactggcccaagctgactctacagatgaaggaacatacatctgccagactctggacggcgcgcttggcgggactgtgacactgcagctgggatacccccctgcccgcccagtcgtttcctgtcaagccgccgattacgagaatttttcatgtacctggagcccgtcgcagatcagcggcttacccacacggtacctcacctcttaccgtaaaaaaacggtgctgggtgcagacagccagagaaggagtccgagtaccgggccttag

SEQ ID NO: 191751 - DNA, 420 bp, Artificial Sequence
  Description of Artificial Sequence: Synthetic coding sequence
atgagcagcagctgcagcggcctgagccgggtgctggtggccgtggcaaccgcactggtgtccgctagcagcccatgccctcaggcctggggcccgcctggggtgcagtacggtcagcccgggaggtccgtgaaactatgttgtcccggagtgacggcaggcgaccccgtgagctggtttcgcgacggggaacccaaactcttacagggcccggacagcggcctcggtcacgagctcgtgctggctcaagccgactcaactgacgagggaacctacatctgccagactctggatggtgcccttggcggtaccgtgacattgcagcttgggtaccctccagctcgacctgtggtgtcatgccaggctgccgactacgagaacttcagctgtacttggtcaccctcccagatctctggctag

SEQ ID NO: 191752 - DNA, 1989 bp, Artificial Sequence
  Description of Artificial Sequence: Synthetic coding sequence
atggagcccctggtgacctgggtggtgcccctgctgttcctgttcctgctgtcacgccagggtgctgcctgcaggacctctgagtgctgcttccaggatccaccgtaccccgacgccgactcgggctccgcctcgggaccaagggacctccgctgttaccgaattagcagcgatcgctatgaatgcagttggcaatatgagggccctactgctggggtgtctcattttctgagatgttgcctgtcctccggacgctgctgttatttcgccgcaggatctgcaacccgattgcagttcagcgaccaggccggagttagtgtgctatataccgtaactctctgggtggagtcctgggctagaaatcagaccgagaaatcacccgaagttacgcttcagttatacaactccgttaaatacgagcctccgttgggggatattaaggtcagcaagttggcgggccagcttcgtatggagtgggagacgcctgataatcaggtgggcgcagaagtccagttcaggcatagaacaccgtcctctccatggaagctcggcgattgcggcccccaggatgacgatacagagagttgcctgtgtcctctggagatgaacgtggcccaggagtttcagttacgccgaaggcagctggggtcgcaggggagttcctggtcaaagtggagttccccggtttgcgtgcccccagagaatcccccccagccccaggtgagattctcggtcgaacagctcgggcaggacgggcgtcgcaggttgactctgaaggaacagcctacccaactcgaactgcctgagggctgtcagggtttggccccagggaccgaagtgacctataggctacaacttcacatgttatcctgcccttgtaaggccaaagctactcgaactctccatctcgggaagatgccctatctgtctggcgcagcttacaatgtagctgtaatcagcagcaatcagtttggccccggcctgaatcaaacatggcatattccagctgacactcacaccgagccagtggccttgaacatctccgtgggcaccaatggcactactatgtattggcctgccagagctcagtcaatgacatattgtatagagtggcagccggtaggacaggatggagggctggctacctgctccctcaccgcgccccaggatcccgatccggctggaatggccacgtactcttggtctagagaatcaggcgctatgggccaggaaaaatgctattacattacaatcttcgcatccgcacatccagagaaattaacattgtggagcacagtgctgtccacttatcactttggtgggaacgctagcgcagccggaacaccacaccacgtgtctgtcaagaatcattccctggactctgtgtcggtagattgggccccctctctgttgagcacttgtcccggagtgttgaaggagtacgtggtacggtgcagagatgaggactcaaagcaggtaagtgagcaccctgtgcagcccactgagacacaggtcacactcagtgggcttagagctggggtggcttacaccgtgcaggttagggccgataccgcctggctcaggggcgtgtggagccagccgcagcggttcagtatcgaggttcaggtgagcgactggctgatcttttttgccagcttaggatcattcctttcgatactcctcgtcggagtactgggttatctaggactgaatagggccgcccgccatctttgcccgcctcttcctacaccttgcgcttctagcgccattgaatttcctggcggcaaggaaacctggcaatggattaatcccgtggatttccaagaggaagctagcctgcaggaggcactagtggtggagatgagctgggataagggcgaacgaactgagccattggaaaagacagagttacctgagggcgcacctgagctcgcccttgatacggaactttctctggaagacggcgatcgctgcaaggcgaagatgtag

SEQ ID NO: 191753 - DNA, 1146 bp, Artificial Sequence
  Description of Artificial Sequence: Synthetic coding sequence
atggagcccctggtgacctgggtggtgcccctgctgttcctgttcctgctgtctagacagggcgcagcttgtagaacttccgagtgttgcttccaggatcccccataccctgatgccgatagcggatccgcttccgggccccgcgaccttcgatgctataggatcagcagcgataggtatgagtgctcgtggcagtatgaagggcccactgcaggagtcagccattttcttagatgctgcctcagtagcggtaggtgttgttactttgccgcaggaagcgccacacgccttcagttttcagaccaagccggggttagcgtgctgtacaccgtcacactttgggtggagtcttgggcccggaaccaaaccgaaaagtcacctgaggtgacgctccagttatataatagtgtgaaatacgaacccccactcggagatatcaaggtgagtaagttggctggccagctacggatggagtgggagacgccggataaccaggtaggagccgaggttcagttcaggcatcggacaccgtcctctccctggaagctgggagactgcggcccccaagacgacgatactgagtcatgtttgtgcccactggaaatgaatgtggctcaagaatttcagctcaggcggcgccagctgggctcccaagggtccagctggtccaaatggtcttccccagtttgtgtgccacctgaaaacccgccacagccccaggtgaggttctccgttgaacagctgggccaggacggccggcggagactgacacttaaggaacaaccaacgcagctcgaactacccgagggttgtcagggtctcgcccctggaaccgaggtgacttatcgactgcagctgcatatgctctcatgcccttgtaaggcgaaggctaccaggactcttcatctcggaaaaatgccttacctctcaggagcggcttataatgtggccgtgatcagctctaaccaatttgggcctggcctcaatcagacttggcatatacccgccgacacccacaccgacggaatgataagcgcccactgtaatctgagactccctgattcaagagattcaccggcctcagcatcgcgcgttgccggcatcacaggcatctgccaccacacacggctcattctctatttttag

SEQ ID NO: 191754 - DNA, 1989 bp, Artificial Sequence
  Description of Artificial Sequence: Synthetic coding sequence
atggagcccctggtgacctgggtggtgcccctgctgttcctgttccttctgagcagacagggggcggcttgccgtacatcagagtgctgctttcaagatccaccctacccagatgcagacagcgggtccgcgtccggaccaagagacctaagatgttaccggatctccagcgatagatatgagtgttcgtggcaatacgaggggccaacagcgggcgtgagccactttcttagatgctgcttaagctccggacgctgttgctattttgccgcgggttctgcgaccagacttcagttctctgatcaagccggggtgagcgtgctgtacactgtcaccctgtgggtggagtcctgggcccgcaaccagacggaaaaatccccagaagtgactctacagctctataattctgtaaagtacgagcccccgctgggcgacatcaaagtgtcaaaactcgccgggcaactcaggatggagtgggaaacccccgataatcaggtaggagcggaggtccagttccggcaccgtacaccgtctagcccttggaagcttggtgactgtggcccccaggacgatgataccgaatcatgtctgtgtcctctagaaatgaacgttgcccaggagttccagttgaggcgccggcaactaggatcccaaggttcaagttggtccaagtggagcagccctgtgtgcgttccacccgagaaccctcctcagccccaggtgagattttccgtggaacagcttgggcaggacgggagacggaggctcacgctgaaagaacaacccacccagctcgaattaccagagggctgtcagggcctggcccccggaaccgaggttacctacaggctccagctacatatgctgtcctgcccatgtaaggcaaaggctacaagaacactgcatcttggtaagatgccctacctgtctggagcagcctacaatgtggccgtgatatcatccaatcagttcgggcctggactaaaccagacctggcacatcccggccgacactcacacagagccagttgccttaaatattagcgtagggactaatggcactacaatgtactggcccgccagggctcaatctatgacgtattgtatagagtggcaaccagtggggcaagatggcggactggccacttgttcgctaaccgcgccacaggaccccgatcctgcaggaatggctacttactcttggagcagagaatcaggcgctatgggccaggagaaatgttattacattaccatctttgcaagtgctcacccagagaagttgacactgtggtccaccgtcttgagtacctaccattttgggggcaatgcctctgccgcggggacaccacatcacgtttccgtaaaaaatcactctctggacagcgtcagtgtggactgggcaccatccctgctttcaacctgccccggagtgctcaaggagtatgtggttcgttgccgcgacgaggattcaaaacaggtgagtgaacaccctgtgcaacccactgaaacccaggtcacccttagcgggctacgggccggcgtggcctacacagtgcaggtcagagctgatacagcttggctgcgaggcgtgtggtctcagcctcagagattctctatcgaggtacaggttagcgattggctcattttctttgcatccctgggcagctttctgtccatcctactggtcggagtcttgggatacctggggctcaatagggccgcacggcatttatgcccccccttgcctaccccctgcgcttcctccgccattgagttccctgggggaaaggagacgtggcaatggatcaatcctgttgattttcaggaggaggcttctttgcaggaagccctcgtagtggaaatgagctgggataagggcgaacgtactgagccccttgagaaaacggagcttcctgagggtgcccccgaactggccctggacaccgagttatccctggaggatggcgataggtgtaaggcgaagatgtag

SEQ ID NO: 191755 - DNA, 2589 bp, Artificial Sequence
  Description of Artificial Sequence: Synthetic coding sequence
atggcccacaccttccggggctgcagcctggccttcatgttcatcatcacctggctactcattaaagccaaaatcgacgcctgtaagagaggagacgtcaccgttaagcccagtcatgtcatcctcctcggcagtactgtgaatatcacctgctctctgaagcccaggcagggctgcttccattactcccgaaggaacaagttaattctgtacaagttcgacaggaggatcaattttcatcacggacattccctgaattcccaagttacaggactgcccctgggaaccacgctcttcgtgtgcaaattagcctgcattaactctgatgaaattcagatttgcggcgccgaaatctttgtgggggtggcacccgagcaaccccagaatttgtcttgcatccagaaaggcgaacagggtacagtggcttgcacttgggaacgaggtcgagatacccacttgtataccgaatatacactccagctctctggacccaagaacctcacctggcagaaacagtgtaaggatatctattgcgactatttagacttcggcataaatctgacaccagaaagccccgaaagcaacttcaccgctaaggtgacggcagtcaactctttgggctcctcatcctctcttccctccacgttcacctttttagacatcgtgagaccactgcccccctgggacatcaggatcaagttccaaaaggctagtgtaagccgctgtacactttactggcgcgatgaggggctggttctgcttaacagactcagataccgaccatcaaactccaggctttggaacatggtaaacgttaccaaggcaaagggccgccacgacttactcgatctgaagcccttcactgaatacgagtttcagatctcctccaagctgcatctgtataagggctcctggagtgattggtccgagagcctcagagctcagacacccgaagaggaacccaccgggatgcttgacgtttggtatatgaagcggcatatcgactactccagacaacagattagtctcttttggaagaacctcagcgtgtcggaagcccgaggaaagatcctgcattatcaggttaccttacaggagttgactggaggaaaggcgatgacacagaacatcaccggacataccagctggacgaccgtaatacctagaactggaaattgggccgtggccgtgagcgcagctaacagcaagggcagcagcctccccacaaggataaacatcatgaacttatgtgaggcgggcctgctcgccccacggcaagtgtcagccaatagtgagggcatggacaacatcttagttacctggcaaccgccacgaaaagatccaagcgcagttcaagagtacgtcgtcgaatggcgagagctccacccaggaggcgatacgcaggtgcctttgaactggttacggagccgtccctacaatgtttcagcccttatctccgagaatatcaaatcttacatttgctacgagataagagtgtatgcccttagcggcgatcagggcggctgttccagtatccttggtaatagcaagcataaagcacctctctctggacctcacatcaatgctattacagaggagaagggatctatcctgatcagttggaatagtatccccgtgcaggagcaaatggggtgcctgctccactaccgcatctactggaaagagagagactcaaattcccagccgcaactgtgcgagatcccctaccgagtgagccagaactcccacccgatcaactctttgcagcctcgagtgacctacgtcctgtggatgacagccttgaccgcagcaggggagagcagccatggaaacgaaagagagttctgcttacaaggcaaagccaactggatggcatttgtagctccatcaatctgtatcgccatcatcatggtaggaatcttctctacccactattttcagcagaaagtattcgtgctcctcgccgctctcagacctcagtggtgcagccgcgagatcccagatcccgcgaattcaacatgcgctaaaaagtaccccatcgcggaagagaagacacagctacctttggaccggctgctcatcgattggcccacccctgaggaccctgagcccctggtcatttctgaggttctccaccaggttacacctgtatttcgccatcccccttgtagtaattggccacagagggaaaaagggatccaagggcaccaggcttcagagaaggatatgatgcacagtgcctcctccccccccccccccagggccctccaggctgagtctaggcaactcgtggacctgtacaaggtgctcgaatcaaggggttccgaccccaaacccgagaaccccgcttgtccatggactgttttgcctgccggggacctgccgacccatgacggctaccttcccagcaatatcgacgatttgccatcacatgaggcacctctcgcagatagtttggaagagttggaacctcagcacatttcactgtcagtcttccccagttcatctctgcacccattgacattctcatgtggagacaaactgactcttgatcagcttaaaatgcgctgtgattctctaatgttatag

SEQ ID NO: 191756 - DNA, 1980 bp, Artificial Sequence
  Description of Artificial Sequence: Synthetic coding sequence
atggcccacaccttccggggctgcagcctggccttcatgttcatcataacatggctcctgataaaggctaagatcgacgcctgcaagcggggtgacgtgaccgttaagccttctcacgtgatactgctcgggagcacagtgaacattacatgctcgttaaagccgagacaggggtgctttcattattctaggagaaacaagctcattctttataagtttgaccggcgcattaactttcatcacggacatagtctgaacagccaggtgacgggcctgcccttggggacaactctgttcgtgtgcaagctggcttgcatcaattccgatgagattcagatctgcggtgccgaaatatttgtcggtgtcgctccggaacagccacagaacctctcttgcatacagaaaggcgaacagggcacagtcgcctgcacgtgggagcgaggaagagacactcacctgtacaccgagtacactttgcaattatccgggccgaaaaatctgacctggcagaaacaatgcaaggatatttactgcgactatcttgacttcggaatcaatctgacaccagagtcccctgaatccaatttcaccgctaaggtcactgctgtgaactcgctgggaagctccagctcgctgcccagtacctttactttcctggacatcgtgcgtccactgccaccctgggacattcgcattaagtttcagaaggcgtctgtgagccgctgtacattatactggagagatgaaggcctggtgctgctaaataggctgcgctataggccaagtaactccaggctctggaatatggtgaacgtcactaaagcaaagggccggcacgacctgttagatctgaagccctttacggaatatgagttccagatctcatcaaagctgcatctttacaaaggatcctggtctgactggtccgagtccctccgggcacagacacccgaggaggaaccaacagggatgctcgatgtgtggtatatgaagcggcatatcgattactcacgacagcagatctctctcttctggaaaaacttgagtgttagtgaggctcgagggaaaattctgcactaccaggtgaccctgcaagagttaacaggaggcaaggccatgacacagaatatcacgggtcatacgtcttggactaccgtgatccccagaaccggtaactgggcggtagcggtgagcgccgcaaacagcaagggctcttcccttcctacacgcattaacattatgaacctctgtgaagccggactgctcgcccctcgtcaagttagtgcgaactcagaggggatggataacatcctggtgacctggcagcctcccaggaaggaccctagcgccgttcaggagtatgttgtggagtggagggaactccatccggggggagacacccaggtgccattgaactggctgcgatcccgcccctataacgtttccgctcttattagtgagaacattaaaagctacatatgttatgagattagagtgtacgcgctcagcggggatcaggggggttgttcctctattctgggtaactcaaaacataaagcccccctgtctggaccccacattaatgccatcactgaggaaaagggatcgatactgatatcatggaattctattcctgttcaagaacaaatgggatgcctgctgcattaccgcatttattggaaggagagggactccaattcccagccccaattgtgcgagattccttacagagtctcacaaaacagtcatccaattaattctctccagccccgcgttacatatgtgctatggatgacagccttgacagcggccggcgaaagctctcatggaaatgaacgtgagttttgcctccaaggtaaggcaaactggatggccttcgttgctccttcaatctgcattgcaataattatggtggggatttttagcacccactattttcagcagaaaaggcgtcactcgtgtccctggacgggatcatag

SEQ ID NO: 191757 - DNA, 693 bp, Artificial Sequence
  Description of Artificial Sequence: Synthetic coding sequence
tgacagaagggcgagcagggcaccgtggcctgcacctgggagcggggccgtgatacacacctctacaccgaatacaccctgcagcttagtggtcctaagaacctgacctggcaaaagcagtgtaaggatatctattgcgattatttagattttggcataaaccttacacccgagtctcccgaatcaaatttcacagccaaggttaccgctgtgaatagtctgggcagcagcagctccctgccttctacctttacctttctggatatagtccgtcccctgcccccttgggatatccgcattaagttccaaaaggctagcgtttctcggtgcaccctttactggcgcgacgagggactggtactattaaaccgccttcgctatagaccgtcgaactctagactgtggaacatggttaatgttaccaaagccaaaggccggcatgacctgctcgatctcaagccatttacagagtacgagttccagatcagctctaaactgcatctctacaaaggaagttggagcgactggagtgaatctttgcgcgcccagacccccgaagaggagcccacagggatgctggacgtctggtatatgaaaagacacattgactatagccgccaacagatctccttattttggaaggtatcattcaagcgccagttgaagacacaggggaataaaaccgagggctag

SEQ ID NO: 191758 - DNA, 1980 bp, Artificial Sequence
  Description of Artificial Sequence: Synthetic coding sequence
atggcccacaccttccggggctgcagcctggccttcatgttcatcattacatggctactgataaaagcaaagattgacgcctgcaaacgaggtgacgtgactgtgaaaccttctcacgtcatcttgctcggatccacagtgaacatcacatgcagcctgaaaccgagacagggctgcttccactattctcggaggaacaaactcattctgtataagttcgataggcgaatcaatttccatcacggtcattctcttaattcccaggttaccggtctccccctaggcacgaccctgtttgtatgtaagcttgcttgtattaattcggacgaaatccagatctgtggtgctgagattttcgtcggtgtcgcgccagaacaaccccagaatctaagttgcattcagaaaggggaacaggggaccgtggcctgcacctgggagcgtggacgggacacacacctctataccgagtacacgttacagttaagcggacctaagaacctcacgtggcaaaaacagtgcaaggacatttactgcgactacctcgacttcggcattaatctgactccggaatccccggaaagcaattttactgcaaaggtgaccgccgtgaattcactggggtctagctctagccttccctcaactttcacatttcttgatatcgtgagaccgttaccaccctgggacatccgcattaaatttcagaaagcctctgtctcacgttgcacactctattggcgggacgaaggccttgttctgctgaataggctcagatatcgaccctctaacagcagactttggaacatggtgaatgtcaccaaagcaaagggacggcatgacttgcttgatctgaaaccattcacagaatacgagtttcagatttctagcaagctgcacctctataaaggttcctggagcgattggtccgaatctctgagagcccagacccctgaagaagaacccaccgggatgcttgacgtgtggtatatgaagaggcacatcgactattcccgccagcagatttccctgttctggaagaatctgagcgtatccgaagcacggggcaagatcttgcattaccaggtgaccttacaagagctcaccggtggaaaggctatgacccagaacatcacagggcacaccagttggaccaccgtgataccgcggacaggaaactgggcagtggccgtgagtgctgccaattccaaggggtcttctctgcctacacgaatcaatattatgaatctctgtgaagctggcttgttggcgccaagacaggtgtcagctaattccgaaggcatggacaacattctagtgacctggcagcctccgcgcaaagaccccagtgctgtgcaggagtatgtagtcgaatggagagagctacatcctgggggcgacacacaggtccctctaaactggctgcggagtcggccttacaatgtttctgccctgattagcgagaatatcaagtcatatatctgctacgaaattcgcgtttatgctctgtcgggcgaccaggggggttgtagttctatcctggggaacagcaaacacaaggcaccgttatccggtcctcacataaacgccattacagaggagaaaggcagtatcttgatcagctggaattccatacccgtccaggaacagatgggctgtctcttgcattacagaatctactggaaggaacgtgatagcaacagccagccccagctatgtgagataccgtaccgggtgagccagaacagccaccctattaattctctccaaccccgagtgacatatgtgctgtggatgacagcactaactgcagcgggggaaagttcccatggcaatgagcgggaattttgtctgcaggggaaggctaactggatggccttcgtcgctccaagcatctgtattgccattataatggtcggaatctttagcacacactatttccaacagaaacgtcggcattcatgtccctggacagggtcgtag

SEQ ID NO: 191759 - DNA, 2331 bp, Artificial Sequence
  Description of Artificial Sequence: Synthetic coding sequence
atggcccacaccttccggggctgcagcctggccttcatgttcatcataacctggttgctgattaaagctaagatcgacgcgtgcaaaaggggggacgtgacggtgaagccctcccacgtcattctacttggcagcactgtgaacattacctgttctctaaagccaagacaagggtgctttcattatagcagacgaaataagctcattctgtacaaattcgatcgccgcataaattttcatcacggccacagcctcaattcacaggttacaggcctgcctctgggcactacgctgttcgtctgtaagctggcttgcatcaacagcgacgaaattcagatttgcggagccgaaatctttgtcggggtggcgccagaacaacctcagaacctttcgtgtattcagaaaggcgagcagggaactgtggcatgtacctgggaaaggggtcgggacacacatctgtataccgaatatacactccaattaagtggaccaaaaaacctgacttggcagaagcagtgcaaagatatctactgtgactatctggattttggaataaatctcaccccagaatcacctgaaagtaacttcactgccaaagtgaccgctgtgaattctttggggtcatcctctagcttaccttctaccttcactttcctcgatattgtgcgcccactccctccttgggacatccggataaagttccagaaggcatccgtgtctcgatgtacactttactggcgggacgaaggactggtgttgttaaacaggctgaggtacaggccctccaactcccgcctgtggaatatggtgaatgttactaaggcaaagggacgacacgatctgctagacctcaagcctttcaccgagtatgagtttcagatttcttcaaaactgcatctgtacaagggaagttggtccgattggtccgaatcccttcgggcccaaacacctgaggaggaaccaacaggcatgctggatgtgtggtacatgaagaggcacatcgattacagcaggcagcagatctcactcttttggaagaatttgtccgtgtccgaagctagagggaaaattctgcactaccaggtgacgctgcaggagttaaccgggggcaaagccatgacccagaatatcacagggcacactagctggacaaccgtgatcccgcgcaccggaaactgggccgtggcagttagtgcagccaattccaaaggcagctcactgccgactcgcattaacattatgaacttgtgtgaagctgggctcctcgctcctagacaagtttccgctaacagcgagggaatggataacatcctggtgacgtggcagccccctcgaaaggatccctccgcagtgcaggagtacgtggttgagtggcgcgagctgcatcctgggggtgacacccaggtgccgctcaactggcttaggtccaggccttacaatgtttctgctctcatttctgagatcccctacagagtcagccaaaattcccatcctattaattctctgcaacctcgagttacgtacgtgttgtggatgacggcccttactgccgctggagaatcatcccacgggaatgagagagagttctgtcttcagggtaaagcaaattggatggcatttgtggcgccaagcatttgcatcgcaataatcatggtgggcattttctccacgcattacttccaacagaaagttttcgtgttgctcgccgcattgaggccccaatggtgttcccgcgagatccctgatccagccaattcaacttgcgcaaagaaataccctatcgccgaagagaagactcagctcccccttgacagactcctgatagattggccaacacctgaagatccagagcctttagttatcagtgaggtcctccaccaggtcacacctgtcttccgtcacccaccatgtagcaattggccgcagcgagaaaagggcatccagggccaccaagcaagcgagaaggatatgatgcactcggcaagcagtccaccaccgccccgggccctgcaggcagagtccaggcagttggttgacctgtacaaagtgctggagtctagaggctcagatcccaagccagaaaatccagcttgtccttggaccgttctgcccgcaggcgaccttcctacccacgatggctatctgccctccaatatagacgacctcccaagtcatgaagcaccattggccgatagcctggaagagctggaaccccagcacatctcgctctctgttttcccttcatcatcgttacaccccctgaccttctcctgtggagacaagctgactttggaccagctgaagatgaggtgtgattccctaatgctgtag

SEQ ID NO: 191760 - DNA, 681 bp, Artificial Sequence
  Description of Artificial Sequence: Synthetic coding sequence
atgagcagccccaccgccagcagcaccaccccccggtgcggcacctctgcgggccctgcatcccctacctggagatgcagagctaccgccctgcatctgcatcacccggtggaccagctaccccatcaggtgctccagcctactacaggacagcgacagcccggcacaggactgccttggcacagcaccccagctcaactggctctggccggattgagacaggcccaaccccatccccagcaacagcgcttgcatcagcccgggctccggggggtggatgctcatggttcagccgcccacgtgccacaggcagtccctcaggccgtgagggcccacccccccggacagcttctgtcatgggccgctgctgtctgcctgctgtgccaacatcatcttcagctgcccggcaaaaagaggaattctacactctacataaccatgctcctgattgtgccggtgattgtcgccggggccatcatcgttttgttattatacctaaagcggctcaaaatcatcattttcccgcccattcctgacccgggtaagattttcaaggaaatgttcggagaccagaacgatgacactctgcactggaaaaagtacgacatatatgagaagcagacgaaagaagaaaccgactcggtcgtgttgatcgaaaaccttaaaaaggcctcccagtag

SEQ ID NO: 191761 - DNA, 840 bp, Artificial Sequence
  Description of Artificial Sequence: Synthetic coding sequence
atggagtggcccgcccggctgtgcggcctgtgggccctgctgctgtgtgcgggaggcgggggcggtggaggcggggccgccccaacggaaacccagccaccggtcactaacctgtctgtgagcgtggaaaacctctgcactgtcatatggacctggaacccacctgagggggcgagctccaactgctcactttggtacttttctcactttggcgataaacaagataaaaaaatcgcccccgagacacggaggtctattgaggtgccactgaatgaaaggatatgcctgcaagttggcagccagtgctcaactaatgagtctgagaagccctcaatactggtcgaaaagtgtattagccctcctgagggagatcccgaatctgcagttacagagctgcagtgcatctggcacaacctctcctacatgaaatgcagttggctgccaggccggaacacatcgcccgacaccaactacacactatactattggcatcgatcactggagaaaatccaccaatgcgaaaatatttttcgcgagggccaatactttggttgctccttcgacttgacaaaagtcaaggactcctcatttgaacaacactccgtgcagattatggttaaggataacgccggcaaaatcaaaccctctttcaatatagtgccactgactagcagagttaagccggatccaccgcatattaagaatctatcctttcacaacgacgatctgtatgtccagtgggaaaacccacagaactttatctcaaggtgtctcttctatgaagtagaggtaaacaatagtcagacagaaacacataatgtattctacgtgcggttttag

SEQ ID NO: 191762 - DNA, 1284 bp, Artificial Sequence
  Description of Artificial Sequence: Synthetic coding sequence
atggagtggcccgcccggctgtgcggcctgtgggccctgctgctgtgtgctggcggcggcgggggcggaggcggcgccgcccccaccgaaacgcagcctcccgttaccaatcttagcgttagcgtcgaaaatctgtgtaccgtgatctggacctggaacccgccagaaggtgcctccagcaattgcagtctctggtacttctcccacttcggggataagcaggacaagaaaatcgccccagagacacgcagaagtatcgaagtcccgctgaatgagagaatctgcctgcaggtgggatctcaatgcagcactaacgagtctgaaaaacctagcattttggtcgaaaaatgcatctcacccccggagggagatccagagagcgctgttactgagctacaatgtatctggcataatctgagttacatgaagtgttcgtggctcccagggcggaatacatctcccgatactaattacactctctattactggcacaggagcctggaaaagatccaccagtgcgagaacatttttcgtgagggccaatattttggctgtagtttcgacctgacaaaggttaaagatagctcattcgaacagcacagcgtccagataatggttaaagacaatgctggaaagattaagccttcgtttaacatcgtgccgctcactagcagggtaaaacccgatcctcctcatataaagaatctttccttccacaacgatgatttgtatgttcaatgggaaaatccgcagaactttatatccaggtgtcttttctacgaagttgaagtgaacaacagtcaaacggagacgcataatgtgttctacgtccaggaagctaaatgcgagaatcctgaattcgaaaggaatgtcgaaaacaccagctgcttcatggtgccaggcgtgctgcctgacaccctgaatacagtgaggattcgagttaagaccaacaagttatgctatgaggatgacaagttgtggtctaattggtcacaggaaatgtctattggaaagaagcgtaatagtacgttatatataactatgctactgattgtcccggtcatcgtcgccggcgccatcattgtgttgttgttgtacctgaagagactcaaaatcataatcttcccccccatccccgatccaggaaagattttcaaggagatgttcggagatcagaatgacgacactttacactggaagaagtatgatatctacgagaaacaaacaaaggaggagaccgacagcgtcgttctgatcgaaaacctgaagaaggccagccagtag

SEQ ID NO: 191763 - DNA, 1143 bp, Artificial Sequence
  Description of Artificial Sequence: Synthetic coding sequence
atggccttcgtgtgcctggccatcggctgcctgtacaccttcctgatctccaccactttcgggtgtacctcgagctcagatacagagattaaagtgaatcctccccaggactttgaaatcgtcgaccctggctatcttggttacttatatctgcaatggcagcccccactttcgctagaccatttcaaagaatgcactgtggaatacgagctgaagtaccggaacataggatccgagacctggaaaacaattattacgaaaaaccttcactataaagatggctttgatctaaacaaaggcattgaagcaaaaattcacacgctgcttccttggcagtgtacgaatggctccgaagtccagagcagctgggccgaaacgacatactggatctctcctcaggggataccagagacgaaggtgcaggacatggactgcgtttattataattggcagtacctcctttgcagttggaaacccggcattggtgtcctcctggataccaactataatctgttttattggtatgaaggtctcgatcacgctctccagtgcgttgattacataaaggctgacggccaaaatatcggatgtcgttttccatacctggaagctagtgattataaagacttttatatttgcgtcaatggcagcagtgagaataaacctatccgtagtagttatttcaccttccagttgcagaatatagttaagccactcccccccgtttatctgacttttacaagagaaagcagttgtgaaatcaagttaaagtggtccatccctttgggaccaataccagcacggtgcttcgattatgaaatagaaattagggaagatgatacaacgcttgtgactgcaacagtggagaatgaaacctatacacttaagaccacgaacgaaactcggcaactctgtttcgtggttagatcgaaggttaacatctattgctccgacgacgggatctggtccgagtggtcagataaacaatgctgggaaggcgaggacctgagtaagaaaactctgcttcggttctggctgcccttcgggttcattctgatactcgtaatcttcgtgacagggctgctgctcaggaaacccaacacgtaccccaagatgattcctgagttcttctgtgacacctag

SEQ ID NO: 191764 - DNA, 1143 bp, Artificial Sequence
  Description of Artificial Sequence: Synthetic coding sequence
atggccttcgtgtgcctggccatcggctgcctgtacaccttcctgatctctactacgttcgggtgtacttctagcagtgatacagagatcaaagtaaatcctcctcaggacttcgagattgttgatcccgggtatcttgggtatctttatctccagtggcagccaccattgagtttggatcattttaaagagtgcacggtcgaatacgagcttaaatacaggaatattggctccgaaacttggaagacaatcataaccaagaatctccattacaaggacggattcgacctgaataagggcatcgaggccaaaattcacaccttactgccatggcaatgcactaacggtagtgaagtgcagtcatcatgggccgagaccacatactggatatcacctcaggggattcctgaaactaaggtccaggatatggactgcgtgtattataactggcaatacctcctttgctcgtggaagcccggaattggcgtgctcctcgataccaattacaatcttttctactggtacgaggggctggaccatgcgttgcagtgcgtagactatattaaagccgatggacaaaatatcgggtgtaggtttccgtacctcgaagcgagcgattataaggatttctatatttgtgtcaatgggtcgagcgagaataagcctatcagaagtagttatttcacttttcagctgcagaatatagtgaagccattaccacccgtgtatctaaccttcactcgcgagtcttcgtgcgagatcaagttgaaatggagcatacctcttggacccatacctgctcgctgcttcgactatgagatagagatcagagaagacgacacaacgctcgtgacagctaccgtcgagaacgagacttacactctgaaaacaactaatgagacccggcagctatgctttgtggtaaggtctaaggttaatatctattgctccgatgatgggatttggagcgagtggtcggacaaacagtgttgggaaggggaggatctgtcaaagaaaacccttctgagattttggctgcccttcgggtttatccttatcctggtcatctttgtaactggtctcctcttgaggaagcccaacacttatcccaaaatgatccccgagttcttttgtgacacttag

SEQ ID NO: 191765 - DNA, 465 bp, Artificial Sequence
  Description of Artificial Sequence: Synthetic coding sequence
atggccccccggcgggcccggggctgccggaccctgggcctgcccgcgctgctgctgttgctattgcttagaccaccagccaccagggagcccgcggcttcaagcccttccagcaataatactgccgccacgacagctgcgatcgttccggggtctcagctcatgccaagtaaatccccctccacgggaaccaccgaaatctccagccacgagtcaagccatggtacaccctcccaaaccacagccaagaactgggaacttaccgcctctgcgtctcatcagcctccaggggtatatccacagggtcatagcgatactaccgttgccatctccaccagtaccgtgcttctgtgcggtctctctgctgtttccctcctcgcctgctacctcaagtcacgtgcctccgtatgtagctgtcacccccgcagtgccggccatacatgttcagtgggatcagtttgctag

SEQ ID NO: 191766 - DNA, 804 bp, Artificial Sequence
  Description of Artificial Sequence: Synthetic coding sequence
atggccccccggcgggcccggggctgccggaccctgggcctgcccgctcttctcctgcttctgctgctcaggcccccggccacccgagggattacctgtcccccacccatgagcgttgagcacgccgatatctgggtgaagtcttattccttgtacagtcgcgagaggtatatctgcaactcaggattcaaacgcaaggccggcacaagctctttgaccgagtgtgtgttaaataaagccacaaatgtggctcattggaccacacctagtctgaagtgcatcagggatccagctctggtccaccaacgcccagcccctcccagtaccgtcacaacagcaggggttacaccccaacccgaatcactctctcctagcggcaaagagcctgcagcctcaagcccctcatccaacaataccgctgccactaccgcagccattgtacctggtagccagctcatgcccagtaaaagcccttcgaccgggacaacggaaatttcatcccatgaatccagccatggcactccaagccagactacagccaagaattgggagctcactgcctctgcttcacatcagccgcctggagtctatccccaaggccacagcgacacaactgtggcaatctctacttcaactgtgctgctgtgcggactatctgctgtcagcttgctcgcgtgctacctgaaaagcagacaaacccccccactggctagcgtggagatggaggccatggaggctttgccagtgacctgggggacctccagccgagatgaggacctcgagaactgttcacatcacctgtag

SEQ ID NO: 191767 - DNA, 612 bp, Artificial Sequence
  Description of Artificial Sequence: Synthetic coding sequence
atgagcgtggagcacgccgacatctgggtgaagagctacagcctgtactctagagaaagatacatctgcaactctggctttaagcgcaaggccggaacttcgagcttaacagagtgtgtgcttaacaaggccacaaatgttgcccactggactactcctagtttgaagtgtataagggaccccgctctcgtgcaccagcgacctgctccgccctccacagttaccaccgccggagtgacaccccagccagagtcactttcgccatctggaaaagagcctgccgcctcaagcccatccagtaacaataccgccgctactaccgcggccattgtgccagggtcacaacttatgccctctaagtccccatctactggcactactgaaatcagcagccacgaatcatcccacggcacacctagccaaaccactgccaaaaattgggaactgacggcaagcgcatctcatcaaccgcccggagtgtatccccagggtcacagtgacaccacagtcgctatctcgacaagcaccgtacttttatgtggtcttagtgcggttagcttgcttgcttgctaccttaaaagttccggagcagtcctctcttattccggttag

SEQ ID NO: 191768 - DNA, 696 bp, Artificial Sequence
  Description of Artificial Sequence: Synthetic coding sequence
atgagcgtggagcacgccgacatctgggtgaagagctacagcctgtattccagagagagatacatctgcaactccgggttcaagagaaaagcaggcacgtctagcttgactgaatgcgtcctcaacaaggccacaaatgtagcccattggacgactccaagccttaagtgcattcgcgaccctgccttggtgcaccagagaccagccccgccctcaaccgtaactactgctggggtgactccgcagccggagagtttgagcccaagcggcaaggagcccgccgcgtcgtcccctagctcaaataatacagctgctacaacagcagcaattgtgccaggatcccagctgatgccgtcaaagtcgcctagcacgggtactactgagatcagtagtcacgagtctagccacggcaccccaagccagaccactgccaaaaactgggagctcaccgcctccgcctcacaccaaccaccaggagtttacccccagggacattccgacacaaccgtggcaatcagcacatcgaccgtgcttctgtgtggtctgtctgctgtttcattactggcctgctacctcaagagccgacagacacccccactggccagcgtggaaatggaggccatggaagctctccccgtgacctggggcacatcttccagagacgaagatcttgagaattgttcccatcacctctag

SEQ ID NO: 191769 - DNA, 510 bp, Artificial Sequence
  Description of Artificial Sequence: Synthetic coding sequence
atggccccccggcgggcccggggctgccggaccctgggcctgcccgcccttttgcttctcctacttctgcggcccccggccacaagggaaccagcggcctctagccccagctccaataacacagcagccacgacagccgccatcgtgccaggctcccagctaatgcccagcaaatctccctcaaccggcaccaccgagatcagcagtcacgagtcctctcacggaactcctagccagacgaccgccaagaactgggagctgactgcaagcgctagtcaccagccgcctggcgtgtacccgcagggccatagcgacacgaccgtggccatatcaacaagcacagttctattgtgtggtctttcagcagtgagcctcctggcttgttacctgaaaagtagacagactcccccgttggcatcggtggagatggaggcaatggaggctctccctgtcacctggggaacgtctagtcgggatgaggatctcgagaactgctctcatcacctgtag

SEQ ID NO: 191770 - DNA, 609 bp, Artificial Sequence
  Description of Artificial Sequence: Synthetic coding sequence
atggccccccggcgggcccggggctgccggaccctgggcctgcccgccctcctccttttgcttcttcttcgcccccccgccaccaggggggatcctgcccttgtacaccagcgacccgcgccaccttccactgtgactactgcaggggttacgccccagcctgaatcgctttcaccatcagggaaagagccagccgccagtagcccaagctctaacaacacggccgccaccaccgcggcaattgttcccggtagccagctgatgccttcaaaatctcccagcaccggtacaacggagatctcctctcatgaatccagccatggcactccttcacagaccactgctaagaactgggaactcaccgcatccgcttcacatcaaccacctggtgtataccctcagggacattccgataccacagtcgccatctccacatccacagtcctgctgtgtgggctttctgcagtgtcactgctggcgtgctacctcaaatctcgccagactcctcccttggcctcagtcgagatggaggccatggaggcactgcccgtgacctgggggacaagtagtcgcgacgaagatctcgaaaactgcagtcatcacctctag

SEQ ID NO: 191771 - DNA, 759 bp, Artificial Sequence
  Description of Artificial Sequence: Synthetic coding sequence
atggccccccggcgggcccggggctgccggaccctgggcctgcccgccctactgctgcttcttcttttaagaccccccgccacaagaggaatcacctgtcctccaccaatgtccgtagaacacgctgacatctgggttaagtcctacagcctgtattctcgtgagagatacatctgcaactcaggctttaagcgaaaggcaggaacctcatcgctaacagagtgtgttttgaacaaggcaactaatgtggcgcattggactaccccttcattgaagtgcatacgggatcccgctctagtgcaccaacggccagccccaccttccacagtgactacagctggcgtgactccccagccagagtcactgtcccctagtgggaaggagcctgctgcaagcagtccaagcagtaataataccgccgccactaccgccgccattgttccagggtcacagctgatgcctagcaagtctccatctacaggcactacagagatctcttcacatgagtcctcccatggtacgccatcccagactacagctaagaattgggagcttacagcctcggccagtcaccagcctcccggggtgtatccacagggacactccgataccaccgtggccatatccacgtctaccgttcttctgtgcggattatccgctgtgagtctgctcgcgtgctatctcaagtcccgtgcttctgtctgcagctgccacccccggtcagctggacacacttgctcagtggggtccgtatgctag

SEQ ID NO: 191772 - DNA, 564 bp, Artificial Sequence
  Description of Artificial Sequence: Synthetic coding sequence
atggccccccggcgggcccggggctgccggaccctgggcctgcccgccctcttgctactgttactcctacgacctcccgccacaaggggggatcctgcgctggtgcatcagcggccagctcctccgagtactgttacaacagccggcgttacaccccagccagagagtttgtcccctagtgggaaggagcccgcagccagctccccatccagcaacaataccgcagccaccaccgcagccattgttcctggtagtcagctgatgccttcgaaaagccccagcacaggaactaccgagatatcgagccatgagagttcgcatggcaccccctctcaaacaaccgcaaagaactgggagctcaccgcttcagcctctcaccagcctccaggggtgtaccctcaaggccattccgacactactgtggccatttctacgtcgacagtgctgctgtgtggactctcggctgtttctctgctcgcttgctacttaaaatcccgagccagcgtatgttcctgtcatcctcgctctgcgggtcatacatgtagcgtaggcagtgtgtgctag

SEQ ID NO: 191773 - DNA, 705 bp, Artificial Sequence
  Description of Artificial Sequence: Synthetic coding sequence
atggccccccggcgggcccggggctgccggaccctgggcctgcccgccctgctattgttgttattactaagaccacctgccactcgggggattacttgcccaccacccatgtccgtggaacacgccgatatctgggtcaagtcttactctctatactctcgggagcggtatatatgcaattctggctttaagcgtaaggctgggacctcgtccctaacagagtgcgtcttgaacaaagctaccaatgtggcacattggacaaccccgtccctcaaatgtatcaagcctgcagcgagtagcccaagctccaataatactgcagcaaccaccgcagccatagtgcccgggagccagctgatgcctagtaagtcccccagcaccggaactactgagattagttcacacgagtcgtcacatggcacgccctcccagacaacagctaagaattgggagttgactgcgagcgcctcacatcagcctccaggagtttacccacagggtcacagtgacacaaccgtggccataagtacaagcaccgttctgttatgtggattgtccgccgttagcctcctcgcatgttatctgaagagccgacagaccccgccgctcgcctctgtggagatggaagccatggaggcactaccagttacatggggcacgagttctcgcgatgaagacctggagaactgtagccatcacctgtag

SEQ ID NO: 191774 - DNA, 660 bp, Artificial Sequence
  Description of Artificial Sequence: Synthetic coding sequence
atggccccccggcgggcccggggctgccggaccctgggcctgcccgctttactgctgctgttactgctgcggcctcctgctacccgcggaataacttgtcccccacccatgagtgtggagcatgctgacatatgggtgaagtcgtattctctctattctcgcgagaggtacatctgtaacagtggattcaaacgcaaggccggtactagtagcctgactgaatgcgtcctgaataaagcgacaaatgtggcacattggactactccttccctgaagtgcatcaagcctgccgcttcaagtcctagttctaataataccgccgccacaaccgccgcaattgtacccggtagtcaactcatgccatccaaatctccatctacgggaacaaccgaaatctcatcacacgagtcttctcatgggacgcccagtcagaccacagccaagaactgggagcttactgctagcgcctcccatcagccaccaggagtgtatcctcagggacatagtgacaccacagtcgccatttcaacgtcgaccgttcttctgtgtggcctgagcgccgtttccctgttggcctgttatctgaagtccagggcctctgtctgttcctgtcatcctaggtcggcaggacacacctgtagtgtgggctctgtatgttag

SEQ ID NO: 191775 - DNA, 2601 bp, Artificial Sequence
  Description of Artificial Sequence: Synthetic coding sequence
atgggcgccgcccggagcccccccagcgccgtgcccggccccctgcttggcctgctcttgttactcttaggggttcttgctccaggaggcgcaagcttgaggttgctggatcatagggccctggtgtgcagccagcctggcctcaattgcaccgtgaagaacagtacctgtttggatgatagctggatccacccaagaaatcttacccccagcagcccaaaggacctccaaatccagctacattttgcacatactcagcaaggagatctgtttcctgtcgctcatatcgagtggaccctgcagaccgacgcttccattctgtacctcgagggggctgagctatccgtgctgcagctcaacaccaatgaacggctgtgcgtcaggttcgagtttctctcaaaactgcgccatcatcaccggcggtggcgtttcacctttagccactttgtggtagatccagatcaggaatatgaggtaacagtgcatcatttgcccaaacccattccagacggcgaccctaatcaccaaagcaagaacttcttagtgccagactgcgagcatgcccgaatgaaggtaaccactccttgtatgagctctggatctctttgggatcccaatataacagtggagactctcgaggcacaccagctgcgtgtgtcctttactctgtggaacgaatcaacacactaccagattcttcttacgagtttcccacatatggagaaccactcttgtttcgaacacatgcatcatatcccagcacctagaccagaggaatttcaccagaggagcaatgtcacgctgacactgcgcaacctcaagggatgctgtcgccatcaggtgcaaatccagcctttttttagctcttgtctgaacgattgtttgcggcacagcgcgaccgtctcctgccctgaaatgcccgatacacctgagcctattccagattatatgccactgtgggtctactggttcatcaccggcatcagcatcctgctcgttggctctgtgatattgctgatagtctgcatgacatggagactcgcaggaccgggctctgaaaaatattcagacgacacaaagtataccgatggcctccccgccgccgacttgatacctcctcctctcaagcctagaaaggtatggatcatctactctgctgatcatccattgtatgtggacgttgtgctgaaatttgctcagtttttgttgacagcttgtggcactgaagtcgcactggatctgcttgaggaacaggccatctccgaagcgggcgtaatgacatgggtgggcaggcaaaagcaggaaatggtcgaaagcaattcaaagatcatcgtgctgtgctctcgcggcacgcgcgctaagtggcaggccctgctgggtcgaggcgcccctgtcagactccggtgtgatcatggcaagcccgtgggcgacttgtttacagctgcaatgaatatgattctaccagacttcaaacgacccgcatgtttcggaacctacgtggtgtgctacttctctgaagtctcttgcgacggggacgtgcccgatctgtttggggcagctcctcgatatcctctgatggacagatttgaagaggtgtactttagaatccaggacttggagatgtttcaaccggggcgcatgcatagagtcggagagctcagcggcgacaactatctcagatcacctggagggaggcaacttcgtgctgcattggaccggttccgcgattggcaggttaggtgtcctgattggtttgagtgcgagaacctctactcagcagacgatcaggacgctccatccctagatgaagaggttttcgaggaacctctgctgcctccagggactggaattgtcaagagagccccgctggtgagagagcctggctcccaagcctgcctcgcaatcgacccgctggttggcgaggaagggggagccgctgttgcaaagctggagcctcacttacagccccggggccagcctgcacctcaacctctgcatacgctggtgttggcggccgaggagggagccctggtcgccgcagtcgagcccggaccactggcggacggcgcagccgtccgattggccctggccggggagggggaggcatgccctttactgggaagtcccggggccggcagaaactctgtgctgttcctcccagtagacccggaggattccccccttggcagttcgacgccgatggcaagcccagatctgctacctgaggacgtgcgggagcatctggaaggactgatgctgtcactattcgagcagtccttatcctgccaggcacagggcgggtgcagtcgccctgccatggtacttacagatccacatacaccctacgaggaggagcaacggcaaagcgtgcaaagcgaccagggctatatctcaagaagtagcccccagccccctgagggcctgaccgaaatggaagaggaggaggaagaagagcaggatcccggaaaacctgccttgcccctctcccccgaagatttggagtctcttagatcactccagcgtcagttgctttttcgccagttacagaagaatagcggttgggacactatgggatctgagtctgagggcccatccgcttag

SEQ ID NO: 191776 - DNA, 2445 bp, Artificial Sequence
  Description of Artificial Sequence: Synthetic coding sequence
atgggcgccgcccggagcccccccagcgccgtgcccggccccctgctgggactgctcctactgttgctgggggtacttgcacccgggggcgcttcattacgtctgctcgatcacagggccctggtctgtagccagcccggattgaactgtacagttaagaactctacatgcctggacgacagctggatacaccctcgaaacctcactcccagttcccccaaagacctacagattcagctccactttgcccacacccagcagggcgacctgtttcctgtggcacatatagagtggacactccagaccgacgcatcaatcctgtatctggaaggagctgagctgtccgtcctgcaacttaataccaacgagcggctctgtgtcaggttcgagtttctgtccaagctgcgccaccatcaccgcaggtggagatttactttcagtcatttcgtcgtcgacccagatcaggagtacgaagtgaccgtccaccacctcccaaagccgattcctgacggcgatcctaatcaccagagcaagaacttcctggttccagactgtgagcatgcaaggatgaaagtgacaacaccatgtatgtcatctggatccctctgggatcctaacattactgtggagactctggaagcccatcagttacgggtctccttcacgctgtggaacgaatctacacactatcagattcttctaacctcattccctcatatggagaatcattcttgttttgaacatatgcaccatatacccgcccctaggcctgaagagtttcatcagcgcagcaatgtgacgctgaccttgaggaatctcaaaggttgctgccgccaccaagtccagattcagccatttttctcttcttgcttaaacgactgcctcaggcacagtgcaacagtctcttgcccggaaatgcccgacacccctgacggactgcccgcagccgatttaatcccccctcccctgaaacctcgtaaggtatggataatttactccgccgatcacccgctctatgtcgatgtggtcctgaaattcgcgcagttcttgttgactgcatgtggcactgaagttgcattggacctcctggaggagcaggcgatcagcgaagccggagttatgacatgggtcggacgtcagaaacaggagatggtagaatctaatagtaaaatcattgtgctgtgctcgagaggaacccgggccaagtggcaagccctgttgggccgaggagctcctgtgcggctgcgctgtgaccacggcaagcccgtcggagatctttttaccgcagccatgaacatgatcttgccagattttaagcgacccgcttgcttcggcacctatgtggtttgctatttttctgaagtctcctgtgatggagatgtgcccgacctgttcggagccgcacctcggtaccctctgatggatagatttgaggaagtgtacttcagaattcaagatctcgaaatgttccaacctggtcggatgcatcgagtgggggagctaagtggggacaactatctccgaagcccagggggccggcaactcagggcggcgcttgaccgattccgggattggcaggtgcgttgccccgattggttcgaatgtgagaatctttacagcgcagacgaccaggatgcaccttcactggacgaggaagtgttcgaggagccgttgctgccacccgggaccggcattgtgaagcgagcacctctcgtgagagagccaggcagtcaggcctgcctggcaatagatccactggtcggcgaagagggaggtgctgctgtggctaaactggagcctcatctgcagccgaggggtcaaccagcccctcagcccctgcacacgttggtcctggctgcagaggaaggggcactcgttgccgcagtcgagcctggacccctggcagacggcgccgctgtccggctggcgcttgccggcgagggcgaggcctgcccactattaggctctcccggcgctggcaggaactctgtgctcttcctgcccgtcgacccagaagatagtccactgggaagcagcacccccatggcctctccggacctccttccagaggatgtccgcgaacacctcgagggactgatgctgagtctgtttgagcagagcctatcttgtcaggcccaaggcgggtgcagcagaccagcgatggtgttgactgacccacacactccctacgaagaggaacagcggcagtctgtgcagagcgaccaagggtatatcagcagatctagcccccagccccccgaaggactgaccgagatggaggaggaagaggaggaggagcaggatcctggtaagcctgctctaccgctctccccagaagatctggaatctctgcgttcactgcagcggcaactgctgtttagacaattgcagaaaaattctggatgggacacaatgggctcagaatctgagggtccatcagcctag

SEQ ID NO: 191777 - DNA, 1509 bp, Artificial Sequence
  Description of Artificial Sequence: Synthetic coding sequence
atgagcctggtgctgctgagcctggccgccctgtgccggagcgccgttcctagggagcccacggtgcagtgtggctctgagacaggcccatcaccggaatggatgctgcagcatgatttgatccccggggatctccgcgaccttagagttgaaccagtcacgacgtccgtggcaaccggtgattatagcatactaatgaacgtgtcctgggtattgagagccgatgcgagtattcgcctgctgaaggctaccaagatctgtgtaaccgggaagagtaattttcaatcctattcctgcgtgagatgcaattacaccgaggctttccagacacagactcgtcctagcggagggaagtggactttctcttatatcggtttccctgtcgagctgaacaccgtctatttcataggcgctcataatataccaaacgccaatatgaatgaggacggcccctctatgagcgtgaactttacttcacccgggtgcctggaccacattatgaagtataagaagaagtgtgtgaaagctggcagcttatgggatccgaatatcaccgcatgtaagaagaacgaagagaccgtggaagtgaactttaccacaacacctttaggcaacagatacatggccttgatccagcattccacaattattggtttttcccaggtctttgaacctcaccagaaaaaacagactagagccagtgtcgtcattcctgtcaccggtgattcggagggcgctacagttcaattaacaccctattttccgacttgcggcagcgactgtatccggcataagggcacagttgtgctgtgtccgcagacaggtgtgccgttccccttggataacaataaatccaaacccggcgggtggttgcctttgctgttactatcactacttgtggctacttgggtgctcgtggctgggatctatctgatgtggaggcatgagaggataaaaaaaacaagtttctcgaccacaacactcctcccacccataaaagtgttggtcgtataccccagcgaaatttgcttccatcatactatctgttattttacggaattcctccagaatcactgtcggtctgaggtcatcctggagaagtggcagaagaaaaagattgctgaaatggggcccgtacaatggctggcaacccagaaaaaagctgccgacaaggttgtgttccttctctccaatgatgtgaactccgtgtgcgacggcacttgtggaaaatctgaggggtcgccttccgagaactcacaggacctattcccactggcctttaatctgttttgcagcgatctgagaagtcagatccacttacacaagtatgtagtggtgtattttagagaaattgatactaaagacgattataacgcgttgtcagtgtgtcctaagtaccacctgatgaaagatgccaccgctttttgtgctgagttgctgcatgttaaacagcaggttagtgccggaaaacgctcacaggcgtgtcacgacgggtgctgttccctgtag

SEQ ID NO: 191778 - DNA, 2376 bp, Artificial Sequence
  Description of Artificial Sequence: Synthetic coding sequence
atgcccgtgccctggttcctgctgagcctggccctgggccggagcccagtcgtgctgtcgctggagcgactagtgggacctcaggacgcaacccactgctcccccgtgagtctcgaaccttggggtgacgaggagagattgcgcgttcagtttctggcgcagcaaagtctgtctttggcccctgtcactgcggcaacagccagaactgccttgtcaggcctcagcggggcagatggccggagggaagagcgaggacgcggaaaatcctgggtctgcctgtccctgggaggatctggcaataccgagcctcaaaaaaaaggactgtcctgtcgcctgtgggacagcgacatcctttgcctgcccggagacatcgtgcccgcaccaggccccgtactggcccctactcacttgcaaacagagctagtactgcgatgccagaaagagaccgactgcgacctctgcctgcgggtggctgtccacctggcagtacatggccactgggaagaacctgaagacgaagagaaattcggcggtgcagccgactcaggcgtcgaggagcctcggaatgcctcattgcaggcacaggttgtgctgtcttttcaggcctatcctacggccaggtgcgtcctgcttgaggtgcaagtccccgccgccctagtccaatttggacaaagcgttggatccgttgtgtacgattgctttgaagctgctctgggaagtgaggtcaggatttggtcttacacacaaccaagatatgagaaggagctgaatcacacccagcaactgcctgattgccgcggtctcgaagtgtggaatagcattccgtcatgttgggctttaccttggttgaatgtatccgctgacggcgataacgtccatctggtcctgaatgtgtcggaagagcagcactttggattgtccctttattggaaccaggtacaagggcccccaaagccacgctggcacaagaacttgaccggcccccaaattataaccctcaatcataccgacctcgtaccctgcttatgcatccaggtttggccattagagcccgactcagtgcgcactaacatttgtcctttccgcgaggatcctcgcgctcatcagaatctgtggcaggccgcccgccttcagctacttaccctgcagagctggctcctagatgctccatgcagtttacccgccgaggctgcgctctgctggagagcccccggaggagatccctgtcagcccctcgtaccccccctcagctgggagaacgttaccgtggacaaggtactcgagtttccgcttctgaaagggcaccccaacctttgcgtccaagtgaactcttccgagaagctccagcttcaggagtgtctttgggctgactccctggggcctctgaaagatgatgtgctcctcctcgaaacgcgcggcccccaagacaaccgcagcttgtgcgccttagaaccatctgggtgcacgtcattgcccagcaaagcatccacccgggcagccagattaggagagtacctcctacaggacctgcagagcggacagtgcctgcagttgtgggatgatgaccttggtgcgctgtgggcatgtccaatggataaatacatacataaaagatgggcgctggtctggctggcatgtctgttgtttgccgctgccctcagcctgatcctcctgctcaagaaggatcacgcgaaggggtggctgcggcttctcaagcaggacgtgagaagtggcgcggctgccagaggtagggccgccctcctactctactcagcagacgattcagggttcgagaggctagtaggcgctctcgcttcagctttatgccagttgcccttacgggttgccgtcgatttgtggtccagacgggagctttccgctcaggggcctgttgcatggtttcacgcccagagacgtcagaccctgcaggagggaggggtcgtcgtccttttgttcagccccggggcggtggccctgtgttctgaatggctgcaggacggagtgtcaggtcccggggcccacggccctcacgacgcttttagggcctcattgtcctgcgtcttacccgacttcctgcagggccgtgcacccgggagctacgtgggagcttgcttcgacaggctcttgcatcccgacgccgttccggcactgtttcggaccgtgcctgtgttcactcttcccagccaactgccagactttctgggggcactgcagcagccacgggctcccagaagtggaagattgcaggagcgcgcggaacaggtctctcgggccttacagcccgcacttgattcatatttccacccccctggcacccccgctcctggccgtggggtcggtccaggagccggccccggtgccggcgacggcacatag

SEQ ID NO: 191779 - DNA, 2118 bp, Artificial Sequence
  Description of Artificial Sequence: Synthetic coding sequence
atgcccgtgccctggttcctgctgagcctggccctgggccggagcccggtggtcctgtcgctggagcgattggtgggtccccaagatgctacccattgctctcctgggctgtcctgccggttgtgggatagcgacatcctttgtttgcccggcgacattgtgcctgcacctggtccggttctcgctcctactcacctgcagaccgagctggttctaaggtgtcaaaaggaaacggactgcgacttgtgtctaagggtggccgtacacttggccgttcacgggcactgggaagaaccagaggacgaggaaaaatttggcggggcagccgactccggggtggaggaacctagaaatgcaagcctacaagcccaggttgtcctctcattccaagcctaccctacagctcgatgcgttttgctggaggtccaggtgcccgcagctcttgtccagtttggccagtccgtgggatcagtggtgtacgactgcttcgaagcggcgctgggtagcgaggtgaggatatggagctacactcaacctcgctatgaaaaagagctgaatcacacccagcaactgcctgcactgccttggttgaacgtctcggccgacggagataacgtgcacctggtcctgaacgtgtccgaagagcaacacttcgggctcagcctttattggaatcaagttcagggtccacccaagccaaggtggcataagaacctgaccggtccccagataattacactgaatcatactgatctggtcccatgcttatgcattcaagtgtggcctctggagcccgactccgttagaacaaacatctgcccttttcgagaagatcctcgggcccatcaaaatctttggcaggcggcccggctacagctgctgaccttacaaagctggctcctggatgcgccctgctcactgcctgcggaagccgccctatgctggcgagcccccggcggggatccctgccaacccctggtgcccccactgagctgggaaaacgtgactgtggataaagtgctcgagttccccttactgaaggggcacccaaacctgtgcgttcaagttaactctagtgagaagctgcagctgcaggaatgcctgtgggcagatagcctgggtcccctgaaggacgacgttctcctgctggagacaaggggcccccaggataacagatcactgtgtgccctcgagccttctggatgcacatccttaccatctaaggccagcacccgagctgcccggctgggggagtatctgctgcaagatttgcagtcgggacagtgcctacagctgtgggacgatgacctgggggccctctgggcttgtcccatggataaatacattcacaaacggtgggctctcgtatggctggcatgtctgctgtttgcagcagccctgagcctcattctgctcctgaaaaaggaccatgccaaaggatggctcagactgttaaaacaagacgtcagaagcggggccgctgcccgaggacgtgcagctctgttgctctacagcgctgatgatagcgggttcgagcgacttgtgggcgctcttgcatccgctttatgtcaacttccactccgcgtggccgttgacctttggagcagaagagagctctctgcacagggtcctgtcgcctggttccacgcccagaggagacagaccttacaggagggtggagtggttgtgcttctgttctctcctggcgccgtggccctttgtagcgaatggctgcaagatggggtgagcggtccaggtgctcacggccctcacgacgccttccgcgctagtctctcctgtgtcctccctgatttccttcaaggaagggcccccggcagctatgttggggcttgcttcgatcgcctgttacacccagacgctgttcccgctctctttcggacggtgcctgtgttcactttaccgagccagctccccgatttccttggcgcattacagcagcctcgcgcaccgcgatcagggcgcctacaggaaagggctgagcaggtgtccagagccctgcagcccgctctagactcgtacttccatccaccgggaacacccgcccccgggcggggtgtgggacccggcgcagggccaggcgctggggacggaacctag

SEQ ID NO: 191780 - DNA, 2163 bp, Artificial Sequence
  Description of Artificial Sequence: Synthetic coding sequence
atgcccgtgccctggttcctgctgagcctggccctgggccggagccccgtggtactgtcactcgaacgacttgttggaccacaagatgcgacacattgcagccccggcttgtcatgtcgtctatgggattctgacattctttgtttaccaggtgacatcgtgcccgcgcctgggccagttctggcaccgacccatctccagaccgagctggtactgagatgccaaaaggaaaccgactgcgacctctgcctgagggttgccgttcacctagctgtgcacgggcattgggaagagccagaggacgaggagaaatttggcggcgccgccgactctggggtcgaggaaccaagaaatgctagcctccaggcccaggttgtgctgtcctttcaagcctacccaacggctcgatgtgtgttattggaggtccaggttccagcggcactggtgcagttcggccaaagcgtgggcagtgtggtttacgactgttttgaagccgcactgggatccgaagtgcgaatctggagttatacccagccccgctatgaaaaggagctgaaccacacccaacagctgcccgattgtaggggactcgaggtgtggaattcaatcccttcctgctgggccctgccgtggcttaatgtgagcgcagacggcgataatgttcatctcgtgctgaacgtgtcagaagaacaacactttggcttgagtctgtactggaatcaagtccaggggcccccgaaaccaagatggcataaaaacttgacagggccacagataattaccctgaatcacaccgaccttgtgccctgtttatgtatccaggtctggccattggaaccagatagtgtgcgcacgaatatctgtccctttcgcgaagaccctagagcgcatcagaatttgtggcaagccgcccggctccagctgcttacactgcagtcatggcttctggatgctccttgcagcctgcctgctgaggctgctctgtgctggcgcgcccctggcggcgatccttgccaacctctggtacccccactaagttgggagaatgtgaccgtagacaaggtgcttgagttccccctcctgaaggggcaccccaatctgtgtgtgcaggtgaatagctcggagaaacttcaactacaggaatgtctgtgggctgatagccttggacctctcaaggacgatgtcttgctgctagagactcggggcccgcaggacaataggtccctgtgcgccctggagcccagtggctgcacttccctcccctctaaggcttctaccagagcagccagactgggcgagtacctcttgcaggacttgcagtctgggcagtgtcttcagttgtgggatgacgatctgggggccctgtgggcttgccctatggataagtacattcacaaacgctgggcccttgtgtggctcgcttgcttgctctttgcggccgctctgagcttgatcctgctcctcaaaaaggaccacgcaaaaggatggctgaggcttcttaagcaagatgtgcggtcaggcgcggccgcgagaggtagggcagcactgctactgtatagcgccgatgatagcggttttgagcgccttgtgggggcactggcttccgcactgtgtcagctccccctccgcgtggccgtggacctatggagccgacgggagctgagtgcccaggggcctgtggcttggttccacgcccagagacgccagactctgcaggaaggcggtgtggttgttttgttatttagccccggcgccgtcgctctgtgctcagagtggctccaggatggagtgtctggtccaggagcccatggacctcatgatgcctttcgcgctagtctctcttgcgtcttacccgatttcctgcaaggccgagcaccaggatcttatgttggggcgtgctttgaccgcctgctccaccccgatgccgtgccagccctcttcagaaccgtgccagtgtttactctgcccagccagctgcctgatttcctcggagcccttcaacaacctcgcgcgccacgcagcgggcgcttgcaggagcgggccgaacaggtgtctagggcccttcaacctgccttggactcctactttcatcccccaggaactccagctcctgggaggggcgtgggccccggcgccgggccaggtgcaggcgatgggacatag

SEQ ID NO: 191781 - DNA, 1641 bp, Artificial Sequence
  Description of Artificial Sequence: Synthetic coding sequence
atggcctaccccaccgcccggtgcgtgctgctggaggtgcaggtgcccgccgccctggtgcagttcggccagtccgtggggagcgttgtgtacgactgctttgaggccgctctcggcagcgaagtccgaatatggagttacacacaaccacgctatgagaaagagcttaaccatacccagcagcttccggccctgccgtggctgaatgtatcagcagatggggataatgtgcatctggtgctgaacgtgtcagaggaacagcacttcggtctcagtctttattggaatcaggtgcagggcccccccaagcctcggtggcataagaacctgaccggaccacagattatcactctgaatcataccgacttagtgccatgtctgtgtatccaagtttggcctctggagcccgactccgttagaaccaatatctgcccctttagagaagatccccgagctcatcaaaacctttggcaagcggctcgccttcaactgctgacactacaaagctggcttctagacgccccctgttcactacctgcagaggctgcactgtgctggagggcacccggcggggatccctgccagcctcttgtcccacctctctcatgggaaaatgtaacagttgatgtcaacagctccgaaaagcttcagctgcaggagtgtttatgggcagattctttgggtccgctgaaagacgacgtgctgctgctggagacccgcggtcctcaggataacaggtcactgtgcgccctggagccttccgggtgcacgtctctgccctctaaggccagcacccgggctgctcgccttggagagtaccttctgcaggacctgcagagcgggcagtgtcttcaattgtgggatgatgatctcggagctctgtgggcctgtcccatggataaatatatccacaaaagatgggccctagtctggctggcatgtttgctgtttgcagctgctttgtccctgatcctgctgcttaaaaaggaccatgccaaagccgcagcacgggggcgggcagctctgctcctttattcagctgacgacagtggcttcgagaggctggtgggcgctctggcaagcgcgttgtgtcagttacccctgcgggtggcagttgacctctggagtcgtagagagttatctgctcaaggtccggttgcatggtttcacgcccagcggcgacagaccctgcaggagggcggtgttgtagtgctgttgttctctcccggcgccgtggccctgtgcagtgaatggctgcaagatggtgtgagcggccccggtgcccacggccctcacgatgccttcagggcctccctcagttgtgttctgcccgatttcctgcagggccgggctccaggctcctacgttggtgcatgttttgataggctgctccaccctgacgccgtgcctgccctttttaggactgtgcccgtgtttacactgcccagtcagttgcccgatttcctgggcgccctgcagcagccgcgcgccccccgctccggacgtctgcaggagcgggcggagcaggtgtcacgagcactgcagcccgcactcgattcatattttcacccccccggcacgcccgccccaggcaggggagtgggcccaggcgcagggccgggtgccggagacggcacgtag

SEQ ID NO: 191782 - DNA, 2124 bp, Artificial Sequence
  Description of Artificial Sequence: Synthetic coding sequence
atgcccgtgccctggttcctgctgagcctggccctgggccggagcccagtggtcctgtctctcgaacggttggtggggccccaggatgctacccattgttctccaggcctttcatgtcggctctgggactccgatatcctgtgtctacccggtgatatagtgccggcgccaggcccggtgctggcacccacgcaccttcaaactgaacttgtgctaagatgtcaaaaagagactgactgcgatctctgcctgcgggtggctgtgcatctggccgtccacggccactgggaagagcccgaagacgaggagaaatttgggggagccgccgactcaggtgtggaggagccaagaaacgcctccctccaggcccaggtggtactgtcttttcaagcttaccctaccgctcgatgcgtattgctcgaggtacaagtaccggccgctctggtgcagttcggccagtcagtagggagtgttgtgtatgactgcttcgaagccgctctcggatctgaggtgcgcatttggtcctacacacagccccgatacgagaaggagctgaatcatactcagcagctgcctgactgcaggggcctggaagtgtggaactccatcccctcttgctgggcactcccatggctgaacgttagcgccgatggagacaacgtgcatctagtattgaacgtgagtgaggaacaacacttcggactgtccctatactggaaccaggtacaggggccccctaaacctcgatggcataagaatctgacaggtccgcagattatcacgctgaatcacacagatctggtgccttgtttgtgcatccaagtatggcccttggagcccgatagtgtgaggacaaacatatgcccattccgcgaggacccacgggctcaccagaacctctggcaggccgccaggctccagttgctcactctccagtcctggttgctggacgccccctgctctctgccagctgaagctgcactatgttggcgggcgccgggcggagacccatgtcaaccccttgtgccaccactctcctgggaaaatgtcaccgtggataaagtgctggaatttcccctcttaaagggacaccctaatctatgcgtccaagtcaattcttcggagaagctgcagctgcaggagtgtctttgggccgattcgctgggcccactcaaggatgacgttctgctgttagaaacacgtgggccccaggacaaccggagcttgtgtgcacttgagccttcagggtgtacgtcgctaccatcaaaagcatccaccagagcagcccggcttggagagtacctgctccaggatttgcagagtggacagtgtcttcagttgtgggacgatgacctcggagccctatgggcttgtcccatggacaaatatattcataagcggtgggccctggtttggctggcctgtctgctcttcgccgccgcattgtctttaatactgctcctgaagaaagatcacgcgaaggcagccgcccgcggtagagctgccctgctcttgtactctgcagacgattctggttttgagcggctcgtgggtgcccttgcatcggctctttgccagctgccactgcgggttgcggtggacctctggagtcgcagagagctgtccgcacagggccccgtcgcctggttccacgcccaacgccgacaaacactccaagaggggggggtggtggtgctgctgttctcccctggggccgtggctctctgttccgaatggctgcaagatggcgtgagcgggcctggcgcccatggaccacatgacgcatttcgggcttcattgtcctgtgtacttcccgacttcctgcaaggacgtgcccccggcagctacgttggtgcctgttttgataggctcctgcacccggacgctgtacccgcactgtttaggacagtccctgttttcactttgccatctcagttgcccgactttttaggggccctccaacagcctagagcaccgcgcagtggaagactgcaggagcgcgccgaacaagtatctcgcgccctgcagcccgctctggactcttattttcacccaccagggacccctgcgccaggccgcggtgtgggccccggcgcagggccaggcgcgggcgacggcacttag

SEQ ID NO: 191783 - DNA, 213 bp, Artificial Sequence
  Description of Artificial Sequence: Synthetic coding sequence
atgcccgtgccctggttcctgctgagcctggccctgggccggagcccagtggtgttatcacttgaaaggctagtgggaccccaagacgccactcattgtagtcctgggcttagctgccgcctgtgggttacttactccgcttgccttggcaccagttgcctactccgggccccctgctggcgtctgcggacatgtcgccagagctggtgctag

SEQ ID NO: 191784 - DNA, 2067 bp, Artificial Sequence
  Description of Artificial Sequence: Synthetic coding sequence
atgcccgtgccctggttcctgctgagcctggccctgggccggagccccgtagtgctgtccttagagaggctcgttggaccccaagacgcaacccattgctcccccggcctgtcttgcaggctgtgggactcagacattctctgcctcccaggcgatattgtccctgcgcccgggccagtgctcgctccaacgcatctgcaaacagaactggtgctccggtgccagaaggagacagactgtgacctgtgcctacgtgtagccgtccacctggcggtacatgggcattgggaggaacccgaggatgaagaaaaattcggaggggccgccgactcaggcgttgaggagccgaggaatgcgtctctacaggcacaggtggtactatctttccaggcctatccaactgccaggtgtgtcctgctcgaggtgcaggttccggcagccctcgttcagttcggccaatctgtggggtccgtagtgtacgactgttttgaagccgctcttggtagtgaggtgcgcatttggtcatatacacaacctcgatatgagaaggagctaaaccacactcaacaactgcccgctttgccctggctgaatgtgtctgctgacggtgataatgtgcacctggttcttaacgtgtctgaagaacagcatttcggtctctcactatattggaaccaggtgcaggggccccccaaaccaagatggcacaagaacctcacaggtccacaaattattaccctgaaccacaccgacctcgtcccctgtctctgcatccaggtatggcctctggagcccgattctgtgcgaactaatatttgtccctttagggaggacccaagagctcaccagaatttatggcaagcagctcgtttgcagctcttaacactccagtcctggctgctcgatgccccttgttcactccctgccgaagcagcgctatgttggagggcacccggcggcgatccttgtcagcctttagtaccccctctctcttgggagaacgttaccgtggatgtgaattctagcgagaagcttcagcttcaagagtgtctgtgggctgattccctggggccactcaaggacgacgtgctgctgttggaaactagaggcccacaggataataggtcgctttgcgctcttgagcctagtggatgtacctcactcccatccaaagctagtacccgggccgccagactgggtgagtatctcctgcaagacttgcagagtggacagtgcctgcagctgtgggacgacgacttaggagccctctgggcttgtccaatggacaagtatatccacaaaaggtgggccttggtctggctcgcttgcctgctgtttgccgccgctctgtcactgattctgctgctgaagaaagaccacgctaaggggtggctcagactcctgaaacaggatgtacgatccggtgccgctgcacggggccgggcagccttactcctctatagtgccgatgacagcggtttcgaacggctggtgggagcgcttgcctcagccctgtgtcagcttcctctgcgagtggctgttgacctctggagcagacgggagctctcagcccaggggcctgtggcttggtttcacgctcagcggcgacaaacacttcaggaggggggtgtggttgttctgctgttttcccctggcgctgtggcgctgtgcagtgagtggcttcaggacggagtgtctggacccggggcccatggtccgcacgatgctttccgcgcaagcctctcatgcgtgctgcctgatttcctacagggccgcgctcctggttcatatgtgggtgcttgttttgatagactccttcaccctgatgcggtgcccgcactgttccgcacagttcccgtgtttacattgcctagtcagctgccagatttcctcggagcattacagcaacctcgagcacctcgttctggccgtttgcaggaacgcgccgagcaggtttcacgcgctctgcagccagcgctcgattcctattttcaccctccaggaactcccgcccctggaaggggcgtgggccccggggctgggcccggcgctggcgatggaacctag

SEQ ID NO: 191785 - DNA, 2220 bp, Artificial Sequence
  Description of Artificial Sequence: Synthetic coding sequence
atggccccctggctgcagctgtgcagcgtgttcttcaccgtgaacgcatgcctgaacgggagtcagctcgcagtggcagccggtggaagtggacgcgctcgcggcgcagatacctgtgggtggcgcggggtgggacccgcctctcgcaactctgggctctacaacattacattcaagtatgataattgtaccacttacctgaatcccgtaggcaaacatgtgattgccgatgcacagaatataacgattagccagtacgcgtgtcacgatcaggtggctgtcacgatcctctggtcgcctggggctctaggcatcgagtttctcaaaggcttccgagtgatactagaagagctgaaatctgaaggccggcagtgtcagcagctgattctgaaggacccgaaacagcttaattccagttttaagcggacagggatggagtcccaaccttttctcaatatgaaattcgagacagactacttcgtgaaggtggtgcccttccccagcatcaagaatgaaagtaactaccatccttttttctttcgcacgcgcgcctgtgatctcttgctccaacctgacaatctggcttgtaagccattttggaagccacgcaacctgaacatctcccaacatggctcagacatgcaggtctctttcgaccacgcaccccacaacttcggctttaggtttttctatctgcactacaagctcaagcacgaggggccattcaagcgaaagacctgcaaacaggaacagaccactgagactacgtcctgtctcctacagaacgtctcacccggtgactatatcatagagcttgtggatgatacaaatacaactcgtaaggtcatgcattacgcgctcaaacccgtgcattctccgtgggccgggccgatccgtgccgtcgccatcaccgtacccctggtggtcatctcagccttcgccacattgttcaccgttatgtgtaggaaaaagcaacaggagaacatttattcacatctggacgaagaatcatctgagtcgtctacgtataccgccgccctgcctcgcgaacgccttagaccccgccccaaagtcttcctgtgttactcctcaaaggatggccagaatcacatgaatgtggtacagtgctttgcttatttcctacaggatttctgtgggtgtgaggtggctcttgatttatgggaggacttttctctgtgtcgcgaaggccagcgcgaatgggtgattcaaaaaattcatgaaagccagttcataattgtcgtctgctcaaaaggcatgaagtatttcgtggacaagaagaattacaagcacaagggagggggacgggggagcgggaagggtgaactgtttttagttgcagtctctgcaatcgcggaaaaactccgtcaagcaaagcaatccagtagcgctgccctgtccaaattcatagccgtgtattttgactactcctgcgaaggcgatgtgccaggaatcctcgatctttccaccaagtatcgcctgatggacaatttaccccagctttgctctcacttgcatagccgggaccacggattgcaggagcccggccagcatacaaggcaggggagcagacgcaactacttccgttctaagagtggtcggagcttatacgtcgccatatgtaacatgcatcaatttattgacgaagaacctgactggttcgagaagcagtttgtgcccttccatccgccacctttgagatatagagaacccgtgctggagaagttcgacagcggactggttctgaatgatgttatgtgcaagcctggccccgagtccgatttctgtctcaaagtcgaggcggcagtcctgggagcaaccggccctgcagactctcagcacgagtctcagcacggagggctcgatcaggacggcgaagctcgccccgccttagatggctccgccgctctacagcccctgctccacacggtcaaagctggaagcccatctgacatgccacgcgacagcggcatttatgattcatcagtgccgtcaagtgagttgtctctgcccctcatggaagggctgagcactgatcaaacagaaacatcctctctaacggaatcggttagctcttcatcaggtttgggggaagaggagccgccagcacttccatctaagttgttatcaagtgggagctgcaaggccgatttgggctgcaggtcatatacagatgagctccatgccgtcgctcccctgtag

SEQ ID NO: 191786 - DNA, 1788 bp, Artificial Sequence
  Description of Artificial Sequence: Synthetic coding sequence
atggagagccagcccttcctgaacatgaagttcgagaccgactactttgtcaaagtggttccattccccagcatcaagaacgaatctaattaccaccccttcttttttcggactcgcgcctgcgatctgttgctgcaacctgacaatctcgcatgcaaaccgttttggaagcctaggaacctgaacatctcgcagcatggctccgatatgcaggtgtccttcgaccacgccccacacaattttggctttcgttttttttatctgcactataaactgaaacacgaagggcccttcaaacgtaaaacttgcaaacaggaacagacaacagaaacaacctcatgtctactgcagaacgtttcgcccggggattacattatcgaactggtggacgatactaataccacaagaaaggtgatgcactacgctttaaagcccgtacatagcccatgggccggtcctatccgggcagttgctatcactgttccgctcgtggtgattagcgctttcgcaaccctgttcacagtcatgtgccgcaaaaagcagcaggagaacatatactctcacctggacgaagagagctctgagagttctacatatacagctgctctcccgagagaacggctgcgcccaagacccaaggttttcctatgctattcttcgaaggatggccaaaaccacatgaatgttgtgcaatgtttcgcctactttctgcaggatttctgcggctgtgaggtagctctggatctttgggaggatttctctctgtgtagagagggacaaagggaatgggtgatacagaagatacacgaatctcagtttataatcgttgtctgttctaagggaatgaagtacttcgtggacaagaagaactataaacacaaaggaggtggccgagggagtgggaagggtgagttgtttctggtggctgtctcagctatagcagaaaaactgaggcaggccaagcaatcctcttccgcggctctcagtaaattcatagcagtgtatttcgactactcttgtgagggagacgtgccaggaatactagacctgtctaccaaatataggctaatggataatcttcctcagttgtgtagccacctccattcaagagaccatgggttacaggaacccggtcaacatactagacagggcagccgcagaaattacttccgctcaaaatctggccgatccctctatgtcgcaatctgtaatatgcaccaattcatcgacgaagaacccgattggtttgagaaacagtttgtgcctttccacccaccccctctgagatacagggagcccgtccttgaaaaatttgactctgggctggtgctcaatgacgtgatgtgtaaacccggaccggaatccgacttttgtttgaaggtcgaggccgccgtgctgggagccacaggccctgccgacagtcagcacgaaagtcagcacggaggactcgatcaggatggggaggctagaccagccctggacggttctgcagccctgcagcccctcctccacactgttaaggccgggagcccaagtgatatgccacgcgacagtgggatctatgactcatctgtgcctagtagtgagctgtcgttgccactgatggaaggcttatccactgatcagactgaaactagctctttgactgagtcagttagctctagttccgggctcggtgaagaagaaccaccggctctgccaagcaagttattatctagcggatcgtgcaaggcggatctcggctgcaggtcctacacagatgagctgcatgctgtggcccccctttag

SEQ ID NO: 191787 - DNA, 2148 bp, Artificial Sequence
  Description of Artificial Sequence: Synthetic coding sequence
atgccccgggccagcgccagcggcgtgcccgccctgttcgtgagcggagagcagggagttggtcccgccagtaggaactcaggcttatacaacattaccttcaaatacgacaattgtactacctatctgaaccccgtaggtaagcacgtgattgcagatgcccaaaacataactatctcccagtacgcttgccacgaccaggtcgccgttactattctatggtcgcccggcgcattaggaattgagtttttgaaaggttttcgcgtgatcttggaggagctcaaatctgagggtcgtcaatgccagcaactgattttgaaggatccaaagcagctcaatagctcattcaagagaacaggtatggaatctcagccatttctcaacatgaaatttgagacagattatttcgtaaaagtagttcccttcccgtccattaaaaatgagtctaactaccacccttttttctttcggacacgggcttgtgacctgttgttacagccagacaatctagcctgtaaacctttctggaagcccagaaaccttaacatctctcagcacggcagcgatatgcaggtatcctttgaccacgcccctcacaatttcgggttccgcttcttttatctccactataagttaaaacacgagggaccgtttaagaggaagacgtgcaagcaagagcagactacagagacaacctcctgcctactgcaaaacgtgtctcccggcgattacataatcgagctggtggacgacacgaataccacccggaaggtgatgcactacgccttaaagccagtgcacagcccgtgggctggccccatacgagccgtagccattaccgtccccctggtggtgatctccgcattcgcaactctctttacagtcatgtgccgcaaaaagcagcaggagaacatctattcccacctggatgaggagtctagcgaaagcagcacgtataccgctgctttaccgcgggagcgtttgaggcctagacccaaggtgtttttatgttattcaagcaaagacggccaaaatcacatgaacgtagtacagtgcttcgcatacttcttacaggacttttgcgggtgcgaggttgcgcttgatctatgggaggatttcagcctgtgtcgggagggccagagggaatgggttatacagaagatacacgagagccagttcattatcgttgtttgttcgaaaggaatgaagtacttcgtggacaagaagaactacaagcacaagggcggtggacgcgggtcagggaagggagagctctttcttgtggccgtgagcgctatagctgagaagctgcgacaggccaagcaaagctcttcagcagctctatcaaagttcatagctgtctactttgattactcctgcgagggcgacgtgccaggcatcctggatctctcaaccaagtacaggttgatggataatcttccacagctatgctctcaccttcatagccgggatcacgggctgcaggagccaggccagcatacaagacaggggtcccggaggaattatttcaggtctaagagcggtcgctcactctacgttgccatctgcaatatgcaccagtttatagacgaagagcccgactggtttgagaagcagttcgtaccttttcacccccccccactgaggtatcgcgagcccgttctggagaagtttgatagtgggctagtcctgaatgatgttatgtgtaagcccggaccagaatctgatttttgtctgaaggtcgaagcggcagttctgggcgccaccggacctgcagactctcaacacgagagccagcatggcgggctggaccaagacggcgaggcccgtcccgctttagatggctctgcagctcttcaaccattacttcacacagtcaaggcggggtctcccagcgacatgccacgtgatagtggcatctacgatagtagcgtcccttcatcagagctctcattacccctgatggaagggctgtctactgaccagacagagacctcctccctcaccgagtccgtgagctcaagcagtggattaggcgaagaagagccacctgctctcccatctaagctcttgtcaagcggcagctgtaaggcagacctcggctgcaggagctacactgacgagttacacgctgtggctcccctgtag

SEQ ID NO: 191788 - DNA, 1788 bp, Artificial Sequence
  Description of Artificial Sequence: Synthetic coding sequence
atggagagccagcccttcctgaacatgaagttcgagaccgactacttcgttaaagtcgtgccttttccttccatcaaaaatgaaagcaactatcacccattcttcttccggaccagagcgtgcgacctgcttcttcaaccggataacctggcatgcaagccattttggaagccaaggaacttgaatatatcccagcacggctctgacatgcaagtctcatttgaccacgccccacacaactttggctttagattcttctaccttcattataagttaaaacacgaagggccctttaaacgcaagacttgcaagcaggaacagactactgaaacaacatcgtgtcttcttcaaaacgtgtcacccggcgactatattattgaactggtggatgataccaacacaactagaaaggtaatgcactatgctttgaagcctgttcacagcccatgggcaggccccattcgggctgtcgcaatcaccgtgcccctagtggtcatttctgcttttgctactctgtttactgtgatgtgtcggaaaaagcagcaagagaacatctattctcacctggacgaagaatcatcagagtcatctacttatacagccgctctccctcgagaaaggttaagacctcggcctaaggtattcctgtgttactcctccaaggatggtcagaaccacatgaacgtagtccaatgctttgcttacttccttcaggacttttgtggttgcgaagtggcactcgatttgtgggaagatttttcactctgtagagaggggcagagagaatgggtcattcagaaaattcacgagagccagtttattattgttgtgtgctccaagggcatgaagtacttcgtggataaaaagaactacaaacacaaggggggcggcagaggatcaggcaagggcgagctgttcctcgtggctgtgtctgcaattgccgagaagctgcgccaggcaaaacagtcgtcttccgccgctctgagcaagtttattgcagtctactttgactattcatgcgaaggagacgtacctggtattctggatctcagcactaagtaccggttgatggataacctgcctcagctgtgctcgcacctccattccagggatcacggcttacaggagcccgggcagcacacgcgccaaggcagccgcagaaattatttccggtctaagagtggacgctcgctgtacgttgcaatttgcaacatgcatcagtttatagacgaggaacccgactggttcgagaagcagttcgtcccgtttcatccaccccctttgcgctacagagagcccgttttggaaaagtttgacagcggattggtccttaacgatgttatgtgcaaacccggccccgaatcagacttctgcctgaaggttgaagctgccgttttgggcgccacgggaccagccgatagtcagcacgaaagccaacacgggggtctggaccaagatggggaggcccgacctgccttggacggttccgcggctttgcagccactcttgcacacggtgaaagcagggagcccttcagacatgcctcgggactctggcatttatgattcctcagtcccatcaagcgagttaagcctccctttgatggagggtctgtccaccgaccagacggaaacaagttcccttactgaaagcgtgtccagctcttctggcctgggcgaagaggaaccgcccgcactgcccagcaagctgctgtcttcggggtcttgtaaagccgatttggggtgccggagctacacggatgagctgcacgcagtggctcctctgtag

SEQ ID NO: 191789 - DNA, 222 bp, Artificial Sequence
  Description of Artificial Sequence: Synthetic coding sequence
atggagagccagcccttcctgaacatgaagttcgagaccgactacttcgtcaaagtggtccctttcccatccatcaaaaatgagagcaactaccatcctttcttcttccgcacacgcgcctgcgatctgctcttgcagccggataacttagcctgcaaaccattctggaagcccagaaatctgaatataagccagcatgggtcagacatgcaggtttcctag

SEQ ID NO: 191790 - DNA, 1671 bp, Artificial Sequence
  Description of Artificial Sequence: Synthetic coding sequence
atgggcttctggatcctggccatcctgaccatcctgatgtacagcacagcagcaaaattttccaaacagtcttgggggctcgagaacgaagctctcatcgttcgttgccctcggcagggcaaaccatcgtacaccgtagattggtactattctcagacgaataaatccatacccacacaggaaagaaatcgagtattcgccagcgggcaactactaaagttcctgcccgcagcagtcgcagatagcggcatctacacctgcatcgtccgctcccccacttttaataggactggctatgctaatgttaccatctacaaaaaacagagtgactgtaatgttcccgattatctgatgtattccaccgtcagtggttctgagaagaacagcaaaatctactgccctaccatcgacctgtacaattggactgctcccctggaatggttcaagaactgtcaggcacttcagggctcccgctacagggcacacaagtccttcctcgtgatagacaacgtcatgaccgaagacgcgggtgactacacatgtaagttcattcacaacgagaatggagccaattactcagtgacagctacacggagtttcaccgtgaaggatgagcagggctttagccttttccccgtcatcggagctcccgctcagaatgaaatcaaggaagtggaaataggtaaaaatgccaatctgacctgtagcgcgtgtttcggaaaggggactcagtttctggctgcagtgctatggcagctcaacggcacaaaaatcactgacttcggagagcctcgtatccagcaggaagagggccaaaaccagtccttttctaatggtctggcatgcctggatatggttcttcggatcgccgacgttaaggaggaggacttgttacttcagtacgattgtctggcactcaacctacacggcctgcgtcgacacacagttcgcctttctaggaaaaaccctatcgatcaccatagcatttattgcattattgcagtttgttctgtctttctcatgctaattaatgttctggtgataatactaaagatgttctggatcgaggccacactgttatggcgggatatagccaaaccctacaagacacgcaatgacgggaagctttatgacgcttatgtggtctatcctcgcaattacaaaagcagtactgacggtgcttcccgagttgagcattttgtccaccagatactaccggacgtgcttgagaacaagtgtggatacactctttgtatttatggccgcgatatgcttccgggagaggatgtcgtcactgccgtggaaacaaatattaggaagtcacgacgacatattttcatcctgactccccagattacccataacaaggagttcgcctatgaacaggaggtcgcccttcactgcgccctgatacagaacgacgctaaggtgatcttgatcgaaatggaagcactgtcagagcttgatatgctgcaggccgaggcactgcaggattccttacagcaccttatgaaggtacaagggacaattaagtggcgggaggatcatattgctaacaaacggagcctgaactccaaattctggaagcacgtgagataccagatgcccgtacctagcaagatcccaaggaaggcaagttcactcacgccattggccgcacaaaaacaatag

SEQ ID NO: 191791 - DNA, 513 bp, Artificial Sequence
  Description of Artificial Sequence: Synthetic coding sequence
atgaactgccgggagctgcccctgaccctgtgggtgctgatcagcgtgagcactgctgagtcctgcacctcccgtcctcatatcacagtcgtcgagggcgaaccgttttatttaaagcactgctcgtgcagcctcgcccatgagattgagacgacgactaaatcatggtacaagagcagtggatctcaagaacatgtggagctgaacccccggagcagcagccgcatagcccttcacgactgcgtgctggaattctggcccgtcgaactgaacgatacaggcagctatttcttccagatgaagaactacacacagaaatggaagcttaacgtgatccggaggaataagcactcatgcttcacagagagacaagtgaccagtaaaattgtggaagtcaagaaattcttccagatcacttgtgaaaacagttactaccaaaccctggtgaattccacatctctctacaaaataggcccacctatctgtaggaaaacaagctccggcctgcactag

SEQ ID NO: 191792 - DNA, 1626 bp, Artificial Sequence
  Description of Artificial Sequence: Synthetic coding sequence
atgaactgccgggagctgcccctgaccctgtgggtgctgatcagcgttagtacagccgagtcgtgtacctctagaccgcacattaccgtggtggaaggcgagcctttctatctgaagcattgcagttgcagcctggctcacgagatagagactacaactaagagttggtacaaatccagcggaagtcaggagcatgtggagctgaatccaaggagctccagccggatcgctctgcatgattgtgtactggaattctggccagtggagcttaacgacactggctcctatttcttccagatgaaaaattacacacagaaatggaaactgaacgttatcaggaggaataaacacagttgctttacggagcgacaggtgacatccaaaatcgttgaagtgaagaagttctttcaaatcacctgtgaaaattcctactatcagaccttggtgaatagtacatctctatataaaaactgcaagaaactcttactcgaaaataacaaaaacccgactatcaagaaaaatgcagaattcgaagatcaaggctattacagctgtgtacacttcctgcatcacaacggaaaacttttcaatataacaaaaacatttaatataactatagtagaggatcgatccaatatcgtccctgtgctgctcggtcctaaactgaaccacgttgctgtggagctgggcaagaatgtgaggttgaactgctcagccctgctgaatgaggaggatgtaatctactggatgtttggcgaggagaacggcagtgacccaaacatccacgaggagaaggaaatgcggattatgactcctgaaggcaagtggcatgcctctaaggtactgagaattgaaaacatcggagagagcaatcttaatgtcctatacaattgcaccgtagctagtacgggcggaaccgacactaagagttttatcttggtgcggaaggcggacatggccgacattccaggccacgtgtttaccaggggaatgataatcgctgtcctcatcctggtcgctgttgtctgcctcgtgaccgtgtgtgtgatctatcgcgtcgacctggtgttgttttatcggcacctcacaagacgggacgaaacattaacggacgggaagacctacgacgcctttgtgtcctatttgaaagaatgcagaccagagaatggagaagaacacactttcgcagtcgaaattctgccccgagttcttgagaagcactttgggtataaactttgcatctttgagcgggatgtggttcccggaggcgccgtggtggatgagattcatagcctgatcgaaaagtcccggcgcctgatcatagtcctgagtaaaagttatatgagcaatgaggtgcgttatgaacttgagtcagggctgcacgaagccttagttgaaaggaagattaaaatcatcctcatagaattcacaccggttaccgatttcacctttttgcctcaatctctgaagttgctgaaaagccaccgcgtcttgaagtggaaggcggataagtcccttagctataattcccgcttttggaaaaatctcttgtacctcatgcctgccaaaaccgttaagcccggtcgggatgagcccgaagtactccctgtgcttagcgaaagttag

SEQ ID NO: 191793 - DNA, 1626 bp, Artificial Sequence
  Description of Artificial Sequence: Synthetic coding sequence
atgaactgccgggagctgcccctgaccctgtgggtgctgatcagcgtctccacggccgaaagttgtacctcgcgaccacatatcactgttgtagagggggaaccgttctatctcaagcattgctcctgtagcctggcccatgagatcgagaccaccaccaagtcatggtacaagtccagcgggtctcaagaacatgtggagcttaatccacggagctcctcccgcatcgccctacacgattgtgtgctggagttctggcctgtagagttaaacgataccggttcctactttttccagatgaagaattacacacagaaatggaagttgaatgtgatccggcggaataagcattcctgctttactgagaggcaggtaacctccaaaatcgtggaggtaaagaaattttttcagattacctgcgaaaacagttactaccaaacccttgttaatagcacttccctgtataaaaactgtaaaaaactgttgctcgaaaataacaaaaaccctactatcaaaaaaaacgctgaattcgaagaccaaggatactacagctgcgtccattttttacaccataacgggaaactctttaatatcacgaaaaccttcaacattactatcgttgaagacagatctaatatcgttcctgtgcttctcggaccaaagctgaaccatgtcgcagttgagctggggaagaatgtgagactgaattgctccgcccttctgaacgaggaggacgtgatttattggatgtttggagaggaaaacgggagtgaccccaacatccatgaggagaaagaaatgcgaataatgaccccagaggggaaatggcacgcctccaaggtgctgaggatagagaacatcggggagagcaatctcaatgtgctgtataactgtactgtggcaagtacaggcggcacggacactaagtcctttattctggtgcgaaaggccgatatggccgacatacccggacatgttttcacacgagggatgatcattgctgtcctcatcttggtggctgtggtttgccttgtcacggtctgcgttatttatagagtggacttagtattattttacagacatctgactagaagagacgaaaccttaactgacggtaaaacatacgacgcctttgtgtcgtatctcaaagaatgtagaccagagaatggtgaggagcacacgttcgccgtggaaatactgccgagggtgttagaaaagcatttcgggtataaattatgcatttttgaacgggacgtggtccccggtggagccgtcgtggatgaaattcatagtctgattgagaagtcacgcaggctcattatcgtgttatctaagagctatatgagcaatgaggtgagatacgagttggaatctggcctgcacgaggctttagtggagaggaagatcaaaatcatattaattgaattcactcccgtgaccgatttcacctttctgccgcagtccttgaaacttctgaaatcacaccgtgtgcttaaatggaaagctgacaagagcttgtcatacaatagccgtttttggaagaacctgctgtacttgatgcccgccaagactgtcaagcctgggcgggatgagcccgaggtcctgcctgttctgtcagaatcttag

SEQ ID NO: 191794 - DNA, 1800 bp, Artificial Sequence
  Description of Artificial Sequence: Synthetic coding sequence
atgctgtgcctgggctggatcttcctgtggctggtggccggcgagcggataaaggggttcaacataagtgggtgcagcacaaagaaactcctatggacctacagcacgcggtccgaagaggagtttgtgttgttctgcgatctaccagaaccgcagaaatctcatttttgccaccgtaatagactgtcgccaaaacaagttcctgagcatttgcccttcatgggcagcaatgacctgagcgatgtccaatggtaccagcagccttccaacggcgacccgctggaggacatcaggaagagctacccacacataatccaggataagtgtaccctgcatttcctaacccctggggtgaataacagcggaagctacatatgcaggcccaagatgataaaaagcccctatgatgtcgcctgctgcgtgaaaatgatcctggaagtgaagcctcagactaatgcaagctgcgaatattccgctagccacaaacaggacttactgttaggctccaccggaagcatatcttgtccctctctgtcttgtcaaagtgacgcacagtctcctgctgtgacttggtacaaaaacggaaagctgctttcggtcgagagatccaaccgtatcgtcgtggatgaggtgtatgattatcaccagggtacatatgtgtgtgactacacacagagcgacactgtgagctcctggactgtccgcgctgtcgtgcaggtgcggaccattgttggggatacgaagctcaaaccagacatactggacccagtggaggacacactggaagttgaactagggaagcctctcacgatcagctgcaaagcaagattcggcttcgaaagagtctttaatccggtcattaagtggtacatcaaggactcggacctggagtgggaagtgtcagtgcccgaggctaagtcaattaagtccacactgaaggatgagattattgagcgtaacattattctcgaaaaagtcacacagcgcgatttgagacggaagttcgtgtgcttcgtgcagaattccatcggaaacacaactcagagtgtgcagctaaaagaaaaacgcggcgtagtactgctttacatcctgctcggcacaattggcacactcgtggcagtgctggctgcgagcgctcttttgtaccggcattggattgaaatcgtgctgctatatcgcacctatcagtctaaagaccagaccctgggtgacaagaaagacttcgatgcgtttgtctcttacgccaagtggtcttcttttccatctgaggcgacctcatcacttagtgaggagcacctggctctcagcctgtttccagatgtactcgaaaataaatatggatatagtctgtgtttactagaaagagacgtggctccaggcggggtgtatgccgaagacattgtgagcattataaagaggagtcgccgtgggatcttcattctgtctcctaattatgttaatgggccttcaatcttcgagctgcaagccgccgtgaacctggcattagacgatcaaactctgaaactgatactcatcaagttctgctattttcaggaaccagagagtcttccccacctggtgaaaaaagctttgcgggtgctgcctacggtcacatggaggggattaaagtctgtacccccaaactccaggttttgggccaaaatgcgatatcatatgccagtaaagaattctcagggatttacatggaaccagttgcggattacctcccggatctttcagtggaaggggctttctcggactgagacgacaggacggtcctctcagcctaaagagtggtag

SEQ ID NO: 191795 - DNA, 1374 bp, Artificial Sequence
  Description of Artificial Sequence: Synthetic coding sequence
atgatcctggaggtgaagccccagaccaacgccagctgcgagtactcggcgtcacacaaacaggatctcctactcggcagcaccggcagcatcagctgccccagtctgtcttgtcagagcgacgcacagagcccagccgtcacctggtacaaaaatggcaagctgctaagcgttgagcgtagcaatcgaatcgttgtggatgaagtctacgactaccatcaggggacttatgtgtgcgattacacacagtcagacactgttagttcatggacggtacgggctgttgttcaggttcgtaccattgtgggagacactaaactaaaaccagatatcctcgacccagtagaagataccctggaggtcgaactaggtaaaccgctgaccatctcatgtaaggcccgctttggcttcgagagagtattcaaccctgtgattaaatggtacataaaggacagcgatctggaatgggaagtgagtgtcccagaggccaagagcattaagtccacattgaaggacgaaattattgaaagaaacattatcctggaaaaagtcacccagcgcgacctgagaaggaagtttgtctgctttgtgcagaattctatcggtaacacaacccagagcgttcagctgaaggaaaaaaggggagtggtactcttgtacattttgctgggtacaattggaactctggtggccgtccttgcggcctccgctctgctctataggcattggatcgagattgtgctcctttatcgtacctatcagagcaaagatcagacgcttggagataaaaaagacttcgatgcattcgtatcttatgctaagtggtcaagctttcccagcgaagccactagtagtttaagcgaagagcatctggccttgagcctgttcccagacgtacttgagaacaagtatgggtatagcctgtgccttcttgagagagatgtggcgccaggcggggtttatgctgaagacatcgtgagtattattaaaagatctaggagggggatttttatccttagccctaattacgtaaacgggccaagcatctttgaactccaagcagcagtcaacctagccctcgatgaccaaactcttaaactgattctaataaagttctgctacttccaggagcctgagtccttgcctcaccttgttaaaaaggccctgagagtgctgcccacagtgacctggcggggtctgaagtctgtgcctccaaacagtaggttttgggcgaaaatgcgctaccatatgcccgtcaagaacagccaggggtttacgtggaaccagttgagaattactagcaggatctttcagtggaagggactctcgagaaccgagactaccggtagatcctcccagccgaaggaatggtag

SEQ ID NO: 191796 - DNA, 135 bp, Artificial Sequence
  Description of Artificial Sequence: Synthetic coding sequence
atgctgtgcctgggctggatcttcctgtggctggtggccggcgagagaatcaaaggtttcaacatctcaggatgctctacaaaaaaactgctctggacttacagcaccagatcagaggaggaatttgtcttatag

SEQ ID NO: 191797 - DNA, 534 bp, Artificial Sequence
  Description of Artificial Sequence: Synthetic coding sequence
atgaagctgcagtgcgtgagcctgtggctgctgggcaccatcctgatcctttgctctgtagacaatcacggtctgcgccggtgtctgatctccaccgatatgcaccatatagaagaatcatttcaggagatcaagcgcgccatccaagcgaaagatactttccccaatgttactatcctgtcgactctcgagacactgcaaattattaaaccactcgatgtttgttgtgtgacgaagaatctgctggccttctacgtcgatcgcgtttttaaagaccatcaggagcccaacccaaaaatcctgcggaagatatcaagtatcgccaacagctttctgtatatgcagaaaaccctgaggcaatgtcaggaacagaggcaatgtcactgtcgccaagaggctaccaacgcaacccgcgtcattcacgacaattacgaccaactggaagtgcacgcagccgctatcaagagcttaggtgagctcgacgtgttccttgcttggatcaacaagaatcacgaggtgatgttctccgcctag

SEQ ID NO: 191798 - DNA, 648 bp, Artificial Sequence
  Description of Artificial Sequence: Synthetic coding sequence
atgtgcaccgagggcgccttcccccaccggagcgcctgcagcctgccactgacccacgttcatacacacatccacgtgtgcgtccctgtcctgtgggggagtgttccacgcggcatgaaattgcagtgcgtctcgctgtggctccttgggaccatcctcattttgtgttccgttgataaccacggcctgagacgttgcttgatctctaccgacatgcaccacatagaagagtcatttcaagagattaaaagggctattcaggcgaaagatacgttcccaaacgtaacaatactaagtaccttggaaaccctacaaatcattaaaccactggatgtctgttgtgtgacaaagaatcttctcgcattttacgttgatagagtctttaaggaccaccaggagccgaaccctaaaattctccgtaagatcagcagcattgccaattcattcctgtacatgcagaaaactctccgccagtgtcaggagcagcgccaatgtcattgccgacaggaggccacaaacgcgactagggtgattcatgacaattacgaccaattagaagttcatgctgccgctatcaagagtctcggggagctggatgtctttctcgcctggattaacaaaaatcacgaggtgatgttcagtgcttag

SEQ ID NO: 191799 - DNA, 792 bp, Artificial Sequence
  Description of Artificial Sequence: Synthetic coding sequence
atggacagctacctgctgatgtggggcctgctgaccttcatcatggtacctgggtgccaggcagaactgtgcgatgacgaccctcccgagattccacatgcaacgtttaaggccatggcctacaaggagggcaccatgttgaactgcgaatgtaaacgcgggtttaggaggataaaatccggatccttatatatgctgtgtaccggaaatagcagccacagttcttgggataaccagtgccagtgcacatcgtctgcgactcggaatacaacaaaacaggtgacgccacagcccgaagaacaaaaggagaggaagactacagagatgcagtccccaatgcagcccgtggatcaggcctcactgcccggccactgccgcgagccacctccttgggagaacgaggccacggaacgcatttaccacttcgtagtcggccagatggtttactatcaatgcgtgcaaggttatagagccctgcatagaggaccggcagaatctgtgtgcaaaatgacccatggcaagactcgttggacgcagccccagctgatttgcaccggtgaagaaaagccccaggccagtccagagggcagacccgagagcgagacttcctgcctggtgacaacaacagattttcaaattcagacggagatggccgccacaatggagacgagcatcttcaccacagagtaccaggtggctgtggcaggctgcgtgttcctgctgatatccgttctgctgttaagtgggttgacctggcagaggagacagcgaaagtctcggagaacaatctag

SEQ ID NO: 191800 - DNA, 603 bp, Artificial Sequence
  Description of Artificial Sequence: Synthetic coding sequence
atggacagctacctgctgatgtggggcctgctgaccttcatcatggtgcccggatgtcaggccgagctttgcgatgacgacccccctgaaatcccgcatgccacatttaaagctatggcatacaaagaagggactatgctgaattgtgaatgtaaacggggtttccgacggatcaaatccggaagcctctatatgctctgcaccggcaattcaagccactcatcctgggacaaccagtgccagtgtaccagttctgcgacacggaatactactaagcaggttaccccacagcccgaagaacagaaagaaaggaaaacaactgaaatgcagtcccctatgcaaccggtggaccaggcctccttaccaggcgaggagaagccacaggcctcccccgaagggcgccctgaaagtgagacctcttgtctcgtgactacaaccgattttcagatccaaaccgaaatggccgctaccatggagacttcaatctttactacagagtatcaggtcgctgtcgccgggtgtgttttcttgttgatttccgtacttctcctcagcgggctcacatggcagcggcgccagcggaagtcaagaaggaccatttag

SEQ ID NO: 191801 - DNA, 819 bp, Artificial Sequence
  Description of Artificial Sequence: Synthetic coding sequence
atggacagctacctgctgatgtggggcctgctgaccttcatcatggttcctggatgtcaggctgagctgtgtgatgatgaccctccagagatccctcacgcaacattcaaggccatggcctacaaggagggtacaatgcttaattgtgagtgtaagagaggattccggcggatcaaatctggcagcttgtacatgctgtgtactggcaactcctctcattcctcttgggacaaccaatgtcagtgtaccagctccgctaccagaaatactaccaagcaagtgacccctcagccagaagaacagaaagagcgcaaaactaccgaaatgcaatcgcccatgcagcccgttgatcaggcttcccttcccgggcattgccgggagccccctccttgggaaaacgaagcgactgagcggatataccactttgtggtgggtcagatggtttattatcaatgcgtccaggggtacagagcactgcacagggggcctgccgaatcagtctgtaaaatgacccacggcaagaccaggtggactcagccacagctgatctgcaccggagaaatggagacctcccaattccccggggaggaaaagcctcaagcatcgcccgaggggcgccctgagagcgagacttcatgcctggtgacaaccacggatttccaaatccagaccgaaatggccgcaaccatggagacctctatatttactactgagtatcaagtcgccgtggccgggtgcgtgttcctcctgatttccgtgttactgctgagcgggctgacgtggcaacgtcggcagaggaaatcgcggaggacgatttag

SEQ ID NO: 191802 - DNA, 489 bp, Artificial Sequence
  Description of Artificial Sequence: Synthetic coding sequence
atggtgcccggctgccaggccgagctgtgcgacgacgacccccccgaaattccccatgccacctttaaagccatggcgtataaggaaggcaccatgctgaactgcgagtgcaagcgaggattccgaaggatcaagagtggctcactatacatgctctgtacgggaaatagctcacacagcagctgggacaaccagtgccagtgcacctcctccgccaccagaaacactacgaaacaggtgaccccccagcccgaagagcagaaggagcgcaaaactacggaaatgcagtctcccatgcagcccgtcgaccaagcttccttacccgactttcagatacaaactgagatggcagcaactatggagactagtattttcacaactgagtaccaagtggcagttgcagggtgtgtttttctactaatttctgtcctcttgttaagcggtctgacctggcaaaggcgacagcggaagagccgacgtaccatttag

SEQ ID NO: 191803 - DNA, 330 bp, Artificial Sequence
  Description of Artificial Sequence: Synthetic coding sequence
tgaatcccccacgccaccttcaaggccatggcctacaaggagggcacaatgctgaactgcgaatgcaagcgagggttcaggcggattaaaagtggatcgttgtatatgttatgcacgggcaactcctcccactcgtcatgggataaccagtgtcaatgtacctccagcgccaccagaaatacgacaaagcaagtaacgcctcagccagaggagcagaaggaaagaaagacaaccgaaatgcaatcgcctatgcagcccgtggatcaggcaagtctccctgacttccagatccagaccgagatggcagccactatggaaacaagcatttag

SEQ ID NO: 191804 - DNA, 1110 bp, Artificial Sequence
  Description of Artificial Sequence: Synthetic coding sequence
atggacccccggaaggtgaacgagctgcgggccttcgtgaagatgtgtaagcaggacccatcagtgctgcacaccgaggagatgcggttcctcagggagtgggtggagagtatgggggggaaggttcccccggcaactcaaaaagctaaaagtgaagaaaacacgaaagaggaaaaacctgacagcaaaaaagtggaggaggaccttaaggctgatgaaccttcctctgaagagtcagatctcgaaatcgataaggaaggagtgatcgagcccgacactgacgcgcctcaagagatgggtgacgaaaatgcagagattaccgaggagatgatggatcaggctaacgataaaaaagtggccgccatcgaggctttgaacgatggcgagttacagaaagccattgacttgttcaccgacgctatcaagctgaacccaaggttggccattctttacgccaaaagagcgagcgtgttcgtcaaactgcagaaacccaacgctgccattcgggattgcgatcgtgccatagaaatcaaccctgattccgcgcagccgtataagtggcgaggcaaggcgcatagactgcttggacactgggaggaagcagctcacgatcttgcactcgcttgcaagttggactatgacgaggacgccagcgccatgttgaaggaagtgcagcctcgggcacaaaagatcgccgagcatagaagaaagtatgaacgcaagcgcgaagagcgggaaatcaaggagcgtattgagagggttaagaaagccagagaggaacacgaacgagcgcaacgcgaagaagaagccagacgtcaatctggcgcacagtatggctcttttcccggtggcttccctggtggcatgccaggtaattttccaggaggcatgcctggcatggggggcggcatgcccgggatggcgggaatgccgggtttaaatgaaatactctcagaccccgaggtgctggcggctatgcaggacccagaagttatggtggcctttcaggatgtggcccaaaatcccgcaaacatgtccaaatatcagagcaatcccaaagttatgaacctcatctctaagttgtctgctaaatttgggggccaggcttag

SEQ ID NO: 191805 - DNA, 441 bp, Artificial Sequence
  Description of Artificial Sequence: Synthetic coding sequence
atggccgcccccgccctgagctggcggctgcccctgctgatcctgctcctgcctctggcgaccagctgggctagtgcagctgtcaacggcaccagccagtttacctgcttttacaacagccgggccaatatcagttgtgtgtggtcccaagatggcgcactgcaagatactagctgtcaggtgcacgcttggcccgaccgtagacgttggaaccagacatgtgagctgctccctgtgtctcaagcttcatgggcctgcaacttgatcctgggggcccccgacagccagaaactaacgactgtggatattgtaacgctacgggttctgtgccgcgagggcgtaagatggcgggtgatggccatccaggattttaaacccttcgagaacctaaggctgatggcccctatttccctacaggttgttcatgtcgaaacgcattag

SEQ ID NO: 191806 - DNA, 267 bp, Artificial Sequence
  Description of Artificial Sequence: Synthetic coding sequence
atggccgcccccgccctgagctggcggctgcccctgctgatcctgcttctgccactggccaccagctgggcatccgcagctgtgaacgggacgagccagtttacgtgtttctacaacagcagagccaatatatcctgcgtttggagccaagacggtgcgctacaagacaccagctgtcaggtccatgcttggcccgaccggcgccgatggaaccagacgtgtgagctgctccctgttagtcaggcctcttgggcttgtaatctgtag

SEQ ID NO: 191807 - DNA, 567 bp, Artificial Sequence
  Description of Artificial Sequence: Synthetic coding sequence
atggccgcccccgccctgagctggcggctgcccctgctgatcctgttgctgcctctggctacgagctgggcttctgccgcagtgaacggcacatcccagtttacgtgcttctataactcgagagccaacattagctgcgtgtggagccaggatggggctctgcaagacaccagctgccaggtgcacgcttggccagatcggcggcggtggaatcagacatgtgagctcctgccagttagccaggccagctgggcctgtaacctcatactgggagccccagactctcagaagctgactaccgtcgacatcgtcacacttcgtgtgttgtgtagggaaggagtcagatggcgcgtgatggcaattcaggacttcaaaccttttgagaatctgagactgatggctccgattagtctccaggtggtccacgtcgaaacacatagatgcaacatttcctgggagatctcccaggcctcccattatttcgagcgccatctggaattcgaagcaaggacgctgagcccaggacacacttgggaggaggcccccttgttgaccctgaagcagtag

SEQ ID NO: 191808 - DNA, 297 bp, Artificial Sequence
  Description of Artificial Sequence: Synthetic coding sequence
atggagccccccaaccccctgggcgagcagtacttcaagcggaccatgcctcgcataccgactcttaagaacctcgaagatctggtgacagaatatcatgggaacttttccgcttggtctggagttagcaagggtttggcggagtcccttcaaccagattactctgagcggctgtgccttgtcagtgagatcccaccaaaagggggggcacttggcgagggccctggcgcgtctccctgcaaccagcacagtccctattgggcgccgccttgctataccttgaaacctgaaacgtag

SEQ ID NO: 191809 - DNA, 474 bp, Artificial Sequence
  Description of Artificial Sequence: Synthetic coding sequence
atgctgaagcccagcctgcccttcaccagcctgctgttcctgcagctgccactccttggcgtgggtctgaacaccacaatcctcacaccaaatggaaacgaagacacaaccgctgatttcttccttacaaccatgcctaccgatagtttgagcgttagcacactacctctgcccgaggtgcagtgctttgtctttaatgtggagtacatgaactgtacttggaatagctcttctgaaccacagccaacaaacctcaccttgcactattggtacaagaatagcgataatgacaaggtacagaagtgttcacactatctttttagcgaagaaatcacatcaggctgtcagctgcaaaaaaaggaaatccacctgtaccaaacattcgtcgtgcagcttcaggatcctcgcgaacctagacgtcaggcgacacagatgctgaaactgcagaacttaggaaccatctctggtctctag

SEQ ID NO: 191810 - DNA, 1110 bp, Artificial Sequence
  Description of Artificial Sequence: Synthetic coding sequence
atgctgaagcccagcctgcccttcaccagcctgctgttcctgcagctccccctgctgggcgttggcttgaacacaactatcctcacccccaacggcaatgaagatactacggccgatttctttctcacaaccatgccaactgattccctttctgtgtcaaccttaccactgcctgaggtccaatgcttcgttttcaacgtagagtacatgaactgcacctggaattctagcagtgagccccaacccaccaacttaacgctgcactattggtataagaactctgacaatgacaaggttcagaagtgtagccattatctcttcagcgaggagatcacgtctggatgtcaactgcagaagaaggaaattcatctgtatcaaacgtttgtcgtccaactccaagaccctcgcgaaccgagacggcaggcgactcaaatgttgaagttacagaacctcgtgatcccatgggctcccgagaatctaaccctccacaaactatctgagagtcagcttgagcttaactggaataatcggttcctcaaccactgcttggagcacctcgtacaataccgaaccgactgggatcattcctggaccgagcaatcagtggactaccgacacaagtttagtctgccatcagtggacggccagaagcgatacacttttagagtccgatctcgatttaatccactctgcgggtccgcccagcactggtcggaatggtcccacccaattcattggggctctaacacatcgaaagagaatccgtttctatttgctcttgaggccgtagtgatctctgtggggagcatggggctgatcattagtctcttgtgtgtgtacttttggctcgaacggaccatgcctagaatccctactctgaagaatttggaagatctggttacggagtatcatggcaacttttcagcctggtcgggtgtcagcaaggggctcgccgagtccctgcaaccagactactccgaacgcctttgcctggtgtccgaaattccacccaagggcggtgccctcggcgaaggccctggcgccagtccctgtaatcagcatagcccctactgggccccgccttgctatacacttaaacccgagacatag

SEQ ID NO: 191811 - DNA, 540 bp, Artificial Sequence
  Description of Artificial Sequence: Synthetic coding sequence
atgggcatgaagaccccccagctggagcagagcgtggactaccggcacaaattttccttgcccagcgtggatgggcaaaaacgatatactttccgcgtcagatcacgcttcaatcccctctgcggaagcgcccagcactggagcgagtggagtcatcctattcactgggggagcaacacaagcaaggaaaacccgtttttgtttgcattggaggcagtagtcatttctgtcggctcaatgggtctgattatcagtctgctctgcgtctacttctggctggagcgaacaatgcccaggatccctaccctcaaaaatctcgaggatctcgtgactgagtaccatgggaacttcagcgcatggtccggcgtgagtaagggcctggcggagtctctacaaccagactactctgagcgactctgcctggtgtcggagattccgcctaagggaggagcactgggcgagggcccgggagccagtccctgcaatcagcactctccttactgggctcctccctgttacacgctgaagcctgaaacctag

SEQ ID NO: 191812 - DNA, 1662 bp, Artificial Sequence
  Description of Artificial Sequence: Synthetic coding sequence
atgcgggcccccggccggcccgccctgcggcccctgcccctgcccccactcctgctgttgctgctcgcggctccctggggacgcgccgtgccctgcgtgtccggagggctgcctaagcctgcaaatatcacattccttagtattaacatgaagaatgtcctccagtggacaccacctgagggcctgcagggcgtcaaagtgacgtatacagtccaatacttcatctatggccagaaaaaatggttgaacaagtccgagtgcagaaacattaatcgcacttactgtgatctgagtgctgagacctcagattacgagcaccagtactatgcaaaggtcaaggccatttgggggacaaagtgtagcaaatgggccgaaagcggccgattctatccatttctggagacccagatcggccctcccgaagttgccctgaccactgatgaaaaaagtatttcggtggtgctgactgcccctgagaagtggaaacgtaaccctgaagacctccccgtgtcaatgcagcagatctacagtaatctgaagtacaatgtatcagtgctaaacaccaaatccaatcgcacctggagtcagtgcgtcacaaaccacacactggtgttgacttggctggagcctaataccctgtactgcgttcatgtggaatctttcgtgccgggacctccccgccgagcacaaccgtccgaaaagcagtgcgccagaacgctcaaagatcagagctccgagttcaaggcaaaaatcattttctggtacgtgcttcccgtcagcattactgtgtttctgttttcagtgatgggttactccatctataggtacatccacgtgggcaaggaaaagcaccccgccaatctgatcctgatttatggcaacgagttcgataaaagattctttgttcccgcggaaaagatcgtaattaacttcattaccctgaatatctcggacgattctaagattagccaccaggatatgagtttgctcggaaaaagctctgatgtgtcaagtttaaatgatccccagcctagcggcaatctgcggcccccgcaggaagaagaggaggtgaaacacctgggctacgcctcccacttgatggagattttctgtgactccgaagagaataccgagggaacatcacttactcagcaagagtctctctctcggacaattcccccagacaaaaccgtaatagaatatgaatatgatgtgagaaccacagacatttgtgcaggaccggaagaacaggaactttccctgcaggaggaggtaagtacccaaggcacgttactcgaaagccaagcagcactagcagtgctcggtccccaaactctccagtatagctatacccctcaactgcaagacttagaccccctggcacaagagcataccgacagcgaggaggggcccgaggaagaaccaagtacgactctagtcgattgggatccccagactgggaggctctgcattccctccctatccagcttcgatcaagattccgagggctgcgaaccttctgaaggcgatggtctgggagaggaagggctcctgagtaggctgtatgaggaacccgccccggaccgacctcctggggaaaacgagacgtatctcatgcaatttatggaggagtggggactgtacgttcagatggaaaactag

SEQ ID NO: 191813 - DNA, 630 bp, Artificial Sequence
  Description of Artificial Sequence: Synthetic coding sequence
atgcgggcccccggccggcccgccctgcggcccctgcccctgcccccacttctcctgctgcttctggcagccccctggggccgagccgttccatgtgtctccggtggcttacctaagccagcgaatatcacatttctgagtatcaacatgaagaatgtcctgcagtggacgcctccagaaggccttcagggagtcaaggtgacctacactgtgcaatactttatttacgggcaaaagaagtggttgaacaagtccgagtgccggaacatcaatcgcacgtattgtgatctgtccgctgagacatccgattacgaacatcaatactatgctaaggtaaaagccatatgggggaccaagtgtagcaagtgggccgagagcgggcgattctatccatttctggagacccaaattgggccaccagaagtggcactgacaactgacgaaaaatccataagcgttgtgctgacggccccagaaaagtggaaacggaaccccgaggacctgccagtgtccatgcaacagatatacagcaatctgaagtataatgtaagtgtccttaatactaaatccaatcgcactgtgtctctcaagtggaacggtgcttacatccacgtgccactgtgcagttag

SEQ ID NO: 191814 - DNA, 1329 bp, Artificial Sequence
  Description of Artificial Sequence: Synthetic coding sequence
atgagctacaacggcctgcaccagcgggtgttcaaggagctgaagctcctgacattgtgcagcatttcttcccagatcggtccccccgaggtcgccttaaccacagatgagaagtcaatcagcgtggtgcttaccgcgcccgaaaagtggaagcgcaacccagaagatctccccgtgagtatgcaacagatatattctaacttgaagtacaacgtttctgtgcttaataccaagagtaacagaacatggagtcagtgtgtgacaaaccacacactcgttctgacgtggttagagccaaacaccctatattgcgttcatgtggaatcttttgttcccggacctccgaggagagcacagccgagtgagaagcagtgtgcacgcaccctcaaggaccagtcatcagagtttaaggccaaaattatcttttggtacgttttgcctgtttcgatcaccgtgtttcttttctccgtgatgggttacagcatctatcgatatatccacgtggggaaagagaagcaccccgctaatctgatcctgatatatggaaacgagttcgacaaaaggttctttgtgccagccgagaaaatagtcattaattttattacccttaacatttcagatgattctaagatatcacaccaggacatgagcttgctgggtaagagctcagacgttagttccctgaatgatccacagcctagcgggaatctgcggcctccacaggaggaagaggaagtgaagcacctgggctatgcttcacatctgatggagatcttctgtgactctgaggagaacaccgagggcacaagtctgacacaacaggagagcctgagccgaacaatacctccagacaagacagtcatcgaatatgagtatgacgtcagaaccaccgatatctgcgcaggccctgaagaacaggagctgagcctgcaggaagaagtgtccactcaaggaacgctgctggagtcccaggccgccctcgcggttctcggaccccagaccctccagtatagctacactccacagcttcaggacctcgatcccctcgcccaagaacacacagattctgaggaaggccccgaggaagagcctagtaccaccctcgttgactgggacccacaaactgggaggctctgtattccctctttaagctctttcgaccaggattctgaaggctgtgaaccgagcgagggggatggcttgggggaagaaggcctcttgtcacgcttgtacgaagaacctgcacccgatcgtccgcccggcgaaaatgaaacctacttaatgcaattcatggaggagtggggcctgtatgtgcagatggagaactag

SEQ ID NO: 191815 - DNA, 1515 bp, Artificial Sequence
  Description of Artificial Sequence: Synthetic coding sequence
atgaagaacgtgctgcagtggaccccccccgagggcctgcagggcgtgaaagtcacctacacagtgcagtacttcatctacggacagaagaaatggcttaacaagagcgagtgccgtaatataaatcgtacctactgtgacctgagtgcggagacaagtgattacgaacaccagtattatgccaaagttaaggcaatatggggcaccaagtgcagcaaatgggccgagtctggtcgattttatcccttcctagaaacgcagatcggcccccctgaggtggccctcacaaccgacgagaaaagcatctccgtggtactcactgcacccgagaagtggaagcgcaatccagaagatcttcctgtctcgatgcagcagatctacagtaatcttaaatataatgtgagcgttctgaatacaaaatccaatcgaacctggtcgcagtgcgtgacaaatcataccctcgtgttgacatggcttgagcccaacaccctctattgtgtgcacgtagaaagctttgtgcccggacctccccgaagggctcagcccagcgagaaacagtgtgcacgaaccctaaaggatcaatcgtcagagttcaaggcaaaaattatattctggtacgtgcttcccgtgtccataacggtattcctattttcggtcatggggtacagtatctatagatacatccatgttgggaaagaaaagcatcctgctaatctcatcctcatttacggaaacgagtttgacaaaagattttttgtccctgcggagaagatcgtgattaacttcatcaccctgaatatttctgatgactccaagattagtcatcaggatatgtcactgctcggtaagtcatcagacgtgagtagtctcaacgacccgcaacctagcgggaacctgaggcctcctcaagaggaagaggaagtaaagcacctgggatacgccagccatctcatggagattttctgcgactccgaggagaacacggaggggacctccctgactcagcaggagtccctgtcccgcacaataccgcccgacaagacagttattgagtacgaatacgacgtgcggaccactgatatttgcgcaggtccagaagaacaggaactgagtctgcaggaggaagtgtctacccagggaacactgctcgaaagtcaggccgcactggcagtcctgggaccgcaaacccttcagtactcctacacccctcagttacaggacctcgatcctttggcgcaggagcacactgattctgaggagggacccgaggaggaaccctcaaccaccctggtagactgggacccccaaaccgggaggctttgcattccctcgctcagttccttcgaccaagactccgagggatgcgaaccgagcgaaggcgatgggcttggagaagagggattgctttctaggctgtacgaagagcccgcacccgatcggccgcctggggagaacgagacctatctgatgcagttcatggaggaatgggggttgtacgtgcaaatggagaattag

SEQ ID NO: 191816 - DNA, 1617 bp, Artificial Sequence
  Description of Artificial Sequence: Synthetic coding sequence
atgccccggggctgggccgcccccctgctgctgctgctgctgcaggggggttgggggtgcccggacctggtgtgttataccgactacctgcagactgtgatctgtattttggaaatgtggaatttacaccctagcacgttgacactcacctggcaagaccagtatgaggagctaaaggacgaagccacgtcctgctctcttcaccgatcagcacacaacgctacccatgccacctacacctgccatatggacgtctttcattttatggccgatgacatcttcagcgttaacattaccgatcagtcaggaaactattcacaggaatgcggtagcttcctactggctgaatcaattaagcccgcgccgcctttcaacgtgacggtcaccttctctggacagtataatattagttggaggtcggactatgaggaccctgccttttacatgttaaaaggtaagctccagtacgagttacaatatcggaatcgcggtgatccctgggctgtgtcaccaaggaggaagctgatatccgtcgactccaggagcgtgtcactgttgcccctagaattcagaaaagattccagttacgaactgcaagtccgggccggaccaatgcctggatctagttatcaaggaacatggagtgaatggtcagatccagttatttttcagacacagagcgaggagcttaaagagggctggaatcctcacttgctgttactactcctcttggtgattgtcttcattccagccttttggtcactcaaaacacaccccttgtggaggctgtggaagaagatctgggccgtgccttcccccgagaggttttttatgccactctacaagggttgtagcggggattttaagaaatgggtgggagccccctttaccggctcttctctggaattgggcccctggtccccagaggttccttcgaccttagaggtctatagctgtcacccacctcggtcccctgccaagcggctgcagctgacagagctgcaggaaccggctgaacttgtggagagtgacggggttccaaaaccgtccttttggcctactgctcaaaactctggtggctccgcctacagcgaggaacgagacaggccatatggactggtctcgatagatacagtcacggtattggacgcagaaggcccttgtacctggccctgctcttgcgaggacgacgggtatcccgccttggatctggatgccggcttagagccaagccccggtttggaagatcctctgttagatgcagggaccactgtcctgagctgtggctgtgtgtccgccggatcacccgggctcggcggtcctttgggatccctactagacagactgaaacccccactcgccgatggggaggactgggctggaggcctaccttggggaggacgttctccaggcggagtgagcgagtcggaggcaggctctcccctcgccggtctcgacatggatacatttgacagtgggtttgtgggaagcgactgttcgtcaccagtggagtgtgactttacaagtccgggcgatgaagggccacccagatcttatctgagacagtgggtggtgattcctccccccttaagttcacccggcccgcaagcatcctag

SEQ ID NO: 191817 - DNA, 1617 bp, Artificial Sequence
  Description of Artificial Sequence: Synthetic coding sequence
atgccccggggctgggccgcccccctgctgctgctgctgctgcagggggggtgggggtgcccagacctagtttgctacaccgattacctacaaactgtgatatgcatcttggagatgtggaatttgcaccctagcactttaactttgacctggcaggaccagtatgaggagctgaaagacgaggccaccagctgttcgcttcatcggagcgcgcataatgccacacacgctacctatacatgccatatggacgtgtttcactttatggccgatgatatcttttcagtgaatattacggaccagtctggaaattattcgcaagagtgtggtagctttctcctcgccgaaagtattaagcctgcaccccccttcaacgtcacggtgacgttttcaggtcagtacaatatatcctggcgatccgactacgaagaccccgccttctatatgctcaaaggtaagttacagtatgagctccaatatcggaacagaggagatccttgggctgtctcaccaaggaggaaactcataagtgttgactcacggtccgtgtccttgctgccattggagtttcgcaaagacagctcatatgaactgcaggtgagggcgggtccgatgcccggttcttcctatcagggaacttggtctgaatggtcggaccccgtcatattccagactcaatcagaggaactgaaggaaggttggaaccctcaccttcttctgcttttactactcgtaatcgtgttcatccccgcattttggagccttaagacacatcccctctggcgtctgtggaaaaagatatgggccgtaccaagccctgagaggttcttcatgccactctataaagggtgttcaggcgactttaagaagtgggtgggtgccccttttacaggctcttctctggaacttggcccatggtccccggaggtgccgagcactctcgaggtatattcctgtcaccctccccgctctccagcaaagcgcctgcagctgactgaactccaggaaccagcggagcttgtggagtctgatggggtcccgaaacccagcttctggccgaccgctcaaaacagcggaggcagcgcgtattccgaggagcgtgaccggccatacggattggtgtccattgacacagtaacagtattagacgccgaagggccctgtacatggccctgctcttgcgaggacgacggatacccggctctcgacctcgatgcgggactcgagcctagtccaggactcgaggacccactgctggatgccggtacaaccgtactgagttgtggctgtgtctccgccggtagtcccggactgggcggcccccttggcagcttactcgatcgactcaaaccccccctagcagatggggaggattgggctggcggacttccatggggaggacgatcccccggcggcgtctctgaatcagaggctggatctcctctcgctggattagatatggacacctttgactcaggattcgtgggatctgattgttcgagcccagtcgaatgtgactttacctcccctggcgacgagggccccccaaggagttaccttaggcaatgggtggttataccccctcctctaagctcacccggacctcaagcctcttag

SEQ ID NO: 191818 - DNA, 1617 bp, Artificial Sequence
  Description of Artificial Sequence: Synthetic coding sequence
atgccccggggctgggccgcccccctgctgctgctgctgctgcagggagggtggggctgtccggatctcgtctgttacacagactaccttcagacagtaatctgtattctggagatgtggaatctccaccccagcacacttacactgacttggcaagaccagtacgaggaattgaaggatgaggccactagttgttctctccatagatcagcccacaatgccacacatgccacatacacatgtcacatggacgtgtttcacttcatggcagacgatatttttagcgttaacattacggatcagtccggaaactattctcaagagtgtggaagttttttgctggccgagtctatcaaacctgctcctccgttcaacgtgactgttacgttctctgggcagtacaatatatcttggagatccgattacgaagatcccgccttttacatgcttaagggcaagctccagtatgagctgcagtacagaaatagaggtgatccgtgggcagtctccccccggaggaaattgatatctgtggatagccgttcagttagcttgctgcccttagagtttcgcaaggattcctcatacgagctacaggtacgtgcaggccctatgcctggcagctcatatcagggaacatggtcagagtggtctgatccagtgatttttcagacacagtccgaggaactgaaagagggttggaatccacacctgctgttgctgctgctcctggtcatcgtgtttattccggccttctggagtctgaaaacccacccactgtggcgcctctggaagaagatatgggcagtgcctagccctgaacgtttttttatgccactttataaggggtgctccggggacttcaaaaaatgggtaggcgcccccttcactggctcatctctggaattgggcccctggtctcccgaagttccatctacactggaggtgtactcatgccatcctccccgaagccctgctaaacgtctgcagctcactgagctgcaggagcccgcggagctggttgagtccgatggggtcccgaagccttcattttggcctacagcccagaatagcggagggtcagcgtactctgaggaaagagaccgtccttacggactggtgtctattgacaccgtgacagtgctcgatgcggaaggcccctgtacatggccatgctcctgtgaagatgatgggtatccagctttggacttagacgccgggctggagccgtcccctggcttggaggaccccctgcttgacgctgggacaacggtgctgtcttgtggttgcgtgagcgcaggctcccccggattaggaggcccactcggatccctcttggataggctcaagcctcctctggccgatggtgaggattgggccggaggactcccttggggtggcaggtcccccggaggtgtgagcgagtccgaagccggaagtcctctcgccgggcttgacatggacaccttcgattctggattcgtagggagcgactgctcttctccagtggaatgcgactttacttcccccggtgatgaaggcccgccaagaagctaccttaggcagtgggtcgtcatcccgccaccactgagtagtccaggtccgcaggcatcctag

SEQ ID NO: 191819 - DNA, 792 bp, Artificial Sequence
  Description of Artificial Sequence: Synthetic coding sequence
atgatgcccaagcactgcttcctgggcttcctgatcagcttcttcctcacaggggtagcgggaactcagtccacacacgagtccttgaaacctcaaagggttcaattccagtcccgcaattttcacaatatccttcagtggcagcccggtcgcgccctcaccggaaacagttccgtgtattttgtccaatacaagattatgttctcttgcagcatgaagagctctcaccagaagccgtcgggctgttggcagcacatttcgtgtaattttcctggttgtcggacactggcgaaatacggacaaagacagtggaaaaacaaggaagattgttggggcacccaggagttgagctgcgacctgacctcagagacatccgacatccaagagccatactacggccgagtccgggccgccagcgccggaagctactctgagtggtctatgacacctcgctttacaccatggtgggaaaccaaaatcgacccgcccgtgatgaatattacgcaggtgaacggttccttactggtgatcctacacgctccaaatttaccctaccggtaccagaaggaaaagaatgtcagtatcgaagattattatgaacttctgtaccgggtgtttattatcaataacagcctcgaaaaagagcagaaagtgtacgagggcgcccacagggccgtggagatcgaggccctgacacctcattcttcgtattgtgtggtagccgaaatctaccaacccatgcttgaccgccgtagccagaggtccgaggagcgatgcgtcgaaataccttag

SEQ ID NO: 191820 - DNA, 393 bp, Artificial Sequence
  Description of Artificial Sequence: Synthetic coding sequence
atgatgcccaagcactgcttcctgggcttcctgatcagcttcttccttacgggggtagcgggcacccagagcacccatgaaagtctgaaacctcagagagtgcagtttcagtcacgcaacttccacaatatattgcagtggcagcctggtcgagccttgacaggaaattcctctgtatactttgtgcagtacaaaatttacggtcaaaggcagtggaagaacaaggaagattgttggggaacccaggagctgtcctgcgatctgacctccgagacctctgatattcaggagccgtactacggccgggtgagagcggcttctgcagggtcttattctgagtggtccatgaccccgcggtttaccccttggtgggaacgggccaaggggctttag

SEQ ID NO: 191821 - DNA, 696 bp, Artificial Sequence
  Description of Artificial Sequence: Synthetic coding sequence
atgatgcccaagcactgcttcctgggcttcctgatcagcttcttcttaaccggtgtggcggggacccagtccacccatgagtcccttaaacctcagagggtgcagttccagtcccgcaacttccataatattctccagtggcaaccaggccgagcactaacaggaaactcttccgtatattttgtccagtataagatctacggccagagacaatggaagaataaggaggactgttgggggactcaggaactgagttgtgacctgacatctgaaacttccgacattcaagaaccatactacggtcgtgtgagagcagcgtctgcggggagttattccgaatggtccatgaccccaaggtttaccccgtggtgggagacaaagatcgatcctcccgtcatgaatattacacaggtgaatggatctcttttggtgatcttgcacgcgcccaacctgccctaccgctatcagaaggaaaagaatgtctcgatcgaggactactacgagttgctataccgggtgttcatcattaacaactccctcgagaaagaacagaaggtgtacgagggcgcccaccgtgccgttgaaatagaggccctgacaccccactctagttactgcgtcgttgctgagatttaccaaccgatgttggaccgccgatcccagaggagcgaggaacgatgtgtggaaatcccatag

SEQ ID NO: 191822 - DNA, 1563 bp, Artificial Sequence
  Description of Artificial Sequence: Synthetic coding sequence
atggccggccccgagcggtggggccccctgctgctgtgcctgctgcaagcagcccccggccgacctcggctcgcccctccccagaacgtcacattactctctcagaacttttctgtgtatctgacctggctgcccggcttgggtaacccccaggacgtgacatacttcgtagcctaccagagcagtcctacccgccggcggtggcgggaagtggaggagtgcgccggaacaaaagagctcttatgttccatgatgtgtttgaaaaagcaggatctgtataacaagttcaaaggccgggtacggacagtgtcccctagctctaagagtccctgggttgagtccgaatatctcgactatctgttcgaggttgagcctgcaccacctgtgttggtcctgacccagactgaggagatcctgtccgctaacgccacgtatcagcttcctccctgcatgcctccgcttgatctaaaatacgaggttgctttctggaaggagggagcaggaaataaaactctctttccagttacacctcacggacaaccggtgcagataacgctgcaacctgcagccagtgaacatcactgtcttagtgctcggacaatatatactttttccgtgccaaaatattcaaaattttctaaacccacatgttttctgctggaggttccagaggccaattgggcttttctggtacttccgagcctgctgatcctgttgctggtcattgcagcagggggagttatttggaaaactttaatgggaaatccatggttccaacgggcaaaaatgcctcgggcattagatttttcagggcacactcatcctgtcgccaccttccaaccaagtcggcccgagagcgtcaatgatttatttttatgtcctcagaaggagcttacccgcggagtgcgtcctacacccagagtgagggccccagctacgcagcagacacgctggaagaaagatctcgccgaggacgaggaagaagaagacgaggaggatacggaagacggcgtatcttttcagccatacatagagccgccctcctttttaggacaggaacaccaggcccctggacactctgaggcggggggagtcgactctggtcggcccagagctcctctagtgccctccgaaggcagttccgcctgggatagctccgacagaagctgggctagtacagtcgattcgtcttgggaccgtgccggatccagcggttacctggcagaaaagggccctggacaaggcccaggtggagatgggcatcaggaaagcctgcccccacctgagttctctaaagactcgggattcctggaggaactgcccgaagataacctaagcagctgggctacatggggaacgttacctccggaacctaatctggtgcctggcgggccccccgtttctctgcagactttaaccttctgttgggagagcagcccagaagaggaggaggaagctcgggagagcgagattgaggattctgatgcgggttcttggggcgcagaatccactcagcgtacagaagacagaggcaggaccctgggtcactacatggctcggtag

SEQ ID NO: 191823 - DNA, 735 bp, Artificial Sequence
  Description of Artificial Sequence: Synthetic coding sequence
atggccggccccgagcggtggggccccctgctgctgtgcctgctgcaggctgctccgggcagacccaggctggctccgccccagaatgtgaccctcctttcccagaactttagtgtgtatcttacctggctacctggtcttggaaatccacaggacgtcacgtacttcgtggcttaccaatcttctcctacacgtcgccggtggcgtgaggtggaagaatgcgccggcactaaggaactgctctgttcaatgatgtgcctgaagaaacaggacctgtacaataaatttaaaggcagagtccggaccgtatccccctcttccaaaagtccttgggtcgagtctgaatacctggactatctgtttgaagtggaaccagccccccctgtgctggtgctgacccagaccgaagaaatccttagtgctaacgcaacctaccagctgccgccttgtatgccacctctcgacttgaagtacgaagtggcgttttggaaagagggtgccggaaataagactcttttcccggtgacaccccacggacagcccgtccaaatcacactgcagccggctgcatctgaacaccactgcttatcagccaggaccatctataccttcagtgtccccaaatatagcaaattcagcaaacccacatgcttcttactcgaagtgccaggtctgttttggacccacacaccttgtggaaacctaagcgcccagcagacgcgggtccgcgagtag

SEQ ID NO: 191824 - DNA, 636 bp, Artificial Sequence
  Description of Artificial Sequence: Synthetic coding sequence
atggccggccccgagcggtggggccccctgctgctgtgcctgctgcaggctgcgcctggaaggccgagactggccccccctcagaatgtaactctccttagccagaattttagtgtgtacttgacatggttaccggggcttggtaacccacaggacgttacttacttcgtcgcatatcagtccagcccgactaggcggagatggcgtgaggtagaggaatgcgccggcacgaaagagctgctctgctcaatgatgtgcctgaagaagcaggacctttataataaatttaaaggacgggtgcgcaccgtctcaccttcctctaagtctccctgggtggaaagcgaatacctggactatctcttcgaggtcgagcccgcaccacctgtgctcgtgctgactcagacagaagaaatactgagtgcaaatgcgacttaccagcttcctccgtgtatgcccccacttgatcttaaatatgaggtggcattttggaaggaaggggcaggcaacaaagtggggtcttctttccccgcaccaaggctgggacccctcttacaccccttcctcctacgttttttctcccctagtcagcccgcccccgcacccctgctacaagaggtcttccctgtgcatagttag

SEQ ID NO: 191825 - DNA, 558 bp, Artificial Sequence
  Description of Artificial Sequence: Synthetic coding sequence
atgatgtgcctgaagaagcaggacctgtacaacaagttcaagggcagggtgcggaccgttagtccaagctccaagagcccctgggtggaatctgagtacctggactacctcttcgaagttgaaccagcccctcccgtgctggtcctgacacagactgaagagatcctgtcggccaatgctacatatcaactgccgccttgcatgccacctttggacctcaagtatgaagtagccttttggaaagagggtgctggaaacaagaccctgtttccagtcacgccacatgggcagcctgttcagatcacgctccagcctgctgcctccgaacaccactgtctctctgcgcgcaccatttatacgtttagcgtgccgaaatacagcaaattctctaagcctacatgttttttgctcgaggtgcccgaggctaattgggcctttttggtcttgccttctcttctgattcttctactcgttatcgctgccggaggtgttatctggaagacgctgatgggaaacccatggttccaaagagccaagatgccccgggcactcgtgtag

SEQ ID NO: 191826 - DNA, 1476 bp, Artificial Sequence
  Description of Artificial Sequence: Synthetic coding sequence
atggccggccccgagcggtggggccccctgctgctgtgcctgctgcaggccgcaccaggccggccacgccttgcacctcctcagaacgtgacccttctatcccagaatttttctgtgtacctgacctggttgccgggactcggcaatccccaagacgtgacttatttcgtggcctaccagtcatctccgacgaggaggagatggcgggaggtggaagagtgtgctggaacaaaagagctgctgtgcagcatgatgtgcctcaaaaaacaggatctgtacaataagttcaaaggcagggtgcgtactgtgtccccatcctcaaagagtccttgggtggaaagcgaatacctggattatctgttcgaggtggaaccggctcctcctgtactagtcctcacacagaccgaggagattttatcagcaaacgcgacttatcagctgcctccttgcatgccacccttggacctgaaatacgaagttgccttctggaaggaaggagcgggaaacaagactctgttcccggttacaccacatggccagccagtacaaattacactacagcccgctgcatccgagcaccactgtttaagcgcccgcaccatttacacattttctgtgccaaagtactctaagttcagcaagccaacctgcttcctgctcgaggtgccggaggccaactgggcttttttagtgcttcctagcttgcttattcttttgttagtgattgccgccgggggggtgatttggaaaacactgatgggcaatccttggtttcaaagggctaaaatgccccgcgctctggagttgacgcggggcgtgcgaccaacgcctagagttcgcgcacccgcgactcagcaaacccgatggaaaaaggacctcgcggaggacgaggaagaagaagacgaggaggataccgaagacggagtatcttttcagccttacatcgagccaccatccttccttggccaggaacaccaggcccccgggcattccgaggctggcggggttgatagtggcagaccgagggctcctctagtcccaagcgagggttctagtgcttgggattctagcgatcgctcatgggccagcactgtagatagctcctgggaccgggctggaagctccgggtacctcgcagagaagggtcctggtcaggggcctggaggcgatggtcaccaagagagcctgccaccgccagagtttagcaaagatagcggctttctggaggagctgccagaagacaatctcagttcttgggccacctggggcaccctgcccccagagccaaacctggtccctggaggcccccccgtaagtctgcagacgttgacattctgctgggaaagctctcccgaggaagaagaggaagccagggagtctgagattgaggatagtgacgctggctcatggggggcagagtccacacagcggaccgaagacaggggtcgaacactcggccactacatggcaaggtag

SEQ ID NO: 191827 - DNA, 459 bp, Artificial Sequence
  Description of Artificial Sequence: Synthetic coding sequence
atgagccggctgcccgtgctgctgctgctgcagctgctggtgcggccaggccttcaggctcctatgactcagacaacacctttgaagacatcctgggtgaactgcagtaatatgatcgatgaaatcattacacacctgaagcaacctccccttccgctccttgattttaataatctcaacggcgaagaccaggatatattgatggagaacaacctgcggaggcctaatctggaagccttcaacagagcagtgaaatctctgcagaacgcgtctgcgatcgaaagcattctcaagaatctcctaccttgcctcccgctggccaccgcagcgcctacccgacaccccatacacatcaaggacggcgattggaacgagttccgccgcaagttgacattttatttgaagacacttgagaacgctcaagcacagcaaactaccttaagtctggctatattttag

SEQ ID NO: 191828 - DNA, 1137 bp, Artificial Sequence
  Description of Artificial Sequence: Synthetic coding sequence
atggtgctgctgtggctgaccctgctgctgatcgccctgccctgcttactgcaaactaaggaagatccaaacccacctatcacaaaccttagaatgaaggccaaggcccagcaactgacatgggacctcaacaggaacgtcacagatattgagtgtgttaaggacgcagattactctatgcctgccgttaacaatagctactgtcaattcggggccatcagcctgtgcgaggtgacaaactacacagtgcgtgtagccaacccacctttctctacctggattctttttcccgagaactctggcaagccttgggccggagcagagaacctcacttgctggattcacgatgtagactttttaagctgttcttgggcagtgggaccgggcgcacccgctgacgtgcagtatgacctgtatctcaatgttgccaaccgccggcaacagtatgaatgcctgcactataagactgacgcccagggcacgcgcatcggctgccggtttgacgacatctcacgtttatcaagcggctcccagtcctctcatatcctcgttcgggggagatccgccgcctttggcattccatgtacagacaagttcgtggtgttcagtcagatcgagatcctgaccccgccaaatatgacagccaagtgtaacaagactcactcatttatgcactggaaaatgcgctcgcacttcaatcggaaatttcgctacgagttgcagatccagaagagaatgcagcccgttattactgagcaggttcgggacagaaccagttttcagctactgaatccaggcacgtatacagtacaaattcgcgccagagagagggtatacgagtttctctccgcgtggtctacaccacagcggttcgaatgtgatcaggaagagggcgccaacaccagggcatggcgcacgtcccttctgatcgccctaggcactctgttggctctcgtgtgtgtgttcgttatctgcagacgctatttggtgatgcagcgactttttcctaggatcccccacatgaaagaccccatcggggattcttttcagaatgacaagctcgtcgtctgggaagccggaaaggccggcttagaagaatgcctggtcacagaagtccaggtggtgcagaaaacatag

SEQ ID NO: 191829 - DNA, 903 bp, Artificial Sequence
  Description of Artificial Sequence: Synthetic coding sequence
atggtgctgctgtggctgaccctgctgctgatcgccctgccctgcctgctgcaaactaaggagggaggtaaaccttgggctggcgcagagaacttaacatgttggatacacgatgtggattttctttcgtgttcgtgggctgtagggcctggggctccagctgacgtacagtacgacttgtacttaaatgtcgccaacaggaggcaacaatacgagtgcctacactacaagaccgacgctcaggggactagaatcgggtgcaggtttgacgatatttctcggctgtcgtctggatctcaatcaagtcacattctcgttaggggcagatcagcagcatttggtatcccctgtactgacaaattcgtagtgttttcgcagatagaaatcctcacccctcctaacatgaccgccaaatgtaataaaacccactcctttatgcactggaaaatgcgcagccactttaataggaagtttcgatatgagctgcagatacagaagcgtatgcagccggtaattacagagcaggtgagggaccgtacctcttttcagctcctaaatcccggtacatataccgtacagatccgcgcccgcgagcgggtctacgagtttctatcggcttggtccacaccacaacgctttgaatgtgatcaggaggaaggggccaatactagagcatggaggacatcactgcttatcgcattgggtacattgcttgctctagtttgtgtgttcgtgatttgccggcggtatctggtcatgcagaggctgttcccccgtatcccacatatgaaggaccccatcggcgacagcttccaaaatgataaactcgtggtgtgggaggccgggaaggccgggctggaggaatgtctcgtaacagaggtgcaagttgtacagaagacttag

SEQ ID NO: 191830 - DNA, 495 bp, Artificial Sequence
  Description of Artificial Sequence: Synthetic coding sequence
atggtgctgctgtggctgaccctgctgctgatcgccctgccctgcctgctgcagaccaaggaaggagggaagccttgggcaggggcagaaaatctcacttgttggattcacgatgtggactttctgagctgttcctgggcagtcggtcccggagcacctgcggatgtccagtatgatctatatctgaacgtcgccaacagaagacagcagtatgagtgccttcactacaaaactgacgcccagggcaccaggataggttgccggtttgacgacatcagccgcctgagctccggttcacagagctctcacatcctggttcgtggaagatccgcagcctttggtattccttgtaccgacaaattcgtggtctttagccaaattgagatcttaactcctcccaatatgaccgcaaagtgcaacaaaactcactcgttcatgcactggaaaatgcgaagtcattttaatcgcaaattccggtacgagcttcaaatttag

SEQ ID NO: 191831 - DNA, 1323 bp, Artificial Sequence
  Description of Artificial Sequence: Synthetic coding sequence
atgacctactggcggctggagaacatcgccaagaccgagccccccaaaatttttcgcgtgaagccggtgctgggcatcaagcggatgatacaaatcgaatggattaaacctgagctggccccggtgtcttctgatctgaagtacaccttgcgctttcgaaccgtgaactccacgagctggatggaagtgaactttgccaagaatagaaaagacaaaaatcagacgtacaacctgacagggctccagccttttactgagtacgtgatcgccctacgatgcgctgttaaagaaagcaagttctggagtgactggtcccaggaaaagatgggcatgaccgaggaagaagctccgtgcggattagaattatggagagtgctaaagccagccgaggccgacgggcgcaggccagtaaggcttctctggaagaaagcaagaggggcccccgtgttagagaaaactcttggatataatatttggtactaccccgaatctaacacaaatttgaccgagaccatgaatactacaaatcagcagttagagctgcatcttggtggagaaagtttttgggtatcaatgatttcttataattcactaggtaagagcccagttgcaacattgcgaattcccgccatccaggaaaagtcgttccaatgcattgaggtgatgcaggcctgtgttgctgaggatcagcttgtggtcaagtggcagtccagtgcccttgatgttaacacttggatgatagagtggtttcctgacgtcgattctgagccgactaccctgagctgggaaagtgtatcccaagccacgaactggacaatccagcaggataagctcaaacctttctggtgctataatatatcagtgtaccccatgctccacgacaaagtcggggaaccatattccatacaggcttacgccaaggaaggggtgccaagcgagggcccagaaacaaaagtggagaacatcggggtaaaaacagtaactatcacctggaaggagatccctaagtcagagcgcaagggcattatttgcaactacaccatattctaccaagccgagggaggcaagggattttgtaagcacgcccatagtgaagttgaaaagaaccccaaaccccagatcgacgctatggaccgccccgtggtgggaatggcaccaccgagtcactgcgacttgcagcccggcatgaatcacctggcttccctgaacctgtcagaaaacggtgctaaatcaacccatctgttaggcttttgggggctgaatgagtccgaggtgaccgtgcctgaacgcagagtactgcggaagtggaaagaacttctttag

SEQ ID NO: 191832 - DNA, 1989 bp, Artificial Sequence
  Description of Artificial Sequence: Synthetic coding sequence
atgaagctgagcccccagcccagctgcgtgaacctgggcatgatgtggacatgggccctttggatgcttccttcactctgtaagttctctttggctgcccttcccgccaaacccgaaaatatcagctgtgtttactactatcgcaaaaacttaacttgcacatggagcccaggaaaggagacaagttacacccaatacacagtaaagcgcacttacgcctttggcgaaaaacacgacaattgtaccacaaactcctccaccagcgagaatcgcgcgagttgttcattcttcctgccccgaatcactatcccagataactacaccatcgaagtggaggctgaaaatggtgatggggtgatcaagtcccacatgacttattggcgactggagaatatcgcaaagaccgaaccgcccaagatcttcagggtgaagccagtgctagggattaaaaggatgatacagatcgaatggatcaagcccgagttagctccagtttccagtgacctaaagtacaccttgcggtttcgaaccgttaatagcaccagctggatggaggtaaactttgcaaaaaaccgcaaggacaagaaccagacctacaatcttaccggtctccagccgtttacagaatatgtcattgcgctgcgttgcgctgtaaaggagagtaaattctggagcgactggtcacaggaaaagatgggtatgactgaagaagaggcaccctgtgggttggagttatggagggtgctgaagccggcagaagcagacggccgccgacccgttcgacttctgtggaagaaggcacggggagcacccgttctcgaaaaaaccctggggtacaacatatggtattacccggaaagcaacaccaaccttacggagacgatgaacaccactaatcagcagctagaactgcatctgggaggagagtccttctgggtgagtatgattagttacaactccttaggcaagtcgcccgttgcaactcttagaatccccgccatccaagagaaaagttttcagtgcatcgaagtgatgcaagcctgcgtcgccgaggatcagctggtcgtgaagtggcagtcttccgctctcgatgtgaatacctggatgatcgagtggttccccgatgtggactccgaaccaactaccctgagctgggagtccgtgagccaagccaccaattggacaatccaacaggacaaactaaaacctttctggtgttataacatctcagtgtacccaatgctccacgacaaagttggcgagccttactccatacaagcctatgctaaggagggagtgccatcagagggccccgagaccaaggtagaaaatatcggggtgaaaacagtgactatcacttggaaagagatacctaaatctgaacgaaaggggatcatctgtaactacaccatcttttaccaggcagaaggtgggaaaggttttagtaagaccgtgaactcctccatcctgcaatatggcctggagtccctaaaacgcaaaactagttatatagtgcaggtcatggcctcaacttcggcaggtgggactaacggcacctcaataaattttaaaacactgtcctttagcgtatttgaaatcatactaatcacttcacttatcggcggaggcctgctgatcttaatcattctcactgtcgcctacggcttgaagaaaccaaataagctgacccacctgtgctggcctacagtgccaaaccctgcagaatcaagcatcgccacctggcatggcgacgattttaaagataagctgaatctgaaagagtcagacgattccgttaatactgaggatcggattctgaagccatgttcaacgccgagcgataagctggtgattgataagttggttgtgaattttggaaatgtgctgcaggaaatttttacagatgaggcccggaccggccaggaaaataatctgggtggagagaagaacgggacgcggatactgtcatcttgccccacctccatctag

SEQ ID NO: 191833 - DNA, 2046 bp, Artificial Sequence
  Description of Artificial Sequence: Synthetic coding sequence
atgtgcatccggcagctgaagttcttcaccaccgcctgcgtgtgcgaatgtccacaaaacattctgtctcctcaaccctcgtgtgtcaatttaggtatgatgtggacctgggccctttggatgctgccgtccctctgtaagtttagcctcgcggccttgccggcgaagccagagaacataagttgcgtgtattactatcggaaaaatcttacctgcacctggagtccaggaaaggagacttcttatacacaatataccgtgaaaaggacctacgctttcggggagaagcatgacaattgtacaaccaattccagcacttcagaaaatcgagcttcatgcagctttttcctgccgcgtattacaatcccagacaattacacgattgaagtggaggccgagaacggagatggagtcataaagtcccacatgacctattggcggctcgagaacatagctaagaccgaaccaccgaaaatattccgcgttaaacccgtcctcggaataaagagaatgattcaaatcgaatggatcaaacctgagttggcgcccgtatcgagcgatctcaagtataccctgaggtttagaacagtgaattctacctcctggatggaggtcaacttcgccaaaaacaggaaagataaaaatcaaacatacaacttaactgggttacaaccatttaccgagtatgtaattgctttgcggtgcgccgtcaaggagagcaaattttggagtgattggagtcaggagaagatgggtatgactgaggaggaggcgccttgcggcctcgaactttggcgcgtgttgaagccggcagaagccgacggaagacgacccgtgaggttgctttggaaaaaagccagaggagctcctgtactggaaaaaaccctaggatataacatttggtactaccccgagagtaatactaatctgactgaaactatgaatacgaccaatcagcaattggagctccacctgggtggagagagcttctgggtcagtatgatctcctacaattctctcggtaagtcaccagtggcaacattaagaatccctgctattcaggaaaaaagttttcagtgcatcgaagttatgcaagcttgtgtggcagaggatcaacttgtggtaaagtggcagtccagcgctctggacgtcaatacctggatgatcgagtggtttcctgacgtggactccgagcccacaactttgagctgggagtcagtgtcccaggccactaactggaccatccagcaggacaaacttaaaccgttctggtgctataatattagcgtgtaccccatgttacatgataaggtcggagagccgtactctatacaggcttacgcaaaggagggcgtgccaagcgaggggcccgaaacgaaggtcgaaaatatcggcgtaaagacggtgaccattacttggaaagaaatacctaaatccgagcgaaagggaatcatttgtaactatacgattttctatcaggccgaaggtggcaaaggcttcagtaagacagttaactcttctattctgcagtatggattggaaagtctgaagcggaaaactagctacatcgtgcaagtgatggcgtccacctccgctgggggcaccaacggaacttccatcaactttaagaccctaagttttagcgtatttgaaattattcttattacttccctgatcggcggcggactgctgatactgatcatcctgactgtagcttatgggttgaagaaacctaataaactgacccatctttgctggccaaccgtaccgaatcccgcagaaagttccattgccacctggcatggcgacgactttaaagataagctaaacctcaaagaatccgacgatagtgttaacacggaagacagaatactcaaaccatgttctacaccgtccgacaaattggtgattgacaagctggtggtgaattttgggaatgtgctgcaggaaatatttaccgatgaagctcgaacaggccaggagaataatttgggaggcgagaagaatggtactagaatcttgtcgtcttgccctacgtccatatag

SEQ ID NO: 191834 - DNA, 1989 bp, Artificial Sequence
  Description of Artificial Sequence: Synthetic coding sequence
atgaagctgagcccccagcccagctgcgtgaacctgggcatgatgtggacatgggcactttggatgctgccatccctgtgtaaattttcacttgctgcgctgcccgcaaagccagaaaacatctcctgcgtgtactactatcgaaagaacttaacctgtacttggtcacccggcaaggaaactagttatactcagtatactgtgaaacgaacttatgccttcggggagaagcatgacaactgtacaacaaatagctccaccagcgagaatagagcctcttgctccttcttcctcccccgcataacaatcccagataactacaccattgaagtcgaagccgagaacggtgatggtgtaattaagtcccacatgacttactggaggctcgaaaatatcgctaagacagagcctcccaaaatcttcagagtaaaacccgtgttgggaatcaagagaatgatacagattgagtggatcaaacctgagctggctccggtgagttcagatctcaagtacaccttacgatttaggacggtcaactccacttcgtggatggaagtaaacttcgctaaaaaccgcaaagataagaaccagacctataacctcaccgggctgcagccattcacagaatacgttattgctctgcgctgcgctgtaaaagagtcaaaattttggtctgattggtcgcaagaaaaaatgggcatgactgaggaggaggctccctgcgggcttgaattgtggagagtcctgaagcctgcagaagcagatgggagaagaccagtcagattattgtggaagaaagcaaggggagcccctgtcctcgaaaagaccttagggtacaatatctggtactaccctgaaagtaatacaaaccttactgagaccatgaataccactaaccagcagctggagcttcatctgggtggcgagagtttctgggtctccatgatcagttacaatagtctgggaaaatcaccagtcgctacccttaggatcccggccatccaggaaaagagctttcagtgtattgaagttatgcaggcttgcgtggccgaggatcagctagtcgttaagtggcaatcgagcgcattggatgtaaacacttggatgatagaatggtttcctgacgttgactcagaacccaccaccctaagttgggaatcagtgagtcaggccaccaactggactattcagcaggataaactgaaacccttctggtgttacaacatctctgtgtacccaatgctgcacgacaaggtgggagaaccctattctatccaagcctatgcaaaggagggggtgccatcagagggcccagaaaccaaggtggagaatattggagttaaaactgtaacgatcacttggaaggagattcccaagtccgagaggaaggggatcatctgcaactatactattttttatcaggctgagggaggcaaggggtttagcaagaccgtgaacagctctattttgcagtacggcttagagtcgcttaaacgcaagaccagctacatcgttcaagtgatggcttcaacaagcgccggaggcactaacgggaccagcataaatttcaagaccttgagcttctcagtttttgagattattttgataacctctctcattggaggtgggcttctcatactcataatactgacagtggcttacggtctaaaaaagccaaataaactgacccatctgtgttggcccaccgttccaaacccagccgagtcttcaattgccacatggcacggagatgacttcaaggacaaattgaacctgaaggagagtgatgacagcgtgaatacagaggaccggattcttaagccctgctctacaccgagtgataagttggtgattgataagctggtggtgaattttggaaatgtgcttcaggaaattttcacggatgaggctcggaccggccaggagaataacctaggaggcgaaaagaacggcacaaggatcttgagtagttgccccacctccatttag

SEQ ID NO: 191835 - DNA, 1749 bp, Artificial Sequence
  Description of Artificial Sequence: Synthetic coding sequence
atgtgcatccggcagctgaagttcttcaccaccgcctgcgtgtgcgagtgcccacaaaacattctgtcacctcaacctagctgcgttaacctggggatgatgtggacatgggctttatggatgctgccctcgctctgtaaattttcccttgcggcgctcccagcgaagcctgaaaatatctcttgtgtatactactatcgaaagaatttgacatgcacttggtcgccaggcaaggaaactagctacacccaatacactgtcaagagaacctacgcttttggagagaagcatgacaactgcaccactaattcaagcacaagcgaaaaccgcgccagttgcagcttcttcttgcctagaattactatacccgataattatacgattgaagtggaagccgagaacggtgacggcgttatcaaatcccatatgacatattggcggcttgaaaacatagcgaagaccgaaccccccaagattttccgagtcaaacctgttctgggcattaaacgcatgattcagattgagtggattaaacctgagctggcacctgtgtcttcagacttgaaatacactttgaggtttaggactgtcaacagcacctcttggatggaagtgaattttgccaagaacaggaaagacaaaaatcagacgtataatctcacagggctacagccattcacagagtatgtgatcgctctgcggtgtgctgtgaaggaatctaaattttggtcagattggtcacaagagaaaatgggaatgactgaggaagaggccccatgcggcctcgaactgtggagagttctgaagccagccgaggcagacggccgcagacccgttagactgctgtggaagaaggcccggggagctccagtgctggaaaaaacactgggctacaacatctggtactatccagagtcaaacactaatctgacggaaaccatgaataccactaaccagcaactggagctgcacctcggcggggaatccttctgggtgagcatgatcagctacaattctttgggcaaaagcccggtggcgaccctacggattccagctatccaggaaaagtcgttccagtgcatcgaggtcatgcaggcttgtgtcgcggaggaccagctcgtagtgaaatggcaatccagtgcgcttgatgttaacacatggatgatagagtggtttccagacgtagactctgaacccacaaccctgagttgggagtccgtgtcccaggctaccaattggactatccaacaggacaaattgaaacccttctggtgctataacatttccgtctatccaatgttacatgacaaagtcggcgaaccatactcaattcaagcctacgctaaggaaggcgtgcctagcgagggccccgaaaccaaagtggagaatattggcgtcaaaacagtgacaattacctggaaagaaatacccaaatccgaacgaaaaggaattatctgcaactacaccattttttaccaggctgagggtggtaagggcttttgtaaacatgctcattccgaggtagagaagaaccctaaaccacaaatagacgcaatggacaggcccgtggtgggtatggccccgccctcccactgcgacctgcagcccgggatgaatcacctggcatcactcaatctgagcgaaaacggcgctaaatctacccatctgttaggcttctgggggcttaatgaaagtgaggtcaccgtccccgaacggcgggtgctgagaaagtggaaagaactgctctag

SEQ ID NO: 191836 - DNA, 2295 bp, Artificial Sequence
  Description of Artificial Sequence: Synthetic coding sequence
atgtgcatccggcagctgaagttcttcaccaccgcctgcgtgtgcgaatgtccacagaacatattgtcccctcagccctcatgcgtcaacctggggatgatgtggacgtgggctttatggatgctaccatctctctgtaagttttctttagccgccctgccggctaaaccggagaacatctcttgcgtttattactatcggaagaatcttacgtgtacgtggtctcccggtaaagaaacgtcctatacgcaatatacggtcaagcggacatacgcgttcggtgagaagcatgacaattgtactactaatagcagtacatcagagaatagggcctcctgctctttcttccttcctcgcatcacgataccagataactatacaatcgaggtagaggccgagaatggagacggggtgataaagtctcacatgacctactggcgacttgagaacatcgccaagacagagcccccaaagatctttagggttaagcccgtattgggaataaaaagaatgatccaaatcgaatggattaagcctgagcttgcacctgtctcttctgatctgaaatatacgcttcgattccgcaccgtgaattccacttcatggatggaagtgaatttcgctaaaaacagaaaggacaaaaatcagacttacaatctgaccggacttcaacctttcaccgagtacgtgatcgcattgcgctgtgcagtgaaagagagcaaattttggagcgattggtctcaagaaaaaatgggtatgactgaagaagaggctccatgcggactagagttgtggagggttctcaagccagcggaagccgatggccggagacctgtgcggctgttatggaagaaggcaaggggcgcgcccgtgttggaaaagaccttgggctataacatctggtattaccccgaaagcaacaccaacctaaccgagacaatgaatactacaaatcagcagttggaacttcacctggggggtgagtctttttgggtgtccatgattagctataactcactcggcaaatctcccgtagccacattgcgcatcccagccatccaggagaaatcttttcagtgcattgaggtgatgcaagcctgcgtcgcggaggaccagcttgtggttaaatggcagagtagtgccttggatgttaacacctggatgatcgagtggttcccagacgtggacagcgaacccactactctgtcttgggaatcagtttctcaagctaccaactggactattcaacaggacaagctgaagccattctggtgttataacatttccgtgtaccctatgctccacgataaggtgggggagccatacagtatccaagcctacgcaaaagaaggagtccccagtgagggccctgaaacaaaggtagagaatatcggggtaaaaacggtcaccatcacctggaaggagataccgaaaagcgaaagaaagggcatcatatgtaattacactatattctaccaggccgagggtggaaaaggcttcagcaagactgttaattcctctatcctccagtatggactagaaagcctcaagcggaagacttcgtacatcgtgcaggtgatggcctctacctccgctgggggtactaacgggacgagcatcaatttcaagacactgtcatttagcgtgtttgaaattatcctcatcacctcactaatcgggggtgggctgctgatcctgattattctgacagtcgcttacggcctgaagaaaccaaacaaactcacccatctctgttggcctaccgtgcctaatccggcagagtctagcatcgctacttggcacggtgatgatttcaaggacaaactcaatctgaaggagagcgacgatagcgttaatacagaggaccgcattctgaagccgtgcagcaccccctcagacaaactggtcattgacaagctcgtggtcaatttcgggaacgtgctgcaggagatcttcaccgatgaagcgcggacaggacaagagaacaatttaggcggggaaaagaacggatatgttacttgcccattcaggcctgactgtccgctggggaagtcattcgaagagctgcccgtttcaccagaaattccccctaggaaatctcaatacttacggtcacgtatgcccgagggcaccagacctgaggccaaggagcagttgctcttctctgggcagtccttagtccctgaccacttatgtgaggagggggccccaaacccctatctcaagaactccgtaactgcgcgcgagtttcttgtgagtgaaaaactgcctgaacacacaaagggcgaagtctag

SEQ ID NO: 191837 - DNA, 1869 bp, Artificial Sequence
  Description of Artificial Sequence: Synthetic coding sequence
atgacctactggcggctggagaacatcgccaagaccgagccccccaagatcttccgagtaaaacccgtgttgggtattaagcgcatgatccagattgaatggattaagcctgaactggcaccagtctcatcggatcttaagtataccttgaggtttaggacagttaactctacttcttggatggaggtgaattttgccaaaaatcgaaaagataaaaaccagacatataacttgaccggacttcagccttttaccgagtacgtgatcgcacttaggtgtgcagtcaaagagtctaagttctggagtgactggtcccaagaaaaaatgggtatgacagaggaagaggcaccgtgcggcctcgagctctggagagtcctgaaaccagcagaggctgatgggagacgaccagtccggttgctctggaaaaaagccaggggcgcccctgtgctggagaaaactttgggctataacatctggtattacccggagtctaacactaacctgactgaaacaatgaatacgaccaatcaacagttagaacttcatcttggcggcgaaagtttctgggtgagtatgatctcttataacagcctgggaaaaagccccgtggcgacactccggatccccgccattcaggagaagtccttccaatgcatcgaagtcatgcaggcctgcgtcgcagaggaccaactggtcgtgaagtggcagtcgagcgctctggacgtgaacacatggatgatagaatggtttccagacgtagacagtgaacctactaccctgagttgggagtctgtgtcccaggcaaccaactggacgattcagcaggacaagcttaaaccattctggtgctataacatttcagtgtaccccatgctgcatgacaaagtgggtgagccctacagcattcaggcgtatgcaaaggagggtgtcccatctgaggggccagagacgaaggtggagaacatcggagtgaagacagtgacgataacatggaaagagattcccaaatcagaacggaaagggattatctgcaactataccatcttttatcaggccgaaggtggcaaaggctttagcaagaccgtcaactcctcgatactccagtacggactcgaaagcctaaaaagaaagacatcatacattgtccaggtcatggcttccaccagtgcaggcggcaccaacggcacttctattaattttaaaaccctgtccttttctgtcttcgagatcatattaatcacttctctgatcggaggcgggctgttaatcttgattattctgaccgtcgcttacggactgaagaagccaaataagttgacacacctgtgctggccaactgtgcccaatcccgccgagtcctccattgccacatggcacggggacgacttcaaggataaactgaacctcaaagagagtgacgattcagtgaacaccgaagacagaattctgaaaccctgttcgactccttccgacaagctggtgattgacaagttggtggtgaacttcggcaacgttctgcaggaaatctttacagatgaggccaggacagggcaggaaaataacctaggtggcgagaagaacggctacgttacctgccctttcagacctgactgtcctctcggtaagagtttcgaggaactccccgtgtcacctgagatccctccacgtaaaagtcagtacttgagatcaagaatgccagagggaacccggcccgaggcgaaagagcagctattattctcaggtcagtccttggtccctgatcacctctgcgaagaaggagctcctaacccttatctaaagaactcagtgacagcccgagagttcttagtgagcgagaagctgccagaacatactaaaggagaggtgtag

SEQ ID NO: 191838 - DNA, 468 bp, Artificial Sequence
  Description of Artificial Sequence: Synthetic coding sequence
atggtgctgagcggcgccctgtgcttccggatgaaggacagcgccttgaaagttctgtacttacacaacaatcaactgttagcaggagggctgcacgcaggcaaggtcatcaagggcgaggaaattagcgtcgttccaaacaggtggctggatgcctcactgagccccgtcatcctgggagtgcagggcggaagccagtgcctatcttgcggtgtggggcaggaacccactctgacattagagcctgtcaacattatggaactgtatctgggagctaaggaatccaagtcctttaccttttacaggcgggacatgggactgacctcgtcatttgaatcggcggcttatcccggttggtttctctgtacagtgcctgaggcagaccagcccgtgcgtttgacacagctccccgagaatggcggctggaacgcgccaattacagatttttactttcagcagtgcgattag

SEQ ID NO: 191839 - DNA, 468 bp, Artificial Sequence
  Description of Artificial Sequence: Synthetic coding sequence
atggtgctgagcggcgccctgtgcttccggatgaaggacagcgccttgaaggtattgtatctccacaacaaccagctgttagcagggggactccatgcaggcaaggtgattaaaggagaagaaatcagcgtggtgcctaacagatggctggatgcttctctgtcacctgttatccttggcgtgcaaggaggcagccagtgcctaagttgtggggtcgggcaggaacccactctcacccttgagccagtgaatatcatggagctatatcttggagccaaggagtctaagtcctttaccttctaccggagggacatgggactgacctcctcattcgagagcgctgcctacccaggatggttcctttgcactgtgcccgaggcagatcagcctgtgaggctcacccagctgccagaaaatggcggctggaatgcccccatcactgatttctattttcagcaatgtgactag

SEQ ID NO: 191840 - DNA, 354 bp, Artificial Sequence
  Description of Artificial Sequence: Synthetic coding sequence
atggtgctgagcggcgccctgtgcttccggatgaaggacagcgccctcaaggtgctgtatctgcataataaccagctcttggccggaggcttgcacgcaggcaaggtgataaagggggaggaaatctctgtagtgcccaacagatggctagatgctagcctctcccccgtgatcctcggcgtccagggggggtctcagtgcctttcatgtggggtgggacaggaacccacactgactttggagcctgtgaacattatggaactttatctgggcgcaaaagaaagtaagtcattcacattttaccgtcgagatatggggcttaccagcagctttgaaagcgctgcgtatccctag

SEQ ID NO: 191841 - DNA, 2478 bp, Artificial Sequence
  Description of Artificial Sequence: Synthetic coding sequence
atgggctggctgtgcagcggcctgctgttccccgtgagctgcctggttttactgcaggtggcatcgagcggaaatatgaaggtgcttcaggagcctacatgcgtcagcgattatatgtccataagtacctgcgaatggaagatgaatgggcctacaaattgtagtacagaattgagactgctgtaccagctggttttcctcctctccgaggcccacacctgtattccagagaataatggcggagccggctgcgtttgtcatctcttaatggatgatgttgtgtccgccgataactatacccttgacctctgggcaggccagcaactgttgtggaaaggttcatttaagccatcagagcacgtcaagcccagggccccagggaacctgactgttcatacaaatgtgtcagataccctcctgctcacctggtccaatccttatccgcctgataactacttgtataatcacctcacctatgcagttaacatttggtcagaaaatgatcccgctgacttcaggatctacaatgtcacctatctcgagccgtctctcaggatcgccgccagcacactaaagagcggcatctcatatagggctagagtgcgcgcttgggctcagtgctacaacaccacatggtctgagtggtcaccctctacgaaatggcacaacagctaccgagagcccttcgagcagcacttgttgttgggcgtcagtgtgtcctgcatcgtgattctagccgtttgcctcctgtgctacgtatctatcacaaaaatcaaaaaggaatggtgggatcagatcccaaaccctgcccgtagccggctggttgctatcatcattcaagatgctcaaggctctcagtgggaaaaaaggagccggggccaggaaccagctaaatgcccgcattggaaaaattgcctgactaagctacttccttgctttcttgaacacaatatgaaacgagacgaggacccacataaagccgctaaggagatgcccttccaggggtctggcaaatccgcttggtgccccgtggagattagcaagacagtcctgtggccagaatcaatttccgtcgtgcgctgcgtggaactgttcgaggctccagtggagtgcgaagaggaagaagaggtagaggaggagaaggggtcattctgcgcttctcctgagagctcccgtgacgatttccaggagggtcgagaagggatagtcgctagattaaccgagagtctgtttctcgacttgctcggtgaggagaacgggggcttctgccagcaagacatgggtgagagctgcttgttgccaccaagcgggtccacatcagctcatatgccctgggacgaatttcccagcgccggaccaaaggaagcacccccatggggaaaagagcagcccctacacctcgagccaagtccaccggcctctcctacccagtcgcccgataacctgacatgcaccgagacaccgttggtaatagccggcaatccagcttatcggagcttctcgaactctctatcacagtcaccctgccctagagagttgggacccgatccactccttgctcgtcaccttgaggaggtcgaacccgaaatgccttgcgtgcctcagttgtctgagcccaccacagtgcctcagcccgagcccgaaacctgggagcagattctgagacgtaatgttctgcagcatggggcagctgctgctcccgtcagcgctccaaccagtggctatcaggaattcgtgcatgccgtggaacaggggggtacccaggcaagtgctgtggtgggcttaggtccccccggagaagccggatacaaagcattctccagtcttctggccagttccgctgtatccccagagaagtgtggattcggtgcctcaagcggggaggaagggtacaagccgttccaggatctgatcccaggttgtcccggcgatcccgcccctgtgccggtacccctatttacattcggcttggacagggagccacctcgctctcctcagtctagccacctgccttcgtcttcccctgaacatctggggctggaacccggcgagaaagttgaagacatgcccaagcccccacttccccaggaacaggccactgatccattggtcgattctcttggctctggtatcgtgtattccgccttaacatgtcacctctgtggtcacctaaaacagtgtcacggccaggaggatggcggccaaacccccgttatggccagtccatgttgtgggtgctgctgcggggatcggtcgagccctcctactactcccctgcgcgcccctgatccctcccctggcggcgtgcccttggaggcctctttgtgtcctgcatctctcgcaccttccggcatttctgaaaaatctaagtctagttcctcgtttcatcccgctcccggcaacgcccaaagttccagtcagaccccgaaaatcgtcaactttgtgtctgtgggacccacctacatgcgcgtatcctag

SEQ ID NO: 191842 - DNA, 2433 bp, Artificial Sequence
  Description of Artificial Sequence: Synthetic coding sequence
atgcagaaggacgcccggcgggagggcaacatgaaggtgctgcaggagcccacgtgcgtgtccgactacatgtccattagtacttgtgaatggaagatgaacgggccaaccaattgttctacggaactgaggctcctgtaccaattggtgtttctgctgtcggaagcacacacatgcattcctgaaaacaacggcggggctggctgcgtatgccatctactgatggatgatgtagtctccgcggataactataccctggatctttgggccggacagcagttactctggaaggggagcttcaagccaagcgaacacgtcaaaccccgcgctcccgggaatctgaccgttcacaccaacgttagcgatacattgctattaacatggtccaacccatacccacctgataattatctatataatcatttgacctatgccgtcaacatttggtcagagaatgaccctgctgactttaggatttacaatgtgacttatcttgagcccagccttcgcatcgccgcttctactctcaaaagcggtatctcgtacagggcccgagtcagagcatgggctcagtgttacaacactacctggtctgagtggagcccatccaccaagtggcacaacagttatcgggagccgtttgagcagcacctgctgttgggggtttctgtgtcatgcattgtcatccttgccgtgtgtttgttatgttatgtatcaatcaccaaaattaaaaaggagtggtgggatcaaatccctaacccagcccgcagcagattggtcgctattatcattcaggacgcacagggatcacagtgggagaagaggagccgggggcaggagccggcgaagtgccctcactggaagaactgtctgacaaaactgcttccctgtttcctcgagcataatatgaagagggatgaggacccccacaaagccgccaaagagatgcctttccagggcagcgggaaatcagcctggtgtcctgtggagatcagcaaaactgttctgtggcctgaatccatctcagtcgtccggtgtgtggaactgtttgaagctccggtcgaatgtgaggaggaagaagaggtcgaggaggagaaaggttctttttgcgctagcccagaatcttctcgggatgacttccaagagggacgggaggggatcgtcgcacgactcactgagtcccttttccttgatctccttggcgaagagaatgggggcttctgccagcaggacatgggggagagctgcttgctgcccccaagcggctcgacttccgcccacatgccatgggacgagttcccatccgccggacccaaggaagcccctccatggggtaaggaacagcccctccatctggagccttcaccgccagcttcaccaacccagagtcccgacaacctgacctgcacagaaacaccattggtcattgctggaaatcctgcctaccgaagttttagcaactctctgagccagtccccatgcccacgggaactcgggccagatcctctgctggctaggcatctcgaagaggttgagcccgagatgccatgtgtgcctcaactatcagaaccaactactgttcctcagcccgaaccggagacctgggaacaaattcttagacggaatgtcctacagcatggggccgctgctgcgcctgtgagcgctcccaccagcggctaccaggaatttgtgcacgctgtggaacagggcggaacacaggcatcagcggttgtgggtcttgggccacccggggaagctgggtataaagccttctcctctctcttggccagctcggccgtgagccctgaaaagtgcggttttggagcctcctccggggaggaaggctacaagcctttccaggatttgatcccaggatgccccggagaccccgcgccagtgccggtgcctctgtttacctttggactggatcgagagccaccacgcagcccacagagttctcacctgccatccagcagccctgagcacctgggcctcgagcctggggaaaaggtggaggatatgcccaagccacccctcccccaagagcaggctactgatcctctggtcgactccctgggctccggcatcgtgtacagcgctctaacgtgccacctctgcggccacttaaaacagtgtcacggacaggaggatgggggccagactccagtcatggcctctccatgctgcggctgctgctgtggagaccgttcatctcctcccacaacccctctgcgggcaccagatccctcaccagggggtgtccccctggaagcctccctctgtccagcatccttggctccttctgggatatcggagaaatcaaagagcagcagctctttccaccctgctccaggcaacgcccaatcttcgagtcagactccgaagatcgttaattttgtgtcagtcgggcccacttacatgcgggtatcctag

SEQ ID NO: 191843 - DNA, 684 bp, Artificial Sequence
  Description of Artificial Sequence: Synthetic coding sequence
atgggctggctgtgcagcggcctgctgttccccgtgagctgcctggtgttgcttcaggtggctagtagcggcaacatgaaggtgctgcaggaacccacgtgcgtttcagactatatgtctataagtacttgtgaatggaagatgaacggccccaccaactgcagcacggagcttcgacttttgtaccaattagtctttctgctctcagaggcgcacacttgtatacccgagaataacggcggtgctgggtgtgtatgccaccttttgatggatgatgtcgtgtccgcagacaattacacactggacctctgggccgggcaacaattgctgtggaaaggctcttttaagccctcggaacacgtcaaacctcgagcacctggcaatctgactgttcacaccaatgtctccgatacccttttactgacgtggtccaacccttaccctcccgacaactacctatataatcacctgacctacgcagtgaatatctggtccgaaaatgatcccgccgacttccgaatatataatgtgacctatctggaaccgtcgctgcggattgcagcctctactctaaagagtggtattagctaccgtgcgcgggttagggcctgggcacagtgctacaacaccacatggtccgagtggagcccatcaaccaaatggcataatttctccgtgtgctag

SEQ ID NO: 191844 - DNA, 2478 bp, Artificial Sequence
  Description of Artificial Sequence: Synthetic coding sequence
atgggctggctgtgcagcggcctgctgttccccgtgagctgcctggtgctgctccaggttgccagttccgggaatatgaaagtgctgcaggaaccaacgtgcgtcagcgactacatgtcaatttcaacttgcgagtggaagatgaacggtcccacaaactgctctacggagctgcgacttttataccagctggtgtttctcctctctgaagcacatacgtgcattcctgagaataatggcggagccggctgcgtttgtcacctgctgatggacgacgtggtctcagctgataactacacgctggacctgtgggccgggcagcagctcctgtggaagggctcctttaaaccttccgagcatgtgaagcctagagcccccgggaatctcaccgtgcacaccaatgttagtgataccctcctccttacctggagtaatccatatccccctgataactatttgtacaatcatctcacttacgctgttaatatctggagcgaaaatgaccctgctgattttagaatttacaacgtcacatatctggagcccagccttcgcatcgcggcttccaccctcaagtctggtatttcatatcgtgcaagggtgcgagcatgggctcaatgctataataccacctggtctgagtggagcccctcaactaagtggcacaatagctaccgcgagccttttgaacagcacttattgctaggcgtgtctgtaagttgtatcgtgattcttgcagtctgtctgctgtgctacgtatcaatcacaaaaatcaagaaagaatggtgggaccaaatcccaaatccagccagaagtagactcgtagcgataattatccaggatgcccaaggttcacaatgggagaagagatccagaggccaagagcctgctaagtgcccccattggaagaactgtctgacaaaactcttgccatgctttctcgagcataatatgaagagggacgaagatcctcacaaggccgcaaaggagatgccttttcaaggcagcggaaagagtgcttggtgcccagtggagatctctaaaactgttctttggcctgaaagcatttccgtcgtgcggtgtgttgagctgtttgaggccccagtcgaatgcgaagaggaagaggaggttgaagaggaaaaaggctccttctgcgctagccctgagagcagcagggacgactttcaggaggggagggaagggatcgttgcacggttgactgaatcactgttcctggacttgcttggagaagaaaacggaggattctgccagcaggatatgggggaaagttgtctccttccacccagtggatccacaagtgcccacatgccctgggatgagttcccttctgccgggcctaaagaggcaccaccatggggcaaagagcagcccctgcatctggagcctagccctcctgcctctcccacccagtccccagacaacctgacctgtactgaaacgccactcgtgattgctggaaatcccgcttaccgaagcttttccaactcactgtctcagtcaccatgtcctagagaactgggtcccgacccattgctcgctcggcacttggaggaagtggagcccgagatgccgtgtgtgcctcagttgtcagagccaactacagtgccccagcccgaacctgaaacctgggagcagatcctaagaaggaacgtgcttcagcatggcgcggccgcagcaccggtgagcgcccctacctctggctaccaagagttcgtacacgcagtggagcagggtggaacccaggcctccgccgtggtgggactcgggcctccaggagaggccggatacaaggctttctcaagtttactcgcctcctcagctgtgtcaccagagaagtgcggatttggggctagctcaggcgaggaaggatacaaaccttttcaagacctgatccccgggtgccccggcgatccagctccagttcctgtccccctgttcacttttgggctagaccgtgaacccccgcgctcgcctcagtcatcccatctaccctcctcatctcccgaacatctcggactagaacccggggagaaggtggaagacatgccaaagcctccactgccacaagaacaggccaccgatcctctggtggattccttagggtccggaattgtctacagtgctctgacatgtcacctgtgtggtcacctcaaacagtgtcacggccaggaggacggtggacagaccccggtgatggctagtccctgttgcggttgctgttgcggggacaggagcagcccaccgaccacaccactgagggctcccgatccctcaccaggaggggttcccctcgaggcatccttgtgtccggcctctctcgcaccttcaggaatttcggaaaagtcaaagtcatcatctagctttcatcccgctccgggtaacgcccagagctcgtcgcagactccaaaaatagtcaacttcgtgtctgtgggtccaacttacatgagggtgagttag

SEQ ID NO: 191845 - DNA, 684 bp, Artificial Sequence
  Description of Artificial Sequence: Synthetic coding sequence
atgggctggctgtgcagcggcctgctgttccccgtgagctgcctggtactattgcaagtggcctcgtcaggcaatatgaaggtcctgcaagaacccacctgcgtttctgattacatgtctatctcaacttgcgagtggaaaatgaatggcccgacaaattgtagcacagagttaaggctgctctatcagctggtctttctgttgtctgaagctcacacctgtatccctgaaaacaatggcggagccggctgcgtctgtcacctcttgatggacgatgtggtcagcgctgataactacacactcgatctctgggctggacagcagctactgtggaagggttcattcaagccctccgaacacgtcaaacctcgggcacccggcaacctcacggtgcatacaaatgtgtcagacacacttttgctcacatggtcgaacccctacccgccggacaactatttgtataatcatctcacctatgctgtaaacatatggtcggagaacgatccagctgacttccgtatctataacgttacatatctggagccttcactgcgtatagctgcttccaccctgaagagtggaatttcatatagagccagggttcgagcttgggctcaatgctacaataccacatggtcagaatggagccccagtaccaaatggcataattctaatatttgctag

SEQ ID NO: 191846 - DNA, 2478 bp, Artificial Sequence
  Description of Artificial Sequence: Synthetic coding sequence
atgggctggctgtgcagcggcctgctgttccccgtgagctgcctggtgcttctgcaggttgccagttcgggtaatatgaaagtgctccaggaacctacgtgcgtgagcgactacatgtcaataagcacctgtgaatggaagatgaatggtcctaccaactgctccactgaactcagactcctgtaccagctggtgtttctcttatccgaggcccatacatgtattccggaaaacaatgggggcgctgggtgcgtgtgccacctattaatggatgacgttgtcagcgccgacaactatactctggacctgtgggctggacagcaattgctgtggaagggcagttttaaaccgagcgagcatgtgaaacctcgggctccaggcaacctgacagtgcacacaaacgtgtcagatactctgctcctcacctggtcaaatccctatccccccgacaattacttgtacaatcaccttacctatgcggtgaatatctggtctgagaacgatccagcagacttccgtatttataatgtgacatatctggagccttctctcagaattgccgcaagcacactgaaatccggaatctcttatcgggctcgtgtgcgcgcctgggctcaatgctacaatacgacgtggagcgaatggtccccgtccactaaatggcacaattcgtatcgggagccatttgagcagcacctcttgctgggtgtgtcagtttcctgtatcgttatcttagcggtttgtctgctatgctatgtgtccataactaagattaagaaagagtggtgggatcagatacccaaccctgcgaggtccaggctggtggccattatcattcaggacgcccagggctcgcagtgggaaaagcgaagtaggggacaggaacctgctaaatgcccgcactggaaaaactgtctgaccaagttactgccttgtttcttagagcacaacatgaagcgagacgaggatccccataaggcagcaaaggagatgccttttcaggggtcgggaaaatctgcctggtgcccggtggaaattagcaaaacagtcctatggccagagagcatttctgtagttaggtgcgtcgaactgtttgaggcgccagtggagtgcgaggaagaagaagaagtagaggaagagaaagggagcttctgcgcaagccccgaatccagcagggatgactttcaggaaggccgggagggcatagttgcacggctcacagagtcactattcctggatctcctcggcgaggagaacggtgggttctgccagcaagacatgggagaaagctgtctgctcccaccaagtgggagtaccagcgcacacatgccttgggatgaattcccaagtgctggccccaaagaggcccctccatgggggaaggagcagccacttcacctggagccgtctccacctgctagccctactcaatcgcctgacaatctcacttgcactgaaacaccgcttgtgatcgccggcaatcccgcttacagatccttttcaaactccttatcacagtccccttgtccgcgcgagttgggccccgaccctctgctcgcgcgacacctggaggaagtcgagcctgaaatgccttgcgtgcctcaactttccgaaccaaccactgtgcctcagcccgagcctgagacctgggagcagattctgcggcggaatgtgctgcaacacggagcggcagccgccccagtgagcgctccaacttccgggtaccaagagtttgtgcatgcggtagaacagggaggaacacaggcttccgccgtagtagggcttggaccccccggagaagccggctataaggctttcagttctctcctcgcctcttctgccgtgtcccccgagaaatgcggctttggcgccagtagcggcgaggaagggtacaagcctttccaggacctcatccctggctgccctggcgatcccgccccggttcccgttcccttatttacattcggtctcgacagggaaccacctcggtctcctcaatcatcacatctcccttctagttcgcctgaacatcttgggttagaacccggagagaaagtagaagatatgccaaaacctccccttcctcaggaacaagcaaccgatcctctggtcgactcactgggaagcggcattgtgtactccgctttgacttgtcacttgtgtggccaccttaaacagtgccacgggcaggaagatgggggccagacacctgtgatggcctctccatgttgcgggtgctgctgtggcgaccgaagttcccctcccacgactcctctccgcgctcctgaccctagtccaggcggggtgcccctggaagcaagtctctgtcctgcaagcctcgccccatcggggatatcagaaaagtccaaatcttcatccagttttcatcccgcgcctggcaacgctcagagctcctcccagacccctaagattgtcaactttgtgagcgttggaccaacgtacatgcgagtatcttag

SEQ ID NO: 191847 - DNA, 1263 bp, Artificial Sequence
  Description of Artificial Sequence: Synthetic coding sequence
atgatcatcgtggcccacgtgctgctgatcctgctgggcgccaccgaaatcctacaggcagacctgctgccagacgaaaagataagcctgctgccgcccgtcaacttcactatcaaagtgactggcttggctcaggtgctcctgcagtggaagccaaatcccgatcaagaacaaagaaacgtgaaccttgagtaccaggtcaagattaatgctcccaaagaagatgactacgagaccagaataacggaatcaaagtgtgtgactattcttcataaggggttctcagcctccgtccggacaattttgcagaacgatcactctctgctcgcatcttcgtgggcctcagccgaactccacgctcccccaggatctcctggaacgtcaatcgtcaatctgacctgtaccacaaatactacagaggacaattattccaggttgcggtcctatcaggtgtcactgcattgtacttggctggtcggcactgatgcacctgaagacacccagtactttctgtattaccggtatggaagctggaccgaggagtgccaggagtattccaaggataccctcggtcgaaacattgcttgctggtttcccagaacctttatcctttccaagggcagggattggctggccgtactcgtgaatggtagttcaaagcattccgctatccgacccttcgaccaactttttgccttacacgcgattgaccagattaatccccccctgaatgtaaccgcagagattgagggcacgagactcagcatacagtgggagaagccagtgtcggcttttcccatacactgcttcgactatgaggtgaaaatccacaacactcgcaatgggtacttacaaattgagaaactgatgactaatgcttttataagcatcattgatgatttgtctaagtacgacgtgcaggtgagagctgccgtgtccagcatgtgtagagaggcagggctctggtccgaatggtcacagcccatctacgttgggaacgatgagcataaacctctgcgagagtggtttgttatagtgataatggctacaatctgttttatcttactcattctgtccctgatctgtaagatatgccatctgtggattaagctcttcccgccaatccccgctcccaagagcaacattaaggacctgtttgtcacaacgaactacgaaaaagcgggatcctccgaaactgagatcgaagttatctgttacattgaaaaaccaggtgtagaaacactggaagactccgtgttttag

SEQ ID NO: 191848 - DNA, 1008 bp, Artificial Sequence
  Description of Artificial Sequence: Synthetic coding sequence
atgatcatcgtggcccacgtgctgctgatcctgctgggcgccaccgaaattctgcaggctgacctgttaccagacgagaagatctcccttctgccaccagtgaatttcaccattaaggtgactgggctggcccaagtactgctccagtggaaaccaaacccggatcaggagcagcggaacgtcaatttagagtatcaagtgaaaatcaatgctccaaaggaagatgactacgagaccaggatcaccgaatccaaatgtgtaacaatcctgcacaaaggcttcagtgctagtgtcagaactattctccaaaatgatcattctctgctcgcctcctcttgggcctctgccgaactgcatgcacctccgggttcaccaggcacgtctatcgtcaatcttacctgtaccactaataccactgaggacaattatagtcgactgcgaagctatcaagtcagcctgcattgtacctggctggttggcactgacgcaccggaggacacgcagtacttcctgtactaccggtacggttcttggaccgaggaatgccaagagtattccaaggacacactcgggagaaacattgcctgctggtttcctaggacattcatactatctaaagggagagattggttagccgtactcgtgaatggctcctcaaagcacagcgccattagaccattcgaccaactgttcgctttacatgccatcgaccagattaacccacctctgaacgtcaccgccgagattgaaggtactagactctcgatccagtgggagaagcctgtttcagcttttccaattcattgtttcgactatgaagtaaagatccacaacacacgcaatggctacctacaaatcgagaaactcatgacaaatgccttcatctcgatcattgacgacctgtcaaaatacgacgtccaagtgagggcagcagtgtcctctatgtgtagagaggccggcctgtggtcagagtggagccagccaatttacgtgggattctccaggtag

SEQ ID NO: 191849 - DNA, 453 bp, Artificial Sequence
  Description of Artificial Sequence: Synthetic coding sequence
atgaccaacgccttcatcagcatcatcgacgacctgagcaagtacgacgtccaggttcgtgcggccgtgagctcaatgtgccgtgaggcaggactgtggagcgaatggagtcagccaatctatgtgggaaatgacgaacacaagccccttcgcgagtggtttgttatcgtgattatggccactatttgctttatactgcttatcctcagcttgatctgtaaaatatgtcacctctggataaagcttttccctcccattcccgcacccaaatccaatattaaggacctgttcgtcactactaattatgaagttttatgtatcttcatctatatcttggactctgcagacaatttcttgcagaagaagaaggctgggagctcagagactgagattgaagtcatttgctatattgaaaaaccaggcgttgaaactctggaggactcagtgttttag

SEQ ID NO: 191850 - DNA, 1008 bp, Artificial Sequence
  Description of Artificial Sequence: Synthetic coding sequence
atgatcatcgtggcccacgtgctgctgatcctgctgggcgccaccgaaatcctgcaggctgatttactgccggacgagaaaatctccctgttgccacctgtgaacttcaccatcaaggttactggtctggcacaagtgttgctccagtggaagcccaatcctgatcaggaacagaggaacgtaaatctggaatatcaggttaagattaacgcgcccaaggaggatgactacgagacacgaatcacagaatccaaatgcgtgactatacttcacaaaggcttttccgcctcagtgagaaccattctgcagaatgaccactccctcttggcctccagttgggcctctgcagagttgcacgcccctcctggtagcccagggacaagtatcgtcaaccttacatgcacaaccaacaccaccgaggacaactactcccggctgaggagctatcaggtctccctgcattgcacttggctagtcggtacagatgcccccgaagacacccagtacttcctgtactacaggtacggcagctggaccgaagagtgccaggaatatagcaaagacaccctaggcagaaatatcgcatgctggttcccaagaactttcattctgtctaagggcagagactggctggcagtcctggtcaacggctcctctaagcattccgcaatcagaccgtttgaccaactgtttgctcttcacgccatagaccaaattaacccgcccttgaatgtcaccgccgaaatagagggtaccaggctctccatccaatgggagaagccagtttcggcattccccatacactgcttcgactatgaagttaaaatacataatacaagaaacggctatcttcagatagagaaacttatgacgaatgccttcatcagcatcattgatgatctgagcaaatacgacgtccaggtgcgcgccgccgtttcctctatgtgcagagaagccgggctgtggtctgaatggtcccagccgatctacgtgggcttttccaggtag

SEQ ID NO: 191851 - DNA, 978 bp, Artificial Sequence
  Description of Artificial Sequence: Synthetic coding sequence
atgatcatcgtggcccacgtgctgctgatcctgctgggcgccaccgagatcctccaggcagatctgctgccggatgaaaagattagcctgctgcctcctgtgaattttaccattaaagtgaccggactggctcaagtcctgctgcagtggaaacctaacccagaccaagagcagcggaatgtgaatctggagtatcaggtaaaaatcaacgctcccaaagaggacgactatgagaccaggatcaccgaaagcaagtgtgtcacaattttgcacaaaggattttccgcatccgtgcgcacgattctgcagaacgatcactcactgctggcatcctcttgggcgtccgctgaacttcacgccccacccgggtcccccgggacctcaatcgtcaacctgacctgtacaacgaatactacagaggacaattactcccgcctgcgctcctaccaggtctcactccactgtacctggctggtggggactgacgctcctgaggacacacagtatttcctgtactataggtacggcagttggacggaggagtgccaggagtactctaaggatactctcggacggaatatcgcttgttggtttccacggacattcattctgtctaaggggagggattggctcgccgttcttgtgaatggttctagcaaacactccgccatccggcctttcgaccagctgttcgccctgcacgccattgggaacgatgagcataaacctctccgagaatggtttgtcatcgtgatcatggctacgatttgctttattctgctgatcttatccctaatctgtaagatctgtcatctatggattaaactctttccacccattcccgcccctaagagtaatattaaagacctgttcgttaccaccaactacgaaaaggccggatccagtgagactgagatcgaagtgatctgttacattgagaaacccggagtcgaaacactggaggattccgtgttttag

SEQ ID NO: 191852 - DNA, 330 bp, Artificial Sequence
  Description of Artificial Sequence: Synthetic coding sequence
atgatcatcgtggcccacgtgctgctgatcctgctgggcgccaccgagatcctccaagccgatctgctgcccgacgagaagatcagcctgctgccccctgtgaacttcactatcaaagtgacaggcctggcccaggtactgctccaatggaagcctaacccggaccaagaacagcgcaatgtgaacctcgaatatcaagtcaaaataaatgctcctaaggaagatgactatgaaacacgtatcaccgagtctaagtgtgtgaccattcttcacaaaggcttcagcgcaagcgtaagaacaatcttgcagaacgaccactccctactgtag

SEQ ID NO: 191853 - DNA, 1002 bp, Artificial Sequence
  Description of Artificial Sequence: Synthetic coding sequence
atgatcatcgtggcccacgtgctgctgatcctgctgggcgccaccgagattctccaggccgatctcctgcccgatgaaaaaatctcgctgctgcccccggtcaacttcactattaaagttaccggcctcgcccaggtcttactgcagtggaagcctaaccccgaccaggagcagagaaatgttaacttagaatatcaagtgaaaatcaatgcccctaaagaagacgattatgagacccggatcaccgagtcgaaatgcgtgacaattttgcataagggattcagcgcatcagtgagaactattttgcagaacgatcacagcctacttgcttcgagctgggcctccgcagaattgcacgccccccccgggagcccaggcacaagcatagttaacctgacatgcaccaccaatactactgaggacaactacagccgactgcgcagttaccaagtgtccctgcactgcacctggctggtaggcacagacgcacccgaggatacccagtacttcttatactatcgttatggcagctggacagaggaatgccaggagtattcaaaagacaccttgggacgcaatatcgcctgctggttccctaggacattcattctatccaagggtagagactggttggcagttctggtcaacggttcctctaagcatagcgcaattcggccttttgaccagctttttgccctgcacgccatcgatcagatcaatcccccgctgaatgtgacagccgaaatcgagggcaccaggctcagcatacagtgggagaagccagtgtcagcctttcccatccattgctttgattatgaagtcaaaatccataatacaagaaacgggtacctgcagattgagaaactgatgacaaatgccttcatatccattatcgatgatctgtccaagtacgatgttcaggttcgcgccgcagtcagttcaatgtgcagagaagccggcctgtggtccgagtggagtcaaccaatttatgtcggtaagtag

SEQ ID NO: 191854 - DNA, 1137 bp, Artificial Sequence
  Description of Artificial Sequence: Synthetic coding sequence
atgatcatcgtggcccacgtgctgctgatcctgctgggcgccaccgagatccttcaggcggacctgctgccagacgagaagatctccctattgccccccgtgaattttactatcaaggttaccggcttggctcaggtactgctgcaatggaaacctaaccctgatcaggagcagcggaatgttaaccttgaatatcaggtcaagattaatgcacccaaggaggatgactacgagactcgaatcaccgagagcaagtgtgtgaccatccttcacaaggggttttctgcctctgtgaggacgattctgcaaaatgatcattctctgctggcatcctcatgggccagtgctgagctccacgcccccccaggtagccccggcacctccatcgtgaacctcacttgcacaacaaacaccaccgaggataattactcaaggctacgaagttatcaggtgagtcttcactgcacgtggctggtggggacggatgcacctgaagacacacagtatttcctctattaccgctacggttcatggactgaggagtgccaggagtattccaaggataccctcggacggaatatcgcatgttggtttccgagaacgttcatcctgagcaaaggaagagattggttggctgtactggtcaatggttccagcaagcacagtgcgatcaggccgttcgaccagttgttcgctttacatgcaattgaccagattaatccccccctgaacgtgacggcagaaatcgagggcactaggcttagtatccaatgggaaaagcccgtctccgcctttcctatccactgctttgattacgaagtgaaaatccacaacacccgtaacggataccttcaaatcgaaaagctcatgactaacgccttcatcagcataatagacgacctgtccaaatacgacgtgcaagtgagagccgctgttagtagtatgtgccgtgaagctggcttgtggtctgagtggagccagccgatctatgtgggcaatgacgagcataagcctcttcgggagtggtttgtgatagtgattatggcaaccatttgttttatcctgctgatcttatccttgatttgcaaaatcaaattgggaccagtgagaaggaagctgaagagcagtgtcatctag

SEQ ID NO: 191855 - DNA, 591 bp, Artificial Sequence
  Description of Artificial Sequence: Synthetic coding sequence
atgatcatcgtggcccacgtgctgctgatcctgctgggcgccaccgagattctccaggctgacctcctgccagatgagaagatcagcctactgccgcccgtgaatttcacaattaaagttacaggcctggcccaggtgctattacagtggaaacctaatcctgatcaggagcagaggaacgtgaatttagaatatcaagtgaaaattaatgctcctaaggaggacgactacgagacccgcatcacagagagcaagtgtgtgactattcttcacaagggatttagcgcctctgtgcggactatcctgcagaatgatcactcccttctggcttctagctgggccagtgccgagctgcatgcgcctcctgggtccccagggacaagcatagtcaatctaacgtgtaccaccaacacaacggaggacaactacagtaggctcagaagttatcaagtaagtctgcactgtacctggcttgtaggcactgatgcacctgaagacacgcagtacttcctgtattacagatatgggagctggactgaagagtgccaggagtactccaaggacacactggggcgcaatattgcctgctag

SEQ ID NO: 191856 - DNA, 636 bp, Artificial Sequence
  Description of Artificial Sequence: Synthetic coding sequence
atgatcatcgtggcccacgtgctgctgatcctgctgggcgccaccgagatccttcaggcagatctcctgcctgatgagaagataagcctgctccccccggtcaatttcacgattaaggtgactggactggcccaggtcctgctccagtggaaaccaaatcctgaccaggagcagcgcaacgtgaatttggaataccaggtaaagataaacgcccccaaagaagatgactacgagaccaggatcaccgagtctaaatgcgtcaccatcctgcataaggggttctcggcgtccgtgcgtaccattctgcagaatgatcatagcttactcgcttcatcatgggcctcggcggagctgcacgctcctccggggaatgatgagcacaaacccctcagggagtggtttgttattgtgatcatggcaaccatctgctttatattattgattctgtcactcatttgcaagatttgtcacctgtggattaaactgttcccccctattcccgccccgaagtccaacataaaggacttgttcgtgactaccaactatgagaaggcaggtagctccgagaccgaaattgaggtaatatgctacatcgagaaaccgggggtagaaactcttgaagactccgtgttttag

SEQ ID NO: 191857 - DNA, 1263 bp, Artificial Sequence
  Description of Artificial Sequence: Synthetic coding sequence
atgatcatcgtggcccacgtgctgctgatcctgctgggcgccaccgagattctgcaagctgacttactgccagacgaaaagatctcattactccctcccgtgaacttcactattaaggtcacgggccttgcgcaggttctcctgcagtggaagcccaatccagatcaggaacagcggaatgtgaatctcgaataccaggtaaagattaacgccccgaaagaagacgactatgagactaggattactgaaagtaagtgcgtgaccattcttcataaaggtttcagtgcttccgtgaggaccattctccagaacgaccacagtcttctggcttcctcatgggcgtcagctgagctgcacgctccccctggcagcccagggacgagtatcgtgaacctcacatgcacaactaacacgacggaagacaattattccaggctgcgaagttaccaggtaagtctccattgcacatggctcgtgggtacggacgcacctgaggacactcagtattttctgtattacagatatggatcgtggaccgaggaatgtcaggaatacagcaaggacaccctgggacgtaacatagcctgttggttcccgcggaccttcattctgtccaagggccgggattggctggctgttctagtgaatgggtcttctaagcactccgccatccgaccttttgatcaactcttcgccctgcacgccatcgaccagataaacccgccgctgaatgtcaccgccgagatagaaggaaccagattgtcaatccaatgggagaagccagtctcggcttttcccattcattgtttcgactacgaggtgaagatacacaacacaaggaatggctatctgcagatcgagaaactgatgactaatgcattcatatccataattgacgatctctcaaagtacgatgtacaggtaagggccgcggtgtcaagcatgtgcagagaagctggcctgtggtccgaatggtcccagcccatctacgtcgggaatgatgagcacaagccactacgcgagtggtttgtcatagtgattatggctacgatctgttttattctgctaattctgtcactgatctgtaagatctgtcacttgtggattaaactgtttcccccaatccctgcacctaaaagcaacataaaggatttattcgtaacaaccaactatgagaaagccgggtcctctgagaccgagattgaggtcatctgttatatcgagaaacctggcgtggagacactggaagattcggtgttctag

SEQ ID NO: 191858 - DNA, 1002 bp, Artificial Sequence
  Description of Artificial Sequence: Synthetic coding sequence
atgatcatcgtggcccacgtgctgctgatcctgctgggcgccaccgagattttgcaggcagacctgctacctgatgagaaaatttcactcttacctccagttaacttcacaattaaagtgaccggcctggcacaagtgttgttgcagtggaaacccaaccccgaccaggagcaacgcaatgtgaacctagaatatcaagtgaaaattaatgcgcctaaagaagacgattacgagacacggatcacggagagtaagtgtgtaaccattctacacaaaggattctctgcaagcgtccgtaccatcctccagaatgaccattccttgctggctagcagctgggccagcgccgaactccatgccccccccggcagccccggaaccagcatcgtgaacctgacgtgcactaccaacacgaccgaggataattactcccgcctccgtagctatcaggtgtccctgcactgcacctggcttgttggcactgacgcaccggaggatacacagtacttcctttattaccgttacggctcatggacagaggagtgccaagagtattccaaagatacattgggacgaaacatagcctgttggttccctaggacatttattttgagtaagggtagggattggcttgcagtgttagtaaacggctccagcaagcatagtgctattcgcccatttgatcagttgttcgcattacatgctattgaccagattaacccaccacttaatgtgaccgctgagattgagggcacaagactcagtatacaatgggaaaaacctgtgtccgctttcccaattcactgcttcgattatgaggttaaaattcataacacacggaatggatacctgcagattgaaaagctgatgaccaacgcatttatctcgatcatcgacgacttgtcgaaatatgatgtgcaggtacgagctgcagtgtccagcatgtgcagggaggcaggactctggtcggagtggtcgcaacccatctacgtgggaaagtag

SEQ ID NO: 191859 - DNA, 1098 bp, Artificial Sequence
  Description of Artificial Sequence: Synthetic coding sequence
atgctggccgtgggctgcgccctgctggccgccctgctggccgcccccggggcggctctagccccacgaagatgccccgcccaggaggtagccagaggggtgctcactagcctgcctggggactccgtgacactcacttgtccaggcgttgagccggaggataatgccacggttcattgggtccttagaaagccagccgctggctcacatcctagtaggtgggcagggatgggtaggaggctgttgctccgtagcgtgcagctgcatgattccggaaattacagctgctatagggcaggccgtccggctggtaccgtccacctcctggtggacgttccccctgaagaaccccagctttcctgcttccggaagagcccgttatctaatgtggtttgcgagtggggtccgcggtcaacccccagcctgaccactaaggcggttttgctcgttcggaaattccaaaacagcccggctgaggactttcaagagccctgccagtactcccaagaatcacagaagttttcttgtcaactggctgtccccgagggggactctagcttctatatcgtgtccatgtgtgtcgcctccagcgtaggctctaagttttctaaaacacagaccttccagggctgtggcattcttcagcctgacccacccgcgaacattactgtgaccgctgtcgcacggaatccacgttggctgtcagtcacatggcaggacccacatagttggaattccagtttctataggctccggtttgagcttaggtacagggctgagcgaagcaaaacgttcacaacctggatggtgaaagacctgcagcatcattgtgtgatccacgacgcctggtcagggcttaggcacgtagtgcagttacgcgcccaggaggaattcggccagggagaatggtctgagtggagcccagaagccatggggaccccgtggaccgaaagtaggagccccccagcagaaaatgaggtgtccacccccatgcaggcccttactactaataaggacgacgataatatcttgtttagggattctgcaaatgctacttctctccctggtagcaggcgaagaggcagctgtgggctgtag

SEQ ID NO: 191860 - DNA, 1407 bp, Artificial Sequence
  Description of Artificial Sequence: Synthetic coding sequence
atgctggccgtgggctgcgccctgctggccgccctgctggccgcccccggggcagccctggctccaaggaggtgccccgcccaggaggtggccaggggggtgcttacaagcttgccaggtgactctgttacactcacctgccctggggtggagccagaggacaacgcgacagtacattgggtcttacgcaagcctgcagccggttctcatccttcgcgatgggcggggatgggccggcgcctgttgctacgcagcgtgcagctccacgatagcggcaattatagctgttatagagccgggaggcctgcaggtacagtgcacctgctggtggatgtgccccctgaagagccccagctctcctgttttcgcaagagccccctttctaatgtggtctgcgagtggggacctcggtcaactccaagtctgacaactaaggcggtcctgttagtccgcaaatttcagaactctccagccgaggactttcaggagccttgtcagtacagccaagagagccagaagttttcctgccagctcgctgtgccagaaggtgatagcagtttctacattgtgtcaatgtgcgtggccagctccgttggatctaagtttagcaagactcagacgttccagggatgtggtattctgcaacccgacccacccgccaacatcaccgtaacagcggtggccagaaatccccgctggttgtctgtgacgtggcaagacccgcactcctggaacagctctttttacagattgcgcttcgagctaaggtacagggcggagcggagtaagacctttaccacatggatggtgaaagacttacagcatcattgtgtgatccacgacgcctggtccggccttcgccacgtggttcagttaagggcccaggaggaattcggacagggcgaatggagcgaatggtcacctgaagctatgggcacgccatggacggagagtagatcacctccagccgaaaatgaggtaagcacaccaatgcaggctctcaccacaaacaaagacgatgacaacatcttgtttcgcgactccgcaaacgccacaagcctgcccgttcaggattcctcttccgtgccactgccaaccttcttagtcgccggaggaagcctggcctttgggacattattatgcatcgccatcgttctgcggtttaagaaaacatggaagctacgcgcgctcaaagagggaaagacaagtatgcatccaccttatagcctcggacaactagtgcctgagcggccacgacctacaccagttctcgtgcctctcatctccccacctgtgagccccagcagtctggggtccgacaacacatctagccacaaccgtcctgacgcaagagacccaaggagcccctatgacattagcaacactgattacttctttccgaggtag

SEQ ID NO: 191861 - DNA, 2757 bp, Artificial Sequence
  Description of Artificial Sequence: Synthetic coding sequence
atgctgaccctgcagacctggctggtgcaggccctgttcatcttcctcaccacagaatccaccggcgagctgttagatccttgcggttatatcagccccgagtctcctgtggtgcagttacatagtaacttcaccgctgtgtgtgtgctgaaggaaaaatgcatggactattttcacgtcaatgctaattacattgtgtggaagactaaccatttcactatcccaaaagagcaatatactattatcaaccggaccgcctcctccgtgacgtttaccgacatcgccagtcttaatatacaactcacatgtaacatcctgacatttggccagcttgaacaaaatgtgtacggtattaccatcataagcgggctgcccccagaaaaaccaaagaacttatcgtgcatcgtcaatgaaggtaaaaaaatgagatgtgagtgggacggcggtagagaaacacatttagagaccaactttacattgaaatccgaatgggcgactcacaagtttgctgactgtaaggccaagcgcgatacacccacttcctgcacggttgactactccacagtttacttcgtgaatatagaggtctgggtagaggctgaaaatgcccttgggaaggtgactagcgaccatatcaatttcgatccagtgtacaaggtgaagcccaatcctccccacaacctcagcgtgatcaactctgaggagttatccagtattctcaaactcacctggacgaacccttcaatcaaaagcgtgatcatcttgaagtacaatatacagtatcgaacaaaggatgctagcacttggtcgcaaatcccacctgaagacacggctagcacacggtcgagcttcacagtgcaggacctgaagccatttacagagtacgtcttccgaattcgctgcatgaaagaagacggaaaaggttattggtccgactggagcgaagaagcttccggtatcacatatgaagacaggccttcaaaggctccctccttctggtataagatcgacccttctcatacccagggttacaggaccgtacagcttgtgtggaaaacattacctcccttcgaagccaacggcaagatccttgattacgaggtgacactgaccagatggaaaagccatctacagaactatacagtcaacgctacaaaactcacagtcaaccttactaatgacaggtatttagctactctgaccgtgaggaatttggtcggcaaatctgacgctgccgttctgactatacccgcttgtgactttcaggctacacacccagtgatggatctcaaagccttccccaaagataacatgctttgggtggaatggacgacgccccgggagtctgtgaaaaagtacattctagaatggtgcgttctgagcgacaaggcaccatgcattaccgattggcaacaggaggatgggacggtgcaccgcacatacctgagaggtaacttggcagaaagtaaatgttacttgatcaccgtaacgcccgtgtacgccgacggtcccggcagcccggaaagcatcaaggcatatcttaagcaggctcctccctcgaaaggccctaccgtcagaaccaagaaagtaggaaaaaatgaagccgtgcttgagtgggatcagctacccgtggacgtacagaacggtttcatccgcaattacactatcttctaccgtaccataatcggcaacgagaccgccgtgaacgttgacagcagccacactgaatatacactgtcctccctgacctccgacaccctctatatggtgcgaatggcagcatacacagatgaaggcggaaaagacggtcccgagttcacgttcactacaccaaagtttgctcagggcgagatagaggccatcgtggtgcctgtatgccttgcctttctcctcacaacactcctcggtgtcttgttctgtttcaacaagagagatttgattaagaaacatatatggcctaacgttccggaccccagcaagtctcatattgctcagtggagtccgcatacaccaccacgccataacttcaatagcaaagatcagatgtatagtgacggtaattttaccgacgtcagtgttgtcgagatcgaggctaatgataaaaagcccttcccagaggacttgaaaagccttgatttattcaaaaaagagaagatcaacaccgaaggccacagctctggaattggaggttctagttgcatgagctccagcagaccttccatctcatcgagtgacgaaaacgagagttcacaaaacacatctagcactgtccagtactcaaccgtcgtgcatagtggctataggcaccaggtccctagcgtgcaggtcttttctagatccgagtccactcagcccctgctggactctgaagagcgtcccgaagacttacagctggtcgatcacgtcgacggcggagatggtattctgcccagacagcagtactttaaacagaattgctctcagcacgaatcatccccagacatttcacacttcgagaggagcaaacaggtttcctctgtgaacgaagaggacttcgtgcgattaaaacaacagataagtgaccacatctcgcagtcatgtggttcaggtcagatgaagatgtttcaagaagtgagcgccgcggacgcatttggccctggcacagaggggcaagtagagaggttcgagacggtgggcatggaggctgccaccgacgaggggatgccaaaaagttacctaccccagaccgtcaggcaaggggggtacatgccccagtag

SEQ ID NO: 191862 - DNA, 990 bp, Artificial Sequence
  Description of Artificial Sequence: Synthetic coding sequence
atgctgaccctgcagacctggctggtgcaggccctgttcatcttcctaaccacggagagcacaggcgagctgctggatccctgcggctacatttcccccgagagcccagtggttcagctacatagcaactttacggccgtctgcgtgctgaaagaaaaatgtatggattatttccacgtcaacgcaaattacatagtctggaaaactaatcatttcaccatacccaaagaacagtacaccattattaatcgcacggcctctagcgtcaccttcactgacatagccagtctgaatatacaactgacatgtaacatcctgacctttggacaattagaacagaatgtctacgggataacaattatttctgggctgccccctgaaaaacccaaaaatctctcatgcatcgtaaacgaaggaaagaaaatgcgttgtgaatgggacggaggacgtgaaacccacttggagactaattttaccctgaagtcagagtgggccacgcataaatttgccgattgtaaggccaagagggacactcccacgtcttgcaccgtggattattccacagtgtattttgttaacatagaagtgtgggtggaagctgaaaatgctctgggtaaagtgactagcgaccatattaatttcgatcccgtgtataaagtgaaaccaaatcctccccacaatctcagtgtgatcaatagcgaagaactgagtagcattctgaagcttacttggaccaatccaagtatcaagtcagtgatcatactgaaatacaacattcagtatcgcactaaggatgcatctacatggtcccagatacctccagaggatacggcttctactaggtccagttttacagtgcaggatctgaagcccttcacggaatatgtattcagaattcgatgcatgaaggaggacgggaagggatactggtcggactggagcgaggaggcgtcgggtataacatacgaggataatatcgcctcattttag
